United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 27

SEQ ID NO: 1177236 - RNA, 16 nt, Human
cagaggggguggccuc

SEQ ID NO: 1177237 - RNA, 17 nt, Human
cagaggggguggccucc

SEQ ID NO: 1177238 - RNA, 19 nt, Human
cagauacuuggggggcuga

SEQ ID NO: 1177239 - RNA, 19 nt, Human
cagauagauauaugcucug

SEQ ID NO: 1177240 - RNA, 12 nt, Human
cagagagggugg

SEQ ID NO: 1177241 - RNA, 13 nt, Human
cagagaggguggg

SEQ ID NO: 1177242 - RNA, 17 nt, Human
cagagaggguggugacc

SEQ ID NO: 1177243 - RNA, 20 nt, Human
cagagaggguggugaccucu

SEQ ID NO: 1177244 - RNA, 22 nt, Human
cagagaggguggugaccucugc

SEQ ID NO: 1177245 - RNA, 23 nt, Human
cagagaggguggugaccucugcc

SEQ ID NO: 1177246 - RNA, 20 nt, Human
cagagagguuaaggugggua

SEQ ID NO: 1177247 - RNA, 13 nt, Human
cagagcugccacc

SEQ ID NO: 1177248 - RNA, 16 nt, Human
cagagcugccaccugc

SEQ ID NO: 1177249 - RNA, 17 nt, Human
cagaggaaagcaaagga

SEQ ID NO: 1177250 - RNA, 19 nt, Human
cagaggaaagcaaaggaga

SEQ ID NO: 1177251 - RNA, 20 nt, Human
cagaggaaagcaaaggagau

SEQ ID NO: 1177252 - RNA, 13 nt, Human
cagaggggguggc

SEQ ID NO: 1177253 - RNA, 16 nt, Human
auuacaggugugaacc

SEQ ID NO: 1177254 - RNA, 14 nt, Human
auucauauuuacuu

SEQ ID NO: 1177255 - RNA, 22 nt, Human
auugaggacacugauauggguc

SEQ ID NO: 1177256 - RNA, 15 nt, Human
auucucuuauccaac

SEQ ID NO: 1177257 - RNA, 16 nt, Human
auucucuccuguaccu

SEQ ID NO: 1177258 - RNA, 20 nt, Human
auucucuaguuugauuaaau

SEQ ID NO: 1177259 - RNA, 23 nt, Human
auucucuaguuugauuaaauucu

SEQ ID NO: 1177260 - RNA, 12 nt, Human
auucucuuaucc

SEQ ID NO: 1177261 - RNA, 14 nt, Human
auucucuuauccaa

SEQ ID NO: 1177262 - RNA, 20 nt, Human
caaaagguuaauaaaguaau

SEQ ID NO: 1177263 - RNA, 19 nt, Human
caaaagcaucuaugugaga

SEQ ID NO: 1177264 - RNA, 13 nt, Human
caaaagcauguga

SEQ ID NO: 1177265 - RNA, 21 nt, Human
caaaagguauuuuaaucacca

SEQ ID NO: 1177266 - RNA, 12 nt, Human
auuuuuuuuucc

SEQ ID NO: 1177267 - RNA, 19 nt, Human
auuuuuauauuugaaauau

SEQ ID NO: 1177268 - RNA, 22 nt, Human
auuuuguuuuugucuuaaaaag

SEQ ID NO: 1177269 - RNA, 16 nt, Human
auuuuuauuaaauuau

SEQ ID NO: 1177270 - RNA, 19 nt, Human
caaaccaucauugaaaucu

SEQ ID NO: 1177271 - RNA, 17 nt, Human
caaaccaucauugaaau

SEQ ID NO: 1177272 - RNA, 14 nt, Human
caaaccaucauuga

SEQ ID NO: 1177273 - RNA, 16 nt, Human
caaaccaucauugaaa

SEQ ID NO: 1177274 - RNA, 19 nt, Human
auuuucuauaauuuaaaua

SEQ ID NO: 1177275 - RNA, 18 nt, Human
auuuucuauaauuuaaau

SEQ ID NO: 1177276 - RNA, 17 nt, Human
auuuucuauaauuuaaa

SEQ ID NO: 1177277 - RNA, 14 nt, Human
auuuguuauaauga

SEQ ID NO: 1177278 - RNA, 12 nt, Human
auuucacucucc

SEQ ID NO: 1177279 - RNA, 14 nt, Human
auuucacucuccuu

SEQ ID NO: 1177280 - RNA, 21 nt, Human
auuucuguuuagauaauacac

SEQ ID NO: 1177281 - RNA, 20 nt, Human
auuucuguuuagauaauaca

SEQ ID NO: 1177282 - RNA, 12 nt, Human
cacuccagccug

SEQ ID NO: 1177283 - RNA, 21 nt, Human
cacuccagugagacagcucug

SEQ ID NO: 1177284 - RNA, 23 nt, Human
cacugaagaagcaccaaucauga

SEQ ID NO: 1177285 - RNA, 16 nt, Human
cacuacauucuguuaa

SEQ ID NO: 1177286 - RNA, 15 nt, Human
cacuacauucuguua

SEQ ID NO: 1177287 - RNA, 16 nt, Human
cacggaagagccuugc

SEQ ID NO: 1177288 - RNA, 22 nt, Human
cacggaagagccuugcggaagg

SEQ ID NO: 1177289 - RNA, 13 nt, Human
cacuacauucugu

SEQ ID NO: 1177290 - RNA, 14 nt, Human
cacuacauucuguu

SEQ ID NO: 1177291 - RNA, 21 nt, Human
cacgcuggagugcagugagcc

SEQ ID NO: 1177292 - RNA, 16 nt, Human
cacgcuggagugcagu

SEQ ID NO: 1177293 - RNA, 17 nt, Human
cacgcuggagugcagug

SEQ ID NO: 1177294 - RNA, 18 nt, Human
cacgcuggagugcaguga

SEQ ID NO: 1177295 - RNA, 20 nt, Human
cacgcuggagugcagugagc

SEQ ID NO: 1177296 - RNA, 12 nt, Human
cacccugcucuc

SEQ ID NO: 1177297 - RNA, 12 nt, Human
cacccuccuuuc

SEQ ID NO: 1177298 - RNA, 11 nt, Human
caccugccagg

SEQ ID NO: 1177299 - RNA, 12 nt, Human
caccugccaggg

SEQ ID NO: 1177300 - RNA, 18 nt, Human
caccugccccucaacucu

SEQ ID NO: 1177301 - RNA, 21 nt, Human
caccugccccucaacucuccu

SEQ ID NO: 1177302 - RNA, 13 nt, Human
caccugccaggga

SEQ ID NO: 1177303 - RNA, 20 nt, Human
caccugcggugcuaucuccc

SEQ ID NO: 1177304 - RNA, 16 nt, Human
caccugcggugcuauc

SEQ ID NO: 1177305 - RNA, 17 nt, Human
caccugcggugcuaucu

SEQ ID NO: 1177306 - RNA, 19 nt, Human
caccugcggugcuaucucc

SEQ ID NO: 1177307 - RNA, 13 nt, Human
cacaucuugcucu

SEQ ID NO: 1177308 - RNA, 14 nt, Human
cacaucuugcucug

SEQ ID NO: 1177309 - RNA, 15 nt, Human
cacaucuugcucugc

SEQ ID NO: 1177310 - RNA, 20 nt, Human
cacaucuugcucugcugaca

SEQ ID NO: 1177311 - RNA, 21 nt, Human
cacaucuugcucugcugacag

SEQ ID NO: 1177312 - RNA, 22 nt, Human
cacaucuugcucugcugacaga

SEQ ID NO: 1177313 - RNA, 12 nt, Human
cacccagcccac

SEQ ID NO: 1177314 - RNA, 16 nt, Human
cacccagcccacuucu

SEQ ID NO: 1177315 - RNA, 23 nt, Human
cacaucuugcucugcugacagac

SEQ ID NO: 1177316 - RNA, 16 nt, Human
cacaucuugcucugcu

SEQ ID NO: 1177317 - RNA, 16 nt, Human
cacaugaaguccaagc

SEQ ID NO: 1177318 - RNA, 17 nt, Human
cacauuuauucugcuca

SEQ ID NO: 1177319 - RNA, 18 nt, Human
cacauuuauucugcucac

SEQ ID NO: 1177320 - RNA, 17 nt, Human
caccagccccagugccc

SEQ ID NO: 1177321 - RNA, 18 nt, Human
caccagccccagugccca

SEQ ID NO: 1177322 - RNA, 21 nt, Human
caccagccccagugcccacag

SEQ ID NO: 1177323 - RNA, 22 nt, Human
caccagccccagugcccacagg

SEQ ID NO: 1177324 - RNA, 19 nt, Human
caccagcccuuagcaggga

SEQ ID NO: 1177325 - RNA, 21 nt, Human
caccagcccuuagcagggaaa

SEQ ID NO: 1177326 - RNA, 19 nt, Human
caagcuccaagcucccagg

SEQ ID NO: 1177327 - RNA, 21 nt, Human
caagcuccaagcucccaggca

SEQ ID NO: 1177328 - RNA, 18 nt, Human
caagcuccaagcucccag

SEQ ID NO: 1177329 - RNA, 12 nt, Human
caagcucccagg

SEQ ID NO: 1177330 - RNA, 14 nt, Human
caagcucccaggca

SEQ ID NO: 1177331 - RNA, 15 nt, Human
caagcucccaggcau

SEQ ID NO: 1177332 - RNA, 17 nt, Human
caagcucccaggcauuc

SEQ ID NO: 1177333 - RNA, 16 nt, Human
caagcucugcuccucu

SEQ ID NO: 1177334 - RNA, 13 nt, Human
caagcugcacccu

SEQ ID NO: 1177335 - RNA, 20 nt, Human
caaggauugcuacuguccua

SEQ ID NO: 1177336 - RNA, 14 nt, Human
caaggcaaggcugu

SEQ ID NO: 1177337 - RNA, 16 nt, Human
caaggcaaggcuguca

SEQ ID NO: 1177338 - RNA, 17 nt, Human
caaguauuauaccuuuu

SEQ ID NO: 1177339 - RNA, 22 nt, Human
caaguauuauaccuuuuuuaga

SEQ ID NO: 1177340 - RNA, 14 nt, Human
caaucaaaucugcu

SEQ ID NO: 1177341 - RNA, 17 nt, Human
caaucagccuaguugau

SEQ ID NO: 1177342 - RNA, 13 nt, Human
caauggcagccuu

SEQ ID NO: 1177343 - RNA, 14 nt, Human
caauggcagccuug

SEQ ID NO: 1177344 - RNA, 15 nt, Human
caauggcagccuugg

SEQ ID NO: 1177345 - RNA, 12 nt, Human
caaugcuggcug

SEQ ID NO: 1177346 - RNA, 16 nt, Human
caauggcagccuuggc

SEQ ID NO: 1177347 - RNA, 20 nt, Human
caauuuauuauggcacauca

SEQ ID NO: 1177348 - RNA, 14 nt, Human
caagcaccuccugc

SEQ ID NO: 1177349 - RNA, 13 nt, Human
caagcaccuccug

SEQ ID NO: 1177350 - RNA, 14 nt, Human
caagcaaguauuag

SEQ ID NO: 1177351 - RNA, 14 nt, Human
caagaccacguuuc

SEQ ID NO: 1177352 - RNA, 16 nt, Human
caagaccacguuucua

SEQ ID NO: 1177353 - RNA, 15 nt, Human
caagaagcccaggaa

SEQ ID NO: 1177354 - RNA, 12 nt, Human
caacuccagaaa

SEQ ID NO: 1177355 - RNA, 18 nt, Human
caagaagcccaggaaagg

SEQ ID NO: 1177356 - RNA, 17 nt, Human
caagaaggaugauucaa

SEQ ID NO: 1177357 - RNA, 14 nt, Human
caacccccagccug

SEQ ID NO: 1177358 - RNA, 14 nt, Human
caaccccuucgcuc

SEQ ID NO: 1177359 - RNA, 16 nt, Human
caaccccuucgcuccu

SEQ ID NO: 1177360 - RNA, 17 nt, Human
caaccccuucgcuccug

SEQ ID NO: 1177361 - RNA, 19 nt, Human
caacuauauuguuugcuaa

SEQ ID NO: 1177362 - RNA, 19 nt, Human
caacuaucucauuuccaag

SEQ ID NO: 1177363 - RNA, 21 nt, Human
caacuaucucauuuccaagca

SEQ ID NO: 1177364 - RNA, 22 nt, Human
gggucucacuauguugcccagg

SEQ ID NO: 1177365 - RNA, 23 nt, Human
gggucucacuauguugcccaggc

SEQ ID NO: 1177366 - RNA, 12 nt, Human
gggucucacucu

SEQ ID NO: 1177367 - RNA, 20 nt, Human
ggguaucaggugcugccauc

SEQ ID NO: 1177368 - RNA, 16 nt, Human
aaacguggcugcuuca

SEQ ID NO: 1177369 - RNA, 17 nt, Human
aaacguggcugcuucaa

SEQ ID NO: 1177370 - RNA, 20 nt, Human
aaacguggcugcuucaagga

SEQ ID NO: 1177371 - RNA, 16 nt, Human
aaacuggauuaaacuu

SEQ ID NO: 1177372 - RNA, 21 nt, Human
aaaauggacguguuaugacuc

SEQ ID NO: 1177373 - RNA, 21 nt, Human
aaaauguaggguuauaauaau

SEQ ID NO: 1177374 - RNA, 19 nt, Human
aaaauuuuuucucuaggaa

SEQ ID NO: 1177375 - RNA, 22 nt, Human
aaaauuuuuucucuaggaaaua

SEQ ID NO: 1177376 - RNA, 18 nt, Human
aaacaagaccacguuucu

SEQ ID NO: 1177377 - RNA, 17 nt, Human
aaacaaggaugaauuaa

SEQ ID NO: 1177378 - RNA, 14 nt, Human
aaacacaacuauau

SEQ ID NO: 1177379 - RNA, 13 nt, Human
aaacauauauaac

SEQ ID NO: 1177380 - RNA, 16 nt, Human
aaacauauauaacaau

SEQ ID NO: 1177381 - RNA, 19 nt, Human
aaacauauauaacaaugcu

SEQ ID NO: 1177382 - RNA, 21 nt, Human
aaacauauauaacaaugcugu

SEQ ID NO: 1177383 - RNA, 22 nt, Human
aaacaugcuacacacugcaugu

SEQ ID NO: 1177384 - RNA, 15 nt, Human
ggggaccucaggccu

SEQ ID NO: 1177385 - RNA, 16 nt, Human
ggggaccucaggccug

SEQ ID NO: 1177386 - RNA, 17 nt, Human
ggggaccucaggccugg

SEQ ID NO: 1177387 - RNA, 17 nt, Human
ggggccaguuggucccc

SEQ ID NO: 1177388 - RNA, 19 nt, Human
ggggccaguuggucccccu

SEQ ID NO: 1177389 - RNA, 16 nt, Human
ggggcccugccuccuu

SEQ ID NO: 1177390 - RNA, 19 nt, Human
ggggcccugccuccuuugu

SEQ ID NO: 1177391 - RNA, 23 nt, Human
ggggcccugccuccuuugugagg

SEQ ID NO: 1177392 - RNA, 23 nt, Human
gguauuggcuagagguucaaaga

SEQ ID NO: 1177393 - RNA, 20 nt, Human
gguccacccaggagccccga

SEQ ID NO: 1177394 - RNA, 22 nt, Human
gguccacccaggagccccgagg

SEQ ID NO: 1177395 - RNA, 12 nt, Human
ggucccacccca

SEQ ID NO: 1177396 - RNA, 14 nt, Human
ggucccaccccaca

SEQ ID NO: 1177397 - RNA, 14 nt, Human
aaacuuuaccuuuu

SEQ ID NO: 1177398 - RNA, 17 nt, Human
aaacuuuaccuuuuuua

SEQ ID NO: 1177399 - RNA, 15 nt, Human
aaagacuguacaaag

SEQ ID NO: 1177400 - RNA, 19 nt, Human
aaagacuuuuccaacccuc

SEQ ID NO: 1177401 - RNA, 18 nt, Human
aaagagaacuuccagauc

SEQ ID NO: 1177402 - RNA, 12 nt, Human
aaagagagaaaa

SEQ ID NO: 1177403 - RNA, 13 nt, Human
aaagagagaaaau

SEQ ID NO: 1177404 - RNA, 14 nt, Human
aaagagagaaaaua

SEQ ID NO: 1177405 - RNA, 15 nt, Human
aaagagagaaaauaa

SEQ ID NO: 1177406 - RNA, 16 nt, Human
aaagagagaaaauaaa

SEQ ID NO: 1177407 - RNA, 17 nt, Human
aaagagagaaaauaaaa

SEQ ID NO: 1177408 - RNA, 18 nt, Human
aaagagagaaaauaaaaa

SEQ ID NO: 1177409 - RNA, 19 nt, Human
aaagagagaaaauaaaaag

SEQ ID NO: 1177410 - RNA, 21 nt, Human
aaagagagaaaauaaaaaguu

SEQ ID NO: 1177411 - RNA, 22 nt, Human
aaagagagaaaauaaaaaguua

SEQ ID NO: 1177412 - RNA, 13 nt, Human
aaagaggcuaugu

SEQ ID NO: 1177413 - RNA, 18 nt, Human
aaagaggcuaugugagca

SEQ ID NO: 1177414 - RNA, 15 nt, Human
aaagaugagugagca

SEQ ID NO: 1177415 - RNA, 14 nt, Human
aaagaugcuucuca

SEQ ID NO: 1177416 - RNA, 22 nt, Human
ggugcacaagcuccaagcuccc

SEQ ID NO: 1177417 - RNA, 14 nt, Human
ggucugugagaugc

SEQ ID NO: 1177418 - RNA, 24 nt, Human
ggucugugagaugcuagaacuccc

SEQ ID NO: 1177419 - RNA, 12 nt, Human
ggucuguucuuu

SEQ ID NO: 1177420 - RNA, 17 nt, Human
ggucuguucuuuccaaa

SEQ ID NO: 1177421 - RNA, 19 nt, Human
ggucuguucuuuccaaagu

SEQ ID NO: 1177422 - RNA, 22 nt, Human
ggucuugaacuccuggccucaa

SEQ ID NO: 1177423 - RNA, 13 nt, Human
aaaggaauuuaaa

SEQ ID NO: 1177424 - RNA, 11 nt, Human
aaaggaaagag

SEQ ID NO: 1177425 - RNA, 22 nt, Human
aaaggaaagagggagguaagga

SEQ ID NO: 1177426 - RNA, 15 nt, Human
aaagcuuguuaagau

SEQ ID NO: 1177427 - RNA, 17 nt, Human
aaagcagugcaugcugu

SEQ ID NO: 1177428 - RNA, 21 nt, Human
aaagcagugcaugcugucccu

SEQ ID NO: 1177429 - RNA, 22 nt, Human
aaagcagugcaugcugucccuu

SEQ ID NO: 1177430 - RNA, 18 nt, Human
aaagcuaggccuggccag

SEQ ID NO: 1177431 - RNA, 21 nt, Human
aaaacguggcugcuucaagga

SEQ ID NO: 1177432 - RNA, 22 nt, Human
aaaacugauuuuuuuuuccuuc

SEQ ID NO: 1177433 - RNA, 20 nt, Human
aaaacugcugacuguuuucu

SEQ ID NO: 1177434 - RNA, 15 nt, Human
aaaaccaauguucuc

SEQ ID NO: 1177435 - RNA, 21 nt, Human
aaaaccaauguucucucuucu

SEQ ID NO: 1177436 - RNA, 16 nt, Human
aaaacguggcugcuuc

SEQ ID NO: 1177437 - RNA, 17 nt, Human
aaaacguggcugcuuca

SEQ ID NO: 1177438 - RNA, 18 nt, Human
aaaacguggcugcuucaa

SEQ ID NO: 1177439 - RNA, 14 nt, Human
gggaacagacugga

SEQ ID NO: 1177440 - RNA, 22 nt, Human
gggaacagacuggaagcacagc

SEQ ID NO: 1177441 - RNA, 19 nt, Human
aaaaaucucaaauuucuaa

SEQ ID NO: 1177442 - RNA, 20 nt, Human
aaaaaucucaaauuucuaaa

SEQ ID NO: 1177443 - RNA, 11 nt, Human
gggagggcucc

SEQ ID NO: 1177444 - RNA, 13 nt, Human
gggagggcuccag

SEQ ID NO: 1177445 - RNA, 20 nt, Human
gggaggcagagguugcagug

SEQ ID NO: 1177446 - RNA, 19 nt, Human
gggaggccaaggugggagg

SEQ ID NO: 1177447 - RNA, 22 nt, Human
aaaagcuccauuuuuagugaaa

SEQ ID NO: 1177448 - RNA, 14 nt, Human
aaaagcugggcagg

SEQ ID NO: 1177449 - RNA, 21 nt, Human
aaaacuuuaugcuaagugaaa

SEQ ID NO: 1177450 - RNA, 15 nt, Human
gggauuuccaugaug

SEQ ID NO: 1177451 - RNA, 14 nt, Human
gggcagaggaaagc

SEQ ID NO: 1177452 - RNA, 12 nt, Human
aaaauaaauuau

SEQ ID NO: 1177453 - RNA, 21 nt, Human
aaaauaauuuuuauauuugaa

SEQ ID NO: 1177454 - RNA, 23 nt, Human
aaaauaauuuuuauauuugaaau

SEQ ID NO: 1177455 - RNA, 14 nt, Human
aaaauaccagccag

SEQ ID NO: 1177456 - RNA, 15 nt, Human
aaaauaccagccagu

SEQ ID NO: 1177457 - RNA, 12 nt, Human
aaaauagccugc

SEQ ID NO: 1177458 - RNA, 18 nt, Human
aaaauaguggugugauuu

SEQ ID NO: 1177459 - RNA, 11 nt, Human
aaaauauacug

SEQ ID NO: 1177460 - RNA, 12 nt, Human
aaaauauacugu

SEQ ID NO: 1177461 - RNA, 13 nt, Human
aaaauauacugua

SEQ ID NO: 1177462 - RNA, 14 nt, Human
aaaauauacuguaa

SEQ ID NO: 1177463 - RNA, 15 nt, Human
aaaauauacuguaaa

SEQ ID NO: 1177464 - RNA, 16 nt, Human
aaaauauacuguaaag

SEQ ID NO: 1177465 - RNA, 17 nt, Human
aaaauauacuguaaaga

SEQ ID NO: 1177466 - RNA, 18 nt, Human
aaaauauacuguaaagaa

SEQ ID NO: 1177467 - RNA, 20 nt, Human
aaaauauacuguaaagaaag

SEQ ID NO: 1177468 - RNA, 22 nt, Human
aaaauauacuguaaagaaagag

SEQ ID NO: 1177469 - RNA, 23 nt, Human
aaaauauacuguaaagaaagaga

SEQ ID NO: 1177470 - RNA, 13 nt, Human
aaaaaaacacaaa

SEQ ID NO: 1177471 - RNA, 16 nt, Human
ggcuucaguggcagcu

SEQ ID NO: 1177472 - RNA, 17 nt, Human
ggcuucaguggcagcug

SEQ ID NO: 1177473 - RNA, 13 nt, Human
gggaaaaucagcc

SEQ ID NO: 1177474 - RNA, 23 nt, Human
gggaaaaucagccugcuccagcu

SEQ ID NO: 1177475 - RNA, 16 nt, Human
ggcuggugucaccuga

SEQ ID NO: 1177476 - RNA, 20 nt, Human
ggcuguaucccaugagccuc

SEQ ID NO: 1177477 - RNA, 22 nt, Human
ggcuguaucccaugagccucag

SEQ ID NO: 1177478 - RNA, 23 nt, Human
ggcuguaucccaugagccucagc

SEQ ID NO: 1177479 - RNA, 15 nt, Human
ggcugucaauuacag

SEQ ID NO: 1177480 - RNA, 15 nt, Human
ggcuucaguggcagc

SEQ ID NO: 1177481 - RNA, 20 nt, Human
ggcucccuucccaccucucu

SEQ ID NO: 1177482 - RNA, 22 nt, Human
ggcucccuucccaccucucuca

SEQ ID NO: 1177483 - RNA, 16 nt, Human
ggcucccuucccaccu

SEQ ID NO: 1177484 - RNA, 17 nt, Human
ggcucccuucccaccuc

SEQ ID NO: 1177485 - RNA, 18 nt, Human
ggcucccuucccaccucu

SEQ ID NO: 1177486 - RNA, 18 nt, Human
ggcucgagcaugccugga

SEQ ID NO: 1177487 - RNA, 23 nt, Human
ggcucuuccaggcugggagagcc

SEQ ID NO: 1177488 - RNA, 24 nt, Human
ggcucuuccaggcugggagagccu

SEQ ID NO: 1177489 - RNA, 20 nt, Human
ggcugcaugcgggcuuccuc

SEQ ID NO: 1177490 - RNA, 22 nt, Human
ggcugcaugcgggcuuccuccu

SEQ ID NO: 1177491 - RNA, 17 nt, Human
ggcuggccuggccccuc

SEQ ID NO: 1177492 - RNA, 22 nt, Human
ggcuggccuggccccucagggu

SEQ ID NO: 1177493 - RNA, 14 nt, Human
ggcuggcgugcagu

SEQ ID NO: 1177494 - RNA, 16 nt, Human
ggcuggcgugcagugg

SEQ ID NO: 1177495 - RNA, 20 nt, Human
ggcuggcgugcaguggugcg

SEQ ID NO: 1177496 - RNA, 21 nt, Human
ggcugccaucucaccuccugc

SEQ ID NO: 1177497 - RNA, 22 nt, Human
ggcugccaucucaccuccugcu

SEQ ID NO: 1177498 - RNA, 23 nt, Human
ggcugccaucucaccuccugcug

SEQ ID NO: 1177499 - RNA, 13 nt, Human
ggcugggagagcc

SEQ ID NO: 1177500 - RNA, 14 nt, Human
ggcccuuccuuuuc

SEQ ID NO: 1177501 - RNA, 13 nt, Human
ggccucccaacuc

SEQ ID NO: 1177502 - RNA, 14 nt, Human
ggccucccaacuca

SEQ ID NO: 1177503 - RNA, 17 nt, Human
ggccucccaacucaccc

SEQ ID NO: 1177504 - RNA, 13 nt, Human
ggccaagguggga

SEQ ID NO: 1177505 - RNA, 23 nt, Human
ggccagagggagugacagaggca

SEQ ID NO: 1177506 - RNA, 19 nt, Human
ggccagaugcaccagcccu

SEQ ID NO: 1177507 - RNA, 20 nt, Human
ggccagaugcaccagcccuu

SEQ ID NO: 1177508 - RNA, 12 nt, Human
ggcauuguggga

SEQ ID NO: 1177509 - RNA, 15 nt, Human
ggccaaagccaaagc

SEQ ID NO: 1177510 - RNA, 12 nt, Human
ggccaaaggaag

SEQ ID NO: 1177511 - RNA, 13 nt, Human
ggccaaaggaagc

SEQ ID NO: 1177512 - RNA, 10 nt, Human
ggcagagcag

SEQ ID NO: 1177513 - RNA, 12 nt, Human
ggcagagcagag

SEQ ID NO: 1177514 - RNA, 15 nt, Human
ggcagccaggccaca

SEQ ID NO: 1177515 - RNA, 17 nt, Human
ggcagccaggccacaag

SEQ ID NO: 1177516 - RNA, 12 nt, Human
ggcagaaggaag

SEQ ID NO: 1177517 - RNA, 21 nt, Human
ggaugaauuccaaauucugcu

SEQ ID NO: 1177518 - RNA, 12 nt, Human
ggaugagaaagg

SEQ ID NO: 1177519 - RNA, 22 nt, Human
ggaugagaaagguugaagcacc

SEQ ID NO: 1177520 - RNA, 22 nt, Human
ggaugguucccuugaugaagaa

SEQ ID NO: 1177521 - RNA, 23 nt, Human
ggaugguucccuugaugaagaag

SEQ ID NO: 1177522 - RNA, 13 nt, Human
ggauguucuggga

SEQ ID NO: 1177523 - RNA, 23 nt, Human
ggauuaaacuuaaucuaaaugga

SEQ ID NO: 1177524 - RNA, 21 nt, Human
ggauuuugauccaagcugguc

SEQ ID NO: 1177525 - RNA, 11 nt, Human
ggcaaaauaau

SEQ ID NO: 1177526 - RNA, 12 nt, Human
ggaggaagagaa

SEQ ID NO: 1177527 - RNA, 19 nt, Human
ggaggaaggaaacccagcu

SEQ ID NO: 1177528 - RNA, 21 nt, Human
ggaggcaugugaugagaggaa

SEQ ID NO: 1177529 - RNA, 18 nt, Human
ggaggccaaggugggagg

SEQ ID NO: 1177530 - RNA, 20 nt, Human
ggaggccaaggugggaggau

SEQ ID NO: 1177531 - RNA, 13 nt, Human
ggaggccagccuu

SEQ ID NO: 1177532 - RNA, 16 nt, Human
ggagcugaguggggga

SEQ ID NO: 1177533 - RNA, 18 nt, Human
ggaggucgaggcaggagg

SEQ ID NO: 1177534 - RNA, 15 nt, Human
ggaggcugagauggg

SEQ ID NO: 1177535 - RNA, 19 nt, Human
ggaggcugagaugggagaa

SEQ ID NO: 1177536 - RNA, 15 nt, Human
ggaggucgaggcagg

SEQ ID NO: 1177537 - RNA, 16 nt, Human
ggaggucgaggcagga

SEQ ID NO: 1177538 - RNA, 13 nt, Human
ggagcagccacau

SEQ ID NO: 1177539 - RNA, 21 nt, Human
ggagcagccacauuccugaug

SEQ ID NO: 1177540 - RNA, 22 nt, Human
ggacucaaugcacugacauugu

SEQ ID NO: 1177541 - RNA, 20 nt, Human
ggacuacaggugugagucac

SEQ ID NO: 1177542 - RNA, 12 nt, Human
ggaccucaggcc

SEQ ID NO: 1177543 - RNA, 19 nt, Human
ggagaaaauggacguguua

SEQ ID NO: 1177544 - RNA, 17 nt, Human
ggacuuggaagcuccgc

SEQ ID NO: 1177545 - RNA, 22 nt, Human
ggagaaccaaaaagaggcuaug

SEQ ID NO: 1177546 - RNA, 13 nt, Human
ggagagccuucca

SEQ ID NO: 1177547 - RNA, 16 nt, Human
ggagagccuuccaggg

SEQ ID NO: 1177548 - RNA, 17 nt, Human
ggagagccuuccagggg

SEQ ID NO: 1177549 - RNA, 18 nt, Human
ggagagccuuccaggggu

SEQ ID NO: 1177550 - RNA, 22 nt, Human
ggagagccuuccagggguggga

SEQ ID NO: 1177551 - RNA, 15 nt, Human
ggagagcuagcagca

SEQ ID NO: 1177552 - RNA, 17 nt, Human
ggagagcuagcagcagg

SEQ ID NO: 1177553 - RNA, 14 nt, Human
ggacccugaggccc

SEQ ID NO: 1177554 - RNA, 15 nt, Human
ggacccugaggccca

SEQ ID NO: 1177555 - RNA, 18 nt, Human
ggacccugaggcccagag

SEQ ID NO: 1177556 - RNA, 19 nt, Human
ggacccugaggcccagagg

SEQ ID NO: 1177557 - RNA, 19 nt, Human
gcuuguacauaaugcgugc

SEQ ID NO: 1177558 - RNA, 19 nt, Human
gcuugggcuucauccuccu

SEQ ID NO: 1177559 - RNA, 14 nt, Human
gcuuguacauaaug

SEQ ID NO: 1177560 - RNA, 16 nt, Human
gcuuguacauaaugcg

SEQ ID NO: 1177561 - RNA, 21 nt, Human
gcugugcucuggacaggcaug

SEQ ID NO: 1177562 - RNA, 12 nt, Human
gcugugcugccc

SEQ ID NO: 1177563 - RNA, 13 nt, Human
gcugugcugcccu

SEQ ID NO: 1177564 - RNA, 14 nt, Human
gcugugcugcccug

SEQ ID NO: 1177565 - RNA, 19 nt, Human
gcugugcugcccugcccac

SEQ ID NO: 1177566 - RNA, 22 nt, Human
gcugugcugcccugcccaccug

SEQ ID NO: 1177567 - RNA, 21 nt, Human
gcuguuggcugggggccucag

SEQ ID NO: 1177568 - RNA, 22 nt, Human
gcuguuggcugggggccucagu

SEQ ID NO: 1177569 - RNA, 20 nt, Human
gcuucacggaagagccuugc

SEQ ID NO: 1177570 - RNA, 14 nt, Human
gcuuaacuucacau

SEQ ID NO: 1177571 - RNA, 15 nt, Human
gcuucacggaagagc

SEQ ID NO: 1177572 - RNA, 17 nt, Human
gcuggguucuacccagg

SEQ ID NO: 1177573 - RNA, 15 nt, Human
gcuggguucuaccca

SEQ ID NO: 1177574 - RNA, 15 nt, Human
gcuggguucugaucc

SEQ ID NO: 1177575 - RNA, 14 nt, Human
gcuggguuggaggg

SEQ ID NO: 1177576 - RNA, 21 nt, Human
gcuggguuggaggguguccca

SEQ ID NO: 1177577 - RNA, 20 nt, Human
gcuguaucccaugagccuca

SEQ ID NO: 1177578 - RNA, 23 nt, Human
gcuguaucccaugagccucagca

SEQ ID NO: 1177579 - RNA, 16 nt, Human
gcugggauuacaggug

SEQ ID NO: 1177580 - RNA, 18 nt, Human
gcuggccuggccccucag

SEQ ID NO: 1177581 - RNA, 19 nt, Human
gcuggccuggccccucagg

SEQ ID NO: 1177582 - RNA, 14 nt, Human
gcuggagugcagug

SEQ ID NO: 1177583 - RNA, 15 nt, Human
gcuggagugcaguga

SEQ ID NO: 1177584 - RNA, 17 nt, Human
gcuggagugcagugagc

SEQ ID NO: 1177585 - RNA, 17 nt, Human
gcuggccuggccccuca

SEQ ID NO: 1177586 - RNA, 18 nt, Human
gcugggauuacaggugug

SEQ ID NO: 1177587 - RNA, 19 nt, Human
gcugggauuacagguguga

SEQ ID NO: 1177588 - RNA, 13 nt, Human
gcugggcagagga

SEQ ID NO: 1177589 - RNA, 14 nt, Human
gcugggcagaggaa

SEQ ID NO: 1177590 - RNA, 15 nt, Human
gcugggcagaggaaa

SEQ ID NO: 1177591 - RNA, 16 nt, Human
gcugggcagaggaaag

SEQ ID NO: 1177592 - RNA, 17 nt, Human
gcugggcagaggaaagc

SEQ ID NO: 1177593 - RNA, 19 nt, Human
gcugggcagaggaaagcaa

SEQ ID NO: 1177594 - RNA, 16 nt, Human
gcugggcucccuuccc

SEQ ID NO: 1177595 - RNA, 17 nt, Human
gcugggcucccuuccca

SEQ ID NO: 1177596 - RNA, 20 nt, Human
gcugggcucccuucccaccu

SEQ ID NO: 1177597 - RNA, 14 nt, Human
gcugggcagguugg

SEQ ID NO: 1177598 - RNA, 21 nt, Human
gcugggcucccuucccaccuc

SEQ ID NO: 1177599 - RNA, 15 nt, Human
gcuggguguggcgca

SEQ ID NO: 1177600 - RNA, 17 nt, Human
gcuggagcucugcccau

SEQ ID NO: 1177601 - RNA, 12 nt, Human
gcuggagugcag

SEQ ID NO: 1177602 - RNA, 18 nt, Human
gcugagggugagugggug

SEQ ID NO: 1177603 - RNA, 16 nt, Human
gcugcaccggcuggcc

SEQ ID NO: 1177604 - RNA, 17 nt, Human
gcugcaccggcuggccu

SEQ ID NO: 1177605 - RNA, 18 nt, Human
gcugcaccggcuggccug

SEQ ID NO: 1177606 - RNA, 19 nt, Human
gcugcaccggcuggccugg

SEQ ID NO: 1177607 - RNA, 22 nt, Human
gcugcaccggcuggccuggccc

SEQ ID NO: 1177608 - RNA, 19 nt, Human
gcugccagccgagauagcc

SEQ ID NO: 1177609 - RNA, 21 nt, Human
gcugccagccgagauagccaa

SEQ ID NO: 1177610 - RNA, 21 nt, Human
gcugccauccagguucagcuu

SEQ ID NO: 1177611 - RNA, 23 nt, Human
gcugccauccagguucagcuugu

SEQ ID NO: 1177612 - RNA, 23 nt, Human
gcugccaucucaccuccugcugg

SEQ ID NO: 1177613 - RNA, 22 nt, Human
gcugccaucucaccuccugcug

SEQ ID NO: 1177614 - RNA, 13 nt, Human
gcugccugggauc

SEQ ID NO: 1177615 - RNA, 16 nt, Human
gcugccugggaucccu

SEQ ID NO: 1177616 - RNA, 18 nt, Human
gcugccugggaucccuca

SEQ ID NO: 1177617 - RNA, 19 nt, Human
gcugccugggaucccucau

SEQ ID NO: 1177618 - RNA, 20 nt, Human
gcugccugggaucccucauc

SEQ ID NO: 1177619 - RNA, 16 nt, Human
gcucuguccugggagu

SEQ ID NO: 1177620 - RNA, 15 nt, Human
gcucuguccugggag

SEQ ID NO: 1177621 - RNA, 12 nt, Human
gcucuuccaggc

SEQ ID NO: 1177622 - RNA, 15 nt, Human
gcucuuccaggcugg

SEQ ID NO: 1177623 - RNA, 16 nt, Human
gcucuuccaggcuggg

SEQ ID NO: 1177624 - RNA, 18 nt, Human
gcucuuccaggcugggag

SEQ ID NO: 1177625 - RNA, 12 nt, Human
gcugaaggcucg

SEQ ID NO: 1177626 - RNA, 20 nt, Human
gcugaaggcucgagcaugcc

SEQ ID NO: 1177627 - RNA, 23 nt, Human
gcugaaggcucgagcaugccugg

SEQ ID NO: 1177628 - RNA, 17 nt, Human
gcugaaugguuuucaaa

SEQ ID NO: 1177629 - RNA, 14 nt, Human
gcugacagacacag

SEQ ID NO: 1177630 - RNA, 15 nt, Human
gcugacagacacagg

SEQ ID NO: 1177631 - RNA, 16 nt, Human
gcugacagacacaggc

SEQ ID NO: 1177632 - RNA, 17 nt, Human
gcugacagacacaggcc

SEQ ID NO: 1177633 - RNA, 20 nt, Human
gcucccaggcauuccccagg

SEQ ID NO: 1177634 - RNA, 21 nt, Human
gcucccaggcauuccccagga

SEQ ID NO: 1177635 - RNA, 22 nt, Human
gcucccaggcauuccccaggag

SEQ ID NO: 1177636 - RNA, 23 nt, Human
gcucccaggcauuccccaggagg

SEQ ID NO: 1177637 - RNA, 14 nt, Human
gcuccccagcccca

SEQ ID NO: 1177638 - RNA, 13 nt, Human
gcucucaggccag

SEQ ID NO: 1177639 - RNA, 14 nt, Human
gcucucaggccagc

SEQ ID NO: 1177640 - RNA, 15 nt, Human
gcucucaggccagcu

SEQ ID NO: 1177641 - RNA, 16 nt, Human
gcucucaggccagcug

SEQ ID NO: 1177642 - RNA, 14 nt, Human
gcuaggccuggcca

SEQ ID NO: 1177643 - RNA, 15 nt, Human
gcuaggccuggccag

SEQ ID NO: 1177644 - RNA, 16 nt, Human
gcuaguaucaaaagaa

SEQ ID NO: 1177645 - RNA, 18 nt, Human
gcuaggaacacuccuuca

SEQ ID NO: 1177646 - RNA, 19 nt, Human
gcuaggaacacuccuucac

SEQ ID NO: 1177647 - RNA, 21 nt, Human
gcuaggaacacuccuucacag

SEQ ID NO: 1177648 - RNA, 14 nt, Human
gccugugucuuuaa

SEQ ID NO: 1177649 - RNA, 19 nt, Human
gccuguucagcuccagcuc

SEQ ID NO: 1177650 - RNA, 20 nt, Human
gccuguucagcuccagcuca

SEQ ID NO: 1177651 - RNA, 14 nt, Human
gccuguucagcucc

SEQ ID NO: 1177652 - RNA, 23 nt, Human
gcucagguggggucacucuggca

SEQ ID NO: 1177653 - RNA, 21 nt, Human
gcucagguggggucacucugg

SEQ ID NO: 1177654 - RNA, 22 nt, Human
gcucagguggggucacucuggc

SEQ ID NO: 1177655 - RNA, 15 nt, Human
gcucagagagggugg

SEQ ID NO: 1177656 - RNA, 18 nt, Human
gcucagagagggugggag

SEQ ID NO: 1177657 - RNA, 20 nt, Human
gcucagagagggugggagug

SEQ ID NO: 1177658 - RNA, 22 nt, Human
gcucagagagggugggaguggg

SEQ ID NO: 1177659 - RNA, 12 nt, Human
gcucagggccug

SEQ ID NO: 1177660 - RNA, 13 nt, Human
gcucagggccugg

SEQ ID NO: 1177661 - RNA, 16 nt, Human
gcucagggccuggcuc

SEQ ID NO: 1177662 - RNA, 17 nt, Human
gcucagggccuggcuca

SEQ ID NO: 1177663 - RNA, 16 nt, Human
gccugccucuucucua

SEQ ID NO: 1177664 - RNA, 15 nt, Human
gccuggccccucagg

SEQ ID NO: 1177665 - RNA, 16 nt, Human
gccuggccccucaggg

SEQ ID NO: 1177666 - RNA, 17 nt, Human
gccuggccccucagggu

SEQ ID NO: 1177667 - RNA, 20 nt, Human
gccuggccccucaggguccc

SEQ ID NO: 1177668 - RNA, 22 nt, Human
gccuggccccucagggucccug

SEQ ID NO: 1177669 - RNA, 10 nt, Human
gccuggccug

SEQ ID NO: 1177670 - RNA, 21 nt, Human
gccugggaggucaaggcugca

SEQ ID NO: 1177671 - RNA, 22 nt, Human
gccugggaggucaaggcugcag

SEQ ID NO: 1177672 - RNA, 14 nt, Human
gccugggaucccuc

SEQ ID NO: 1177673 - RNA, 18 nt, Human
gccugggaucccucaucc

SEQ ID NO: 1177674 - RNA, 21 nt, Human
gccugggaucccucauccuca

SEQ ID NO: 1177675 - RNA, 13 nt, Human
gccugugucuuua

SEQ ID NO: 1177676 - RNA, 22 nt, Human
gccugugucuuuaaaugcugcu

SEQ ID NO: 1177677 - RNA, 12 nt, Human
gccucuucucua

SEQ ID NO: 1177678 - RNA, 23 nt, Human
gccucuucucuacucuagggaaa

SEQ ID NO: 1177679 - RNA, 18 nt, Human
gccugcccaggccccugc

SEQ ID NO: 1177680 - RNA, 19 nt, Human
gccugcccaggccccugcc

SEQ ID NO: 1177681 - RNA, 20 nt, Human
gccugcccaggccccugcca

SEQ ID NO: 1177682 - RNA, 13 nt, Human
gccuccuccagcc

SEQ ID NO: 1177683 - RNA, 13 nt, Human
gccuccugugugu

SEQ ID NO: 1177684 - RNA, 12 nt, Human
gccucugggacu

SEQ ID NO: 1177685 - RNA, 14 nt, Human
gccucugggacugg

SEQ ID NO: 1177686 - RNA, 16 nt, Human
gcccugccuccuuugu

SEQ ID NO: 1177687 - RNA, 22 nt, Human
gcccugccuccuuugugaggaa

SEQ ID NO: 1177688 - RNA, 16 nt, Human
gcccuuaccugccagg

SEQ ID NO: 1177689 - RNA, 20 nt, Human
gcccuuaccugccaggaagc

SEQ ID NO: 1177690 - RNA, 21 nt, Human
gcccuuaccugccaggaagcc

SEQ ID NO: 1177691 - RNA, 15 nt, Human
gccgccaugcuccug

SEQ ID NO: 1177692 - RNA, 16 nt, Human
gccgccaugcuccugg

SEQ ID NO: 1177693 - RNA, 13 nt, Human
gccccugcccggc

SEQ ID NO: 1177694 - RNA, 14 nt, Human
gccccugcccggcu

SEQ ID NO: 1177695 - RNA, 18 nt, Human
gccccaaaacucuccucu

SEQ ID NO: 1177696 - RNA, 19 nt, Human
gccccaaaacucuccucug

SEQ ID NO: 1177697 - RNA, 15 nt, Human
gccccugcccggcug

SEQ ID NO: 1177698 - RNA, 16 nt, Human
gccccuggaugcagcc

SEQ ID NO: 1177699 - RNA, 18 nt, Human
gccccuggaugcagccuc

SEQ ID NO: 1177700 - RNA, 22 nt, Human
gccccuggaugcagccucacag

SEQ ID NO: 1177701 - RNA, 22 nt, Human
gcccuaaaguguauuuuuuuac

SEQ ID NO: 1177702 - RNA, 19 nt, Human
gcccacgcuggagugcagu

SEQ ID NO: 1177703 - RNA, 13 nt, Human
gcccacucccugc

SEQ ID NO: 1177704 - RNA, 14 nt, Human
gcccacucccugca

SEQ ID NO: 1177705 - RNA, 15 nt, Human
gcccacucccugcaa

SEQ ID NO: 1177706 - RNA, 19 nt, Human
gcccacucccugcaaccug

SEQ ID NO: 1177707 - RNA, 19 nt, Human
gccauguuggccaggcugg

SEQ ID NO: 1177708 - RNA, 20 nt, Human
gccauguuggccaggcuggu

SEQ ID NO: 1177709 - RNA, 22 nt, Human
gccauguuggccaggcuggucu

SEQ ID NO: 1177710 - RNA, 24 nt, Human
gccauguuggccaggcuggucuca

SEQ ID NO: 1177711 - RNA, 18 nt, Human
gcccaccuuggcucaagu

SEQ ID NO: 1177712 - RNA, 13 nt, Human
gcccacgccccca

SEQ ID NO: 1177713 - RNA, 14 nt, Human
gcccacgcccccac

SEQ ID NO: 1177714 - RNA, 15 nt, Human
gcccacgcccccacu

SEQ ID NO: 1177715 - RNA, 15 nt, Human
gcccacgcuggagug

SEQ ID NO: 1177716 - RNA, 16 nt, Human
gcccacgcuggagugc

SEQ ID NO: 1177717 - RNA, 17 nt, Human
gcccacgcuggagugca

SEQ ID NO: 1177718 - RNA, 19 nt, Human
gccauauucuguuggccag

SEQ ID NO: 1177719 - RNA, 20 nt, Human
gccauauucuguuggccagu

SEQ ID NO: 1177720 - RNA, 14 nt, Human
gccauguuggccag

SEQ ID NO: 1177721 - RNA, 15 nt, Human
gccauguuggccagg

SEQ ID NO: 1177722 - RNA, 16 nt, Human
gccauguuggccaggc

SEQ ID NO: 1177723 - RNA, 17 nt, Human
gccauguuggccaggcu

SEQ ID NO: 1177724 - RNA, 18 nt, Human
gccauguuggccaggcug

SEQ ID NO: 1177725 - RNA, 22 nt, Human
gccagacaucaacagauaaaua

SEQ ID NO: 1177726 - RNA, 13 nt, Human
gccagcaggcucu

SEQ ID NO: 1177727 - RNA, 16 nt, Human
gccagcaggcucucag

SEQ ID NO: 1177728 - RNA, 17 nt, Human
gccagcaggcucucagg

SEQ ID NO: 1177729 - RNA, 18 nt, Human
gccagcaggcucucaggc

SEQ ID NO: 1177730 - RNA, 19 nt, Human
gccagcaggcucucaggcc

SEQ ID NO: 1177731 - RNA, 20 nt, Human
gccagcaggcucucaggcca

SEQ ID NO: 1177732 - RNA, 21 nt, Human
gccagcaggcucucaggccag

SEQ ID NO: 1177733 - RNA, 23 nt, Human
gccagcaggcucucaggccagcu

SEQ ID NO: 1177734 - RNA, 12 nt, Human
gccaggccagag

SEQ ID NO: 1177735 - RNA, 13 nt, Human
gccaggccagagg

SEQ ID NO: 1177736 - RNA, 16 nt, Human
gccaggcccucugccc

SEQ ID NO: 1177737 - RNA, 17 nt, Human
gccaggcccucugccca

SEQ ID NO: 1177738 - RNA, 19 nt, Human
gccaggcccucugcccacu

SEQ ID NO: 1177739 - RNA, 20 nt, Human
gccaggcccucugcccacuc

SEQ ID NO: 1177740 - RNA, 21 nt, Human
gccaggcccucugcccacucc

SEQ ID NO: 1177741 - RNA, 18 nt, Human
gccacugugaagagaacc

SEQ ID NO: 1177742 - RNA, 19 nt, Human
gccacugugaagagaacca

SEQ ID NO: 1177743 - RNA, 13 nt, Human
gccacccugggga

SEQ ID NO: 1177744 - RNA, 19 nt, Human
gccacccuggggagaaagu

SEQ ID NO: 1177745 - RNA, 23 nt, Human
gccacugcaccgggccacagaga

SEQ ID NO: 1177746 - RNA, 21 nt, Human
gccacugcacuauagccuagg

SEQ ID NO: 1177747 - RNA, 22 nt, Human
gccaccaacauacucccaucug

SEQ ID NO: 1177748 - RNA, 19 nt, Human
gccaccaacauacucccau

SEQ ID NO: 1177749 - RNA, 20 nt, Human
gccaccaacauacucccauc

SEQ ID NO: 1177750 - RNA, 21 nt, Human
gccaccaacauacucccaucu

SEQ ID NO: 1177751 - RNA, 16 nt, Human
gccacauuccugaugc

SEQ ID NO: 1177752 - RNA, 20 nt, Human
gccacauuccugaugcuucu

SEQ ID NO: 1177753 - RNA, 23 nt, Human
gcaccgggccacagagaaaguac

SEQ ID NO: 1177754 - RNA, 22 nt, Human
gcacaucagcacgauuucuguu

SEQ ID NO: 1177755 - RNA, 23 nt, Human
gcacaucagcacgauuucuguuu

SEQ ID NO: 1177756 - RNA, 13 nt, Human
gcacucagaagac

SEQ ID NO: 1177757 - RNA, 16 nt, Human
gcacucagaagacacu

SEQ ID NO: 1177758 - RNA, 17 nt, Human
gcacucagaagacacug

SEQ ID NO: 1177759 - RNA, 17 nt, Human
gcacuccccugcugggu

SEQ ID NO: 1177760 - RNA, 22 nt, Human
gcacuccccugcuggguguggc

SEQ ID NO: 1177761 - RNA, 20 nt, Human
gcacaccgggcacucagaag

SEQ ID NO: 1177762 - RNA, 14 nt, Human
gcacaccgggcacu

SEQ ID NO: 1177763 - RNA, 16 nt, Human
gauuuuuuuuuccuuc

SEQ ID NO: 1177764 - RNA, 12 nt, Human
gauuauuggaaa

SEQ ID NO: 1177765 - RNA, 16 nt, Human
gauuuaccacuugugu

SEQ ID NO: 1177766 - RNA, 17 nt, Human
gauucuuccucccuccc

SEQ ID NO: 1177767 - RNA, 18 nt, Human
gauucuuccucccucccu

SEQ ID NO: 1177768 - RNA, 12 nt, Human
gauucuucugcu

SEQ ID NO: 1177769 - RNA, 15 nt, Human
gauuuaccacuugug

SEQ ID NO: 1177770 - RNA, 15 nt, Human
gauucuccugccuca

SEQ ID NO: 1177771 - RNA, 17 nt, Human
gauucuccugccucagc

SEQ ID NO: 1177772 - RNA, 18 nt, Human
gauucuccugccucagcc

SEQ ID NO: 1177773 - RNA, 16 nt, Human
gaugagugagcaugcc

SEQ ID NO: 1177774 - RNA, 15 nt, Human
gaugaucuaggaaga

SEQ ID NO: 1177775 - RNA, 21 nt, Human
gaugaucuaggaagacuuugg

SEQ ID NO: 1177776 - RNA, 14 nt, Human
gaugaucuuugcag

SEQ ID NO: 1177777 - RNA, 18 nt, Human
gauguagaggagaaacug

SEQ ID NO: 1177778 - RNA, 13 nt, Human
gaggccagagaca

SEQ ID NO: 1177779 - RNA, 14 nt, Human
gaggccagagacac

SEQ ID NO: 1177780 - RNA, 19 nt, Human
gaggccagagacacaagcc

SEQ ID NO: 1177781 - RNA, 22 nt, Human
gaggcuagugugguguuuccug

SEQ ID NO: 1177782 - RNA, 19 nt, Human
gaggcuccacuuggucugu

SEQ ID NO: 1177783 - RNA, 23 nt, Human
gaggcuccacuuggucugugaga

SEQ ID NO: 1177784 - RNA, 12 nt, Human
gaggcuccacuu

SEQ ID NO: 1177785 - RNA, 15 nt, Human
gaggacgcucucugg

SEQ ID NO: 1177786 - RNA, 20 nt, Human
gaggacgcucucuggccuuc

SEQ ID NO: 1177787 - RNA, 14 nt, Human
gaggcagggucuca

SEQ ID NO: 1177788 - RNA, 15 nt, Human
gaggcagggucucac

SEQ ID NO: 1177789 - RNA, 18 nt, Human
gaggcagggucucacucu

SEQ ID NO: 1177790 - RNA, 22 nt, Human
gaggccaaggugggaggauugc

SEQ ID NO: 1177791 - RNA, 12 nt, Human
gaggggccucuu

SEQ ID NO: 1177792 - RNA, 23 nt, Human
gagccuuccaggggugggacacc

SEQ ID NO: 1177793 - RNA, 13 nt, Human
gagccuugaacuu

SEQ ID NO: 1177794 - RNA, 19 nt, Human
gagccuugaacuuugaccu

SEQ ID NO: 1177795 - RNA, 20 nt, Human
gagccuuccaggggugggac

SEQ ID NO: 1177796 - RNA, 15 nt, Human
gaggucgaggcagga

SEQ ID NO: 1177797 - RNA, 23 nt, Human
gaggugaccccagguuucuaugu

SEQ ID NO: 1177798 - RNA, 16 nt, Human
gagucaccaagcccag

SEQ ID NO: 1177799 - RNA, 17 nt, Human
gagucaccaagcccagu

SEQ ID NO: 1177800 - RNA, 22 nt, Human
gagucagaaguuucugccgcag

SEQ ID NO: 1177801 - RNA, 12 nt, Human
gagucccaccuu

SEQ ID NO: 1177802 - RNA, 13 nt, Human
gagucccaccuug

SEQ ID NO: 1177803 - RNA, 18 nt, Human
gagugacagaggcagccc

SEQ ID NO: 1177804 - RNA, 20 nt, Human
gagugacagaggcagcccca

SEQ ID NO: 1177805 - RNA, 15 nt, Human
gaguugauucagcuc

SEQ ID NO: 1177806 - RNA, 16 nt, Human
gaguugauucagcucu

SEQ ID NO: 1177807 - RNA, 17 nt, Human
gaguugauucagcucug

SEQ ID NO: 1177808 - RNA, 16 nt, Human
gaguuuaaauuguaau

SEQ ID NO: 1177809 - RNA, 18 nt, Human
gaguugauucagcucugc

SEQ ID NO: 1177810 - RNA, 14 nt, Human
gacucuuaagaaga

SEQ ID NO: 1177811 - RNA, 15 nt, Human
gacucuuaagaagac

SEQ ID NO: 1177812 - RNA, 21 nt, Human
gacucuuaagaagacugcauu

SEQ ID NO: 1177813 - RNA, 16 nt, Human
gacugaauuucuuuug

SEQ ID NO: 1177814 - RNA, 14 nt, Human
gacugaauuucuuu

SEQ ID NO: 1177815 - RNA, 20 nt, Human
gaccaucccugaaggccccg

SEQ ID NO: 1177816 - RNA, 14 nt, Human
gaccaucccugaag

SEQ ID NO: 1177817 - RNA, 14 nt, Human
gaccucugcagcaa

SEQ ID NO: 1177818 - RNA, 11 nt, Human
gaccugaggcc

SEQ ID NO: 1177819 - RNA, 13 nt, Human
gaccugaggcccu

SEQ ID NO: 1177820 - RNA, 14 nt, Human
gaccugaggcccuu

SEQ ID NO: 1177821 - RNA, 16 nt, Human
gacgccaucccagccc

SEQ ID NO: 1177822 - RNA, 17 nt, Human
gacgccaucccagcccc

SEQ ID NO: 1177823 - RNA, 18 nt, Human
gacgccaucccagcccca

SEQ ID NO: 1177824 - RNA, 19 nt, Human
gacgccaucccagccccaa

SEQ ID NO: 1177825 - RNA, 16 nt, Human
gacgcuacccgggaag

SEQ ID NO: 1177826 - RNA, 18 nt, Human
gacgcuacccgggaaggg

SEQ ID NO: 1177827 - RNA, 19 nt, Human
gacgcuacccgggaagggg

SEQ ID NO: 1177828 - RNA, 16 nt, Human
gacgcucucuggccuu

SEQ ID NO: 1177829 - RNA, 17 nt, Human
gacgcucucuggccuuc

SEQ ID NO: 1177830 - RNA, 20 nt, Human
gacagcccgggcucugccuc

SEQ ID NO: 1177831 - RNA, 18 nt, Human
gacagcccgggcucugcc

SEQ ID NO: 1177832 - RNA, 19 nt, Human
gacagcccgggcucugccu

SEQ ID NO: 1177833 - RNA, 21 nt, Human
gacagugagacucugucucag

SEQ ID NO: 1177834 - RNA, 14 nt, Human
gacauugcggacag

SEQ ID NO: 1177835 - RNA, 15 nt, Human
gacauugcggacagc

SEQ ID NO: 1177836 - RNA, 17 nt, Human
gacauugcggacagcca

SEQ ID NO: 1177837 - RNA, 19 nt, Human
gacauuguuggccaaagcc

SEQ ID NO: 1177838 - RNA, 16 nt, Human
gacauuugcucaugga

SEQ ID NO: 1177839 - RNA, 17 nt, Human
gacauuugcucauggaa

SEQ ID NO: 1177840 - RNA, 20 nt, Human
gaccagggauuuccaugaug

SEQ ID NO: 1177841 - RNA, 12 nt, Human
gaccaucccuga

SEQ ID NO: 1177842 - RNA, 13 nt, Human
gaccaucccugaa

SEQ ID NO: 1177843 - RNA, 19 nt, Human
gaccaucccugaaggcccc

SEQ ID NO: 1177844 - RNA, 18 nt, Human
gaccagggauuuccauga

SEQ ID NO: 1177845 - RNA, 17 nt, Human
gacagcccgggcucugc

SEQ ID NO: 1177846 - RNA, 15 nt, Human
gacacacugaagaag

SEQ ID NO: 1177847 - RNA, 16 nt, Human
gacacacugaagaagc

SEQ ID NO: 1177848 - RNA, 14 nt, Human
gacacagcucuucu

SEQ ID NO: 1177849 - RNA, 16 nt, Human
gacacagcucuucucc

SEQ ID NO: 1177850 - RNA, 17 nt, Human
gacacagcucuucucca

SEQ ID NO: 1177851 - RNA, 22 nt, Human
gacacagcucuucuccaggcug

SEQ ID NO: 1177852 - RNA, 23 nt, Human
gacacagcucuucuccaggcugu

SEQ ID NO: 1177853 - RNA, 12 nt, Human
gacacaggcccg

SEQ ID NO: 1177854 - RNA, 14 nt, Human
gaauauugcugaug

SEQ ID NO: 1177855 - RNA, 15 nt, Human
gaauauugcugaugg

SEQ ID NO: 1177856 - RNA, 19 nt, Human
gaauauugcugauggugca

SEQ ID NO: 1177857 - RNA, 20 nt, Human
gaauauugcugauggugcaa

SEQ ID NO: 1177858 - RNA, 22 nt, Human
gaaggggagauaaggguaucug

SEQ ID NO: 1177859 - RNA, 22 nt, Human
gaagcuccgcuuucuacccagc

SEQ ID NO: 1177860 - RNA, 18 nt, Human
gaaggccccgcccaggcu

SEQ ID NO: 1177861 - RNA, 19 nt, Human
gaaggccccgcccaggcuu

SEQ ID NO: 1177862 - RNA, 21 nt, Human
gaaggcucgagcaugccugga

SEQ ID NO: 1177863 - RNA, 15 nt, Human
gaaggcuggguucug

SEQ ID NO: 1177864 - RNA, 19 nt, Human
gaaggcuggguucugaucc

SEQ ID NO: 1177865 - RNA, 20 nt, Human
gaaggcuggguucugauccu

SEQ ID NO: 1177866 - RNA, 22 nt, Human
gaaggcuggguucugauccuag

SEQ ID NO: 1177867 - RNA, 14 nt, Human
gaacugaaaucaua

SEQ ID NO: 1177868 - RNA, 11 nt, Human
gaacuggcugc

SEQ ID NO: 1177869 - RNA, 12 nt, Human
gaacuggcugca

SEQ ID NO: 1177870 - RNA, 16 nt, Human
gaagacaaugacuuac

SEQ ID NO: 1177871 - RNA, 22 nt, Human
gaagacaaugacuuacuguaca

SEQ ID NO: 1177872 - RNA, 23 nt, Human
gaagacaaugugaaaagaaaaau

SEQ ID NO: 1177873 - RNA, 14 nt, Human
gaagcaaaauuuuu

SEQ ID NO: 1177874 - RNA, 23 nt, Human
gaagcaacccaaauguucaucaa

SEQ ID NO: 1177875 - RNA, 15 nt, Human
gaagcacaugccucu

SEQ ID NO: 1177876 - RNA, 17 nt, Human
gaagcacaugccucucu

SEQ ID NO: 1177877 - RNA, 20 nt, Human
gaagcacaugccucucucag

SEQ ID NO: 1177878 - RNA, 21 nt, Human
gaagcacaugccucucucagg

SEQ ID NO: 1177879 - RNA, 15 nt, Human
gaagcagaggaagga

SEQ ID NO: 1177880 - RNA, 19 nt, Human
cuuugacgccaucccagcc

SEQ ID NO: 1177881 - RNA, 21 nt, Human
cuuugacgccaucccagcccc

SEQ ID NO: 1177882 - RNA, 22 nt, Human
cuuugacgccaucccagcccca

SEQ ID NO: 1177883 - RNA, 19 nt, Human
cuuuuauaaacuuuaccuu

SEQ ID NO: 1177884 - RNA, 16 nt, Human
cuuuuauaaacuuuac

SEQ ID NO: 1177885 - RNA, 18 nt, Human
cuuuuauaaacuuuaccu

SEQ ID NO: 1177886 - RNA, 15 nt, Human
cuuuuauaaacuuua

SEQ ID NO: 1177887 - RNA, 16 nt, Human
cuuuggucuacacugu

SEQ ID NO: 1177888 - RNA, 20 nt, Human
cuuuggucuacacugugcug

SEQ ID NO: 1177889 - RNA, 15 nt, Human
cuuuucaaaacauuu

SEQ ID NO: 1177890 - RNA, 14 nt, Human
cuuguggacacagc

SEQ ID NO: 1177891 - RNA, 15 nt, Human
cuuguggacacagcu

SEQ ID NO: 1177892 - RNA, 16 nt, Human
cuuguggacacagcuc

SEQ ID NO: 1177893 - RNA, 14 nt, Human
cuuuaaaugcugcu

SEQ ID NO: 1177894 - RNA, 15 nt, Human
cuuuaaaugcugcuu

SEQ ID NO: 1177895 - RNA, 20 nt, Human
cuuucaauaggaaaaacuga

SEQ ID NO: 1177896 - RNA, 21 nt, Human
cuuucaauaggaaaaacugau

SEQ ID NO: 1177897 - RNA, 22 nt, Human
cuuucaauaggaaaaacugauu

SEQ ID NO: 1177898 - RNA, 23 nt, Human
cuuucaauaggaaaaacugauuu

SEQ ID NO: 1177899 - RNA, 23 nt, Human
cuugaaugaugccaugaggaaca

SEQ ID NO: 1177900 - RNA, 12 nt, Human
cuugacagggca

SEQ ID NO: 1177901 - RNA, 20 nt, Human
cuugccgucuaccugagggg

SEQ ID NO: 1177902 - RNA, 23 nt, Human
cuugccgucuaccugaggggccu

SEQ ID NO: 1177903 - RNA, 13 nt, Human
cuugacagggcac

SEQ ID NO: 1177904 - RNA, 12 nt, Human
cuugcucugcug

SEQ ID NO: 1177905 - RNA, 13 nt, Human
cuugcucugcuga

SEQ ID NO: 1177906 - RNA, 20 nt, Human
cuugaaugaugccaugagga

SEQ ID NO: 1177907 - RNA, 22 nt, Human
cuucuucagagacuccugcagg

SEQ ID NO: 1177908 - RNA, 23 nt, Human
cuucuucagagacuccugcaggc

SEQ ID NO: 1177909 - RNA, 15 nt, Human
cuucuguuuuauaau

SEQ ID NO: 1177910 - RNA, 20 nt, Human
cuucuguuuuauaauuuugu

SEQ ID NO: 1177911 - RNA, 20 nt, Human
cuucuucagagacuccugca

SEQ ID NO: 1177912 - RNA, 21 nt, Human
cuucuucagagacuccugcag

SEQ ID NO: 1177913 - RNA, 18 nt, Human
cuucaguggcagcugcuu

SEQ ID NO: 1177914 - RNA, 23 nt, Human
cuucagagacuccugcaggcagc

SEQ ID NO: 1177915 - RNA, 24 nt, Human
cuucagagacuccugcaggcagcc

SEQ ID NO: 1177916 - RNA, 13 nt, Human
cuucaucccucug

SEQ ID NO: 1177917 - RNA, 15 nt, Human
cuucauccuccucag

SEQ ID NO: 1177918 - RNA, 16 nt, Human
cuucauccuccucaga

SEQ ID NO: 1177919 - RNA, 23 nt, Human
cuucaugcugucuacacuaagag

SEQ ID NO: 1177920 - RNA, 17 nt, Human
cuucaccuuugucccca

SEQ ID NO: 1177921 - RNA, 20 nt, Human
cuucaccuuuguccccaccg

SEQ ID NO: 1177922 - RNA, 18 nt, Human
cuuauugcccacgcugga

SEQ ID NO: 1177923 - RNA, 14 nt, Human
cuucaccuuugucc

SEQ ID NO: 1177924 - RNA, 11 nt, Human
cuucagacaua

SEQ ID NO: 1177925 - RNA, 16 nt, Human
cuucagagacuccugc

SEQ ID NO: 1177926 - RNA, 17 nt, Human
cuucagagacuccugca

SEQ ID NO: 1177927 - RNA, 21 nt, Human
cuucagagacuccugcaggca

SEQ ID NO: 1177928 - RNA, 22 nt, Human
cuucagagacuccugcaggcag

SEQ ID NO: 1177929 - RNA, 16 nt, Human
cuuccauggacuuugu

SEQ ID NO: 1177930 - RNA, 17 nt, Human
cuuccauggacuuuguu

SEQ ID NO: 1177931 - RNA, 18 nt, Human
cuuccagugaggcucugc

SEQ ID NO: 1177932 - RNA, 19 nt, Human
cuuccagugaggcucugcc

SEQ ID NO: 1177933 - RNA, 20 nt, Human
cuuccagugaggcucugccc

SEQ ID NO: 1177934 - RNA, 18 nt, Human
cuuagcagggaaacagcu

SEQ ID NO: 1177935 - RNA, 21 nt, Human
cuuagcagggaaacagcuaau

SEQ ID NO: 1177936 - RNA, 14 nt, Human
cuuaugggcugggu

SEQ ID NO: 1177937 - RNA, 21 nt, Human
cuuaugggcuggguucuaccc

SEQ ID NO: 1177938 - RNA, 22 nt, Human
cuuaugggcuggguucuaccca

SEQ ID NO: 1177939 - RNA, 23 nt, Human
cuuaugggcuggguucuacccag

SEQ ID NO: 1177940 - RNA, 13 nt, Human
cuuauugcccacg

SEQ ID NO: 1177941 - RNA, 16 nt, Human
cuguugggccaggagc

SEQ ID NO: 1177942 - RNA, 17 nt, Human
cuguugggccaggagcc

SEQ ID NO: 1177943 - RNA, 20 nt, Human
cuguugggccaggagccucc

SEQ ID NO: 1177944 - RNA, 21 nt, Human
cuuaaagaguguggcaaaaua

SEQ ID NO: 1177945 - RNA, 15 nt, Human
cuuaaagaguguggc

SEQ ID NO: 1177946 - RNA, 13 nt, Human
cuuaccucggugc

SEQ ID NO: 1177947 - RNA, 17 nt, Human
cuuacccucauguucuu

SEQ ID NO: 1177948 - RNA, 18 nt, Human
cuuacccucauguucuua

SEQ ID NO: 1177949 - RNA, 19 nt, Human
cuuacccucauguucuuaa

SEQ ID NO: 1177950 - RNA, 19 nt, Human
cuuaccucggugccuuccu

SEQ ID NO: 1177951 - RNA, 21 nt, Human
cuuaccucggugccuuccucu

SEQ ID NO: 1177952 - RNA, 13 nt, Human
cuuaccugccagg

SEQ ID NO: 1177953 - RNA, 20 nt, Human
cugugucuugcaauggcagc

SEQ ID NO: 1177954 - RNA, 16 nt, Human
cugugucuugcaaugg

SEQ ID NO: 1177955 - RNA, 19 nt, Human
cugugucuugcaauggcag

SEQ ID NO: 1177956 - RNA, 13 nt, Human
cuguucagcucca

SEQ ID NO: 1177957 - RNA, 14 nt, Human
cuguucagcuccag

SEQ ID NO: 1177958 - RNA, 20 nt, Human
cugugcugagucugaaggcu

SEQ ID NO: 1177959 - RNA, 22 nt, Human
cugugcugagucugaaggcugg

SEQ ID NO: 1177960 - RNA, 11 nt, Human
cugugcugccc

SEQ ID NO: 1177961 - RNA, 20 nt, Human
cugugucagcauagaaguaa

SEQ ID NO: 1177962 - RNA, 19 nt, Human
cugugucagguggggcagc

SEQ ID NO: 1177963 - RNA, 21 nt, Human
cugugucagguggggcagcuu

SEQ ID NO: 1177964 - RNA, 22 nt, Human
cugugucagguggggcagcuug

SEQ ID NO: 1177965 - RNA, 14 nt, Human
cugugucucccuuc

SEQ ID NO: 1177966 - RNA, 19 nt, Human
cugugucucccuucauccu

SEQ ID NO: 1177967 - RNA, 14 nt, Human
cugugucuugcaau

SEQ ID NO: 1177968 - RNA, 18 nt, Human
cugcugaaggcucgagca

SEQ ID NO: 1177969 - RNA, 13 nt, Human
cugcugacagugu

SEQ ID NO: 1177970 - RNA, 15 nt, Human
cugcugacaguguug

SEQ ID NO: 1177971 - RNA, 13 nt, Human
cugcugaaggcuc

SEQ ID NO: 1177972 - RNA, 14 nt, Human
cugcugaaggcucg

SEQ ID NO: 1177973 - RNA, 15 nt, Human
cugcugaaggcucga

SEQ ID NO: 1177974 - RNA, 12 nt, Human
cugcugacagug

SEQ ID NO: 1177975 - RNA, 16 nt, Human
cugcucacauaucugu

SEQ ID NO: 1177976 - RNA, 19 nt, Human
cugcucacauaucugucau

SEQ ID NO: 1177977 - RNA, 15 nt, Human
cuggaugcagccuca

SEQ ID NO: 1177978 - RNA, 15 nt, Human
cuggaguucugguuc

SEQ ID NO: 1177979 - RNA, 16 nt, Human
cuggaguucugguucc

SEQ ID NO: 1177980 - RNA, 17 nt, Human
cuggaguucugguuccu

SEQ ID NO: 1177981 - RNA, 12 nt, Human
cuggcccuuccu

SEQ ID NO: 1177982 - RNA, 13 nt, Human
cuggcuaugcauu

SEQ ID NO: 1177983 - RNA, 14 nt, Human
cuggcuaugcauuu

SEQ ID NO: 1177984 - RNA, 15 nt, Human
cuggcuaugcauuug

SEQ ID NO: 1177985 - RNA, 16 nt, Human
cuggcuaugcauuuga

SEQ ID NO: 1177986 - RNA, 22 nt, Human
cuggcuaugcauuugaaaauuu

SEQ ID NO: 1177987 - RNA, 14 nt, Human
cugggacaugggaa

SEQ ID NO: 1177988 - RNA, 18 nt, Human
cugggacaugggaaaggg

SEQ ID NO: 1177989 - RNA, 22 nt, Human
cugggacaugggaaaggggaag

SEQ ID NO: 1177990 - RNA, 13 nt, Human
cugggacuacagg

SEQ ID NO: 1177991 - RNA, 15 nt, Human
cugggacuacaggca

SEQ ID NO: 1177992 - RNA, 16 nt, Human
cugggacuacaggcac

SEQ ID NO: 1177993 - RNA, 22 nt, Human
cugggagaaccaaaaagaggcu

SEQ ID NO: 1177994 - RNA, 13 nt, Human
cugggcagaggaa

SEQ ID NO: 1177995 - RNA, 16 nt, Human
cugggcagaggaaagc

SEQ ID NO: 1177996 - RNA, 20 nt, Human
cugggcagaggaaagcaaag

SEQ ID NO: 1177997 - RNA, 20 nt, Human
cugggcagguuggugggggc

SEQ ID NO: 1177998 - RNA, 13 nt, Human
cuggggagaaagu

SEQ ID NO: 1177999 - RNA, 14 nt, Human
cuggggagaaagua

SEQ ID NO: 1178000 - RNA, 18 nt, Human
cuggguggcaccagcagc

SEQ ID NO: 1178001 - RNA, 20 nt, Human
cuggguggcaccagcagccu

SEQ ID NO: 1178002 - RNA, 21 nt, Human
cuggguggcaccagcagccug

SEQ ID NO: 1178003 - RNA, 22 nt, Human
cuggguggcaccagcagccugg

SEQ ID NO: 1178004 - RNA, 14 nt, Human
cuggguguggcgca

SEQ ID NO: 1178005 - RNA, 15 nt, Human
cuggguguggcgcag

SEQ ID NO: 1178006 - RNA, 21 nt, Human
cuggugccucaccccuugcca

SEQ ID NO: 1178007 - RNA, 21 nt, Human
cugcaaaggguaucaggugcu

SEQ ID NO: 1178008 - RNA, 22 nt, Human
cugcaaaggguaucaggugcug

SEQ ID NO: 1178009 - RNA, 22 nt, Human
cugaugggcaacccccagccug

SEQ ID NO: 1178010 - RNA, 23 nt, Human
cugaugggcaacccccagccugc

SEQ ID NO: 1178011 - RNA, 24 nt, Human
cugaugggcaacccccagccugcu

SEQ ID NO: 1178012 - RNA, 18 nt, Human
cugaugcuucuucagaga

SEQ ID NO: 1178013 - RNA, 19 nt, Human
cugaugcuucuucagagac

SEQ ID NO: 1178014 - RNA, 20 nt, Human
cugaugcuucuucagagacu

SEQ ID NO: 1178015 - RNA, 18 nt, Human
cugaugggcaacccccag

SEQ ID NO: 1178016 - RNA, 21 nt, Human
cugaugggcaacccccagccu

SEQ ID NO: 1178017 - RNA, 14 nt, Human
cucuuaugggcugg

SEQ ID NO: 1178018 - RNA, 15 nt, Human
cucuuaugggcuggg

SEQ ID NO: 1178019 - RNA, 13 nt, Human
cucuuauugccca

SEQ ID NO: 1178020 - RNA, 16 nt, Human
cugaugcuucuucaga

SEQ ID NO: 1178021 - RNA, 17 nt, Human
cugaugcuucuucagag

SEQ ID NO: 1178022 - RNA, 22 nt, Human
cugcaaccugauugugucucuu

SEQ ID NO: 1178023 - RNA, 18 nt, Human
cugcaagaauugaagcag

SEQ ID NO: 1178024 - RNA, 20 nt, Human
cugcaaccuccgccucuugg

SEQ ID NO: 1178025 - RNA, 22 nt, Human
cugcaaccuccgccucuugggu

SEQ ID NO: 1178026 - RNA, 14 nt, Human
cugcaaccugauug

SEQ ID NO: 1178027 - RNA, 19 nt, Human
cugcaaccugauugugucu

SEQ ID NO: 1178028 - RNA, 21 nt, Human
cugcaaccugauugugucucu

SEQ ID NO: 1178029 - RNA, 20 nt, Human
cugcaagaauugaagcagga

SEQ ID NO: 1178030 - RNA, 12 nt, Human
cugcaagggagu

SEQ ID NO: 1178031 - RNA, 23 nt, Human
cugcaccgggccacagagaaagu

SEQ ID NO: 1178032 - RNA, 13 nt, Human
cugcacuccagcc

SEQ ID NO: 1178033 - RNA, 22 nt, Human
cugcacuauagccuaggugaca

SEQ ID NO: 1178034 - RNA, 23 nt, Human
cugcacuauagccuaggugacag

SEQ ID NO: 1178035 - RNA, 15 nt, Human
cugcacuccagccug

SEQ ID NO: 1178036 - RNA, 16 nt, Human
cugcacuccagccuga

SEQ ID NO: 1178037 - RNA, 17 nt, Human
cugcacuccagccugag

SEQ ID NO: 1178038 - RNA, 20 nt, Human
cugcacuccagccugagcga

SEQ ID NO: 1178039 - RNA, 16 nt, Human
cugcacuauagccuag

SEQ ID NO: 1178040 - RNA, 17 nt, Human
cugcacuauagccuagg

SEQ ID NO: 1178041 - RNA, 18 nt, Human
cugcacuauagccuaggu

SEQ ID NO: 1178042 - RNA, 20 nt, Human
cugcacuauagccuagguga

SEQ ID NO: 1178043 - RNA, 16 nt, Human
cugcacuccagccugg

SEQ ID NO: 1178044 - RNA, 17 nt, Human
cugcacuccagccuggg

SEQ ID NO: 1178045 - RNA, 18 nt, Human
cugcacuccagccugggu

SEQ ID NO: 1178046 - RNA, 19 nt, Human
cugcacuccagccugggug

SEQ ID NO: 1178047 - RNA, 24 nt, Human
cugcagccucaaccuccugggcua

SEQ ID NO: 1178048 - RNA, 12 nt, Human
cugcagcuuugu

SEQ ID NO: 1178049 - RNA, 13 nt, Human
cugcaggcagcca

SEQ ID NO: 1178050 - RNA, 14 nt, Human
cugcaggcagccag

SEQ ID NO: 1178051 - RNA, 15 nt, Human
cugcaggcagccagg

SEQ ID NO: 1178052 - RNA, 16 nt, Human
cugcaggcagccaggc

SEQ ID NO: 1178053 - RNA, 17 nt, Human
cugcaggcagccaggcc

SEQ ID NO: 1178054 - RNA, 18 nt, Human
cugcaggcagccaggcca

SEQ ID NO: 1178055 - RNA, 19 nt, Human
cugcaggcagccaggccac

SEQ ID NO: 1178056 - RNA, 20 nt, Human
cugcaggcagccaggccaca

SEQ ID NO: 1178057 - RNA, 17 nt, Human
cugcauuuaaaagauac

SEQ ID NO: 1178058 - RNA, 18 nt, Human
cugcauuuaaaagauaca

SEQ ID NO: 1178059 - RNA, 20 nt, Human
cugccagggacagagggggu

SEQ ID NO: 1178060 - RNA, 22 nt, Human
cugccagggacagagggggugg

SEQ ID NO: 1178061 - RNA, 23 nt, Human
cugccagggacagaggggguggc

SEQ ID NO: 1178062 - RNA, 16 nt, Human
cugccauauucuguug

SEQ ID NO: 1178063 - RNA, 16 nt, Human
cugccauccagguuca

SEQ ID NO: 1178064 - RNA, 18 nt, Human
cugccauccagguucagc

SEQ ID NO: 1178065 - RNA, 19 nt, Human
cugccauccagguucagcu

SEQ ID NO: 1178066 - RNA, 20 nt, Human
cugccauauucuguuggcca

SEQ ID NO: 1178067 - RNA, 12 nt, Human
cugcccuuaccu

SEQ ID NO: 1178068 - RNA, 16 nt, Human
cugcccuuaccugcca

SEQ ID NO: 1178069 - RNA, 17 nt, Human
cugcccuuaccugccag

SEQ ID NO: 1178070 - RNA, 14 nt, Human
cugcauuuaaaaga

SEQ ID NO: 1178071 - RNA, 14 nt, Human
cacccaagggccug

SEQ ID NO: 1178072 - RNA, 15 nt, Human
cacccaagggccugg

SEQ ID NO: 1178073 - RNA, 13 nt, Human
cauugugggaagg

SEQ ID NO: 1178074 - RNA, 17 nt, Human
cauuguuggccaaagcc

SEQ ID NO: 1178075 - RNA, 18 nt, Human
cauuguuggccaaagcca

SEQ ID NO: 1178076 - RNA, 17 nt, Human
cauuuaggccaugggac

SEQ ID NO: 1178077 - RNA, 12 nt, Human
cauuuaaaagau

SEQ ID NO: 1178078 - RNA, 15 nt, Human
cauuuaaaagauaca

SEQ ID NO: 1178079 - RNA, 16 nt, Human
cauuuaaaagauacag

SEQ ID NO: 1178080 - RNA, 21 nt, Human
cauuuaaaagauacaguuacu

SEQ ID NO: 1178081 - RNA, 12 nt, Human
cauuuccugugu

SEQ ID NO: 1178082 - RNA, 13 nt, Human
cauuuccuguguc

SEQ ID NO: 1178083 - RNA, 16 nt, Human
cacccaagggccuggc

SEQ ID NO: 1178084 - RNA, 23 nt, Human
cauuuuucuuagggaaggauaca

SEQ ID NO: 1178085 - RNA, 22 nt, Human
cauuugaaaauuuugauguuuu

SEQ ID NO: 1178086 - RNA, 17 nt, Human
cauuugagcagggcuca

SEQ ID NO: 1178087 - RNA, 18 nt, Human
cauuugagcagggcucag

SEQ ID NO: 1178088 - RNA, 20 nt, Human
cauuugagcagggcucagcg

SEQ ID NO: 1178089 - RNA, 13 nt, Human
cauuugcucaugg

SEQ ID NO: 1178090 - RNA, 14 nt, Human
cauuugcucaugga

SEQ ID NO: 1178091 - RNA, 13 nt, Human
cauuugcuccuuu

SEQ ID NO: 1178092 - RNA, 14 nt, Human
cauuugcuccuuuc

SEQ ID NO: 1178093 - RNA, 13 nt, Human
cauuugcugaaua

SEQ ID NO: 1178094 - RNA, 20 nt, Human
cauuuguuugaacugauaaa

SEQ ID NO: 1178095 - RNA, 22 nt, Human
cauuuguuugaacugauaaaga

SEQ ID NO: 1178096 - RNA, 13 nt, Human
ccaacaucaacau

SEQ ID NO: 1178097 - RNA, 21 nt, Human
ccaacauacucccaucuguga

SEQ ID NO: 1178098 - RNA, 22 nt, Human
ccaacauacucccaucugugaa

SEQ ID NO: 1178099 - RNA, 17 nt, Human
ccaacauacucccaucu

SEQ ID NO: 1178100 - RNA, 18 nt, Human
ccaacauacucccaucug

SEQ ID NO: 1178101 - RNA, 19 nt, Human
ccaacauacucccaucugu

SEQ ID NO: 1178102 - RNA, 20 nt, Human
ccaacauacucccaucugug

SEQ ID NO: 1178103 - RNA, 15 nt, Human
ccaaaguacacuguu

SEQ ID NO: 1178104 - RNA, 18 nt, Human
ccaaaguacacuguuuca

SEQ ID NO: 1178105 - RNA, 20 nt, Human
ccaaaguacacuguuucaaa

SEQ ID NO: 1178106 - RNA, 20 nt, Human
ccaaacucaccugccccuca

SEQ ID NO: 1178107 - RNA, 22 nt, Human
ccaaacugacucuuaagaagac

SEQ ID NO: 1178108 - RNA, 23 nt, Human
ccaaagcagugcaugcugucccu

SEQ ID NO: 1178109 - RNA, 19 nt, Human
ccaaagccaaagcuaggcc

SEQ ID NO: 1178110 - RNA, 17 nt, Human
ccaaagccuccuccagc

SEQ ID NO: 1178111 - RNA, 22 nt, Human
ccaaagccuccuccagccgcca

SEQ ID NO: 1178112 - RNA, 15 nt, Human
ccaaagcuaggccug

SEQ ID NO: 1178113 - RNA, 16 nt, Human
ccaaagcuaggccugg

SEQ ID NO: 1178114 - RNA, 17 nt, Human
ccaaagcuaggccuggc

SEQ ID NO: 1178115 - RNA, 21 nt, Human
ccaaagcuaggccuggccaga

SEQ ID NO: 1178116 - RNA, 15 nt, Human
ccaaaggaagcacau

SEQ ID NO: 1178117 - RNA, 23 nt, Human
ccaaaggaagcacaugccucucu

SEQ ID NO: 1178118 - RNA, 12 nt, Human
ccaacccucauc

SEQ ID NO: 1178119 - RNA, 13 nt, Human
ccaacccucauca

SEQ ID NO: 1178120 - RNA, 19 nt, Human
ccaagaagcccaggaaagg

SEQ ID NO: 1178121 - RNA, 20 nt, Human
ccaagaagcccaggaaaggc

SEQ ID NO: 1178122 - RNA, 23 nt, Human
ccaagcagagguugggaggccau

SEQ ID NO: 1178123 - RNA, 15 nt, Human
ccaagcucccaggca

SEQ ID NO: 1178124 - RNA, 16 nt, Human
ccaagcucccaggcau

SEQ ID NO: 1178125 - RNA, 22 nt, Human
ccaagcucccaggcauucccca

SEQ ID NO: 1178126 - RNA, 17 nt, Human
ccaaggccaaaggaagc

SEQ ID NO: 1178127 - RNA, 17 nt, Human
ccaagcauuuagaugua

SEQ ID NO: 1178128 - RNA, 13 nt, Human
ccaaggugggagg

SEQ ID NO: 1178129 - RNA, 18 nt, Human
ccaaggugggaggauugc

SEQ ID NO: 1178130 - RNA, 23 nt, Human
ccaagguuuggggaagaacgaag

SEQ ID NO: 1178131 - RNA, 20 nt, Human
ccaagucaagugaaaaagga

SEQ ID NO: 1178132 - RNA, 18 nt, Human
ccaaggccaaaggaagca

SEQ ID NO: 1178133 - RNA, 21 nt, Human
ccaaggccaaaggaagcacau

SEQ ID NO: 1178134 - RNA, 15 nt, Human
ccaagggccuggccu

SEQ ID NO: 1178135 - RNA, 16 nt, Human
ccaagggccuggccug

SEQ ID NO: 1178136 - RNA, 18 nt, Human
ccaagggccuggccugag

SEQ ID NO: 1178137 - RNA, 19 nt, Human
ccaagggccuggccugagc

SEQ ID NO: 1178138 - RNA, 22 nt, Human
ccaaggggaauguuugccucug

SEQ ID NO: 1178139 - RNA, 14 nt, Human
ccaagcaaguauua

SEQ ID NO: 1178140 - RNA, 20 nt, Human
ccacaggaaccacaagacug

SEQ ID NO: 1178141 - RNA, 16 nt, Human
ccacaggaucagucug

SEQ ID NO: 1178142 - RNA, 20 nt, Human
ccacacccagcccacuucug

SEQ ID NO: 1178143 - RNA, 21 nt, Human
ccacacccagcccacuucugc

SEQ ID NO: 1178144 - RNA, 22 nt, Human
ccacacccagcccacuucugcc

SEQ ID NO: 1178145 - RNA, 18 nt, Human
ccacaucuugcucugcug

SEQ ID NO: 1178146 - RNA, 19 nt, Human
ccacaucuugcucugcuga

SEQ ID NO: 1178147 - RNA, 20 nt, Human
ccacaucuugcucugcugac

SEQ ID NO: 1178148 - RNA, 16 nt, Human
ccacaugugcacaugc

SEQ ID NO: 1178149 - RNA, 16 nt, Human
ccacauuccugaugcu

SEQ ID NO: 1178150 - RNA, 16 nt, Human
ccaauauucauagcag

SEQ ID NO: 1178151 - RNA, 23 nt, Human
ccacccaggagccccgaggccuu

SEQ ID NO: 1178152 - RNA, 17 nt, Human
ccacccccacccaaggg

SEQ ID NO: 1178153 - RNA, 16 nt, Human
ccacuacauucuguua

SEQ ID NO: 1178154 - RNA, 17 nt, Human
ccacuacauucuguuaa

SEQ ID NO: 1178155 - RNA, 11 nt, Human
ccacuacauuc

SEQ ID NO: 1178156 - RNA, 15 nt, Human
ccacuacauucuguu

SEQ ID NO: 1178157 - RNA, 18 nt, Human
ccacucaguccauagcag

SEQ ID NO: 1178158 - RNA, 15 nt, Human
ccaccccacacacgc

SEQ ID NO: 1178159 - RNA, 15 nt, Human
ccacccccacccaag

SEQ ID NO: 1178160 - RNA, 16 nt, Human
ccacgcuggagugcag

SEQ ID NO: 1178161 - RNA, 18 nt, Human
ccacgcuggagugcagug

SEQ ID NO: 1178162 - RNA, 19 nt, Human
ccacgcuggagugcaguga

SEQ ID NO: 1178163 - RNA, 18 nt, Human
ccacggccaggccagagg

SEQ ID NO: 1178164 - RNA, 23 nt, Human
ccacggccaggccagagggagug

SEQ ID NO: 1178165 - RNA, 14 nt, Human
ccacuacauucugu

SEQ ID NO: 1178166 - RNA, 13 nt, Human
ccacugcagaaga

SEQ ID NO: 1178167 - RNA, 18 nt, Human
ccacugcagaagacagua

SEQ ID NO: 1178168 - RNA, 13 nt, Human
ccacuucagcuga

SEQ ID NO: 1178169 - RNA, 14 nt, Human
ccacuucagcugac

SEQ ID NO: 1178170 - RNA, 22 nt, Human
ccagaaguuugagaucagccug

SEQ ID NO: 1178171 - RNA, 23 nt, Human
ccagaaguuugagaucagccugg

SEQ ID NO: 1178172 - RNA, 18 nt, Human
ccagaauuucccaaagca

SEQ ID NO: 1178173 - RNA, 12 nt, Human
ccagaauuuccc

SEQ ID NO: 1178174 - RNA, 19 nt, Human
ccagaauuucccaaagcag

SEQ ID NO: 1178175 - RNA, 21 nt, Human
ccagaauuucccaaagcagug

SEQ ID NO: 1178176 - RNA, 21 nt, Human
ccagacaccuugacagggcac

SEQ ID NO: 1178177 - RNA, 19 nt, Human
ccaggcuggucucaaacuc

SEQ ID NO: 1178178 - RNA, 20 nt, Human
ccaggcuguaucccaugagc

SEQ ID NO: 1178179 - RNA, 13 nt, Human
ccaggccccugcc

SEQ ID NO: 1178180 - RNA, 24 nt, Human
ccaggcuguaucccaugagccuca

SEQ ID NO: 1178181 - RNA, 13 nt, Human
ccaguaucuugaa

SEQ ID NO: 1178182 - RNA, 15 nt, Human
ccagguucagcuugu

SEQ ID NO: 1178183 - RNA, 21 nt, Human
ccaggugcuaggaacacuccu

SEQ ID NO: 1178184 - RNA, 14 nt, Human
ccagguucagcuug

SEQ ID NO: 1178185 - RNA, 18 nt, Human
ccaggugcacaagcucca

SEQ ID NO: 1178186 - RNA, 19 nt, Human
ccaggugcuaggaacacuc

SEQ ID NO: 1178187 - RNA, 16 nt, Human
ccaggagcagccacau

SEQ ID NO: 1178188 - RNA, 15 nt, Human
ccaggagccccgagg

SEQ ID NO: 1178189 - RNA, 13 nt, Human
ccaggagccuccu

SEQ ID NO: 1178190 - RNA, 14 nt, Human
ccaggagccuccug

SEQ ID NO: 1178191 - RNA, 18 nt, Human
ccaggagccuccugcccu

SEQ ID NO: 1178192 - RNA, 16 nt, Human
ccaggagccccgaggc

SEQ ID NO: 1178193 - RNA, 19 nt, Human
ccaggagccuccugcccuu

SEQ ID NO: 1178194 - RNA, 12 nt, Human
ccaggaggccag

SEQ ID NO: 1178195 - RNA, 13 nt, Human
ccaggaggccagc

SEQ ID NO: 1178196 - RNA, 14 nt, Human
ccaggaggccagcc

SEQ ID NO: 1178197 - RNA, 13 nt, Human
ccaggcauggugg

SEQ ID NO: 1178198 - RNA, 14 nt, Human
ccaggcauucccca

SEQ ID NO: 1178199 - RNA, 17 nt, Human
ccaggcauuccccagga

SEQ ID NO: 1178200 - RNA, 23 nt, Human
ccaggcauuccccaggaggccag

SEQ ID NO: 1178201 - RNA, 24 nt, Human
ccaggcauuccccaggaggccagc

SEQ ID NO: 1178202 - RNA, 21 nt, Human
ccaggccacaagacccuugug

SEQ ID NO: 1178203 - RNA, 22 nt, Human
ccaggaagccagcaggcucuca

SEQ ID NO: 1178204 - RNA, 16 nt, Human
ccagagcccaccuugg

SEQ ID NO: 1178205 - RNA, 22 nt, Human
ccagagcccaccuuggcucaag

SEQ ID NO: 1178206 - RNA, 19 nt, Human
ccagccuugaccauucucc

SEQ ID NO: 1178207 - RNA, 20 nt, Human
ccagccuugaccauucucca

SEQ ID NO: 1178208 - RNA, 22 nt, Human
ccagccuugaccauucuccacc

SEQ ID NO: 1178209 - RNA, 14 nt, Human
ccagcgagcccugg

SEQ ID NO: 1178210 - RNA, 15 nt, Human
ccagcgagcccuggu

SEQ ID NO: 1178211 - RNA, 16 nt, Human
ccagcgagcccuggug

SEQ ID NO: 1178212 - RNA, 21 nt, Human
ccagcgagcccugguggcagu

SEQ ID NO: 1178213 - RNA, 11 nt, Human
ccagcucuggu

SEQ ID NO: 1178214 - RNA, 12 nt, Human
ccagcucugguc

SEQ ID NO: 1178215 - RNA, 13 nt, Human
ccagcucuggucc

SEQ ID NO: 1178216 - RNA, 14 nt, Human
ccagcucuggucca

SEQ ID NO: 1178217 - RNA, 17 nt, Human
ccagcucugguccauag

SEQ ID NO: 1178218 - RNA, 21 nt, Human
ccagcucugguccauagagag

SEQ ID NO: 1178219 - RNA, 22 nt, Human
ccagcucugguccauagagagc

SEQ ID NO: 1178220 - RNA, 23 nt, Human
ccagcugcuugggcuucauccuc

SEQ ID NO: 1178221 - RNA, 13 nt, Human
ccagcugcuuggg

SEQ ID NO: 1178222 - RNA, 18 nt, Human
ccagugaggcucugcccu

SEQ ID NO: 1178223 - RNA, 19 nt, Human
ccagugaggcucugcccuu

SEQ ID NO: 1178224 - RNA, 20 nt, Human
ccagugaggcucugcccuug

SEQ ID NO: 1178225 - RNA, 13 nt, Human
ccauaugccuggg

SEQ ID NO: 1178226 - RNA, 13 nt, Human
ccaucaccagaca

SEQ ID NO: 1178227 - RNA, 22 nt, Human
ccaucauugaaaucuuuuugcu

SEQ ID NO: 1178228 - RNA, 18 nt, Human
ccauccagguucagcuug

SEQ ID NO: 1178229 - RNA, 12 nt, Human
ccauccucugua

SEQ ID NO: 1178230 - RNA, 19 nt, Human
ccauccucuguacagagcc

SEQ ID NO: 1178231 - RNA, 16 nt, Human
ccaugauguuuagaaa

SEQ ID NO: 1178232 - RNA, 18 nt, Human
ccaugauguuuuccauga

SEQ ID NO: 1178233 - RNA, 19 nt, Human
ccaugauuaaccacuucag

SEQ ID NO: 1178234 - RNA, 21 nt, Human
ccaugauuaaccacuucagcu

SEQ ID NO: 1178235 - RNA, 14 nt, Human
ccaugaagauguag

SEQ ID NO: 1178236 - RNA, 13 nt, Human
ccaugcuccuggc

SEQ ID NO: 1178237 - RNA, 11 nt, Human
ccaugcugccc

SEQ ID NO: 1178238 - RNA, 13 nt, Human
ccaugcugcccug

SEQ ID NO: 1178239 - RNA, 14 nt, Human
ccaugcugcccugu

SEQ ID NO: 1178240 - RNA, 15 nt, Human
ccaugcugcccugug

SEQ ID NO: 1178241 - RNA, 20 nt, Human
ccauccucuguacagagccc

SEQ ID NO: 1178242 - RNA, 18 nt, Human
cccaaaaggcagaagcaa

SEQ ID NO: 1178243 - RNA, 21 nt, Human
ccauuuuguauuuuacuaaua

SEQ ID NO: 1178244 - RNA, 13 nt, Human
cccaaaaggcaga

SEQ ID NO: 1178245 - RNA, 20 nt, Human
ccauuuugggguacccacug

SEQ ID NO: 1178246 - RNA, 22 nt, Human
ccauuuugggguacccacugcu

SEQ ID NO: 1178247 - RNA, 12 nt, Human
cccaaagaugca

SEQ ID NO: 1178248 - RNA, 15 nt, Human
cccaaagaugcagcc

SEQ ID NO: 1178249 - RNA, 16 nt, Human
cccaaagcagugcaug

SEQ ID NO: 1178250 - RNA, 13 nt, Human
ccauggacuuugu

SEQ ID NO: 1178251 - RNA, 14 nt, Human
ccauggacuuuguu

SEQ ID NO: 1178252 - RNA, 15 nt, Human
ccauucuccaccugc

SEQ ID NO: 1178253 - RNA, 16 nt, Human
ccauucuccaccugcc

SEQ ID NO: 1178254 - RNA, 17 nt, Human
ccauucuccaccugcca

SEQ ID NO: 1178255 - RNA, 18 nt, Human
ccauucuccaccugccag

SEQ ID NO: 1178256 - RNA, 17 nt, Human
ccauucugccugcccag

SEQ ID NO: 1178257 - RNA, 18 nt, Human
ccauucugccugcccagg

SEQ ID NO: 1178258 - RNA, 19 nt, Human
ccauucugccugcccaggc

SEQ ID NO: 1178259 - RNA, 20 nt, Human
ccauucugccugcccaggcc

SEQ ID NO: 1178260 - RNA, 21 nt, Human
ccauucugccugcccaggccc

SEQ ID NO: 1178261 - RNA, 21 nt, Human
cccacaaaggagagcuagcag

SEQ ID NO: 1178262 - RNA, 17 nt, Human
cccaggccuccuacagc

SEQ ID NO: 1178263 - RNA, 18 nt, Human
cccaggccuccuacagcu

SEQ ID NO: 1178264 - RNA, 22 nt, Human
cccaggugcuaggaacacuccu

SEQ ID NO: 1178265 - RNA, 23 nt, Human
cccaggugcuaggaacacuccuu

SEQ ID NO: 1178266 - RNA, 13 nt, Human
cccagguuucuau

SEQ ID NO: 1178267 - RNA, 20 nt, Human
cccagucuggaaugcagugg

SEQ ID NO: 1178268 - RNA, 13 nt, Human
cccagugcccaca

SEQ ID NO: 1178269 - RNA, 21 nt, Human
cccaggagccccgaggccuuc

SEQ ID NO: 1178270 - RNA, 13 nt, Human
cccaggaggccag

SEQ ID NO: 1178271 - RNA, 22 nt, Human
cccaggaggccagccuugacca

SEQ ID NO: 1178272 - RNA, 11 nt, Human
cccaggcaggu

SEQ ID NO: 1178273 - RNA, 13 nt, Human
cccaggcaggucu

SEQ ID NO: 1178274 - RNA, 17 nt, Human
cccaggcaggucuugaa

SEQ ID NO: 1178275 - RNA, 20 nt, Human
cccaggcauuccccaggagg

SEQ ID NO: 1178276 - RNA, 21 nt, Human
cccaggcauuccccaggaggc

SEQ ID NO: 1178277 - RNA, 22 nt, Human
cccaggcauuccccaggaggcc

SEQ ID NO: 1178278 - RNA, 23 nt, Human
cccaggcauuccccaggaggcca

SEQ ID NO: 1178279 - RNA, 11 nt, Human
cccaggccccu

SEQ ID NO: 1178280 - RNA, 16 nt, Human
cccaggccccugccac

SEQ ID NO: 1178281 - RNA, 18 nt, Human
cccaggccccugccaccc

SEQ ID NO: 1178282 - RNA, 21 nt, Human
cccaggccccugccacccugg

SEQ ID NO: 1178283 - RNA, 22 nt, Human
cccaggccccugccacccuggg

SEQ ID NO: 1178284 - RNA, 18 nt, Human
cccaagggccuggccuga

SEQ ID NO: 1178285 - RNA, 19 nt, Human
cccaagggccuggccugag

SEQ ID NO: 1178286 - RNA, 23 nt, Human
cccaagggccuggccugagcugg

SEQ ID NO: 1178287 - RNA, 20 nt, Human
cccagagggccugcaaggga

SEQ ID NO: 1178288 - RNA, 20 nt, Human
cccagauugcaacaggcugg

SEQ ID NO: 1178289 - RNA, 21 nt, Human
cccagauugcaacaggcuggg

SEQ ID NO: 1178290 - RNA, 22 nt, Human
cccagauugcaacaggcugggc

SEQ ID NO: 1178291 - RNA, 18 nt, Human
cccagcaagugagagcug

SEQ ID NO: 1178292 - RNA, 19 nt, Human
cccagcaagugagagcugg

SEQ ID NO: 1178293 - RNA, 20 nt, Human
cccagcaagugagagcuggg

SEQ ID NO: 1178294 - RNA, 21 nt, Human
cccagcaagugagagcugggu

SEQ ID NO: 1178295 - RNA, 22 nt, Human
cccagcaagugagagcugggug

SEQ ID NO: 1178296 - RNA, 23 nt, Human
cccagcaagugagagcugggugu

SEQ ID NO: 1178297 - RNA, 23 nt, Human
cccagauugcaacaggcugggcu

SEQ ID NO: 1178298 - RNA, 11 nt, Human
cccagccccuu

SEQ ID NO: 1178299 - RNA, 18 nt, Human
cccagccccuucugaccc

SEQ ID NO: 1178300 - RNA, 12 nt, Human
cccagccugcua

SEQ ID NO: 1178301 - RNA, 17 nt, Human
cccagcgagcccuggug

SEQ ID NO: 1178302 - RNA, 18 nt, Human
cccagcgagcccuggugg

SEQ ID NO: 1178303 - RNA, 19 nt, Human
cccagcgagcccugguggc

SEQ ID NO: 1178304 - RNA, 23 nt, Human
cccagcgagcccugguggcagug

SEQ ID NO: 1178305 - RNA, 14 nt, Human
ccccacccaagggc

SEQ ID NO: 1178306 - RNA, 20 nt, Human
ccccacccaagggccuggcc

SEQ ID NO: 1178307 - RNA, 21 nt, Human
ccccacccaagggccuggccu

SEQ ID NO: 1178308 - RNA, 13 nt, Human
cccauucugccug

SEQ ID NO: 1178309 - RNA, 22 nt, Human
ccccaaauggaaaugggcagag

SEQ ID NO: 1178310 - RNA, 15 nt, Human
cccagugcccacagg

SEQ ID NO: 1178311 - RNA, 20 nt, Human
cccagugcccacaggaucag

SEQ ID NO: 1178312 - RNA, 21 nt, Human
cccagugcccacaggaucagu

SEQ ID NO: 1178313 - RNA, 18 nt, Human
cccagugccgagaaggaa

SEQ ID NO: 1178314 - RNA, 15 nt, Human
cccaugcugcccugu

SEQ ID NO: 1178315 - RNA, 16 nt, Human
cccaugcugcccugug

SEQ ID NO: 1178316 - RNA, 17 nt, Human
cccaugcugcccuguga

SEQ ID NO: 1178317 - RNA, 18 nt, Human
cccaugcugcccugugag

SEQ ID NO: 1178318 - RNA, 17 nt, Human
ccccaggaggccagccu

SEQ ID NO: 1178319 - RNA, 22 nt, Human
ccccucagggucccugguggca

SEQ ID NO: 1178320 - RNA, 14 nt, Human
ccccaggaggccag

SEQ ID NO: 1178321 - RNA, 15 nt, Human
ccccaggaggccagc

SEQ ID NO: 1178322 - RNA, 21 nt, Human
ccccaggaggccagccuugac

SEQ ID NO: 1178323 - RNA, 22 nt, Human
ccccaggaggccagccuugacc

SEQ ID NO: 1178324 - RNA, 12 nt, Human
ccccacugguga

SEQ ID NO: 1178325 - RNA, 13 nt, Human
ccccacuggugac

SEQ ID NO: 1178326 - RNA, 14 nt, Human
ccccacuggugaca

SEQ ID NO: 1178327 - RNA, 12 nt, Human
cccccagcccca

SEQ ID NO: 1178328 - RNA, 11 nt, Human
cccccacacac

SEQ ID NO: 1178329 - RNA, 12 nt, Human
cccccacacaca

SEQ ID NO: 1178330 - RNA, 14 nt, Human
cccccacacacaca

SEQ ID NO: 1178331 - RNA, 19 nt, Human
cccccacacacacacacau

SEQ ID NO: 1178332 - RNA, 21 nt, Human
cccccgcugucagccauuccu

SEQ ID NO: 1178333 - RNA, 21 nt, Human
cccugguggcagugggagcug

SEQ ID NO: 1178334 - RNA, 16 nt, Human
cccugguggcaguggg

SEQ ID NO: 1178335 - RNA, 19 nt, Human
cccugguggcagugggagc

SEQ ID NO: 1178336 - RNA, 17 nt, Human
ccccucagggucccugg

SEQ ID NO: 1178337 - RNA, 18 nt, Human
ccccucagggucccuggu

SEQ ID NO: 1178338 - RNA, 20 nt, Human
ccccucagggucccuggugg

SEQ ID NO: 1178339 - RNA, 21 nt, Human
cccuguagagugggagcugag

SEQ ID NO: 1178340 - RNA, 16 nt, Human
cccugugggcccccaa

SEQ ID NO: 1178341 - RNA, 18 nt, Human
cccugugggcccccaaau

SEQ ID NO: 1178342 - RNA, 15 nt, Human
cccuguuuguuucug

SEQ ID NO: 1178343 - RNA, 16 nt, Human
cccuguuuguuucuga

SEQ ID NO: 1178344 - RNA, 19 nt, Human
cccuuaccucggugccuuc

SEQ ID NO: 1178345 - RNA, 16 nt, Human
cccuugaugaagaagu

SEQ ID NO: 1178346 - RNA, 17 nt, Human
cccuugccgucuaccug

SEQ ID NO: 1178347 - RNA, 18 nt, Human
cccuugccgucuaccuga

SEQ ID NO: 1178348 - RNA, 22 nt, Human
cccuugccgucuaccugagggg

SEQ ID NO: 1178349 - RNA, 20 nt, Human
cccuuugacgccaucccagc

SEQ ID NO: 1178350 - RNA, 18 nt, Human
cccuuggggagcaggcuc

SEQ ID NO: 1178351 - RNA, 14 nt, Human
cccuugugguccca

SEQ ID NO: 1178352 - RNA, 16 nt, Human
cccuuguggucccacc

SEQ ID NO: 1178353 - RNA, 18 nt, Human
cccuuguggucccacccc

SEQ ID NO: 1178354 - RNA, 20 nt, Human
cccuuguggucccaccccac

SEQ ID NO: 1178355 - RNA, 18 nt, Human
ccgagaucacgccacugc

SEQ ID NO: 1178356 - RNA, 11 nt, Human
cccuuuuccuu

SEQ ID NO: 1178357 - RNA, 13 nt, Human
cccuuuucuguuu

SEQ ID NO: 1178358 - RNA, 17 nt, Human
cccuuuuuuggcugcug

SEQ ID NO: 1178359 - RNA, 18 nt, Human
cccuuuuuuggcugcuga

SEQ ID NO: 1178360 - RNA, 19 nt, Human
cccuuuuuuggcugcugaa

SEQ ID NO: 1178361 - RNA, 17 nt, Human
ccgagaaggaagccucc

SEQ ID NO: 1178362 - RNA, 19 nt, Human
ccgagauagccaaggccaa

SEQ ID NO: 1178363 - RNA, 22 nt, Human
ccgagauagccaaggccaaagg

SEQ ID NO: 1178364 - RNA, 12 nt, Human
ccggcuggccug

SEQ ID NO: 1178365 - RNA, 13 nt, Human
ccggcuggccugg

SEQ ID NO: 1178366 - RNA, 15 nt, Human
ccggcuggccuggcc

SEQ ID NO: 1178367 - RNA, 15 nt, Human
ccgggcacucagaag

SEQ ID NO: 1178368 - RNA, 20 nt, Human
ccgggcacucagaagacacu

SEQ ID NO: 1178369 - RNA, 20 nt, Human
ccgggcgcgguggcucacgc

SEQ ID NO: 1178370 - RNA, 14 nt, Human
ccuaaaguguauuu

SEQ ID NO: 1178371 - RNA, 17 nt, Human
ccucacaguccuuacca

SEQ ID NO: 1178372 - RNA, 20 nt, Human
ccucacaguccuuaccagca

SEQ ID NO: 1178373 - RNA, 22 nt, Human
ccucacaguccuuaccagcaga

SEQ ID NO: 1178374 - RNA, 23 nt, Human
ccucacaguccuuaccagcagag

SEQ ID NO: 1178375 - RNA, 12 nt, Human
ccucaccccacu

SEQ ID NO: 1178376 - RNA, 15 nt, Human
ccucaccccacugug

SEQ ID NO: 1178377 - RNA, 17 nt, Human
ccucaccuuucccaucu

SEQ ID NO: 1178378 - RNA, 20 nt, Human
ccucagaaaacaaggaugaa

SEQ ID NO: 1178379 - RNA, 16 nt, Human
ccucagcauccuggca

SEQ ID NO: 1178380 - RNA, 17 nt, Human
ccucagcauccuggcac

SEQ ID NO: 1178381 - RNA, 11 nt, Human
ccucaggccug

SEQ ID NO: 1178382 - RNA, 14 nt, Human
ccucaggccugggg

SEQ ID NO: 1178383 - RNA, 21 nt, Human
ccucaggccugggggcugggc

SEQ ID NO: 1178384 - RNA, 23 nt, Human
ccucaggccugggggcugggcag

SEQ ID NO: 1178385 - RNA, 14 nt, Human
ccucagggucccug

SEQ ID NO: 1178386 - RNA, 15 nt, Human
ccucagggucccugg

SEQ ID NO: 1178387 - RNA, 16 nt, Human
ccucaggugagaagca

SEQ ID NO: 1178388 - RNA, 17 nt, Human
ccucaggugauccaccc

SEQ ID NO: 1178389 - RNA, 19 nt, Human
ccucaggugauccacccac

SEQ ID NO: 1178390 - RNA, 22 nt, Human
ccucaggugauccacccaccuc

SEQ ID NO: 1178391 - RNA, 17 nt, Human
ccucaggugagaagcag

SEQ ID NO: 1178392 - RNA, 19 nt, Human
ccucagucuggcccuuccu

SEQ ID NO: 1178393 - RNA, 15 nt, Human
ccucagucuggcccu

SEQ ID NO: 1178394 - RNA, 13 nt, Human
ccucccucccucu

SEQ ID NO: 1178395 - RNA, 15 nt, Human
ccucccucccucuuu

SEQ ID NO: 1178396 - RNA, 16 nt, Human
ccucccucccucuuuc

SEQ ID NO: 1178397 - RNA, 13 nt, Human
ccuccugccucga

SEQ ID NO: 1178398 - RNA, 13 nt, Human
ccuccugggcuaa

SEQ ID NO: 1178399 - RNA, 13 nt, Human
ccuccugugugug

SEQ ID NO: 1178400 - RNA, 15 nt, Human
ccuccugugugugcg

SEQ ID NO: 1178401 - RNA, 22 nt, Human
ccuccugugugugcgccuacag

SEQ ID NO: 1178402 - RNA, 23 nt, Human
ccuccugugugugcgccuacagg

SEQ ID NO: 1178403 - RNA, 12 nt, Human
ccucucccauca

SEQ ID NO: 1178404 - RNA, 23 nt, Human
ccucugaaaaccaauguucucuc

SEQ ID NO: 1178405 - RNA, 16 nt, Human
ccucugacacacagcu

SEQ ID NO: 1178406 - RNA, 12 nt, Human
ccucugggacug

SEQ ID NO: 1178407 - RNA, 17 nt, Human
ccucugacacacagcuc

SEQ ID NO: 1178408 - RNA, 18 nt, Human
ccucugacacacagcucu

SEQ ID NO: 1178409 - RNA, 15 nt, Human
ccucugcacaagcug

SEQ ID NO: 1178410 - RNA, 17 nt, Human
ccucugcacaagcugca

SEQ ID NO: 1178411 - RNA, 19 nt, Human
ccucugcacaagcugcacc

SEQ ID NO: 1178412 - RNA, 20 nt, Human
ccucugcacaagcugcaccc

SEQ ID NO: 1178413 - RNA, 14 nt, Human
ccucugcacucccc

SEQ ID NO: 1178414 - RNA, 15 nt, Human
ccucugcacuccccu

SEQ ID NO: 1178415 - RNA, 20 nt, Human
ccucugcacuccccugcugg

SEQ ID NO: 1178416 - RNA, 21 nt, Human
ccucugcacuccccugcuggg

SEQ ID NO: 1178417 - RNA, 22 nt, Human
ccucugcacuccccugcugggu

SEQ ID NO: 1178418 - RNA, 23 nt, Human
ccucugcacuccccugcugggug

SEQ ID NO: 1178419 - RNA, 14 nt, Human
ccucuguacagagc

SEQ ID NO: 1178420 - RNA, 15 nt, Human
ccucuguacagagcc

SEQ ID NO: 1178421 - RNA, 16 nt, Human
ccucuguacagagccc

SEQ ID NO: 1178422 - RNA, 17 nt, Human
ccucuguacagagccca

SEQ ID NO: 1178423 - RNA, 18 nt, Human
ccucuguacagagcccac

SEQ ID NO: 1178424 - RNA, 23 nt, Human
ccucuguacagagcccacgcccc

SEQ ID NO: 1178425 - RNA, 14 nt, Human
ccucuuagaaaaac

SEQ ID NO: 1178426 - RNA, 23 nt, Human
ccucuuagaugcaguucugaaga

SEQ ID NO: 1178427 - RNA, 14 nt, Human
ccucuuaugggcug

SEQ ID NO: 1178428 - RNA, 15 nt, Human
ccucuuaugggcugg

SEQ ID NO: 1178429 - RNA, 16 nt, Human
ccucuuaugggcuggg

SEQ ID NO: 1178430 - RNA, 22 nt, Human
ccucuuuggucuacacugugcu

SEQ ID NO: 1178431 - RNA, 17 nt, Human
ccucuuaugggcugggu

SEQ ID NO: 1178432 - RNA, 18 nt, Human
ccugaaagaggaaugaag

SEQ ID NO: 1178433 - RNA, 23 nt, Human
ccugaaagaggaaugaaguacuc

SEQ ID NO: 1178434 - RNA, 14 nt, Human
ccugaaggccccgc

SEQ ID NO: 1178435 - RNA, 19 nt, Human
ccugaagucacacagugag

SEQ ID NO: 1178436 - RNA, 13 nt, Human
ccugaaggccccg

SEQ ID NO: 1178437 - RNA, 15 nt, Human
ccugaagucacacag

SEQ ID NO: 1178438 - RNA, 16 nt, Human
ccugaagucacacagu

SEQ ID NO: 1178439 - RNA, 17 nt, Human
ccugaagucacacagug

SEQ ID NO: 1178440 - RNA, 21 nt, Human
ccugaagacucauucuucugu

SEQ ID NO: 1178441 - RNA, 23 nt, Human
ccugacaacacucauugaccuga

SEQ ID NO: 1178442 - RNA, 12 nt, Human
ccugacaacacu

SEQ ID NO: 1178443 - RNA, 14 nt, Human
ccugacaacacuca

SEQ ID NO: 1178444 - RNA, 15 nt, Human
ccugacaacacucau

SEQ ID NO: 1178445 - RNA, 16 nt, Human
ccugacaacacucauu

SEQ ID NO: 1178446 - RNA, 12 nt, Human
ccugaggcccag

SEQ ID NO: 1178447 - RNA, 13 nt, Human
ccugaggcccaga

SEQ ID NO: 1178448 - RNA, 14 nt, Human
ccugaggcccagag

SEQ ID NO: 1178449 - RNA, 16 nt, Human
ccugaggcccuucucu

SEQ ID NO: 1178450 - RNA, 17 nt, Human
ccugaggcccuucucuc

SEQ ID NO: 1178451 - RNA, 19 nt, Human
ccugaggcccuucucucca

SEQ ID NO: 1178452 - RNA, 20 nt, Human
ccugaggcccuucucuccag

SEQ ID NO: 1178453 - RNA, 21 nt, Human
ccugaggcccuucucuccagc

SEQ ID NO: 1178454 - RNA, 22 nt, Human
ccugaggcccuucucuccagcc

SEQ ID NO: 1178455 - RNA, 23 nt, Human
ccugaggcccuucucuccagccc

SEQ ID NO: 1178456 - RNA, 18 nt, Human
ccugaggcuccacuuggu

SEQ ID NO: 1178457 - RNA, 20 nt, Human
ccugaggcuccacuuggucu

SEQ ID NO: 1178458 - RNA, 14 nt, Human
ccugaugcuucuuc

SEQ ID NO: 1178459 - RNA, 17 nt, Human
ccugaugcuucuucaga

SEQ ID NO: 1178460 - RNA, 18 nt, Human
ccugaugcuucuucagag

SEQ ID NO: 1178461 - RNA, 19 nt, Human
ccugaugcuucuucagaga

SEQ ID NO: 1178462 - RNA, 23 nt, Human
ccugauugugucucuugguccug

SEQ ID NO: 1178463 - RNA, 13 nt, Human
ccugcugguucag

SEQ ID NO: 1178464 - RNA, 19 nt, Human
ccugcugguucaggguugg

SEQ ID NO: 1178465 - RNA, 18 nt, Human
ccugcaacaccuuguuuc

SEQ ID NO: 1178466 - RNA, 19 nt, Human
ccugcaacaccuuguuucc

SEQ ID NO: 1178467 - RNA, 16 nt, Human
ccugcaaccugauugu

SEQ ID NO: 1178468 - RNA, 21 nt, Human
ccugcaaccugauugugucuc

SEQ ID NO: 1178469 - RNA, 23 nt, Human
ccugcgucucauacucaccucac

SEQ ID NO: 1178470 - RNA, 17 nt, Human
ccugcuaauuccccaga

SEQ ID NO: 1178471 - RNA, 12 nt, Human
ccugcuccagcu

SEQ ID NO: 1178472 - RNA, 13 nt, Human
ccugcuccagcug

SEQ ID NO: 1178473 - RNA, 14 nt, Human
ccugcuccagcugu

SEQ ID NO: 1178474 - RNA, 22 nt, Human
ccugcuccagcuguucagcugg

SEQ ID NO: 1178475 - RNA, 20 nt, Human
ccugggaggucaaggcugca

SEQ ID NO: 1178476 - RNA, 16 nt, Human
ccugggaucccucauc

SEQ ID NO: 1178477 - RNA, 20 nt, Human
ccugggaucccucauccuca

SEQ ID NO: 1178478 - RNA, 12 nt, Human
ccugggcagaag

SEQ ID NO: 1178479 - RNA, 14 nt, Human
ccugggcagaagga

SEQ ID NO: 1178480 - RNA, 15 nt, Human
ccugggcagaaggaa

SEQ ID NO: 1178481 - RNA, 14 nt, Human
ccuggccccucagg

SEQ ID NO: 1178482 - RNA, 16 nt, Human
ccuggccccucagggu

SEQ ID NO: 1178483 - RNA, 18 nt, Human
ccuggcaugggaaugaau

SEQ ID NO: 1178484 - RNA, 23 nt, Human
ccuggcaugggaaugaaugucag

SEQ ID NO: 1178485 - RNA, 13 nt, Human
ccuggacccugug

SEQ ID NO: 1178486 - RNA, 14 nt, Human
ccuggacccugugg

SEQ ID NO: 1178487 - RNA, 16 nt, Human
ccuggcaugggaauga

SEQ ID NO: 1178488 - RNA, 17 nt, Human
ccuggcaugggaaugaa

SEQ ID NO: 1178489 - RNA, 21 nt, Human
ccuggcacugcuuccagugag

SEQ ID NO: 1178490 - RNA, 16 nt, Human
ccuggcagccccuguu

SEQ ID NO: 1178491 - RNA, 20 nt, Human
ccuggcacugcuuccaguga

SEQ ID NO: 1178492 - RNA, 12 nt, Human
ccugguggcagc

SEQ ID NO: 1178493 - RNA, 13 nt, Human
ccugguggcagcu

SEQ ID NO: 1178494 - RNA, 14 nt, Human
ccugguggcagcuc

SEQ ID NO: 1178495 - RNA, 16 nt, Human
ccugguggcagcucac

SEQ ID NO: 1178496 - RNA, 17 nt, Human
ccugguggcagcucacc

SEQ ID NO: 1178497 - RNA, 18 nt, Human
ccugguggcagcucaccu

SEQ ID NO: 1178498 - RNA, 19 nt, Human
ccugguggcagcucaccuc

SEQ ID NO: 1178499 - RNA, 20 nt, Human
ccuguaauccuagcacuuug

SEQ ID NO: 1178500 - RNA, 21 nt, Human
ccuguagagugggagcugagu

SEQ ID NO: 1178501 - RNA, 23 nt, Human
ccuguagagugggagcugagugg

SEQ ID NO: 1178502 - RNA, 15 nt, Human
ccugugccucuggga

SEQ ID NO: 1178503 - RNA, 17 nt, Human
ccugugccucugggacu

SEQ ID NO: 1178504 - RNA, 19 nt, Human
ccugugccucugggacugg

SEQ ID NO: 1178505 - RNA, 17 nt, Human
ccugugauggggcccug

SEQ ID NO: 1178506 - RNA, 18 nt, Human
ccugugauggggcccugc

SEQ ID NO: 1178507 - RNA, 19 nt, Human
ccugugauggggcccugcc

SEQ ID NO: 1178508 - RNA, 20 nt, Human
ccugugauggggcccugccu

SEQ ID NO: 1178509 - RNA, 21 nt, Human
ccugugauggggcccugccuc

SEQ ID NO: 1178510 - RNA, 22 nt, Human
ccugugauggggcccugccucc

SEQ ID NO: 1178511 - RNA, 17 nt, Human
ccugucccccugacaac

SEQ ID NO: 1178512 - RNA, 18 nt, Human
ccuguccccgcacugggc

SEQ ID NO: 1178513 - RNA, 20 nt, Human
ccugugaguacuacaguccu

SEQ ID NO: 1178514 - RNA, 16 nt, Human
ccuuagacagucccug

SEQ ID NO: 1178515 - RNA, 17 nt, Human
ccuuagacagucccugc

SEQ ID NO: 1178516 - RNA, 18 nt, Human
ccuuagacagucccugcc

SEQ ID NO: 1178517 - RNA, 19 nt, Human
ccuuagacagucccugcca

SEQ ID NO: 1178518 - RNA, 21 nt, Human
ccuuagacagucccugccaau

SEQ ID NO: 1178519 - RNA, 14 nt, Human
ccuuaccagcagag

SEQ ID NO: 1178520 - RNA, 15 nt, Human
ccuuaccagcagagc

SEQ ID NO: 1178521 - RNA, 16 nt, Human
ccuuaccagcagagca

SEQ ID NO: 1178522 - RNA, 17 nt, Human
ccuuaccagcagagcac

SEQ ID NO: 1178523 - RNA, 20 nt, Human
ccuuaccucggugccuuccu

SEQ ID NO: 1178524 - RNA, 14 nt, Human
ccuuaccugccagg

SEQ ID NO: 1178525 - RNA, 18 nt, Human
ccuuccaggggugggaca

SEQ ID NO: 1178526 - RNA, 22 nt, Human
ccuuccaggggugggacacccu

SEQ ID NO: 1178527 - RNA, 15 nt, Human
ccuuccagggguggg

SEQ ID NO: 1178528 - RNA, 16 nt, Human
ccuuccagggguggga

SEQ ID NO: 1178529 - RNA, 14 nt, Human
ccuuccucuuucca

SEQ ID NO: 1178530 - RNA, 10 nt, Human
ccuucagugc

SEQ ID NO: 1178531 - RNA, 13 nt, Human
ccuucagugccuu

SEQ ID NO: 1178532 - RNA, 14 nt, Human
ccuucagugccuua

SEQ ID NO: 1178533 - RNA, 15 nt, Human
ccuucagugccuuau

SEQ ID NO: 1178534 - RNA, 20 nt, Human
ccuucagugccuuauggaac

SEQ ID NO: 1178535 - RNA, 19 nt, Human
ccuucagugccuuauggaa

SEQ ID NO: 1178536 - RNA, 15 nt, Human
ccuugaaaacacugu

SEQ ID NO: 1178537 - RNA, 13 nt, Human
ccuucgcuccugu

SEQ ID NO: 1178538 - RNA, 14 nt, Human
ccuucgcuccugug

SEQ ID NO: 1178539 - RNA, 15 nt, Human
ccuucgcuccugugu

SEQ ID NO: 1178540 - RNA, 18 nt, Human
ccuucgcuccugugucuu

SEQ ID NO: 1178541 - RNA, 19 nt, Human
ccuugaaaacacuguucuc

SEQ ID NO: 1178542 - RNA, 21 nt, Human
ccuugaaaacacuguucucug

SEQ ID NO: 1178543 - RNA, 22 nt, Human
ccuugaaaacacuguucucugc

SEQ ID NO: 1178544 - RNA, 14 nt, Human
ccuugaacugggua

SEQ ID NO: 1178545 - RNA, 16 nt, Human
ccuugaacuggguacu

SEQ ID NO: 1178546 - RNA, 17 nt, Human
ccuugaacuuugaccuc

SEQ ID NO: 1178547 - RNA, 20 nt, Human
ccuugaaaacuuuaugcuaa

SEQ ID NO: 1178548 - RNA, 19 nt, Human
ccuugaacuuugaccucug

SEQ ID NO: 1178549 - RNA, 14 nt, Human
ccuugacagggcac

SEQ ID NO: 1178550 - RNA, 15 nt, Human
ccuugacagggcaca

SEQ ID NO: 1178551 - RNA, 17 nt, Human
ccuugacagggcacacc

SEQ ID NO: 1178552 - RNA, 19 nt, Human
ccuugaccauucuccaccu

SEQ ID NO: 1178553 - RNA, 20 nt, Human
ccuugaccauucuccaccug

SEQ ID NO: 1178554 - RNA, 21 nt, Human
ccuugaccauucuccaccugc

SEQ ID NO: 1178555 - RNA, 22 nt, Human
ccuugaccauucuccaccugcc

SEQ ID NO: 1178556 - RNA, 22 nt, Human
ccuugaguugauucagcucugc

SEQ ID NO: 1178557 - RNA, 23 nt, Human
ccuugaguugauucagcucugca

SEQ ID NO: 1178558 - RNA, 14 nt, Human
ccuugaugaagaag

SEQ ID NO: 1178559 - RNA, 13 nt, Human
ccuugacagggca

SEQ ID NO: 1178560 - RNA, 11 nt, Human
ccuuuggcuuc

SEQ ID NO: 1178561 - RNA, 15 nt, Human
cgcccccacugguga

SEQ ID NO: 1178562 - RNA, 13 nt, Human
cgcagacaggacc

SEQ ID NO: 1178563 - RNA, 14 nt, Human
cgcagacaggacca

SEQ ID NO: 1178564 - RNA, 16 nt, Human
cgcgacaaugcaaacc

SEQ ID NO: 1178565 - RNA, 17 nt, Human
cgcgacaaugcaaacca

SEQ ID NO: 1178566 - RNA, 16 nt, Human
cgcgugcacacaccag

SEQ ID NO: 1178567 - RNA, 19 nt, Human
cgcgugcacacaccagagc

SEQ ID NO: 1178568 - RNA, 20 nt, Human
cgcgugcacacaccagagcc

SEQ ID NO: 1178569 - RNA, 14 nt, Human
cgcuaagagggagg

SEQ ID NO: 1178570 - RNA, 15 nt, Human
cgcuaagagggaggg

SEQ ID NO: 1178571 - RNA, 16 nt, Human
cgcuaagagggaggga

SEQ ID NO: 1178572 - RNA, 21 nt, Human
cgcuaagagggagggagggcu

SEQ ID NO: 1178573 - RNA, 12 nt, Human
ccuuggcugcag

SEQ ID NO: 1178574 - RNA, 13 nt, Human
ccuuggcugcagg

SEQ ID NO: 1178575 - RNA, 19 nt, Human
ccuuguggucccaccccac

SEQ ID NO: 1178576 - RNA, 20 nt, Human
ccuuguggucccaccccaca

SEQ ID NO: 1178577 - RNA, 14 nt, Human
ccuuggcugcaggg

SEQ ID NO: 1178578 - RNA, 13 nt, Human
ccuuuaagagaaa

SEQ ID NO: 1178579 - RNA, 14 nt, Human
ccuuuaagagaaau

SEQ ID NO: 1178580 - RNA, 15 nt, Human
ccuuuguauucucuc

SEQ ID NO: 1178581 - RNA, 18 nt, Human
ccuuuguauucucuccug

SEQ ID NO: 1178582 - RNA, 20 nt, Human
ccuuuguauucucuccugua

SEQ ID NO: 1178583 - RNA, 12 nt, Human
cgaggacaggga

SEQ ID NO: 1178584 - RNA, 13 nt, Human
cgaggacagggag

SEQ ID NO: 1178585 - RNA, 14 nt, Human
cgaggacagggagg

SEQ ID NO: 1178586 - RNA, 18 nt, Human
cgaggccuucucugaagg

SEQ ID NO: 1178587 - RNA, 19 nt, Human
cgaggccuucucugaagga

SEQ ID NO: 1178588 - RNA, 19 nt, Human
cgaucuggguucacugcaa

SEQ ID NO: 1178589 - RNA, 13 nt, Human
cgauucuucugcu

SEQ ID NO: 1178590 - RNA, 19 nt, Human
cgauucuucugcuucagcc

SEQ ID NO: 1178591 - RNA, 21 nt, Human
cgauucuucugcuucagccuc

SEQ ID NO: 1178592 - RNA, 12 nt, Human
cgauuucuguuu

SEQ ID NO: 1178593 - RNA, 20 nt, Human
cgauuucuguuuagauaaua

SEQ ID NO: 1178594 - RNA, 11 nt, Human
cgcaaugugac

SEQ ID NO: 1178595 - RNA, 20 nt, Human
cggacagccacggccaggcc

SEQ ID NO: 1178596 - RNA, 13 nt, Human
cgcuccugugucu

SEQ ID NO: 1178597 - RNA, 17 nt, Human
cggaaagcccugugcuc

SEQ ID NO: 1178598 - RNA, 20 nt, Human
cggaaugaaccacaucuugc

SEQ ID NO: 1178599 - RNA, 15 nt, Human
cggacagccacggcc

SEQ ID NO: 1178600 - RNA, 16 nt, Human
cggacagccacggcca

SEQ ID NO: 1178601 - RNA, 18 nt, Human
cggacagccacggccagg

SEQ ID NO: 1178602 - RNA, 14 nt, Human
cgcucucuggccuu

SEQ ID NO: 1178603 - RNA, 20 nt, Human
cgggaggauguucugggaca

SEQ ID NO: 1178604 - RNA, 21 nt, Human
cgggaggauguucugggacac

SEQ ID NO: 1178605 - RNA, 16 nt, Human
cgggaggucgaggcag

SEQ ID NO: 1178606 - RNA, 17 nt, Human
cgggaggucgaggcagg

SEQ ID NO: 1178607 - RNA, 12 nt, Human
cgggcaugacac

SEQ ID NO: 1178608 - RNA, 15 nt, Human
cgggcaugacacgaa

SEQ ID NO: 1178609 - RNA, 16 nt, Human
cggccuccauccugag

SEQ ID NO: 1178610 - RNA, 17 nt, Human
cggccuccauccugagg

SEQ ID NO: 1178611 - RNA, 15 nt, Human
cggccuuuggcuuca

SEQ ID NO: 1178612 - RNA, 15 nt, Human
cggcuggccuggccc

SEQ ID NO: 1178613 - RNA, 16 nt, Human
cggcuggccuggcccc

SEQ ID NO: 1178614 - RNA, 18 nt, Human
cggcuggccuggccccuc

SEQ ID NO: 1178615 - RNA, 19 nt, Human
cggcuggccuggccccuca

SEQ ID NO: 1178616 - RNA, 23 nt, Human
cggugcuaucucccccagcccca

SEQ ID NO: 1178617 - RNA, 11 nt, Human
cguccccuguc

SEQ ID NO: 1178618 - RNA, 14 nt, Human
cguccccugucccc

SEQ ID NO: 1178619 - RNA, 14 nt, Human
cgucuaccugaggg

SEQ ID NO: 1178620 - RNA, 16 nt, Human
cgucuaccugaggggc

SEQ ID NO: 1178621 - RNA, 13 nt, Human
cgucugacaggca

SEQ ID NO: 1178622 - RNA, 14 nt, Human
cgucugacaggcaa

SEQ ID NO: 1178623 - RNA, 12 nt, Human
cgugacaacacu

SEQ ID NO: 1178624 - RNA, 21 nt, Human
cgugcacacaccagagcccac

SEQ ID NO: 1178625 - RNA, 22 nt, Human
cgugcacacaccagagcccacc

SEQ ID NO: 1178626 - RNA, 14 nt, Human
cgugcauaccacuu

SEQ ID NO: 1178627 - RNA, 18 nt, Human
cgugcauaccacuuuugu

SEQ ID NO: 1178628 - RNA, 19 nt, Human
cgugcauaccacuuuuguu

SEQ ID NO: 1178629 - RNA, 23 nt, Human
cgugcauaccacuuuuguucuug

SEQ ID NO: 1178630 - RNA, 12 nt, Human
cguggcugcuuc

SEQ ID NO: 1178631 - RNA, 14 nt, Human
cguggcugcuucaa

SEQ ID NO: 1178632 - RNA, 15 nt, Human
cguggcugcuucaag

SEQ ID NO: 1178633 - RNA, 17 nt, Human
cguggcugcuucaagga

SEQ ID NO: 1178634 - RNA, 19 nt, Human
cguuucuaaaggcuaccuu

SEQ ID NO: 1178635 - RNA, 21 nt, Human
cguuucuaaaggcuaccuuug

SEQ ID NO: 1178636 - RNA, 20 nt, Human
cguuucuaugacacaugcaa

SEQ ID NO: 1178637 - RNA, 14 nt, Human
cucagggucccugg

SEQ ID NO: 1178638 - RNA, 23 nt, Human
cucagguggggucacucuggcag

SEQ ID NO: 1178639 - RNA, 15 nt, Human
cucaggugucccugc

SEQ ID NO: 1178640 - RNA, 16 nt, Human
cucaggugucccugca

SEQ ID NO: 1178641 - RNA, 23 nt, Human
cuaaaagguaugcaaucaaaucu

SEQ ID NO: 1178642 - RNA, 12 nt, Human
cucagggucccu

SEQ ID NO: 1178643 - RNA, 17 nt, Human
cucaggugucccugcac

SEQ ID NO: 1178644 - RNA, 18 nt, Human
cucaggugucccugcacu

SEQ ID NO: 1178645 - RNA, 19 nt, Human
cucaggugucccugcacuu

SEQ ID NO: 1178646 - RNA, 14 nt, Human
cucaggugagaagc

SEQ ID NO: 1178647 - RNA, 15 nt, Human
cucauacccaccccc

SEQ ID NO: 1178648 - RNA, 18 nt, Human
cucauaguaugguggcug

SEQ ID NO: 1178649 - RNA, 19 nt, Human
cucauaguaugguggcugg

SEQ ID NO: 1178650 - RNA, 20 nt, Human
cucauaguaugguggcuggg

SEQ ID NO: 1178651 - RNA, 13 nt, Human
cucauucuucugu

SEQ ID NO: 1178652 - RNA, 14 nt, Human
cucauucuucugua

SEQ ID NO: 1178653 - RNA, 23 nt, Human
cucauucuucuguacgucugaca

SEQ ID NO: 1178654 - RNA, 13 nt, Human
cucauugaccuga

SEQ ID NO: 1178655 - RNA, 15 nt, Human
cucauugaccugagg

SEQ ID NO: 1178656 - RNA, 16 nt, Human
cucauugaccugaggc

SEQ ID NO: 1178657 - RNA, 17 nt, Human
cucauugaccugaggcc

SEQ ID NO: 1178658 - RNA, 21 nt, Human
cucauuagcauuuugcuaaau

SEQ ID NO: 1178659 - RNA, 17 nt, Human
cucauuaggauggcuag

SEQ ID NO: 1178660 - RNA, 18 nt, Human
cucauuaggauggcuagu

SEQ ID NO: 1178661 - RNA, 20 nt, Human
cuccagcucaccagccccag

SEQ ID NO: 1178662 - RNA, 11 nt, Human
cuccacccugc

SEQ ID NO: 1178663 - RNA, 12 nt, Human
cuccacccugcu

SEQ ID NO: 1178664 - RNA, 17 nt, Human
cuccaccugccagggac

SEQ ID NO: 1178665 - RNA, 18 nt, Human
cuccaccugccagggaca

SEQ ID NO: 1178666 - RNA, 21 nt, Human
cuccaccugccagggacagag

SEQ ID NO: 1178667 - RNA, 23 nt, Human
cuccauccugaggcuccacuugg

SEQ ID NO: 1178668 - RNA, 11 nt, Human
cuccaggcucc

SEQ ID NO: 1178669 - RNA, 15 nt, Human
cuccaggcuccuuua

SEQ ID NO: 1178670 - RNA, 21 nt, Human
cuccauccugaggcuccacuu

SEQ ID NO: 1178671 - RNA, 13 nt, Human
cuccagcuguuca

SEQ ID NO: 1178672 - RNA, 18 nt, Human
cuccagcuguucagcugg

SEQ ID NO: 1178673 - RNA, 19 nt, Human
cuccagcuguucagcuggu

SEQ ID NO: 1178674 - RNA, 21 nt, Human
cucccaaggggcccaaauucu

SEQ ID NO: 1178675 - RNA, 22 nt, Human
cucccaaggggcccaaauucuu

SEQ ID NO: 1178676 - RNA, 22 nt, Human
cucccaggcauuccccaggagg

SEQ ID NO: 1178677 - RNA, 17 nt, Human
cucccaggcauucccca

SEQ ID NO: 1178678 - RNA, 19 nt, Human
cucccaggcauuccccagg

SEQ ID NO: 1178679 - RNA, 20 nt, Human
cucccaggcauuccccagga

SEQ ID NO: 1178680 - RNA, 21 nt, Human
cucccaggcauuccccaggag

SEQ ID NO: 1178681 - RNA, 14 nt, Human
cucccaucacccgc

SEQ ID NO: 1178682 - RNA, 14 nt, Human
cucccaucucacac

SEQ ID NO: 1178683 - RNA, 15 nt, Human
cucccaucucacaca

SEQ ID NO: 1178684 - RNA, 18 nt, Human
cucccaucucacacauga

SEQ ID NO: 1178685 - RNA, 21 nt, Human
cucccaucucacacaugagca

SEQ ID NO: 1178686 - RNA, 10 nt, Human
cucccuuccu

SEQ ID NO: 1178687 - RNA, 13 nt, Human
cucccuuccucuu

SEQ ID NO: 1178688 - RNA, 14 nt, Human
cucccuuccucuuu

SEQ ID NO: 1178689 - RNA, 16 nt, Human
cucccuucucuucaca

SEQ ID NO: 1178690 - RNA, 17 nt, Human
cucccuuggauuguccc

SEQ ID NO: 1178691 - RNA, 20 nt, Human
cucccuuggauuguccccga

SEQ ID NO: 1178692 - RNA, 13 nt, Human
cucccuuucaaca

SEQ ID NO: 1178693 - RNA, 17 nt, Human
cucccuuucuucccuac

SEQ ID NO: 1178694 - RNA, 12 nt, Human
cuccucagaucu

SEQ ID NO: 1178695 - RNA, 14 nt, Human
cuccucagaucuuc

SEQ ID NO: 1178696 - RNA, 13 nt, Human
cuccugcaggcag

SEQ ID NO: 1178697 - RNA, 14 nt, Human
cuccugcaggcagc

SEQ ID NO: 1178698 - RNA, 23 nt, Human
cuccugugucuugcaauggcagc

SEQ ID NO: 1178699 - RNA, 11 nt, Human
cuccugugugu

SEQ ID NO: 1178700 - RNA, 15 nt, Human
cuccugcaggcagcc

SEQ ID NO: 1178701 - RNA, 22 nt, Human
cuccugcaggcagccaggccac

SEQ ID NO: 1178702 - RNA, 16 nt, Human
cuccugcaggcagcca

SEQ ID NO: 1178703 - RNA, 14 nt, Human
cuccugugugugcg

SEQ ID NO: 1178704 - RNA, 14 nt, Human
cuccuucaccuuug

SEQ ID NO: 1178705 - RNA, 16 nt, Human
cuccuucaccuuuguc

SEQ ID NO: 1178706 - RNA, 19 nt, Human
cuccuucaccuuugucccc

SEQ ID NO: 1178707 - RNA, 21 nt, Human
cuccuucaccuuuguccccac

SEQ ID NO: 1178708 - RNA, 14 nt, Human
cuccuucuguccua

SEQ ID NO: 1178709 - RNA, 15 nt, Human
cuccuucuguccuac

SEQ ID NO: 1178710 - RNA, 20 nt, Human
cuccuucuguccuacucugu

SEQ ID NO: 1178711 - RNA, 11 nt, Human
cuccuucuucc

SEQ ID NO: 1178712 - RNA, 21 nt, Human
cuccuugaaaacacuguucuc

SEQ ID NO: 1178713 - RNA, 15 nt, Human
cucgcgacaaugcaa

SEQ ID NO: 1178714 - RNA, 16 nt, Human
cucgaguuacagacaa

SEQ ID NO: 1178715 - RNA, 20 nt, Human
cucgaguuacagacaaagcg

SEQ ID NO: 1178716 - RNA, 23 nt, Human
cucucaggccagcugcuugggcu

SEQ ID NO: 1178717 - RNA, 12 nt, Human
cucuccagcccc

SEQ ID NO: 1178718 - RNA, 13 nt, Human
cucuccagccccu

SEQ ID NO: 1178719 - RNA, 13 nt, Human
cucucccaucacu

SEQ ID NO: 1178720 - RNA, 14 nt, Human
cucucccaucacuu

SEQ ID NO: 1178721 - RNA, 18 nt, Human
cucucccaucacuucccu

SEQ ID NO: 1178722 - RNA, 20 nt, Human
cucucccaucacuucccuac

SEQ ID NO: 1178723 - RNA, 13 nt, Human
cucuccccagcaa

SEQ ID NO: 1178724 - RNA, 13 nt, Human
cucuccuguaccu

SEQ ID NO: 1178725 - RNA, 14 nt, Human
cucuccuguaccuc

SEQ ID NO: 1178726 - RNA, 15 nt, Human
cucuccuguaccucu

SEQ ID NO: 1178727 - RNA, 17 nt, Human
cucuccuguaccucuug

SEQ ID NO: 1178728 - RNA, 18 nt, Human
cucuccuguaccucuuga

SEQ ID NO: 1178729 - RNA, 22 nt, Human
cucuccuguaccucuugagccu

SEQ ID NO: 1178730 - RNA, 15 nt, Human
cucucucacuccuug

SEQ ID NO: 1178731 - RNA, 16 nt, Human
cucucucacuccuuga

SEQ ID NO: 1178732 - RNA, 12 nt, Human
cucucucaggcc

SEQ ID NO: 1178733 - RNA, 13 nt, Human
cucucucaggcca

SEQ ID NO: 1178734 - RNA, 20 nt, Human
cucugagacucgcgacaaug

SEQ ID NO: 1178735 - RNA, 22 nt, Human
cucugcaagaauugaagcagga

SEQ ID NO: 1178736 - RNA, 10 nt, Human
cucugcacaa

SEQ ID NO: 1178737 - RNA, 23 nt, Human
cucugcauacucauuaggauggc

SEQ ID NO: 1178738 - RNA, 12 nt, Human
cucugcccuugg

SEQ ID NO: 1178739 - RNA, 14 nt, Human
cucugcccuccaag

SEQ ID NO: 1178740 - RNA, 15 nt, Human
cucugcccuccaaga

SEQ ID NO: 1178741 - RNA, 16 nt, Human
cucugcccuccaagac

SEQ ID NO: 1178742 - RNA, 23 nt, Human
cucugcccuccaagaccuucucc

SEQ ID NO: 1178743 - RNA, 14 nt, Human
cucugccucugaca

SEQ ID NO: 1178744 - RNA, 16 nt, Human
cucugccucugacaca

SEQ ID NO: 1178745 - RNA, 14 nt, Human
cucuggacaggcau

SEQ ID NO: 1178746 - RNA, 19 nt, Human
cucuggcagcucagagagg

SEQ ID NO: 1178747 - RNA, 20 nt, Human
cucuggcagcucagagaggg

SEQ ID NO: 1178748 - RNA, 17 nt, Human
cucuggcagcucagaga

SEQ ID NO: 1178749 - RNA, 18 nt, Human
cucuggcagcucagagag

SEQ ID NO: 1178750 - RNA, 13 nt, Human
cucuuaagaagac

SEQ ID NO: 1178751 - RNA, 24 nt, Human
cucuuaaaacccaagugccuuagc

SEQ ID NO: 1178752 - RNA, 13 nt, Human
cucuucuccaggc

SEQ ID NO: 1178753 - RNA, 12 nt, Human
cucuucuccagg

SEQ ID NO: 1178754 - RNA, 22 nt, Human
cucuuccaggcugggagagccu

SEQ ID NO: 1178755 - RNA, 23 nt, Human
cucuuccaggcugggagagccuu

SEQ ID NO: 1178756 - RNA, 13 nt, Human
cucuugaccucag

SEQ ID NO: 1178757 - RNA, 15 nt, Human
cucuugaccucaggu

SEQ ID NO: 1178758 - RNA, 16 nt, Human
cucuugaccucaggug

SEQ ID NO: 1178759 - RNA, 13 nt, Human
cucuugagccugg

SEQ ID NO: 1178760 - RNA, 18 nt, Human
cucuugguccugcugcag

SEQ ID NO: 1178761 - RNA, 19 nt, Human
cucuugguccugcugcagu

SEQ ID NO: 1178762 - RNA, 17 nt, Human
cucuuuccaucuacccu

SEQ ID NO: 1178763 - RNA, 13 nt, Human
cucuuucccuccc

SEQ ID NO: 1178764 - RNA, 15 nt, Human
cucuuuggacacuca

SEQ ID NO: 1178765 - RNA, 18 nt, Human
cucuuuggacacucacac

SEQ ID NO: 1178766 - RNA, 16 nt, Human
cugaagucacacagug

SEQ ID NO: 1178767 - RNA, 15 nt, Human
cugaagucacacagu

SEQ ID NO: 1178768 - RNA, 14 nt, Human
cugaagucacacag

SEQ ID NO: 1178769 - RNA, 16 nt, Human
cugaauacagaggcaa

SEQ ID NO: 1178770 - RNA, 18 nt, Human
cucuuugggccuggcucc

SEQ ID NO: 1178771 - RNA, 19 nt, Human
cucuuuggucuacacugug

SEQ ID NO: 1178772 - RNA, 21 nt, Human
cucuuuggucuacacugugcu

SEQ ID NO: 1178773 - RNA, 21 nt, Human
cugaaccuggguaacuaggga

SEQ ID NO: 1178774 - RNA, 15 nt, Human
cugaacuuggcgcug

SEQ ID NO: 1178775 - RNA, 16 nt, Human
cugaacuuggcgcugc

SEQ ID NO: 1178776 - RNA, 21 nt, Human
cugaacuuggcgcugccccug

SEQ ID NO: 1178777 - RNA, 21 nt, Human
cugaagacucauucuucugua

SEQ ID NO: 1178778 - RNA, 21 nt, Human
cugacagacacaggcccggcu

SEQ ID NO: 1178779 - RNA, 11 nt, Human
cugacaggcaa

SEQ ID NO: 1178780 - RNA, 17 nt, Human
cugaaugaaacccccac

SEQ ID NO: 1178781 - RNA, 18 nt, Human
cugaaugaaacccccaca

SEQ ID NO: 1178782 - RNA, 19 nt, Human
cugaaugaaacccccacac

SEQ ID NO: 1178783 - RNA, 20 nt, Human
cugaaugaaacccccacaca

SEQ ID NO: 1178784 - RNA, 21 nt, Human
cugaaugaaacccccacacac

SEQ ID NO: 1178785 - RNA, 22 nt, Human
cugaaugaaacccccacacaca

SEQ ID NO: 1178786 - RNA, 23 nt, Human
cugaaugaaacccccacacacac

SEQ ID NO: 1178787 - RNA, 21 nt, Human
cugacauuguuggccaaagcc

SEQ ID NO: 1178788 - RNA, 11 nt, Human
cugacccacug

SEQ ID NO: 1178789 - RNA, 16 nt, Human
cugacaggcaaugcug

SEQ ID NO: 1178790 - RNA, 17 nt, Human
cugacaggcaaugcugg

SEQ ID NO: 1178791 - RNA, 18 nt, Human
cugacaggcaaugcuggc

SEQ ID NO: 1178792 - RNA, 19 nt, Human
cugacaggcaaugcuggcu

SEQ ID NO: 1178793 - RNA, 20 nt, Human
cugacaggcaaugcuggcug

SEQ ID NO: 1178794 - RNA, 21 nt, Human
cugacaggcaaugcuggcugu

SEQ ID NO: 1178795 - RNA, 17 nt, Human
cugacauuguuggccaa

SEQ ID NO: 1178796 - RNA, 17 nt, Human
cugagucugaaggcugg

SEQ ID NO: 1178797 - RNA, 13 nt, Human
cugagucugaagg

SEQ ID NO: 1178798 - RNA, 14 nt, Human
cugagucugaaggc

SEQ ID NO: 1178799 - RNA, 15 nt, Human
cugagucugaaggcu

SEQ ID NO: 1178800 - RNA, 16 nt, Human
cugagucugaaggcug

SEQ ID NO: 1178801 - RNA, 22 nt, Human
cugagugggggaucacagccuc

SEQ ID NO: 1178802 - RNA, 13 nt, Human
cugauaaagauga

SEQ ID NO: 1178803 - RNA, 12 nt, Human
cugacccacugc

SEQ ID NO: 1178804 - RNA, 13 nt, Human
cugacccaugcug

SEQ ID NO: 1178805 - RNA, 15 nt, Human
cugauucccaagcuc

SEQ ID NO: 1178806 - RNA, 17 nt, Human
cugauucccaagcucug

SEQ ID NO: 1178807 - RNA, 18 nt, Human
cugauucccaagcucugc

SEQ ID NO: 1178808 - RNA, 19 nt, Human
cugauucccaagcucugcu

SEQ ID NO: 1178809 - RNA, 20 nt, Human
cugauucccaagcucugcuc

SEQ ID NO: 1178810 - RNA, 22 nt, Human
cugauucccaagcucugcuccu

SEQ ID NO: 1178811 - RNA, 21 nt, Human
cugauaaagaugagugagcau

SEQ ID NO: 1178812 - RNA, 14 nt, Human
cugaucucucguga

SEQ ID NO: 1178813 - RNA, 18 nt, Human
cugcacaagcugcacccu

SEQ ID NO: 1178814 - RNA, 13 nt, Human
cugcacaagcugc

SEQ ID NO: 1178815 - RNA, 14 nt, Human
cugcacaagcugca

SEQ ID NO: 1178816 - RNA, 15 nt, Human
cugcacaagcugcac

SEQ ID NO: 1178817 - RNA, 16 nt, Human
cugcacaagcugcacc

SEQ ID NO: 1178818 - RNA, 17 nt, Human
cugcacccucaggcagg

SEQ ID NO: 1178819 - RNA, 18 nt, Human
cugcacccucaggcaggu

SEQ ID NO: 1178820 - RNA, 13 nt, Human
cugcagaagacag

SEQ ID NO: 1178821 - RNA, 23 nt, Human
cugcagaagacaguauggcagcu

SEQ ID NO: 1178822 - RNA, 17 nt, Human
cugcaccggcuggccug

SEQ ID NO: 1178823 - RNA, 18 nt, Human
cugcaccggcuggccugg

SEQ ID NO: 1178824 - RNA, 19 nt, Human
cugcaccggcuggccuggc

SEQ ID NO: 1178825 - RNA, 20 nt, Human
cugcaccggcuggccuggcc

SEQ ID NO: 1178826 - RNA, 14 nt, Human
cugcacuugcagac

SEQ ID NO: 1178827 - RNA, 16 nt, Human
cugcacuugcagacuc

SEQ ID NO: 1178828 - RNA, 17 nt, Human
cugcacuugcagacucu

SEQ ID NO: 1178829 - RNA, 22 nt, Human
cugcagggaguccgaaagggac

SEQ ID NO: 1178830 - RNA, 19 nt, Human
cugcagccucaaccuccug

SEQ ID NO: 1178831 - RNA, 20 nt, Human
cugcagccucaaccuccugg

SEQ ID NO: 1178832 - RNA, 22 nt, Human
cugcagccucaaccuccugggc

SEQ ID NO: 1178833 - RNA, 23 nt, Human
cugcagccucaaccuccugggcu

SEQ ID NO: 1178834 - RNA, 11 nt, Human
cugcagccuca

SEQ ID NO: 1178835 - RNA, 15 nt, Human
cugccacccugggga

SEQ ID NO: 1178836 - RNA, 16 nt, Human
cugccacccuggggag

SEQ ID NO: 1178837 - RNA, 20 nt, Human
cugccacccuggggagaaag

SEQ ID NO: 1178838 - RNA, 19 nt, Human
cugccagccgagauagcca

SEQ ID NO: 1178839 - RNA, 15 nt, Human
cugccaggaagccag

SEQ ID NO: 1178840 - RNA, 16 nt, Human
cugccaggaagccagc

SEQ ID NO: 1178841 - RNA, 18 nt, Human
cugccaggaagccagcag

SEQ ID NO: 1178842 - RNA, 19 nt, Human
cugccaggaagccagcagg

SEQ ID NO: 1178843 - RNA, 17 nt, Human
cugccaugccagcuuau

SEQ ID NO: 1178844 - RNA, 19 nt, Human
cugccaugccagcuuaucu

SEQ ID NO: 1178845 - RNA, 13 nt, Human
cugcccaggcccc

SEQ ID NO: 1178846 - RNA, 14 nt, Human
cugccccuggcagc

SEQ ID NO: 1178847 - RNA, 15 nt, Human
cugccccuggcagcc

SEQ ID NO: 1178848 - RNA, 16 nt, Human
cugccccuggcagccc

SEQ ID NO: 1178849 - RNA, 17 nt, Human
cugccccuggcagcccc

SEQ ID NO: 1178850 - RNA, 11 nt, Human
cugcccggcug

SEQ ID NO: 1178851 - RNA, 15 nt, Human
cugcccggcugcgga

SEQ ID NO: 1178852 - RNA, 13 nt, Human
cugcccugcccac

SEQ ID NO: 1178853 - RNA, 14 nt, Human
cugcccugcccacc

SEQ ID NO: 1178854 - RNA, 15 nt, Human
cugcccugcccaccu

SEQ ID NO: 1178855 - RNA, 16 nt, Human
cugcccugcccaccug

SEQ ID NO: 1178856 - RNA, 17 nt, Human
cugcccugcccaccugg

SEQ ID NO: 1178857 - RNA, 15 nt, Human
cugccuaagugcagc

SEQ ID NO: 1178858 - RNA, 13 nt, Human
cugccucagccuc

SEQ ID NO: 1178859 - RNA, 14 nt, Human
cugccucagccucc

SEQ ID NO: 1178860 - RNA, 13 nt, Human
cugccucuucucu

SEQ ID NO: 1178861 - RNA, 14 nt, Human
cugccucuucucua

SEQ ID NO: 1178862 - RNA, 13 nt, Human
cugccugcccagg

SEQ ID NO: 1178863 - RNA, 14 nt, Human
cugccugcccaggc

SEQ ID NO: 1178864 - RNA, 15 nt, Human
cugccugcccaggcc

SEQ ID NO: 1178865 - RNA, 20 nt, Human
cugcggaaugaaccacaucu

SEQ ID NO: 1178866 - RNA, 21 nt, Human
cugcggaaugaaccacaucuu

SEQ ID NO: 1178867 - RNA, 15 nt, Human
cugcgguccacccag

SEQ ID NO: 1178868 - RNA, 16 nt, Human
cugcgguccacccagg

SEQ ID NO: 1178869 - RNA, 17 nt, Human
cugcgguccacccagga

SEQ ID NO: 1178870 - RNA, 14 nt, Human
cugcuccagcuguu

SEQ ID NO: 1178871 - RNA, 15 nt, Human
cugcuccagcuguuc

SEQ ID NO: 1178872 - RNA, 16 nt, Human
cugcuccucuccccag

SEQ ID NO: 1178873 - RNA, 17 nt, Human
cugcuccucuccccagc

SEQ ID NO: 1178874 - RNA, 18 nt, Human
cugcuccucuccccagca

SEQ ID NO: 1178875 - RNA, 23 nt, Human
cuggaauaauccuaaacauauga

SEQ ID NO: 1178876 - RNA, 15 nt, Human
cuggaagcacagcuu

SEQ ID NO: 1178877 - RNA, 18 nt, Human
cuggaagcacagcuucau

SEQ ID NO: 1178878 - RNA, 15 nt, Human
cuggaaugcaguggu

SEQ ID NO: 1178879 - RNA, 14 nt, Human
cuggacaggcaugu

SEQ ID NO: 1178880 - RNA, 12 nt, Human
cuggagcucugc

SEQ ID NO: 1178881 - RNA, 15 nt, Human
cuggauggggcugca

SEQ ID NO: 1178882 - RNA, 16 nt, Human
cuggauggggcugcac

SEQ ID NO: 1178883 - RNA, 13 nt, Human
cuggauuaaacuu

SEQ ID NO: 1178884 - RNA, 23 nt, Human
cuggauuaaacuuaaucuaaaug

SEQ ID NO: 1178885 - RNA, 23 nt, Human
cuggcacuauaauguaagcucua

SEQ ID NO: 1178886 - RNA, 13 nt, Human
cuggcacugcuuc

SEQ ID NO: 1178887 - RNA, 14 nt, Human
cuggcacugcuucc

SEQ ID NO: 1178888 - RNA, 15 nt, Human
cuggcacugcuucca

SEQ ID NO: 1178889 - RNA, 16 nt, Human
cuggcacugcuuccag

SEQ ID NO: 1178890 - RNA, 17 nt, Human
cuggcacugcuuccagu

SEQ ID NO: 1178891 - RNA, 18 nt, Human
cuggcacugcuuccagug

SEQ ID NO: 1178892 - RNA, 16 nt, Human
cuggccaacgggguga

SEQ ID NO: 1178893 - RNA, 16 nt, Human
cuggccagaugcacca

SEQ ID NO: 1178894 - RNA, 17 nt, Human
cuggccagaugcaccag

SEQ ID NO: 1178895 - RNA, 18 nt, Human
cuggccagaugcaccagc

SEQ ID NO: 1178896 - RNA, 19 nt, Human
cuggccagaugcaccagcc

SEQ ID NO: 1178897 - RNA, 20 nt, Human
cuggccagaugcaccagccc

SEQ ID NO: 1178898 - RNA, 21 nt, Human
cuggccagaugcaccagcccu

SEQ ID NO: 1178899 - RNA, 22 nt, Human
cuggccagaugcaccagcccuu

SEQ ID NO: 1178900 - RNA, 12 nt, Human
cuggcccacugc

SEQ ID NO: 1178901 - RNA, 13 nt, Human
cuggcccacugca

SEQ ID NO: 1178902 - RNA, 17 nt, Human
cuggccuagcauacgua

SEQ ID NO: 1178903 - RNA, 23 nt, Human
cuggccuagcauacguacacauu

SEQ ID NO: 1178904 - RNA, 22 nt, Human
cuggccucaagugauucuccug

SEQ ID NO: 1178905 - RNA, 13 nt, Human
cuggccugagcug

SEQ ID NO: 1178906 - RNA, 15 nt, Human
cuggccugagcuggg

SEQ ID NO: 1178907 - RNA, 18 nt, Human
cuggcucuuccaggcugg

SEQ ID NO: 1178908 - RNA, 19 nt, Human
cuggcucuuccaggcuggg

SEQ ID NO: 1178909 - RNA, 20 nt, Human
cuggcucuuccaggcuggga

SEQ ID NO: 1178910 - RNA, 20 nt, Human
cuggcuguuggcugggggcc

SEQ ID NO: 1178911 - RNA, 21 nt, Human
cuggcuggguggcaccagcag

SEQ ID NO: 1178912 - RNA, 22 nt, Human
cuggcuggguggcaccagcagc

SEQ ID NO: 1178913 - RNA, 19 nt, Human
cuggcuguuggcugggggc

SEQ ID NO: 1178914 - RNA, 18 nt, Human
cugggaggucaaggcugc

SEQ ID NO: 1178915 - RNA, 13 nt, Human
cugggagugagcu

SEQ ID NO: 1178916 - RNA, 16 nt, Human
cugggagugagcuggu

SEQ ID NO: 1178917 - RNA, 20 nt, Human
cugggcaaugugauaaaacc

SEQ ID NO: 1178918 - RNA, 13 nt, Human
cuggguuggaggg

SEQ ID NO: 1178919 - RNA, 15 nt, Human
cugguccauagagag

SEQ ID NO: 1178920 - RNA, 17 nt, Human
cugguccauagagagca

SEQ ID NO: 1178921 - RNA, 18 nt, Human
cugguccauagagagcaa

SEQ ID NO: 1178922 - RNA, 21 nt, Human
cugguccauagagagcaagac

SEQ ID NO: 1178923 - RNA, 15 nt, Human
cuggucccacucagu

SEQ ID NO: 1178924 - RNA, 18 nt, Human
cuggucccacucagucca

SEQ ID NO: 1178925 - RNA, 15 nt, Human
cuggguuggagggug

SEQ ID NO: 1178926 - RNA, 23 nt, Human
cugguggcagugggagcugccug

SEQ ID NO: 1178927 - RNA, 18 nt, Human
cugggcuucaguggcagc

SEQ ID NO: 1178928 - RNA, 19 nt, Human
cugggcuucaguggcagcu

SEQ ID NO: 1178929 - RNA, 20 nt, Human
cugggcuucaguggcagcug

SEQ ID NO: 1178930 - RNA, 21 nt, Human
cugggcuucaguggcagcugc

SEQ ID NO: 1178931 - RNA, 22 nt, Human
cugggcuucaguggcagcugcu

SEQ ID NO: 1178932 - RNA, 23 nt, Human
cugggcuucaguggcagcugcuu

SEQ ID NO: 1178933 - RNA, 17 nt, Human
cugggcuuggggaccag

SEQ ID NO: 1178934 - RNA, 20 nt, Human
cugggcuuggggaccagagc

SEQ ID NO: 1178935 - RNA, 21 nt, Human
cugggcuuggggaccagagcu

SEQ ID NO: 1178936 - RNA, 19 nt, Human
cugggcucccuucccaccu

SEQ ID NO: 1178937 - RNA, 13 nt, Human
cugggggccucag

SEQ ID NO: 1178938 - RNA, 17 nt, Human
cugggggccucagugcc

SEQ ID NO: 1178939 - RNA, 18 nt, Human
cugggggccucagugcca

SEQ ID NO: 1178940 - RNA, 17 nt, Human
cugggguggggaccuca

SEQ ID NO: 1178941 - RNA, 18 nt, Human
cugggguggggaccucag

SEQ ID NO: 1178942 - RNA, 19 nt, Human
cugggguggggaccucagg

SEQ ID NO: 1178943 - RNA, 21 nt, Human
cugggguggggaccucaggcc

SEQ ID NO: 1178944 - RNA, 22 nt, Human
cugggguggggaccucaggccu

SEQ ID NO: 1178945 - RNA, 23 nt, Human
cugggguggggaccucaggccug

SEQ ID NO: 1178946 - RNA, 20 nt, Human
cuggguacuuguggacacag

SEQ ID NO: 1178947 - RNA, 21 nt, Human
cuggguacuuguggacacagc

SEQ ID NO: 1178948 - RNA, 23 nt, Human
cuggguacuuguggacacagcuc

SEQ ID NO: 1178949 - RNA, 12 nt, Human
cuguuuagauaa

SEQ ID NO: 1178950 - RNA, 14 nt, Human
cuguuuagauaaua

SEQ ID NO: 1178951 - RNA, 18 nt, Human
cuguuuguuucugaaagg

SEQ ID NO: 1178952 - RNA, 21 nt, Human
cuguuuguuucugaaagggac

SEQ ID NO: 1178953 - RNA, 23 nt, Human
cuguuuguuucugaaagggacgc

SEQ ID NO: 1178954 - RNA, 21 nt, Human
cuguuuuauuuuaauucaguu

SEQ ID NO: 1178955 - RNA, 14 nt, Human
cuguuuucucuuga

SEQ ID NO: 1178956 - RNA, 17 nt, Human
cuguuuucucuugagag

SEQ ID NO: 1178957 - RNA, 14 nt, Human
cuuaaucuaaaugg

SEQ ID NO: 1178958 - RNA, 16 nt, Human
cuuaaucuaaauggaa

SEQ ID NO: 1178959 - RNA, 18 nt, Human
cuuaaugccacuaaauug

SEQ ID NO: 1178960 - RNA, 21 nt, Human
cuuaagaagacugcauuauau

SEQ ID NO: 1178961 - RNA, 12 nt, Human
cuuaacuucaca

SEQ ID NO: 1178962 - RNA, 14 nt, Human
cuuaacuucacaua

SEQ ID NO: 1178963 - RNA, 15 nt, Human
cuuaacuucacauau

SEQ ID NO: 1178964 - RNA, 16 nt, Human
cuuaacuucacauauu

SEQ ID NO: 1178965 - RNA, 17 nt, Human
cuuaacuucacauauug

SEQ ID NO: 1178966 - RNA, 22 nt, Human
cuuaacuucacauauugauuuc

SEQ ID NO: 1178967 - RNA, 15 nt, Human
cuuagaagucacaca

SEQ ID NO: 1178968 - RNA, 14 nt, Human
cuuagacagucccu

SEQ ID NO: 1178969 - RNA, 15 nt, Human
cuuagacagucccug

SEQ ID NO: 1178970 - RNA, 16 nt, Human
cuuagacagucccugc

SEQ ID NO: 1178971 - RNA, 17 nt, Human
cuuagacagucccugcc

SEQ ID NO: 1178972 - RNA, 18 nt, Human
cuuagacagucccugcca

SEQ ID NO: 1178973 - RNA, 19 nt, Human
cuuagacagucccugccaa

SEQ ID NO: 1178974 - RNA, 17 nt, Human
cuuagaagucacacagu

SEQ ID NO: 1178975 - RNA, 19 nt, Human
cuuagaugcaguucugaag

SEQ ID NO: 1178976 - RNA, 20 nt, Human
cuuagaugcaguucugaaga

SEQ ID NO: 1178977 - RNA, 15 nt, Human
cuuacgugaguccug

SEQ ID NO: 1178978 - RNA, 19 nt, Human
cuuacuaguuucccuugca

SEQ ID NO: 1178979 - RNA, 16 nt, Human
cuuacuguacaugaaa

SEQ ID NO: 1178980 - RNA, 21 nt, Human
cuuaggguuaugauuaaguaa

SEQ ID NO: 1178981 - RNA, 17 nt, Human
cuuagguuggcaaaaag

SEQ ID NO: 1178982 - RNA, 21 nt, Human
cuuagguuggcaaaaaggcag

SEQ ID NO: 1178983 - RNA, 13 nt, Human
cuuauaauuuaaa

SEQ ID NO: 1178984 - RNA, 14 nt, Human
cuuauaauuuaaaa

SEQ ID NO: 1178985 - RNA, 15 nt, Human
cuuauacauuugaua

SEQ ID NO: 1178986 - RNA, 15 nt, Human
cuuauuuaaugaaag

SEQ ID NO: 1178987 - RNA, 15 nt, Human
cuucagcugacuuuu

SEQ ID NO: 1178988 - RNA, 11 nt, Human
cuucagcugac

SEQ ID NO: 1178989 - RNA, 18 nt, Human
cuucagcgguuuauauaa

SEQ ID NO: 1178990 - RNA, 23 nt, Human
cuuccacaagagcccaggccucc

SEQ ID NO: 1178991 - RNA, 11 nt, Human
cuucagugccu

SEQ ID NO: 1178992 - RNA, 12 nt, Human
cuucagugccuu

SEQ ID NO: 1178993 - RNA, 13 nt, Human
cuucagugccuua

SEQ ID NO: 1178994 - RNA, 14 nt, Human
cuucagugccuuau

SEQ ID NO: 1178995 - RNA, 18 nt, Human
cuucauuuccugugucuu

SEQ ID NO: 1178996 - RNA, 22 nt, Human
cuuccaggggugggacacccug

SEQ ID NO: 1178997 - RNA, 24 nt, Human
cuuccaggggugggacacccugug

SEQ ID NO: 1178998 - RNA, 14 nt, Human
cuuccagugaggcu

SEQ ID NO: 1178999 - RNA, 15 nt, Human
cuuccagugaggcuc

SEQ ID NO: 1179000 - RNA, 17 nt, Human
cuuccagugaggcucug

SEQ ID NO: 1179001 - RNA, 20 nt, Human
cuucgggaggucgaggcagg

SEQ ID NO: 1179002 - RNA, 21 nt, Human
cuucgggaggucgaggcagga

SEQ ID NO: 1179003 - RNA, 16 nt, Human
cuucgcuccugugucu

SEQ ID NO: 1179004 - RNA, 17 nt, Human
cuucggccuccauccug

SEQ ID NO: 1179005 - RNA, 18 nt, Human
cuucggccuccauccuga

SEQ ID NO: 1179006 - RNA, 19 nt, Human
cuucggccuccauccugag

SEQ ID NO: 1179007 - RNA, 13 nt, Human
cuucgcuccugug

SEQ ID NO: 1179008 - RNA, 14 nt, Human
cuucgcuccugugu

SEQ ID NO: 1179009 - RNA, 15 nt, Human
cuucgcuccuguguc

SEQ ID NO: 1179010 - RNA, 22 nt, Human
cuucuccuucaccuuugucccc

SEQ ID NO: 1179011 - RNA, 14 nt, Human
cuucuccacccugc

SEQ ID NO: 1179012 - RNA, 15 nt, Human
cuucuccacccugcu

SEQ ID NO: 1179013 - RNA, 16 nt, Human
cuucuccacccugcuc

SEQ ID NO: 1179014 - RNA, 17 nt, Human
cuucuccaggcuguauc

SEQ ID NO: 1179015 - RNA, 12 nt, Human
cuucucuccagc

SEQ ID NO: 1179016 - RNA, 17 nt, Human
cuucugccauauucugu

SEQ ID NO: 1179017 - RNA, 21 nt, Human
cuucugccauauucuguuggc

SEQ ID NO: 1179018 - RNA, 20 nt, Human
cuucugccauuucugagauc

SEQ ID NO: 1179019 - RNA, 16 nt, Human
cuucugcuucagccuc

SEQ ID NO: 1179020 - RNA, 17 nt, Human
cuucugcuucagccucc

SEQ ID NO: 1179021 - RNA, 18 nt, Human
cuucugcuucagccuccc

SEQ ID NO: 1179022 - RNA, 14 nt, Human
cuugagagggugga

SEQ ID NO: 1179023 - RNA, 12 nt, Human
cuugagccuggg

SEQ ID NO: 1179024 - RNA, 15 nt, Human
cuugagccugggagg

SEQ ID NO: 1179025 - RNA, 16 nt, Human
cuugagccugggaggu

SEQ ID NO: 1179026 - RNA, 15 nt, Human
cuugaggguugggcu

SEQ ID NO: 1179027 - RNA, 17 nt, Human
cuugaggguugggcugg

SEQ ID NO: 1179028 - RNA, 19 nt, Human
cuugaguugauucagcucu

SEQ ID NO: 1179029 - RNA, 20 nt, Human
cuugaguugauucagcucug

SEQ ID NO: 1179030 - RNA, 21 nt, Human
cuugaguugauucagcucugc

SEQ ID NO: 1179031 - RNA, 16 nt, Human
cuugcaauggcagccu

SEQ ID NO: 1179032 - RNA, 17 nt, Human
cuugcaauggcagccuu

SEQ ID NO: 1179033 - RNA, 18 nt, Human
cuugcaauggcagccuug

SEQ ID NO: 1179034 - RNA, 21 nt, Human
cuugcagacucuacagaggcc

SEQ ID NO: 1179035 - RNA, 13 nt, Human
cuugcaugaggcu

SEQ ID NO: 1179036 - RNA, 14 nt, Human
cuugcaugaggcua

SEQ ID NO: 1179037 - RNA, 17 nt, Human
cuugcaugaggcuagug

SEQ ID NO: 1179038 - RNA, 20 nt, Human
cuugcuugauuguauggugg

SEQ ID NO: 1179039 - RNA, 13 nt, Human
cuugcuugcuuuu

SEQ ID NO: 1179040 - RNA, 20 nt, Human
cuuggaagcuccgcuuucua

SEQ ID NO: 1179041 - RNA, 22 nt, Human
cuugcucugcugacagacacag

SEQ ID NO: 1179042 - RNA, 20 nt, Human
cuugggccacugugaagaga

SEQ ID NO: 1179043 - RNA, 16 nt, Human
cuuggggcugaugcag

SEQ ID NO: 1179044 - RNA, 18 nt, Human
cuuggggcugaugcaguu

SEQ ID NO: 1179045 - RNA, 14 nt, Human
cuugguuuguaaau

SEQ ID NO: 1179046 - RNA, 15 nt, Human
cuugguuuguaaauu

SEQ ID NO: 1179047 - RNA, 20 nt, Human
cuugguuuguaaauuaacuu

SEQ ID NO: 1179048 - RNA, 12 nt, Human
cuuguacauaau

SEQ ID NO: 1179049 - RNA, 17 nt, Human
cuuuaccuuuuuuauac

SEQ ID NO: 1179050 - RNA, 19 nt, Human
cuuuaccuuuuuuauacau

SEQ ID NO: 1179051 - RNA, 20 nt, Human
cuuuaccuuuuuuauacaua

SEQ ID NO: 1179052 - RNA, 22 nt, Human
cuuuaccuuuuuuauacauaaa

SEQ ID NO: 1179053 - RNA, 15 nt, Human
cuuguggucccaccc

SEQ ID NO: 1179054 - RNA, 16 nt, Human
cuuguggucccacccc

SEQ ID NO: 1179055 - RNA, 19 nt, Human
cuuguggucccaccccaca

SEQ ID NO: 1179056 - RNA, 16 nt, Human
cuuguuaagauaguua

SEQ ID NO: 1179057 - RNA, 16 nt, Human
cuuuccucuuuggucu

SEQ ID NO: 1179058 - RNA, 13 nt, Human
cuuugaccucugc

SEQ ID NO: 1179059 - RNA, 12 nt, Human
cuuuggaaagac

SEQ ID NO: 1179060 - RNA, 23 nt, Human
cuuuggaaagacuuuuccaaccc

SEQ ID NO: 1179061 - RNA, 19 nt, Human
cuuuggaaagaguaggaag

SEQ ID NO: 1179062 - RNA, 17 nt, Human
cuuugggccuggcuccc

SEQ ID NO: 1179063 - RNA, 23 nt, Human
cuuugugaggaagccgcuggggc

SEQ ID NO: 1179064 - RNA, 12 nt, Human
cuuugugauuuu

SEQ ID NO: 1179065 - RNA, 13 nt, Human
cuuuguggcuucc

SEQ ID NO: 1179066 - RNA, 16 nt, Human
cuuuguucuggcucuu

SEQ ID NO: 1179067 - RNA, 21 nt, Human
cuuuguucuggcucuuccagg

SEQ ID NO: 1179068 - RNA, 21 nt, Human
cuuuguuuguugucagcugaa

SEQ ID NO: 1179069 - RNA, 15 nt, Human
cuuuucuguuugcua

SEQ ID NO: 1179070 - RNA, 18 nt, Human
cuuuucuugcaugaggcu

SEQ ID NO: 1179071 - RNA, 22 nt, Human
cuuuuguucuugguuuguaaau

SEQ ID NO: 1179072 - RNA, 15 nt, Human
gaaaauaaaaaguua

SEQ ID NO: 1179073 - RNA, 16 nt, Human
gaaaauaaaaaguuaa

SEQ ID NO: 1179074 - RNA, 19 nt, Human
gaaaauaacaauaaaagac

SEQ ID NO: 1179075 - RNA, 14 nt, Human
gaaaaguauguuag

SEQ ID NO: 1179076 - RNA, 20 nt, Human
gaaaaguauguuagugcaaa

SEQ ID NO: 1179077 - RNA, 19 nt, Human
gaaaacaugcuacacacug

SEQ ID NO: 1179078 - RNA, 22 nt, Human
gaaaacacuguucucugcccuc

SEQ ID NO: 1179079 - RNA, 14 nt, Human
gaaaacguggcugc

SEQ ID NO: 1179080 - RNA, 16 nt, Human
cuuuuuuagaguugau

SEQ ID NO: 1179081 - RNA, 14 nt, Human
gaaaacaaggauga

SEQ ID NO: 1179082 - RNA, 19 nt, Human
gaaaacacuguucucugcc

SEQ ID NO: 1179083 - RNA, 20 nt, Human
gaaaacacuguucucugccc

SEQ ID NO: 1179084 - RNA, 21 nt, Human
gaaaacacuguucucugcccu

SEQ ID NO: 1179085 - RNA, 18 nt, Human
gaaaacaugcuacacacu

SEQ ID NO: 1179086 - RNA, 17 nt, Human
gaaaauaaaaaguuaaa

SEQ ID NO: 1179087 - RNA, 16 nt, Human
gaaauuguauuacaaa

SEQ ID NO: 1179088 - RNA, 12 nt, Human
gaaaauauacug

SEQ ID NO: 1179089 - RNA, 13 nt, Human
gaaaauauacugu

SEQ ID NO: 1179090 - RNA, 14 nt, Human
gaaaauauacugua

SEQ ID NO: 1179091 - RNA, 15 nt, Human
gaaaauauacuguaa

SEQ ID NO: 1179092 - RNA, 16 nt, Human
gaaaauauacuguaaa

SEQ ID NO: 1179093 - RNA, 18 nt, Human
gaaauuguauuacaaauc

SEQ ID NO: 1179094 - RNA, 18 nt, Human
gaaaauauacuguaaaga

SEQ ID NO: 1179095 - RNA, 17 nt, Human
gaaaauauacuguaaag

SEQ ID NO: 1179096 - RNA, 14 nt, Human
gaacacucugagac

SEQ ID NO: 1179097 - RNA, 15 nt, Human
gaacacucugagacu

SEQ ID NO: 1179098 - RNA, 16 nt, Human
gaacagugauuaccag

SEQ ID NO: 1179099 - RNA, 20 nt, Human
gaacagugauuaccagggac

SEQ ID NO: 1179100 - RNA, 18 nt, Human
gaaccuuuugagugccuu

SEQ ID NO: 1179101 - RNA, 19 nt, Human
gaaccuuuugagugccuua

SEQ ID NO: 1179102 - RNA, 21 nt, Human
gaaccuuuugagugccuuaca

SEQ ID NO: 1179103 - RNA, 22 nt, Human
gaaccuuuugagugccuuacac

SEQ ID NO: 1179104 - RNA, 21 nt, Human
gaacuagaguuuagcuggaaa

SEQ ID NO: 1179105 - RNA, 19 nt, Human
gaagagaaugcacaaacag

SEQ ID NO: 1179106 - RNA, 20 nt, Human
gaagacuuuucuuucagcca

SEQ ID NO: 1179107 - RNA, 14 nt, Human
gaagacuuuggaaa

SEQ ID NO: 1179108 - RNA, 17 nt, Human
gaagacuuuggaaagag

SEQ ID NO: 1179109 - RNA, 23 nt, Human
gaacuuugaccucugcagcaaua

SEQ ID NO: 1179110 - RNA, 12 nt, Human
gaagaacugaaa

SEQ ID NO: 1179111 - RNA, 19 nt, Human
gaagacugcauuauauuua

SEQ ID NO: 1179112 - RNA, 11 nt, Human
gaagacuuugg

SEQ ID NO: 1179113 - RNA, 13 nt, Human
gaagacuuuggaa

SEQ ID NO: 1179114 - RNA, 20 nt, Human
gaagauaauauuaaggaaga

SEQ ID NO: 1179115 - RNA, 18 nt, Human
gaagauguagaggagaaa

SEQ ID NO: 1179116 - RNA, 17 nt, Human
gaagcauuuacuuugug

SEQ ID NO: 1179117 - RNA, 18 nt, Human
gaagcauuuacuuugugu

SEQ ID NO: 1179118 - RNA, 20 nt, Human
gaagccagcaggcucucagg

SEQ ID NO: 1179119 - RNA, 21 nt, Human
gaagccagcaggcucucaggc

SEQ ID NO: 1179120 - RNA, 22 nt, Human
gaagccagcaggcucucaggcc

SEQ ID NO: 1179121 - RNA, 13 nt, Human
gaagcccaggaaa

SEQ ID NO: 1179122 - RNA, 15 nt, Human
gaagcccaggaaagg

SEQ ID NO: 1179123 - RNA, 16 nt, Human
gaagcccaggaaaggc

SEQ ID NO: 1179124 - RNA, 19 nt, Human
gaagcccaggaaaggcucc

SEQ ID NO: 1179125 - RNA, 23 nt, Human
gaagccagcaggcucucaggcca

SEQ ID NO: 1179126 - RNA, 23 nt, Human
gaagcccuucuaccuuccugcaa

SEQ ID NO: 1179127 - RNA, 16 nt, Human
gaaugaaacccccaca

SEQ ID NO: 1179128 - RNA, 22 nt, Human
gaaugaaccacaucuugcucug

SEQ ID NO: 1179129 - RNA, 23 nt, Human
gaaugaaccacaucuugcucugc

SEQ ID NO: 1179130 - RNA, 14 nt, Human
gaaugaaaccccca

SEQ ID NO: 1179131 - RNA, 22 nt, Human
gaaugguuuucaaaauaaaaau

SEQ ID NO: 1179132 - RNA, 14 nt, Human
gaaugucaguguga

SEQ ID NO: 1179133 - RNA, 20 nt, Human
gaaugucagugugacugauc

SEQ ID NO: 1179134 - RNA, 21 nt, Human
gaaugucagugugacugaucu

SEQ ID NO: 1179135 - RNA, 17 nt, Human
gaauucucagaaucuca

SEQ ID NO: 1179136 - RNA, 17 nt, Human
gaauucucuaguuugau

SEQ ID NO: 1179137 - RNA, 19 nt, Human
gaauucucuaguuugauua

SEQ ID NO: 1179138 - RNA, 14 nt, Human
gaauugaaaaacca

SEQ ID NO: 1179139 - RNA, 14 nt, Human
gaauugaagcagga

SEQ ID NO: 1179140 - RNA, 22 nt, Human
gaauuguaaggaaugauuaauu

SEQ ID NO: 1179141 - RNA, 15 nt, Human
gaauuucccaaagca

SEQ ID NO: 1179142 - RNA, 22 nt, Human
gaauagcugggacuacaggugu

SEQ ID NO: 1179143 - RNA, 23 nt, Human
gaauagcugggacuacaggugug

SEQ ID NO: 1179144 - RNA, 15 nt, Human
gaauaccuguccccc

SEQ ID NO: 1179145 - RNA, 13 nt, Human
gaauaccuguccc

SEQ ID NO: 1179146 - RNA, 20 nt, Human
gaauaauccuaaacauauga

SEQ ID NO: 1179147 - RNA, 21 nt, Human
gaauacagaggcaacugcauu

SEQ ID NO: 1179148 - RNA, 17 nt, Human
gaauaauacaguaucuc

SEQ ID NO: 1179149 - RNA, 20 nt, Human
gaaguuugagaucagccugg

SEQ ID NO: 1179150 - RNA, 18 nt, Human
gaauaacauguaauuaag

SEQ ID NO: 1179151 - RNA, 19 nt, Human
gaauaacauguaauuaagu

SEQ ID NO: 1179152 - RNA, 16 nt, Human
gaaguauccuucagcc

SEQ ID NO: 1179153 - RNA, 14 nt, Human
gaaguauccuucag

SEQ ID NO: 1179154 - RNA, 12 nt, Human
gaaguccaagca

SEQ ID NO: 1179155 - RNA, 22 nt, Human
gaaguccaagcauuuagaugua

SEQ ID NO: 1179156 - RNA, 15 nt, Human
gaagucuuagaugua

SEQ ID NO: 1179157 - RNA, 21 nt, Human
gaaguuucugccgcagcccug

SEQ ID NO: 1179158 - RNA, 18 nt, Human
gaagucuuagauguauau

SEQ ID NO: 1179159 - RNA, 16 nt, Human
gaagggggcugggaca

SEQ ID NO: 1179160 - RNA, 19 nt, Human
gaagggggcugggacaugg

SEQ ID NO: 1179161 - RNA, 22 nt, Human
gaaguaauaugcacacauuuuu

SEQ ID NO: 1179162 - RNA, 18 nt, Human
gaaguacuauaauuuacc

SEQ ID NO: 1179163 - RNA, 15 nt, Human
gaaguacuggagaaa

SEQ ID NO: 1179164 - RNA, 20 nt, Human
gacagagcuacacaggggaa

SEQ ID NO: 1179165 - RNA, 12 nt, Human
gacagaggcagc

SEQ ID NO: 1179166 - RNA, 13 nt, Human
gacagagggggug

SEQ ID NO: 1179167 - RNA, 21 nt, Human
gacagagucucacuguugccc

SEQ ID NO: 1179168 - RNA, 16 nt, Human
gacagagugagacucu

SEQ ID NO: 1179169 - RNA, 19 nt, Human
gacagagugagacucuguc

SEQ ID NO: 1179170 - RNA, 16 nt, Human
gaauuucccaaagcag

SEQ ID NO: 1179171 - RNA, 18 nt, Human
gaauuucccaaagcagug

SEQ ID NO: 1179172 - RNA, 22 nt, Human
gaauuucccaaagcagugcaug

SEQ ID NO: 1179173 - RNA, 22 nt, Human
gacacgaauauugcugauggug

SEQ ID NO: 1179174 - RNA, 16 nt, Human
gacacuagaagauuuu

SEQ ID NO: 1179175 - RNA, 20 nt, Human
gacagacacaggcccggcuc

SEQ ID NO: 1179176 - RNA, 22 nt, Human
gacagacacaggcccggcucca

SEQ ID NO: 1179177 - RNA, 22 nt, Human
gacaggcauguucucugaggac

SEQ ID NO: 1179178 - RNA, 16 nt, Human
gacaucaacugcauca

SEQ ID NO: 1179179 - RNA, 23 nt, Human
gacaucaacugcaucaagaugug

SEQ ID NO: 1179180 - RNA, 13 nt, Human
gacaggcaagcac

SEQ ID NO: 1179181 - RNA, 17 nt, Human
gacaggcaagcaccucc

SEQ ID NO: 1179182 - RNA, 18 nt, Human
gacaggcaagcaccuccu

SEQ ID NO: 1179183 - RNA, 20 nt, Human
gacaggcaagcaccuccugc

SEQ ID NO: 1179184 - RNA, 21 nt, Human
gacaggcaagcaccuccugcc

SEQ ID NO: 1179185 - RNA, 19 nt, Human
gacaggcaaugcuggcugu

SEQ ID NO: 1179186 - RNA, 23 nt, Human
gacaggcaaugcuggcuguuggc

SEQ ID NO: 1179187 - RNA, 24 nt, Human
gacaggcaaugcuggcuguuggcu

SEQ ID NO: 1179188 - RNA, 21 nt, Human
gacaggcauguucucugagga

SEQ ID NO: 1179189 - RNA, 18 nt, Human
gaccacaaaacuuuucua

SEQ ID NO: 1179190 - RNA, 16 nt, Human
gaccacugcagaagac

SEQ ID NO: 1179191 - RNA, 18 nt, Human
gaccacugcagaagacag

SEQ ID NO: 1179192 - RNA, 22 nt, Human
gaccagacaccuugacagggca

SEQ ID NO: 1179193 - RNA, 23 nt, Human
gaccagacaccuugacagggcac

SEQ ID NO: 1179194 - RNA, 24 nt, Human
gaccagacaccuugacagggcaca

SEQ ID NO: 1179195 - RNA, 21 nt, Human
gaccagagcugccaccugccu

SEQ ID NO: 1179196 - RNA, 20 nt, Human
gaccagcaccaucucuccuc

SEQ ID NO: 1179197 - RNA, 21 nt, Human
gaccagcaccaucucuccucc

SEQ ID NO: 1179198 - RNA, 20 nt, Human
gacccaaaaggcagaagcaa

SEQ ID NO: 1179199 - RNA, 19 nt, Human
gacccaaaaggcagaagca

SEQ ID NO: 1179200 - RNA, 13 nt, Human
gacccaugcugcc

SEQ ID NO: 1179201 - RNA, 18 nt, Human
gacccaugcugcccugug

SEQ ID NO: 1179202 - RNA, 19 nt, Human
gacccaugcugcccuguga

SEQ ID NO: 1179203 - RNA, 20 nt, Human
gacccaugcugcccugugag

SEQ ID NO: 1179204 - RNA, 11 nt, Human
gacccugaggc

SEQ ID NO: 1179205 - RNA, 12 nt, Human
gacccugaggcc

SEQ ID NO: 1179206 - RNA, 16 nt, Human
gacccugaggcccaga

SEQ ID NO: 1179207 - RNA, 18 nt, Human
gacccugaggcccagagg

SEQ ID NO: 1179208 - RNA, 20 nt, Human
gacccugcccugugggcccc

SEQ ID NO: 1179209 - RNA, 22 nt, Human
gacccugcccugugggccccca

SEQ ID NO: 1179210 - RNA, 16 nt, Human
gacugaggggagggga

SEQ ID NO: 1179211 - RNA, 18 nt, Human
gacugaguacguugugca

SEQ ID NO: 1179212 - RNA, 13 nt, Human
gacuacaggcacc

SEQ ID NO: 1179213 - RNA, 15 nt, Human
gacuacaggcaccca

SEQ ID NO: 1179214 - RNA, 18 nt, Human
gacuacaggcacccacca

SEQ ID NO: 1179215 - RNA, 13 nt, Human
gacuacaggugug

SEQ ID NO: 1179216 - RNA, 19 nt, Human
gacuccugcaggcagccag

SEQ ID NO: 1179217 - RNA, 20 nt, Human
gacuccugcaggcagccagg

SEQ ID NO: 1179218 - RNA, 21 nt, Human
gacuccugcaggcagccaggc

SEQ ID NO: 1179219 - RNA, 15 nt, Human
gacucuacagaggcc

SEQ ID NO: 1179220 - RNA, 21 nt, Human
gacucuacagaggccaugggc

SEQ ID NO: 1179221 - RNA, 12 nt, Human
gacuucaucccu

SEQ ID NO: 1179222 - RNA, 20 nt, Human
gacuucaucccucuggggcu

SEQ ID NO: 1179223 - RNA, 12 nt, Human
gacuuacuguac

SEQ ID NO: 1179224 - RNA, 15 nt, Human
gacuuacuguacaug

SEQ ID NO: 1179225 - RNA, 16 nt, Human
gacuuacuguacauga

SEQ ID NO: 1179226 - RNA, 18 nt, Human
gacuuacuguacaugaaa

SEQ ID NO: 1179227 - RNA, 23 nt, Human
gacuuacuguacaugaaaacaca

SEQ ID NO: 1179228 - RNA, 23 nt, Human
gacuggccaagguuuggggaaga

SEQ ID NO: 1179229 - RNA, 16 nt, Human
gacuaacuugucuuug

SEQ ID NO: 1179230 - RNA, 23 nt, Human
gacuaacuugucuuuggacccug

SEQ ID NO: 1179231 - RNA, 11 nt, Human
gacguguuaug

SEQ ID NO: 1179232 - RNA, 14 nt, Human
gacguguuaugacu

SEQ ID NO: 1179233 - RNA, 15 nt, Human
gacguguuaugacuc

SEQ ID NO: 1179234 - RNA, 23 nt, Human
gaccuugaacuggguacuugugg

SEQ ID NO: 1179235 - RNA, 11 nt, Human
gaccuuucaau

SEQ ID NO: 1179236 - RNA, 19 nt, Human
gaccuuucaauaggaaaaa

SEQ ID NO: 1179237 - RNA, 20 nt, Human
gaccuuucaauaggaaaaac

SEQ ID NO: 1179238 - RNA, 22 nt, Human
gacgcugugcugcccugcccac

SEQ ID NO: 1179239 - RNA, 13 nt, Human
gacggagucccac

SEQ ID NO: 1179240 - RNA, 14 nt, Human
gacggagucccacc

SEQ ID NO: 1179241 - RNA, 19 nt, Human
gacccuugccgucuaccug

SEQ ID NO: 1179242 - RNA, 20 nt, Human
gacccuugccgucuaccuga

SEQ ID NO: 1179243 - RNA, 23 nt, Human
gacccuugccgucuaccugaggg

SEQ ID NO: 1179244 - RNA, 15 nt, Human
gacccuugugguccc

SEQ ID NO: 1179245 - RNA, 14 nt, Human
gaccuucuccuuca

SEQ ID NO: 1179246 - RNA, 15 nt, Human
gaccuucuccuucac

SEQ ID NO: 1179247 - RNA, 16 nt, Human
gaccuucuccuucacc

SEQ ID NO: 1179248 - RNA, 20 nt, Human
gaccuucuccuucaccuuug

SEQ ID NO: 1179249 - RNA, 21 nt, Human
gaccuucuccuucaccuuugu

SEQ ID NO: 1179250 - RNA, 14 nt, Human
gaccuugaacuggg

SEQ ID NO: 1179251 - RNA, 17 nt, Human
gauaggucagugcaaau

SEQ ID NO: 1179252 - RNA, 16 nt, Human
gauacaaaagcaugug

SEQ ID NO: 1179253 - RNA, 17 nt, Human
gauacaaaagcauguga

SEQ ID NO: 1179254 - RNA, 20 nt, Human
gauagugucccacggugccu

SEQ ID NO: 1179255 - RNA, 18 nt, Human
gauauaugcucugcaugu

SEQ ID NO: 1179256 - RNA, 23 nt, Human
gauauaugcucugcauguuacau

SEQ ID NO: 1179257 - RNA, 23 nt, Human
gaucacggcucacugcagccuca

SEQ ID NO: 1179258 - RNA, 23 nt, Human
gaucagcuuauugucuagugaaa

SEQ ID NO: 1179259 - RNA, 20 nt, Human
gaguucauacccuguuacca

SEQ ID NO: 1179260 - RNA, 13 nt, Human
gaguucugguucc

SEQ ID NO: 1179261 - RNA, 13 nt, Human
gauaaacaguagu

SEQ ID NO: 1179262 - RNA, 12 nt, Human
gauaauacacca

SEQ ID NO: 1179263 - RNA, 14 nt, Human
gauaauacaccacu

SEQ ID NO: 1179264 - RNA, 23 nt, Human
gauaauacaccacuacauucugu

SEQ ID NO: 1179265 - RNA, 24 nt, Human
gauaauacaccacuacauucuguu

SEQ ID NO: 1179266 - RNA, 18 nt, Human
gauccuaggcauuugcug

SEQ ID NO: 1179267 - RNA, 14 nt, Human
gauccuccaggugc

SEQ ID NO: 1179268 - RNA, 16 nt, Human
gauccucccaccucag

SEQ ID NO: 1179269 - RNA, 17 nt, Human
gauccucccaccucagc

SEQ ID NO: 1179270 - RNA, 18 nt, Human
gauccucccaccucagcc

SEQ ID NO: 1179271 - RNA, 13 nt, Human
gaucauccacugu

SEQ ID NO: 1179272 - RNA, 16 nt, Human
gaucauccacugugcc

SEQ ID NO: 1179273 - RNA, 12 nt, Human
gauccugagcca

SEQ ID NO: 1179274 - RNA, 13 nt, Human
gauccugagccag

SEQ ID NO: 1179275 - RNA, 14 nt, Human
gauccuggaaauca

SEQ ID NO: 1179276 - RNA, 13 nt, Human
gaucuaggaagac

SEQ ID NO: 1179277 - RNA, 14 nt, Human
gaucuaggaagacu

SEQ ID NO: 1179278 - RNA, 18 nt, Human
gaucuaggaagacuuugg

SEQ ID NO: 1179279 - RNA, 20 nt, Human
gaucuaggaagacuuuggaa

SEQ ID NO: 1179280 - RNA, 22 nt, Human
gaucuucuguggguuucuaaag

SEQ ID NO: 1179281 - RNA, 19 nt, Human
gaucuucuuuauaauucua

SEQ ID NO: 1179282 - RNA, 15 nt, Human
gaugaaaugagguca

SEQ ID NO: 1179283 - RNA, 21 nt, Human
gaugaaaugaggucagagccu

SEQ ID NO: 1179284 - RNA, 18 nt, Human
gaugaccuugaaugaugc

SEQ ID NO: 1179285 - RNA, 20 nt, Human
gaugaccuugaaugaugcca

SEQ ID NO: 1179286 - RNA, 14 nt, Human
gaugagaggaaauc

SEQ ID NO: 1179287 - RNA, 15 nt, Human
gaugcaccagcccuu

SEQ ID NO: 1179288 - RNA, 23 nt, Human
gaugcaccagcccuuagcaggga

SEQ ID NO: 1179289 - RNA, 16 nt, Human
gaugagaggaaaucac

SEQ ID NO: 1179290 - RNA, 14 nt, Human
gaugcagugcuucc

SEQ ID NO: 1179291 - RNA, 18 nt, Human
gaugcaguucugaagaag

SEQ ID NO: 1179292 - RNA, 15 nt, Human
gaugccugguggcag

SEQ ID NO: 1179293 - RNA, 16 nt, Human
gaugccugguggcagc

SEQ ID NO: 1179294 - RNA, 17 nt, Human
gaugccugguggcagcu

SEQ ID NO: 1179295 - RNA, 20 nt, Human
gaugcgggccagugcuccag

SEQ ID NO: 1179296 - RNA, 16 nt, Human
gaugcuagaacucccu

SEQ ID NO: 1179297 - RNA, 22 nt, Human
gaugcgggccagugcuccagcc

SEQ ID NO: 1179298 - RNA, 18 nt, Human
gaugcuagaacucccuuu

SEQ ID NO: 1179299 - RNA, 18 nt, Human
gauguucuagcauggcug

SEQ ID NO: 1179300 - RNA, 14 nt, Human
gauguucugggaca

SEQ ID NO: 1179301 - RNA, 21 nt, Human
gauguuuuaaggaugcuugua

SEQ ID NO: 1179302 - RNA, 14 nt, Human
gauuaaguaaugau

SEQ ID NO: 1179303 - RNA, 22 nt, Human
gauuaaguaaugauaacuggaa

SEQ ID NO: 1179304 - RNA, 13 nt, Human
gauuacaagcgug

SEQ ID NO: 1179305 - RNA, 21 nt, Human
gauuacaagcgugagccacug

SEQ ID NO: 1179306 - RNA, 13 nt, Human
gauucagacagcu

SEQ ID NO: 1179307 - RNA, 14 nt, Human
gauucagacagcug

SEQ ID NO: 1179308 - RNA, 17 nt, Human
gauucagacagcugccu

SEQ ID NO: 1179309 - RNA, 18 nt, Human
gauucagacagcugccug

SEQ ID NO: 1179310 - RNA, 15 nt, Human
gauucccaagcucug

SEQ ID NO: 1179311 - RNA, 22 nt, Human
gauuucuguuuagauaauacac

SEQ ID NO: 1179312 - RNA, 12 nt, Human
gauuuaaaucag

SEQ ID NO: 1179313 - RNA, 16 nt, Human
gauucccaagcucugc

SEQ ID NO: 1179314 - RNA, 17 nt, Human
gauucccaagcucugcu

SEQ ID NO: 1179315 - RNA, 18 nt, Human
gauucccaagcucugcuc

SEQ ID NO: 1179316 - RNA, 20 nt, Human
gauucuuuccugaggcuggg

SEQ ID NO: 1179317 - RNA, 22 nt, Human
gauucuuuccugaggcugggcu

SEQ ID NO: 1179318 - RNA, 16 nt, Human
gauugcaacaggcugg

SEQ ID NO: 1179319 - RNA, 17 nt, Human
gauugcaacaggcuggg

SEQ ID NO: 1179320 - RNA, 18 nt, Human
gauugcaacaggcugggc

SEQ ID NO: 1179321 - RNA, 18 nt, Human
gauugcuugagcucagga

SEQ ID NO: 1179322 - RNA, 18 nt, Human
gcaacugcauuggcuuug

SEQ ID NO: 1179323 - RNA, 16 nt, Human
gcaaaccaucauugaa

SEQ ID NO: 1179324 - RNA, 17 nt, Human
gcaaaccaucauugaaa

SEQ ID NO: 1179325 - RNA, 19 nt, Human
gcaaaccaucauugaaauc

SEQ ID NO: 1179326 - RNA, 20 nt, Human
gcaaaccaucauugaaaucu

SEQ ID NO: 1179327 - RNA, 21 nt, Human
gcaaaccaucauugaaaucuu

SEQ ID NO: 1179328 - RNA, 15 nt, Human
gcaagcaccuccugc

SEQ ID NO: 1179329 - RNA, 16 nt, Human
gcaagcaccuccugcc

SEQ ID NO: 1179330 - RNA, 18 nt, Human
gcaagcaccuccugccuc

SEQ ID NO: 1179331 - RNA, 20 nt, Human
gcaagcaccuccugccucga

SEQ ID NO: 1179332 - RNA, 14 nt, Human
gcaaggcugucaau

SEQ ID NO: 1179333 - RNA, 18 nt, Human
gcaaggcugucaauuaca

SEQ ID NO: 1179334 - RNA, 20 nt, Human
gcaaguauuagaauaccaca

SEQ ID NO: 1179335 - RNA, 17 nt, Human
gcaauccugcaagaaca

SEQ ID NO: 1179336 - RNA, 18 nt, Human
gcacuaaggugugcucug

SEQ ID NO: 1179337 - RNA, 19 nt, Human
gcacuaaggugugcucuga

SEQ ID NO: 1179338 - RNA, 18 nt, Human
gcacccggccccugcugg

SEQ ID NO: 1179339 - RNA, 18 nt, Human
gcaccuggaauauauaac

SEQ ID NO: 1179340 - RNA, 17 nt, Human
gcacuaaggugugcucu

SEQ ID NO: 1179341 - RNA, 22 nt, Human
gcacugggcuuggggaccagag

SEQ ID NO: 1179342 - RNA, 23 nt, Human
gcacugggcuuggggaccagagc

SEQ ID NO: 1179343 - RNA, 14 nt, Human
gcagaagacaguau

SEQ ID NO: 1179344 - RNA, 12 nt, Human
gcagaaggaaga

SEQ ID NO: 1179345 - RNA, 13 nt, Human
gcagaaggaagac

SEQ ID NO: 1179346 - RNA, 14 nt, Human
gcagaaggaagacu

SEQ ID NO: 1179347 - RNA, 13 nt, Human
gcaaugaccuuuc

SEQ ID NO: 1179348 - RNA, 14 nt, Human
gcaaugaccuuuca

SEQ ID NO: 1179349 - RNA, 15 nt, Human
gcaaugaccuuucaa

SEQ ID NO: 1179350 - RNA, 20 nt, Human
gcacagccucuuagaugcag

SEQ ID NO: 1179351 - RNA, 19 nt, Human
gcacagcuaacauggaagu

SEQ ID NO: 1179352 - RNA, 16 nt, Human
gcacagcuucauuucc

SEQ ID NO: 1179353 - RNA, 21 nt, Human
gcacagcuucauuuccugugu

SEQ ID NO: 1179354 - RNA, 19 nt, Human
gcaccacugcacuccagcc

SEQ ID NO: 1179355 - RNA, 20 nt, Human
gcaccacugcacuccagccu

SEQ ID NO: 1179356 - RNA, 15 nt, Human
gcacccggccccugc

SEQ ID NO: 1179357 - RNA, 17 nt, Human
gcacccggccccugcug

SEQ ID NO: 1179358 - RNA, 14 nt, Human
gcaccuccugccuc

SEQ ID NO: 1179359 - RNA, 15 nt, Human
gcaccuccugccucg

SEQ ID NO: 1179360 - RNA, 19 nt, Human
gcagccucaaccuccuggg

SEQ ID NO: 1179361 - RNA, 20 nt, Human
gcagccucaaccuccugggc

SEQ ID NO: 1179362 - RNA, 15 nt, Human
gcagccucacagucc

SEQ ID NO: 1179363 - RNA, 21 nt, Human
gcagccucaaccuccugggcu

SEQ ID NO: 1179364 - RNA, 22 nt, Human
gcagccucaaccuccugggcua

SEQ ID NO: 1179365 - RNA, 14 nt, Human
gcagccuggacccu

SEQ ID NO: 1179366 - RNA, 20 nt, Human
gcaggaggaucacuugaguc

SEQ ID NO: 1179367 - RNA, 18 nt, Human
gcagaaggaagacuucau

SEQ ID NO: 1179368 - RNA, 19 nt, Human
gcagagaaugaaagggccc

SEQ ID NO: 1179369 - RNA, 20 nt, Human
gcagagaaugaaagggccca

SEQ ID NO: 1179370 - RNA, 21 nt, Human
gcagagaaugaaagggcccag

SEQ ID NO: 1179371 - RNA, 22 nt, Human
gcagagaaugaaagggcccaga

SEQ ID NO: 1179372 - RNA, 23 nt, Human
gcagagaaugaaagggcccagag

SEQ ID NO: 1179373 - RNA, 21 nt, Human
gcagagaauucucuuauccaa

SEQ ID NO: 1179374 - RNA, 14 nt, Human
gcagagaccauccc

SEQ ID NO: 1179375 - RNA, 15 nt, Human
gcagagaccaucccu

SEQ ID NO: 1179376 - RNA, 17 nt, Human
gcagagaccaucccuga

SEQ ID NO: 1179377 - RNA, 19 nt, Human
gcagagaccaucccugaag

SEQ ID NO: 1179378 - RNA, 15 nt, Human
gcagaguugaagaca

SEQ ID NO: 1179379 - RNA, 16 nt, Human
gcagaguugaagacag

SEQ ID NO: 1179380 - RNA, 17 nt, Human
gcagaguugaagacaga

SEQ ID NO: 1179381 - RNA, 19 nt, Human
gcagaguugaagacagagc

SEQ ID NO: 1179382 - RNA, 20 nt, Human
gcagaguugaagacagagcu

SEQ ID NO: 1179383 - RNA, 12 nt, Human
gcagcaauaaag

SEQ ID NO: 1179384 - RNA, 20 nt, Human
gcaggauucuuccucccucc

SEQ ID NO: 1179385 - RNA, 16 nt, Human
gcagggagggcuucug

SEQ ID NO: 1179386 - RNA, 12 nt, Human
gcagggcucagc

SEQ ID NO: 1179387 - RNA, 14 nt, Human
gcagggcucagcgg

SEQ ID NO: 1179388 - RNA, 23 nt, Human
gcagugcuuccaaggauggacca

SEQ ID NO: 1179389 - RNA, 16 nt, Human
gcagugggagcugccu

SEQ ID NO: 1179390 - RNA, 15 nt, Human
gcauauucaggaagc

SEQ ID NO: 1179391 - RNA, 17 nt, Human
gcauauucaggaagcuc

SEQ ID NO: 1179392 - RNA, 18 nt, Human
gcauauucaggaagcuca

SEQ ID NO: 1179393 - RNA, 20 nt, Human
gcauauucaggaagcucagg

SEQ ID NO: 1179394 - RNA, 21 nt, Human
gcaucaagaugugacauguuu

SEQ ID NO: 1179395 - RNA, 13 nt, Human
gcaguucugaaga

SEQ ID NO: 1179396 - RNA, 14 nt, Human
gcaguucugaagaa

SEQ ID NO: 1179397 - RNA, 17 nt, Human
gcagugggagcugccug

SEQ ID NO: 1179398 - RNA, 18 nt, Human
gcagugggagcugccugu

SEQ ID NO: 1179399 - RNA, 15 nt, Human
gcaugcugucccuua

SEQ ID NO: 1179400 - RNA, 17 nt, Human
gcauguuugugauugac

SEQ ID NO: 1179401 - RNA, 15 nt, Human
gcaucaggccaggcc

SEQ ID NO: 1179402 - RNA, 16 nt, Human
gcaucaggccaggccc

SEQ ID NO: 1179403 - RNA, 17 nt, Human
gcaucaggccaggcccu

SEQ ID NO: 1179404 - RNA, 18 nt, Human
gcaucaggccaggcccuc

SEQ ID NO: 1179405 - RNA, 20 nt, Human
gcaugacacgaauauugcug

SEQ ID NO: 1179406 - RNA, 17 nt, Human
gcaugccuggauggggc

SEQ ID NO: 1179407 - RNA, 22 nt, Human
gcaugccuggauggggcugcac

SEQ ID NO: 1179408 - RNA, 12 nt, Human
gcauuccccacu

SEQ ID NO: 1179409 - RNA, 12 nt, Human
gcauuccccagg

SEQ ID NO: 1179410 - RNA, 23 nt, Human
gcauuugcugaauacagaggcaa

SEQ ID NO: 1179411 - RNA, 21 nt, Human
gcauuuggugguuucagaaau

SEQ ID NO: 1179412 - RNA, 22 nt, Human
gcauuuugcuaaaugugaauga

SEQ ID NO: 1179413 - RNA, 21 nt, Human
gccaaacucaccugccccuca

SEQ ID NO: 1179414 - RNA, 14 nt, Human
gccaaaggaagcac

SEQ ID NO: 1179415 - RNA, 16 nt, Human
gccaaaggaagcacau

SEQ ID NO: 1179416 - RNA, 20 nt, Human
gccaaaggaagcacaugccu

SEQ ID NO: 1179417 - RNA, 17 nt, Human
gccacugcaccgggcca

SEQ ID NO: 1179418 - RNA, 18 nt, Human
gccacugcaccgggccac

SEQ ID NO: 1179419 - RNA, 19 nt, Human
gccacugcaccgggccaca

SEQ ID NO: 1179420 - RNA, 12 nt, Human
gccagagacaca

SEQ ID NO: 1179421 - RNA, 15 nt, Human
gccagagacacaagc

SEQ ID NO: 1179422 - RNA, 16 nt, Human
gccagagacacaagcc

SEQ ID NO: 1179423 - RNA, 18 nt, Human
gccagagggagugacaga

SEQ ID NO: 1179424 - RNA, 13 nt, Human
gccaaagccaaag

SEQ ID NO: 1179425 - RNA, 14 nt, Human
gccacggccaggcc

SEQ ID NO: 1179426 - RNA, 15 nt, Human
gccacggccaggcca

SEQ ID NO: 1179427 - RNA, 16 nt, Human
gccacggccaggccag

SEQ ID NO: 1179428 - RNA, 17 nt, Human
gccacggccaggccaga

SEQ ID NO: 1179429 - RNA, 22 nt, Human
gccacguucuuacuaguuuccc

SEQ ID NO: 1179430 - RNA, 21 nt, Human
gccacuauuguuagucucuug

SEQ ID NO: 1179431 - RNA, 19 nt, Human
gccagagggagugacagag

SEQ ID NO: 1179432 - RNA, 20 nt, Human
gccagagggagugacagagg

SEQ ID NO: 1179433 - RNA, 16 nt, Human
gccagauucuuuccug

SEQ ID NO: 1179434 - RNA, 17 nt, Human
gccagauucuuuccuga

SEQ ID NO: 1179435 - RNA, 19 nt, Human
gccagauucuuuccugagg

SEQ ID NO: 1179436 - RNA, 20 nt, Human
gccagccgagauagccaagg

SEQ ID NO: 1179437 - RNA, 21 nt, Human
gccagccgagauagccaaggc

SEQ ID NO: 1179438 - RNA, 12 nt, Human
gccagccuugac

SEQ ID NO: 1179439 - RNA, 14 nt, Human
gccagccuugacca

SEQ ID NO: 1179440 - RNA, 20 nt, Human
gccagccuugaccauucucc

SEQ ID NO: 1179441 - RNA, 21 nt, Human
gccagccuugaccauucucca

SEQ ID NO: 1179442 - RNA, 22 nt, Human
gccagccuugaccauucuccac

SEQ ID NO: 1179443 - RNA, 14 nt, Human
gccagcugcuuggg

SEQ ID NO: 1179444 - RNA, 15 nt, Human
gccagcugcuugggc

SEQ ID NO: 1179445 - RNA, 16 nt, Human
gccagcugcuugggcu

SEQ ID NO: 1179446 - RNA, 19 nt, Human
gccauccagguucagcuug

SEQ ID NO: 1179447 - RNA, 20 nt, Human
gccauccagguucagcuugu

SEQ ID NO: 1179448 - RNA, 13 nt, Human
gccaucccagccc

SEQ ID NO: 1179449 - RNA, 14 nt, Human
gccaucccagcccc

SEQ ID NO: 1179450 - RNA, 15 nt, Human
gccaucccagcccca

SEQ ID NO: 1179451 - RNA, 16 nt, Human
gccaucccagccccaa

SEQ ID NO: 1179452 - RNA, 17 nt, Human
gccaucccagccccaau

SEQ ID NO: 1179453 - RNA, 11 nt, Human
gccaggaagcc

SEQ ID NO: 1179454 - RNA, 17 nt, Human
gccaggaagccagcagg

SEQ ID NO: 1179455 - RNA, 18 nt, Human
gccaggaagccagcaggc

SEQ ID NO: 1179456 - RNA, 19 nt, Human
gccaggaagccagcaggcu

SEQ ID NO: 1179457 - RNA, 20 nt, Human
gccaggaagccagcaggcuc

SEQ ID NO: 1179458 - RNA, 17 nt, Human
gccaggggaaaaucagc

SEQ ID NO: 1179459 - RNA, 21 nt, Human
gccaggggaaaaucagccugc

SEQ ID NO: 1179460 - RNA, 22 nt, Human
gccaggggaaaaucagccugcu

SEQ ID NO: 1179461 - RNA, 23 nt, Human
gccaggggaaaaucagccugcuc

SEQ ID NO: 1179462 - RNA, 14 nt, Human
gccaugggacaggg

SEQ ID NO: 1179463 - RNA, 19 nt, Human
gccaugggacagggaggac

SEQ ID NO: 1179464 - RNA, 22 nt, Human
gccaugggacagggaggacgcu

SEQ ID NO: 1179465 - RNA, 17 nt, Human
gccauuucuuccacaag

SEQ ID NO: 1179466 - RNA, 20 nt, Human
gccauuucuuccacaagagc

SEQ ID NO: 1179467 - RNA, 22 nt, Human
gccauuucuuccacaagagccc

SEQ ID NO: 1179468 - RNA, 16 nt, Human
gcccaaagaugcagcc

SEQ ID NO: 1179469 - RNA, 16 nt, Human
gccauuuguguuuaua

SEQ ID NO: 1179470 - RNA, 16 nt, Human
gcccacagcuguauga

SEQ ID NO: 1179471 - RNA, 13 nt, Human
gcccacaggauca

SEQ ID NO: 1179472 - RNA, 18 nt, Human
gcccacaggaucagucug

SEQ ID NO: 1179473 - RNA, 19 nt, Human
gcccacaggaucagucuga

SEQ ID NO: 1179474 - RNA, 15 nt, Human
gcccaccccucaaca

SEQ ID NO: 1179475 - RNA, 11 nt, Human
gcccaggcugg

SEQ ID NO: 1179476 - RNA, 12 nt, Human
gcccaggaaagg

SEQ ID NO: 1179477 - RNA, 15 nt, Human
gcccaggaaaggcuc

SEQ ID NO: 1179478 - RNA, 16 nt, Human
gcccaggaaaggcucc

SEQ ID NO: 1179479 - RNA, 18 nt, Human
gcccaggccuccuacagc

SEQ ID NO: 1179480 - RNA, 14 nt, Human
gcccaggcuggcgu

SEQ ID NO: 1179481 - RNA, 15 nt, Human
gcccaggcuggcgug

SEQ ID NO: 1179482 - RNA, 16 nt, Human
gcccaggcuggcgugc

SEQ ID NO: 1179483 - RNA, 22 nt, Human
gcccagucuggaaugcaguggu

SEQ ID NO: 1179484 - RNA, 15 nt, Human
gcccaguugggugga

SEQ ID NO: 1179485 - RNA, 16 nt, Human
gccccagugcccacag

SEQ ID NO: 1179486 - RNA, 17 nt, Human
gccccagugcccacagg

SEQ ID NO: 1179487 - RNA, 21 nt, Human
gccccagugcccacaggauca

SEQ ID NO: 1179488 - RNA, 23 nt, Human
gccccauccucuguacagagccc

SEQ ID NO: 1179489 - RNA, 17 nt, Human
gccccauucugccugcc

SEQ ID NO: 1179490 - RNA, 18 nt, Human
gccccauucugccugccc

SEQ ID NO: 1179491 - RNA, 20 nt, Human
gccccauucugccugcccag

SEQ ID NO: 1179492 - RNA, 21 nt, Human
gccccauucugccugcccagg

SEQ ID NO: 1179493 - RNA, 17 nt, Human
gccccgugggguuccuc

SEQ ID NO: 1179494 - RNA, 22 nt, Human
gccccauucugccugcccaggc

SEQ ID NO: 1179495 - RNA, 23 nt, Human
gccccauucugccugcccaggcc

SEQ ID NO: 1179496 - RNA, 23 nt, Human
gccccgaggccuucucugaagga

SEQ ID NO: 1179497 - RNA, 14 nt, Human
gccccgcccaggcu

SEQ ID NO: 1179498 - RNA, 19 nt, Human
gccccugcacuccagccug

SEQ ID NO: 1179499 - RNA, 23 nt, Human
gccccuggcagccccuguucugg

SEQ ID NO: 1179500 - RNA, 23 nt, Human
gccccucaacucuccuccagagu

SEQ ID NO: 1179501 - RNA, 19 nt, Human
gccccucagggucccuggu

SEQ ID NO: 1179502 - RNA, 21 nt, Human
gccccucagggucccuggugg

SEQ ID NO: 1179503 - RNA, 19 nt, Human
gcccgggcucugccuccca

SEQ ID NO: 1179504 - RNA, 20 nt, Human
gcccgggcucugccucccau

SEQ ID NO: 1179505 - RNA, 21 nt, Human
gcccgggcucugccucccauc

SEQ ID NO: 1179506 - RNA, 22 nt, Human
gcccucugcccacucccugcaa

SEQ ID NO: 1179507 - RNA, 19 nt, Human
gccccuucugacccaugcu

SEQ ID NO: 1179508 - RNA, 20 nt, Human
gccccuucugacccaugcug

SEQ ID NO: 1179509 - RNA, 13 nt, Human
gcccggcuccagg

SEQ ID NO: 1179510 - RNA, 14 nt, Human
gcccggcuccaggc

SEQ ID NO: 1179511 - RNA, 15 nt, Human
gcccggcuccaggcu

SEQ ID NO: 1179512 - RNA, 13 nt, Human
gcccgggcucugc

SEQ ID NO: 1179513 - RNA, 14 nt, Human
gcccgggcucugcc

SEQ ID NO: 1179514 - RNA, 15 nt, Human
gcccgggcucugccu

SEQ ID NO: 1179515 - RNA, 18 nt, Human
gcccgggcucugccuccc

SEQ ID NO: 1179516 - RNA, 13 nt, Human
gcccuucucucca

SEQ ID NO: 1179517 - RNA, 19 nt, Human
gcccuucuuuccacagaag

SEQ ID NO: 1179518 - RNA, 16 nt, Human
gccgagauagccaagg

SEQ ID NO: 1179519 - RNA, 17 nt, Human
gccgagauagccaaggc

SEQ ID NO: 1179520 - RNA, 19 nt, Human
gccgagauagccaaggcca

SEQ ID NO: 1179521 - RNA, 15 nt, Human
gccgcagcccugcag

SEQ ID NO: 1179522 - RNA, 16 nt, Human
gccgcagcccugcaga

SEQ ID NO: 1179523 - RNA, 17 nt, Human
gccgcagcccugcagag

SEQ ID NO: 1179524 - RNA, 19 nt, Human
gccgcagcccugcagaggg

SEQ ID NO: 1179525 - RNA, 20 nt, Human
gccgucuaccugaggggccu

SEQ ID NO: 1179526 - RNA, 22 nt, Human
gccgucuaccugaggggccucu

SEQ ID NO: 1179527 - RNA, 23 nt, Human
gccgucuaccugaggggccucuu

SEQ ID NO: 1179528 - RNA, 24 nt, Human
gccucaagugauucuccugccuca

SEQ ID NO: 1179529 - RNA, 18 nt, Human
gccucagcauccuggcac

SEQ ID NO: 1179530 - RNA, 21 nt, Human
gccucagcauccuggcacccg

SEQ ID NO: 1179531 - RNA, 21 nt, Human
gccucugcacuccccugcugg

SEQ ID NO: 1179532 - RNA, 15 nt, Human
gccugaagucacaca

SEQ ID NO: 1179533 - RNA, 15 nt, Human
gccucugacacacag

SEQ ID NO: 1179534 - RNA, 16 nt, Human
gccucugacacacagc

SEQ ID NO: 1179535 - RNA, 16 nt, Human
gccucugcacuccccu

SEQ ID NO: 1179536 - RNA, 17 nt, Human
gccucugcacuccccug

SEQ ID NO: 1179537 - RNA, 18 nt, Human
gccucugcacuccccugc

SEQ ID NO: 1179538 - RNA, 19 nt, Human
gccucugcacuccccugcu

SEQ ID NO: 1179539 - RNA, 20 nt, Human
gccucugcacuccccugcug

SEQ ID NO: 1179540 - RNA, 11 nt, Human
gccugcccagg

SEQ ID NO: 1179541 - RNA, 12 nt, Human
gccugcccaggc

SEQ ID NO: 1179542 - RNA, 12 nt, Human
gccucagccucc

SEQ ID NO: 1179543 - RNA, 14 nt, Human
gccucagccuccca

SEQ ID NO: 1179544 - RNA, 22 nt, Human
gccucagccucccaaagugcug

SEQ ID NO: 1179545 - RNA, 18 nt, Human
gccucccgaauagcuggg

SEQ ID NO: 1179546 - RNA, 19 nt, Human
gccucccgaauagcuggga

SEQ ID NO: 1179547 - RNA, 20 nt, Human
gccucccgaauagcugggac

SEQ ID NO: 1179548 - RNA, 21 nt, Human
gccucccgaauagcugggacu

SEQ ID NO: 1179549 - RNA, 21 nt, Human
gccucccgaguagcugggacu

SEQ ID NO: 1179550 - RNA, 23 nt, Human
gccucccgaguagcugggacuac

SEQ ID NO: 1179551 - RNA, 15 nt, Human
gccucucccaucacu

SEQ ID NO: 1179552 - RNA, 21 nt, Human
gccuuauggaacacucugaga

SEQ ID NO: 1179553 - RNA, 22 nt, Human
gccuuauggaacacucugagac

SEQ ID NO: 1179554 - RNA, 23 nt, Human
gccuuauggaacacucugagacu

SEQ ID NO: 1179555 - RNA, 15 nt, Human
gccugguggcagcug

SEQ ID NO: 1179556 - RNA, 16 nt, Human
gccugguggcagcugc

SEQ ID NO: 1179557 - RNA, 17 nt, Human
gccugguggcagcugcg

SEQ ID NO: 1179558 - RNA, 18 nt, Human
gccugguggcagcugcgg

SEQ ID NO: 1179559 - RNA, 18 nt, Human
gccuguaaucacagcuac

SEQ ID NO: 1179560 - RNA, 18 nt, Human
gccuucggccuccauccu

SEQ ID NO: 1179561 - RNA, 19 nt, Human
gccuucggccuccauccug

SEQ ID NO: 1179562 - RNA, 18 nt, Human
gccuuggggcugaugcag

SEQ ID NO: 1179563 - RNA, 17 nt, Human
gcgcugccccuggcagc

SEQ ID NO: 1179564 - RNA, 14 nt, Human
gcgcugccccuggc

SEQ ID NO: 1179565 - RNA, 20 nt, Human
gcgccuacaggagugagcac

SEQ ID NO: 1179566 - RNA, 21 nt, Human
gcgccuacaggagugagcacu

SEQ ID NO: 1179567 - RNA, 19 nt, Human
gcggaaugaaccacaucuu

SEQ ID NO: 1179568 - RNA, 19 nt, Human
gcggacagccacggccagg

SEQ ID NO: 1179569 - RNA, 23 nt, Human
gcggacagccacggccaggccag

SEQ ID NO: 1179570 - RNA, 19 nt, Human
gcggggacagcuccuucug

SEQ ID NO: 1179571 - RNA, 23 nt, Human
gcggggacagcuccuucuguccu

SEQ ID NO: 1179572 - RNA, 23 nt, Human
gcgguccacccaggagccccgag

SEQ ID NO: 1179573 - RNA, 16 nt, Human
gcgugagccacugcac

SEQ ID NO: 1179574 - RNA, 15 nt, Human
gcgugagccacugca

SEQ ID NO: 1179575 - RNA, 14 nt, Human
gcgugagccacugc

SEQ ID NO: 1179576 - RNA, 17 nt, Human
gcuaacauggaaguacu

SEQ ID NO: 1179577 - RNA, 18 nt, Human
gcuaacauggaaguacua

SEQ ID NO: 1179578 - RNA, 21 nt, Human
gcuagacgagcaggcuucuuc

SEQ ID NO: 1179579 - RNA, 22 nt, Human
gcuagacgagcaggcuucuucc

SEQ ID NO: 1179580 - RNA, 22 nt, Human
gcuagcagcagggagggcuucu

SEQ ID NO: 1179581 - RNA, 11 nt, Human
gcugcccugug

SEQ ID NO: 1179582 - RNA, 18 nt, Human
gcuagauguauguacuuc

SEQ ID NO: 1179583 - RNA, 12 nt, Human
gcugcccuguga

SEQ ID NO: 1179584 - RNA, 14 nt, Human
gcugcccugugagu

SEQ ID NO: 1179585 - RNA, 17 nt, Human
gcugcgguccacccagg

SEQ ID NO: 1179586 - RNA, 18 nt, Human
gcugcgguccacccagga

SEQ ID NO: 1179587 - RNA, 19 nt, Human
gcugcgguccacccaggag

SEQ ID NO: 1179588 - RNA, 13 nt, Human
gcugcuucaagga

SEQ ID NO: 1179589 - RNA, 21 nt, Human
gcugcuucaaggauccugagc

SEQ ID NO: 1179590 - RNA, 22 nt, Human
gcugcuucaaggauccugagcc

SEQ ID NO: 1179591 - RNA, 23 nt, Human
gcugcuucaaggauccugagcca

SEQ ID NO: 1179592 - RNA, 16 nt, Human
gcugcuugggcuucau

SEQ ID NO: 1179593 - RNA, 12 nt, Human
gcuggccuggcc

SEQ ID NO: 1179594 - RNA, 20 nt, Human
gcugggacaugggaaagggg

SEQ ID NO: 1179595 - RNA, 13 nt, Human
gcugggacuacag

SEQ ID NO: 1179596 - RNA, 18 nt, Human
gcugggacuacaggcacc

SEQ ID NO: 1179597 - RNA, 19 nt, Human
gcugggacuacaggcaccc

SEQ ID NO: 1179598 - RNA, 20 nt, Human
gcugggacuacaggcaccca

SEQ ID NO: 1179599 - RNA, 19 nt, Human
gcugggacuacagguguga

SEQ ID NO: 1179600 - RNA, 17 nt, Human
gcugcuugggcuucauc

SEQ ID NO: 1179601 - RNA, 22 nt, Human
gcugcuugggcuucauccuccu

SEQ ID NO: 1179602 - RNA, 18 nt, Human
gcuggaccuugaacuggg

SEQ ID NO: 1179603 - RNA, 21 nt, Human
gcuggaccuugaacuggguac

SEQ ID NO: 1179604 - RNA, 22 nt, Human
gcuggaccuugaacuggguacu

SEQ ID NO: 1179605 - RNA, 17 nt, Human
gcugggcuucaguggca

SEQ ID NO: 1179606 - RNA, 12 nt, Human
gcugggagagcc

SEQ ID NO: 1179607 - RNA, 13 nt, Human
gcugggagagccu

SEQ ID NO: 1179608 - RNA, 17 nt, Human
gcugggagagccuucca

SEQ ID NO: 1179609 - RNA, 18 nt, Human
gcugggagagccuuccag

SEQ ID NO: 1179610 - RNA, 19 nt, Human
gcugggagagccuuccagg

SEQ ID NO: 1179611 - RNA, 22 nt, Human
gcugggagagccuuccaggggu

SEQ ID NO: 1179612 - RNA, 18 nt, Human
gcugggcuucaguggcag

SEQ ID NO: 1179613 - RNA, 19 nt, Human
gcugggcuucaguggcagc

SEQ ID NO: 1179614 - RNA, 12 nt, Human
gcuggggccagu

SEQ ID NO: 1179615 - RNA, 23 nt, Human
gcugggggaagaagcucucuccu

SEQ ID NO: 1179616 - RNA, 19 nt, Human
gcugggggccucagugcca

SEQ ID NO: 1179617 - RNA, 20 nt, Human
gcugggggccucagugccac

SEQ ID NO: 1179618 - RNA, 13 nt, Human
gcugggggccuca

SEQ ID NO: 1179619 - RNA, 15 nt, Human
gcuggucccacucag

SEQ ID NO: 1179620 - RNA, 19 nt, Human
gcuggucccacucagucca

SEQ ID NO: 1179621 - RNA, 20 nt, Human
gcuggucccacucaguccau

SEQ ID NO: 1179622 - RNA, 17 nt, Human
gcugggguggggaccuc

SEQ ID NO: 1179623 - RNA, 18 nt, Human
gcuggugucaccugaaga

SEQ ID NO: 1179624 - RNA, 21 nt, Human
gcugguuagagguucccuuug

SEQ ID NO: 1179625 - RNA, 15 nt, Human
gcugguucaggguug

SEQ ID NO: 1179626 - RNA, 22 nt, Human
gcugguucaggguuggccccug

SEQ ID NO: 1179627 - RNA, 16 nt, Human
gcugucaauuacagga

SEQ ID NO: 1179628 - RNA, 17 nt, Human
gcugucaauuacaggaa

SEQ ID NO: 1179629 - RNA, 19 nt, Human
gcugucaauuacaggaagu

SEQ ID NO: 1179630 - RNA, 22 nt, Human
gcugucaauuacaggaaguacu

SEQ ID NO: 1179631 - RNA, 23 nt, Human
gcugucaauuacaggaaguacug

SEQ ID NO: 1179632 - RNA, 19 nt, Human
gcugucccuuacgugaguc

SEQ ID NO: 1179633 - RNA, 21 nt, Human
gcugucccuuacgugaguccu

SEQ ID NO: 1179634 - RNA, 22 nt, Human
gcugucccuuacgugaguccug

SEQ ID NO: 1179635 - RNA, 17 nt, Human
gcuugcccuggugccuc

SEQ ID NO: 1179636 - RNA, 19 nt, Human
gcuugcccuggugccucac

SEQ ID NO: 1179637 - RNA, 13 nt, Human
gcuuggaggaagg

SEQ ID NO: 1179638 - RNA, 14 nt, Human
gcuuggaggaagga

SEQ ID NO: 1179639 - RNA, 15 nt, Human
gcuuggaggaaggaa

SEQ ID NO: 1179640 - RNA, 13 nt, Human
gcuguucagcugg

SEQ ID NO: 1179641 - RNA, 19 nt, Human
gcuuccagugaggcucugc

SEQ ID NO: 1179642 - RNA, 20 nt, Human
gcuuccagugaggcucugcc

SEQ ID NO: 1179643 - RNA, 21 nt, Human
gcuuccagugaggcucugccc

SEQ ID NO: 1179644 - RNA, 22 nt, Human
gcuuccagugaggcucugcccu

SEQ ID NO: 1179645 - RNA, 17 nt, Human
gcuucucacugccaugc

SEQ ID NO: 1179646 - RNA, 20 nt, Human
ggaaaaaauaacaaugaaag

SEQ ID NO: 1179647 - RNA, 14 nt, Human
gcuuuuacuuaaac

SEQ ID NO: 1179648 - RNA, 15 nt, Human
ggaaaaauagccugc

SEQ ID NO: 1179649 - RNA, 14 nt, Human
ggaaaaacugauuu

SEQ ID NO: 1179650 - RNA, 13 nt, Human
ggaaaaauagccu

SEQ ID NO: 1179651 - RNA, 19 nt, Human
ggaacagacuggaagcaca

SEQ ID NO: 1179652 - RNA, 20 nt, Human
ggaacagacuggaagcacag

SEQ ID NO: 1179653 - RNA, 14 nt, Human
ggaaaauaaauuau

SEQ ID NO: 1179654 - RNA, 15 nt, Human
ggaaaaucagccugc

SEQ ID NO: 1179655 - RNA, 12 nt, Human
ggaaauauuuau

SEQ ID NO: 1179656 - RNA, 13 nt, Human
ggaaauauuuauu

SEQ ID NO: 1179657 - RNA, 15 nt, Human
ggaaauauuuauuuu

SEQ ID NO: 1179658 - RNA, 17 nt, Human
ggaaauauuuauuuuaa

SEQ ID NO: 1179659 - RNA, 18 nt, Human
ggaaauauuuauuuuaau

SEQ ID NO: 1179660 - RNA, 21 nt, Human
ggaagcacaugccucucucag

SEQ ID NO: 1179661 - RNA, 22 nt, Human
ggaagcacaugccucucucagg

SEQ ID NO: 1179662 - RNA, 23 nt, Human
ggaagcacaugccucucucaggc

SEQ ID NO: 1179663 - RNA, 13 nt, Human
ggaagccagcagg

SEQ ID NO: 1179664 - RNA, 14 nt, Human
ggaagccagcaggc

SEQ ID NO: 1179665 - RNA, 15 nt, Human
ggaagccagcaggcu

SEQ ID NO: 1179666 - RNA, 16 nt, Human
ggaagccagcaggcuc

SEQ ID NO: 1179667 - RNA, 17 nt, Human
ggaagccagcaggcucu

SEQ ID NO: 1179668 - RNA, 18 nt, Human
ggaagccagcaggcucuc

SEQ ID NO: 1179669 - RNA, 13 nt, Human
ggaagagccuugc

SEQ ID NO: 1179670 - RNA, 17 nt, Human
ggaagcacagcuucauu

SEQ ID NO: 1179671 - RNA, 13 nt, Human
ggaagcacaugcc

SEQ ID NO: 1179672 - RNA, 14 nt, Human
ggaagcacaugccu

SEQ ID NO: 1179673 - RNA, 15 nt, Human
ggaagcacaugccuc

SEQ ID NO: 1179674 - RNA, 17 nt, Human
ggaagcacaugccucuc

SEQ ID NO: 1179675 - RNA, 20 nt, Human
ggaagccagcaggcucucag

SEQ ID NO: 1179676 - RNA, 21 nt, Human
ggagagcuagcagcagggagg

SEQ ID NO: 1179677 - RNA, 15 nt, Human
ggagaggggcacagg

SEQ ID NO: 1179678 - RNA, 20 nt, Human
ggagauuuacaacuggggga

SEQ ID NO: 1179679 - RNA, 20 nt, Human
ggagcaaaaucgaugcagug

SEQ ID NO: 1179680 - RNA, 20 nt, Human
ggaggacgcucucuggccuu

SEQ ID NO: 1179681 - RNA, 21 nt, Human
ggaggacgcucucuggccuuc

SEQ ID NO: 1179682 - RNA, 23 nt, Human
ggaggaucacuugaguccagaag

SEQ ID NO: 1179683 - RNA, 17 nt, Human
ggaggaucucuugagcc

SEQ ID NO: 1179684 - RNA, 21 nt, Human
ggaggaucucuugagccuggg

SEQ ID NO: 1179685 - RNA, 15 nt, Human
ggaggauguucuggg

SEQ ID NO: 1179686 - RNA, 12 nt, Human
ggagggagggcu

SEQ ID NO: 1179687 - RNA, 12 nt, Human
ggagggcuccag

SEQ ID NO: 1179688 - RNA, 13 nt, Human
ggagggcuccaga

SEQ ID NO: 1179689 - RNA, 14 nt, Human
ggagggcuccagac

SEQ ID NO: 1179690 - RNA, 15 nt, Human
ggagggcuccagaca

SEQ ID NO: 1179691 - RNA, 17 nt, Human
ggagggcuccagacaca

SEQ ID NO: 1179692 - RNA, 19 nt, Human
ggaggggagcaugggaagu

SEQ ID NO: 1179693 - RNA, 20 nt, Human
ggagucccaccuuggcugca

SEQ ID NO: 1179694 - RNA, 21 nt, Human
ggagucccaccuuggcugcag

SEQ ID NO: 1179695 - RNA, 11 nt, Human
ggagugacaga

SEQ ID NO: 1179696 - RNA, 16 nt, Human
ggagugacagaggcag

SEQ ID NO: 1179697 - RNA, 17 nt, Human
ggagugacagaggcagc

SEQ ID NO: 1179698 - RNA, 18 nt, Human
ggagugacagaggcagcc

SEQ ID NO: 1179699 - RNA, 19 nt, Human
ggagugacagaggcagccc

SEQ ID NO: 1179700 - RNA, 21 nt, Human
ggagugacagaggcagcccca

SEQ ID NO: 1179701 - RNA, 12 nt, Human
ggagugagcugg

SEQ ID NO: 1179702 - RNA, 14 nt, Human
ggagugagcugguu

SEQ ID NO: 1179703 - RNA, 21 nt, Human
ggagugaguugauagcacaga

SEQ ID NO: 1179704 - RNA, 23 nt, Human
ggagugaguugauagcacagacc

SEQ ID NO: 1179705 - RNA, 16 nt, Human
ggaucacagccucuga

SEQ ID NO: 1179706 - RNA, 19 nt, Human
ggcaacugcauuggcuuug

SEQ ID NO: 1179707 - RNA, 18 nt, Human
ggcaacugcauuggcuuu

SEQ ID NO: 1179708 - RNA, 21 nt, Human
ggaucagucugauucccaagc

SEQ ID NO: 1179709 - RNA, 16 nt, Human
ggcaaggcugucaauu

SEQ ID NO: 1179710 - RNA, 15 nt, Human
ggcacccggccccug

SEQ ID NO: 1179711 - RNA, 16 nt, Human
ggcacccggccccugc

SEQ ID NO: 1179712 - RNA, 17 nt, Human
ggcacccggccccugcu

SEQ ID NO: 1179713 - RNA, 15 nt, Human
ggcagagcagagacc

SEQ ID NO: 1179714 - RNA, 16 nt, Human
ggcagagcagagacca

SEQ ID NO: 1179715 - RNA, 20 nt, Human
ggcagagcagagaccauccc

SEQ ID NO: 1179716 - RNA, 22 nt, Human
ggcagagcagagaccaucccug

SEQ ID NO: 1179717 - RNA, 13 nt, Human
ggcagguccaggg

SEQ ID NO: 1179718 - RNA, 23 nt, Human
ggcaggucuugaacuccuggccu

SEQ ID NO: 1179719 - RNA, 18 nt, Human
ggcagcucaccucucccu

SEQ ID NO: 1179720 - RNA, 21 nt, Human
ggcagcucaccucucccuugg

SEQ ID NO: 1179721 - RNA, 22 nt, Human
ggcagcucaccucucccuugga

SEQ ID NO: 1179722 - RNA, 13 nt, Human
ggcagcucagaga

SEQ ID NO: 1179723 - RNA, 19 nt, Human
ggcagcugcgguccaccca

SEQ ID NO: 1179724 - RNA, 21 nt, Human
ggcagcugcgguccacccagg

SEQ ID NO: 1179725 - RNA, 21 nt, Human
ggcagcuugaggguugggcug

SEQ ID NO: 1179726 - RNA, 17 nt, Human
ggcagaggaaagcaaag

SEQ ID NO: 1179727 - RNA, 23 nt, Human
ggcagaguugaagacagagcuac

SEQ ID NO: 1179728 - RNA, 23 nt, Human
ggcagauacaggaaaagcugcug

SEQ ID NO: 1179729 - RNA, 11 nt, Human
ggccaggcugg

SEQ ID NO: 1179730 - RNA, 14 nt, Human
ggccaggccagagg

SEQ ID NO: 1179731 - RNA, 16 nt, Human
ggccaggccagaggga

SEQ ID NO: 1179732 - RNA, 11 nt, Human
ggccacuguga

SEQ ID NO: 1179733 - RNA, 16 nt, Human
ggccacugugaagaga

SEQ ID NO: 1179734 - RNA, 20 nt, Human
ggccacugugaagagaacca

SEQ ID NO: 1179735 - RNA, 16 nt, Human
ggccaggagccuccug

SEQ ID NO: 1179736 - RNA, 15 nt, Human
ggcagguuggugggg

SEQ ID NO: 1179737 - RNA, 17 nt, Human
ggcagguuggugggggc

SEQ ID NO: 1179738 - RNA, 15 nt, Human
ggcauuccccaggag

SEQ ID NO: 1179739 - RNA, 16 nt, Human
ggcauuccccaggagg

SEQ ID NO: 1179740 - RNA, 16 nt, Human
ggccacaagacccuug

SEQ ID NO: 1179741 - RNA, 17 nt, Human
ggccacaagacccuugu

SEQ ID NO: 1179742 - RNA, 16 nt, Human
ggccaccugcggugcu

SEQ ID NO: 1179743 - RNA, 22 nt, Human
ggccaccugcggugcuaucucc

SEQ ID NO: 1179744 - RNA, 12 nt, Human
ggccaggcuggu

SEQ ID NO: 1179745 - RNA, 14 nt, Human
ggccaggcccucug

SEQ ID NO: 1179746 - RNA, 22 nt, Human
ggccaugggacagggaggacgc

SEQ ID NO: 1179747 - RNA, 13 nt, Human
ggccaugggccuc

SEQ ID NO: 1179748 - RNA, 16 nt, Human
ggccaugggccuccug

SEQ ID NO: 1179749 - RNA, 16 nt, Human
ggccccucaggguccc

SEQ ID NO: 1179750 - RNA, 19 nt, Human
ggccccucagggucccugg

SEQ ID NO: 1179751 - RNA, 20 nt, Human
ggccccucagggucccuggu

SEQ ID NO: 1179752 - RNA, 21 nt, Human
ggccccucagggucccuggug

SEQ ID NO: 1179753 - RNA, 12 nt, Human
ggccccugccac

SEQ ID NO: 1179754 - RNA, 13 nt, Human
ggccccugccacc

SEQ ID NO: 1179755 - RNA, 16 nt, Human
ggccccugccacccug

SEQ ID NO: 1179756 - RNA, 17 nt, Human
ggccccugccacccugg

SEQ ID NO: 1179757 - RNA, 18 nt, Human
ggccccugccacccuggg

SEQ ID NO: 1179758 - RNA, 13 nt, Human
ggccccugcccgg

SEQ ID NO: 1179759 - RNA, 21 nt, Human
ggcuuagucacugagacagcc

SEQ ID NO: 1179760 - RNA, 17 nt, Human
ggcugggcucccuuccc

SEQ ID NO: 1179761 - RNA, 18 nt, Human
ggcugggcucccuuccca

SEQ ID NO: 1179762 - RNA, 12 nt, Human
ggcugggcuuca

SEQ ID NO: 1179763 - RNA, 13 nt, Human
ggcugggcuucag

SEQ ID NO: 1179764 - RNA, 17 nt, Human
ggcugggcuucaguggc

SEQ ID NO: 1179765 - RNA, 18 nt, Human
ggcugggcuucaguggca

SEQ ID NO: 1179766 - RNA, 10 nt, Human
ggcuuuugug

SEQ ID NO: 1179767 - RNA, 22 nt, Human
ggcuugaguuuaaauuguaaua

SEQ ID NO: 1179768 - RNA, 21 nt, Human
ggcuuggggaccagagcugcc

SEQ ID NO: 1179769 - RNA, 14 nt, Human
ggcuuuugugcauu

SEQ ID NO: 1179770 - RNA, 21 nt, Human
gggaaggauacaaaagcaugu

SEQ ID NO: 1179771 - RNA, 23 nt, Human
gggaaggauacaaaagcauguga

SEQ ID NO: 1179772 - RNA, 14 nt, Human
gggaagggggcugg

SEQ ID NO: 1179773 - RNA, 16 nt, Human
gggaagggggcuggga

SEQ ID NO: 1179774 - RNA, 17 nt, Human
gggaagggggcugggac

SEQ ID NO: 1179775 - RNA, 12 nt, Human
gggaccucaggc

SEQ ID NO: 1179776 - RNA, 13 nt, Human
gggaccucaggcc

SEQ ID NO: 1179777 - RNA, 15 nt, Human
gggaccucaggccug

SEQ ID NO: 1179778 - RNA, 17 nt, Human
gggacuacaggcaccca

SEQ ID NO: 1179779 - RNA, 16 nt, Human
gggacucaaugcacug

SEQ ID NO: 1179780 - RNA, 13 nt, Human
ggcugggcagagg

SEQ ID NO: 1179781 - RNA, 14 nt, Human
ggcugggcagagga

SEQ ID NO: 1179782 - RNA, 20 nt, Human
ggcugggagagccuuccagg

SEQ ID NO: 1179783 - RNA, 23 nt, Human
ggcugggagagccuuccaggggu

SEQ ID NO: 1179784 - RNA, 15 nt, Human
ggcugggcagaggaa

SEQ ID NO: 1179785 - RNA, 19 nt, Human
ggcugggcagaggaaagca

SEQ ID NO: 1179786 - RNA, 23 nt, Human
ggcugcuucaaggauccugagcc

SEQ ID NO: 1179787 - RNA, 19 nt, Human
ggcugggagagccuuccag

SEQ ID NO: 1179788 - RNA, 12 nt, Human
ggcugcagggag

SEQ ID NO: 1179789 - RNA, 13 nt, Human
ggcugcagggagu

SEQ ID NO: 1179790 - RNA, 14 nt, Human
ggcugcugaaggcu

SEQ ID NO: 1179791 - RNA, 15 nt, Human
ggcugcugaaggcuc

SEQ ID NO: 1179792 - RNA, 17 nt, Human
ggcugcugaaggcucga

SEQ ID NO: 1179793 - RNA, 18 nt, Human
ggcugcugaaggcucgag

SEQ ID NO: 1179794 - RNA, 17 nt, Human
ggcugcagggaguccga

SEQ ID NO: 1179795 - RNA, 11 nt, Human
ggcugcuucaa

SEQ ID NO: 1179796 - RNA, 12 nt, Human
ggcugcuucaag

SEQ ID NO: 1179797 - RNA, 14 nt, Human
ggcugcuucaagga

SEQ ID NO: 1179798 - RNA, 22 nt, Human
ggcugcuucaaggauccugagc

SEQ ID NO: 1179799 - RNA, 16 nt, Human
ggccccugcccggcug

SEQ ID NO: 1179800 - RNA, 17 nt, Human
ggccccugcccggcugc

SEQ ID NO: 1179801 - RNA, 20 nt, Human
ggccccugcccggcugcgga

SEQ ID NO: 1179802 - RNA, 13 nt, Human
ggcugagguggga

SEQ ID NO: 1179803 - RNA, 15 nt, Human
ggcugaggugggagg

SEQ ID NO: 1179804 - RNA, 18 nt, Human
ggcugcaaaggguaucag

SEQ ID NO: 1179805 - RNA, 22 nt, Human
ggcugcaaaggguaucaggugc

SEQ ID NO: 1179806 - RNA, 23 nt, Human
ggcugcaaaggguaucaggugcu

SEQ ID NO: 1179807 - RNA, 24 nt, Human
ggcugcaaaggguaucaggugcug

SEQ ID NO: 1179808 - RNA, 17 nt, Human
ggcugcaccggcuggcc

SEQ ID NO: 1179809 - RNA, 18 nt, Human
ggcugcaccggcuggccu

SEQ ID NO: 1179810 - RNA, 19 nt, Human
ggcugcaccggcuggccug

SEQ ID NO: 1179811 - RNA, 16 nt, Human
gggcacucagaagaca

SEQ ID NO: 1179812 - RNA, 19 nt, Human
gggcacucagaagacacug

SEQ ID NO: 1179813 - RNA, 13 nt, Human
gggcacagggucu

SEQ ID NO: 1179814 - RNA, 16 nt, Human
gggcacagggucucua

SEQ ID NO: 1179815 - RNA, 23 nt, Human
gggcacaccgggcacucagaaga

SEQ ID NO: 1179816 - RNA, 18 nt, Human
gggcacagaaaauggaag

SEQ ID NO: 1179817 - RNA, 20 nt, Human
gggcacagaaaauggaagac

SEQ ID NO: 1179818 - RNA, 21 nt, Human
gggcacagaaaauggaagaca

SEQ ID NO: 1179819 - RNA, 20 nt, Human
gggcacucagaagacacuga

SEQ ID NO: 1179820 - RNA, 14 nt, Human
gggcagaaggaaga

SEQ ID NO: 1179821 - RNA, 18 nt, Human
gggcagaaggaagacuuc

SEQ ID NO: 1179822 - RNA, 11 nt, Human
gggcagagcag

SEQ ID NO: 1179823 - RNA, 12 nt, Human
gggcagagcaga

SEQ ID NO: 1179824 - RNA, 17 nt, Human
gggcagguugguggggg

SEQ ID NO: 1179825 - RNA, 16 nt, Human
gggaggugaccccagg

SEQ ID NO: 1179826 - RNA, 17 nt, Human
gggaggugggauccucc

SEQ ID NO: 1179827 - RNA, 20 nt, Human
gggaggugggauccuccagg

SEQ ID NO: 1179828 - RNA, 18 nt, Human
gggagugacagaggcagc

SEQ ID NO: 1179829 - RNA, 11 nt, Human
gggagugagcu

SEQ ID NO: 1179830 - RNA, 14 nt, Human
gggagugagcuggu

SEQ ID NO: 1179831 - RNA, 13 nt, Human
gggauagagagag

SEQ ID NO: 1179832 - RNA, 21 nt, Human
gggauaugauuuaaaucagcc

SEQ ID NO: 1179833 - RNA, 15 nt, Human
gggauccuccaggug

SEQ ID NO: 1179834 - RNA, 16 nt, Human
gggauccuccaggugc

SEQ ID NO: 1179835 - RNA, 23 nt, Human
gggauccuggaguucugguuccu

SEQ ID NO: 1179836 - RNA, 18 nt, Human
gggcaacccuggugacca

SEQ ID NO: 1179837 - RNA, 12 nt, Human
gggcaugacacg

SEQ ID NO: 1179838 - RNA, 16 nt, Human
gggccacagagaaagu

SEQ ID NO: 1179839 - RNA, 23 nt, Human
gggccacagagaaaguacuucuc

SEQ ID NO: 1179840 - RNA, 17 nt, Human
gggcccagagagggugg

SEQ ID NO: 1179841 - RNA, 13 nt, Human
gggcccugccucc

SEQ ID NO: 1179842 - RNA, 13 nt, Human
gggccuggccuga

SEQ ID NO: 1179843 - RNA, 14 nt, Human
gggccuggccugag

SEQ ID NO: 1179844 - RNA, 18 nt, Human
gggccuggccugagcugg

SEQ ID NO: 1179845 - RNA, 13 nt, Human
gggccuggcuccc

SEQ ID NO: 1179846 - RNA, 19 nt, Human
gggccuggccugagcuggg

SEQ ID NO: 1179847 - RNA, 16 nt, Human
ggggaaaaucagccug

SEQ ID NO: 1179848 - RNA, 17 nt, Human
ggggaaaaucagccugc

SEQ ID NO: 1179849 - RNA, 19 nt, Human
ggggaaaaucagccugcuc

SEQ ID NO: 1179850 - RNA, 21 nt, Human
ggggaaaaucagccugcucca

SEQ ID NO: 1179851 - RNA, 24 nt, Human
ggggaaaaucagccugcuccagcu

SEQ ID NO: 1179852 - RNA, 16 nt, Human
ggggcaacccugguga

SEQ ID NO: 1179853 - RNA, 17 nt, Human
ggggcugaggugggagg

SEQ ID NO: 1179854 - RNA, 17 nt, Human
ggguaagugagagaggg

SEQ ID NO: 1179855 - RNA, 14 nt, Human
gggucucacucugu

SEQ ID NO: 1179856 - RNA, 12 nt, Human
gggucugaggaa

SEQ ID NO: 1179857 - RNA, 21 nt, Human
gggucugaggaauccagaccc

SEQ ID NO: 1179858 - RNA, 19 nt, Human
ggggcugaggugggaggau

SEQ ID NO: 1179859 - RNA, 12 nt, Human
ggggcugcaccg

SEQ ID NO: 1179860 - RNA, 21 nt, Human
ggggcugcaccggcuggccug

SEQ ID NO: 1179861 - RNA, 22 nt, Human
ggggcugcaccggcuggccugg

SEQ ID NO: 1179862 - RNA, 23 nt, Human
ggggcugcaccggcuggccuggc

SEQ ID NO: 1179863 - RNA, 22 nt, Human
gggggaggugggauccuccagg

SEQ ID NO: 1179864 - RNA, 17 nt, Human
gggggaucacagccucu

SEQ ID NO: 1179865 - RNA, 12 nt, Human
gggguggccucc

SEQ ID NO: 1179866 - RNA, 17 nt, Human
gggguggggaccucagg

SEQ ID NO: 1179867 - RNA, 12 nt, Human
ggguucuaccca

SEQ ID NO: 1179868 - RNA, 17 nt, Human
ggguucuacccaggugc

SEQ ID NO: 1179869 - RNA, 16 nt, Human
ggguuggccccugccc

SEQ ID NO: 1179870 - RNA, 22 nt, Human
ggguucaagcgauucuucugcu

SEQ ID NO: 1179871 - RNA, 23 nt, Human
ggguucaagcgauucuucugcuu

SEQ ID NO: 1179872 - RNA, 17 nt, Human
gggugaagugaagacaa

SEQ ID NO: 1179873 - RNA, 19 nt, Human
gggugacagagcaagugag

SEQ ID NO: 1179874 - RNA, 12 nt, Human
ggucacucuggc

SEQ ID NO: 1179875 - RNA, 11 nt, Human
ggucagagccu

SEQ ID NO: 1179876 - RNA, 15 nt, Human
ggucccaccccacac

SEQ ID NO: 1179877 - RNA, 16 nt, Human
ggucccaccccacaca

SEQ ID NO: 1179878 - RNA, 11 nt, Human
gguacccacug

SEQ ID NO: 1179879 - RNA, 13 nt, Human
gguacccacugcu

SEQ ID NO: 1179880 - RNA, 16 nt, Human
gguacccacugcucug

SEQ ID NO: 1179881 - RNA, 16 nt, Human
gguacuuguggacaca

SEQ ID NO: 1179882 - RNA, 17 nt, Human
gguacuuguggacacag

SEQ ID NO: 1179883 - RNA, 20 nt, Human
gguacuuguggacacagcuc

SEQ ID NO: 1179884 - RNA, 23 nt, Human
gguagaaauaucugaaaauguau

SEQ ID NO: 1179885 - RNA, 22 nt, Human
gguagaagcccuucuaccuucc

SEQ ID NO: 1179886 - RNA, 22 nt, Human
gguggccucccaacucacccca

SEQ ID NO: 1179887 - RNA, 23 nt, Human
gguggccucccaacucaccccag

SEQ ID NO: 1179888 - RNA, 21 nt, Human
ggugcuaucucccccagcccc

SEQ ID NO: 1179889 - RNA, 15 nt, Human
ggugcugccauccag

SEQ ID NO: 1179890 - RNA, 21 nt, Human
ggugcugccauccagguucag

SEQ ID NO: 1179891 - RNA, 19 nt, Human
gguggcagugggagcugcc

SEQ ID NO: 1179892 - RNA, 22 nt, Human
gguggcagugggagcugccugu

SEQ ID NO: 1179893 - RNA, 15 nt, Human
ggugagaagcagagg

SEQ ID NO: 1179894 - RNA, 16 nt, Human
ggugagaggggaacag

SEQ ID NO: 1179895 - RNA, 15 nt, Human
ggugcgaucuggguu

SEQ ID NO: 1179896 - RNA, 16 nt, Human
ggugcuaucuccccca

SEQ ID NO: 1179897 - RNA, 17 nt, Human
ggugcuaucucccccag

SEQ ID NO: 1179898 - RNA, 19 nt, Human
ggugcuaucucccccagcc

SEQ ID NO: 1179899 - RNA, 20 nt, Human
ggugcuaucucccccagccc

SEQ ID NO: 1179900 - RNA, 17 nt, Human
ggucccaccccacacac

SEQ ID NO: 1179901 - RNA, 22 nt, Human
ggucccaccccacacacgccag

SEQ ID NO: 1179902 - RNA, 21 nt, Human
ggucucacuauguugcccagg

SEQ ID NO: 1179903 - RNA, 22 nt, Human
ggucucacucugucgcccaguc

SEQ ID NO: 1179904 - RNA, 23 nt, Human
ggucucacucugucgcccagucu

SEQ ID NO: 1179905 - RNA, 14 nt, Human
ggucugacccacug

SEQ ID NO: 1179906 - RNA, 22 nt, Human
ggugaccagcaccaucucuccu

SEQ ID NO: 1179907 - RNA, 13 nt, Human
gguuauggagagg

SEQ ID NO: 1179908 - RNA, 17 nt, Human
gguuaggcauuguggga

SEQ ID NO: 1179909 - RNA, 21 nt, Human
gguuacccaguuagcucucaa

SEQ ID NO: 1179910 - RNA, 20 nt, Human
gguucacugcaaccuccgcc

SEQ ID NO: 1179911 - RNA, 13 nt, Human
gguugagguuuca

SEQ ID NO: 1179912 - RNA, 13 nt, Human
gguucaaagauau

SEQ ID NO: 1179913 - RNA, 21 nt, Human
gguucaaagauauuuugcuuu

SEQ ID NO: 1179914 - RNA, 12 nt, Human
gguggcuggguu

SEQ ID NO: 1179915 - RNA, 14 nt, Human
gguggugaccucug

SEQ ID NO: 1179916 - RNA, 15 nt, Human
gguggugaccucugc

SEQ ID NO: 1179917 - RNA, 16 nt, Human
gguggugaccucugcc

SEQ ID NO: 1179918 - RNA, 21 nt, Human
ggugguuauggagaggguguc

SEQ ID NO: 1179919 - RNA, 17 nt, Human
ggugguuucagaaaugu

SEQ ID NO: 1179920 - RNA, 18 nt, Human
ggugguuucagaaaugug

SEQ ID NO: 1179921 - RNA, 15 nt, Human
ggugguuuucuguuc

SEQ ID NO: 1179922 - RNA, 18 nt, Human
ggugguuuucuguucuuu

SEQ ID NO: 1179923 - RNA, 17 nt, Human
ggugucaagagggucug

SEQ ID NO: 1179924 - RNA, 19 nt, Human
ggugucaagagggucugag

SEQ ID NO: 1179925 - RNA, 19 nt, Human
ggugucaccugaagacuca

SEQ ID NO: 1179926 - RNA, 16 nt, Human
guuuccuggcacugcu

SEQ ID NO: 1179927 - RNA, 20 nt, Human
guuuccuggcacugcuucca

SEQ ID NO: 1179928 - RNA, 21 nt, Human
guuuccuggcacugcuuccag

SEQ ID NO: 1179929 - RNA, 22 nt, Human
guuuccuggcacugcuuccagu

SEQ ID NO: 1179930 - RNA, 18 nt, Human
guuucagaaauguguuau

SEQ ID NO: 1179931 - RNA, 20 nt, Human
guuuagcuggaaaaguaugu

SEQ ID NO: 1179932 - RNA, 21 nt, Human
gguuggccccugcccggcugc

SEQ ID NO: 1179933 - RNA, 13 nt, Human
guuuagaaagcuu

SEQ ID NO: 1179934 - RNA, 17 nt, Human
guuuagaaagcuugccc

SEQ ID NO: 1179935 - RNA, 17 nt, Human
guuuguaaauuaacuuu

SEQ ID NO: 1179936 - RNA, 19 nt, Human
guuuguaaauuaacuuuua

SEQ ID NO: 1179937 - RNA, 20 nt, Human
guuuguaaauuaacuuuuau

SEQ ID NO: 1179938 - RNA, 17 nt, Human
guuugauuaaauucuug

SEQ ID NO: 1179939 - RNA, 19 nt, Human
guuugauuaaauucuugca

SEQ ID NO: 1179940 - RNA, 22 nt, Human
guuugauuaaauucuugcaaag

SEQ ID NO: 1179941 - RNA, 23 nt, Human
guuugauuaaauucuugcaaagu

SEQ ID NO: 1179942 - RNA, 14 nt, Human
guuucuaaagcugc

SEQ ID NO: 1179943 - RNA, 15 nt, Human
guuucuaaagcugcc

SEQ ID NO: 1179944 - RNA, 16 nt, Human
guuucuaaagcugcca

SEQ ID NO: 1179945 - RNA, 20 nt, Human
guuucuaaagcugccagccg

SEQ ID NO: 1179946 - RNA, 16 nt, Human
guuugaaccaagaacu

SEQ ID NO: 1179947 - RNA, 18 nt, Human
guuuguuucugaaaggga

SEQ ID NO: 1179948 - RNA, 18 nt, Human
guuuucaggcuagaugua

SEQ ID NO: 1179949 - RNA, 16 nt, Human
guuuucaguguacaug

SEQ ID NO: 1179950 - RNA, 17 nt, Human
guuuucaguguacaugg

SEQ ID NO: 1179951 - RNA, 20 nt, Human
guuuuccagguuuaagcugu

SEQ ID NO: 1179952 - RNA, 12 nt, Human
guuuucucuuga

SEQ ID NO: 1179953 - RNA, 19 nt, Human
guuuucucuugagagggug

SEQ ID NO: 1179954 - RNA, 19 nt, Human
guuuuuauggcuuuugugc

SEQ ID NO: 1179955 - RNA, 22 nt, Human
guuuuuauggcuuuugugcauu

SEQ ID NO: 1179956 - RNA, 23 nt, Human
guuuuuauggcuuuugugcauua

SEQ ID NO: 1179957 - RNA, 20 nt, Human
uaaaaaacugcugacuguuu

SEQ ID NO: 1179958 - RNA, 23 nt, Human
uaaaaaacugcugacuguuuucu

SEQ ID NO: 1179959 - RNA, 16 nt, Human
uaaaaaagaaacauuu

SEQ ID NO: 1179960 - RNA, 14 nt, Human
uaaacuuaaucuaa

SEQ ID NO: 1179961 - RNA, 18 nt, Human
uaaacuuaaucuaaaugg

SEQ ID NO: 1179962 - RNA, 19 nt, Human
uaaacuuaaucuaaaugga

SEQ ID NO: 1179963 - RNA, 16 nt, Human
uaaacuuuaccuuuuu

SEQ ID NO: 1179964 - RNA, 22 nt, Human
uaaacuuuaccuuuuuuauaca

SEQ ID NO: 1179965 - RNA, 19 nt, Human
uaaacaagaccacguuucu

SEQ ID NO: 1179966 - RNA, 18 nt, Human
uaaacaagaccacguuuc

SEQ ID NO: 1179967 - RNA, 15 nt, Human
uaaaaaugguuuaaa

SEQ ID NO: 1179968 - RNA, 19 nt, Human
uaaaauccauacauuugug

SEQ ID NO: 1179969 - RNA, 17 nt, Human
uaaauaaaaauaauccu

SEQ ID NO: 1179970 - RNA, 13 nt, Human
uaaaguuucuguu

SEQ ID NO: 1179971 - RNA, 21 nt, Human
uaaaguguauuuuuuuacuaa

SEQ ID NO: 1179972 - RNA, 22 nt, Human
uaaaguguauuuuuuuacuaau

SEQ ID NO: 1179973 - RNA, 23 nt, Human
uaaaguguauuuuuuuacuaaua

SEQ ID NO: 1179974 - RNA, 19 nt, Human
uaaaucagccguguaacca

SEQ ID NO: 1179975 - RNA, 18 nt, Human
uaaauauaugcuaagucu

SEQ ID NO: 1179976 - RNA, 13 nt, Human
uaacagaaaugua

SEQ ID NO: 1179977 - RNA, 14 nt, Human
uaacagaaauguac

SEQ ID NO: 1179978 - RNA, 15 nt, Human
uaacagaaauguaca

SEQ ID NO: 1179979 - RNA, 20 nt, Human
uaacuuuuauaaacuuuacc

SEQ ID NO: 1179980 - RNA, 19 nt, Human
uaacaggcagauacaggaa

SEQ ID NO: 1179981 - RNA, 14 nt, Human
uaaccagcagaaau

SEQ ID NO: 1179982 - RNA, 16 nt, Human
uaaccagcagaaaugc

SEQ ID NO: 1179983 - RNA, 19 nt, Human
uaaccagcagaaaugccuu

SEQ ID NO: 1179984 - RNA, 17 nt, Human
uaaccaggggccaugaa

SEQ ID NO: 1179985 - RNA, 19 nt, Human
uaaggaugcuuguacauaa

SEQ ID NO: 1179986 - RNA, 20 nt, Human
uaagccagacaucaacagau

SEQ ID NO: 1179987 - RNA, 21 nt, Human
uaagccagacaucaacagaua

SEQ ID NO: 1179988 - RNA, 20 nt, Human
uaaggaugcuuguacauaau

SEQ ID NO: 1179989 - RNA, 21 nt, Human
uaaggaugcuuguacauaaug

SEQ ID NO: 1179990 - RNA, 22 nt, Human
uaaggaugcuuguacauaaugc

SEQ ID NO: 1179991 - RNA, 23 nt, Human
uaaggaugcuuguacauaaugcg

SEQ ID NO: 1179992 - RNA, 16 nt, Human
uaaggauguucuagca

SEQ ID NO: 1179993 - RNA, 16 nt, Human
uaagcauuccaacuau

SEQ ID NO: 1179994 - RNA, 18 nt, Human
uaagcauuccaacuaucu

SEQ ID NO: 1179995 - RNA, 20 nt, Human
uaagcauuccaacuaucuca

SEQ ID NO: 1179996 - RNA, 13 nt, Human
uaagccagacauc

SEQ ID NO: 1179997 - RNA, 21 nt, Human
uaacuuuuauaaacuuuaccu

SEQ ID NO: 1179998 - RNA, 22 nt, Human
uaacuuuuauaaacuuuaccuu

SEQ ID NO: 1179999 - RNA, 12 nt, Human
uaagagggaggg

SEQ ID NO: 1180000 - RNA, 22 nt, Human
uaagagggagggagggcuccag

SEQ ID NO: 1180001 - RNA, 23 nt, Human
uaagagggagggagggcuccaga

SEQ ID NO: 1180002 - RNA, 14 nt, Human
uaagauaaaugugc

SEQ ID NO: 1180003 - RNA, 16 nt, Human
uaagauaaaugugcug

SEQ ID NO: 1180004 - RNA, 17 nt, Human
uaagauaaaugugcuga

SEQ ID NO: 1180005 - RNA, 19 nt, Human
uaaugccacuaaauugaca

SEQ ID NO: 1180006 - RNA, 11 nt, Human
uaaucuaaaug

SEQ ID NO: 1180007 - RNA, 12 nt, Human
uaaucuaaaugg

SEQ ID NO: 1180008 - RNA, 20 nt, Human
uaagugguacuaacuuuccu

SEQ ID NO: 1180009 - RNA, 15 nt, Human
uaauaauguuucaaa

SEQ ID NO: 1180010 - RNA, 14 nt, Human
uaauacaccacuac

SEQ ID NO: 1180011 - RNA, 14 nt, Human
uaaugcgugcauac

SEQ ID NO: 1180012 - RNA, 14 nt, Human
uaauguuucaaaca

SEQ ID NO: 1180013 - RNA, 15 nt, Human
uaauguuucaaacau

SEQ ID NO: 1180014 - RNA, 22 nt, Human
uaauguuucaaacauauauaac

SEQ ID NO: 1180015 - RNA, 17 nt, Human
uaauuaaaacacaacau

SEQ ID NO: 1180016 - RNA, 18 nt, Human
uaauucuuagcucauucu

SEQ ID NO: 1180017 - RNA, 20 nt, Human
uaauugacaggauuauugga

SEQ ID NO: 1180018 - RNA, 22 nt, Human
uaauugacaggauuauuggaaa

SEQ ID NO: 1180019 - RNA, 20 nt, Human
uaauuuguaguguuggagaa

SEQ ID NO: 1180020 - RNA, 23 nt, Human
uaauuuguaguguuggagaagaa

SEQ ID NO: 1180021 - RNA, 14 nt, Human
uaauuugugauaca

SEQ ID NO: 1180022 - RNA, 15 nt, Human
uaauuugugauacaa

SEQ ID NO: 1180023 - RNA, 18 nt, Human
uaauuugugauacaaugc

SEQ ID NO: 1180024 - RNA, 19 nt, Human
uaauuugugauacaaugcu

SEQ ID NO: 1180025 - RNA, 22 nt, Human
uaauuugugauacaaugcugug

SEQ ID NO: 1180026 - RNA, 22 nt, Human
uaauuggaaaggcagcucuaaa

SEQ ID NO: 1180027 - RNA, 13 nt, Human
uaauuuugugaag

SEQ ID NO: 1180028 - RNA, 17 nt, Human
uacacaaugguuuucuu

SEQ ID NO: 1180029 - RNA, 21 nt, Human
uacacaaugguuuucuugugu

SEQ ID NO: 1180030 - RNA, 23 nt, Human
uacacaaugguuuucuugugugu

SEQ ID NO: 1180031 - RNA, 21 nt, Human
uacacacacacgcgugcacac

SEQ ID NO: 1180032 - RNA, 15 nt, Human
uacacacacauacac

SEQ ID NO: 1180033 - RNA, 22 nt, Human
uacacacacacacacagccaca

SEQ ID NO: 1180034 - RNA, 23 nt, Human
uacacacacacacacagccacac

SEQ ID NO: 1180035 - RNA, 22 nt, Human
uacacacugcauguuugugauu

SEQ ID NO: 1180036 - RNA, 16 nt, Human
uacacugugcugaguc

SEQ ID NO: 1180037 - RNA, 19 nt, Human
uacaggaaaagcugcugac

SEQ ID NO: 1180038 - RNA, 16 nt, Human
uacaggcacccaccau

SEQ ID NO: 1180039 - RNA, 22 nt, Human
uacagcuugaccgugaggccag

SEQ ID NO: 1180040 - RNA, 23 nt, Human
uacagcuugaccgugaggccaga

SEQ ID NO: 1180041 - RNA, 17 nt, Human
uacaggaaaagcugcug

SEQ ID NO: 1180042 - RNA, 18 nt, Human
uacaggaaaagcugcuga

SEQ ID NO: 1180043 - RNA, 13 nt, Human
uacagaauuuuau

SEQ ID NO: 1180044 - RNA, 17 nt, Human
uacacuguuucaaacuu

SEQ ID NO: 1180045 - RNA, 18 nt, Human
uacacuguuucaaacuuu

SEQ ID NO: 1180046 - RNA, 19 nt, Human
uacacuguuucaaacuuua

SEQ ID NO: 1180047 - RNA, 13 nt, Human
uacacuuuaugca

SEQ ID NO: 1180048 - RNA, 23 nt, Human
uaccacaggaaccacaagacugc

SEQ ID NO: 1180049 - RNA, 18 nt, Human
uaccaccagucugacugu

SEQ ID NO: 1180050 - RNA, 23 nt, Human
uaccauuuugggguacccacugc

SEQ ID NO: 1180051 - RNA, 13 nt, Human
uaccacagacaua

SEQ ID NO: 1180052 - RNA, 12 nt, Human
uacccaccccca

SEQ ID NO: 1180053 - RNA, 15 nt, Human
uacccacccccaccc

SEQ ID NO: 1180054 - RNA, 17 nt, Human
uacccacccccacccaa

SEQ ID NO: 1180055 - RNA, 19 nt, Human
uacccacccccacccaagg

SEQ ID NO: 1180056 - RNA, 23 nt, Human
uacccacccccacccaagggccu

SEQ ID NO: 1180057 - RNA, 11 nt, Human
uacccacugcu

SEQ ID NO: 1180058 - RNA, 12 nt, Human
uacccacugcuc

SEQ ID NO: 1180059 - RNA, 13 nt, Human
uacccacugcucu

SEQ ID NO: 1180060 - RNA, 14 nt, Human
uacccacugcucug

SEQ ID NO: 1180061 - RNA, 15 nt, Human
uacccacugcucugg

SEQ ID NO: 1180062 - RNA, 18 nt, Human
uacccagcgagcccuggu

SEQ ID NO: 1180063 - RNA, 22 nt, Human
uacccaggugcuaggaacacuc

SEQ ID NO: 1180064 - RNA, 21 nt, Human
uacaugagguacugagaguga

SEQ ID NO: 1180065 - RNA, 22 nt, Human
uacaugagguacugagagugaa

SEQ ID NO: 1180066 - RNA, 16 nt, Human
uacauuuguauaaaau

SEQ ID NO: 1180067 - RNA, 17 nt, Human
uacauuuguauaaaaua

SEQ ID NO: 1180068 - RNA, 11 nt, Human
uacauuugugu

SEQ ID NO: 1180069 - RNA, 19 nt, Human
uacaguuacucagaauucu

SEQ ID NO: 1180070 - RNA, 23 nt, Human
uacaguuacucagaauucucuag

SEQ ID NO: 1180071 - RNA, 18 nt, Human
uacauaagauaaaugugc

SEQ ID NO: 1180072 - RNA, 19 nt, Human
uacauaagauaaaugugcu

SEQ ID NO: 1180073 - RNA, 22 nt, Human
uacauaagauaaaugugcugaa

SEQ ID NO: 1180074 - RNA, 21 nt, Human
uacuguaucaugacaaagacu

SEQ ID NO: 1180075 - RNA, 17 nt, Human
uacugcauaugaaagga

SEQ ID NO: 1180076 - RNA, 15 nt, Human
uacuuguggacacag

SEQ ID NO: 1180077 - RNA, 18 nt, Human
uacuuguggacacagcuc

SEQ ID NO: 1180078 - RNA, 19 nt, Human
uacuuguggacacagcucu

SEQ ID NO: 1180079 - RNA, 15 nt, Human
uagaaauauaauuga

SEQ ID NO: 1180080 - RNA, 20 nt, Human
uagaaauaucugaaaaugua

SEQ ID NO: 1180081 - RNA, 21 nt, Human
uagaaauaucugaaaauguau

SEQ ID NO: 1180082 - RNA, 23 nt, Human
uagaaauaucugaaaauguaugu

SEQ ID NO: 1180083 - RNA, 18 nt, Human
uacucgaguuacagacaa

SEQ ID NO: 1180084 - RNA, 15 nt, Human
uacugaggugcuaug

SEQ ID NO: 1180085 - RNA, 14 nt, Human
uacucccaucugug

SEQ ID NO: 1180086 - RNA, 16 nt, Human
uacucccaucugugaa

SEQ ID NO: 1180087 - RNA, 17 nt, Human
uacucccaucugugaaa

SEQ ID NO: 1180088 - RNA, 20 nt, Human
uacuacaguccucccaucuc

SEQ ID NO: 1180089 - RNA, 13 nt, Human
uacuacuccugua

SEQ ID NO: 1180090 - RNA, 12 nt, Human
uacucaccucac

SEQ ID NO: 1180091 - RNA, 14 nt, Human
uacucaccucaccc

SEQ ID NO: 1180092 - RNA, 16 nt, Human
uacucagaauucucua

SEQ ID NO: 1180093 - RNA, 22 nt, Human
uacucagaauucucuaguuuga

SEQ ID NO: 1180094 - RNA, 22 nt, Human
uacccaucccauaugccugggc

SEQ ID NO: 1180095 - RNA, 20 nt, Human
uaccuuuguauucucuccug

SEQ ID NO: 1180096 - RNA, 18 nt, Human
uaccuuuuuuauacauaa

SEQ ID NO: 1180097 - RNA, 19 nt, Human
uaccuuuuuuauacauaaa

SEQ ID NO: 1180098 - RNA, 20 nt, Human
uaccuuuuuuauacauaaac

SEQ ID NO: 1180099 - RNA, 22 nt, Human
uaccuuuuuuauacauaaacaa

SEQ ID NO: 1180100 - RNA, 18 nt, Human
uacuaaccagcagaaaug

SEQ ID NO: 1180101 - RNA, 19 nt, Human
uacuaaccagcagaaaugc

SEQ ID NO: 1180102 - RNA, 13 nt, Human
uacuaacuuuccu

SEQ ID NO: 1180103 - RNA, 15 nt, Human
uacuaauagacaauu

SEQ ID NO: 1180104 - RNA, 17 nt, Human
uacuaauagacaauuua

SEQ ID NO: 1180105 - RNA, 20 nt, Human
uacuaauagacaauuuauua

SEQ ID NO: 1180106 - RNA, 12 nt, Human
uacuacaguccu

SEQ ID NO: 1180107 - RNA, 17 nt, Human
uacuacaguccucccau

SEQ ID NO: 1180108 - RNA, 16 nt, Human
uagagagagaccacuu

SEQ ID NO: 1180109 - RNA, 19 nt, Human
uagagguucaaagauauuu

SEQ ID NO: 1180110 - RNA, 21 nt, Human
uagagguucaaagauauuuug

SEQ ID NO: 1180111 - RNA, 17 nt, Human
uagaguuuagcuggaaa

SEQ ID NO: 1180112 - RNA, 18 nt, Human
uagaguuuagcuggaaaa

SEQ ID NO: 1180113 - RNA, 18 nt, Human
uagauaauacaccacuac

SEQ ID NO: 1180114 - RNA, 12 nt, Human
uagauguauaua

SEQ ID NO: 1180115 - RNA, 16 nt, Human
uagauguauguacuuc

SEQ ID NO: 1180116 - RNA, 20 nt, Human
uagauguauguacuucaugc

SEQ ID NO: 1180117 - RNA, 19 nt, Human
uagcagagaaugaaagggc

SEQ ID NO: 1180118 - RNA, 23 nt, Human
uagcagagaaugaaagggcccag

SEQ ID NO: 1180119 - RNA, 16 nt, Human
uagcauacguacacau

SEQ ID NO: 1180120 - RNA, 14 nt, Human
uagcccaaaaccaa

SEQ ID NO: 1180121 - RNA, 18 nt, Human
uagcugggacuacaggug

SEQ ID NO: 1180122 - RNA, 12 nt, Human
uagcugggacua

SEQ ID NO: 1180123 - RNA, 20 nt, Human
uagcugggacuacaggcacc

SEQ ID NO: 1180124 - RNA, 11 nt, Human
uagcugggacu

SEQ ID NO: 1180125 - RNA, 21 nt, Human
uagcucuaggagggcuggcaa

SEQ ID NO: 1180126 - RNA, 17 nt, Human
uagccugccucuucucu

SEQ ID NO: 1180127 - RNA, 15 nt, Human
uaggaagguuaaugu

SEQ ID NO: 1180128 - RNA, 23 nt, Human
uaggaauugacccacaagaaaug

SEQ ID NO: 1180129 - RNA, 13 nt, Human
uaggccaugggac

SEQ ID NO: 1180130 - RNA, 16 nt, Human
uaggccaugggacagg

SEQ ID NO: 1180131 - RNA, 13 nt, Human
uaggccuggccag

SEQ ID NO: 1180132 - RNA, 14 nt, Human
uaggccuggccaga

SEQ ID NO: 1180133 - RNA, 13 nt, Human
uaggaacacuccu

SEQ ID NO: 1180134 - RNA, 14 nt, Human
uaggaacacuccuu

SEQ ID NO: 1180135 - RNA, 17 nt, Human
uaggaacacuccuucac

SEQ ID NO: 1180136 - RNA, 21 nt, Human
uaggaacuuaaauaaugugaa

SEQ ID NO: 1180137 - RNA, 13 nt, Human
uaggaagacuuug

SEQ ID NO: 1180138 - RNA, 14 nt, Human
uaggaagacuuugg

SEQ ID NO: 1180139 - RNA, 15 nt, Human
uaggaagacuuugga

SEQ ID NO: 1180140 - RNA, 16 nt, Human
uaggaagacuuuggaa

SEQ ID NO: 1180141 - RNA, 17 nt, Human
uaggaagacuuuggaaa

SEQ ID NO: 1180142 - RNA, 18 nt, Human
uagucaaauugugugaaa

SEQ ID NO: 1180143 - RNA, 15 nt, Human
uaguggauguucuga

SEQ ID NO: 1180144 - RNA, 21 nt, Human
uaguuguaccgcaaugugacu

SEQ ID NO: 1180145 - RNA, 13 nt, Human
uaguuucuccaag

SEQ ID NO: 1180146 - RNA, 23 nt, Human
uaguuugauuaaauucuugcaaa

SEQ ID NO: 1180147 - RNA, 12 nt, Human
uaguuugcaguu

SEQ ID NO: 1180148 - RNA, 14 nt, Human
uauaauguaagcuc

SEQ ID NO: 1180149 - RNA, 19 nt, Human
uauaauguaagcucuacug

SEQ ID NO: 1180150 - RNA, 20 nt, Human
uauaauguaagcucuacuga

SEQ ID NO: 1180151 - RNA, 17 nt, Human
uauaauucuacuuugag

SEQ ID NO: 1180152 - RNA, 15 nt, Human
uaguuuuauaugcuu

SEQ ID NO: 1180153 - RNA, 18 nt, Human
uauaacaaugcuguauuu

SEQ ID NO: 1180154 - RNA, 18 nt, Human
uauaaugaaugaaacauu

SEQ ID NO: 1180155 - RNA, 20 nt, Human
uauaaugaaugaaacauuuu

SEQ ID NO: 1180156 - RNA, 17 nt, Human
uaucaugacaaagacug

SEQ ID NO: 1180157 - RNA, 16 nt, Human
uaucaugacaaagacu

SEQ ID NO: 1180158 - RNA, 19 nt, Human
uauauuuuuuguuaaauga

SEQ ID NO: 1180159 - RNA, 17 nt, Human
uaucaggugcugccauc

SEQ ID NO: 1180160 - RNA, 14 nt, Human
uauccuucagccug

SEQ ID NO: 1180161 - RNA, 19 nt, Human
uaucgucacugcuuaacuu

SEQ ID NO: 1180162 - RNA, 15 nt, Human
uaucuaaauguugaa

SEQ ID NO: 1180163 - RNA, 16 nt, Human
uaucuaaauguugaaa

SEQ ID NO: 1180164 - RNA, 23 nt, Human
uauauuuauuacuguaagaaaau

SEQ ID NO: 1180165 - RNA, 13 nt, Human
uauauuugaaaua

SEQ ID NO: 1180166 - RNA, 14 nt, Human
uauauuugaaauau

SEQ ID NO: 1180167 - RNA, 20 nt, Human
uauauuugaaauauugacuu

SEQ ID NO: 1180168 - RNA, 20 nt, Human
uauaugcucugcauguuaca

SEQ ID NO: 1180169 - RNA, 23 nt, Human
uauacuguaaagaaagagagaaa

SEQ ID NO: 1180170 - RNA, 22 nt, Human
ucaaaacgguuuuacugcagcu

SEQ ID NO: 1180171 - RNA, 14 nt, Human
ucaaacucuuaaaa

SEQ ID NO: 1180172 - RNA, 14 nt, Human
uaucugaaaaugua

SEQ ID NO: 1180173 - RNA, 15 nt, Human
uaucugaaaauguau

SEQ ID NO: 1180174 - RNA, 20 nt, Human
uaucugaaaauguaugugua

SEQ ID NO: 1180175 - RNA, 23 nt, Human
uauuuauuaaaugcccagccccu

SEQ ID NO: 1180176 - RNA, 13 nt, Human
uauuuauuacugu

SEQ ID NO: 1180177 - RNA, 22 nt, Human
uauuucuaugaaauauuauguu

SEQ ID NO: 1180178 - RNA, 13 nt, Human
ucaaugcagcccc

SEQ ID NO: 1180179 - RNA, 18 nt, Human
ucaaugcacugacauugu

SEQ ID NO: 1180180 - RNA, 13 nt, Human
ucaauuacaggaa

SEQ ID NO: 1180181 - RNA, 18 nt, Human
ucaauuacaggaaguacu

SEQ ID NO: 1180182 - RNA, 13 nt, Human
ucaauaggaaaaa

SEQ ID NO: 1180183 - RNA, 14 nt, Human
ucaauaggaaaaac

SEQ ID NO: 1180184 - RNA, 17 nt, Human
ucaauaggaaaaacuga

SEQ ID NO: 1180185 - RNA, 14 nt, Human
ucaaugcacugaca

SEQ ID NO: 1180186 - RNA, 19 nt, Human
ucaauuacaggaaguacug

SEQ ID NO: 1180187 - RNA, 20 nt, Human
ucaauuacaggaaguacugg

SEQ ID NO: 1180188 - RNA, 21 nt, Human
ucacacaguauuacuucugcu

SEQ ID NO: 1180189 - RNA, 22 nt, Human
ucacacaguauuacuucugcua

SEQ ID NO: 1180190 - RNA, 13 nt, Human
ucacacagugagu

SEQ ID NO: 1180191 - RNA, 22 nt, Human
ucacacagugagucgaggacag

SEQ ID NO: 1180192 - RNA, 23 nt, Human
ucacacagugagucgaggacagg

SEQ ID NO: 1180193 - RNA, 21 nt, Human
ucacacaugagcaucaggcca

SEQ ID NO: 1180194 - RNA, 22 nt, Human
ucacacaugagcaucaggccag

SEQ ID NO: 1180195 - RNA, 19 nt, Human
ucacaggaaguagaggagg

SEQ ID NO: 1180196 - RNA, 23 nt, Human
ucacaggacagcccuucuuucca

SEQ ID NO: 1180197 - RNA, 11 nt, Human
ucacaggcagg

SEQ ID NO: 1180198 - RNA, 22 nt, Human
ucaaacucuugaccucagguga

SEQ ID NO: 1180199 - RNA, 15 nt, Human
ucaaacuuuacuaug

SEQ ID NO: 1180200 - RNA, 16 nt, Human
ucaaacuuuacuaugg

SEQ ID NO: 1180201 - RNA, 23 nt, Human
ucaaacugaaugaaacccccaca

SEQ ID NO: 1180202 - RNA, 13 nt, Human
ucaaccuccuggg

SEQ ID NO: 1180203 - RNA, 14 nt, Human
ucaaccuccugggc

SEQ ID NO: 1180204 - RNA, 19 nt, Human
ucaacuccaaacugacucu

SEQ ID NO: 1180205 - RNA, 16 nt, Human
ucaagcgauucuucug

SEQ ID NO: 1180206 - RNA, 17 nt, Human
ucaagcgauucuucugc

SEQ ID NO: 1180207 - RNA, 18 nt, Human
ucaaggauccugagccag

SEQ ID NO: 1180208 - RNA, 19 nt, Human
ucaaggauccugagccaga

SEQ ID NO: 1180209 - RNA, 20 nt, Human
ucaaggauccugagccagau

SEQ ID NO: 1180210 - RNA, 23 nt, Human
ucaaggauccugagccagauuuc

SEQ ID NO: 1180211 - RNA, 22 nt, Human
ucaagugauucuccugccucag

SEQ ID NO: 1180212 - RNA, 16 nt, Human
ucacaggcagguccag

SEQ ID NO: 1180213 - RNA, 12 nt, Human
ucacaggcaggu

SEQ ID NO: 1180214 - RNA, 15 nt, Human
ucacaggcaggucca

SEQ ID NO: 1180215 - RNA, 14 nt, Human
ucaccuuucccauc

SEQ ID NO: 1180216 - RNA, 12 nt, Human
ucaccuuugucc

SEQ ID NO: 1180217 - RNA, 14 nt, Human
ucaccuuugucccc

SEQ ID NO: 1180218 - RNA, 15 nt, Human
ucaccuuugucccca

SEQ ID NO: 1180219 - RNA, 17 nt, Human
ucaccuuuguccccacc

SEQ ID NO: 1180220 - RNA, 18 nt, Human
ucaccuuuguccccaccg

SEQ ID NO: 1180221 - RNA, 22 nt, Human
ucaccuuuguccccaccgcaga

SEQ ID NO: 1180222 - RNA, 13 nt, Human
ucacgccacugca

SEQ ID NO: 1180223 - RNA, 14 nt, Human
ucacgccacugcac

SEQ ID NO: 1180224 - RNA, 16 nt, Human
ucacgccacugcacua

SEQ ID NO: 1180225 - RNA, 19 nt, Human
ucacgccuguaauccuagc

SEQ ID NO: 1180226 - RNA, 20 nt, Human
ucacgccuguaauccuagca

SEQ ID NO: 1180227 - RNA, 13 nt, Human
ucacuccuugaaa

SEQ ID NO: 1180228 - RNA, 14 nt, Human
ucacggaagagccu

SEQ ID NO: 1180229 - RNA, 16 nt, Human
ucacggaagagccuug

SEQ ID NO: 1180230 - RNA, 17 nt, Human
ucacggaagagccuugc

SEQ ID NO: 1180231 - RNA, 13 nt, Human
ucacggcucacug

SEQ ID NO: 1180232 - RNA, 15 nt, Human
ucacggcucacugca

SEQ ID NO: 1180233 - RNA, 20 nt, Human
ucacggcucacugcagccuc

SEQ ID NO: 1180234 - RNA, 12 nt, Human
ucacucuccuug

SEQ ID NO: 1180235 - RNA, 14 nt, Human
ucacucuccuuggu

SEQ ID NO: 1180236 - RNA, 23 nt, Human
ucacucuccuuggugucgggcau

SEQ ID NO: 1180237 - RNA, 12 nt, Human
ucacucuggcag

SEQ ID NO: 1180238 - RNA, 13 nt, Human
ucacucuggcagc

SEQ ID NO: 1180239 - RNA, 14 nt, Human
ucacucuggcagcu

SEQ ID NO: 1180240 - RNA, 15 nt, Human
ucacucuggcagcuc

SEQ ID NO: 1180241 - RNA, 16 nt, Human
ucacucuggcagcuca

SEQ ID NO: 1180242 - RNA, 17 nt, Human
ucacucuggcagcucag

SEQ ID NO: 1180243 - RNA, 18 nt, Human
ucacucuggcagcucaga

SEQ ID NO: 1180244 - RNA, 19 nt, Human
ucacucuggcagcucagag

SEQ ID NO: 1180245 - RNA, 20 nt, Human
ucacucuggcagcucagaga

SEQ ID NO: 1180246 - RNA, 22 nt, Human
ucacucuggcagcucagagagg

SEQ ID NO: 1180247 - RNA, 12 nt, Human
ucacucugucgc

SEQ ID NO: 1180248 - RNA, 16 nt, Human
ucacucugucgcccag

SEQ ID NO: 1180249 - RNA, 19 nt, Human
ucacucugucgcccagucu

SEQ ID NO: 1180250 - RNA, 22 nt, Human
ucacucugucgcccagucugga

SEQ ID NO: 1180251 - RNA, 15 nt, Human
ucacugcuuaacuuc

SEQ ID NO: 1180252 - RNA, 17 nt, Human
ucacugcuuaacuucac

SEQ ID NO: 1180253 - RNA, 18 nt, Human
ucacugcuuaacuucaca

SEQ ID NO: 1180254 - RNA, 20 nt, Human
ucacugcuuaacuucacaua

SEQ ID NO: 1180255 - RNA, 17 nt, Human
ucacuugucaauaaaau

SEQ ID NO: 1180256 - RNA, 19 nt, Human
ucagcacgauuucuguuua

SEQ ID NO: 1180257 - RNA, 15 nt, Human
ucagacagcugccug

SEQ ID NO: 1180258 - RNA, 16 nt, Human
ucagacagcugccugg

SEQ ID NO: 1180259 - RNA, 17 nt, Human
ucagacagcugccuggg

SEQ ID NO: 1180260 - RNA, 18 nt, Human
ucagacagcugccuggga

SEQ ID NO: 1180261 - RNA, 19 nt, Human
ucagacagcugccugggau

SEQ ID NO: 1180262 - RNA, 20 nt, Human
ucagacagcugccugggauc

SEQ ID NO: 1180263 - RNA, 19 nt, Human
ucagacauagaauuaacac

SEQ ID NO: 1180264 - RNA, 22 nt, Human
ucagacauagaauuaacacaug

SEQ ID NO: 1180265 - RNA, 17 nt, Human
ucaguuguuaguguguc

SEQ ID NO: 1180266 - RNA, 13 nt, Human
ucauacccacccc

SEQ ID NO: 1180267 - RNA, 24 nt, Human
ucagucugauucccaagcucugcu

SEQ ID NO: 1180268 - RNA, 15 nt, Human
ucagucuggcccuuc

SEQ ID NO: 1180269 - RNA, 23 nt, Human
ucagugguuggcaauuguuucaa

SEQ ID NO: 1180270 - RNA, 11 nt, Human
ucaguguacau

SEQ ID NO: 1180271 - RNA, 13 nt, Human
ucagugugacuga

SEQ ID NO: 1180272 - RNA, 17 nt, Human
ucagugugacugaucuc

SEQ ID NO: 1180273 - RNA, 14 nt, Human
ucauacccaccccc

SEQ ID NO: 1180274 - RNA, 15 nt, Human
ucauacccaccccca

SEQ ID NO: 1180275 - RNA, 20 nt, Human
ucauacccacccccacccaa

SEQ ID NO: 1180276 - RNA, 21 nt, Human
ucauacccacccccacccaag

SEQ ID NO: 1180277 - RNA, 16 nt, Human
ucauuaggugugacug

SEQ ID NO: 1180278 - RNA, 18 nt, Human
ucauuaggugugacugaa

SEQ ID NO: 1180279 - RNA, 21 nt, Human
ucauuaggugugacugaauuu

SEQ ID NO: 1180280 - RNA, 22 nt, Human
ucauuaggugugacugaauuuc

SEQ ID NO: 1180281 - RNA, 20 nt, Human
uccaagcauuuagauguaua

SEQ ID NO: 1180282 - RNA, 14 nt, Human
uccacaagagccca

SEQ ID NO: 1180283 - RNA, 15 nt, Human
uccacaagagcccag

SEQ ID NO: 1180284 - RNA, 14 nt, Human
uccaccuacaugag

SEQ ID NO: 1180285 - RNA, 12 nt, Human
uccaccugccag

SEQ ID NO: 1180286 - RNA, 13 nt, Human
uccaccugccagg

SEQ ID NO: 1180287 - RNA, 15 nt, Human
uccaccugccaggga

SEQ ID NO: 1180288 - RNA, 12 nt, Human
uccacuuggucu

SEQ ID NO: 1180289 - RNA, 13 nt, Human
uccacuuggucug

SEQ ID NO: 1180290 - RNA, 14 nt, Human
uccacuuggucugu

SEQ ID NO: 1180291 - RNA, 16 nt, Human
uccagauccuggaaau

SEQ ID NO: 1180292 - RNA, 17 nt, Human
uccagauccuggaaauc

SEQ ID NO: 1180293 - RNA, 23 nt, Human
uccagccaaagccuccuccagcc

SEQ ID NO: 1180294 - RNA, 16 nt, Human
uccaaaauaaaacuuu

SEQ ID NO: 1180295 - RNA, 17 nt, Human
uccaaaauaaaacuuuu

SEQ ID NO: 1180296 - RNA, 18 nt, Human
uccaaaauaaaacuuuuu

SEQ ID NO: 1180297 - RNA, 23 nt, Human
uccaaacugacucuuaagaagac

SEQ ID NO: 1180298 - RNA, 20 nt, Human
uccaagaagcccaggaaagg

SEQ ID NO: 1180299 - RNA, 22 nt, Human
uccaagaagcccaggaaaggcu

SEQ ID NO: 1180300 - RNA, 19 nt, Human
uccaagaccuucuccuuca

SEQ ID NO: 1180301 - RNA, 17 nt, Human
uccaagcauuuagaugu

SEQ ID NO: 1180302 - RNA, 23 nt, Human
uccagcucaccagccccagugcc

SEQ ID NO: 1180303 - RNA, 14 nt, Human
uccauggacuuugu

SEQ ID NO: 1180304 - RNA, 15 nt, Human
uccauggacuuuguu

SEQ ID NO: 1180305 - RNA, 17 nt, Human
ucccaagcucugcuccu

SEQ ID NO: 1180306 - RNA, 17 nt, Human
ucccaacucaccccagc

SEQ ID NO: 1180307 - RNA, 12 nt, Human
ucccaagcucug

SEQ ID NO: 1180308 - RNA, 13 nt, Human
ucccaagcucugc

SEQ ID NO: 1180309 - RNA, 14 nt, Human
ucccaagcucugcu

SEQ ID NO: 1180310 - RNA, 15 nt, Human
ucccaagcucugcuc

SEQ ID NO: 1180311 - RNA, 14 nt, Human
ucccaacucacccc

SEQ ID NO: 1180312 - RNA, 15 nt, Human
ucccaacucacccca

SEQ ID NO: 1180313 - RNA, 16 nt, Human
ucccaacucaccccag

SEQ ID NO: 1180314 - RNA, 13 nt, Human
ucccaccucagcc

SEQ ID NO: 1180315 - RNA, 14 nt, Human
ucccaccucagccu

SEQ ID NO: 1180316 - RNA, 15 nt, Human
ucccaccucagccuc

SEQ ID NO: 1180317 - RNA, 16 nt, Human
ucccaccucagccucc

SEQ ID NO: 1180318 - RNA, 23 nt, Human
ucccaggcauuccccaggaggcc

SEQ ID NO: 1180319 - RNA, 22 nt, Human
ucccaggcauuccccaggaggc

SEQ ID NO: 1180320 - RNA, 20 nt, Human
ucccaggcauuccccaggag

SEQ ID NO: 1180321 - RNA, 21 nt, Human
ucccaggcauuccccaggagg

SEQ ID NO: 1180322 - RNA, 23 nt, Human
ucccaucucacacaugagcauca

SEQ ID NO: 1180323 - RNA, 21 nt, Human
ucccaucugugaaaggaaaga

SEQ ID NO: 1180324 - RNA, 13 nt, Human
uccccaggaggcc

SEQ ID NO: 1180325 - RNA, 20 nt, Human
uccccgcacugggcuugggg

SEQ ID NO: 1180326 - RNA, 22 nt, Human
uccccuguagagugggagcuga

SEQ ID NO: 1180327 - RNA, 23 nt, Human
uccccuguccccgcacugggcuu

SEQ ID NO: 1180328 - RNA, 24 nt, Human
uccccugcuggguguggcgcagca

SEQ ID NO: 1180329 - RNA, 19 nt, Human
uccccuguagagugggagc

SEQ ID NO: 1180330 - RNA, 14 nt, Human
uccccugcugggug

SEQ ID NO: 1180331 - RNA, 15 nt, Human
uccccugcugggugu

SEQ ID NO: 1180332 - RNA, 20 nt, Human
uccccugcuggguguggcgc

SEQ ID NO: 1180333 - RNA, 21 nt, Human
uccccugcuggguguggcgca

SEQ ID NO: 1180334 - RNA, 18 nt, Human
uccccuguuuguuucuga

SEQ ID NO: 1180335 - RNA, 15 nt, Human
ucccucccucuuucc

SEQ ID NO: 1180336 - RNA, 17 nt, Human
ucccucccucuuucccu

SEQ ID NO: 1180337 - RNA, 15 nt, Human
ucccuacuguaauuu

SEQ ID NO: 1180338 - RNA, 14 nt, Human
uccuuaccagcaga

SEQ ID NO: 1180339 - RNA, 12 nt, Human
uccuucuguccu

SEQ ID NO: 1180340 - RNA, 19 nt, Human
uccuucuguccuacucugu

SEQ ID NO: 1180341 - RNA, 15 nt, Human
uccugguguggaaga

SEQ ID NO: 1180342 - RNA, 10 nt, Human
ucccucccuu

SEQ ID NO: 1180343 - RNA, 22 nt, Human
uccuggcaugggaaugaauguc

SEQ ID NO: 1180344 - RNA, 18 nt, Human
ucccucccuuccucuuuc

SEQ ID NO: 1180345 - RNA, 17 nt, Human
uccuggcccacugcauc

SEQ ID NO: 1180346 - RNA, 15 nt, Human
ucgaguuacagacaa

SEQ ID NO: 1180347 - RNA, 17 nt, Human
ucgaguuacagacaaag

SEQ ID NO: 1180348 - RNA, 15 nt, Human
ucuaacuucaccaua

SEQ ID NO: 1180349 - RNA, 16 nt, Human
ucuaacuucaccauau

SEQ ID NO: 1180350 - RNA, 22 nt, Human
ucuaacuucaccauauuaccac

SEQ ID NO: 1180351 - RNA, 21 nt, Human
ucuacacuaagagagaaugag

SEQ ID NO: 1180352 - RNA, 17 nt, Human
ucuacacuccagugaga

SEQ ID NO: 1180353 - RNA, 12 nt, Human
ucuacacugugc

SEQ ID NO: 1180354 - RNA, 14 nt, Human
ucuacacugugcug

SEQ ID NO: 1180355 - RNA, 15 nt, Human
ucuacacugugcuga

SEQ ID NO: 1180356 - RNA, 21 nt, Human
ucuacacugugcugagucuga

SEQ ID NO: 1180357 - RNA, 18 nt, Human
ucuacugaggugcuaugu

SEQ ID NO: 1180358 - RNA, 19 nt, Human
ucuacugaggugcuauguu

SEQ ID NO: 1180359 - RNA, 22 nt, Human
ucuacugaggugcuauguucuu

SEQ ID NO: 1180360 - RNA, 22 nt, Human
ucuagggaaaaaccagcgugug

SEQ ID NO: 1180361 - RNA, 13 nt, Human
ucucaaacucuug

SEQ ID NO: 1180362 - RNA, 21 nt, Human
ucucaaacucuugaccucagg

SEQ ID NO: 1180363 - RNA, 22 nt, Human
ucucaaacucuugaccucaggu

SEQ ID NO: 1180364 - RNA, 15 nt, Human
ucucaacuccaaacu

SEQ ID NO: 1180365 - RNA, 17 nt, Human
ucucacucugucgccca

SEQ ID NO: 1180366 - RNA, 18 nt, Human
ucucacucugucgcccag

SEQ ID NO: 1180367 - RNA, 22 nt, Human
ucucacucugucgcccagucug

SEQ ID NO: 1180368 - RNA, 18 nt, Human
ucucacuguugcccaggc

SEQ ID NO: 1180369 - RNA, 19 nt, Human
ucucacuguugcccaggcu

SEQ ID NO: 1180370 - RNA, 20 nt, Human
ucucacuguugcccaggcug

SEQ ID NO: 1180371 - RNA, 21 nt, Human
ucucacuguugcccaggcugg

SEQ ID NO: 1180372 - RNA, 17 nt, Human
ucucagaaucucaaaua

SEQ ID NO: 1180373 - RNA, 21 nt, Human
ucucagaaucucaaauaacua

SEQ ID NO: 1180374 - RNA, 21 nt, Human
ucucagugucaaugcagcccc

SEQ ID NO: 1180375 - RNA, 14 nt, Human
ucucccccagcccc

SEQ ID NO: 1180376 - RNA, 15 nt, Human
ucucccccagcccca

SEQ ID NO: 1180377 - RNA, 17 nt, Human
ucucccccagccccauc

SEQ ID NO: 1180378 - RNA, 18 nt, Human
ucucccccagccccaucc

SEQ ID NO: 1180379 - RNA, 20 nt, Human
ucucccccagccccauccuc

SEQ ID NO: 1180380 - RNA, 22 nt, Human
ucucccccagccccauccucug

SEQ ID NO: 1180381 - RNA, 22 nt, Human
ucuccugccucagccucccaaa

SEQ ID NO: 1180382 - RNA, 15 nt, Human
ucucuacaaaaagca

SEQ ID NO: 1180383 - RNA, 13 nt, Human
ucuccuguaccuc

SEQ ID NO: 1180384 - RNA, 13 nt, Human
ucucuaggaaaua

SEQ ID NO: 1180385 - RNA, 19 nt, Human
ucucuaggaaauauuuauu

SEQ ID NO: 1180386 - RNA, 18 nt, Human
ucucuaguuugauuaaau

SEQ ID NO: 1180387 - RNA, 19 nt, Human
ucucuaguuugauuaaauu

SEQ ID NO: 1180388 - RNA, 13 nt, Human
ucucugaggacac

SEQ ID NO: 1180389 - RNA, 14 nt, Human
ucucugaggacacu

SEQ ID NO: 1180390 - RNA, 18 nt, Human
ucucuucacagucacauu

SEQ ID NO: 1180391 - RNA, 15 nt, Human
ucucuuuucaaaaca

SEQ ID NO: 1180392 - RNA, 16 nt, Human
ucucuuuucaaaacau

SEQ ID NO: 1180393 - RNA, 16 nt, Human
ucugaaaauguaugug

SEQ ID NO: 1180394 - RNA, 23 nt, Human
ucugaaaauguauguguaaguau

SEQ ID NO: 1180395 - RNA, 13 nt, Human
ucugaaagggacg

SEQ ID NO: 1180396 - RNA, 19 nt, Human
ucugacccaugcugcccug

SEQ ID NO: 1180397 - RNA, 15 nt, Human
ucugacccaugcugc

SEQ ID NO: 1180398 - RNA, 16 nt, Human
ucugacccaugcugcc

SEQ ID NO: 1180399 - RNA, 17 nt, Human
ucugacccaugcugccc

SEQ ID NO: 1180400 - RNA, 18 nt, Human
ucugacccaugcugcccu

SEQ ID NO: 1180401 - RNA, 20 nt, Human
ucugaacuuggcgcugcccc

SEQ ID NO: 1180402 - RNA, 21 nt, Human
ucugaacuuggcgcugccccu

SEQ ID NO: 1180403 - RNA, 14 nt, Human
ucugacccaugcug

SEQ ID NO: 1180404 - RNA, 16 nt, Human
ucugaggaauccagac

SEQ ID NO: 1180405 - RNA, 17 nt, Human
ucugaggaauccagacc

SEQ ID NO: 1180406 - RNA, 20 nt, Human
ucugaggacacuaaccacgc

SEQ ID NO: 1180407 - RNA, 23 nt, Human
ucugaggacacuaaccacgcugg

SEQ ID NO: 1180408 - RNA, 19 nt, Human
ucugcacaagcugcacccu

SEQ ID NO: 1180409 - RNA, 14 nt, Human
ucugcacaagcugc

SEQ ID NO: 1180410 - RNA, 23 nt, Human
ucugauucccaagcucugcuccu

SEQ ID NO: 1180411 - RNA, 19 nt, Human
ucuucuccacuuucuagcc

SEQ ID NO: 1180412 - RNA, 21 nt, Human
ucuucuccacuuucuagccag

SEQ ID NO: 1180413 - RNA, 21 nt, Human
ucuuccacaagagcccaggcc

SEQ ID NO: 1180414 - RNA, 16 nt, Human
ucuucaguaagccgug

SEQ ID NO: 1180415 - RNA, 14 nt, Human
ucuuccaggcuggg

SEQ ID NO: 1180416 - RNA, 15 nt, Human
ucuuauacauuugau

SEQ ID NO: 1180417 - RNA, 14 nt, Human
ucuuagugugugca

SEQ ID NO: 1180418 - RNA, 13 nt, Human
ucuuaugggcugg

SEQ ID NO: 1180419 - RNA, 15 nt, Human
ucuucaguaagccgu

SEQ ID NO: 1180420 - RNA, 12 nt, Human
ucuucuccaggc

SEQ ID NO: 1180421 - RNA, 13 nt, Human
ucuucuccaggcu

SEQ ID NO: 1180422 - RNA, 14 nt, Human
ucuucuccaggcug

SEQ ID NO: 1180423 - RNA, 15 nt, Human
ucuucuccaggcugu

SEQ ID NO: 1180424 - RNA, 16 nt, Human
ucuugaacuccuggcc

SEQ ID NO: 1180425 - RNA, 17 nt, Human
ucuugaacuccuggccu

SEQ ID NO: 1180426 - RNA, 18 nt, Human
ucuugaacuccuggccuc

SEQ ID NO: 1180427 - RNA, 21 nt, Human
ucuugaauuguaaggaaugau

SEQ ID NO: 1180428 - RNA, 11 nt, Human
ucuugcucugc

SEQ ID NO: 1180429 - RNA, 12 nt, Human
ucuugcucugcu

SEQ ID NO: 1180430 - RNA, 13 nt, Human
ucuugcucugcug

SEQ ID NO: 1180431 - RNA, 14 nt, Human
ucuguccuacucug

SEQ ID NO: 1180432 - RNA, 22 nt, Human
ucuguggguuucuaaagcugcc

SEQ ID NO: 1180433 - RNA, 19 nt, Human
ucuguccgagcuuugaaaa

SEQ ID NO: 1180434 - RNA, 17 nt, Human
ucuguacgucugacagg

SEQ ID NO: 1180435 - RNA, 18 nt, Human
ucuguacgucugacaggc

SEQ ID NO: 1180436 - RNA, 23 nt, Human
ucuguggguuucuaaagcugcca

SEQ ID NO: 1180437 - RNA, 22 nt, Human
ucuguuuuauaauuuugugaag

SEQ ID NO: 1180438 - RNA, 18 nt, Human
ucuuaaaaaguggaaaaa

SEQ ID NO: 1180439 - RNA, 18 nt, Human
ucuggagguacgaaaaga

SEQ ID NO: 1180440 - RNA, 14 nt, Human
ucuggcuaugcauu

SEQ ID NO: 1180441 - RNA, 17 nt, Human
ucuggcuaugcauuuga

SEQ ID NO: 1180442 - RNA, 15 nt, Human
ucuggcucuuccagg

SEQ ID NO: 1180443 - RNA, 16 nt, Human
ucuggcucuuccaggc

SEQ ID NO: 1180444 - RNA, 17 nt, Human
ucuggcucuuccaggcu

SEQ ID NO: 1180445 - RNA, 18 nt, Human
ucuggcucuuccaggcug

SEQ ID NO: 1180446 - RNA, 12 nt, Human
ucugggacacag

SEQ ID NO: 1180447 - RNA, 13 nt, Human
ucugggacacagu

SEQ ID NO: 1180448 - RNA, 16 nt, Human
ugaaacgcaaccacca

SEQ ID NO: 1180449 - RNA, 17 nt, Human
ugaaaggaaagaggcuc

SEQ ID NO: 1180450 - RNA, 12 nt, Human
ugaaaggaaaga

SEQ ID NO: 1180451 - RNA, 18 nt, Human
ugaaagcagggacuugaa

SEQ ID NO: 1180452 - RNA, 19 nt, Human
ugaaagcagggacuugaac

SEQ ID NO: 1180453 - RNA, 23 nt, Human
ugaaagcagggacuugaacccau

SEQ ID NO: 1180454 - RNA, 16 nt, Human
ugaaagggcccagaga

SEQ ID NO: 1180455 - RNA, 17 nt, Human
ugaaagggcccagagag

SEQ ID NO: 1180456 - RNA, 18 nt, Human
ugaaagggcccagagagg

SEQ ID NO: 1180457 - RNA, 17 nt, Human
ugaaaucuuuuugcuuu

SEQ ID NO: 1180458 - RNA, 19 nt, Human
ugaaaugaggucagagccu

SEQ ID NO: 1180459 - RNA, 20 nt, Human
ugaaaugaggucagagccug

SEQ ID NO: 1180460 - RNA, 21 nt, Human
ugaaaugaggucagagccugc

SEQ ID NO: 1180461 - RNA, 22 nt, Human
ugaaaugaggucagagccugca

SEQ ID NO: 1180462 - RNA, 23 nt, Human
ugaaaugaggucagagccugcag

SEQ ID NO: 1180463 - RNA, 17 nt, Human
ucuuucacauuuaaaua

SEQ ID NO: 1180464 - RNA, 21 nt, Human
ucuuuucucccuuuuaauccu

SEQ ID NO: 1180465 - RNA, 17 nt, Human
ucuuuugccguuauuaa

SEQ ID NO: 1180466 - RNA, 19 nt, Human
ucuuuugccguuauuaaaa

SEQ ID NO: 1180467 - RNA, 16 nt, Human
ucuuuuugcuuugcuu

SEQ ID NO: 1180468 - RNA, 19 nt, Human
ugaaaacuuuaugcuaagu

SEQ ID NO: 1180469 - RNA, 15 nt, Human
ugaaaagaaaaauga

SEQ ID NO: 1180470 - RNA, 18 nt, Human
ugaacucuucaaucucuu

SEQ ID NO: 1180471 - RNA, 20 nt, Human
ugaaccacaucuugcucugc

SEQ ID NO: 1180472 - RNA, 21 nt, Human
ugaaccacaucuugcucugcu

SEQ ID NO: 1180473 - RNA, 22 nt, Human
ugaaccacaucuugcucugcug

SEQ ID NO: 1180474 - RNA, 15 nt, Human
ugaacucuucaaucu

SEQ ID NO: 1180475 - RNA, 13 nt, Human
ugaacugauaaag

SEQ ID NO: 1180476 - RNA, 15 nt, Human
ugaacugauaaagau

SEQ ID NO: 1180477 - RNA, 19 nt, Human
ugaaauggacuuuuguaca

SEQ ID NO: 1180478 - RNA, 17 nt, Human
ugaagacuuuucuuuca

SEQ ID NO: 1180479 - RNA, 22 nt, Human
ugaagacuuuucuuucagccaa

SEQ ID NO: 1180480 - RNA, 14 nt, Human
ugaagacuuuucuu

SEQ ID NO: 1180481 - RNA, 23 nt, Human
ugaacuggguacuuguggacaca

SEQ ID NO: 1180482 - RNA, 22 nt, Human
ugaacuuguaaaggaauuuaaa

SEQ ID NO: 1180483 - RNA, 14 nt, Human
ugaagacagagcua

SEQ ID NO: 1180484 - RNA, 16 nt, Human
ugaagacagagcuaca

SEQ ID NO: 1180485 - RNA, 19 nt, Human
ugaacuggguacuugugga

SEQ ID NO: 1180486 - RNA, 14 nt, Human
ugaacuuggcgcug

SEQ ID NO: 1180487 - RNA, 12 nt, Human
ugaacuugguuc

SEQ ID NO: 1180488 - RNA, 17 nt, Human
ugaagauguagaggaga

SEQ ID NO: 1180489 - RNA, 20 nt, Human
ugaaggcucgagcaugccug

SEQ ID NO: 1180490 - RNA, 21 nt, Human
ugaaggcucgagcaugccugg

SEQ ID NO: 1180491 - RNA, 21 nt, Human
ugaaguccaagcauuuagaug

SEQ ID NO: 1180492 - RNA, 22 nt, Human
ugaaguccaagcauuuagaugu

SEQ ID NO: 1180493 - RNA, 23 nt, Human
ugcacagcuaacauggaaguacu

SEQ ID NO: 1180494 - RNA, 18 nt, Human
ugcacagcuaacauggaa

SEQ ID NO: 1180495 - RNA, 20 nt, Human
ugcacagcuaacauggaagu

SEQ ID NO: 1180496 - RNA, 15 nt, Human
ugcacaucaaaauau

SEQ ID NO: 1180497 - RNA, 17 nt, Human
ugcacagcuaacaugga

SEQ ID NO: 1180498 - RNA, 23 nt, Human
ugcacagaguuguuacauuuuua

SEQ ID NO: 1180499 - RNA, 21 nt, Human
ugcacagaguuguuacauuuu

SEQ ID NO: 1180500 - RNA, 22 nt, Human
ugcacagaguuguuacauuuuu

SEQ ID NO: 1180501 - RNA, 16 nt, Human
ugaaggcuggguucug

SEQ ID NO: 1180502 - RNA, 17 nt, Human
ugaagucuuuguacaga

SEQ ID NO: 1180503 - RNA, 20 nt, Human
ugaagucuuuguacagacaa

SEQ ID NO: 1180504 - RNA, 22 nt, Human
ugaagucuuuguacagacaaca

SEQ ID NO: 1180505 - RNA, 14 nt, Human
ugcagcaauaaagc

SEQ ID NO: 1180506 - RNA, 15 nt, Human
ugcagcaauaaagca

SEQ ID NO: 1180507 - RNA, 16 nt, Human
ugcagcaauaaagcag

SEQ ID NO: 1180508 - RNA, 20 nt, Human
ugcagcaauaaagcagcguu

SEQ ID NO: 1180509 - RNA, 14 nt, Human
ugcaggaccucagg

SEQ ID NO: 1180510 - RNA, 15 nt, Human
ugcaggaccucaggu

SEQ ID NO: 1180511 - RNA, 16 nt, Human
ugcaggaccucaggug

SEQ ID NO: 1180512 - RNA, 18 nt, Human
ugcaggaccucaggugag

SEQ ID NO: 1180513 - RNA, 16 nt, Human
ugcacguacacacaca

SEQ ID NO: 1180514 - RNA, 19 nt, Human
ugcacguacacacacauac

SEQ ID NO: 1180515 - RNA, 21 nt, Human
ugcacuugcagacucuacaga

SEQ ID NO: 1180516 - RNA, 15 nt, Human
ugcacuuuguucugg

SEQ ID NO: 1180517 - RNA, 18 nt, Human
ugcacuuuguucuggcuc

SEQ ID NO: 1180518 - RNA, 19 nt, Human
ugcacuuuguucuggcucu

SEQ ID NO: 1180519 - RNA, 20 nt, Human
ugcacuuuguucuggcucuu

SEQ ID NO: 1180520 - RNA, 16 nt, Human
ugcagauaaacaguag

SEQ ID NO: 1180521 - RNA, 17 nt, Human
ugcagauaaacaguagu

SEQ ID NO: 1180522 - RNA, 15 nt, Human
ugcaucguuucaucu

SEQ ID NO: 1180523 - RNA, 17 nt, Human
ugcaucguuucaucuuc

SEQ ID NO: 1180524 - RNA, 16 nt, Human
ugcaggcagccaggcc

SEQ ID NO: 1180525 - RNA, 17 nt, Human
ugcaggcagccaggcca

SEQ ID NO: 1180526 - RNA, 18 nt, Human
ugcaggcagccaggccac

SEQ ID NO: 1180527 - RNA, 19 nt, Human
ugcaggcagccaggccaca

SEQ ID NO: 1180528 - RNA, 19 nt, Human
ugcauguuacauaagauaa

SEQ ID NO: 1180529 - RNA, 15 nt, Human
ugcauuauauuuauu

SEQ ID NO: 1180530 - RNA, 20 nt, Human
ugcauuauauuuauuacugu

SEQ ID NO: 1180531 - RNA, 21 nt, Human
ugcauuauauuuauuacugua

SEQ ID NO: 1180532 - RNA, 11 nt, Human
ugccagggaca

SEQ ID NO: 1180533 - RNA, 22 nt, Human
ugccagggacagaggggguggc

SEQ ID NO: 1180534 - RNA, 14 nt, Human
ugccagucaccccg

SEQ ID NO: 1180535 - RNA, 15 nt, Human
ugccagucaccccgg

SEQ ID NO: 1180536 - RNA, 20 nt, Human
ugccaucucaccuccugcug

SEQ ID NO: 1180537 - RNA, 21 nt, Human
ugccaucucaccuccugcugg

SEQ ID NO: 1180538 - RNA, 22 nt, Human
ugccaucucaccuccugcuggg

SEQ ID NO: 1180539 - RNA, 23 nt, Human
ugccaucucaccuccugcugggc

SEQ ID NO: 1180540 - RNA, 15 nt, Human
ugcccaccuggccuc

SEQ ID NO: 1180541 - RNA, 17 nt, Human
ugcccaccuggccucug

SEQ ID NO: 1180542 - RNA, 18 nt, Human
ugcccaccuggccucugc

SEQ ID NO: 1180543 - RNA, 19 nt, Human
ugcccaccuggccucugca

SEQ ID NO: 1180544 - RNA, 10 nt, Human
ugcccagccc

SEQ ID NO: 1180545 - RNA, 11 nt, Human
ugcccagcccc

SEQ ID NO: 1180546 - RNA, 12 nt, Human
ugcccagccccu

SEQ ID NO: 1180547 - RNA, 23 nt, Human
ugcccaggcuggcgugcaguggu

SEQ ID NO: 1180548 - RNA, 16 nt, Human
ugccuccuuugugagg

SEQ ID NO: 1180549 - RNA, 17 nt, Human
ugccuccuuugugagga

SEQ ID NO: 1180550 - RNA, 18 nt, Human
ugccuccuuugugaggaa

SEQ ID NO: 1180551 - RNA, 20 nt, Human
ugccuccuuugugaggaagc

SEQ ID NO: 1180552 - RNA, 18 nt, Human
ugccugaagucacacagu

SEQ ID NO: 1180553 - RNA, 22 nt, Human
ugccugaagucacacagugagu

SEQ ID NO: 1180554 - RNA, 18 nt, Human
ugccuuauggaacacucu

SEQ ID NO: 1180555 - RNA, 20 nt, Human
ugccuuauggaacacucuga

SEQ ID NO: 1180556 - RNA, 21 nt, Human
ugccuuauggaacacucugag

SEQ ID NO: 1180557 - RNA, 22 nt, Human
ugccuuauggaacacucugaga

SEQ ID NO: 1180558 - RNA, 13 nt, Human
ugcgccuacagga

SEQ ID NO: 1180559 - RNA, 23 nt, Human
ugcggugcuaucucccccagccc

SEQ ID NO: 1180560 - RNA, 22 nt, Human
ugccuucucaacuccaaacuga

SEQ ID NO: 1180561 - RNA, 19 nt, Human
ugcuagaacucccuuucaa

SEQ ID NO: 1180562 - RNA, 20 nt, Human
ugcuagaacucccuuucaac

SEQ ID NO: 1180563 - RNA, 21 nt, Human
ugcuagaacucccuuucaaca

SEQ ID NO: 1180564 - RNA, 16 nt, Human
ugcuaggaacacuccu

SEQ ID NO: 1180565 - RNA, 17 nt, Human
ugcuaggaacacuccuu

SEQ ID NO: 1180566 - RNA, 19 nt, Human
ugcuaggaacacuccuuca

SEQ ID NO: 1180567 - RNA, 20 nt, Human
ugcuaggaacacuccuucac

SEQ ID NO: 1180568 - RNA, 14 nt, Human
ugcuaguaauugga

SEQ ID NO: 1180569 - RNA, 11 nt, Human
ugcucauggaa

SEQ ID NO: 1180570 - RNA, 19 nt, Human
ugcuccucuccccagcaag

SEQ ID NO: 1180571 - RNA, 19 nt, Human
ugcuccuggcccacugcau

SEQ ID NO: 1180572 - RNA, 18 nt, Human
ugcugaauacagaggcaa

SEQ ID NO: 1180573 - RNA, 23 nt, Human
ugcugaauacagaggcaacugca

SEQ ID NO: 1180574 - RNA, 17 nt, Human
ugcugaaugguuuucaa

SEQ ID NO: 1180575 - RNA, 18 nt, Human
ugcugaaugguuuucaaa

SEQ ID NO: 1180576 - RNA, 22 nt, Human
ugcugaaugguuuucaaaauaa

SEQ ID NO: 1180577 - RNA, 15 nt, Human
ugcugacagacacag

SEQ ID NO: 1180578 - RNA, 16 nt, Human
ugcugacagacacagg

SEQ ID NO: 1180579 - RNA, 19 nt, Human
ugcugacagacacaggccc

SEQ ID NO: 1180580 - RNA, 20 nt, Human
ugcugauggugcaaugaccu

SEQ ID NO: 1180581 - RNA, 23 nt, Human
ugcugauggugcaaugaccuuuc

SEQ ID NO: 1180582 - RNA, 15 nt, Human
ugcugcaguugccag

SEQ ID NO: 1180583 - RNA, 16 nt, Human
ugcugcaguugccagu

SEQ ID NO: 1180584 - RNA, 18 nt, Human
ugcuuccagugaggcucu

SEQ ID NO: 1180585 - RNA, 19 nt, Human
ugcuuccagugaggcucug

SEQ ID NO: 1180586 - RNA, 20 nt, Human
ugcuuccagugaggcucugc

SEQ ID NO: 1180587 - RNA, 21 nt, Human
ugcuuccagugaggcucugcc

SEQ ID NO: 1180588 - RNA, 12 nt, Human
ugcuucucacug

SEQ ID NO: 1180589 - RNA, 14 nt, Human
ugcuucuguuuuau

SEQ ID NO: 1180590 - RNA, 16 nt, Human
ugcuucuucagagacu

SEQ ID NO: 1180591 - RNA, 17 nt, Human
ugcuucuguuuuauaau

SEQ ID NO: 1180592 - RNA, 17 nt, Human
uggaaaaauagccugcc

SEQ ID NO: 1180593 - RNA, 15 nt, Human
uggaaaauaaauuau

SEQ ID NO: 1180594 - RNA, 16 nt, Human
uggaaaauaaauuauu

SEQ ID NO: 1180595 - RNA, 14 nt, Human
uggaacucucgagc

SEQ ID NO: 1180596 - RNA, 11 nt, Human
uggaagacagc

SEQ ID NO: 1180597 - RNA, 12 nt, Human
uggaagacagcu

SEQ ID NO: 1180598 - RNA, 14 nt, Human
uggaagacagcucu

SEQ ID NO: 1180599 - RNA, 15 nt, Human
uggaagacagcucuu

SEQ ID NO: 1180600 - RNA, 12 nt, Human
uggacaggcaug

SEQ ID NO: 1180601 - RNA, 16 nt, Human
uggacaggcauguucu

SEQ ID NO: 1180602 - RNA, 17 nt, Human
uggacaggcauguucuc

SEQ ID NO: 1180603 - RNA, 22 nt, Human
uggaggcaugugaugagaggaa

SEQ ID NO: 1180604 - RNA, 20 nt, Human
uggcagugggagcugccugu

SEQ ID NO: 1180605 - RNA, 14 nt, Human
uggcagugggagcu

SEQ ID NO: 1180606 - RNA, 15 nt, Human
uggcagugggagcug

SEQ ID NO: 1180607 - RNA, 16 nt, Human
uggcagugggagcugc

SEQ ID NO: 1180608 - RNA, 19 nt, Human
uggcagugggagcugccug

SEQ ID NO: 1180609 - RNA, 14 nt, Human
uggaugccuggugg

SEQ ID NO: 1180610 - RNA, 15 nt, Human
uggaugccugguggc

SEQ ID NO: 1180611 - RNA, 14 nt, Human
uggcacugcuucca

SEQ ID NO: 1180612 - RNA, 16 nt, Human
uggcacugcuuccagu

SEQ ID NO: 1180613 - RNA, 18 nt, Human
uggcacugcuuccaguga

SEQ ID NO: 1180614 - RNA, 19 nt, Human
uggcacugcuuccagugag

SEQ ID NO: 1180615 - RNA, 21 nt, Human
uggcagcugcgguccacccag

SEQ ID NO: 1180616 - RNA, 22 nt, Human
uggcagcugcgguccacccagg

SEQ ID NO: 1180617 - RNA, 23 nt, Human
uggcagcugcgguccacccagga

SEQ ID NO: 1180618 - RNA, 20 nt, Human
uggcucagguggggucacuc

SEQ ID NO: 1180619 - RNA, 22 nt, Human
uggcucagguggggucacucug

SEQ ID NO: 1180620 - RNA, 14 nt, Human
uggcuaaauucaug

SEQ ID NO: 1180621 - RNA, 13 nt, Human
uggcucuuccagg

SEQ ID NO: 1180622 - RNA, 15 nt, Human
uggcucuuccaggcu

SEQ ID NO: 1180623 - RNA, 16 nt, Human
uggcucuuccaggcug

SEQ ID NO: 1180624 - RNA, 19 nt, Human
uggcucuuccaggcuggga

SEQ ID NO: 1180625 - RNA, 12 nt, Human
uggcugggggcc

SEQ ID NO: 1180626 - RNA, 15 nt, Human
uggccagaugcacca

SEQ ID NO: 1180627 - RNA, 17 nt, Human
uggccuucggccuccau

SEQ ID NO: 1180628 - RNA, 18 nt, Human
uggccuucggccuccauc

SEQ ID NO: 1180629 - RNA, 20 nt, Human
uggccuucggccuccauccu

SEQ ID NO: 1180630 - RNA, 14 nt, Human
uggcgcugccccug

SEQ ID NO: 1180631 - RNA, 15 nt, Human
uggcgcugccccugg

SEQ ID NO: 1180632 - RNA, 22 nt, Human
uggcgugcaguggugcgaucug

SEQ ID NO: 1180633 - RNA, 22 nt, Human
ugggaaugaaugucagugugac

SEQ ID NO: 1180634 - RNA, 18 nt, Human
ugggacagucaccucaug

SEQ ID NO: 1180635 - RNA, 20 nt, Human
ugggacagucaccucaugga

SEQ ID NO: 1180636 - RNA, 21 nt, Human
ugggacagucaccucauggaa

SEQ ID NO: 1180637 - RNA, 14 nt, Human
uggcugggggccuc

SEQ ID NO: 1180638 - RNA, 22 nt, Human
uggcugguuagagguucccuuu

SEQ ID NO: 1180639 - RNA, 15 nt, Human
uggcugggggccuca

SEQ ID NO: 1180640 - RNA, 16 nt, Human
ugggacaugggaaagg

SEQ ID NO: 1180641 - RNA, 19 nt, Human
ugggacauuugcucaugga

SEQ ID NO: 1180642 - RNA, 20 nt, Human
ugggacauuugcucauggaa

SEQ ID NO: 1180643 - RNA, 16 nt, Human
ugggccuccugugugu

SEQ ID NO: 1180644 - RNA, 22 nt, Human
ugggccuccugugugugcgccu

SEQ ID NO: 1180645 - RNA, 14 nt, Human
ugggccuccugugu

SEQ ID NO: 1180646 - RNA, 24 nt, Human
ugggagcugccuguucagcuccag

SEQ ID NO: 1180647 - RNA, 18 nt, Human
ugggcuucaguggcagcu

SEQ ID NO: 1180648 - RNA, 19 nt, Human
ugggcuucaguggcagcug

SEQ ID NO: 1180649 - RNA, 21 nt, Human
ugggcuucaguggcagcugcu

SEQ ID NO: 1180650 - RNA, 20 nt, Human
ugggcuucaguggcagcugc

SEQ ID NO: 1180651 - RNA, 19 nt, Human
ugggcuuggggaccagagc

SEQ ID NO: 1180652 - RNA, 21 nt, Human
ugggcuuggggaccagagcug

SEQ ID NO: 1180653 - RNA, 22 nt, Human
ugggcuuggggaccagagcugc

SEQ ID NO: 1180654 - RNA, 16 nt, Human
uggggcagcuugaggg

SEQ ID NO: 1180655 - RNA, 15 nt, Human
uggguucuacccagg

SEQ ID NO: 1180656 - RNA, 21 nt, Human
ugggugucaagagggucugag

SEQ ID NO: 1180657 - RNA, 23 nt, Human
ugggugucaagagggucugagga

SEQ ID NO: 1180658 - RNA, 14 nt, Human
uggguguggcgcag

SEQ ID NO: 1180659 - RNA, 23 nt, Human
uggguucaagcgauucuucugcu

SEQ ID NO: 1180660 - RNA, 16 nt, Human
uggguucacugcaacc

SEQ ID NO: 1180661 - RNA, 17 nt, Human
ugggguggggaccucag

SEQ ID NO: 1180662 - RNA, 17 nt, Human
uggguagacacacauga

SEQ ID NO: 1180663 - RNA, 17 nt, Human
uguacgucugacaggca

SEQ ID NO: 1180664 - RNA, 17 nt, Human
uguagauaauacaguuc

SEQ ID NO: 1180665 - RNA, 19 nt, Human
uguacugcauaugaaagga

SEQ ID NO: 1180666 - RNA, 15 nt, Human
uguaccgcaauguga

SEQ ID NO: 1180667 - RNA, 22 nt, Human
uguaccucuugagccuugaacu

SEQ ID NO: 1180668 - RNA, 23 nt, Human
uguaccucuugagccuugaacuu

SEQ ID NO: 1180669 - RNA, 15 nt, Human
uguaaucacagcuac

SEQ ID NO: 1180670 - RNA, 13 nt, Human
uguaaauuaacuu

SEQ ID NO: 1180671 - RNA, 14 nt, Human
uguaaauuaacuuu

SEQ ID NO: 1180672 - RNA, 15 nt, Human
uguaaauuaacuuuu

SEQ ID NO: 1180673 - RNA, 16 nt, Human
uguaaauuaacuuuua

SEQ ID NO: 1180674 - RNA, 17 nt, Human
uguaaauuaacuuuuau

SEQ ID NO: 1180675 - RNA, 19 nt, Human
uguaucccaugagccucag

SEQ ID NO: 1180676 - RNA, 23 nt, Human
uguaucccaugagccucagcauc

SEQ ID NO: 1180677 - RNA, 12 nt, Human
ugucagugugac

SEQ ID NO: 1180678 - RNA, 20 nt, Human
ugucagugugacugaucucu

SEQ ID NO: 1180679 - RNA, 14 nt, Human
ugucagugugacug

SEQ ID NO: 1180680 - RNA, 23 nt, Human
ugucccaaaaagaaaggagggga

SEQ ID NO: 1180681 - RNA, 13 nt, Human
uguccccaccgca

SEQ ID NO: 1180682 - RNA, 21 nt, Human
ugucucaguccaugaagaugu

SEQ ID NO: 1180683 - RNA, 22 nt, Human
ugucucaguccaugaagaugua

SEQ ID NO: 1180684 - RNA, 18 nt, Human
ugucuuuggacccugagg

SEQ ID NO: 1180685 - RNA, 19 nt, Human
ugucuuuggacccugaggc

SEQ ID NO: 1180686 - RNA, 22 nt, Human
ugucuuuggacccugaggccca

SEQ ID NO: 1180687 - RNA, 13 nt, Human
ugugaaaggaaag

SEQ ID NO: 1180688 - RNA, 14 nt, Human
ugugaaaggaaaga

SEQ ID NO: 1180689 - RNA, 21 nt, Human
ugugacaaggauugcuacugu

SEQ ID NO: 1180690 - RNA, 15 nt, Human
ugugacauguuuuau

SEQ ID NO: 1180691 - RNA, 22 nt, Human
ugugaccacugcagaagacagu

SEQ ID NO: 1180692 - RNA, 18 nt, Human
ugugaguacuacaguccu

SEQ ID NO: 1180693 - RNA, 19 nt, Human
ugugaguacuacaguccuc

SEQ ID NO: 1180694 - RNA, 20 nt, Human
ugugaguacuacaguccucc

SEQ ID NO: 1180695 - RNA, 23 nt, Human
ugugaguacuacaguccucccau

SEQ ID NO: 1180696 - RNA, 15 nt, Human
ugugagucaccaagc

SEQ ID NO: 1180697 - RNA, 21 nt, Human
ugugauacaaugcugugcccu

SEQ ID NO: 1180698 - RNA, 13 nt, Human
ugugccucuggga

SEQ ID NO: 1180699 - RNA, 15 nt, Human
ugugccucugggacu

SEQ ID NO: 1180700 - RNA, 16 nt, Human
ugugccucugggacug

SEQ ID NO: 1180701 - RNA, 22 nt, Human
ugugcacaugcacgugugugca

SEQ ID NO: 1180702 - RNA, 14 nt, Human
ugugcacguacaca

SEQ ID NO: 1180703 - RNA, 17 nt, Human
ugugccucugggacugg

SEQ ID NO: 1180704 - RNA, 20 nt, Human
ugugcgugcauguguguuca

SEQ ID NO: 1180705 - RNA, 14 nt, Human
uguggacacagcuc

SEQ ID NO: 1180706 - RNA, 12 nt, Human
uguggagaagcg

SEQ ID NO: 1180707 - RNA, 21 nt, Human
uguggagaagcggcuggcagc

SEQ ID NO: 1180708 - RNA, 15 nt, Human
uguggacacagcucu

SEQ ID NO: 1180709 - RNA, 16 nt, Human
uguggacacagcucuu

SEQ ID NO: 1180710 - RNA, 12 nt, Human
ugugggaagggg

SEQ ID NO: 1180711 - RNA, 14 nt, Human
uguucuuucuggcu

SEQ ID NO: 1180712 - RNA, 18 nt, Human
uguucugacccugcuuca

SEQ ID NO: 1180713 - RNA, 19 nt, Human
uguucucugcccuccaaga

SEQ ID NO: 1180714 - RNA, 15 nt, Human
uguucugacccugcu

SEQ ID NO: 1180715 - RNA, 20 nt, Human
uguucuuucuggcuaugcau

SEQ ID NO: 1180716 - RNA, 22 nt, Human
uguucuuucuggcuaugcauuu

SEQ ID NO: 1180717 - RNA, 23 nt, Human
uguucuuucuggcuaugcauuug

SEQ ID NO: 1180718 - RNA, 11 nt, Human
uguugaaagau

SEQ ID NO: 1180719 - RNA, 16 nt, Human
uguucucugaggacac

SEQ ID NO: 1180720 - RNA, 18 nt, Human
uguucucugaggacacua

SEQ ID NO: 1180721 - RNA, 12 nt, Human
uguucucugccc

SEQ ID NO: 1180722 - RNA, 21 nt, Human
uguuggagaagaacugaaauc

SEQ ID NO: 1180723 - RNA, 11 nt, Human
uguuggccagg

SEQ ID NO: 1180724 - RNA, 14 nt, Human
uguuggccaggcug

SEQ ID NO: 1180725 - RNA, 13 nt, Human
uguguuuauuguc

SEQ ID NO: 1180726 - RNA, 19 nt, Human
ugugucagcauagaaguaa

SEQ ID NO: 1180727 - RNA, 13 nt, Human
uguuacauuuuua

SEQ ID NO: 1180728 - RNA, 22 nt, Human
uguuacauuuuuaagugcugca

SEQ ID NO: 1180729 - RNA, 15 nt, Human
uguuacugucuucag

SEQ ID NO: 1180730 - RNA, 16 nt, Human
uguuacugucuucagu

SEQ ID NO: 1180731 - RNA, 12 nt, Human
uguuauaaucuu

SEQ ID NO: 1180732 - RNA, 15 nt, Human
uguucagcuccagcu

SEQ ID NO: 1180733 - RNA, 16 nt, Human
uguucagcuccagcuc

SEQ ID NO: 1180734 - RNA, 18 nt, Human
uguucagcuccagcucac

SEQ ID NO: 1180735 - RNA, 11 nt, Human
uguucagcugg

SEQ ID NO: 1180736 - RNA, 16 nt, Human
uuaaaugcaccuggaa

SEQ ID NO: 1180737 - RNA, 17 nt, Human
uuaaaugcaccuggaau

SEQ ID NO: 1180738 - RNA, 18 nt, Human
uuaaaugcaccuggaaua

SEQ ID NO: 1180739 - RNA, 13 nt, Human
uuaaaugcccagc

SEQ ID NO: 1180740 - RNA, 18 nt, Human
uuaaaugcccagccccuu

SEQ ID NO: 1180741 - RNA, 12 nt, Human
uuaaaugcugcu

SEQ ID NO: 1180742 - RNA, 14 nt, Human
uuaaaacccaagug

SEQ ID NO: 1180743 - RNA, 19 nt, Human
uuaaaagaaugauuaugaa

SEQ ID NO: 1180744 - RNA, 16 nt, Human
uuaaacuuaaucuaaa

SEQ ID NO: 1180745 - RNA, 18 nt, Human
uuaaacuuaaucuaaaug

SEQ ID NO: 1180746 - RNA, 20 nt, Human
uuaaacuuaaucuaaaugga

SEQ ID NO: 1180747 - RNA, 22 nt, Human
uuaaacuuaaucuaaauggaac

SEQ ID NO: 1180748 - RNA, 17 nt, Human
uguuuguugucagcuga

SEQ ID NO: 1180749 - RNA, 20 nt, Human
uguuuccuggcacugcuucc

SEQ ID NO: 1180750 - RNA, 21 nt, Human
uguuuccuggcacugcuucca

SEQ ID NO: 1180751 - RNA, 22 nt, Human
uguuuccuggcacugcuuccag

SEQ ID NO: 1180752 - RNA, 23 nt, Human
uguuuccuggcacugcuuccagu

SEQ ID NO: 1180753 - RNA, 17 nt, Human
uuaaugucacaggcagg

SEQ ID NO: 1180754 - RNA, 18 nt, Human
uuaaugucacaggcaggu

SEQ ID NO: 1180755 - RNA, 21 nt, Human
uuaaggaagacaaugugaaaa

SEQ ID NO: 1180756 - RNA, 17 nt, Human
uuaaggaugcuuguaca

SEQ ID NO: 1180757 - RNA, 18 nt, Human
uuaaggaugcuuguacau

SEQ ID NO: 1180758 - RNA, 19 nt, Human
uuaaggaugcuuguacaua

SEQ ID NO: 1180759 - RNA, 20 nt, Human
uuaaggaugcuuguacauaa

SEQ ID NO: 1180760 - RNA, 22 nt, Human
uuaaggaugcuuguacauaaug

SEQ ID NO: 1180761 - RNA, 18 nt, Human
uuaauaauguuucaaaca

SEQ ID NO: 1180762 - RNA, 14 nt, Human
uuacauuuguauaa

SEQ ID NO: 1180763 - RNA, 15 nt, Human
uuacauuuguauaaa

SEQ ID NO: 1180764 - RNA, 20 nt, Human
uuacauuuuuaagugcugca

SEQ ID NO: 1180765 - RNA, 21 nt, Human
uuacauuuuuaagugcugcau

SEQ ID NO: 1180766 - RNA, 22 nt, Human
uuacauuuuuaagugcugcauu

SEQ ID NO: 1180767 - RNA, 20 nt, Human
uuacauuuguauaaaauaau

SEQ ID NO: 1180768 - RNA, 23 nt, Human
uuacauuuuuaagugcugcauuu

SEQ ID NO: 1180769 - RNA, 21 nt, Human
uuaccacuuguguuuugcaag

SEQ ID NO: 1180770 - RNA, 14 nt, Human
uuaccagcagagca

SEQ ID NO: 1180771 - RNA, 19 nt, Human
uuaccuuuuuuauacauaa

SEQ ID NO: 1180772 - RNA, 20 nt, Human
uuaccuuuuuuauacauaaa

SEQ ID NO: 1180773 - RNA, 22 nt, Human
uuaccuuuuuuauacauaaaca

SEQ ID NO: 1180774 - RNA, 20 nt, Human
uuacgguuuuccagguuuaa

SEQ ID NO: 1180775 - RNA, 13 nt, Human
uucaaagauauuu

SEQ ID NO: 1180776 - RNA, 13 nt, Human
uuacgugaguccu

SEQ ID NO: 1180777 - RNA, 14 nt, Human
uuacgugaguccug

SEQ ID NO: 1180778 - RNA, 21 nt, Human
uucaacagguuuuccugaaga

SEQ ID NO: 1180779 - RNA, 18 nt, Human
uucaauucucauuuguca

SEQ ID NO: 1180780 - RNA, 17 nt, Human
uucaggaagcucagggc

SEQ ID NO: 1180781 - RNA, 19 nt, Human
uucaggaagcucagggccu

SEQ ID NO: 1180782 - RNA, 20 nt, Human
uucaggaagcucagggccug

SEQ ID NO: 1180783 - RNA, 23 nt, Human
uucagcuccagcucaccagcccc

SEQ ID NO: 1180784 - RNA, 17 nt, Human
uucagcucugcaagaau

SEQ ID NO: 1180785 - RNA, 24 nt, Human
uucagcucugcaagaauugaagca

SEQ ID NO: 1180786 - RNA, 17 nt, Human
uucagcugacuuuucug

SEQ ID NO: 1180787 - RNA, 21 nt, Human
uucagcugguugagguuucaa

SEQ ID NO: 1180788 - RNA, 16 nt, Human
uucaggaagcucaggg

SEQ ID NO: 1180789 - RNA, 14 nt, Human
uucacucuccuugg

SEQ ID NO: 1180790 - RNA, 15 nt, Human
uucagagacuccugc

SEQ ID NO: 1180791 - RNA, 19 nt, Human
uucagagacuccugcaggc

SEQ ID NO: 1180792 - RNA, 19 nt, Human
uucagugccuuauggaaca

SEQ ID NO: 1180793 - RNA, 21 nt, Human
uucagugccuuauggaacacu

SEQ ID NO: 1180794 - RNA, 13 nt, Human
uucaguggcagcu

SEQ ID NO: 1180795 - RNA, 13 nt, Human
uucauaaugacuu

SEQ ID NO: 1180796 - RNA, 23 nt, Human
uucauaaugacuuaagcacacuu

SEQ ID NO: 1180797 - RNA, 20 nt, Human
uucaucuuccaacucaaacu

SEQ ID NO: 1180798 - RNA, 11 nt, Human
uucaucuugaa

SEQ ID NO: 1180799 - RNA, 12 nt, Human
uucaucuugaau

SEQ ID NO: 1180800 - RNA, 17 nt, Human
uucaucuugaauuguaa

SEQ ID NO: 1180801 - RNA, 19 nt, Human
uucauuuaggugaggaagc

SEQ ID NO: 1180802 - RNA, 19 nt, Human
uuccacuuauaggaauuga

SEQ ID NO: 1180803 - RNA, 17 nt, Human
uuccaugaguccccugu

SEQ ID NO: 1180804 - RNA, 16 nt, Human
uuccuucagugccuua

SEQ ID NO: 1180805 - RNA, 19 nt, Human
uuccuucagugccuuaugg

SEQ ID NO: 1180806 - RNA, 23 nt, Human
uuccuucagugccuuauggaaca

SEQ ID NO: 1180807 - RNA, 19 nt, Human
uuccuucauucaacccacc

SEQ ID NO: 1180808 - RNA, 18 nt, Human
uucggccuccauccugag

SEQ ID NO: 1180809 - RNA, 19 nt, Human
uucggccuccauccugagg

SEQ ID NO: 1180810 - RNA, 22 nt, Human
uucggccuccauccugaggcuc

SEQ ID NO: 1180811 - RNA, 16 nt, Human
uucuaaaggcuaccuu

SEQ ID NO: 1180812 - RNA, 17 nt, Human
uucuaaaggcuaccuuu

SEQ ID NO: 1180813 - RNA, 18 nt, Human
uucuaaaggcuaccuuug

SEQ ID NO: 1180814 - RNA, 19 nt, Human
uucuaaaggcuaccuuugu

SEQ ID NO: 1180815 - RNA, 22 nt, Human
uuccccacuugagaauuacccu

SEQ ID NO: 1180816 - RNA, 19 nt, Human
uucccuuugacgccauccc

SEQ ID NO: 1180817 - RNA, 23 nt, Human
uuccucauaguaugguggcuggg

SEQ ID NO: 1180818 - RNA, 12 nt, Human
uuccucccuccc

SEQ ID NO: 1180819 - RNA, 19 nt, Human
uuccucccucccucuuucc

SEQ ID NO: 1180820 - RNA, 21 nt, Human
uuccucccucccucuuucccu

SEQ ID NO: 1180821 - RNA, 22 nt, Human
uuccucccucccucuuucccuc

SEQ ID NO: 1180822 - RNA, 14 nt, Human
uucuauuguuucuu

SEQ ID NO: 1180823 - RNA, 16 nt, Human
uucuaugacacaugca

SEQ ID NO: 1180824 - RNA, 17 nt, Human
uucuaugacacaugcaa

SEQ ID NO: 1180825 - RNA, 16 nt, Human
uucuccaagcaggaca

SEQ ID NO: 1180826 - RNA, 13 nt, Human
uucuccacccugc

SEQ ID NO: 1180827 - RNA, 16 nt, Human
uucuccacccugcucu

SEQ ID NO: 1180828 - RNA, 11 nt, Human
uucuccaggcu

SEQ ID NO: 1180829 - RNA, 18 nt, Human
uucucuccagccccugga

SEQ ID NO: 1180830 - RNA, 23 nt, Human
uucucuccucuccccaugauguu

SEQ ID NO: 1180831 - RNA, 18 nt, Human
uucugacccaugcugccc

SEQ ID NO: 1180832 - RNA, 20 nt, Human
uucugacccaugcugcccug

SEQ ID NO: 1180833 - RNA, 21 nt, Human
uucugacccaugcugcccugu

SEQ ID NO: 1180834 - RNA, 22 nt, Human
uucugacccaugcugcccugug

SEQ ID NO: 1180835 - RNA, 23 nt, Human
uucuguggguuucuaaagcugcc

SEQ ID NO: 1180836 - RNA, 17 nt, Human
uucuguccuacucugug

SEQ ID NO: 1180837 - RNA, 19 nt, Human
uucuguccuacucuguguc

SEQ ID NO: 1180838 - RNA, 14 nt, Human
uucugagcauuuaa

SEQ ID NO: 1180839 - RNA, 21 nt, Human
uucuguccgagcuuugaaaau

SEQ ID NO: 1180840 - RNA, 11 nt, Human
uucuguucuuu

SEQ ID NO: 1180841 - RNA, 19 nt, Human
uucuuauuuaaugaaagac

SEQ ID NO: 1180842 - RNA, 23 nt, Human
uucuuauuuaaugaaagacugua

SEQ ID NO: 1180843 - RNA, 13 nt, Human
uucuugguuugua

SEQ ID NO: 1180844 - RNA, 16 nt, Human
uucuugguuuguaaau

SEQ ID NO: 1180845 - RNA, 17 nt, Human
uucuugguuuguaaauu

SEQ ID NO: 1180846 - RNA, 18 nt, Human
uucuugguuuguaaauua

SEQ ID NO: 1180847 - RNA, 23 nt, Human
uucuugguuuguaaauuaacuuu

SEQ ID NO: 1180848 - RNA, 18 nt, Human
uucuuuauaauucuacuu

SEQ ID NO: 1180849 - RNA, 19 nt, Human
uugaaaacacuguucucug

SEQ ID NO: 1180850 - RNA, 21 nt, Human
uugaaaacacuguucucugcc

SEQ ID NO: 1180851 - RNA, 22 nt, Human
uugaaaacacuguucucugccc

SEQ ID NO: 1180852 - RNA, 19 nt, Human
uugaacucuucaaucucuu

SEQ ID NO: 1180853 - RNA, 16 nt, Human
uugaacugauaaagau

SEQ ID NO: 1180854 - RNA, 22 nt, Human
uugaacuuugaccucugcagca

SEQ ID NO: 1180855 - RNA, 17 nt, Human
uugaagacagagcuaca

SEQ ID NO: 1180856 - RNA, 19 nt, Human
uugaagacuuuucuuucag

SEQ ID NO: 1180857 - RNA, 22 nt, Human
uugcagacaggcaagcaccucc

SEQ ID NO: 1180858 - RNA, 16 nt, Human
uugcagacaggcaagc

SEQ ID NO: 1180859 - RNA, 14 nt, Human
uugcaacaggcugg

SEQ ID NO: 1180860 - RNA, 17 nt, Human
uugcaacaggcugggcu

SEQ ID NO: 1180861 - RNA, 18 nt, Human
uugauuuccguuaaaaua

SEQ ID NO: 1180862 - RNA, 21 nt, Human
uugauagcacagacccugccc

SEQ ID NO: 1180863 - RNA, 23 nt, Human
uugauagcacagacccugcccug

SEQ ID NO: 1180864 - RNA, 12 nt, Human
uugaugaagaag

SEQ ID NO: 1180865 - RNA, 13 nt, Human
uugaugaagaagu

SEQ ID NO: 1180866 - RNA, 22 nt, Human
uugaccugaggcccuucucucc

SEQ ID NO: 1180867 - RNA, 12 nt, Human
uugaccugaggc

SEQ ID NO: 1180868 - RNA, 19 nt, Human
uugaccugaggcccuucuc

SEQ ID NO: 1180869 - RNA, 14 nt, Human
uugacgccauccca

SEQ ID NO: 1180870 - RNA, 15 nt, Human
uugacgccaucccag

SEQ ID NO: 1180871 - RNA, 22 nt, Human
uugacgccaucccagccccaau

SEQ ID NO: 1180872 - RNA, 20 nt, Human
uugaccgugaggccagagac

SEQ ID NO: 1180873 - RNA, 21 nt, Human
uugaccgugaggccagagaca

SEQ ID NO: 1180874 - RNA, 15 nt, Human
uugaccucaggugau

SEQ ID NO: 1180875 - RNA, 21 nt, Human
uugaccucaggugauccaccc

SEQ ID NO: 1180876 - RNA, 14 nt, Human
uugaggacacugau

SEQ ID NO: 1180877 - RNA, 15 nt, Human
uugaggacacugaua

SEQ ID NO: 1180878 - RNA, 19 nt, Human
uugauagcacagacccugc

SEQ ID NO: 1180879 - RNA, 20 nt, Human
uugauagcacagacccugcc

SEQ ID NO: 1180880 - RNA, 18 nt, Human
uugccagucaccccggcc

SEQ ID NO: 1180881 - RNA, 11 nt, Human
uugcccaggca

SEQ ID NO: 1180882 - RNA, 11 nt, Human
uugccucugcc

SEQ ID NO: 1180883 - RNA, 14 nt, Human
uugccucugccucu

SEQ ID NO: 1180884 - RNA, 16 nt, Human
uugccucugccucuga

SEQ ID NO: 1180885 - RNA, 18 nt, Human
uugccucugccucugaca

SEQ ID NO: 1180886 - RNA, 20 nt, Human
uugcugauggugcaaugacc

SEQ ID NO: 1180887 - RNA, 22 nt, Human
uugcugauggugcaaugaccuu

SEQ ID NO: 1180888 - RNA, 15 nt, Human
uuggacccugaggcc

SEQ ID NO: 1180889 - RNA, 14 nt, Human
uuggauuguccccg

SEQ ID NO: 1180890 - RNA, 17 nt, Human
uuggcaaaaaggcagga

SEQ ID NO: 1180891 - RNA, 19 nt, Human
uuggaaggaacguccccug

SEQ ID NO: 1180892 - RNA, 14 nt, Human
uuggccaggcuggu

SEQ ID NO: 1180893 - RNA, 24 nt, Human
uuggccaaagccaaagcuaggccu

SEQ ID NO: 1180894 - RNA, 13 nt, Human
uuggcauucccca

SEQ ID NO: 1180895 - RNA, 18 nt, Human
uuggcugggggccucagu

SEQ ID NO: 1180896 - RNA, 21 nt, Human
uuggcugggggccucagugcc

SEQ ID NO: 1180897 - RNA, 22 nt, Human
uuggcugggggccucagugcca

SEQ ID NO: 1180898 - RNA, 22 nt, Human
uuggcuuuggguugcaggaccu

SEQ ID NO: 1180899 - RNA, 16 nt, Human
uugggaggccauuugu

SEQ ID NO: 1180900 - RNA, 12 nt, Human
uugggaggcuga

SEQ ID NO: 1180901 - RNA, 14 nt, Human
uuguagagccaggg

SEQ ID NO: 1180902 - RNA, 15 nt, Human
uuguagagccagggu

SEQ ID NO: 1180903 - RNA, 14 nt, Human
uuguacauaaugcg

SEQ ID NO: 1180904 - RNA, 12 nt, Human
uuguacagacaa

SEQ ID NO: 1180905 - RNA, 13 nt, Human
uuguacagacaac

SEQ ID NO: 1180906 - RNA, 16 nt, Human
uuguaaaggaauuuaa

SEQ ID NO: 1180907 - RNA, 22 nt, Human
uuggucccccuuccauggacuu

SEQ ID NO: 1180908 - RNA, 12 nt, Human
uugguccugcug

SEQ ID NO: 1180909 - RNA, 13 nt, Human
uugguccugcugc

SEQ ID NO: 1180910 - RNA, 20 nt, Human
uuguauuuuacuaauaaaau

SEQ ID NO: 1180911 - RNA, 15 nt, Human
uuuacuuuguguuca

SEQ ID NO: 1180912 - RNA, 12 nt, Human
uuuagaaacaca

SEQ ID NO: 1180913 - RNA, 20 nt, Human
uuuagaaacacaacuauauu

SEQ ID NO: 1180914 - RNA, 14 nt, Human
uuuauugucaaagu

SEQ ID NO: 1180915 - RNA, 16 nt, Human
uuuauugucaaagugg

SEQ ID NO: 1180916 - RNA, 18 nt, Human
uuuagaguugauacuaca

SEQ ID NO: 1180917 - RNA, 14 nt, Human
uuuauaaacuuuac

SEQ ID NO: 1180918 - RNA, 16 nt, Human
uuuauaaacuuuaccu

SEQ ID NO: 1180919 - RNA, 21 nt, Human
uuuaucgucacugcuuaacuu

SEQ ID NO: 1180920 - RNA, 18 nt, Human
uuuauaaacuuuaccuuu

SEQ ID NO: 1180921 - RNA, 20 nt, Human
uuucaauaggaaaaacugau

SEQ ID NO: 1180922 - RNA, 22 nt, Human
uuucaauaggaaaaacugauuu

SEQ ID NO: 1180923 - RNA, 15 nt, Human
uuucagauaaucaca

SEQ ID NO: 1180924 - RNA, 21 nt, Human
uuucagauaaucacaauacau

SEQ ID NO: 1180925 - RNA, 15 nt, Human
uuucagccaagaauu

SEQ ID NO: 1180926 - RNA, 16 nt, Human
uuucagccaagaauuc

SEQ ID NO: 1180927 - RNA, 22 nt, Human
uuucauugcugggcuugucugu

SEQ ID NO: 1180928 - RNA, 12 nt, Human
uuuccaaaguac

SEQ ID NO: 1180929 - RNA, 15 nt, Human
uuuccaaaguacacu

SEQ ID NO: 1180930 - RNA, 13 nt, Human
uuuccaggaaggc

SEQ ID NO: 1180931 - RNA, 21 nt, Human
uuuccucuuuggucuacacug

SEQ ID NO: 1180932 - RNA, 22 nt, Human
uuuccucaaaacuucagacaua

SEQ ID NO: 1180933 - RNA, 17 nt, Human
uuucuaaagcugccagc

SEQ ID NO: 1180934 - RNA, 14 nt, Human
uuucuaaaggcuac

SEQ ID NO: 1180935 - RNA, 18 nt, Human
uuucuaaaggcuaccuuu

SEQ ID NO: 1180936 - RNA, 15 nt, Human
uuucuagccagagga

SEQ ID NO: 1180937 - RNA, 22 nt, Human
uuugaggucuguucuuuccaaa

SEQ ID NO: 1180938 - RNA, 13 nt, Human
uuugagugccuua

SEQ ID NO: 1180939 - RNA, 15 nt, Human
uuugagcagggcuca

SEQ ID NO: 1180940 - RNA, 18 nt, Human
uuugccauguuggccagg

SEQ ID NO: 1180941 - RNA, 22 nt, Human
uuugccauguuggccaggcugg

SEQ ID NO: 1180942 - RNA, 14 nt, Human
uuugcagacaggca

SEQ ID NO: 1180943 - RNA, 13 nt, Human
uuuguccccaccg

SEQ ID NO: 1180944 - RNA, 21 nt, Human
uuuguccccaccgcagacagg

SEQ ID NO: 1180945 - RNA, 15 nt, Human
uuuguaaauuaacuu

SEQ ID NO: 1180946 - RNA, 16 nt, Human
uuuguaaauuaacuuu

SEQ ID NO: 1180947 - RNA, 17 nt, Human
uuuguaaauuaacuuuu

SEQ ID NO: 1180948 - RNA, 22 nt, Human
uuuguaaauuaacuuuuauaaa

SEQ ID NO: 1180949 - RNA, 21 nt, Human
uuuguauaaaauaauuuuuau

SEQ ID NO: 1180950 - RNA, 20 nt, Human
uuuuauaucaauuuaaaaaa

SEQ ID NO: 1180951 - RNA, 15 nt, Human
uuuuauaugcuucug

SEQ ID NO: 1180952 - RNA, 20 nt, Human
uuuuauaugcuucuguuuua

SEQ ID NO: 1180953 - RNA, 10 nt, Human
uuuuauauuu

SEQ ID NO: 1180954 - RNA, 18 nt, Human
uuuuaucgucacugcuua

SEQ ID NO: 1180955 - RNA, 19 nt, Human
uuuuaucgucacugcuuaa

SEQ ID NO: 1180956 - RNA, 15 nt, Human
uuuucacaguucucu

SEQ ID NO: 1180957 - RNA, 15 nt, Human
uuuuccuucagugcc

SEQ ID NO: 1180958 - RNA, 17 nt, Human
uuuucuugcaugaggcu

SEQ ID NO: 1180959 - RNA, 19 nt, Human
uuuuccaugaguccccugu

SEQ ID NO: 1180960 - RNA, 13 nt, Human
uuuuccugaaaac

SEQ ID NO: 1180961 - RNA, 11 nt, Human
caaaaugaaac

SEQ ID NO: 1180962 - RNA, 22 nt, Human
caaaaugaaacgcaaccaccac

SEQ ID NO: 1180963 - RNA, 16 nt, Human
caaaauuuuuucucua

SEQ ID NO: 1180964 - RNA, 13 nt, Human
caaacagaggccg

SEQ ID NO: 1180965 - RNA, 15 nt, Human
caaacagaggccgcc

SEQ ID NO: 1180966 - RNA, 17 nt, Human
caaacucuugaccucag

SEQ ID NO: 1180967 - RNA, 19 nt, Human
caaacucuugaccucaggu

SEQ ID NO: 1180968 - RNA, 20 nt, Human
caaacucuugaccucaggug

SEQ ID NO: 1180969 - RNA, 21 nt, Human
caaacucuugaccucagguga

SEQ ID NO: 1180970 - RNA, 21 nt, Human
caaacugaaugaaacccccac

SEQ ID NO: 1180971 - RNA, 16 nt, Human
caaacugacucuuaag

SEQ ID NO: 1180972 - RNA, 17 nt, Human
caaacugacucuuaaga

SEQ ID NO: 1180973 - RNA, 21 nt, Human
caaacugacucuuaagaagac

SEQ ID NO: 1180974 - RNA, 22 nt, Human
caaacugaaugaaacccccaca

SEQ ID NO: 1180975 - RNA, 21 nt, Human
caaaaucgaugcagugcuucc

SEQ ID NO: 1180976 - RNA, 16 nt, Human
caaaauaaaacuuuuu

SEQ ID NO: 1180977 - RNA, 20 nt, Human
caaaauaaaacuuuuuaaaa

SEQ ID NO: 1180978 - RNA, 18 nt, Human
auuuuauuuuauuaugca

SEQ ID NO: 1180979 - RNA, 15 nt, Human
caaaacgguuuuacu

SEQ ID NO: 1180980 - RNA, 21 nt, Human
caaaacgguuuuacugcagcu

SEQ ID NO: 1180981 - RNA, 15 nt, Human
caaaacucuccucug

SEQ ID NO: 1180982 - RNA, 16 nt, Human
caaaacucuccucugc

SEQ ID NO: 1180983 - RNA, 19 nt, Human
caaaacucuccucugcugc

SEQ ID NO: 1180984 - RNA, 14 nt, Human
caaaaguuucucuu

SEQ ID NO: 1180985 - RNA, 13 nt, Human
caacaggcugggc

SEQ ID NO: 1180986 - RNA, 23 nt, Human
caaagugcugggauuacaagcgu

SEQ ID NO: 1180987 - RNA, 19 nt, Human
caaagugcugggauuacaa

SEQ ID NO: 1180988 - RNA, 23 nt, Human
caaauggaaaugggcagagcaga

SEQ ID NO: 1180989 - RNA, 14 nt, Human
caaauguucaucaa

SEQ ID NO: 1180990 - RNA, 18 nt, Human
caaauguucaucaaugaa

SEQ ID NO: 1180991 - RNA, 20 nt, Human
caaauguucaucaaugaaug

SEQ ID NO: 1180992 - RNA, 20 nt, Human
caacauacucccaucuguga

SEQ ID NO: 1180993 - RNA, 12 nt, Human
caacaggcuggg

SEQ ID NO: 1180994 - RNA, 17 nt, Human
caacauacucccaucug

SEQ ID NO: 1180995 - RNA, 19 nt, Human
caacauacucccaucugug

SEQ ID NO: 1180996 - RNA, 15 nt, Human
caaauuucuaaaucu

SEQ ID NO: 1180997 - RNA, 22 nt, Human
caaauuucuaaaucuccaaaau

SEQ ID NO: 1180998 - RNA, 17 nt, Human
caagaaaugaaagcagg

SEQ ID NO: 1180999 - RNA, 19 nt, Human
caagaaaugaaagcaggga

SEQ ID NO: 1181000 - RNA, 13 nt, Human
caagaagcccagg

SEQ ID NO: 1181001 - RNA, 14 nt, Human
caagaagcccagga

SEQ ID NO: 1181002 - RNA, 13 nt, Human
caagagcccaggc

SEQ ID NO: 1181003 - RNA, 21 nt, Human
caagaccuucuccuucaccuu

SEQ ID NO: 1181004 - RNA, 23 nt, Human
caagaccuucuccuucaccuuug

SEQ ID NO: 1181005 - RNA, 13 nt, Human
caagacgcugugc

SEQ ID NO: 1181006 - RNA, 15 nt, Human
caagacgcugugcug

SEQ ID NO: 1181007 - RNA, 22 nt, Human
caaggauccugagccagauuuc

SEQ ID NO: 1181008 - RNA, 20 nt, Human
caaggauccugagccagauu

SEQ ID NO: 1181009 - RNA, 17 nt, Human
caaggcugcagugagcc

SEQ ID NO: 1181010 - RNA, 22 nt, Human
caaggcugcagugagccgagau

SEQ ID NO: 1181011 - RNA, 16 nt, Human
caaggagauuuacaac

SEQ ID NO: 1181012 - RNA, 18 nt, Human
caaggauccugagccaga

SEQ ID NO: 1181013 - RNA, 19 nt, Human
caaggauccugagccagau

SEQ ID NO: 1181014 - RNA, 20 nt, Human
caaggaaaaaauaacaauga

SEQ ID NO: 1181015 - RNA, 18 nt, Human
caaggaaaaaauaacaau

SEQ ID NO: 1181016 - RNA, 22 nt, Human
caagcuggucccacucagucca

SEQ ID NO: 1181017 - RNA, 23 nt, Human
caagcuggucccacucaguccau

SEQ ID NO: 1181018 - RNA, 15 nt, Human
caagcgauucuucug

SEQ ID NO: 1181019 - RNA, 17 nt, Human
caagcgauucuucugcu

SEQ ID NO: 1181020 - RNA, 18 nt, Human
caagcgauucuucugcuu

SEQ ID NO: 1181021 - RNA, 21 nt, Human
caagcugcacccucaggcagg

SEQ ID NO: 1181022 - RNA, 22 nt, Human
caagcugcacccucaggcaggu

SEQ ID NO: 1181023 - RNA, 19 nt, Human
caagcgauucuucugcuuc

SEQ ID NO: 1181024 - RNA, 15 nt, Human
caauaggaaaaacug

SEQ ID NO: 1181025 - RNA, 16 nt, Human
caauaggaaaaacuga

SEQ ID NO: 1181026 - RNA, 17 nt, Human
caauaggaaaaacugau

SEQ ID NO: 1181027 - RNA, 19 nt, Human
caauagucaaauuguguga

SEQ ID NO: 1181028 - RNA, 18 nt, Human
caaggcugggggaagaag

SEQ ID NO: 1181029 - RNA, 18 nt, Human
caauaggaaaaacugauu

SEQ ID NO: 1181030 - RNA, 13 nt, Human
cacacugaagaag

SEQ ID NO: 1181031 - RNA, 14 nt, Human
cacacugaagaagc

SEQ ID NO: 1181032 - RNA, 19 nt, Human
cacagagaaaguacuucuc

SEQ ID NO: 1181033 - RNA, 20 nt, Human
cacagagaaaguacuucucc

SEQ ID NO: 1181034 - RNA, 21 nt, Human
cacagagaaaguacuucucca

SEQ ID NO: 1181035 - RNA, 13 nt, Human
cacagaggcugcc

SEQ ID NO: 1181036 - RNA, 22 nt, Human
cacagaguuguuacauuuuuaa

SEQ ID NO: 1181037 - RNA, 17 nt, Human
cacagccacacacacag

SEQ ID NO: 1181038 - RNA, 18 nt, Human
cacagccacacacacaga

SEQ ID NO: 1181039 - RNA, 19 nt, Human
cacagccacacacacagaa

SEQ ID NO: 1181040 - RNA, 20 nt, Human
cacagccacacacacagaaa

SEQ ID NO: 1181041 - RNA, 21 nt, Human
cacagccacacacacagaaaa

SEQ ID NO: 1181042 - RNA, 22 nt, Human
cacagccacacacacagaaaau

SEQ ID NO: 1181043 - RNA, 23 nt, Human
cacagccacacacacagaaaaua

SEQ ID NO: 1181044 - RNA, 17 nt, Human
cacaaagguagcuuuuc

SEQ ID NO: 1181045 - RNA, 20 nt, Human
cacaagaaaugaaagcaggg

SEQ ID NO: 1181046 - RNA, 21 nt, Human
cacaagaaaugaaagcaggga

SEQ ID NO: 1181047 - RNA, 13 nt, Human
cacaaaggagagc

SEQ ID NO: 1181048 - RNA, 13 nt, Human
cacacacacacac

SEQ ID NO: 1181049 - RNA, 14 nt, Human
cacacacacacaca

SEQ ID NO: 1181050 - RNA, 15 nt, Human
cacacacacacacag

SEQ ID NO: 1181051 - RNA, 16 nt, Human
cacacacacacacagc

SEQ ID NO: 1181052 - RNA, 15 nt, Human
cacacacacacacau

SEQ ID NO: 1181053 - RNA, 16 nt, Human
cacacacacacacaug

SEQ ID NO: 1181054 - RNA, 13 nt, Human
cacacacacacag

SEQ ID NO: 1181055 - RNA, 14 nt, Human
cacacacacacagc

SEQ ID NO: 1181056 - RNA, 15 nt, Human
cacacacacacagcc

SEQ ID NO: 1181057 - RNA, 16 nt, Human
cacacacacacagcca

SEQ ID NO: 1181058 - RNA, 13 nt, Human
cacacacacacau

SEQ ID NO: 1181059 - RNA, 14 nt, Human
cacacacacacaug

SEQ ID NO: 1181060 - RNA, 15 nt, Human
cacacacacacaugc

SEQ ID NO: 1181061 - RNA, 16 nt, Human
cacacacacacaugca

SEQ ID NO: 1181062 - RNA, 11 nt, Human
cacacacacag

SEQ ID NO: 1181063 - RNA, 12 nt, Human
cacacacacaga

SEQ ID NO: 1181064 - RNA, 13 nt, Human
cacacacacagaa

SEQ ID NO: 1181065 - RNA, 14 nt, Human
cacacacacagaaa

SEQ ID NO: 1181066 - RNA, 15 nt, Human
cacacacacagaaaa

SEQ ID NO: 1181067 - RNA, 12 nt, Human
cacacacacagc

SEQ ID NO: 1181068 - RNA, 13 nt, Human
cacacacacagcc

SEQ ID NO: 1181069 - RNA, 14 nt, Human
cacacacacagcca

SEQ ID NO: 1181070 - RNA, 15 nt, Human
cacacacacagccac

SEQ ID NO: 1181071 - RNA, 12 nt, Human
cacacacacaug

SEQ ID NO: 1181072 - RNA, 13 nt, Human
cacacacacaugc

SEQ ID NO: 1181073 - RNA, 14 nt, Human
cacacacacaugca

SEQ ID NO: 1181074 - RNA, 15 nt, Human
cacacacacaugcau

SEQ ID NO: 1181075 - RNA, 11 nt, Human
cacacacagaa

SEQ ID NO: 1181076 - RNA, 13 nt, Human
cacacacagaaaa

SEQ ID NO: 1181077 - RNA, 14 nt, Human
cacacacagaaaau

SEQ ID NO: 1181078 - RNA, 15 nt, Human
cacacacagaaaaua

SEQ ID NO: 1181079 - RNA, 16 nt, Human
cacacacagaaaauau

SEQ ID NO: 1181080 - RNA, 19 nt, Human
cacacacagaaaauauacu

SEQ ID NO: 1181081 - RNA, 20 nt, Human
cacacacagaaaauauacug

SEQ ID NO: 1181082 - RNA, 21 nt, Human
cacacacagaaaauauacugu

SEQ ID NO: 1181083 - RNA, 23 nt, Human
cacacacagaaaauauacuguaa

SEQ ID NO: 1181084 - RNA, 11 nt, Human
cacacacagcc

SEQ ID NO: 1181085 - RNA, 12 nt, Human
cacacacagcca

SEQ ID NO: 1181086 - RNA, 13 nt, Human
cacacacagccac

SEQ ID NO: 1181087 - RNA, 14 nt, Human
cacacacagccaca

SEQ ID NO: 1181088 - RNA, 15 nt, Human
cacacacagccacac

SEQ ID NO: 1181089 - RNA, 16 nt, Human
cacacacagccacaca

SEQ ID NO: 1181090 - RNA, 17 nt, Human
cacacacgcgugcacac

SEQ ID NO: 1181091 - RNA, 18 nt, Human
caauuacaggaaguacug

SEQ ID NO: 1181092 - RNA, 13 nt, Human
cacaaacagaggc

SEQ ID NO: 1181093 - RNA, 14 nt, Human
cacaaacagaggcc

SEQ ID NO: 1181094 - RNA, 15 nt, Human
cacaaacagaggccg

SEQ ID NO: 1181095 - RNA, 21 nt, Human
caauaucuuuuuuuuaauaaa

SEQ ID NO: 1181096 - RNA, 22 nt, Human
caaugugaaaagaaaaaugagc

SEQ ID NO: 1181097 - RNA, 22 nt, Human
caaugugacuuaaugccacuaa

SEQ ID NO: 1181098 - RNA, 19 nt, Human
cacaggaaccacaagacug

SEQ ID NO: 1181099 - RNA, 17 nt, Human
cacaguucaauucucau

SEQ ID NO: 1181100 - RNA, 15 nt, Human
guauaaaauaauuuu

SEQ ID NO: 1181101 - RNA, 21 nt, Human
guauaaaauaauuuuuauauu

SEQ ID NO: 1181102 - RNA, 16 nt, Human
guaucaggugcugcca

SEQ ID NO: 1181103 - RNA, 18 nt, Human
guaucaggugcugccauc

SEQ ID NO: 1181104 - RNA, 16 nt, Human
guauauuuuauaucaa

SEQ ID NO: 1181105 - RNA, 21 nt, Human
guaucccaugagccucagcau

SEQ ID NO: 1181106 - RNA, 14 nt, Human
guaugguggcuggg

SEQ ID NO: 1181107 - RNA, 15 nt, Human
guaugguggcugggu

SEQ ID NO: 1181108 - RNA, 16 nt, Human
guaugguggcuggguu

SEQ ID NO: 1181109 - RNA, 22 nt, Human
guaucaggugcugccauccagg

SEQ ID NO: 1181110 - RNA, 19 nt, Human
guaucccaugagccucagc

SEQ ID NO: 1181111 - RNA, 22 nt, Human
guaacaggaaaauuuuaaaaau

SEQ ID NO: 1181112 - RNA, 12 nt, Human
guaacaggcaga

SEQ ID NO: 1181113 - RNA, 20 nt, Human
guaguguuggagaagaacug

SEQ ID NO: 1181114 - RNA, 18 nt, Human
guauguacuucaugcugu

SEQ ID NO: 1181115 - RNA, 19 nt, Human
aaaugucuaguuguaacac

SEQ ID NO: 1181116 - RNA, 24 nt, Human
aaaugucuaguuguaacaccauga

SEQ ID NO: 1181117 - RNA, 18 nt, Human
gucaaaguggugagaggc

SEQ ID NO: 1181118 - RNA, 22 nt, Human
guauuuuguuuuugucuuaaaa

SEQ ID NO: 1181119 - RNA, 17 nt, Human
aacaaugcuguauuuua

SEQ ID NO: 1181120 - RNA, 22 nt, Human
aacaaugcuguauuuuaaaaga

SEQ ID NO: 1181121 - RNA, 15 nt, Human
aacacaacuauauug

SEQ ID NO: 1181122 - RNA, 16 nt, Human
aacacaacuauauugu

SEQ ID NO: 1181123 - RNA, 12 nt, Human
aacaauaaaaga

SEQ ID NO: 1181124 - RNA, 15 nt, Human
aacaaugcuguauuu

SEQ ID NO: 1181125 - RNA, 18 nt, Human
aacaaggcaaggcuguca

SEQ ID NO: 1181126 - RNA, 21 nt, Human
aacaaggcaaggcugucaauu

SEQ ID NO: 1181127 - RNA, 23 nt, Human
aacaaggcaaggcugucaauuac

SEQ ID NO: 1181128 - RNA, 21 nt, Human
aacaagccuccuuuuaaagua

SEQ ID NO: 1181129 - RNA, 16 nt, Human
aacaaggcaaggcugu

SEQ ID NO: 1181130 - RNA, 18 nt, Human
aaauuuugauguuuuaag

SEQ ID NO: 1181131 - RNA, 23 nt, Human
aaauuuugauguuuuaaggaugc

SEQ ID NO: 1181132 - RNA, 20 nt, Human
aaauuuuuucucuaggaaau

SEQ ID NO: 1181133 - RNA, 22 nt, Human
gucacacaguauuacuucugcu

SEQ ID NO: 1181134 - RNA, 18 nt, Human
aaauuuguuauaaugaau

SEQ ID NO: 1181135 - RNA, 17 nt, Human
aacacaacuauauuguu

SEQ ID NO: 1181136 - RNA, 19 nt, Human
gucauuuuuuuuaagaaaa

SEQ ID NO: 1181137 - RNA, 21 nt, Human
gucauuuuuuuuaagaaaaag

SEQ ID NO: 1181138 - RNA, 13 nt, Human
guccaagaagccc

SEQ ID NO: 1181139 - RNA, 15 nt, Human
guccaagaagcccag

SEQ ID NO: 1181140 - RNA, 16 nt, Human
guccaagaagcccagg

SEQ ID NO: 1181141 - RNA, 17 nt, Human
guccaagaagcccagga

SEQ ID NO: 1181142 - RNA, 18 nt, Human
guccaagaagcccaggaa

SEQ ID NO: 1181143 - RNA, 20 nt, Human
guccaagaagcccaggaaag

SEQ ID NO: 1181144 - RNA, 13 nt, Human
guccauagagagc

SEQ ID NO: 1181145 - RNA, 14 nt, Human
guccauagagagca

SEQ ID NO: 1181146 - RNA, 21 nt, Human
gucccaccccacacacgccag

SEQ ID NO: 1181147 - RNA, 14 nt, Human
gucccaccuuggcu

SEQ ID NO: 1181148 - RNA, 15 nt, Human
gucccaccuuggcug

SEQ ID NO: 1181149 - RNA, 16 nt, Human
gucccaccuuggcugc

SEQ ID NO: 1181150 - RNA, 17 nt, Human
gucccaccuuggcugca

SEQ ID NO: 1181151 - RNA, 14 nt, Human
gucccccuuccaug

SEQ ID NO: 1181152 - RNA, 16 nt, Human
gucccccuuccaugga

SEQ ID NO: 1181153 - RNA, 18 nt, Human
gucccccuuccauggacu

SEQ ID NO: 1181154 - RNA, 16 nt, Human
guccuacccacccucc

SEQ ID NO: 1181155 - RNA, 12 nt, Human
guccuacucugu

SEQ ID NO: 1181156 - RNA, 12 nt, Human
aacagaaaugua

SEQ ID NO: 1181157 - RNA, 13 nt, Human
aacagaaauguac

SEQ ID NO: 1181158 - RNA, 14 nt, Human
aacagaaauguaca

SEQ ID NO: 1181159 - RNA, 15 nt, Human
aacagaaauguacag

SEQ ID NO: 1181160 - RNA, 13 nt, Human
guccuacucugug

SEQ ID NO: 1181161 - RNA, 22 nt, Human
aacagugauuaccagggacuga

SEQ ID NO: 1181162 - RNA, 15 nt, Human
aaccaagucaaguga

SEQ ID NO: 1181163 - RNA, 19 nt, Human
aaccaccacacccagccca

SEQ ID NO: 1181164 - RNA, 23 nt, Human
aaccauuuugcugucccuuuucc

SEQ ID NO: 1181165 - RNA, 21 nt, Human
aaccaccacacccagcccacu

SEQ ID NO: 1181166 - RNA, 12 nt, Human
aaccaucauuga

SEQ ID NO: 1181167 - RNA, 17 nt, Human
aaccaucauugaaaucu

SEQ ID NO: 1181168 - RNA, 18 nt, Human
aaccaucauugaaaucuu

SEQ ID NO: 1181169 - RNA, 18 nt, Human
aaccugagccccaaaagg

SEQ ID NO: 1181170 - RNA, 16 nt, Human
aacccgggaggcagag

SEQ ID NO: 1181171 - RNA, 10 nt, Human
aacccagcuc

SEQ ID NO: 1181172 - RNA, 12 nt, Human
aacccccacaca

SEQ ID NO: 1181173 - RNA, 13 nt, Human
aacccccacacac

SEQ ID NO: 1181174 - RNA, 14 nt, Human
aacccccacacaca

SEQ ID NO: 1181175 - RNA, 15 nt, Human
aacccccacacacac

SEQ ID NO: 1181176 - RNA, 21 nt, Human
aacuagaguuuagcuggaaaa

SEQ ID NO: 1181177 - RNA, 12 nt, Human
aaccugugucuc

SEQ ID NO: 1181178 - RNA, 18 nt, Human
aaccuugaaaacuuuaug

SEQ ID NO: 1181179 - RNA, 15 nt, Human
aacucuccuccagag

SEQ ID NO: 1181180 - RNA, 18 nt, Human
aacucuccuccagaguca

SEQ ID NO: 1181181 - RNA, 16 nt, Human
aacucuccucugcugc

SEQ ID NO: 1181182 - RNA, 17 nt, Human
aacucuccucugcugcu

SEQ ID NO: 1181183 - RNA, 22 nt, Human
gugaaccaccacacccagccca

SEQ ID NO: 1181184 - RNA, 23 nt, Human
gugaaccaccacacccagcccac

SEQ ID NO: 1181185 - RNA, 16 nt, Human
gucuuucacauuuaaa

SEQ ID NO: 1181186 - RNA, 17 nt, Human
gucuuuaaaugcugcuu

SEQ ID NO: 1181187 - RNA, 16 nt, Human
gucuuuuuucacuaca

SEQ ID NO: 1181188 - RNA, 20 nt, Human
aaccugagccccaaaaggua

SEQ ID NO: 1181189 - RNA, 14 nt, Human
gucuggcccuuccu

SEQ ID NO: 1181190 - RNA, 22 nt, Human
gugagucgaggacagggaggug

SEQ ID NO: 1181191 - RNA, 21 nt, Human
aacucuucaaucucuugcacu

SEQ ID NO: 1181192 - RNA, 12 nt, Human
aacugaaaucau

SEQ ID NO: 1181193 - RNA, 13 nt, Human
aacugaaaucaua

SEQ ID NO: 1181194 - RNA, 17 nt, Human
gugaacuugggccacug

SEQ ID NO: 1181195 - RNA, 19 nt, Human
gugaacuugggccacugug

SEQ ID NO: 1181196 - RNA, 21 nt, Human
gugagaugcuagaacucccuu

SEQ ID NO: 1181197 - RNA, 15 nt, Human
gugagcaauccugca

SEQ ID NO: 1181198 - RNA, 17 nt, Human
gugaggccagagacaca

SEQ ID NO: 1181199 - RNA, 22 nt, Human
gugaggccagagacacaagccu

SEQ ID NO: 1181200 - RNA, 15 nt, Human
aacugcugacuguuu

SEQ ID NO: 1181201 - RNA, 20 nt, Human
aacugcugacuguuuucucu

SEQ ID NO: 1181202 - RNA, 21 nt, Human
aacugcugacuguuuucucuu

SEQ ID NO: 1181203 - RNA, 23 nt, Human
aacugcugacuguuuucucuuga

SEQ ID NO: 1181204 - RNA, 15 nt, Human
aacuggauuaaacuu

SEQ ID NO: 1181205 - RNA, 16 nt, Human
aacuggauuaaacuua

SEQ ID NO: 1181206 - RNA, 11 nt, Human
aacuggcugca

SEQ ID NO: 1181207 - RNA, 17 nt, Human
aacugggacaggggaga

SEQ ID NO: 1181208 - RNA, 21 nt, Human
aacugggggagggugaaguga

SEQ ID NO: 1181209 - RNA, 22 nt, Human
aacugggggagggugaagugaa

SEQ ID NO: 1181210 - RNA, 16 nt, Human
aacuggguacuugugg

SEQ ID NO: 1181211 - RNA, 21 nt, Human
aacuggguacuuguggacaca

SEQ ID NO: 1181212 - RNA, 19 nt, Human
gugauggggcccugccucc

SEQ ID NO: 1181213 - RNA, 21 nt, Human
gugcacacaccagagcccacc

SEQ ID NO: 1181214 - RNA, 19 nt, Human
gugcauguguguucaugca

SEQ ID NO: 1181215 - RNA, 15 nt, Human
gugcauuaucuagau

SEQ ID NO: 1181216 - RNA, 19 nt, Human
gugcauuaucuagauacug

SEQ ID NO: 1181217 - RNA, 23 nt, Human
gugcauuaucuagauacuguauc

SEQ ID NO: 1181218 - RNA, 13 nt, Human
aacuuccaauuua

SEQ ID NO: 1181219 - RNA, 18 nt, Human
aacuuccagauccuggaa

SEQ ID NO: 1181220 - RNA, 14 nt, Human
gugaugagaggaaa

SEQ ID NO: 1181221 - RNA, 16 nt, Human
gugaugagaggaaauc

SEQ ID NO: 1181222 - RNA, 22 nt, Human
gugaugcgcaugucacggaggg

SEQ ID NO: 1181223 - RNA, 14 nt, Human
gugauggggcccug

SEQ ID NO: 1181224 - RNA, 16 nt, Human
gugauggggcccugcc

SEQ ID NO: 1181225 - RNA, 17 nt, Human
gugauggggcccugccu

SEQ ID NO: 1181226 - RNA, 18 nt, Human
gugauggggcccugccuc

SEQ ID NO: 1181227 - RNA, 23 nt, Human
gugggaggaucucuugagccugg

SEQ ID NO: 1181228 - RNA, 22 nt, Human
gugggacacccugugauggggc

SEQ ID NO: 1181229 - RNA, 15 nt, Human
gugggagcugccugu

SEQ ID NO: 1181230 - RNA, 18 nt, Human
gugggagcugccuguuca

SEQ ID NO: 1181231 - RNA, 15 nt, Human
guggggucacucugg

SEQ ID NO: 1181232 - RNA, 22 nt, Human
guggcgcagcauauucaggaag

SEQ ID NO: 1181233 - RNA, 13 nt, Human
gugggacacccug

SEQ ID NO: 1181234 - RNA, 15 nt, Human
gugggacacccugug

SEQ ID NO: 1181235 - RNA, 23 nt, Human
aagaggaaugaaguacucauaca

SEQ ID NO: 1181236 - RNA, 21 nt, Human
guggccucccaacucacccca

SEQ ID NO: 1181237 - RNA, 22 nt, Human
guggccucccaacucaccccag

SEQ ID NO: 1181238 - RNA, 13 nt, Human
aagacgcugugcu

SEQ ID NO: 1181239 - RNA, 15 nt, Human
aagacgcugugcugc

SEQ ID NO: 1181240 - RNA, 17 nt, Human
aagacgcugugcugccc

SEQ ID NO: 1181241 - RNA, 18 nt, Human
aagacgcugugcugcccu

SEQ ID NO: 1181242 - RNA, 19 nt, Human
aagacgcugugcugcccug

SEQ ID NO: 1181243 - RNA, 11 nt, Human
gugccuuaugg

SEQ ID NO: 1181244 - RNA, 15 nt, Human
aagaccuucuccuuc

SEQ ID NO: 1181245 - RNA, 18 nt, Human
aagaccuucuccuucacc

SEQ ID NO: 1181246 - RNA, 19 nt, Human
aagaccuucuccuucaccu

SEQ ID NO: 1181247 - RNA, 20 nt, Human
aagacgcugugcugcccugc

SEQ ID NO: 1181248 - RNA, 23 nt, Human
aagacugaguacguugugcauuu

SEQ ID NO: 1181249 - RNA, 16 nt, Human
aagacugcacaucaaa

SEQ ID NO: 1181250 - RNA, 17 nt, Human
aagacugcauuauauuu

SEQ ID NO: 1181251 - RNA, 16 nt, Human
aagacuuuggaaagac

SEQ ID NO: 1181252 - RNA, 19 nt, Human
aagaugcuucucacugcca

SEQ ID NO: 1181253 - RNA, 17 nt, Human
aagaugcuucucacugc

SEQ ID NO: 1181254 - RNA, 13 nt, Human
aagaguaggaaga

SEQ ID NO: 1181255 - RNA, 14 nt, Human
aagaguaggaagac

SEQ ID NO: 1181256 - RNA, 17 nt, Human
guggggucacucuggca

SEQ ID NO: 1181257 - RNA, 20 nt, Human
guggggucacucuggcagcu

SEQ ID NO: 1181258 - RNA, 21 nt, Human
guggggucacucuggcagcuc

SEQ ID NO: 1181259 - RNA, 22 nt, Human
guggggucacucuggcagcuca

SEQ ID NO: 1181260 - RNA, 23 nt, Human
aagagggagggagggcuccagac

SEQ ID NO: 1181261 - RNA, 22 nt, Human
aagagggucugaggaauccaga

SEQ ID NO: 1181262 - RNA, 12 nt, Human
aagaguaggaag

SEQ ID NO: 1181263 - RNA, 16 nt, Human
gugugguagagugugc

SEQ ID NO: 1181264 - RNA, 22 nt, Human
gugugacaaggauugcuacugu

SEQ ID NO: 1181265 - RNA, 21 nt, Human
gugugaccacugcagaagaca

SEQ ID NO: 1181266 - RNA, 13 nt, Human
aagauguagagga

SEQ ID NO: 1181267 - RNA, 19 nt, Human
aagauguagaggagaaacu

SEQ ID NO: 1181268 - RNA, 17 nt, Human
guguauuuuuuuacuaa

SEQ ID NO: 1181269 - RNA, 23 nt, Human
guguauuuuuuuacuaauagaca

SEQ ID NO: 1181270 - RNA, 20 nt, Human
gugucaagagggucugagga

SEQ ID NO: 1181271 - RNA, 16 nt, Human
gugucagcauagaagu

SEQ ID NO: 1181272 - RNA, 21 nt, Human
aagcccugugcuccauggcug

SEQ ID NO: 1181273 - RNA, 20 nt, Human
aagccgcuggggccaguugg

SEQ ID NO: 1181274 - RNA, 19 nt, Human
aagcccugagcuuucugcu

SEQ ID NO: 1181275 - RNA, 22 nt, Human
aagccaaagcuaggccuggcca

SEQ ID NO: 1181276 - RNA, 17 nt, Human
aagcccaggaaaggcuc

SEQ ID NO: 1181277 - RNA, 19 nt, Human
aagcccaggaaaggcucca

SEQ ID NO: 1181278 - RNA, 22 nt, Human
aagcccaggaaaggcuccagga

SEQ ID NO: 1181279 - RNA, 21 nt, Human
gugugugcgccuacaggagug

SEQ ID NO: 1181280 - RNA, 12 nt, Human
aagcagugcaug

SEQ ID NO: 1181281 - RNA, 14 nt, Human
aagcagugcaugcu

SEQ ID NO: 1181282 - RNA, 15 nt, Human
aagcagugcaugcug

SEQ ID NO: 1181283 - RNA, 20 nt, Human
aagcagugcaugcugucccu

SEQ ID NO: 1181284 - RNA, 16 nt, Human
aagcauuuagauguau

SEQ ID NO: 1181285 - RNA, 23 nt, Human
guuauuuuuauuuauuuaaauuu

SEQ ID NO: 1181286 - RNA, 20 nt, Human
guucaaagauauuuugcuuu

SEQ ID NO: 1181287 - RNA, 21 nt, Human
guucaaagauauuuugcuuug

SEQ ID NO: 1181288 - RNA, 22 nt, Human
guucaaagauauuuugcuuugu

SEQ ID NO: 1181289 - RNA, 18 nt, Human
guucaagcgauucuucug

SEQ ID NO: 1181290 - RNA, 11 nt, Human
guuaagagaaa

SEQ ID NO: 1181291 - RNA, 12 nt, Human
guuaagagaaau

SEQ ID NO: 1181292 - RNA, 18 nt, Human
guuaagagaaaugagcuu

SEQ ID NO: 1181293 - RNA, 19 nt, Human
guuaggcauugugggaagg

SEQ ID NO: 1181294 - RNA, 20 nt, Human
guuaggcauugugggaaggg

SEQ ID NO: 1181295 - RNA, 13 nt, Human
guucagccugccu

SEQ ID NO: 1181296 - RNA, 13 nt, Human
guucagcuccagc

SEQ ID NO: 1181297 - RNA, 15 nt, Human
guucagcuccagcuc

SEQ ID NO: 1181298 - RNA, 12 nt, Human
aagcuaggccug

SEQ ID NO: 1181299 - RNA, 16 nt, Human
aagcuaggccuggcca

SEQ ID NO: 1181300 - RNA, 20 nt, Human
aagcucacagaccuuugaac

SEQ ID NO: 1181301 - RNA, 12 nt, Human
aagcucagggcc

SEQ ID NO: 1181302 - RNA, 13 nt, Human
aagcucagggccu

SEQ ID NO: 1181303 - RNA, 16 nt, Human
aagcucagggccuggc

SEQ ID NO: 1181304 - RNA, 17 nt, Human
aagcucagggccuggcu

SEQ ID NO: 1181305 - RNA, 18 nt, Human
aagcucagggccuggcuc

SEQ ID NO: 1181306 - RNA, 19 nt, Human
aagcucagggccuggcuca

SEQ ID NO: 1181307 - RNA, 20 nt, Human
aagcucagggccuggcucag

SEQ ID NO: 1181308 - RNA, 17 nt, Human
aagcuccaagcucccag

SEQ ID NO: 1181309 - RNA, 18 nt, Human
aagcuccaagcucccagg

SEQ ID NO: 1181310 - RNA, 13 nt, Human
aagcuccagguag

SEQ ID NO: 1181311 - RNA, 14 nt, Human
aagcuccagguaga

SEQ ID NO: 1181312 - RNA, 15 nt, Human
aaggaaagagggagg

SEQ ID NO: 1181313 - RNA, 17 nt, Human
aaggaauaccugucccc

SEQ ID NO: 1181314 - RNA, 16 nt, Human
aaggaagcacaugccu

SEQ ID NO: 1181315 - RNA, 14 nt, Human
aaggaagacuucau

SEQ ID NO: 1181316 - RNA, 15 nt, Human
aaggaagacuucauc

SEQ ID NO: 1181317 - RNA, 13 nt, Human
aaggaagcacaug

SEQ ID NO: 1181318 - RNA, 18 nt, Human
aaggaauaccuguccccc

SEQ ID NO: 1181319 - RNA, 11 nt, Human
aaggagagcua

SEQ ID NO: 1181320 - RNA, 14 nt, Human
aaggagauuuacaa

SEQ ID NO: 1181321 - RNA, 17 nt, Human
aaggagauuuacaacug

SEQ ID NO: 1181322 - RNA, 18 nt, Human
aaggaggaagagaaaaaa

SEQ ID NO: 1181323 - RNA, 20 nt, Human
aaggaggggauagagagaga

SEQ ID NO: 1181324 - RNA, 13 nt, Human
aaggauacaaaag

SEQ ID NO: 1181325 - RNA, 21 nt, Human
aaggauacaaaagcaugugag

SEQ ID NO: 1181326 - RNA, 16 nt, Human
aaggccaaaggaagca

SEQ ID NO: 1181327 - RNA, 23 nt, Human
guugcccaggcaggucuugaacu

SEQ ID NO: 1181328 - RNA, 12 nt, Human
guugcccaggcu

SEQ ID NO: 1181329 - RNA, 13 nt, Human
guugcccaggcug

SEQ ID NO: 1181330 - RNA, 14 nt, Human
guugcccaggcugg

SEQ ID NO: 1181331 - RNA, 22 nt, Human
aaggggcccaaauucuuucagu

SEQ ID NO: 1181332 - RNA, 14 nt, Human
aagguacuucaaau

SEQ ID NO: 1181333 - RNA, 20 nt, Human
aagguagaaauaucugaaaa

SEQ ID NO: 1181334 - RNA, 12 nt, Human
aaggucauuuuu

SEQ ID NO: 1181335 - RNA, 18 nt, Human
aaggucauuuuuuuuaag

SEQ ID NO: 1181336 - RNA, 19 nt, Human
guuucuauguguagggcgg

SEQ ID NO: 1181337 - RNA, 18 nt, Human
guuucugaaagggacgcu

SEQ ID NO: 1181338 - RNA, 13 nt, Human
guuuauugucaaa

SEQ ID NO: 1181339 - RNA, 15 nt, Human
guugggcugguguca

SEQ ID NO: 1181340 - RNA, 15 nt, Human
guugggccaggagcc

SEQ ID NO: 1181341 - RNA, 17 nt, Human
guugggccaggagccuc

SEQ ID NO: 1181342 - RNA, 13 nt, Human
guugggcuggugu

SEQ ID NO: 1181343 - RNA, 13 nt, Human
guuucaaacuuua

SEQ ID NO: 1181344 - RNA, 14 nt, Human
guuucaaacuuuac

SEQ ID NO: 1181345 - RNA, 16 nt, Human
guuucaaacuuuacua

SEQ ID NO: 1181346 - RNA, 17 nt, Human
guuucaaacuuuacuau

SEQ ID NO: 1181347 - RNA, 16 nt, Human
aaggcuccaggagcag

SEQ ID NO: 1181348 - RNA, 18 nt, Human
aaggcuccaggagcagcc

SEQ ID NO: 1181349 - RNA, 19 nt, Human
aaggcuccaggagcagcca

SEQ ID NO: 1181350 - RNA, 22 nt, Human
aaggcuccaggagcagccacau

SEQ ID NO: 1181351 - RNA, 16 nt, Human
aaggcucgagcaugcc

SEQ ID NO: 1181352 - RNA, 18 nt, Human
aaggcucgagcaugccug

SEQ ID NO: 1181353 - RNA, 19 nt, Human
aaggcucgagcaugccugg

SEQ ID NO: 1181354 - RNA, 20 nt, Human
aaggcucgagcaugccugga

SEQ ID NO: 1181355 - RNA, 22 nt, Human
aaggcucgagcaugccuggaug

SEQ ID NO: 1181356 - RNA, 16 nt, Human
aagucuuucacauuua

SEQ ID NO: 1181357 - RNA, 21 nt, Human
aagugaaaaaggaggaagaga

SEQ ID NO: 1181358 - RNA, 17 nt, Human
aagugaagacaaugacu

SEQ ID NO: 1181359 - RNA, 19 nt, Human
aagugaagacaaugacuua

SEQ ID NO: 1181360 - RNA, 12 nt, Human
aagugagagagg

SEQ ID NO: 1181361 - RNA, 14 nt, Human
aagugagagcuggg

SEQ ID NO: 1181362 - RNA, 15 nt, Human
aagugagagcugggu

SEQ ID NO: 1181363 - RNA, 14 nt, Human
guuucugccgcagc

SEQ ID NO: 1181364 - RNA, 15 nt, Human
guuucugccgcagcc

SEQ ID NO: 1181365 - RNA, 18 nt, Human
guuucugccgcagcccug

SEQ ID NO: 1181366 - RNA, 16 nt, Human
guuuugccauguuggc

SEQ ID NO: 1181367 - RNA, 20 nt, Human
guuuugccauguuggccagg

SEQ ID NO: 1181368 - RNA, 21 nt, Human
guuuugccauguuggccaggc

SEQ ID NO: 1181369 - RNA, 22 nt, Human
guuuugccauguuggccaggcu

SEQ ID NO: 1181370 - RNA, 14 nt, Human
aaguaaugauaacu

SEQ ID NO: 1181371 - RNA, 19 nt, Human
aaguaaugauaacuggaaa

SEQ ID NO: 1181372 - RNA, 13 nt, Human
aaguacacuguuu

SEQ ID NO: 1181373 - RNA, 18 nt, Human
aaguacacuguuucaaac

SEQ ID NO: 1181374 - RNA, 19 nt, Human
aaguacacuguuucaaacu

SEQ ID NO: 1181375 - RNA, 20 nt, Human
aaguacacuguuucaaacuu

SEQ ID NO: 1181376 - RNA, 23 nt, Human
aaguacacuguuucaaacuuuac

SEQ ID NO: 1181377 - RNA, 13 nt, Human
aaguauuagaaua

SEQ ID NO: 1181378 - RNA, 16 nt, Human
aagugaggaugaaaaa

SEQ ID NO: 1181379 - RNA, 20 nt, Human
aagugauucuccugccucag

SEQ ID NO: 1181380 - RNA, 19 nt, Human
aagugauucuccugccuca

SEQ ID NO: 1181381 - RNA, 15 nt, Human
aagugauucuccugc

SEQ ID NO: 1181382 - RNA, 16 nt, Human
aagugauucuccugcc

SEQ ID NO: 1181383 - RNA, 17 nt, Human
aagugauucuccugccu

SEQ ID NO: 1181384 - RNA, 18 nt, Human
aagugauucuccugccuc

SEQ ID NO: 1181385 - RNA, 20 nt, Human
uaaaagacagugaaagaaaa

SEQ ID NO: 1181386 - RNA, 20 nt, Human
uaaaauaauuuuuauauuug

SEQ ID NO: 1181387 - RNA, 22 nt, Human
uaaaauaccagccaguaaaugg

SEQ ID NO: 1181388 - RNA, 19 nt, Human
uaaaaaucucaaauuucua

SEQ ID NO: 1181389 - RNA, 20 nt, Human
uaaaaaucucaaauuucuaa

SEQ ID NO: 1181390 - RNA, 21 nt, Human
uaaaaaucucaaauuucuaaa

SEQ ID NO: 1181391 - RNA, 23 nt, Human
uaaaaaucucaaauuucuaaauc

SEQ ID NO: 1181392 - RNA, 20 nt, Human
uaaaacuugauguguuaucu

SEQ ID NO: 1181393 - RNA, 22 nt, Human
uaaaacuugauguguuaucucu

SEQ ID NO: 1181394 - RNA, 12 nt, Human
uaaaagaaugau

SEQ ID NO: 1181395 - RNA, 15 nt, Human
guuuuucuucucccu

SEQ ID NO: 1181396 - RNA, 15 nt, Human
uaaaaaguggaaaaa

SEQ ID NO: 1181397 - RNA, 9 nt, Human
uaaaaaguu

SEQ ID NO: 1181398 - RNA, 11 nt, Human
uaaaaaguuaa

SEQ ID NO: 1181399 - RNA, 12 nt, Human
uaaaaaguuaaa

SEQ ID NO: 1181400 - RNA, 13 nt, Human
uaaaaaguuaaaa

SEQ ID NO: 1181401 - RNA, 15 nt, Human
uaaaaaguuaaaaag

SEQ ID NO: 1181402 - RNA, 17 nt, Human
uaaaaaguuaaaaaguu

SEQ ID NO: 1181403 - RNA, 15 nt, Human
uaaaaaucucaaauu

SEQ ID NO: 1181404 - RNA, 16 nt, Human
uaaaaaucucaaauuu

SEQ ID NO: 1181405 - RNA, 17 nt, Human
uaaaaaucucaaauuuc

SEQ ID NO: 1181406 - RNA, 19 nt, Human
uaaauuaacuuuuauaaac

SEQ ID NO: 1181407 - RNA, 20 nt, Human
uaaauuaacuuuuauaaacu

SEQ ID NO: 1181408 - RNA, 18 nt, Human
aaguguauuuuuuuacua

SEQ ID NO: 1181409 - RNA, 21 nt, Human
aaguguauuuuuuuacuaaua

SEQ ID NO: 1181410 - RNA, 18 nt, Human
uaaaugaaaaucgugaca

SEQ ID NO: 1181411 - RNA, 23 nt, Human
aaguguauuuuuuuacuaauaga

SEQ ID NO: 1181412 - RNA, 21 nt, Human
uaaauuaacuuuuauaaacuu

SEQ ID NO: 1181413 - RNA, 22 nt, Human
uaaauuaacuuuuauaaacuuu

SEQ ID NO: 1181414 - RNA, 11 nt, Human
uaaauuauuuu

SEQ ID NO: 1181415 - RNA, 13 nt, Human
uaacaaugcugua

SEQ ID NO: 1181416 - RNA, 13 nt, Human
aauacagaggcaa

SEQ ID NO: 1181417 - RNA, 21 nt, Human
aauaccugucccccugacaac

SEQ ID NO: 1181418 - RNA, 19 nt, Human
aauaccugucccccugaca

SEQ ID NO: 1181419 - RNA, 15 nt, Human
aauaccugucccccu

SEQ ID NO: 1181420 - RNA, 18 nt, Human
aauaccugucccccugac

SEQ ID NO: 1181421 - RNA, 23 nt, Human
aauaccacaggaaccacaagacu

SEQ ID NO: 1181422 - RNA, 17 nt, Human
aauaccagccaguaaau

SEQ ID NO: 1181423 - RNA, 19 nt, Human
aauaccagccaguaaaugg

SEQ ID NO: 1181424 - RNA, 13 nt, Human
uaacuucacauau

SEQ ID NO: 1181425 - RNA, 14 nt, Human
uaacuaaaagguau

SEQ ID NO: 1181426 - RNA, 16 nt, Human
uaacuugucuuuggac

SEQ ID NO: 1181427 - RNA, 20 nt, Human
uaacuugucuuuggacccug

SEQ ID NO: 1181428 - RNA, 13 nt, Human
uaagaagugaaaa

SEQ ID NO: 1181429 - RNA, 18 nt, Human
uaagaagugaaaaucuac

SEQ ID NO: 1181430 - RNA, 16 nt, Human
aauaguggugugauuu

SEQ ID NO: 1181431 - RNA, 21 nt, Human
aauaguucagguaacaggcag

SEQ ID NO: 1181432 - RNA, 19 nt, Human
uaacauguaauuaaguacu

SEQ ID NO: 1181433 - RNA, 15 nt, Human
aauauuuauuuuaau

SEQ ID NO: 1181434 - RNA, 16 nt, Human
aaucagccuaguugau

SEQ ID NO: 1181435 - RNA, 11 nt, Human
aaucagccugc

SEQ ID NO: 1181436 - RNA, 13 nt, Human
aaucagccugcuc

SEQ ID NO: 1181437 - RNA, 18 nt, Human
aaucagccugcuccagcu

SEQ ID NO: 1181438 - RNA, 19 nt, Human
aaucagccugcuccagcug

SEQ ID NO: 1181439 - RNA, 16 nt, Human
aaucaggguuaguauu

SEQ ID NO: 1181440 - RNA, 14 nt, Human
uaagauucauauuu

SEQ ID NO: 1181441 - RNA, 14 nt, Human
uaagcaaaauguga

SEQ ID NO: 1181442 - RNA, 15 nt, Human
uaagcaaaaugugau

SEQ ID NO: 1181443 - RNA, 21 nt, Human
uaagcaaaaugugauauguac

SEQ ID NO: 1181444 - RNA, 21 nt, Human
uaagcuauucaguaauaacuc

SEQ ID NO: 1181445 - RNA, 13 nt, Human
uaaggaagacaau

SEQ ID NO: 1181446 - RNA, 9 nt, Human
uaaggaaua

SEQ ID NO: 1181447 - RNA, 17 nt, Human
uaaggaauaccuguccc

SEQ ID NO: 1181448 - RNA, 18 nt, Human
uaaggaauaccugucccc

SEQ ID NO: 1181449 - RNA, 17 nt, Human
aaucccauuuaaaaaaa

SEQ ID NO: 1181450 - RNA, 12 nt, Human
aaucuaaaugga

SEQ ID NO: 1181451 - RNA, 13 nt, Human
aaucucaaauaac

SEQ ID NO: 1181452 - RNA, 18 nt, Human
uaaggaugcuuguacaua

SEQ ID NO: 1181453 - RNA, 20 nt, Human
uaaguaaugauaacuggaaa

SEQ ID NO: 1181454 - RNA, 14 nt, Human
aaugauaacuggaa

SEQ ID NO: 1181455 - RNA, 12 nt, Human
aaugagccuggc

SEQ ID NO: 1181456 - RNA, 13 nt, Human
aaugagccuggca

SEQ ID NO: 1181457 - RNA, 14 nt, Human
aaugagccuggcaa

SEQ ID NO: 1181458 - RNA, 16 nt, Human
aaugaggucagagccu

SEQ ID NO: 1181459 - RNA, 18 nt, Human
aaugaggucagagccugc

SEQ ID NO: 1181460 - RNA, 21 nt, Human
aaugaccuuucaauaggaaaa

SEQ ID NO: 1181461 - RNA, 22 nt, Human
aaugagagacacacugaagaag

SEQ ID NO: 1181462 - RNA, 11 nt, Human
aaugagccugg

SEQ ID NO: 1181463 - RNA, 22 nt, Human
uaauuccguagguuauuuucag

SEQ ID NO: 1181464 - RNA, 18 nt, Human
uaauuuuuauauuugaaa

SEQ ID NO: 1181465 - RNA, 19 nt, Human
uaauuuuuauauuugaaau

SEQ ID NO: 1181466 - RNA, 21 nt, Human
uaauuuuuauauuugaaauau

SEQ ID NO: 1181467 - RNA, 16 nt, Human
aaugauuucauucaau

SEQ ID NO: 1181468 - RNA, 13 nt, Human
aaugauuuuuaaa

SEQ ID NO: 1181469 - RNA, 11 nt, Human
aaugcaaacca

SEQ ID NO: 1181470 - RNA, 12 nt, Human
aaugcaaaccau

SEQ ID NO: 1181471 - RNA, 14 nt, Human
aaugcaaaccauca

SEQ ID NO: 1181472 - RNA, 13 nt, Human
aaugcaccuggaa

SEQ ID NO: 1181473 - RNA, 18 nt, Human
uaauuuuuuugagacaga

SEQ ID NO: 1181474 - RNA, 21 nt, Human
uacaaaaaaaaaaaaaaauua

SEQ ID NO: 1181475 - RNA, 13 nt, Human
uacaaugcugugc

SEQ ID NO: 1181476 - RNA, 14 nt, Human
uacaaugcugugcc

SEQ ID NO: 1181477 - RNA, 16 nt, Human
uacaaugcugugcccu

SEQ ID NO: 1181478 - RNA, 22 nt, Human
aaugcuggcuguuggcuggggg

SEQ ID NO: 1181479 - RNA, 21 nt, Human
aaugcuguauuuuaaaagaau

SEQ ID NO: 1181480 - RNA, 22 nt, Human
aaugcuguauuuuaaaagaaug

SEQ ID NO: 1181481 - RNA, 13 nt, Human
aauggaagacagc

SEQ ID NO: 1181482 - RNA, 16 nt, Human
aaugguuuucaaaaua

SEQ ID NO: 1181483 - RNA, 16 nt, Human
aaugguuuucuugugu

SEQ ID NO: 1181484 - RNA, 16 nt, Human
aauggaagacagcucu

SEQ ID NO: 1181485 - RNA, 18 nt, Human
aauggaagacagcucuua

SEQ ID NO: 1181486 - RNA, 14 nt, Human
aaugguuuucaaaa

SEQ ID NO: 1181487 - RNA, 13 nt, Human
uacagacaaagcg

SEQ ID NO: 1181488 - RNA, 14 nt, Human
uacagacaaagcgu

SEQ ID NO: 1181489 - RNA, 15 nt, Human
uacagacaaagcgug

SEQ ID NO: 1181490 - RNA, 19 nt, Human
uacagacaaagcguggugg

SEQ ID NO: 1181491 - RNA, 17 nt, Human
uacagagacagaaagca

SEQ ID NO: 1181492 - RNA, 23 nt, Human
uacagagcagacaguuaagagaa

SEQ ID NO: 1181493 - RNA, 19 nt, Human
uacagagcccacgccccca

SEQ ID NO: 1181494 - RNA, 22 nt, Human
uacagagcccacgcccccacug

SEQ ID NO: 1181495 - RNA, 19 nt, Human
uaccagggacugaggggag

SEQ ID NO: 1181496 - RNA, 12 nt, Human
uacauucuguua

SEQ ID NO: 1181497 - RNA, 12 nt, Human
uaccagcagagc

SEQ ID NO: 1181498 - RNA, 13 nt, Human
uaccagcagagca

SEQ ID NO: 1181499 - RNA, 14 nt, Human
uaccagcagagcac

SEQ ID NO: 1181500 - RNA, 22 nt, Human
uaccagcagagcaccuuagaca

SEQ ID NO: 1181501 - RNA, 18 nt, Human
uaccagccaguaaauggg

SEQ ID NO: 1181502 - RNA, 13 nt, Human
aauguucaucaau

SEQ ID NO: 1181503 - RNA, 23 nt, Human
uacagagcccacgcccccacugg

SEQ ID NO: 1181504 - RNA, 16 nt, Human
aauguucaucaaugaa

SEQ ID NO: 1181505 - RNA, 20 nt, Human
aauguucaucaaugaaugaa

SEQ ID NO: 1181506 - RNA, 21 nt, Human
aauguucucucuucuccaccu

SEQ ID NO: 1181507 - RNA, 12 nt, Human
aauuaacuuuua

SEQ ID NO: 1181508 - RNA, 13 nt, Human
aauuaacuuuuau

SEQ ID NO: 1181509 - RNA, 15 nt, Human
aauuaacuuuuauaa

SEQ ID NO: 1181510 - RNA, 16 nt, Human
aauuaacuuuuauaaa

SEQ ID NO: 1181511 - RNA, 16 nt, Human
aauuaaguacuaugua

SEQ ID NO: 1181512 - RNA, 17 nt, Human
aauuaaguacuauguau

SEQ ID NO: 1181513 - RNA, 21 nt, Human
aauuauuuauuaaaugcccag

SEQ ID NO: 1181514 - RNA, 22 nt, Human
aauuauuuauuaaaugcccagc

SEQ ID NO: 1181515 - RNA, 11 nt, Human
aauucaguugu

SEQ ID NO: 1181516 - RNA, 17 nt, Human
aauucaguuguuagugu

SEQ ID NO: 1181517 - RNA, 22 nt, Human
aauucaguuguuagugugucuu

SEQ ID NO: 1181518 - RNA, 16 nt, Human
uaccugaagucuuugu

SEQ ID NO: 1181519 - RNA, 13 nt, Human
uaccugaggggcc

SEQ ID NO: 1181520 - RNA, 15 nt, Human
uaccugaggggccuc

SEQ ID NO: 1181521 - RNA, 13 nt, Human
uaccugaagucuu

SEQ ID NO: 1181522 - RNA, 14 nt, Human
uaccugaagucuuu

SEQ ID NO: 1181523 - RNA, 15 nt, Human
uacccucauguucuu

SEQ ID NO: 1181524 - RNA, 22 nt, Human
uaccucuugagccuugaacuuu

SEQ ID NO: 1181525 - RNA, 23 nt, Human
uaccucuugagccuugaacuuug

SEQ ID NO: 1181526 - RNA, 16 nt, Human
uaccugaggggccucu

SEQ ID NO: 1181527 - RNA, 16 nt, Human
uaccugccaggaagcc

SEQ ID NO: 1181528 - RNA, 17 nt, Human
aauuacaggaaguacug

SEQ ID NO: 1181529 - RNA, 19 nt, Human
aauuacaggaaguacugga

SEQ ID NO: 1181530 - RNA, 20 nt, Human
aauuacaggaaguacuggag

SEQ ID NO: 1181531 - RNA, 13 nt, Human
aauuacauuugua

SEQ ID NO: 1181532 - RNA, 14 nt, Human
aauuacauuuguau

SEQ ID NO: 1181533 - RNA, 15 nt, Human
uagaaacacaacuau

SEQ ID NO: 1181534 - RNA, 16 nt, Human
uagaacucccuuucaa

SEQ ID NO: 1181535 - RNA, 17 nt, Human
uagaacucccuuucaac

SEQ ID NO: 1181536 - RNA, 18 nt, Human
uagaacucccuuucaaca

SEQ ID NO: 1181537 - RNA, 18 nt, Human
aauuugggggaaaauuua

SEQ ID NO: 1181538 - RNA, 14 nt, Human
aauuugugauacaa

SEQ ID NO: 1181539 - RNA, 17 nt, Human
aauuugugauacaaugc

SEQ ID NO: 1181540 - RNA, 18 nt, Human
aauuugugauacaaugcu

SEQ ID NO: 1181541 - RNA, 20 nt, Human
aauuugugauacaaugcugu

SEQ ID NO: 1181542 - RNA, 17 nt, Human
uagacagucccugccaa

SEQ ID NO: 1181543 - RNA, 21 nt, Human
uagacagucccugccaaugga

SEQ ID NO: 1181544 - RNA, 21 nt, Human
uagacagagucucacuguugc

SEQ ID NO: 1181545 - RNA, 15 nt, Human
uagaagucacacagu

SEQ ID NO: 1181546 - RNA, 13 nt, Human
uagacacacauga

SEQ ID NO: 1181547 - RNA, 10 nt, Human
uagacagagu

SEQ ID NO: 1181548 - RNA, 14 nt, Human
uagagccagggucu

SEQ ID NO: 1181549 - RNA, 22 nt, Human
uagagcggagaaaggaagggcu

SEQ ID NO: 1181550 - RNA, 14 nt, Human
uagaggguguguaa

SEQ ID NO: 1181551 - RNA, 14 nt, Human
uagcacagacccug

SEQ ID NO: 1181552 - RNA, 15 nt, Human
uagcacagacccugc

SEQ ID NO: 1181553 - RNA, 16 nt, Human
uagcacagacccugcc

SEQ ID NO: 1181554 - RNA, 20 nt, Human
uagcacagacccugcccugu

SEQ ID NO: 1181555 - RNA, 21 nt, Human
uagcacagacccugcccugug

SEQ ID NO: 1181556 - RNA, 22 nt, Human
uagcacagacccugcccugugg

SEQ ID NO: 1181557 - RNA, 24 nt, Human
uagcacagacccugcccugugggc

SEQ ID NO: 1181558 - RNA, 16 nt, Human
uagcacuuugggaggc

SEQ ID NO: 1181559 - RNA, 12 nt, Human
uagccaaggcca

SEQ ID NO: 1181560 - RNA, 13 nt, Human
uagccaaggccaa

SEQ ID NO: 1181561 - RNA, 14 nt, Human
uagccaaggccaaa

SEQ ID NO: 1181562 - RNA, 13 nt, Human
uaggaaaaacuga

SEQ ID NO: 1181563 - RNA, 14 nt, Human
uaggaaaaacugau

SEQ ID NO: 1181564 - RNA, 17 nt, Human
uagcgcccaguugggug

SEQ ID NO: 1181565 - RNA, 21 nt, Human
uagccuuagaagucacacagu

SEQ ID NO: 1181566 - RNA, 14 nt, Human
uagcgcccaguugg

SEQ ID NO: 1181567 - RNA, 20 nt, Human
uagccuuagaagucacacag

SEQ ID NO: 1181568 - RNA, 14 nt, Human
uaggcauuguggga

SEQ ID NO: 1181569 - RNA, 13 nt, Human
uagggaagauaau

SEQ ID NO: 1181570 - RNA, 21 nt, Human
uagggaaggauacaaaagcau

SEQ ID NO: 1181571 - RNA, 16 nt, Human
uaggaaaaacugauuu

SEQ ID NO: 1181572 - RNA, 17 nt, Human
uaggaaaaacugauuuu

SEQ ID NO: 1181573 - RNA, 13 nt, Human
uaggauguugaaa

SEQ ID NO: 1181574 - RNA, 19 nt, Human
uaggguaagugagagaggg

SEQ ID NO: 1181575 - RNA, 15 nt, Human
uaggguuauaauaau

SEQ ID NO: 1181576 - RNA, 17 nt, Human
uaggguuauaauaaugu

SEQ ID NO: 1181577 - RNA, 20 nt, Human
acaaugacuuacuguacaug

SEQ ID NO: 1181578 - RNA, 22 nt, Human
acaaugacuuacuguacaugaa

SEQ ID NO: 1181579 - RNA, 11 nt, Human
acaaugcaaac

SEQ ID NO: 1181580 - RNA, 16 nt, Human
acaaugcaaaccauca

SEQ ID NO: 1181581 - RNA, 17 nt, Human
acaaugcaaaccaucau

SEQ ID NO: 1181582 - RNA, 18 nt, Human
acaaugcaaaccaucauu

SEQ ID NO: 1181583 - RNA, 19 nt, Human
acaaugcaaaccaucauug

SEQ ID NO: 1181584 - RNA, 21 nt, Human
acaaugcaaaccaucauugaa

SEQ ID NO: 1181585 - RNA, 23 nt, Human
acaaugcaaaccaucauugaaau

SEQ ID NO: 1181586 - RNA, 13 nt, Human
acacaacuauauu

SEQ ID NO: 1181587 - RNA, 14 nt, Human
acacaacuauauug

SEQ ID NO: 1181588 - RNA, 14 nt, Human
acacacacacacag

SEQ ID NO: 1181589 - RNA, 15 nt, Human
acacacacacacagc

SEQ ID NO: 1181590 - RNA, 16 nt, Human
acacacacacacagcc

SEQ ID NO: 1181591 - RNA, 14 nt, Human
acacacacacacau

SEQ ID NO: 1181592 - RNA, 15 nt, Human
acacacacacacaug

SEQ ID NO: 1181593 - RNA, 16 nt, Human
acacacacacacaugc

SEQ ID NO: 1181594 - RNA, 17 nt, Human
acacacacacacaugca

SEQ ID NO: 1181595 - RNA, 12 nt, Human
acacacacacag

SEQ ID NO: 1181596 - RNA, 13 nt, Human
acacacacacagc

SEQ ID NO: 1181597 - RNA, 14 nt, Human
acacacacacagcc

SEQ ID NO: 1181598 - RNA, 15 nt, Human
acacacacacagcca

SEQ ID NO: 1181599 - RNA, 12 nt, Human
acacacacacau

SEQ ID NO: 1181600 - RNA, 13 nt, Human
acacacacacaug

SEQ ID NO: 1181601 - RNA, 14 nt, Human
acacacacacaugc

SEQ ID NO: 1181602 - RNA, 20 nt, Human
acacacagaaaauauacugu

SEQ ID NO: 1181603 - RNA, 21 nt, Human
acacacagaaaauauacugua

SEQ ID NO: 1181604 - RNA, 22 nt, Human
acacacagaaaauauacuguaa

SEQ ID NO: 1181605 - RNA, 15 nt, Human
acacacacacaugca

SEQ ID NO: 1181606 - RNA, 13 nt, Human
acacacagaaaau

SEQ ID NO: 1181607 - RNA, 14 nt, Human
acacacagaaaaua

SEQ ID NO: 1181608 - RNA, 15 nt, Human
acacacagaaaauau

SEQ ID NO: 1181609 - RNA, 16 nt, Human
acacacagaaaauaua

SEQ ID NO: 1181610 - RNA, 17 nt, Human
acacacagaaaauauac

SEQ ID NO: 1181611 - RNA, 18 nt, Human
acacacagaaaauauacu

SEQ ID NO: 1181612 - RNA, 19 nt, Human
acacacagaaaauauacug

SEQ ID NO: 1181613 - RNA, 11 nt, Human
acacacagcca

SEQ ID NO: 1181614 - RNA, 12 nt, Human
acacacagccac

SEQ ID NO: 1181615 - RNA, 16 nt, Human
acacaggcccggcucc

SEQ ID NO: 1181616 - RNA, 17 nt, Human
acacaggcccggcucca

SEQ ID NO: 1181617 - RNA, 18 nt, Human
acacaggcccggcuccag

SEQ ID NO: 1181618 - RNA, 19 nt, Human
acacaggcccggcuccagg

SEQ ID NO: 1181619 - RNA, 20 nt, Human
acacaggcccggcuccaggc

SEQ ID NO: 1181620 - RNA, 21 nt, Human
acacaggcccggcuccaggcu

SEQ ID NO: 1181621 - RNA, 22 nt, Human
acacaggcccggcuccaggcuc

SEQ ID NO: 1181622 - RNA, 23 nt, Human
acacaggcccggcuccaggcucc

SEQ ID NO: 1181623 - RNA, 24 nt, Human
acacaggcccggcuccaggcuccu

SEQ ID NO: 1181624 - RNA, 16 nt, Human
acacaguauuacuucu

SEQ ID NO: 1181625 - RNA, 14 nt, Human
uagucacugagaca

SEQ ID NO: 1181626 - RNA, 15 nt, Human
uaguagagacagggu

SEQ ID NO: 1181627 - RNA, 22 nt, Human
uaguagagacaggguuuugcca

SEQ ID NO: 1181628 - RNA, 23 nt, Human
uauaggaacuuaaauaaugugaa

SEQ ID NO: 1181629 - RNA, 12 nt, Human
uauaggaauuga

SEQ ID NO: 1181630 - RNA, 18 nt, Human
uauagccuaggugacaga

SEQ ID NO: 1181631 - RNA, 16 nt, Human
acacucauugaccuga

SEQ ID NO: 1181632 - RNA, 17 nt, Human
uagucacugagacagcc

SEQ ID NO: 1181633 - RNA, 20 nt, Human
uagucacugagacagcccgg

SEQ ID NO: 1181634 - RNA, 15 nt, Human
acacuaaugaggaaa

SEQ ID NO: 1181635 - RNA, 22 nt, Human
acacuaaugaggaaacugcacu

SEQ ID NO: 1181636 - RNA, 21 nt, Human
acacucaaaagcugggcaggu

SEQ ID NO: 1181637 - RNA, 18 nt, Human
uauaauuuaccugaaguc

SEQ ID NO: 1181638 - RNA, 21 nt, Human
uauaauuuaccugaagucuuu

SEQ ID NO: 1181639 - RNA, 22 nt, Human
uauacacuuacacuuuaugcac

SEQ ID NO: 1181640 - RNA, 18 nt, Human
acacuuacacuuuaugca

SEQ ID NO: 1181641 - RNA, 21 nt, Human
acacuuacacuuuaugcacaa

SEQ ID NO: 1181642 - RNA, 17 nt, Human
acacucauugaccugag

SEQ ID NO: 1181643 - RNA, 19 nt, Human
acacucauugaccugaggc

SEQ ID NO: 1181644 - RNA, 17 nt, Human
acacuguuucaaacuuu

SEQ ID NO: 1181645 - RNA, 18 nt, Human
acacuguuucaaacuuua

SEQ ID NO: 1181646 - RNA, 20 nt, Human
acacuguuucaaacuuuacu

SEQ ID NO: 1181647 - RNA, 23 nt, Human
acacuguuucaaacuuuacuaug

SEQ ID NO: 1181648 - RNA, 16 nt, Human
acacuuacacuuuaug

SEQ ID NO: 1181649 - RNA, 12 nt, Human
acagaaaauaua

SEQ ID NO: 1181650 - RNA, 13 nt, Human
acagaaaauauac

SEQ ID NO: 1181651 - RNA, 14 nt, Human
acagaaaauauacu

SEQ ID NO: 1181652 - RNA, 15 nt, Human
acagaaaauauacug

SEQ ID NO: 1181653 - RNA, 16 nt, Human
acagaaaauauacugu

SEQ ID NO: 1181654 - RNA, 13 nt, Human
acagaaauguaca

SEQ ID NO: 1181655 - RNA, 18 nt, Human
acagacauacuaaccagc

SEQ ID NO: 1181656 - RNA, 19 nt, Human
acagacauacuaaccagca

SEQ ID NO: 1181657 - RNA, 17 nt, Human
uaucagaauucucagaa

SEQ ID NO: 1181658 - RNA, 19 nt, Human
uauccaacaucaacaucuu

SEQ ID NO: 1181659 - RNA, 14 nt, Human
acagaccuuugaac

SEQ ID NO: 1181660 - RNA, 19 nt, Human
uaucacccagaagaaaaua

SEQ ID NO: 1181661 - RNA, 22 nt, Human
uaucacccagaagaaaauagug

SEQ ID NO: 1181662 - RNA, 16 nt, Human
acagcccgggcucugc

SEQ ID NO: 1181663 - RNA, 15 nt, Human
acagcccgggcucug

SEQ ID NO: 1181664 - RNA, 19 nt, Human
acagcccuucuuuccacag

SEQ ID NO: 1181665 - RNA, 14 nt, Human
uaugaggcauuugu

SEQ ID NO: 1181666 - RNA, 15 nt, Human
uaugaggcauuuguu

SEQ ID NO: 1181667 - RNA, 21 nt, Human
uaugaggcauuuguuugaacu

SEQ ID NO: 1181668 - RNA, 23 nt, Human
uaugaggcauuuguuugaacuga

SEQ ID NO: 1181669 - RNA, 20 nt, Human
uauggcccuggccuagcaua

SEQ ID NO: 1181670 - RNA, 21 nt, Human
uauggcccuggccuagcauac

SEQ ID NO: 1181671 - RNA, 22 nt, Human
uauggcccuggccuagcauacg

SEQ ID NO: 1181672 - RNA, 16 nt, Human
uaugggacucaaugca

SEQ ID NO: 1181673 - RNA, 23 nt, Human
uaugggacucaaugcacugacau

SEQ ID NO: 1181674 - RNA, 10 nt, Human
uaugggagag

SEQ ID NO: 1181675 - RNA, 22 nt, Human
uaugcaugaaguaauaugcaca

SEQ ID NO: 1181676 - RNA, 14 nt, Human
uaugaucacggcuc

SEQ ID NO: 1181677 - RNA, 15 nt, Human
uaugccccauucaac

SEQ ID NO: 1181678 - RNA, 14 nt, Human
uaugcucugcaugu

SEQ ID NO: 1181679 - RNA, 20 nt, Human
acaggaaaauuuuaaaaaua

SEQ ID NO: 1181680 - RNA, 22 nt, Human
acaggaaccacaagacugcaca

SEQ ID NO: 1181681 - RNA, 13 nt, Human
acaggcaggucca

SEQ ID NO: 1181682 - RNA, 16 nt, Human
acaggcccggcuccag

SEQ ID NO: 1181683 - RNA, 17 nt, Human
acaggcccggcuccagg

SEQ ID NO: 1181684 - RNA, 18 nt, Human
acaggcccggcuccaggc

SEQ ID NO: 1181685 - RNA, 20 nt, Human
acaggcccggcuccaggcuc

SEQ ID NO: 1181686 - RNA, 21 nt, Human
acaggcccggcuccaggcucc

SEQ ID NO: 1181687 - RNA, 22 nt, Human
acaggcccggcuccaggcuccu

SEQ ID NO: 1181688 - RNA, 15 nt, Human
acagcuaaugggaca

SEQ ID NO: 1181689 - RNA, 16 nt, Human
acagcuaaugggacac

SEQ ID NO: 1181690 - RNA, 17 nt, Human
acagcuaaugggacacu

SEQ ID NO: 1181691 - RNA, 19 nt, Human
acagcuaaugggacacuaa

SEQ ID NO: 1181692 - RNA, 14 nt, Human
acagcuguaugauu

SEQ ID NO: 1181693 - RNA, 19 nt, Human
acagcuguaugauucccag

SEQ ID NO: 1181694 - RNA, 20 nt, Human
acagcuguaugauucccagc

SEQ ID NO: 1181695 - RNA, 23 nt, Human
acagcuguaugauucccagccag

SEQ ID NO: 1181696 - RNA, 17 nt, Human
acagcuucauuuccugu

SEQ ID NO: 1181697 - RNA, 19 nt, Human
acagcuucauuuccugugu

SEQ ID NO: 1181698 - RNA, 21 nt, Human
acagcuucauuuccugugucu

SEQ ID NO: 1181699 - RNA, 17 nt, Human
acagcuugaccgugagg

SEQ ID NO: 1181700 - RNA, 20 nt, Human
acagcuugaccgugaggcca

SEQ ID NO: 1181701 - RNA, 21 nt, Human
acagcuugaccgugaggccag

SEQ ID NO: 1181702 - RNA, 22 nt, Human
acagcuugaccgugaggccaga

SEQ ID NO: 1181703 - RNA, 23 nt, Human
acagcuugaccgugaggccagag

SEQ ID NO: 1181704 - RNA, 19 nt, Human
acaggaaaagcugcugaca

SEQ ID NO: 1181705 - RNA, 20 nt, Human
acaggaaaagcugcugacag

SEQ ID NO: 1181706 - RNA, 21 nt, Human
acaggaaaagcugcugacagu

SEQ ID NO: 1181707 - RNA, 13 nt, Human
ucaaagauauuuu

SEQ ID NO: 1181708 - RNA, 20 nt, Human
ucaaagauauuuugcuuugu

SEQ ID NO: 1181709 - RNA, 22 nt, Human
ucaaagauauuuugcuuuguga

SEQ ID NO: 1181710 - RNA, 13 nt, Human
acaugagcaucag

SEQ ID NO: 1181711 - RNA, 23 nt, Human
acaugaaaacacauuuuucuuag

SEQ ID NO: 1181712 - RNA, 23 nt, Human
acaugagcaucaggccaggcccu

SEQ ID NO: 1181713 - RNA, 16 nt, Human
acaugagguacugaga

SEQ ID NO: 1181714 - RNA, 18 nt, Human
acauggaauaacauguaa

SEQ ID NO: 1181715 - RNA, 20 nt, Human
acauggaauaacauguaauu

SEQ ID NO: 1181716 - RNA, 15 nt, Human
acauggaguauaugu

SEQ ID NO: 1181717 - RNA, 19 nt, Human
acauggaguauaugucaag

SEQ ID NO: 1181718 - RNA, 21 nt, Human
acaugucuuuucuugcaugag

SEQ ID NO: 1181719 - RNA, 15 nt, Human
acaucuugcucugcu

SEQ ID NO: 1181720 - RNA, 16 nt, Human
acaucuugcucugcug

SEQ ID NO: 1181721 - RNA, 17 nt, Human
acaucuugcucugcuga

SEQ ID NO: 1181722 - RNA, 19 nt, Human
acaucuuggucagauuuga

SEQ ID NO: 1181723 - RNA, 15 nt, Human
acaugaaaacacauu

SEQ ID NO: 1181724 - RNA, 16 nt, Human
acaugaaaacacauuu

SEQ ID NO: 1181725 - RNA, 14 nt, Human
uauuuuaaaagaau

SEQ ID NO: 1181726 - RNA, 18 nt, Human
uauuuuaaaagaaugauu

SEQ ID NO: 1181727 - RNA, 19 nt, Human
uauuuuaauaauguuucaa

SEQ ID NO: 1181728 - RNA, 22 nt, Human
uauuuuaauaauguuucaaaca

SEQ ID NO: 1181729 - RNA, 13 nt, Human
uauuuugcuuugu

SEQ ID NO: 1181730 - RNA, 15 nt, Human
uauuuugcuuuguga

SEQ ID NO: 1181731 - RNA, 20 nt, Human
uauuuugcuuugugauuuuu

SEQ ID NO: 1181732 - RNA, 17 nt, Human
uauuuuuguagagccag

SEQ ID NO: 1181733 - RNA, 17 nt, Human
ucaagagggucugagga

SEQ ID NO: 1181734 - RNA, 16 nt, Human
ucaagugauucuccug

SEQ ID NO: 1181735 - RNA, 17 nt, Human
ucaagugauucuccugc

SEQ ID NO: 1181736 - RNA, 18 nt, Human
ucaagugauucuccugcc

SEQ ID NO: 1181737 - RNA, 18 nt, Human
ucaauaggaaaaacugau

SEQ ID NO: 1181738 - RNA, 19 nt, Human
ucaauaggaaaaacugauu

SEQ ID NO: 1181739 - RNA, 22 nt, Human
ucaauaggaaaaacugauuuuu

SEQ ID NO: 1181740 - RNA, 14 nt, Human
acauuuuauuuuau

SEQ ID NO: 1181741 - RNA, 15 nt, Human
acauuuuuaagugcu

SEQ ID NO: 1181742 - RNA, 18 nt, Human
acauuuuuaagugcugca

SEQ ID NO: 1181743 - RNA, 19 nt, Human
acauuuuuaagugcugcau

SEQ ID NO: 1181744 - RNA, 13 nt, Human
acauuuuucuuag

SEQ ID NO: 1181745 - RNA, 23 nt, Human
acauuuuucuuagggaaggauac

SEQ ID NO: 1181746 - RNA, 21 nt, Human
acauugcggacagccacggcc

SEQ ID NO: 1181747 - RNA, 22 nt, Human
acauugcggacagccacggcca

SEQ ID NO: 1181748 - RNA, 16 nt, Human
accacaagacugcaca

SEQ ID NO: 1181749 - RNA, 17 nt, Human
accacacagaggcugcc

SEQ ID NO: 1181750 - RNA, 15 nt, Human
accacacccagccca

SEQ ID NO: 1181751 - RNA, 16 nt, Human
accacacccagcccac

SEQ ID NO: 1181752 - RNA, 20 nt, Human
accacacccagcccacuucu

SEQ ID NO: 1181753 - RNA, 21 nt, Human
accacacccagcccacuucug

SEQ ID NO: 1181754 - RNA, 23 nt, Human
accacacccagcccacuucugcc

SEQ ID NO: 1181755 - RNA, 23 nt, Human
accaaaaaucucaauauuucaga

SEQ ID NO: 1181756 - RNA, 16 nt, Human
accaaaucagcugcua

SEQ ID NO: 1181757 - RNA, 19 nt, Human
accaaaucagcugcuacua

SEQ ID NO: 1181758 - RNA, 16 nt, Human
accaacauacucccau

SEQ ID NO: 1181759 - RNA, 17 nt, Human
accaacauacucccauc

SEQ ID NO: 1181760 - RNA, 20 nt, Human
accaaccacugcgaccacaa

SEQ ID NO: 1181761 - RNA, 13 nt, Human
ucaauuuaaaaaa

SEQ ID NO: 1181762 - RNA, 12 nt, Human
ucaauuuaaaaa

SEQ ID NO: 1181763 - RNA, 16 nt, Human
ucacagaccuuugaac

SEQ ID NO: 1181764 - RNA, 14 nt, Human
ucacagaugggugc

SEQ ID NO: 1181765 - RNA, 15 nt, Human
ucacagaugggugcu

SEQ ID NO: 1181766 - RNA, 14 nt, Human
ucacaggaaguaga

SEQ ID NO: 1181767 - RNA, 16 nt, Human
ucacauauugauuucc

SEQ ID NO: 1181768 - RNA, 18 nt, Human
ucacauauugauuuccgu

SEQ ID NO: 1181769 - RNA, 20 nt, Human
ucacauauugauuuccguua

SEQ ID NO: 1181770 - RNA, 17 nt, Human
ucaccagccccagugcc

SEQ ID NO: 1181771 - RNA, 18 nt, Human
ucacugcaaccuccgccu

SEQ ID NO: 1181772 - RNA, 14 nt, Human
ucacuguugcccag

SEQ ID NO: 1181773 - RNA, 15 nt, Human
ucacuguugcccagg

SEQ ID NO: 1181774 - RNA, 16 nt, Human
ucacuguugcccaggc

SEQ ID NO: 1181775 - RNA, 23 nt, Human
ucacugagacagcccgggcucug

SEQ ID NO: 1181776 - RNA, 22 nt, Human
ucaccagccccagugcccacag

SEQ ID NO: 1181777 - RNA, 21 nt, Human
ucacuauguugcccaggcagg

SEQ ID NO: 1181778 - RNA, 19 nt, Human
accauucuccaccugccag

SEQ ID NO: 1181779 - RNA, 20 nt, Human
accauucuccaccugccagg

SEQ ID NO: 1181780 - RNA, 21 nt, Human
accauucuccaccugccaggg

SEQ ID NO: 1181781 - RNA, 22 nt, Human
accauuuugcugucccuuuucc

SEQ ID NO: 1181782 - RNA, 23 nt, Human
accauuuugcugucccuuuuccu

SEQ ID NO: 1181783 - RNA, 21 nt, Human
accauuuugggguacccacug

SEQ ID NO: 1181784 - RNA, 20 nt, Human
acccacugcuuuuggucugu

SEQ ID NO: 1181785 - RNA, 22 nt, Human
accauuuugggguacccacugc

SEQ ID NO: 1181786 - RNA, 16 nt, Human
acccaaauguucauca

SEQ ID NO: 1181787 - RNA, 20 nt, Human
acccaaauguucaucaauga

SEQ ID NO: 1181788 - RNA, 23 nt, Human
ucagagacuccugcaggcagcca

SEQ ID NO: 1181789 - RNA, 16 nt, Human
ucagagacuccugcag

SEQ ID NO: 1181790 - RNA, 16 nt, Human
ucagaucucuaacuuc

SEQ ID NO: 1181791 - RNA, 15 nt, Human
acccagcccacuucu

SEQ ID NO: 1181792 - RNA, 10 nt, Human
ucagaauucu

SEQ ID NO: 1181793 - RNA, 12 nt, Human
ucagaauucuca

SEQ ID NO: 1181794 - RNA, 20 nt, Human
ucagaauucucagaaucuca

SEQ ID NO: 1181795 - RNA, 16 nt, Human
ucagaauucucuaguu

SEQ ID NO: 1181796 - RNA, 13 nt, Human
acccagcgagccc

SEQ ID NO: 1181797 - RNA, 16 nt, Human
acccagcgagcccugg

SEQ ID NO: 1181798 - RNA, 17 nt, Human
acccagcgagcccuggu

SEQ ID NO: 1181799 - RNA, 13 nt, Human
acccaggagcccc

SEQ ID NO: 1181800 - RNA, 15 nt, Human
acccaggagccccga

SEQ ID NO: 1181801 - RNA, 19 nt, Human
acccaggagccccgaggcc

SEQ ID NO: 1181802 - RNA, 11 nt, Human
acccaggugcu

SEQ ID NO: 1181803 - RNA, 23 nt, Human
acccaggugcuaggaacacuccu

SEQ ID NO: 1181804 - RNA, 13 nt, Human
accccagguuucu

SEQ ID NO: 1181805 - RNA, 13 nt, Human
ucaggccagcugc

SEQ ID NO: 1181806 - RNA, 14 nt, Human
ucaggccagcugcu

SEQ ID NO: 1181807 - RNA, 13 nt, Human
ucaggccaggccc

SEQ ID NO: 1181808 - RNA, 14 nt, Human
ucaggccaggcccu

SEQ ID NO: 1181809 - RNA, 15 nt, Human
ucaggccaggcccuc

SEQ ID NO: 1181810 - RNA, 16 nt, Human
ucaggccaggcccucu

SEQ ID NO: 1181811 - RNA, 12 nt, Human
acccccagccug

SEQ ID NO: 1181812 - RNA, 13 nt, Human
acccccagccugc

SEQ ID NO: 1181813 - RNA, 14 nt, Human
acccccagccugcu

SEQ ID NO: 1181814 - RNA, 17 nt, Human
ucaggcaggugggaugg

SEQ ID NO: 1181815 - RNA, 18 nt, Human
ucaggcaggugggaugga

SEQ ID NO: 1181816 - RNA, 23 nt, Human
ucaggguuggccccugcccggcu

SEQ ID NO: 1181817 - RNA, 18 nt, Human
ucaggguuggccccugcc

SEQ ID NO: 1181818 - RNA, 19 nt, Human
ucaggguuggccccugccc

SEQ ID NO: 1181819 - RNA, 19 nt, Human
acccgcuaagagggaggga

SEQ ID NO: 1181820 - RNA, 17 nt, Human
ucaggccaggcccucug

SEQ ID NO: 1181821 - RNA, 18 nt, Human
ucaggccaggcccucugc

SEQ ID NO: 1181822 - RNA, 19 nt, Human
ucaggccaggcccucugcc

SEQ ID NO: 1181823 - RNA, 20 nt, Human
ucaggccaggcccucugccc

SEQ ID NO: 1181824 - RNA, 12 nt, Human
ucaggggugugc

SEQ ID NO: 1181825 - RNA, 19 nt, Human
ucaggggugugcggccuuu

SEQ ID NO: 1181826 - RNA, 23 nt, Human
ucaggggugugcggccuuuggcu

SEQ ID NO: 1181827 - RNA, 11 nt, Human
acccugaggcc

SEQ ID NO: 1181828 - RNA, 13 nt, Human
acccugaggccca

SEQ ID NO: 1181829 - RNA, 19 nt, Human
acccugaggcccagagggc

SEQ ID NO: 1181830 - RNA, 21 nt, Human
acccugaggcccagagggccu

SEQ ID NO: 1181831 - RNA, 23 nt, Human
acccugaggcccagagggccugc

SEQ ID NO: 1181832 - RNA, 19 nt, Human
acccgggaagggggcuggg

SEQ ID NO: 1181833 - RNA, 20 nt, Human
acccgggaagggggcuggga

SEQ ID NO: 1181834 - RNA, 22 nt, Human
acccgggaagggggcugggaca

SEQ ID NO: 1181835 - RNA, 14 nt, Human
acccucauguucuu

SEQ ID NO: 1181836 - RNA, 15 nt, Human
acccucauguucuua

SEQ ID NO: 1181837 - RNA, 17 nt, Human
acccucauguucuuaau

SEQ ID NO: 1181838 - RNA, 15 nt, Human
acccgggaggcagag

SEQ ID NO: 1181839 - RNA, 21 nt, Human
acccuccuuucaccacaugug

SEQ ID NO: 1181840 - RNA, 22 nt, Human
ucaggugucccugcacuugcag

SEQ ID NO: 1181841 - RNA, 13 nt, Human
ucaguaagccgug

SEQ ID NO: 1181842 - RNA, 13 nt, Human
ucaguaauaacuc

SEQ ID NO: 1181843 - RNA, 20 nt, Human
acccuugccgucuaccugag

SEQ ID NO: 1181844 - RNA, 15 nt, Human
acccuugugguccca

SEQ ID NO: 1181845 - RNA, 21 nt, Human
accgaaaacguggcugcuuca

SEQ ID NO: 1181846 - RNA, 22 nt, Human
accgaaaacguggcugcuucaa

SEQ ID NO: 1181847 - RNA, 22 nt, Human
ucagguggggucacucuggcag

SEQ ID NO: 1181848 - RNA, 23 nt, Human
ucagguggggucacucuggcagc

SEQ ID NO: 1181849 - RNA, 15 nt, Human
ucaggugucccugca

SEQ ID NO: 1181850 - RNA, 17 nt, Human
ucaggugucccugcacu

SEQ ID NO: 1181851 - RNA, 18 nt, Human
ucaggugucccugcacuu

SEQ ID NO: 1181852 - RNA, 14 nt, Human
ucaguggcagcugc

SEQ ID NO: 1181853 - RNA, 15 nt, Human
ucaguggcagcugcu

SEQ ID NO: 1181854 - RNA, 16 nt, Human
ucaguggcagcugcuu

SEQ ID NO: 1181855 - RNA, 19 nt, Human
ucagugccuuauggaacac

SEQ ID NO: 1181856 - RNA, 20 nt, Human
ucagugccuuauggaacacu

SEQ ID NO: 1181857 - RNA, 22 nt, Human
ucagugccuuauggaacacucu

SEQ ID NO: 1181858 - RNA, 23 nt, Human
ucagugccuuauggaacacucug

SEQ ID NO: 1181859 - RNA, 19 nt, Human
ucaguuguuagugugucuu

SEQ ID NO: 1181860 - RNA, 12 nt, Human
accugagcccca

SEQ ID NO: 1181861 - RNA, 17 nt, Human
accugagccccaaaagg

SEQ ID NO: 1181862 - RNA, 23 nt, Human
accugaggcccuucucuccagcc

SEQ ID NO: 1181863 - RNA, 16 nt, Human
ucauaauaaguugcau

SEQ ID NO: 1181864 - RNA, 12 nt, Human
ucauaaugacuu

SEQ ID NO: 1181865 - RNA, 13 nt, Human
ucauaaugacuua

SEQ ID NO: 1181866 - RNA, 18 nt, Human
accugaagacucauucuu

SEQ ID NO: 1181867 - RNA, 19 nt, Human
accugaauuuuggcugugu

SEQ ID NO: 1181868 - RNA, 18 nt, Human
accugccaggaagccagc

SEQ ID NO: 1181869 - RNA, 19 nt, Human
accugccaggaagccagca

SEQ ID NO: 1181870 - RNA, 16 nt, Human
accugccaggaagcca

SEQ ID NO: 1181871 - RNA, 17 nt, Human
accugccaggaagccag

SEQ ID NO: 1181872 - RNA, 14 nt, Human
accugaggggccuc

SEQ ID NO: 1181873 - RNA, 16 nt, Human
accugaggggccucuu

SEQ ID NO: 1181874 - RNA, 14 nt, Human
accugauugugucu

SEQ ID NO: 1181875 - RNA, 20 nt, Human
accuggaauauauaaccagu

SEQ ID NO: 1181876 - RNA, 23 nt, Human
accugccuguugggccaggagcc

SEQ ID NO: 1181877 - RNA, 16 nt, Human
accugcggugcuaucu

SEQ ID NO: 1181878 - RNA, 21 nt, Human
accugcgucucauacucaccu

SEQ ID NO: 1181879 - RNA, 18 nt, Human
accugcggugcuaucucc

SEQ ID NO: 1181880 - RNA, 18 nt, Human
ucauuuuuuuuaagaaaa

SEQ ID NO: 1181881 - RNA, 19 nt, Human
ucauuuuuaguagagacag

SEQ ID NO: 1181882 - RNA, 14 nt, Human
ucauuugucacaca

SEQ ID NO: 1181883 - RNA, 16 nt, Human
ucauuugucacacacu

SEQ ID NO: 1181884 - RNA, 18 nt, Human
uccaaggguacuaaggaa

SEQ ID NO: 1181885 - RNA, 12 nt, Human
uccacccaccuc

SEQ ID NO: 1181886 - RNA, 13 nt, Human
uccacccaccuca

SEQ ID NO: 1181887 - RNA, 17 nt, Human
uccacccaccucagccu

SEQ ID NO: 1181888 - RNA, 20 nt, Human
uccacccaggagccccgagg

SEQ ID NO: 1181889 - RNA, 12 nt, Human
accuggccucug

SEQ ID NO: 1181890 - RNA, 13 nt, Human
accuggccucugc

SEQ ID NO: 1181891 - RNA, 21 nt, Human
accuggguaacuagggaagau

SEQ ID NO: 1181892 - RNA, 22 nt, Human
accuucuccuucaccuuugucc

SEQ ID NO: 1181893 - RNA, 14 nt, Human
accuuuguccccac

SEQ ID NO: 1181894 - RNA, 15 nt, Human
accuuuguccccacc

SEQ ID NO: 1181895 - RNA, 16 nt, Human
accuuuguccccaccg

SEQ ID NO: 1181896 - RNA, 17 nt, Human
accuuuguccccaccgc

SEQ ID NO: 1181897 - RNA, 16 nt, Human
accuuuuuuauacaua

SEQ ID NO: 1181898 - RNA, 17 nt, Human
accuuuuuuauacauaa

SEQ ID NO: 1181899 - RNA, 18 nt, Human
accuuuuuuauacauaaa

SEQ ID NO: 1181900 - RNA, 16 nt, Human
ucccaaagugcuggga

SEQ ID NO: 1181901 - RNA, 15 nt, Human
ucccaaagugcuggg

SEQ ID NO: 1181902 - RNA, 16 nt, Human
ucccacaaaggagagc

SEQ ID NO: 1181903 - RNA, 21 nt, Human
ucccaaagugcugggauuaca

SEQ ID NO: 1181904 - RNA, 14 nt, Human
ucccacaaaggaga

SEQ ID NO: 1181905 - RNA, 11 nt, Human
ucccaccccac

SEQ ID NO: 1181906 - RNA, 14 nt, Human
ucccaccccacaca

SEQ ID NO: 1181907 - RNA, 15 nt, Human
uccaugaguccccug

SEQ ID NO: 1181908 - RNA, 16 nt, Human
uccaugaguccccugu

SEQ ID NO: 1181909 - RNA, 17 nt, Human
uccaugaguccccuguu

SEQ ID NO: 1181910 - RNA, 11 nt, Human
uccauccugag

SEQ ID NO: 1181911 - RNA, 14 nt, Human
acggcucacugcag

SEQ ID NO: 1181912 - RNA, 15 nt, Human
acggcucacugcagc

SEQ ID NO: 1181913 - RNA, 14 nt, Human
uccagugagacagc

SEQ ID NO: 1181914 - RNA, 18 nt, Human
uccagugaggcucugccc

SEQ ID NO: 1181915 - RNA, 19 nt, Human
uccagugaggcucugcccu

SEQ ID NO: 1181916 - RNA, 20 nt, Human
uccagugaggcucugcccuu

SEQ ID NO: 1181917 - RNA, 15 nt, Human
acgacugcccggcag

SEQ ID NO: 1181918 - RNA, 18 nt, Human
acgccaggggaaaaucag

SEQ ID NO: 1181919 - RNA, 23 nt, Human
acgccaggggaaaaucagccugc

SEQ ID NO: 1181920 - RNA, 11 nt, Human
acgccauccca

SEQ ID NO: 1181921 - RNA, 14 nt, Human
acgccaucccagcc

SEQ ID NO: 1181922 - RNA, 15 nt, Human
acgccaucccagccc

SEQ ID NO: 1181923 - RNA, 16 nt, Human
acgccaucccagcccc

SEQ ID NO: 1181924 - RNA, 17 nt, Human
acgccaucccagcccca

SEQ ID NO: 1181925 - RNA, 18 nt, Human
acgccaucccagccccaa

SEQ ID NO: 1181926 - RNA, 14 nt, Human
uccaggcugggaga

SEQ ID NO: 1181927 - RNA, 17 nt, Human
uccaggcugggagagcc

SEQ ID NO: 1181928 - RNA, 18 nt, Human
uccaggcugggagagccu

SEQ ID NO: 1181929 - RNA, 14 nt, Human
acgaauauugcuga

SEQ ID NO: 1181930 - RNA, 14 nt, Human
acgcccccacuggu

SEQ ID NO: 1181931 - RNA, 23 nt, Human
acgcgugcacacaccagagccca

SEQ ID NO: 1181932 - RNA, 13 nt, Human
acgcuacccggga

SEQ ID NO: 1181933 - RNA, 17 nt, Human
acgcuacccgggaaggg

SEQ ID NO: 1181934 - RNA, 18 nt, Human
acgcuacccgggaagggg

SEQ ID NO: 1181935 - RNA, 15 nt, Human
acgcucucuggccuu

SEQ ID NO: 1181936 - RNA, 16 nt, Human
acgcucucuggccuuc

SEQ ID NO: 1181937 - RNA, 17 nt, Human
acgcucucuggccuucg

SEQ ID NO: 1181938 - RNA, 19 nt, Human
acggagucccaccuuggcu

SEQ ID NO: 1181939 - RNA, 21 nt, Human
acggagucccaccuuggcugc

SEQ ID NO: 1181940 - RNA, 16 nt, Human
acggccaggccagagg

SEQ ID NO: 1181941 - RNA, 21 nt, Human
acuauaauguaagcucuacug

SEQ ID NO: 1181942 - RNA, 12 nt, Human
acuauaauguaa

SEQ ID NO: 1181943 - RNA, 13 nt, Human
acuauaauguaag

SEQ ID NO: 1181944 - RNA, 14 nt, Human
acuauaauguaagc

SEQ ID NO: 1181945 - RNA, 14 nt, Human
acuauguugcccag

SEQ ID NO: 1181946 - RNA, 12 nt, Human
acuauguaucaa

SEQ ID NO: 1181947 - RNA, 14 nt, Human
acucaaugcacuga

SEQ ID NO: 1181948 - RNA, 19 nt, Human
acucacauuuauucugcuc

SEQ ID NO: 1181949 - RNA, 20 nt, Human
acucacauuuauucugcuca

SEQ ID NO: 1181950 - RNA, 21 nt, Human
acucacauuuauucugcucac

SEQ ID NO: 1181951 - RNA, 13 nt, Human
acguacacacaca

SEQ ID NO: 1181952 - RNA, 12 nt, Human
acguacacauuu

SEQ ID NO: 1181953 - RNA, 13 nt, Human
acguacacauuuu

SEQ ID NO: 1181954 - RNA, 14 nt, Human
acguacacauuuua

SEQ ID NO: 1181955 - RNA, 22 nt, Human
uccccacuugagaauuacccuu

SEQ ID NO: 1181956 - RNA, 11 nt, Human
ucccccagccc

SEQ ID NO: 1181957 - RNA, 18 nt, Human
acuacggaauaguuggcu

SEQ ID NO: 1181958 - RNA, 20 nt, Human
acuagaguuuagcuggaaaa

SEQ ID NO: 1181959 - RNA, 17 nt, Human
acucaccccagccccaa

SEQ ID NO: 1181960 - RNA, 23 nt, Human
ucccugaaggccccgcccaggcu

SEQ ID NO: 1181961 - RNA, 14 nt, Human
ucccucuuucccuc

SEQ ID NO: 1181962 - RNA, 18 nt, Human
ucccugaaggccccgccc

SEQ ID NO: 1181963 - RNA, 21 nt, Human
ucccugaaggccccgcccagg

SEQ ID NO: 1181964 - RNA, 22 nt, Human
ucccugaaggccccgcccaggc

SEQ ID NO: 1181965 - RNA, 18 nt, Human
ucccucagucuggcccuu

SEQ ID NO: 1181966 - RNA, 20 nt, Human
ucccucagucuggcccuucc

SEQ ID NO: 1181967 - RNA, 11 nt, Human
ucccucuuucc

SEQ ID NO: 1181968 - RNA, 13 nt, Human
ucccucuuucccu

SEQ ID NO: 1181969 - RNA, 14 nt, Human
acucaccugccccu

SEQ ID NO: 1181970 - RNA, 19 nt, Human
acucaccugccccucaacu

SEQ ID NO: 1181971 - RNA, 21 nt, Human
acucaccugccccucaacucu

SEQ ID NO: 1181972 - RNA, 14 nt, Human
acucagaagacacu

SEQ ID NO: 1181973 - RNA, 15 nt, Human
acucagaagacacug

SEQ ID NO: 1181974 - RNA, 16 nt, Human
acucagaagacacuga

SEQ ID NO: 1181975 - RNA, 17 nt, Human
acucagaagacacugau

SEQ ID NO: 1181976 - RNA, 18 nt, Human
acucagaagacacugaug

SEQ ID NO: 1181977 - RNA, 14 nt, Human
acucagaauucucu

SEQ ID NO: 1181978 - RNA, 21 nt, Human
acucagaauucucuaguuuga

SEQ ID NO: 1181979 - RNA, 22 nt, Human
acucagaauucucuaguuugau

SEQ ID NO: 1181980 - RNA, 12 nt, Human
acucaucuuagg

SEQ ID NO: 1181981 - RNA, 16 nt, Human
acucauugaccugagg

SEQ ID NO: 1181982 - RNA, 17 nt, Human
acucauugaccugaggc

SEQ ID NO: 1181983 - RNA, 18 nt, Human
acucauugaccugaggcc

SEQ ID NO: 1181984 - RNA, 22 nt, Human
acucauugaccugaggcccuuc

SEQ ID NO: 1181985 - RNA, 21 nt, Human
acuccaaacugacucuuaaga

SEQ ID NO: 1181986 - RNA, 15 nt, Human
acucgcgacaaugca

SEQ ID NO: 1181987 - RNA, 16 nt, Human
acucgcgacaaugcaa

SEQ ID NO: 1181988 - RNA, 17 nt, Human
acucgcgacaaugcaaa

SEQ ID NO: 1181989 - RNA, 11 nt, Human
acucugagacu

SEQ ID NO: 1181990 - RNA, 17 nt, Human
acucuggcagcucagag

SEQ ID NO: 1181991 - RNA, 19 nt, Human
acucuggcagcucagagag

SEQ ID NO: 1181992 - RNA, 20 nt, Human
acucuggcagcucagagagg

SEQ ID NO: 1181993 - RNA, 21 nt, Human
acucuuauugcccacgcugga

SEQ ID NO: 1181994 - RNA, 14 nt, Human
acuccagaaaguga

SEQ ID NO: 1181995 - RNA, 18 nt, Human
acuccagaaagugacaag

SEQ ID NO: 1181996 - RNA, 13 nt, Human
uccguuaaaauac

SEQ ID NO: 1181997 - RNA, 15 nt, Human
uccguuaaaauacca

SEQ ID NO: 1181998 - RNA, 12 nt, Human
uccuacucugug

SEQ ID NO: 1181999 - RNA, 21 nt, Human
uccuagccugugccucuggga

SEQ ID NO: 1182000 - RNA, 16 nt, Human
acucgaguuacagaca

SEQ ID NO: 1182001 - RNA, 17 nt, Human
uccucuccccaugaugu

SEQ ID NO: 1182002 - RNA, 14 nt, Human
uccucccaccucag

SEQ ID NO: 1182003 - RNA, 15 nt, Human
uccucccaccucagc

SEQ ID NO: 1182004 - RNA, 16 nt, Human
uccucccaccucagcc

SEQ ID NO: 1182005 - RNA, 18 nt, Human
uccucccaccucagccuc

SEQ ID NO: 1182006 - RNA, 20 nt, Human
uccucccaccucagccuccc

SEQ ID NO: 1182007 - RNA, 21 nt, Human
uccucccaccucagccucccg

SEQ ID NO: 1182008 - RNA, 12 nt, Human
uccucugcugcu

SEQ ID NO: 1182009 - RNA, 21 nt, Human
uccugaaaacccuugccaugu

SEQ ID NO: 1182010 - RNA, 22 nt, Human
uccugaaaacccuugccaugug

SEQ ID NO: 1182011 - RNA, 15 nt, Human
uccugaagaauugaa

SEQ ID NO: 1182012 - RNA, 20 nt, Human
acuguacaugaaaacacauu

SEQ ID NO: 1182013 - RNA, 21 nt, Human
acuguacaugaaaacacauuu

SEQ ID NO: 1182014 - RNA, 14 nt, Human
acuguaucaugaca

SEQ ID NO: 1182015 - RNA, 17 nt, Human
acuggguacuuguggac

SEQ ID NO: 1182016 - RNA, 18 nt, Human
acuggguacuuguggaca

SEQ ID NO: 1182017 - RNA, 16 nt, Human
acuguacaaaguagaa

SEQ ID NO: 1182018 - RNA, 22 nt, Human
acuguacaaaguagaagucuua

SEQ ID NO: 1182019 - RNA, 19 nt, Human
acuguacaugaaaacacau

SEQ ID NO: 1182020 - RNA, 16 nt, Human
acuguaucaugacaaa

SEQ ID NO: 1182021 - RNA, 20 nt, Human
acuguaucaugacaaagacu

SEQ ID NO: 1182022 - RNA, 22 nt, Human
acugaagaagcaccaaucauga

SEQ ID NO: 1182023 - RNA, 23 nt, Human
ucgcugugucagcauagaaguaa

SEQ ID NO: 1182024 - RNA, 21 nt, Human
acugggcuuggggaccagagc

SEQ ID NO: 1182025 - RNA, 22 nt, Human
acugggcuuggggaccagagcu

SEQ ID NO: 1182026 - RNA, 15 nt, Human
acuggguacuugugg

SEQ ID NO: 1182027 - RNA, 17 nt, Human
ucgggaggucgaggcag

SEQ ID NO: 1182028 - RNA, 23 nt, Human
ucgucacugcuuaacuucacaua

SEQ ID NO: 1182029 - RNA, 13 nt, Human
acuguggguagac

SEQ ID NO: 1182030 - RNA, 17 nt, Human
acuguuaauaguucagg

SEQ ID NO: 1182031 - RNA, 21 nt, Human
acuguuaauaguucagguaac

SEQ ID NO: 1182032 - RNA, 17 nt, Human
ucuaaagcugccagccg

SEQ ID NO: 1182033 - RNA, 13 nt, Human
ucuaaaggcuacc

SEQ ID NO: 1182034 - RNA, 16 nt, Human
ucuaaaggcuaccuuu

SEQ ID NO: 1182035 - RNA, 17 nt, Human
ucuaaaggcuaccuuug

SEQ ID NO: 1182036 - RNA, 17 nt, Human
ucuaccaaaaaucucaa

SEQ ID NO: 1182037 - RNA, 21 nt, Human
ucuacccucuuagaaaaacca

SEQ ID NO: 1182038 - RNA, 14 nt, Human
ucuacccuggcacu

SEQ ID NO: 1182039 - RNA, 20 nt, Human
acuuccagauccuggaaauc

SEQ ID NO: 1182040 - RNA, 18 nt, Human
acuuccaauuuacauacu

SEQ ID NO: 1182041 - RNA, 17 nt, Human
acuuccacugccauccu

SEQ ID NO: 1182042 - RNA, 16 nt, Human
acuuacuguacaugaa

SEQ ID NO: 1182043 - RNA, 12 nt, Human
ucuaccugaggg

SEQ ID NO: 1182044 - RNA, 19 nt, Human
ucuaccugaggggccucuu

SEQ ID NO: 1182045 - RNA, 13 nt, Human
acuuacuguacau

SEQ ID NO: 1182046 - RNA, 14 nt, Human
acuuacuguacaug

SEQ ID NO: 1182047 - RNA, 15 nt, Human
acuuacuguacauga

SEQ ID NO: 1182048 - RNA, 20 nt, Human
acuuagagguggggagcaga

SEQ ID NO: 1182049 - RNA, 13 nt, Human
ucuauaauuuaaa

SEQ ID NO: 1182050 - RNA, 23 nt, Human
ucuaguuugauuaaauucuugca

SEQ ID NO: 1182051 - RNA, 16 nt, Human
ucuaggaaauauuuau

SEQ ID NO: 1182052 - RNA, 24 nt, Human
ucuagauacuguaucaugacaaag

SEQ ID NO: 1182053 - RNA, 16 nt, Human
ucuauuguuucuuuca

SEQ ID NO: 1182054 - RNA, 16 nt, Human
ucucaaaaaaagaaaa

SEQ ID NO: 1182055 - RNA, 17 nt, Human
acuucgggaggucgagg

SEQ ID NO: 1182056 - RNA, 20 nt, Human
acuucgggaggucgaggcag

SEQ ID NO: 1182057 - RNA, 22 nt, Human
acuucgggaggucgaggcagga

SEQ ID NO: 1182058 - RNA, 14 nt, Human
acuugucuuuggac

SEQ ID NO: 1182059 - RNA, 14 nt, Human
acuuggaagcuccg

SEQ ID NO: 1182060 - RNA, 23 nt, Human
acuugaacccgggaggcagaggu

SEQ ID NO: 1182061 - RNA, 19 nt, Human
acuugagaauuacccuuuu

SEQ ID NO: 1182062 - RNA, 15 nt, Human
acuuguggacacagc

SEQ ID NO: 1182063 - RNA, 16 nt, Human
acuuuaaaaggagcca

SEQ ID NO: 1182064 - RNA, 18 nt, Human
acuugucuuuggacccug

SEQ ID NO: 1182065 - RNA, 14 nt, Human
acuuguggacacag

SEQ ID NO: 1182066 - RNA, 12 nt, Human
acuuuggaaaga

SEQ ID NO: 1182067 - RNA, 13 nt, Human
acuuuggaaagag

SEQ ID NO: 1182068 - RNA, 14 nt, Human
acuuuggaaagagu

SEQ ID NO: 1182069 - RNA, 23 nt, Human
acuuuggaaagaguaggaagacu

SEQ ID NO: 1182070 - RNA, 12 nt, Human
ucucucaggcca

SEQ ID NO: 1182071 - RNA, 21 nt, Human
ucucucaggccaaacucaccu

SEQ ID NO: 1182072 - RNA, 16 nt, Human
acuuuguguucaccuu

SEQ ID NO: 1182073 - RNA, 18 nt, Human
acuuuguguucaccuugu

SEQ ID NO: 1182074 - RNA, 20 nt, Human
ucuccuuaaagaguguggca

SEQ ID NO: 1182075 - RNA, 21 nt, Human
ucuccuuggugucgggcauga

SEQ ID NO: 1182076 - RNA, 23 nt, Human
ucuccuuggugucgggcaugaca

SEQ ID NO: 1182077 - RNA, 18 nt, Human
ucugaaggcuggguucug

SEQ ID NO: 1182078 - RNA, 20 nt, Human
agaaagacuaucuaaauguu

SEQ ID NO: 1182079 - RNA, 22 nt, Human
agaaagacuaucuaaauguuga

SEQ ID NO: 1182080 - RNA, 10 nt, Human
agaaagagag

SEQ ID NO: 1182081 - RNA, 11 nt, Human
agaaagagaga

SEQ ID NO: 1182082 - RNA, 12 nt, Human
agaaagagagaa

SEQ ID NO: 1182083 - RNA, 13 nt, Human
agaaagagagaaa

SEQ ID NO: 1182084 - RNA, 14 nt, Human
agaaagagagaaaa

SEQ ID NO: 1182085 - RNA, 15 nt, Human
agaaagagagaaaau

SEQ ID NO: 1182086 - RNA, 16 nt, Human
agaaagagagaaaaua

SEQ ID NO: 1182087 - RNA, 17 nt, Human
agaaagagagaaaauaa

SEQ ID NO: 1182088 - RNA, 18 nt, Human
agaaagagagaaaauaaa

SEQ ID NO: 1182089 - RNA, 22 nt, Human
agaaagagagaaaauaaaaagu

SEQ ID NO: 1182090 - RNA, 17 nt, Human
agaaagcagaacaguga

SEQ ID NO: 1182091 - RNA, 18 nt, Human
agaaagcagaacagugau

SEQ ID NO: 1182092 - RNA, 20 nt, Human
agaaagcagaacagugauua

SEQ ID NO: 1182093 - RNA, 18 nt, Human
agaaaaaugagccuggca

SEQ ID NO: 1182094 - RNA, 17 nt, Human
agaaaaaauauuuuccu

SEQ ID NO: 1182095 - RNA, 23 nt, Human
agaaaaaauauuuuccugccagg

SEQ ID NO: 1182096 - RNA, 17 nt, Human
ucucuugguccugcugc

SEQ ID NO: 1182097 - RNA, 18 nt, Human
ucucuugguccugcugca

SEQ ID NO: 1182098 - RNA, 16 nt, Human
agaaaacaaggaugaa

SEQ ID NO: 1182099 - RNA, 16 nt, Human
agaaacacaacuauau

SEQ ID NO: 1182100 - RNA, 15 nt, Human
agaaacauuugguaa

SEQ ID NO: 1182101 - RNA, 19 nt, Human
agaagcaccaaucaugaau

SEQ ID NO: 1182102 - RNA, 16 nt, Human
agaagcagaggaagga

SEQ ID NO: 1182103 - RNA, 20 nt, Human
ucugcccauccugccccuga

SEQ ID NO: 1182104 - RNA, 12 nt, Human
ucugcccuuggu

SEQ ID NO: 1182105 - RNA, 23 nt, Human
ucugcccuugguuaggcauugug

SEQ ID NO: 1182106 - RNA, 19 nt, Human
agaaccuuuugagugccuu

SEQ ID NO: 1182107 - RNA, 23 nt, Human
agaaccuuuugagugccuuacac

SEQ ID NO: 1182108 - RNA, 16 nt, Human
agaacucccuuucaac

SEQ ID NO: 1182109 - RNA, 17 nt, Human
agaacucccuuucaaca

SEQ ID NO: 1182110 - RNA, 22 nt, Human
ucugcuuugggguuuaucagaa

SEQ ID NO: 1182111 - RNA, 23 nt, Human
ucugcuuuuuaaagaaugcucuu

SEQ ID NO: 1182112 - RNA, 19 nt, Human
ucuggaauaaggagaauga

SEQ ID NO: 1182113 - RNA, 20 nt, Human
ucuggcagaguugaagacag

SEQ ID NO: 1182114 - RNA, 23 nt, Human
ucuggcagaguugaagacagagc

SEQ ID NO: 1182115 - RNA, 17 nt, Human
ucuggcagcucagagag

SEQ ID NO: 1182116 - RNA, 18 nt, Human
ucuggcagcucagagagg

SEQ ID NO: 1182117 - RNA, 21 nt, Human
ucuggcagcucagagagggug

SEQ ID NO: 1182118 - RNA, 10 nt, Human
ucuggccuuc

SEQ ID NO: 1182119 - RNA, 13 nt, Human
agaaguugauaug

SEQ ID NO: 1182120 - RNA, 22 nt, Human
agaaguuugagaucagccuggg

SEQ ID NO: 1182121 - RNA, 14 nt, Human
agaaucacuugaac

SEQ ID NO: 1182122 - RNA, 17 nt, Human
ucuucagagacuccugc

SEQ ID NO: 1182123 - RNA, 18 nt, Human
ucuucagagacuccugca

SEQ ID NO: 1182124 - RNA, 21 nt, Human
ucuuccaggcugggagagccu

SEQ ID NO: 1182125 - RNA, 20 nt, Human
ucuucagagacuccugcagg

SEQ ID NO: 1182126 - RNA, 15 nt, Human
ucuuccaggcuggga

SEQ ID NO: 1182127 - RNA, 17 nt, Human
ucuuccaggcugggaga

SEQ ID NO: 1182128 - RNA, 20 nt, Human
ucuuccaggcugggagagcc

SEQ ID NO: 1182129 - RNA, 15 nt, Human
ucuuccucccucccu

SEQ ID NO: 1182130 - RNA, 19 nt, Human
ucuucccuacaguugaaaa

SEQ ID NO: 1182131 - RNA, 22 nt, Human
ucuucccuacaguugaaaaaca

SEQ ID NO: 1182132 - RNA, 14 nt, Human
ucuuccucccuccc

SEQ ID NO: 1182133 - RNA, 15 nt, Human
ucuucuguacgucug

SEQ ID NO: 1182134 - RNA, 20 nt, Human
ucuucuguacgucugacagg

SEQ ID NO: 1182135 - RNA, 20 nt, Human
ucuucuguggguuucuaaag

SEQ ID NO: 1182136 - RNA, 21 nt, Human
ucuucugaacuuggcgcugcc

SEQ ID NO: 1182137 - RNA, 12 nt, Human
ucuucugcuuca

SEQ ID NO: 1182138 - RNA, 19 nt, Human
ucuucugcuucagccuccc

SEQ ID NO: 1182139 - RNA, 19 nt, Human
agacauacuaaccagcaga

SEQ ID NO: 1182140 - RNA, 23 nt, Human
agacauacuaaccagcagaaaug

SEQ ID NO: 1182141 - RNA, 21 nt, Human
agacauagaauuaacacauga

SEQ ID NO: 1182142 - RNA, 17 nt, Human
agacaucaacagauaaa

SEQ ID NO: 1182143 - RNA, 18 nt, Human
agacaucaacagauaaau

SEQ ID NO: 1182144 - RNA, 11 nt, Human
agaccuucucc

SEQ ID NO: 1182145 - RNA, 15 nt, Human
agaccuucuccuuca

SEQ ID NO: 1182146 - RNA, 18 nt, Human
agaccuucuccuucaccu

SEQ ID NO: 1182147 - RNA, 21 nt, Human
agaccuucuccuucaccuuug

SEQ ID NO: 1182148 - RNA, 23 nt, Human
agaccuucuccuucaccuuuguc

SEQ ID NO: 1182149 - RNA, 13 nt, Human
ucuugagccuggg

SEQ ID NO: 1182150 - RNA, 16 nt, Human
ucuugagccugggagg

SEQ ID NO: 1182151 - RNA, 16 nt, Human
ucuugagccuugaacu

SEQ ID NO: 1182152 - RNA, 13 nt, Human
ucuugauucauaa

SEQ ID NO: 1182153 - RNA, 17 nt, Human
ucuuuccugaggcuggg

SEQ ID NO: 1182154 - RNA, 15 nt, Human
ucuugguccugcugc

SEQ ID NO: 1182155 - RNA, 17 nt, Human
ucuugguccugcugcag

SEQ ID NO: 1182156 - RNA, 19 nt, Human
ucuugguccugcugcaguu

SEQ ID NO: 1182157 - RNA, 16 nt, Human
ucuuuaaaugcugcuu

SEQ ID NO: 1182158 - RNA, 19 nt, Human
ucuugcaauggcagccuug

SEQ ID NO: 1182159 - RNA, 22 nt, Human
ucuugcaauggcagccuuggca

SEQ ID NO: 1182160 - RNA, 23 nt, Human
ucuugcaauggcagccuuggcaa

SEQ ID NO: 1182161 - RNA, 17 nt, Human
ucuuggucagauuugaa

SEQ ID NO: 1182162 - RNA, 14 nt, Human
ucuugguccugcug

SEQ ID NO: 1182163 - RNA, 11 nt, Human
agagacuccug

SEQ ID NO: 1182164 - RNA, 17 nt, Human
agagacuccugcaggca

SEQ ID NO: 1182165 - RNA, 18 nt, Human
agagacuccugcaggcag

SEQ ID NO: 1182166 - RNA, 19 nt, Human
agagacuccugcaggcagc

SEQ ID NO: 1182167 - RNA, 20 nt, Human
agagacuccugcaggcagcc

SEQ ID NO: 1182168 - RNA, 21 nt, Human
agagacuccugcaggcagcca

SEQ ID NO: 1182169 - RNA, 22 nt, Human
agagacuccugcaggcagccag

SEQ ID NO: 1182170 - RNA, 13 nt, Human
ugaaagacuguac

SEQ ID NO: 1182171 - RNA, 15 nt, Human
ugaaagacuguacaa

SEQ ID NO: 1182172 - RNA, 23 nt, Human
agagacuccugcaggcagccagg

SEQ ID NO: 1182173 - RNA, 13 nt, Human
agagagaaaauaa

SEQ ID NO: 1182174 - RNA, 15 nt, Human
agagagaaaauaaaa

SEQ ID NO: 1182175 - RNA, 16 nt, Human
agagagaaaauaaaaa

SEQ ID NO: 1182176 - RNA, 17 nt, Human
agagagaaaauaaaaag

SEQ ID NO: 1182177 - RNA, 18 nt, Human
agagagaaaauaaaaagu

SEQ ID NO: 1182178 - RNA, 20 nt, Human
agagagaaaauaaaaaguua

SEQ ID NO: 1182179 - RNA, 22 nt, Human
agagagaaaauaaaaaguuaaa

SEQ ID NO: 1182180 - RNA, 22 nt, Human
agagaucaaccccuucgcuccu

SEQ ID NO: 1182181 - RNA, 19 nt, Human
agagcaagacgcugugcug

SEQ ID NO: 1182182 - RNA, 23 nt, Human
agagcaagacgcugugcugcccu

SEQ ID NO: 1182183 - RNA, 22 nt, Human
agagcaccuuagacagucccug

SEQ ID NO: 1182184 - RNA, 23 nt, Human
agagcaccuuagacagucccugc

SEQ ID NO: 1182185 - RNA, 13 nt, Human
agagccuuccagg

SEQ ID NO: 1182186 - RNA, 15 nt, Human
agagccuuccagggg

SEQ ID NO: 1182187 - RNA, 17 nt, Human
agagccuuccaggggug

SEQ ID NO: 1182188 - RNA, 22 nt, Human
agagccuuccaggggugggaca

SEQ ID NO: 1182189 - RNA, 13 nt, Human
agagccagggucu

SEQ ID NO: 1182190 - RNA, 20 nt, Human
agagcuagcagcagggaggg

SEQ ID NO: 1182191 - RNA, 14 nt, Human
agagcugccaccug

SEQ ID NO: 1182192 - RNA, 19 nt, Human
ugaaacucguuaauuugua

SEQ ID NO: 1182193 - RNA, 20 nt, Human
ugaaaaucuuauaauuuaaa

SEQ ID NO: 1182194 - RNA, 19 nt, Human
ugaaaaucgugacaacacu

SEQ ID NO: 1182195 - RNA, 17 nt, Human
ugaaaauguauguguaa

SEQ ID NO: 1182196 - RNA, 20 nt, Human
ugaaaaaggaggaagagaaa

SEQ ID NO: 1182197 - RNA, 22 nt, Human
ugaaaaaggaggaagagaaaaa

SEQ ID NO: 1182198 - RNA, 22 nt, Human
ugaaaaaguucugcagauaaac

SEQ ID NO: 1182199 - RNA, 20 nt, Human
ucuuucuggcuaugcauuug

SEQ ID NO: 1182200 - RNA, 21 nt, Human
ucuuucuggcuaugcauuuga

SEQ ID NO: 1182201 - RNA, 22 nt, Human
ucuuuggucuacacugugcuga

SEQ ID NO: 1182202 - RNA, 16 nt, Human
ugaaaaaggaggaaga

SEQ ID NO: 1182203 - RNA, 16 nt, Human
agagguggggagcaga

SEQ ID NO: 1182204 - RNA, 15 nt, Human
agagguuaagguggg

SEQ ID NO: 1182205 - RNA, 13 nt, Human
agagguucaaaga

SEQ ID NO: 1182206 - RNA, 16 nt, Human
agagggagggagggcu

SEQ ID NO: 1182207 - RNA, 20 nt, Human
agagggagggagggcuccag

SEQ ID NO: 1182208 - RNA, 15 nt, Human
ugaauacuuuauaaa

SEQ ID NO: 1182209 - RNA, 23 nt, Human
ugaauuucuuuugccguuauuaa

SEQ ID NO: 1182210 - RNA, 14 nt, Human
agaucaaccccuuc

SEQ ID NO: 1182211 - RNA, 19 nt, Human
ugacaaagacugaguacgu

SEQ ID NO: 1182212 - RNA, 18 nt, Human
ugacacacagcucugucc

SEQ ID NO: 1182213 - RNA, 19 nt, Human
ugacacacagcucuguccu

SEQ ID NO: 1182214 - RNA, 20 nt, Human
ugacacacagcucuguccug

SEQ ID NO: 1182215 - RNA, 12 nt, Human
ugacacaugcaa

SEQ ID NO: 1182216 - RNA, 20 nt, Human
ugacacaugcaaggucauuu

SEQ ID NO: 1182217 - RNA, 15 nt, Human
agagucacuggaaca

SEQ ID NO: 1182218 - RNA, 22 nt, Human
agagucagaaguuucugccgca

SEQ ID NO: 1182219 - RNA, 17 nt, Human
agaguuguuacauuuuu

SEQ ID NO: 1182220 - RNA, 19 nt, Human
agaguuguuacauuuuuaa

SEQ ID NO: 1182221 - RNA, 20 nt, Human
agaguuguuacauuuuuaag

SEQ ID NO: 1182222 - RNA, 21 nt, Human
agaguuguuacauuuuuaagu

SEQ ID NO: 1182223 - RNA, 17 nt, Human
agauaaggguaucuggu

SEQ ID NO: 1182224 - RNA, 18 nt, Human
agauaauauuaaggaaga

SEQ ID NO: 1182225 - RNA, 22 nt, Human
agauaauauuaaggaagacaau

SEQ ID NO: 1182226 - RNA, 20 nt, Human
agauacaggaaaagcugcug

SEQ ID NO: 1182227 - RNA, 13 nt, Human
agauacaguuacu

SEQ ID NO: 1182228 - RNA, 22 nt, Human
agauacaguuacucagaauucu

SEQ ID NO: 1182229 - RNA, 11 nt, Human
agauacuguau

SEQ ID NO: 1182230 - RNA, 15 nt, Human
agauacuguaucaug

SEQ ID NO: 1182231 - RNA, 16 nt, Human
agauacuguaucauga

SEQ ID NO: 1182232 - RNA, 20 nt, Human
agauauuuugcuuugugauu

SEQ ID NO: 1182233 - RNA, 21 nt, Human
agauauuuugcuuugugauuu

SEQ ID NO: 1182234 - RNA, 18 nt, Human
agaucaaaagguuaauaa

SEQ ID NO: 1182235 - RNA, 22 nt, Human
agauauuuugcuuugugauuuu

SEQ ID NO: 1182236 - RNA, 16 nt, Human
agaugccgcauuugga

SEQ ID NO: 1182237 - RNA, 17 nt, Human
ugacacuuaaaaauggu

SEQ ID NO: 1182238 - RNA, 16 nt, Human
agaugcaguucugaag

SEQ ID NO: 1182239 - RNA, 17 nt, Human
agaugcaguucugaaga

SEQ ID NO: 1182240 - RNA, 14 nt, Human
ugacccaugcugcc

SEQ ID NO: 1182241 - RNA, 15 nt, Human
ugacccaugcugccc

SEQ ID NO: 1182242 - RNA, 16 nt, Human
ugacccaugcugcccu

SEQ ID NO: 1182243 - RNA, 17 nt, Human
ugacccaugcugcccug

SEQ ID NO: 1182244 - RNA, 21 nt, Human
ugacccaugcugcccugugag

SEQ ID NO: 1182245 - RNA, 13 nt, Human
ugacuuacuguac

SEQ ID NO: 1182246 - RNA, 15 nt, Human
ugacuuacuguacau

SEQ ID NO: 1182247 - RNA, 16 nt, Human
ugacuuacuguacaug

SEQ ID NO: 1182248 - RNA, 18 nt, Human
ugaccugaggcccuucuc

SEQ ID NO: 1182249 - RNA, 19 nt, Human
ugaccugaggcccuucucu

SEQ ID NO: 1182250 - RNA, 22 nt, Human
agauucauauuuacuucuuaua

SEQ ID NO: 1182251 - RNA, 19 nt, Human
ugacuuacuguacaugaaa

SEQ ID NO: 1182252 - RNA, 13 nt, Human
agauuggaaggaa

SEQ ID NO: 1182253 - RNA, 17 nt, Human
agauuugaacucuucaa

SEQ ID NO: 1182254 - RNA, 21 nt, Human
agauuuugaaauuuuuauuaa

SEQ ID NO: 1182255 - RNA, 13 nt, Human
agcaagacgcugu

SEQ ID NO: 1182256 - RNA, 16 nt, Human
agcaagacgcugugcu

SEQ ID NO: 1182257 - RNA, 17 nt, Human
agcaagacgcugugcug

SEQ ID NO: 1182258 - RNA, 20 nt, Human
agcaagacgcugugcugccc

SEQ ID NO: 1182259 - RNA, 21 nt, Human
agcaagacgcugugcugcccu

SEQ ID NO: 1182260 - RNA, 22 nt, Human
agcaagacgcugugcugcccug

SEQ ID NO: 1182261 - RNA, 23 nt, Human
agcaagacgcugugcugcccugc

SEQ ID NO: 1182262 - RNA, 20 nt, Human
ugagaagcagaggaaggaga

SEQ ID NO: 1182263 - RNA, 17 nt, Human
ugaguacuacaguccuc

SEQ ID NO: 1182264 - RNA, 21 nt, Human
ugaguacuacaguccucccau

SEQ ID NO: 1182265 - RNA, 22 nt, Human
ugaguacuacaguccucccauc

SEQ ID NO: 1182266 - RNA, 23 nt, Human
ugaguacuacaguccucccaucu

SEQ ID NO: 1182267 - RNA, 22 nt, Human
ugaguaacugauuuguaacaag

SEQ ID NO: 1182268 - RNA, 15 nt, Human
ugaguacuacagucc

SEQ ID NO: 1182269 - RNA, 14 nt, Human
agcauauucaggaa

SEQ ID NO: 1182270 - RNA, 16 nt, Human
agcauauucaggaagc

SEQ ID NO: 1182271 - RNA, 23 nt, Human
agcauaaauguugacaugggaca

SEQ ID NO: 1182272 - RNA, 15 nt, Human
agcauacguacacau

SEQ ID NO: 1182273 - RNA, 16 nt, Human
agcauacguacacauu

SEQ ID NO: 1182274 - RNA, 17 nt, Human
agcauacguacacauuu

SEQ ID NO: 1182275 - RNA, 18 nt, Human
agcauacguacacauuuu

SEQ ID NO: 1182276 - RNA, 19 nt, Human
agcauacguacacauuuua

SEQ ID NO: 1182277 - RNA, 20 nt, Human
agcauacguacacauuuuau

SEQ ID NO: 1182278 - RNA, 21 nt, Human
agcauacguacacauuuuauu

SEQ ID NO: 1182279 - RNA, 14 nt, Human
ugagucaccaagcc

SEQ ID NO: 1182280 - RNA, 16 nt, Human
ugagucaccaagccca

SEQ ID NO: 1182281 - RNA, 17 nt, Human
ugagucaccaagcccag

SEQ ID NO: 1182282 - RNA, 17 nt, Human
ugagugccuuacacaau

SEQ ID NO: 1182283 - RNA, 20 nt, Human
ugagugccuuacacaauggu

SEQ ID NO: 1182284 - RNA, 18 nt, Human
ugagucaccaagcccagu

SEQ ID NO: 1182285 - RNA, 21 nt, Human
ugagugggugaauaauacagu

SEQ ID NO: 1182286 - RNA, 17 nt, Human
ugaguucauacccuguu

SEQ ID NO: 1182287 - RNA, 18 nt, Human
ugaguucauacccuguua

SEQ ID NO: 1182288 - RNA, 20 nt, Human
ugauacaaugcugugcccua

SEQ ID NO: 1182289 - RNA, 21 nt, Human
ugauacaaugcugugcccuaa

SEQ ID NO: 1182290 - RNA, 14 nt, Human
ugauacuacaguuu

SEQ ID NO: 1182291 - RNA, 17 nt, Human
ugauacuacaguuuguu

SEQ ID NO: 1182292 - RNA, 12 nt, Human
ugauaugggucu

SEQ ID NO: 1182293 - RNA, 20 nt, Human
agcaucacaugaacuuguaa

SEQ ID NO: 1182294 - RNA, 13 nt, Human
agcaucaggccag

SEQ ID NO: 1182295 - RNA, 20 nt, Human
ugaucacggcucacugcagc

SEQ ID NO: 1182296 - RNA, 21 nt, Human
ugaucacggcucacugcagcc

SEQ ID NO: 1182297 - RNA, 19 nt, Human
ugaucacggcucacugcag

SEQ ID NO: 1182298 - RNA, 20 nt, Human
agcaugucgucaaagcugaa

SEQ ID NO: 1182299 - RNA, 17 nt, Human
agcaugucgucaaagcu

SEQ ID NO: 1182300 - RNA, 12 nt, Human
agcauggcugcc

SEQ ID NO: 1182301 - RNA, 21 nt, Human
agcaucaggccaggcccucug

SEQ ID NO: 1182302 - RNA, 13 nt, Human
agcauggcugcca

SEQ ID NO: 1182303 - RNA, 14 nt, Human
agcaucaggccagg

SEQ ID NO: 1182304 - RNA, 16 nt, Human
agcaucaggccaggcc

SEQ ID NO: 1182305 - RNA, 17 nt, Human
agcaucaggccaggccc

SEQ ID NO: 1182306 - RNA, 18 nt, Human
agcaucaggccaggcccu

SEQ ID NO: 1182307 - RNA, 19 nt, Human
agcaucaggccaggcccuc

SEQ ID NO: 1182308 - RNA, 20 nt, Human
agcaucaggccaggcccucu

SEQ ID NO: 1182309 - RNA, 14 nt, Human
agccacggccaggc

SEQ ID NO: 1182310 - RNA, 14 nt, Human
agccacauuccuga

SEQ ID NO: 1182311 - RNA, 18 nt, Human
agccacauuccugaugcu

SEQ ID NO: 1182312 - RNA, 19 nt, Human
agccaccaacauacuccca

SEQ ID NO: 1182313 - RNA, 20 nt, Human
agccaccaacauacucccau

SEQ ID NO: 1182314 - RNA, 23 nt, Human
agccaccaacauacucccaucug

SEQ ID NO: 1182315 - RNA, 15 nt, Human
agccacggccaggcc

SEQ ID NO: 1182316 - RNA, 16 nt, Human
agccacggccaggcca

SEQ ID NO: 1182317 - RNA, 17 nt, Human
ugaugaagaaguugaua

SEQ ID NO: 1182318 - RNA, 13 nt, Human
agccacugcaccg

SEQ ID NO: 1182319 - RNA, 16 nt, Human
agccacugcaccgggc

SEQ ID NO: 1182320 - RNA, 21 nt, Human
agccacugcaccgggccacag

SEQ ID NO: 1182321 - RNA, 22 nt, Human
agccacugcaccgggccacaga

SEQ ID NO: 1182322 - RNA, 12 nt, Human
ugauuaaaccaa

SEQ ID NO: 1182323 - RNA, 14 nt, Human
ugauuaccagggac

SEQ ID NO: 1182324 - RNA, 16 nt, Human
ugauuaccagggacug

SEQ ID NO: 1182325 - RNA, 15 nt, Human
ugauggugguauguu

SEQ ID NO: 1182326 - RNA, 17 nt, Human
ugauguuuuaaggaugc

SEQ ID NO: 1182327 - RNA, 18 nt, Human
ugauguuuuaaggaugcu

SEQ ID NO: 1182328 - RNA, 14 nt, Human
ugaugauccuaggc

SEQ ID NO: 1182329 - RNA, 20 nt, Human
ugaugauccuaggcauuugc

SEQ ID NO: 1182330 - RNA, 16 nt, Human
ugauggugcaaugacc

SEQ ID NO: 1182331 - RNA, 17 nt, Human
ugauggugcaaugaccu

SEQ ID NO: 1182332 - RNA, 23 nt, Human
ugauggugcaaugaccuuucaau

SEQ ID NO: 1182333 - RNA, 23 nt, Human
agccaguaaaugggggugcauuu

SEQ ID NO: 1182334 - RNA, 21 nt, Human
agccaggccacaagacccuug

SEQ ID NO: 1182335 - RNA, 22 nt, Human
agccaggccacaagacccuugu

SEQ ID NO: 1182336 - RNA, 12 nt, Human
agccagggucuc

SEQ ID NO: 1182337 - RNA, 12 nt, Human
agccaggccaca

SEQ ID NO: 1182338 - RNA, 14 nt, Human
agccaggccacaag

SEQ ID NO: 1182339 - RNA, 19 nt, Human
agcccaggaaaggcuccag

SEQ ID NO: 1182340 - RNA, 20 nt, Human
agcccaggaaaggcuccagg

SEQ ID NO: 1182341 - RNA, 21 nt, Human
agcccaggaaaggcuccagga

SEQ ID NO: 1182342 - RNA, 22 nt, Human
agcccaggaaaggcuccaggag

SEQ ID NO: 1182343 - RNA, 23 nt, Human
agcccaggaaaggcuccaggagc

SEQ ID NO: 1182344 - RNA, 24 nt, Human
agcccaggaaaggcuccaggagca

SEQ ID NO: 1182345 - RNA, 14 nt, Human
ugauucagcucugc

SEQ ID NO: 1182346 - RNA, 15 nt, Human
ugauucauaaugacu

SEQ ID NO: 1182347 - RNA, 15 nt, Human
ugauucccaagcucu

SEQ ID NO: 1182348 - RNA, 16 nt, Human
ugauucccaagcucug

SEQ ID NO: 1182349 - RNA, 18 nt, Human
ugauucccaagcucugcu

SEQ ID NO: 1182350 - RNA, 19 nt, Human
ugauucccaagcucugcuc

SEQ ID NO: 1182351 - RNA, 21 nt, Human
ugauucccaagcucugcuccu

SEQ ID NO: 1182352 - RNA, 20 nt, Human
agccccuucugacccaugcu

SEQ ID NO: 1182353 - RNA, 24 nt, Human
agccccuucugacccaugcugccc

SEQ ID NO: 1182354 - RNA, 18 nt, Human
ugcacaagcugcacccuc

SEQ ID NO: 1182355 - RNA, 21 nt, Human
ugcacaagcugcacccucagg

SEQ ID NO: 1182356 - RNA, 22 nt, Human
agcccugguggcagugggagcu

SEQ ID NO: 1182357 - RNA, 23 nt, Human
agcccugguggcagugggagcug

SEQ ID NO: 1182358 - RNA, 15 nt, Human
ugcacaagcugcacc

SEQ ID NO: 1182359 - RNA, 10 nt, Human
ugcacacauu

SEQ ID NO: 1182360 - RNA, 11 nt, Human
ugcacacauuu

SEQ ID NO: 1182361 - RNA, 16 nt, Human
ugcacccucaggcagg

SEQ ID NO: 1182362 - RNA, 17 nt, Human
ugcacccucaggcaggu

SEQ ID NO: 1182363 - RNA, 14 nt, Human
ugcacgugugugca

SEQ ID NO: 1182364 - RNA, 15 nt, Human
ugcacgugugugcac

SEQ ID NO: 1182365 - RNA, 17 nt, Human
agccccuggaugcagcc

SEQ ID NO: 1182366 - RNA, 18 nt, Human
agccccuggaugcagccu

SEQ ID NO: 1182367 - RNA, 19 nt, Human
agccccuggaugcagccuc

SEQ ID NO: 1182368 - RNA, 22 nt, Human
agccccuggaugcagccucaca

SEQ ID NO: 1182369 - RNA, 24 nt, Human
agccccaaaacucuccucugcugc

SEQ ID NO: 1182370 - RNA, 17 nt, Human
agccccgaggccuucuc

SEQ ID NO: 1182371 - RNA, 22 nt, Human
agccccgaggccuucucugaag

SEQ ID NO: 1182372 - RNA, 15 nt, Human
ugauucuccugccuc

SEQ ID NO: 1182373 - RNA, 19 nt, Human
ugauucuccugccucagcc

SEQ ID NO: 1182374 - RNA, 20 nt, Human
ugauucuccugccucagccu

SEQ ID NO: 1182375 - RNA, 18 nt, Human
agcccauggcacucuaug

SEQ ID NO: 1182376 - RNA, 21 nt, Human
agccccaaaacucuccucugc

SEQ ID NO: 1182377 - RNA, 22 nt, Human
agccccaaaacucuccucugcu

SEQ ID NO: 1182378 - RNA, 20 nt, Human
agccgagauagccaaggcca

SEQ ID NO: 1182379 - RNA, 17 nt, Human
agcccuucuuuccacag

SEQ ID NO: 1182380 - RNA, 23 nt, Human
ugcacuauagccuaggugacaga

SEQ ID NO: 1182381 - RNA, 23 nt, Human
agcccuucuaccuuccugcaaca

SEQ ID NO: 1182382 - RNA, 20 nt, Human
agccucauguccacugguuc

SEQ ID NO: 1182383 - RNA, 16 nt, Human
agccucccaaagugcu

SEQ ID NO: 1182384 - RNA, 22 nt, Human
agccucagcauccuggcacccg

SEQ ID NO: 1182385 - RNA, 23 nt, Human
agccucagcauccuggcacccgg

SEQ ID NO: 1182386 - RNA, 15 nt, Human
agccucauguccacu

SEQ ID NO: 1182387 - RNA, 17 nt, Human
agccucagcauccuggc

SEQ ID NO: 1182388 - RNA, 19 nt, Human
agccucagcauccuggcac

SEQ ID NO: 1182389 - RNA, 20 nt, Human
agccucagcauccuggcacc

SEQ ID NO: 1182390 - RNA, 21 nt, Human
agccucagcauccuggcaccc

SEQ ID NO: 1182391 - RNA, 14 nt, Human
ugcauaaguuaacu

SEQ ID NO: 1182392 - RNA, 17 nt, Human
ugcauaaguuaacuucc

SEQ ID NO: 1182393 - RNA, 22 nt, Human
agccugaaagaggaaugaagua

SEQ ID NO: 1182394 - RNA, 17 nt, Human
agccucccaaagugcug

SEQ ID NO: 1182395 - RNA, 13 nt, Human
ugcagccucacag

SEQ ID NO: 1182396 - RNA, 15 nt, Human
ugcagccucacaguc

SEQ ID NO: 1182397 - RNA, 16 nt, Human
ugcagccucacagucc

SEQ ID NO: 1182398 - RNA, 17 nt, Human
ugcagccucacaguccu

SEQ ID NO: 1182399 - RNA, 21 nt, Human
ugcauuaucuagauacuguau

SEQ ID NO: 1182400 - RNA, 22 nt, Human
ugcauuaucuagauacuguauc

SEQ ID NO: 1182401 - RNA, 11 nt, Human
agccuuccagg

SEQ ID NO: 1182402 - RNA, 14 nt, Human
agccuuccaggggu

SEQ ID NO: 1182403 - RNA, 16 nt, Human
agccuuccaggggugg

SEQ ID NO: 1182404 - RNA, 17 nt, Human
agccuuccagggguggg

SEQ ID NO: 1182405 - RNA, 16 nt, Human
agcggagaaaggaagg

SEQ ID NO: 1182406 - RNA, 20 nt, Human
agcggagaaaggaagggcug

SEQ ID NO: 1182407 - RNA, 18 nt, Human
agcggagacggaguccca

SEQ ID NO: 1182408 - RNA, 20 nt, Human
ugcauuaucuagauacugua

SEQ ID NO: 1182409 - RNA, 12 nt, Human
ugcauaccacuu

SEQ ID NO: 1182410 - RNA, 14 nt, Human
ugcauacacacaca

SEQ ID NO: 1182411 - RNA, 15 nt, Human
ugcauacacacacac

SEQ ID NO: 1182412 - RNA, 16 nt, Human
ugcauacacacacaca

SEQ ID NO: 1182413 - RNA, 21 nt, Human
ugcauacacacacacacacag

SEQ ID NO: 1182414 - RNA, 22 nt, Human
ugcauacacacacacacacagc

SEQ ID NO: 1182415 - RNA, 23 nt, Human
ugcauacacacacacacacagcc

SEQ ID NO: 1182416 - RNA, 14 nt, Human
ugcauaccacuuuu

SEQ ID NO: 1182417 - RNA, 15 nt, Human
agccugcuccagcug

SEQ ID NO: 1182418 - RNA, 16 nt, Human
agccugcuccagcugu

SEQ ID NO: 1182419 - RNA, 17 nt, Human
agccugcuccagcuguu

SEQ ID NO: 1182420 - RNA, 19 nt, Human
agccugcuccagcuguuca

SEQ ID NO: 1182421 - RNA, 22 nt, Human
agccugcuccagcuguucagcu

SEQ ID NO: 1182422 - RNA, 22 nt, Human
agccugggugacagagcaagug

SEQ ID NO: 1182423 - RNA, 21 nt, Human
agccugugccucugggacugg

SEQ ID NO: 1182424 - RNA, 16 nt, Human
agccugugucuuuaaa

SEQ ID NO: 1182425 - RNA, 23 nt, Human
agccugugucuuuaaaugcugcu

SEQ ID NO: 1182426 - RNA, 19 nt, Human
agcuacuaauuuuaaaaug

SEQ ID NO: 1182427 - RNA, 19 nt, Human
agcgugagccacugcaccg

SEQ ID NO: 1182428 - RNA, 22 nt, Human
agcgugagccacugcaccgggc

SEQ ID NO: 1182429 - RNA, 15 nt, Human
agcgugcauaaguua

SEQ ID NO: 1182430 - RNA, 17 nt, Human
agcuacuugggaggcug

SEQ ID NO: 1182431 - RNA, 18 nt, Human
agcuacuugggaggcuga

SEQ ID NO: 1182432 - RNA, 18 nt, Human
agcuagacgagcaggcuu

SEQ ID NO: 1182433 - RNA, 20 nt, Human
agcucauucuccuuguguua

SEQ ID NO: 1182434 - RNA, 21 nt, Human
agcucauucuccuuguguuac

SEQ ID NO: 1182435 - RNA, 19 nt, Human
ugcccacaggaucagucug

SEQ ID NO: 1182436 - RNA, 20 nt, Human
ugcccacaggaucagucuga

SEQ ID NO: 1182437 - RNA, 21 nt, Human
ugcccagccccuucugaccca

SEQ ID NO: 1182438 - RNA, 12 nt, Human
agcuaggccugg

SEQ ID NO: 1182439 - RNA, 14 nt, Human
agcuaggccuggcc

SEQ ID NO: 1182440 - RNA, 15 nt, Human
agcuaggccuggcca

SEQ ID NO: 1182441 - RNA, 16 nt, Human
agcuaggccuggccag

SEQ ID NO: 1182442 - RNA, 18 nt, Human
agcucaggugucccugca

SEQ ID NO: 1182443 - RNA, 20 nt, Human
agcucaggugucccugcacu

SEQ ID NO: 1182444 - RNA, 21 nt, Human
agcucaggugucccugcacuu

SEQ ID NO: 1182445 - RNA, 22 nt, Human
agcucaggugucccugcacuug

SEQ ID NO: 1182446 - RNA, 18 nt, Human
ugcgguccacccaggagc

SEQ ID NO: 1182447 - RNA, 17 nt, Human
ugcggugcuaucucccc

SEQ ID NO: 1182448 - RNA, 21 nt, Human
ugcggugcuaucucccccagc

SEQ ID NO: 1182449 - RNA, 17 nt, Human
ugcggccuuuggcuuca

SEQ ID NO: 1182450 - RNA, 19 nt, Human
ugcggccuuuggcuucacg

SEQ ID NO: 1182451 - RNA, 20 nt, Human
ugcgggcuuccuccuggugu

SEQ ID NO: 1182452 - RNA, 17 nt, Human
ugccuuuucccaacucc

SEQ ID NO: 1182453 - RNA, 22 nt, Human
ugcggacagccacggccaggcc

SEQ ID NO: 1182454 - RNA, 23 nt, Human
ugcggacagccacggccaggcca

SEQ ID NO: 1182455 - RNA, 11 nt, Human
ugcuacacacu

SEQ ID NO: 1182456 - RNA, 19 nt, Human
agcuugaccgugaggccag

SEQ ID NO: 1182457 - RNA, 14 nt, Human
agcuugaggguugg

SEQ ID NO: 1182458 - RNA, 18 nt, Human
agcuugaggguugggcug

SEQ ID NO: 1182459 - RNA, 22 nt, Human
agcuugaggguugggcuggugu

SEQ ID NO: 1182460 - RNA, 18 nt, Human
agcuuguaaauagcucag

SEQ ID NO: 1182461 - RNA, 12 nt, Human
ugcccaggcagg

SEQ ID NO: 1182462 - RNA, 13 nt, Human
ugcccaggcaggu

SEQ ID NO: 1182463 - RNA, 14 nt, Human
ugcccaggcagguc

SEQ ID NO: 1182464 - RNA, 13 nt, Human
ugccucugccucu

SEQ ID NO: 1182465 - RNA, 14 nt, Human
ugccucugccucug

SEQ ID NO: 1182466 - RNA, 15 nt, Human
ugccucugccucuga

SEQ ID NO: 1182467 - RNA, 17 nt, Human
ugccucugccucugaca

SEQ ID NO: 1182468 - RNA, 14 nt, Human
ugccugcccaggcc

SEQ ID NO: 1182469 - RNA, 15 nt, Human
ugccugcccaggccc

SEQ ID NO: 1182470 - RNA, 16 nt, Human
ugccugcccaggcccc

SEQ ID NO: 1182471 - RNA, 14 nt, Human
ugccuggauggggc

SEQ ID NO: 1182472 - RNA, 15 nt, Human
ugccuggauggggcu

SEQ ID NO: 1182473 - RNA, 20 nt, Human
agcugccuguucagcuccag

SEQ ID NO: 1182474 - RNA, 21 nt, Human
agcugccuguucagcuccagc

SEQ ID NO: 1182475 - RNA, 22 nt, Human
agcugccuguucagcuccagcu

SEQ ID NO: 1182476 - RNA, 21 nt, Human
agcugcuugggcuucauccuc

SEQ ID NO: 1182477 - RNA, 21 nt, Human
agcugcuuuugucuaugggac

SEQ ID NO: 1182478 - RNA, 22 nt, Human
agcugcuuuugucuaugggacu

SEQ ID NO: 1182479 - RNA, 15 nt, Human
agcugggacuacagg

SEQ ID NO: 1182480 - RNA, 20 nt, Human
agcugugcucuggacaggca

SEQ ID NO: 1182481 - RNA, 21 nt, Human
agcugugcucuggacaggcau

SEQ ID NO: 1182482 - RNA, 23 nt, Human
agcugugcucuggacaggcaugu

SEQ ID NO: 1182483 - RNA, 14 nt, Human
agcuguuacugucu

SEQ ID NO: 1182484 - RNA, 13 nt, Human
agcuguucagcug

SEQ ID NO: 1182485 - RNA, 14 nt, Human
agcuguucagcugg

SEQ ID NO: 1182486 - RNA, 18 nt, Human
ugccuguucagcuccagc

SEQ ID NO: 1182487 - RNA, 20 nt, Human
ugccuguucagcuccagcuc

SEQ ID NO: 1182488 - RNA, 21 nt, Human
ugccuguucagcuccagcuca

SEQ ID NO: 1182489 - RNA, 20 nt, Human
ugccuguugggccaggagcc

SEQ ID NO: 1182490 - RNA, 15 nt, Human
ugccuuauggaacac

SEQ ID NO: 1182491 - RNA, 16 nt, Human
ugccuuauggaacacu

SEQ ID NO: 1182492 - RNA, 17 nt, Human
ugcucuggacaggcaug

SEQ ID NO: 1182493 - RNA, 15 nt, Human
ugcucuggacaggca

SEQ ID NO: 1182494 - RNA, 16 nt, Human
ugcucuggacaggcau

SEQ ID NO: 1182495 - RNA, 14 nt, Human
ugcucuggacaggc

SEQ ID NO: 1182496 - RNA, 14 nt, Human
ugcucauggaauug

SEQ ID NO: 1182497 - RNA, 19 nt, Human
ugcuaucucccccagcccc

SEQ ID NO: 1182498 - RNA, 20 nt, Human
ugcuaucucccccagcccca

SEQ ID NO: 1182499 - RNA, 16 nt, Human
ugcugacuguuuucuc

SEQ ID NO: 1182500 - RNA, 13 nt, Human
aggaaaggcucca

SEQ ID NO: 1182501 - RNA, 14 nt, Human
aggaaaggcuccag

SEQ ID NO: 1182502 - RNA, 15 nt, Human
aggaaaggcuccagg

SEQ ID NO: 1182503 - RNA, 16 nt, Human
aggaaaggcuccagga

SEQ ID NO: 1182504 - RNA, 12 nt, Human
aggaaauauuua

SEQ ID NO: 1182505 - RNA, 11 nt, Human
aggaagcacau

SEQ ID NO: 1182506 - RNA, 16 nt, Human
aggaagcacaugccuc

SEQ ID NO: 1182507 - RNA, 17 nt, Human
aggaagcacaugccucu

SEQ ID NO: 1182508 - RNA, 13 nt, Human
aggaaauauuuau

SEQ ID NO: 1182509 - RNA, 15 nt, Human
aggaaaucaccgaaa

SEQ ID NO: 1182510 - RNA, 19 nt, Human
aggaaaucaccgaaaacgu

SEQ ID NO: 1182511 - RNA, 22 nt, Human
aggaagcacaugccucucucag

SEQ ID NO: 1182512 - RNA, 21 nt, Human
aggaagccagcaggcucucag

SEQ ID NO: 1182513 - RNA, 22 nt, Human
aggaagccagcaggcucucagg

SEQ ID NO: 1182514 - RNA, 23 nt, Human
aggaagccagcaggcucucaggc

SEQ ID NO: 1182515 - RNA, 18 nt, Human
aggaagccgcuggggcca

SEQ ID NO: 1182516 - RNA, 19 nt, Human
aggaagccgcuggggccag

SEQ ID NO: 1182517 - RNA, 20 nt, Human
aggaagccgcuggggccagu

SEQ ID NO: 1182518 - RNA, 12 nt, Human
aggaagcucagg

SEQ ID NO: 1182519 - RNA, 22 nt, Human
aggaaggaaacccagcucuggu

SEQ ID NO: 1182520 - RNA, 23 nt, Human
aggaaggaaacccagcucugguc

SEQ ID NO: 1182521 - RNA, 19 nt, Human
ugcuggcuguuggcugggg

SEQ ID NO: 1182522 - RNA, 21 nt, Human
ugcuggcuguuggcugggggc

SEQ ID NO: 1182523 - RNA, 19 nt, Human
ugcugggauuacaagcgug

SEQ ID NO: 1182524 - RNA, 20 nt, Human
ugcugggauuacagguguga

SEQ ID NO: 1182525 - RNA, 21 nt, Human
ugcugggauuacaagcgugag

SEQ ID NO: 1182526 - RNA, 17 nt, Human
ugcugggauuacaggug

SEQ ID NO: 1182527 - RNA, 13 nt, Human
ugcuguauuuuaa

SEQ ID NO: 1182528 - RNA, 21 nt, Human
ugcuguauuuuaaaagaauga

SEQ ID NO: 1182529 - RNA, 22 nt, Human
ugcuguauuuuaaaagaaugau

SEQ ID NO: 1182530 - RNA, 13 nt, Human
ugcugcccugccc

SEQ ID NO: 1182531 - RNA, 16 nt, Human
ugcugcccugcccacc

SEQ ID NO: 1182532 - RNA, 17 nt, Human
ugcugcccugcccaccu

SEQ ID NO: 1182533 - RNA, 18 nt, Human
ugcugcccugcccaccug

SEQ ID NO: 1182534 - RNA, 19 nt, Human
ugcugcccugcccaccugg

SEQ ID NO: 1182535 - RNA, 21 nt, Human
ugcugcccugcccaccuggcc

SEQ ID NO: 1182536 - RNA, 11 nt, Human
ugcugcccugu

SEQ ID NO: 1182537 - RNA, 12 nt, Human
ugcugcccugug

SEQ ID NO: 1182538 - RNA, 17 nt, Human
ugcugucccuuuuccuu

SEQ ID NO: 1182539 - RNA, 23 nt, Human
ugcuguauuuuaaaagaaugauu

SEQ ID NO: 1182540 - RNA, 19 nt, Human
ugcugucccuuacgugagu

SEQ ID NO: 1182541 - RNA, 15 nt, Human
ugcugucccuuuucc

SEQ ID NO: 1182542 - RNA, 19 nt, Human
aggacacuaaccacgcugg

SEQ ID NO: 1182543 - RNA, 16 nt, Human
ugcuuccagugaggcu

SEQ ID NO: 1182544 - RNA, 18 nt, Human
aggacacuaaccacgcug

SEQ ID NO: 1182545 - RNA, 12 nt, Human
ugcuucaaggau

SEQ ID NO: 1182546 - RNA, 21 nt, Human
ugcuucaaggauccugagcca

SEQ ID NO: 1182547 - RNA, 23 nt, Human
ugcuucaaggauccugagccaga

SEQ ID NO: 1182548 - RNA, 18 nt, Human
uggaaguacuauaauuua

SEQ ID NO: 1182549 - RNA, 17 nt, Human
uggaaaugggcagagca

SEQ ID NO: 1182550 - RNA, 18 nt, Human
uggaaaugggcagagcag

SEQ ID NO: 1182551 - RNA, 16 nt, Human
uggaagcacagcuuca

SEQ ID NO: 1182552 - RNA, 13 nt, Human
aggauccugagcc

SEQ ID NO: 1182553 - RNA, 14 nt, Human
aggauccugagcca

SEQ ID NO: 1182554 - RNA, 23 nt, Human
aggacagcccuucuuuccacaga

SEQ ID NO: 1182555 - RNA, 21 nt, Human
ugcuugaggcaacucaucuua

SEQ ID NO: 1182556 - RNA, 14 nt, Human
ugcuuggaggaagg

SEQ ID NO: 1182557 - RNA, 15 nt, Human
ugcuuggaggaagga

SEQ ID NO: 1182558 - RNA, 16 nt, Human
ugcuuggaggaaggaa

SEQ ID NO: 1182559 - RNA, 12 nt, Human
ugcuuguacaua

SEQ ID NO: 1182560 - RNA, 13 nt, Human
ugcuuguacauaa

SEQ ID NO: 1182561 - RNA, 14 nt, Human
ugcuuguacauaau

SEQ ID NO: 1182562 - RNA, 16 nt, Human
ugcuuguacauaaugc

SEQ ID NO: 1182563 - RNA, 22 nt, Human
ugcuuguacauaaugcgugcau

SEQ ID NO: 1182564 - RNA, 12 nt, Human
ugcuuugugauu

SEQ ID NO: 1182565 - RNA, 14 nt, Human
ugcuuugugauuuu

SEQ ID NO: 1182566 - RNA, 16 nt, Human
ugcuuugugauuuuug

SEQ ID NO: 1182567 - RNA, 17 nt, Human
ugcuuugugauuuuugu

SEQ ID NO: 1182568 - RNA, 14 nt, Human
ugcuuuuggucugu

SEQ ID NO: 1182569 - RNA, 17 nt, Human
ugcuuuuggucugugug

SEQ ID NO: 1182570 - RNA, 13 nt, Human
uggagaagaacug

SEQ ID NO: 1182571 - RNA, 11 nt, Human
uggacuuuguu

SEQ ID NO: 1182572 - RNA, 14 nt, Human
uggagaagaacuga

SEQ ID NO: 1182573 - RNA, 13 nt, Human
uggagaagcggcu

SEQ ID NO: 1182574 - RNA, 22 nt, Human
uggagaagcggcuggcagccca

SEQ ID NO: 1182575 - RNA, 14 nt, Human
aggcaaugcuggcu

SEQ ID NO: 1182576 - RNA, 20 nt, Human
aggcacccaccaucaugucu

SEQ ID NO: 1182577 - RNA, 21 nt, Human
aggcacccaccaucaugucug

SEQ ID NO: 1182578 - RNA, 22 nt, Human
aggcacccaccaucaugucugg

SEQ ID NO: 1182579 - RNA, 14 nt, Human
uggagcucguggaa

SEQ ID NO: 1182580 - RNA, 17 nt, Human
aggaucucuugagccug

SEQ ID NO: 1182581 - RNA, 18 nt, Human
aggaucucuugagccugg

SEQ ID NO: 1182582 - RNA, 19 nt, Human
aggaucucuugagccuggg

SEQ ID NO: 1182583 - RNA, 13 nt, Human
uggacacagcucu

SEQ ID NO: 1182584 - RNA, 14 nt, Human
uggacacagcucuu

SEQ ID NO: 1182585 - RNA, 22 nt, Human
uggacacagcucuucuccaggc

SEQ ID NO: 1182586 - RNA, 23 nt, Human
uggacacagcucuucuccaggcu

SEQ ID NO: 1182587 - RNA, 16 nt, Human
uggacccugaggccca

SEQ ID NO: 1182588 - RNA, 18 nt, Human
uggacccugaggcccaga

SEQ ID NO: 1182589 - RNA, 19 nt, Human
uggacccugaggcccagag

SEQ ID NO: 1182590 - RNA, 20 nt, Human
uggacccugaggcccagagg

SEQ ID NO: 1182591 - RNA, 21 nt, Human
uggacccugaggcccagaggg

SEQ ID NO: 1182592 - RNA, 23 nt, Human
uggacccuguggaugauaaaaca

SEQ ID NO: 1182593 - RNA, 20 nt, Human
uggaccuugaacuggguacu

SEQ ID NO: 1182594 - RNA, 14 nt, Human
uggaguauauguca

SEQ ID NO: 1182595 - RNA, 13 nt, Human
uggauuguccccg

SEQ ID NO: 1182596 - RNA, 21 nt, Human
uggauuguccccgacccuugc

SEQ ID NO: 1182597 - RNA, 16 nt, Human
aggcagccccauucug

SEQ ID NO: 1182598 - RNA, 17 nt, Human
aggcagccccauucugc

SEQ ID NO: 1182599 - RNA, 16 nt, Human
aggccaaaggaagcac

SEQ ID NO: 1182600 - RNA, 18 nt, Human
aggccaaaggaagcacau

SEQ ID NO: 1182601 - RNA, 19 nt, Human
aggccaaaggaagcacaug

SEQ ID NO: 1182602 - RNA, 19 nt, Human
aggcagccccauucugccu

SEQ ID NO: 1182603 - RNA, 20 nt, Human
aggccaaaggaagcacaugc

SEQ ID NO: 1182604 - RNA, 16 nt, Human
aggccaaggugggagg

SEQ ID NO: 1182605 - RNA, 18 nt, Human
aggccaaggugggaggau

SEQ ID NO: 1182606 - RNA, 20 nt, Human
uggagguacgaaaagagggg

SEQ ID NO: 1182607 - RNA, 17 nt, Human
uggcagccuuggcaaac

SEQ ID NO: 1182608 - RNA, 15 nt, Human
uggcagcucaccucu

SEQ ID NO: 1182609 - RNA, 19 nt, Human
uggcagcucaccucucccu

SEQ ID NO: 1182610 - RNA, 17 nt, Human
aggccacaagacccuug

SEQ ID NO: 1182611 - RNA, 18 nt, Human
aggccacaagacccuugu

SEQ ID NO: 1182612 - RNA, 19 nt, Human
aggccacaagacccuugug

SEQ ID NO: 1182613 - RNA, 14 nt, Human
aggccagagggagu

SEQ ID NO: 1182614 - RNA, 20 nt, Human
aggccagagggagugacaga

SEQ ID NO: 1182615 - RNA, 20 nt, Human
aggccacaagacccuugugg

SEQ ID NO: 1182616 - RNA, 21 nt, Human
aggcccagagggccugcaagg

SEQ ID NO: 1182617 - RNA, 21 nt, Human
uggccaaagccaaagcuaggc

SEQ ID NO: 1182618 - RNA, 23 nt, Human
uggccaaagccaaagcuaggccu

SEQ ID NO: 1182619 - RNA, 23 nt, Human
uggccagugugacaaggauugcu

SEQ ID NO: 1182620 - RNA, 17 nt, Human
aggccccgcccaggcuu

SEQ ID NO: 1182621 - RNA, 12 nt, Human
aggccccugcca

SEQ ID NO: 1182622 - RNA, 13 nt, Human
uggcccacgcacu

SEQ ID NO: 1182623 - RNA, 18 nt, Human
uggccugagcugggauga

SEQ ID NO: 1182624 - RNA, 18 nt, Human
uggccuggccccucaggg

SEQ ID NO: 1182625 - RNA, 21 nt, Human
uggccuggccccucagggucc

SEQ ID NO: 1182626 - RNA, 14 nt, Human
uggccuucggccuc

SEQ ID NO: 1182627 - RNA, 12 nt, Human
aggccuggggac

SEQ ID NO: 1182628 - RNA, 18 nt, Human
aggccugggggcugggca

SEQ ID NO: 1182629 - RNA, 20 nt, Human
aggccugggggcugggcaga

SEQ ID NO: 1182630 - RNA, 17 nt, Human
ugggcaacccccagccu

SEQ ID NO: 1182631 - RNA, 20 nt, Human
ugggcaacccccagccugcu

SEQ ID NO: 1182632 - RNA, 21 nt, Human
ugggcaacccccagccugcua

SEQ ID NO: 1182633 - RNA, 13 nt, Human
ugggccaggagcc

SEQ ID NO: 1182634 - RNA, 14 nt, Human
ugggccaggagccu

SEQ ID NO: 1182635 - RNA, 16 nt, Human
ugggccaggagccucc

SEQ ID NO: 1182636 - RNA, 20 nt, Human
ugggcccaaugcacuuuguu

SEQ ID NO: 1182637 - RNA, 14 nt, Human
ugggaguacaaaag

SEQ ID NO: 1182638 - RNA, 17 nt, Human
aggccuucucugaagga

SEQ ID NO: 1182639 - RNA, 18 nt, Human
ugggaggucaaggcugca

SEQ ID NO: 1182640 - RNA, 19 nt, Human
ugggaggucaaggcugcag

SEQ ID NO: 1182641 - RNA, 20 nt, Human
ugggaggucaaggcugcagu

SEQ ID NO: 1182642 - RNA, 23 nt, Human
ugggaggucaaggcugcagugag

SEQ ID NO: 1182643 - RNA, 17 nt, Human
agggaggugaccccagg

SEQ ID NO: 1182644 - RNA, 17 nt, Human
agggagugacagaggca

SEQ ID NO: 1182645 - RNA, 18 nt, Human
agggagugacagaggcag

SEQ ID NO: 1182646 - RNA, 19 nt, Human
agggagugacagaggcagc

SEQ ID NO: 1182647 - RNA, 20 nt, Human
agggagugacagaggcagcc

SEQ ID NO: 1182648 - RNA, 23 nt, Human
agggcccagagaggguggugacc

SEQ ID NO: 1182649 - RNA, 20 nt, Human
ugggcucccuucccaccucu

SEQ ID NO: 1182650 - RNA, 21 nt, Human
ugggcucccuucccaccucuc

SEQ ID NO: 1182651 - RNA, 23 nt, Human
agggcuucugccauuucugagau

SEQ ID NO: 1182652 - RNA, 18 nt, Human
ugggcucccuucccaccu

SEQ ID NO: 1182653 - RNA, 19 nt, Human
ugggcucccuucccaccuc

SEQ ID NO: 1182654 - RNA, 14 nt, Human
uggggaccagagcu

SEQ ID NO: 1182655 - RNA, 15 nt, Human
uggggaccagagcug

SEQ ID NO: 1182656 - RNA, 17 nt, Human
uggggaccagagcugcc

SEQ ID NO: 1182657 - RNA, 18 nt, Human
uggggaccagagcugcca

SEQ ID NO: 1182658 - RNA, 13 nt, Human
uggggaccucagg

SEQ ID NO: 1182659 - RNA, 18 nt, Human
ugggcuggguucuaccca

SEQ ID NO: 1182660 - RNA, 19 nt, Human
ugggcuggguucuacccag

SEQ ID NO: 1182661 - RNA, 23 nt, Human
ugggcuggguucuacccaggugc

SEQ ID NO: 1182662 - RNA, 18 nt, Human
uggggcggugagagggga

SEQ ID NO: 1182663 - RNA, 15 nt, Human
uggggcccugccucc

SEQ ID NO: 1182664 - RNA, 16 nt, Human
uggggcccugccuccu

SEQ ID NO: 1182665 - RNA, 23 nt, Human
uggggaccucaggccugggggcu

SEQ ID NO: 1182666 - RNA, 12 nt, Human
uggggagaaagu

SEQ ID NO: 1182667 - RNA, 20 nt, Human
uggggcugcaccggcuggcc

SEQ ID NO: 1182668 - RNA, 22 nt, Human
uggggcugcaccggcuggccug

SEQ ID NO: 1182669 - RNA, 14 nt, Human
ugggguacccacug

SEQ ID NO: 1182670 - RNA, 15 nt, Human
ugggguacccacugc

SEQ ID NO: 1182671 - RNA, 16 nt, Human
ugggguacccacugcu

SEQ ID NO: 1182672 - RNA, 15 nt, Human
ugggguaugggagag

SEQ ID NO: 1182673 - RNA, 17 nt, Human
uggggucacucuggcag

SEQ ID NO: 1182674 - RNA, 18 nt, Human
uggggucacucuggcagc

SEQ ID NO: 1182675 - RNA, 23 nt, Human
aggggagcaaaaucgaugcagug

SEQ ID NO: 1182676 - RNA, 19 nt, Human
uggggucacucuggcagcu

SEQ ID NO: 1182677 - RNA, 20 nt, Human
uggggucacucuggcagcuc

SEQ ID NO: 1182678 - RNA, 15 nt, Human
aggggguggccuccc

SEQ ID NO: 1182679 - RNA, 17 nt, Human
aggggguggccucccaa

SEQ ID NO: 1182680 - RNA, 18 nt, Human
aggggguggccucccaac

SEQ ID NO: 1182681 - RNA, 20 nt, Human
aggggugggacacccuguga

SEQ ID NO: 1182682 - RNA, 22 nt, Human
aggggugggacacccugugaug

SEQ ID NO: 1182683 - RNA, 24 nt, Human
agggguucccuuuuuuggcugcug

SEQ ID NO: 1182684 - RNA, 21 nt, Human
agggucucacuauguugccca

SEQ ID NO: 1182685 - RNA, 22 nt, Human
agggucucacuauguugcccag

SEQ ID NO: 1182686 - RNA, 23 nt, Human
agggucucacuauguugcccagg

SEQ ID NO: 1182687 - RNA, 16 nt, Human
ugguacuaacuuuccu

SEQ ID NO: 1182688 - RNA, 20 nt, Human
ugguaaggggaauugaggac

SEQ ID NO: 1182689 - RNA, 22 nt, Human
agggucucacucugucgcccag

SEQ ID NO: 1182690 - RNA, 15 nt, Human
agggugggagugggc

SEQ ID NO: 1182691 - RNA, 15 nt, Human
ugggugcuuggagga

SEQ ID NO: 1182692 - RNA, 19 nt, Human
ugggugcuuggaggaagga

SEQ ID NO: 1182693 - RNA, 22 nt, Human
ugggugcuuggaggaaggaaac

SEQ ID NO: 1182694 - RNA, 16 nt, Human
uggucucaaacucuug

SEQ ID NO: 1182695 - RNA, 16 nt, Human
uggucccaccccacac

SEQ ID NO: 1182696 - RNA, 13 nt, Human
uggucccacucag

SEQ ID NO: 1182697 - RNA, 17 nt, Human
uggucucaaacucuuga

SEQ ID NO: 1182698 - RNA, 23 nt, Human
uggucucaaacucuugaccucag

SEQ ID NO: 1182699 - RNA, 18 nt, Human
uggucaccaaaucagcug

SEQ ID NO: 1182700 - RNA, 20 nt, Human
uggucaccaaaucagcugcu

SEQ ID NO: 1182701 - RNA, 14 nt, Human
uggucccaccccac

SEQ ID NO: 1182702 - RNA, 15 nt, Human
uggucccaccccaca

SEQ ID NO: 1182703 - RNA, 16 nt, Human
uggucugacccacugc

SEQ ID NO: 1182704 - RNA, 17 nt, Human
uggucugacccacugcu

SEQ ID NO: 1182705 - RNA, 18 nt, Human
uggucugacccacugcuu

SEQ ID NO: 1182706 - RNA, 22 nt, Human
aggguguccggucccuguccca

SEQ ID NO: 1182707 - RNA, 13 nt, Human
aggguuauaauaa

SEQ ID NO: 1182708 - RNA, 17 nt, Human
aggguuaugauuaagua

SEQ ID NO: 1182709 - RNA, 21 nt, Human
agguaugcaaucaaaucugcu

SEQ ID NO: 1182710 - RNA, 23 nt, Human
agguagaaauaucugaaaaugua

SEQ ID NO: 1182711 - RNA, 23 nt, Human
agguacuucaaauccuugaagau

SEQ ID NO: 1182712 - RNA, 17 nt, Human
agguagaaauaucugaa

SEQ ID NO: 1182713 - RNA, 19 nt, Human
agguagaaauaucugaaaa

SEQ ID NO: 1182714 - RNA, 13 nt, Human
aggguugggcugg

SEQ ID NO: 1182715 - RNA, 18 nt, Human
aggguuggccccugcccg

SEQ ID NO: 1182716 - RNA, 23 nt, Human
aggguuggccccugcccggcugc

SEQ ID NO: 1182717 - RNA, 12 nt, Human
aggucagagccu

SEQ ID NO: 1182718 - RNA, 13 nt, Human
aggucagagccug

SEQ ID NO: 1182719 - RNA, 17 nt, Human
aggucauuuuuuuuaag

SEQ ID NO: 1182720 - RNA, 20 nt, Human
aggucauuuuuuuuaagaaa

SEQ ID NO: 1182721 - RNA, 21 nt, Human
aggugcacaagcuccaagcuc

SEQ ID NO: 1182722 - RNA, 20 nt, Human
aggugggauccuccaggugc

SEQ ID NO: 1182723 - RNA, 23 nt, Human
aggucuugaacuccuggccucaa

SEQ ID NO: 1182724 - RNA, 15 nt, Human
aggugcacaagcucc

SEQ ID NO: 1182725 - RNA, 16 nt, Human
aggugcacaagcucca

SEQ ID NO: 1182726 - RNA, 17 nt, Human
aggugcacaagcuccaa

SEQ ID NO: 1182727 - RNA, 18 nt, Human
aggugcacaagcuccaag

SEQ ID NO: 1182728 - RNA, 20 nt, Human
aggugcacaagcuccaagcu

SEQ ID NO: 1182729 - RNA, 17 nt, Human
aggugguuauggagagg

SEQ ID NO: 1182730 - RNA, 14 nt, Human
agguugcagugagc

SEQ ID NO: 1182731 - RNA, 14 nt, Human
agguuggugggggc

SEQ ID NO: 1182732 - RNA, 17 nt, Human
uguaagaaaauaucacu

SEQ ID NO: 1182733 - RNA, 22 nt, Human
uguaagcucuacugaggugcua

SEQ ID NO: 1182734 - RNA, 11 nt, Human
agguuuuccug

SEQ ID NO: 1182735 - RNA, 18 nt, Human
aguaauaugcacacauuu

SEQ ID NO: 1182736 - RNA, 19 nt, Human
aguaauaugcacacauuuu

SEQ ID NO: 1182737 - RNA, 20 nt, Human
aguaauaugcacacauuuuu

SEQ ID NO: 1182738 - RNA, 14 nt, Human
uguaauuugugaua

SEQ ID NO: 1182739 - RNA, 18 nt, Human
uguagaggagaaacugga

SEQ ID NO: 1182740 - RNA, 13 nt, Human
uguagagugggag

SEQ ID NO: 1182741 - RNA, 14 nt, Human
uguagagugggagc

SEQ ID NO: 1182742 - RNA, 20 nt, Human
uguaggaagguuaauguuca

SEQ ID NO: 1182743 - RNA, 19 nt, Human
aguagauaggccaugggca

SEQ ID NO: 1182744 - RNA, 17 nt, Human
aguagaagucuuagaug

SEQ ID NO: 1182745 - RNA, 14 nt, Human
aguacacuguuuca

SEQ ID NO: 1182746 - RNA, 16 nt, Human
aguacacuguuucaaa

SEQ ID NO: 1182747 - RNA, 20 nt, Human
aguacacuguuucaaacuuu

SEQ ID NO: 1182748 - RNA, 16 nt, Human
ugucagcugaaccugg

SEQ ID NO: 1182749 - RNA, 19 nt, Human
agucacugagacagcccgg

SEQ ID NO: 1182750 - RNA, 19 nt, Human
ugucagcugaaccugggua

SEQ ID NO: 1182751 - RNA, 16 nt, Human
ugucagguggggcagc

SEQ ID NO: 1182752 - RNA, 13 nt, Human
aguauuucuauga

SEQ ID NO: 1182753 - RNA, 15 nt, Human
aguauuucuaugaaa

SEQ ID NO: 1182754 - RNA, 16 nt, Human
aguauuucuaugaaau

SEQ ID NO: 1182755 - RNA, 13 nt, Human
agucaccaagccc

SEQ ID NO: 1182756 - RNA, 14 nt, Human
agucaccaagccca

SEQ ID NO: 1182757 - RNA, 20 nt, Human
ugucaaucagccuaguugau

SEQ ID NO: 1182758 - RNA, 16 nt, Human
aguaggaagacuuugg

SEQ ID NO: 1182759 - RNA, 17 nt, Human
aguaggaagacuuugga

SEQ ID NO: 1182760 - RNA, 18 nt, Human
aguaggaagacuuuggaa

SEQ ID NO: 1182761 - RNA, 19 nt, Human
aguaggaagacuuuggaaa

SEQ ID NO: 1182762 - RNA, 22 nt, Human
aguaggaagacuuuggaaagac

SEQ ID NO: 1182763 - RNA, 19 nt, Human
ugucaagagggucugagga

SEQ ID NO: 1182764 - RNA, 15 nt, Human
ugucaagccauaauu

SEQ ID NO: 1182765 - RNA, 14 nt, Human
uguauuuuuuuacu

SEQ ID NO: 1182766 - RNA, 16 nt, Human
uguauuuuuuuacuaa

SEQ ID NO: 1182767 - RNA, 16 nt, Human
uguccuacccacccuc

SEQ ID NO: 1182768 - RNA, 13 nt, Human
uguccgagcuuug

SEQ ID NO: 1182769 - RNA, 14 nt, Human
uguccgagcuuuga

SEQ ID NO: 1182770 - RNA, 12 nt, Human
ugucgggcauga

SEQ ID NO: 1182771 - RNA, 14 nt, Human
ugucgcccagucug

SEQ ID NO: 1182772 - RNA, 15 nt, Human
ugucgcccagucugg

SEQ ID NO: 1182773 - RNA, 14 nt, Human
ugucgggcaugaca

SEQ ID NO: 1182774 - RNA, 15 nt, Human
ugucgggcaugacac

SEQ ID NO: 1182775 - RNA, 16 nt, Human
agucaggaaagagaac

SEQ ID NO: 1182776 - RNA, 19 nt, Human
agucagggguucccuuuuu

SEQ ID NO: 1182777 - RNA, 12 nt, Human
agucccugccaa

SEQ ID NO: 1182778 - RNA, 23 nt, Human
aguccgaaagggacuuggaagcu

SEQ ID NO: 1182779 - RNA, 16 nt, Human
agucucacuguugccc

SEQ ID NO: 1182780 - RNA, 17 nt, Human
agucucacuguugccca

SEQ ID NO: 1182781 - RNA, 22 nt, Human
ugugcucugaucauccacugug

SEQ ID NO: 1182782 - RNA, 23 nt, Human
ugugcucugaucauccacugugc

SEQ ID NO: 1182783 - RNA, 15 nt, Human
ugugcucuggacagg

SEQ ID NO: 1182784 - RNA, 18 nt, Human
agucucacuguugcccag

SEQ ID NO: 1182785 - RNA, 19 nt, Human
agucucacuguugcccagg

SEQ ID NO: 1182786 - RNA, 20 nt, Human
agucucacuguugcccaggc

SEQ ID NO: 1182787 - RNA, 21 nt, Human
agucucacuguugcccaggcu

SEQ ID NO: 1182788 - RNA, 20 nt, Human
ugugcccuaaaguguauuuu

SEQ ID NO: 1182789 - RNA, 21 nt, Human
ugugcccuaaaguguauuuuu

SEQ ID NO: 1182790 - RNA, 16 nt, Human
ugugcucuggacaggc

SEQ ID NO: 1182791 - RNA, 18 nt, Human
ugugcucuggacaggcau

SEQ ID NO: 1182792 - RNA, 19 nt, Human
ugugcucuggacaggcaug

SEQ ID NO: 1182793 - RNA, 13 nt, Human
ugugcugcccugc

SEQ ID NO: 1182794 - RNA, 14 nt, Human
ugugcugcccugcc

SEQ ID NO: 1182795 - RNA, 15 nt, Human
ugugcugcccugccc

SEQ ID NO: 1182796 - RNA, 18 nt, Human
ugugcugcccugcccacc

SEQ ID NO: 1182797 - RNA, 16 nt, Human
agugccaaaaacaaca

SEQ ID NO: 1182798 - RNA, 14 nt, Human
agugcaugcugucc

SEQ ID NO: 1182799 - RNA, 14 nt, Human
agugcccacaggau

SEQ ID NO: 1182800 - RNA, 16 nt, Human
agugagucgaggacag

SEQ ID NO: 1182801 - RNA, 24 nt, Human
agugauucuccugccucagccucc

SEQ ID NO: 1182802 - RNA, 21 nt, Human
agugaguugauagcacagacc

SEQ ID NO: 1182803 - RNA, 18 nt, Human
agugcaaauugucacagg

SEQ ID NO: 1182804 - RNA, 21 nt, Human
agugcaaauugucacaggaca

SEQ ID NO: 1182805 - RNA, 22 nt, Human
agugcaaauugucacaggacag

SEQ ID NO: 1182806 - RNA, 19 nt, Human
agugcugggauuacaggug

SEQ ID NO: 1182807 - RNA, 20 nt, Human
agugcugggauuacaggugu

SEQ ID NO: 1182808 - RNA, 22 nt, Human
agugcugcauuuaaaagauaca

SEQ ID NO: 1182809 - RNA, 20 nt, Human
agugcugggauuacaagcgu

SEQ ID NO: 1182810 - RNA, 21 nt, Human
agugccuguaaucacagcuac

SEQ ID NO: 1182811 - RNA, 15 nt, Human
agugccuuacacaau

SEQ ID NO: 1182812 - RNA, 17 nt, Human
agugccuuacacaaugg

SEQ ID NO: 1182813 - RNA, 12 nt, Human
ugugguuucauu

SEQ ID NO: 1182814 - RNA, 16 nt, Human
agugcuuccaaggaug

SEQ ID NO: 1182815 - RNA, 17 nt, Human
ugugucagguggggcag

SEQ ID NO: 1182816 - RNA, 19 nt, Human
ugugucagguggggcagcu

SEQ ID NO: 1182817 - RNA, 20 nt, Human
ugugucagguggggcagcuu

SEQ ID NO: 1182818 - RNA, 13 nt, Human
ugugucucuuggu

SEQ ID NO: 1182819 - RNA, 16 nt, Human
ugugucucuugguccu

SEQ ID NO: 1182820 - RNA, 14 nt, Human
uguguuaugaagca

SEQ ID NO: 1182821 - RNA, 21 nt, Human
uguuaacauggacaugaucuu

SEQ ID NO: 1182822 - RNA, 19 nt, Human
uguuaaugauagcuacugu

SEQ ID NO: 1182823 - RNA, 11 nt, Human
aguggaaaaau

SEQ ID NO: 1182824 - RNA, 18 nt, Human
aguggaaaaauagccugc

SEQ ID NO: 1182825 - RNA, 19 nt, Human
aguggaaaaauagccugcc

SEQ ID NO: 1182826 - RNA, 23 nt, Human
aguguuggagaagaacugaaauc

SEQ ID NO: 1182827 - RNA, 17 nt, Human
aguguuggagaagaacu

SEQ ID NO: 1182828 - RNA, 18 nt, Human
aguguuggagaagaacug

SEQ ID NO: 1182829 - RNA, 14 nt, Human
aguguuggagaaga

SEQ ID NO: 1182830 - RNA, 16 nt, Human
aguguuggagaagaac

SEQ ID NO: 1182831 - RNA, 20 nt, Human
uguucuugguuuguaaauua

SEQ ID NO: 1182832 - RNA, 22 nt, Human
uguucuugguuuguaaauuaac

SEQ ID NO: 1182833 - RNA, 19 nt, Human
uguucuuucacccuuuucu

SEQ ID NO: 1182834 - RNA, 13 nt, Human
uguugcccaggcu

SEQ ID NO: 1182835 - RNA, 15 nt, Human
uguugcccaggcugg

SEQ ID NO: 1182836 - RNA, 20 nt, Human
uguugcccaggcuggcgugc

SEQ ID NO: 1182837 - RNA, 18 nt, Human
uguucuagcauggcugcc

SEQ ID NO: 1182838 - RNA, 18 nt, Human
uguucuuaguuugcaguu

SEQ ID NO: 1182839 - RNA, 16 nt, Human
agugugguguuuccug

SEQ ID NO: 1182840 - RNA, 23 nt, Human
aguuccucauuagcauuuugcua

SEQ ID NO: 1182841 - RNA, 16 nt, Human
aguucaauucucauuu

SEQ ID NO: 1182842 - RNA, 20 nt, Human
aguucggugagcuacaaaug

SEQ ID NO: 1182843 - RNA, 19 nt, Human
aguucggugagcuacaaau

SEQ ID NO: 1182844 - RNA, 12 nt, Human
aguucucuccuu

SEQ ID NO: 1182845 - RNA, 14 nt, Human
uguuuauugucaaa

SEQ ID NO: 1182846 - RNA, 17 nt, Human
uguuuauugucaaagug

SEQ ID NO: 1182847 - RNA, 13 nt, Human
uuaaucauuaggu

SEQ ID NO: 1182848 - RNA, 22 nt, Human
uuaaucauuaggugugacugaa

SEQ ID NO: 1182849 - RNA, 23 nt, Human
uuaaucauuaggugugacugaau

SEQ ID NO: 1182850 - RNA, 22 nt, Human
uuaaucugguuuauuuuuguuc

SEQ ID NO: 1182851 - RNA, 18 nt, Human
uuaaugaaagacuguaca

SEQ ID NO: 1182852 - RNA, 19 nt, Human
uuaaugaaagacuguacaa

SEQ ID NO: 1182853 - RNA, 20 nt, Human
uuaaugaaagacuguacaaa

SEQ ID NO: 1182854 - RNA, 22 nt, Human
uuaagaaagacuaucuaaaugu

SEQ ID NO: 1182855 - RNA, 20 nt, Human
uuaagaagacugcauuauau

SEQ ID NO: 1182856 - RNA, 9 nt, Human
uuaaggugg

SEQ ID NO: 1182857 - RNA, 15 nt, Human
uuaagugcugcauuu

SEQ ID NO: 1182858 - RNA, 16 nt, Human
uuaagugcugcauuua

SEQ ID NO: 1182859 - RNA, 19 nt, Human
uuaagugcugcauuuaaaa

SEQ ID NO: 1182860 - RNA, 22 nt, Human
uuaagugcugcauuuaaaagau

SEQ ID NO: 1182861 - RNA, 23 nt, Human
aguuuuuauggcuuuugugcauu

SEQ ID NO: 1182862 - RNA, 12 nt, Human
auaaaauaauuu

SEQ ID NO: 1182863 - RNA, 15 nt, Human
auaaaauaauuuuua

SEQ ID NO: 1182864 - RNA, 20 nt, Human
uuaagaaaaaggaugcacag

SEQ ID NO: 1182865 - RNA, 21 nt, Human
uuaagaaaaaggaugcacaga

SEQ ID NO: 1182866 - RNA, 15 nt, Human
uuaaauaaugugaaa

SEQ ID NO: 1182867 - RNA, 14 nt, Human
uuaaaaaucucaaa

SEQ ID NO: 1182868 - RNA, 15 nt, Human
uuaaaaaucucaaau

SEQ ID NO: 1182869 - RNA, 16 nt, Human
uuaaaaaucucaaauu

SEQ ID NO: 1182870 - RNA, 17 nt, Human
uuaaaaaucucaaauuu

SEQ ID NO: 1182871 - RNA, 16 nt, Human
uuaaauaaugugaaac

SEQ ID NO: 1182872 - RNA, 18 nt, Human
uuaaauaaugugaaacug

SEQ ID NO: 1182873 - RNA, 19 nt, Human
uuaaauaaugugaaacugg

SEQ ID NO: 1182874 - RNA, 19 nt, Human
uuaacagaaauguacagca

SEQ ID NO: 1182875 - RNA, 20 nt, Human
uuaacagaaauguacagcaa

SEQ ID NO: 1182876 - RNA, 14 nt, Human
aguuuaaauuguaa

SEQ ID NO: 1182877 - RNA, 11 nt, Human
aguuggucccc

SEQ ID NO: 1182878 - RNA, 13 nt, Human
aguuggucccccu

SEQ ID NO: 1182879 - RNA, 17 nt, Human
aguuggucccccuucca

SEQ ID NO: 1182880 - RNA, 18 nt, Human
aguuggucccccuuccau

SEQ ID NO: 1182881 - RNA, 13 nt, Human
uuaaaaaaaaucc

SEQ ID NO: 1182882 - RNA, 13 nt, Human
uguuucaaacaua

SEQ ID NO: 1182883 - RNA, 19 nt, Human
uguuucaaacauauauaac

SEQ ID NO: 1182884 - RNA, 23 nt, Human
aguugccagucaccccggccacc

SEQ ID NO: 1182885 - RNA, 19 nt, Human
aguugggcuuccucauagu

SEQ ID NO: 1182886 - RNA, 17 nt, Human
aguuggguggaugccug

SEQ ID NO: 1182887 - RNA, 19 nt, Human
uuacccucauguucuuaau

SEQ ID NO: 1182888 - RNA, 20 nt, Human
uuagacagagucucacuguu

SEQ ID NO: 1182889 - RNA, 13 nt, Human
uuagacagucccu

SEQ ID NO: 1182890 - RNA, 22 nt, Human
auaacgauaaaagacagugaaa

SEQ ID NO: 1182891 - RNA, 16 nt, Human
auaacuaaaagguaug

SEQ ID NO: 1182892 - RNA, 11 nt, Human
auaaauuauuu

SEQ ID NO: 1182893 - RNA, 14 nt, Human
auaaauaaaaauaa

SEQ ID NO: 1182894 - RNA, 15 nt, Human
auaaauaguuuauga

SEQ ID NO: 1182895 - RNA, 13 nt, Human
auaaauaaaaaua

SEQ ID NO: 1182896 - RNA, 18 nt, Human
auaauccuaaacauauga

SEQ ID NO: 1182897 - RNA, 15 nt, Human
auaaugcgugcauac

SEQ ID NO: 1182898 - RNA, 20 nt, Human
auaaugcgugcauaccacuu

SEQ ID NO: 1182899 - RNA, 22 nt, Human
auaauugacaggauuauuggaa

SEQ ID NO: 1182900 - RNA, 14 nt, Human
uuagacagucccug

SEQ ID NO: 1182901 - RNA, 12 nt, Human
auaauacaccac

SEQ ID NO: 1182902 - RNA, 18 nt, Human
auaauacaccacuacauu

SEQ ID NO: 1182903 - RNA, 20 nt, Human
auaauacaccacuacauucu

SEQ ID NO: 1182904 - RNA, 21 nt, Human
auaauacaccacuacauucug

SEQ ID NO: 1182905 - RNA, 18 nt, Human
uuagcaaauucuguuuuu

SEQ ID NO: 1182906 - RNA, 18 nt, Human
auaauuuaccugaagucu

SEQ ID NO: 1182907 - RNA, 18 nt, Human
uuagccaagugugguaga

SEQ ID NO: 1182908 - RNA, 14 nt, Human
uuagcggagacgga

SEQ ID NO: 1182909 - RNA, 20 nt, Human
uuagggaaggauacaaaagc

SEQ ID NO: 1182910 - RNA, 16 nt, Human
uuaggugaggaagcaa

SEQ ID NO: 1182911 - RNA, 16 nt, Human
uuaggugugacugaau

SEQ ID NO: 1182912 - RNA, 21 nt, Human
uuaggugugacugaauuucuu

SEQ ID NO: 1182913 - RNA, 15 nt, Human
uuaguuucuccaagc

SEQ ID NO: 1182914 - RNA, 22 nt, Human
uuaguuugcaguuacacuaaaa

SEQ ID NO: 1182915 - RNA, 23 nt, Human
uucacaagacccaaaaggcagaa

SEQ ID NO: 1182916 - RNA, 20 nt, Human
uucacagaugggugcuugga

SEQ ID NO: 1182917 - RNA, 15 nt, Human
uucacaguucucucc

SEQ ID NO: 1182918 - RNA, 20 nt, Human
uucacaguucucuccuucuu

SEQ ID NO: 1182919 - RNA, 17 nt, Human
auaggcguaacuaauuu

SEQ ID NO: 1182920 - RNA, 19 nt, Human
auaggaacuuaaauaaugu

SEQ ID NO: 1182921 - RNA, 12 nt, Human
auaggaaaaacu

SEQ ID NO: 1182922 - RNA, 14 nt, Human
auaggaaaaacuga

SEQ ID NO: 1182923 - RNA, 16 nt, Human
auaggaaaaacugauu

SEQ ID NO: 1182924 - RNA, 17 nt, Human
auaggaaaaacugauuu

SEQ ID NO: 1182925 - RNA, 21 nt, Human
uucaagcgauucuucugcuuc

SEQ ID NO: 1182926 - RNA, 17 nt, Human
uucaaaauaaaaaugag

SEQ ID NO: 1182927 - RNA, 14 nt, Human
uucaaacauauaua

SEQ ID NO: 1182928 - RNA, 17 nt, Human
uuauuuuuagacagagu

SEQ ID NO: 1182929 - RNA, 18 nt, Human
uuauuuuuagacagaguc

SEQ ID NO: 1182930 - RNA, 17 nt, Human
auaguggcuuaaaacaa

SEQ ID NO: 1182931 - RNA, 15 nt, Human
auaguggugugauuu

SEQ ID NO: 1182932 - RNA, 22 nt, Human
auaguuaagcgugcauaaguua

SEQ ID NO: 1182933 - RNA, 22 nt, Human
auaguuggcuaggaccccucca

SEQ ID NO: 1182934 - RNA, 20 nt, Human
auaguuguaccgcaauguga

SEQ ID NO: 1182935 - RNA, 14 nt, Human
auauauaacaaugc

SEQ ID NO: 1182936 - RNA, 12 nt, Human
auauauaaccag

SEQ ID NO: 1182937 - RNA, 13 nt, Human
auauauaaccagu

SEQ ID NO: 1182938 - RNA, 17 nt, Human
uuccagguuuaagcugu

SEQ ID NO: 1182939 - RNA, 23 nt, Human
uucccaaagcagugcaugcuguc

SEQ ID NO: 1182940 - RNA, 21 nt, Human
uuccaggggugggacacccug

SEQ ID NO: 1182941 - RNA, 13 nt, Human
uuccaggcuggga

SEQ ID NO: 1182942 - RNA, 19 nt, Human
uuccagugaggcucugccc

SEQ ID NO: 1182943 - RNA, 20 nt, Human
uuccagugaggcucugcccu

SEQ ID NO: 1182944 - RNA, 21 nt, Human
uuccagugaggcucugcccuu

SEQ ID NO: 1182945 - RNA, 22 nt, Human
uuccagugaggcucugcccuug

SEQ ID NO: 1182946 - RNA, 18 nt, Human
uucccaacuccagaaagu

SEQ ID NO: 1182947 - RNA, 13 nt, Human
uucccaagcucug

SEQ ID NO: 1182948 - RNA, 14 nt, Human
uucccaagcucugc

SEQ ID NO: 1182949 - RNA, 15 nt, Human
uucccaagcucugcu

SEQ ID NO: 1182950 - RNA, 16 nt, Human
uucccaagcucugcuc

SEQ ID NO: 1182951 - RNA, 18 nt, Human
uucccaagcucugcuccu

SEQ ID NO: 1182952 - RNA, 12 nt, Human
uucccaccucuc

SEQ ID NO: 1182953 - RNA, 22 nt, Human
uucccaccucucucacuccuug

SEQ ID NO: 1182954 - RNA, 15 nt, Human
auauguggaguucau

SEQ ID NO: 1182955 - RNA, 16 nt, Human
auauguggaguucauc

SEQ ID NO: 1182956 - RNA, 18 nt, Human
uucauuuaggugaggaag

SEQ ID NO: 1182957 - RNA, 15 nt, Human
uuccaaggguacuaa

SEQ ID NO: 1182958 - RNA, 17 nt, Human
uuccaaggguacuaagg

SEQ ID NO: 1182959 - RNA, 19 nt, Human
uuccaccaucaagccacca

SEQ ID NO: 1182960 - RNA, 16 nt, Human
auaucugaaaauguau

SEQ ID NO: 1182961 - RNA, 17 nt, Human
auaucugaaaauguaug

SEQ ID NO: 1182962 - RNA, 20 nt, Human
auaucugaaaauguaugugu

SEQ ID NO: 1182963 - RNA, 22 nt, Human
auaucugaaaauguauguguaa

SEQ ID NO: 1182964 - RNA, 14 nt, Human
auaugcacacauuu

SEQ ID NO: 1182965 - RNA, 15 nt, Human
auaugcacacauuuu

SEQ ID NO: 1182966 - RNA, 16 nt, Human
auaugcacacauuuuu

SEQ ID NO: 1182967 - RNA, 22 nt, Human
auaugcacacauuuuuuaaaug

SEQ ID NO: 1182968 - RNA, 16 nt, Human
auauguaacaagccac

SEQ ID NO: 1182969 - RNA, 17 nt, Human
auauguaacaagccacc

SEQ ID NO: 1182970 - RNA, 18 nt, Human
uucagugccuuauggaac

SEQ ID NO: 1182971 - RNA, 11 nt, Human
uucagaaaugu

SEQ ID NO: 1182972 - RNA, 13 nt, Human
uucagaaaugugu

SEQ ID NO: 1182973 - RNA, 12 nt, Human
uucagugccuua

SEQ ID NO: 1182974 - RNA, 13 nt, Human
uucagugccuuau

SEQ ID NO: 1182975 - RNA, 17 nt, Human
uucaucccucuggggcu

SEQ ID NO: 1182976 - RNA, 21 nt, Human
uucaucccucuggggcuguuc

SEQ ID NO: 1182977 - RNA, 15 nt, Human
uucccuauuagagaa

SEQ ID NO: 1182978 - RNA, 18 nt, Human
uucccuuuuuuggcugcu

SEQ ID NO: 1182979 - RNA, 19 nt, Human
uucccuuuuuuggcugcug

SEQ ID NO: 1182980 - RNA, 20 nt, Human
uucccuuuuuuggcugcuga

SEQ ID NO: 1182981 - RNA, 22 nt, Human
aucaaccccuucgcuccugugu

SEQ ID NO: 1182982 - RNA, 19 nt, Human
aucaaccccuucgcuccug

SEQ ID NO: 1182983 - RNA, 20 nt, Human
aucaaccccuucgcuccugu

SEQ ID NO: 1182984 - RNA, 21 nt, Human
uucgcaggauucuuccucccu

SEQ ID NO: 1182985 - RNA, 13 nt, Human
uucgcuccugugu

SEQ ID NO: 1182986 - RNA, 19 nt, Human
uucuaaaucuccaaaauaa

SEQ ID NO: 1182987 - RNA, 13 nt, Human
uucuaagaaguga

SEQ ID NO: 1182988 - RNA, 13 nt, Human
uucucagaaucuc

SEQ ID NO: 1182989 - RNA, 13 nt, Human
aucaggccaggcc

SEQ ID NO: 1182990 - RNA, 14 nt, Human
aucaggccaggccc

SEQ ID NO: 1182991 - RNA, 14 nt, Human
uucuauaauuuaaa

SEQ ID NO: 1182992 - RNA, 13 nt, Human
uucuauaauuuaa

SEQ ID NO: 1182993 - RNA, 21 nt, Human
aucaggccaggcccucugccc

SEQ ID NO: 1182994 - RNA, 22 nt, Human
aucaggccaggcccucugccca

SEQ ID NO: 1182995 - RNA, 23 nt, Human
aucaggccaggcccucugcccac

SEQ ID NO: 1182996 - RNA, 21 nt, Human
aucauugaaaucuuuuugcuu

SEQ ID NO: 1182997 - RNA, 16 nt, Human
uucugacccaugcugc

SEQ ID NO: 1182998 - RNA, 14 nt, Human
uucugacccaugcu

SEQ ID NO: 1182999 - RNA, 19 nt, Human
uucugcagccacuauuguu

SEQ ID NO: 1183000 - RNA, 13 nt, Human
uucugccgcagcc

SEQ ID NO: 1183001 - RNA, 17 nt, Human
uucucuacucuagggaa

SEQ ID NO: 1183002 - RNA, 12 nt, Human
uucucuaggaaa

SEQ ID NO: 1183003 - RNA, 16 nt, Human
uucucuuuucaaaaca

SEQ ID NO: 1183004 - RNA, 14 nt, Human
uucugccgcagccc

SEQ ID NO: 1183005 - RNA, 15 nt, Human
uucugccgcagcccu

SEQ ID NO: 1183006 - RNA, 18 nt, Human
uucuggcuaugcauuuga

SEQ ID NO: 1183007 - RNA, 20 nt, Human
uucuggcuaugcauuugaaa

SEQ ID NO: 1183008 - RNA, 16 nt, Human
uucugccgcagcccug

SEQ ID NO: 1183009 - RNA, 15 nt, Human
uucuggcucuuccag

SEQ ID NO: 1183010 - RNA, 14 nt, Human
auccauacauuugu

SEQ ID NO: 1183011 - RNA, 18 nt, Human
uucuguucuuucuggcua

SEQ ID NO: 1183012 - RNA, 21 nt, Human
uucuguuggccagugugacaa

SEQ ID NO: 1183013 - RNA, 20 nt, Human
uucuguuuuucuaggccugg

SEQ ID NO: 1183014 - RNA, 13 nt, Human
uucuuaauucuua

SEQ ID NO: 1183015 - RNA, 12 nt, Human
uucuugcaaagu

SEQ ID NO: 1183016 - RNA, 13 nt, Human
uucuugcaaagua

SEQ ID NO: 1183017 - RNA, 20 nt, Human
uugaaauauaggaacuuaaa

SEQ ID NO: 1183018 - RNA, 19 nt, Human
uugaaauauugacuuuuua

SEQ ID NO: 1183019 - RNA, 11 nt, Human
uugaaaucuuu

SEQ ID NO: 1183020 - RNA, 21 nt, Human
uugaaauuuuuauuaaauuau

SEQ ID NO: 1183021 - RNA, 13 nt, Human
auccuaguuccac

SEQ ID NO: 1183022 - RNA, 18 nt, Human
uugaacccgggaggcaga

SEQ ID NO: 1183023 - RNA, 20 nt, Human
aucucaccuccugcugggca

SEQ ID NO: 1183024 - RNA, 21 nt, Human
aucucaccuccugcugggcag

SEQ ID NO: 1183025 - RNA, 14 nt, Human
aucucagggccugg

SEQ ID NO: 1183026 - RNA, 15 nt, Human
auccuaguuccacca

SEQ ID NO: 1183027 - RNA, 19 nt, Human
auccuaguuccaccaucaa

SEQ ID NO: 1183028 - RNA, 15 nt, Human
aucucacacaugagc

SEQ ID NO: 1183029 - RNA, 16 nt, Human
aucucacacaugagca

SEQ ID NO: 1183030 - RNA, 21 nt, Human
aucucauuuccaagcaaguau

SEQ ID NO: 1183031 - RNA, 23 nt, Human
aucucauuuccaagcaaguauua

SEQ ID NO: 1183032 - RNA, 13 nt, Human
aucuccaaaauaa

SEQ ID NO: 1183033 - RNA, 12 nt, Human
aucucccccagc

SEQ ID NO: 1183034 - RNA, 13 nt, Human
aucucccccagcc

SEQ ID NO: 1183035 - RNA, 14 nt, Human
aucucccccagccc

SEQ ID NO: 1183036 - RNA, 18 nt, Human
uugauggugguauguuuu

SEQ ID NO: 1183037 - RNA, 19 nt, Human
uugauggugguauguuuuc

SEQ ID NO: 1183038 - RNA, 14 nt, Human
uugauucagacagc

SEQ ID NO: 1183039 - RNA, 15 nt, Human
uugauucagacagcu

SEQ ID NO: 1183040 - RNA, 16 nt, Human
uugauucagacagcug

SEQ ID NO: 1183041 - RNA, 14 nt, Human
uugcaccacugcac

SEQ ID NO: 1183042 - RNA, 12 nt, Human
uugcaugaggcu

SEQ ID NO: 1183043 - RNA, 13 nt, Human
uugccgucuaccu

SEQ ID NO: 1183044 - RNA, 15 nt, Human
uugccgucuaccuga

SEQ ID NO: 1183045 - RNA, 18 nt, Human
uugccgucuaccugaggg

SEQ ID NO: 1183046 - RNA, 19 nt, Human
uugccgucuaccugagggg

SEQ ID NO: 1183047 - RNA, 14 nt, Human
uugccguuauuaaa

SEQ ID NO: 1183048 - RNA, 19 nt, Human
aucuggguucacugcaacc

SEQ ID NO: 1183049 - RNA, 18 nt, Human
aucuugaauuguaaggaa

SEQ ID NO: 1183050 - RNA, 19 nt, Human
aucuugcucugcugacaga

SEQ ID NO: 1183051 - RNA, 15 nt, Human
augaaagcagggacu

SEQ ID NO: 1183052 - RNA, 13 nt, Human
uuggcugcaggga

SEQ ID NO: 1183053 - RNA, 23 nt, Human
uuggcgcugccccuggcagcccc

SEQ ID NO: 1183054 - RNA, 18 nt, Human
uuggcuagagguucaaag

SEQ ID NO: 1183055 - RNA, 15 nt, Human
augaauuaaguuuuu

SEQ ID NO: 1183056 - RNA, 22 nt, Human
uuggggggcugaggugggagga

SEQ ID NO: 1183057 - RNA, 18 nt, Human
augaagauguagaggaga

SEQ ID NO: 1183058 - RNA, 17 nt, Human
augaaauauuauguuaa

SEQ ID NO: 1183059 - RNA, 18 nt, Human
augaaauauuauguuaaa

SEQ ID NO: 1183060 - RNA, 15 nt, Human
augaaagggcccaga

SEQ ID NO: 1183061 - RNA, 20 nt, Human
augaaauauuauguuaaaac

SEQ ID NO: 1183062 - RNA, 22 nt, Human
augacuuaagcacacuugacau

SEQ ID NO: 1183063 - RNA, 14 nt, Human
augacuuacuguac

SEQ ID NO: 1183064 - RNA, 18 nt, Human
augacacgaauauugcug

SEQ ID NO: 1183065 - RNA, 16 nt, Human
augacuuacuguacau

SEQ ID NO: 1183066 - RNA, 17 nt, Human
augacuuacuguacaug

SEQ ID NO: 1183067 - RNA, 21 nt, Human
augagaaagguugaagcacca

SEQ ID NO: 1183068 - RNA, 22 nt, Human
augagaaagguugaagcaccaa

SEQ ID NO: 1183069 - RNA, 13 nt, Human
augagagacacac

SEQ ID NO: 1183070 - RNA, 14 nt, Human
augagagacacacu

SEQ ID NO: 1183071 - RNA, 17 nt, Human
augagagacacacugaa

SEQ ID NO: 1183072 - RNA, 19 nt, Human
augagagacacacugaaga

SEQ ID NO: 1183073 - RNA, 16 nt, Human
uuguauaaaauaauuu

SEQ ID NO: 1183074 - RNA, 17 nt, Human
uuguauaaaauaauuuu

SEQ ID NO: 1183075 - RNA, 23 nt, Human
uuguaguguuggagaagaacuga

SEQ ID NO: 1183076 - RNA, 19 nt, Human
uuguauaaaauaauuuuua

SEQ ID NO: 1183077 - RNA, 14 nt, Human
augacacaugcaag

SEQ ID NO: 1183078 - RNA, 22 nt, Human
augacacaugcaaggucauuuu

SEQ ID NO: 1183079 - RNA, 12 nt, Human
augauucccagc

SEQ ID NO: 1183080 - RNA, 21 nt, Human
augauucaacagguuuuccug

SEQ ID NO: 1183081 - RNA, 19 nt, Human
augauuaaccacuucagcu

SEQ ID NO: 1183082 - RNA, 20 nt, Human
augauuaaccacuucagcug

SEQ ID NO: 1183083 - RNA, 21 nt, Human
augauuaaccacuucagcuga

SEQ ID NO: 1183084 - RNA, 14 nt, Human
augauuaaguaaug

SEQ ID NO: 1183085 - RNA, 22 nt, Human
augauuaugaauuacauuugua

SEQ ID NO: 1183086 - RNA, 13 nt, Human
augcaccagcccu

SEQ ID NO: 1183087 - RNA, 14 nt, Human
augcaccagcccuu

SEQ ID NO: 1183088 - RNA, 12 nt, Human
augcacuuuguu

SEQ ID NO: 1183089 - RNA, 13 nt, Human
uugugguuaaucu

SEQ ID NO: 1183090 - RNA, 23 nt, Human
uugugugaaagguacuucaaauc

SEQ ID NO: 1183091 - RNA, 17 nt, Human
uuguguguuuauuguca

SEQ ID NO: 1183092 - RNA, 19 nt, Human
uuguucuggcucuuccagg

SEQ ID NO: 1183093 - RNA, 20 nt, Human
uuguucuggcucuuccaggc

SEQ ID NO: 1183094 - RNA, 22 nt, Human
uuguucuggcucuuccaggcug

SEQ ID NO: 1183095 - RNA, 18 nt, Human
uugugauacaaugcugug

SEQ ID NO: 1183096 - RNA, 19 nt, Human
uugugauacaaugcugugc

SEQ ID NO: 1183097 - RNA, 20 nt, Human
augagagacacacugaagaa

SEQ ID NO: 1183098 - RNA, 21 nt, Human
augagagacacacugaagaag

SEQ ID NO: 1183099 - RNA, 23 nt, Human
augagagacacacugaagaagca

SEQ ID NO: 1183100 - RNA, 13 nt, Human
augcagugcuucc

SEQ ID NO: 1183101 - RNA, 17 nt, Human
augcaguucugaagaag

SEQ ID NO: 1183102 - RNA, 19 nt, Human
uuuaauuuuuuugagacag

SEQ ID NO: 1183103 - RNA, 13 nt, Human
augcagccucaca

SEQ ID NO: 1183104 - RNA, 14 nt, Human
augcagccucacag

SEQ ID NO: 1183105 - RNA, 15 nt, Human
augcagccucacagu

SEQ ID NO: 1183106 - RNA, 17 nt, Human
augcagccucacagucc

SEQ ID NO: 1183107 - RNA, 18 nt, Human
augcaguucugaagaaga

SEQ ID NO: 1183108 - RNA, 19 nt, Human
augcaguucugaagaagau

SEQ ID NO: 1183109 - RNA, 15 nt, Human
augccacuaaauuga

SEQ ID NO: 1183110 - RNA, 17 nt, Human
augccacuaaauugaca

SEQ ID NO: 1183111 - RNA, 11 nt, Human
augcccagccc

SEQ ID NO: 1183112 - RNA, 17 nt, Human
uuuaagugcugcauuua

SEQ ID NO: 1183113 - RNA, 19 nt, Human
uuuaagugcugcauuuaaa

SEQ ID NO: 1183114 - RNA, 15 nt, Human
uuuaagugcugcauu

SEQ ID NO: 1183115 - RNA, 16 nt, Human
uuuaagugcugcauuu

SEQ ID NO: 1183116 - RNA, 15 nt, Human
augcacuuuguucug

SEQ ID NO: 1183117 - RNA, 16 nt, Human
augcacuuuguucugg

SEQ ID NO: 1183118 - RNA, 13 nt, Human
uuguuuucagugu

SEQ ID NO: 1183119 - RNA, 16 nt, Human
uuguuuucaguguaca

SEQ ID NO: 1183120 - RNA, 22 nt, Human
uuuagcuggaaaaguauguuag

SEQ ID NO: 1183121 - RNA, 24 nt, Human
uuuauggcuuuugugcauuaucua

SEQ ID NO: 1183122 - RNA, 13 nt, Human
uuuauauaagcuu

SEQ ID NO: 1183123 - RNA, 15 nt, Human
augcuagaacucccu

SEQ ID NO: 1183124 - RNA, 16 nt, Human
augcuagaacucccuu

SEQ ID NO: 1183125 - RNA, 19 nt, Human
augcuagaacucccuuuca

SEQ ID NO: 1183126 - RNA, 16 nt, Human
uuuauuacuguaagaa

SEQ ID NO: 1183127 - RNA, 15 nt, Human
augcucugcauguua

SEQ ID NO: 1183128 - RNA, 19 nt, Human
augcugucccuuacgugag

SEQ ID NO: 1183129 - RNA, 23 nt, Human
augcugucccuuacgugaguccu

SEQ ID NO: 1183130 - RNA, 22 nt, Human
augcugucuacacuaagagaga

SEQ ID NO: 1183131 - RNA, 23 nt, Human
augcugucuacacuaagagagaa

SEQ ID NO: 1183132 - RNA, 14 nt, Human
auggaacacucuga

SEQ ID NO: 1183133 - RNA, 15 nt, Human
auggaacacucugag

SEQ ID NO: 1183134 - RNA, 16 nt, Human
auggaacacucugaga

SEQ ID NO: 1183135 - RNA, 17 nt, Human
auggaacacucugagac

SEQ ID NO: 1183136 - RNA, 15 nt, Human
auggaagacagcucu

SEQ ID NO: 1183137 - RNA, 16 nt, Human
auggaagacagcucuu

SEQ ID NO: 1183138 - RNA, 14 nt, Human
auggacaugaucuu

SEQ ID NO: 1183139 - RNA, 19 nt, Human
auggacaugaucuucuuua

SEQ ID NO: 1183140 - RNA, 17 nt, Human
auggcacaucagcacga

SEQ ID NO: 1183141 - RNA, 23 nt, Human
auggcacaucagcacgauuucug

SEQ ID NO: 1183142 - RNA, 19 nt, Human
auggacguguuaugacucc

SEQ ID NO: 1183143 - RNA, 20 nt, Human
auggacguguuaugacucca

SEQ ID NO: 1183144 - RNA, 23 nt, Human
auggacguguuaugacuccagaa

SEQ ID NO: 1183145 - RNA, 19 nt, Human
auggacuaacuugucuuug

SEQ ID NO: 1183146 - RNA, 21 nt, Human
auggccgggcgcgguggcuca

SEQ ID NO: 1183147 - RNA, 20 nt, Human
auggcuaguaucaaaagaaa

SEQ ID NO: 1183148 - RNA, 16 nt, Human
auguccacugguucuu

SEQ ID NO: 1183149 - RNA, 16 nt, Human
augucagugugacuga

SEQ ID NO: 1183150 - RNA, 21 nt, Human
augucagugugacugaucucu

SEQ ID NO: 1183151 - RNA, 19 nt, Human
auguccaagaagcccagga

SEQ ID NO: 1183152 - RNA, 23 nt, Human
auguccaagaagcccaggaaagg

SEQ ID NO: 1183153 - RNA, 22 nt, Human
uuugggggaaaauuuagaaaua

SEQ ID NO: 1183154 - RNA, 15 nt, Human
auguaucugagcagg

SEQ ID NO: 1183155 - RNA, 12 nt, Human
auguauguguaa

SEQ ID NO: 1183156 - RNA, 15 nt, Human
auguauguguaagua

SEQ ID NO: 1183157 - RNA, 13 nt, Human
uuugcucauggaa

SEQ ID NO: 1183158 - RNA, 22 nt, Human
uuugggaggccaaggugggagg

SEQ ID NO: 1183159 - RNA, 14 nt, Human
uuuggggauauuuu

SEQ ID NO: 1183160 - RNA, 11 nt, Human
uuugcucaugg

SEQ ID NO: 1183161 - RNA, 12 nt, Human
uuugcucaugga

SEQ ID NO: 1183162 - RNA, 13 nt, Human
uuuguagagccag

SEQ ID NO: 1183163 - RNA, 18 nt, Human
uuugugaggaagccgcug

SEQ ID NO: 1183164 - RNA, 19 nt, Human
uuugugaggaagccgcugg

SEQ ID NO: 1183165 - RNA, 15 nt, Human
uuugugauacaaugc

SEQ ID NO: 1183166 - RNA, 12 nt, Human
uuuguuugaacu

SEQ ID NO: 1183167 - RNA, 13 nt, Human
uuuguuugaacug

SEQ ID NO: 1183168 - RNA, 14 nt, Human
uuuguuugaacuga

SEQ ID NO: 1183169 - RNA, 14 nt, Human
uuuuaaaagaauga

SEQ ID NO: 1183170 - RNA, 15 nt, Human
uuuuaaaagaaugau

SEQ ID NO: 1183171 - RNA, 18 nt, Human
uuuguuugaacugauaaa

SEQ ID NO: 1183172 - RNA, 13 nt, Human
uuuuaaaaaagaa

SEQ ID NO: 1183173 - RNA, 15 nt, Human
uuuuaagugcugcau

SEQ ID NO: 1183174 - RNA, 15 nt, Human
uuuuaagaggcaggg

SEQ ID NO: 1183175 - RNA, 16 nt, Human
uuuuaagaggcagggu

SEQ ID NO: 1183176 - RNA, 15 nt, Human
auguugacaugggac

SEQ ID NO: 1183177 - RNA, 19 nt, Human
auguucaucaaugaaugaa

SEQ ID NO: 1183178 - RNA, 21 nt, Human
auguucaucauccuaagcuau

SEQ ID NO: 1183179 - RNA, 16 nt, Human
uuuuaagugcugcauu

SEQ ID NO: 1183180 - RNA, 17 nt, Human
uuuuaagugcugcauuu

SEQ ID NO: 1183181 - RNA, 21 nt, Human
uuuuaagugcugcauuuaaaa

SEQ ID NO: 1183182 - RNA, 16 nt, Human
auguuggccaggcugg

SEQ ID NO: 1183183 - RNA, 14 nt, Human
auguuggccaggcu

SEQ ID NO: 1183184 - RNA, 12 nt, Human
uuuuauaaacuu

SEQ ID NO: 1183185 - RNA, 13 nt, Human
uuuuauaaacuuu

SEQ ID NO: 1183186 - RNA, 21 nt, Human
uuuuauaauuuugugaagcaa

SEQ ID NO: 1183187 - RNA, 22 nt, Human
uuuuauggcacuaguauuucua

SEQ ID NO: 1183188 - RNA, 19 nt, Human
uuuuauggcacuaguauuu

SEQ ID NO: 1183189 - RNA, 14 nt, Human
uuuuauaaacuuua

SEQ ID NO: 1183190 - RNA, 17 nt, Human
uuuuauaaacuuuaccu

SEQ ID NO: 1183191 - RNA, 19 nt, Human
uuuuauaaacuuuaccuuu

SEQ ID NO: 1183192 - RNA, 14 nt, Human
uuuuauaauuuugu

SEQ ID NO: 1183193 - RNA, 19 nt, Human
uuuuccagguuuaagcugu

SEQ ID NO: 1183194 - RNA, 18 nt, Human
uuuuccaugaguccccug

SEQ ID NO: 1183195 - RNA, 18 nt, Human
auguuucaaacauauaua

SEQ ID NO: 1183196 - RNA, 21 nt, Human
auguuucaaacauauauaaca

SEQ ID NO: 1183197 - RNA, 14 nt, Human
auguuuuccaugag

SEQ ID NO: 1183198 - RNA, 18 nt, Human
auguuuuucuucucccuc

SEQ ID NO: 1183199 - RNA, 15 nt, Human
auuaaaaaucucaaa

SEQ ID NO: 1183200 - RNA, 17 nt, Human
auuaaacuuaaucuaaa

SEQ ID NO: 1183201 - RNA, 19 nt, Human
auuaaacuuaaucuaaaug

SEQ ID NO: 1183202 - RNA, 21 nt, Human
auuaaacuuaaucuaaaugga

SEQ ID NO: 1183203 - RNA, 17 nt, Human
auuaaccacuucagcug

SEQ ID NO: 1183204 - RNA, 18 nt, Human
auuaaccacuucagcuga

SEQ ID NO: 1183205 - RNA, 20 nt, Human
auuaaccacuucagcugacu

SEQ ID NO: 1183206 - RNA, 12 nt, Human
auuaacuuuuau

SEQ ID NO: 1183207 - RNA, 16 nt, Human
auuaacuuuuauaaac

SEQ ID NO: 1183208 - RNA, 17 nt, Human
auuaacuuuuauaaacu

SEQ ID NO: 1183209 - RNA, 19 nt, Human
auuaacuuuuauaaacuuu

SEQ ID NO: 1183210 - RNA, 20 nt, Human
auuaacuuuuauaaacuuua

SEQ ID NO: 1183211 - RNA, 23 nt, Human
auuaacuuuuauaaacuuuaccu

SEQ ID NO: 1183212 - RNA, 13 nt, Human
auuaagaaagacu

SEQ ID NO: 1183213 - RNA, 14 nt, Human
auuaagaaagacua

SEQ ID NO: 1183214 - RNA, 14 nt, Human
auucagcucugcaa

SEQ ID NO: 1183215 - RNA, 18 nt, Human
auucagcucugcaagaau

SEQ ID NO: 1183216 - RNA, 21 nt, Human
auucaggaagcucagggccug

SEQ ID NO: 1183217 - RNA, 22 nt, Human
auucaggaagcucagggccugg

SEQ ID NO: 1183218 - RNA, 23 nt, Human
auucaggaagcucagggccuggc

SEQ ID NO: 1183219 - RNA, 21 nt, Human
auucaguuguuagugugucuu

SEQ ID NO: 1183220 - RNA, 14 nt, Human
auucauaaugacuu

SEQ ID NO: 1183221 - RNA, 20 nt, Human
auuccacuuauaggaauuga

SEQ ID NO: 1183222 - RNA, 20 nt, Human
auuccccagauugcaacagg

SEQ ID NO: 1183223 - RNA, 16 nt, Human
auuccccaggaggcca

SEQ ID NO: 1183224 - RNA, 19 nt, Human
auuccccaggaggccagcc

SEQ ID NO: 1183225 - RNA, 17 nt, Human
auuauauuuacaaaugg

SEQ ID NO: 1183226 - RNA, 23 nt, Human
auuauuuauuaaaugcccagccc

SEQ ID NO: 1183227 - RNA, 16 nt, Human
auuauauuuacaaaug

SEQ ID NO: 1183228 - RNA, 23 nt, Human
uuuuuuaaaaaagaaacauuugg

SEQ ID NO: 1183229 - RNA, 13 nt, Human
auuaaguaaugau

SEQ ID NO: 1183230 - RNA, 15 nt, Human
auuaaguaaugauaa

SEQ ID NO: 1183231 - RNA, 21 nt, Human
auuaaguaaugauaacuggaa

SEQ ID NO: 1183232 - RNA, 13 nt, Human
auuacauuuguau

SEQ ID NO: 1183233 - RNA, 15 nt, Human
auuacauuuguauaa

SEQ ID NO: 1183234 - RNA, 16 nt, Human
auuacauuuguauaaa

SEQ ID NO: 1183235 - RNA, 19 nt, Human
auuaccacagacauacuaa

SEQ ID NO: 1183236 - RNA, 12 nt, Human
auuaccagggac

SEQ ID NO: 1183237 - RNA, 22 nt, Human
auuaccugaauuuuggcugugu

SEQ ID NO: 1183238 - RNA, 23 nt, Human
auugccauuucuuccacaagagc

SEQ ID NO: 1183239 - RNA, 17 nt, Human
auugcccacgcuggagu

SEQ ID NO: 1183240 - RNA, 21 nt, Human
auugcccacgcuggagugcag

SEQ ID NO: 1183241 - RNA, 16 nt, Human
auugcggacagccacg

SEQ ID NO: 1183242 - RNA, 18 nt, Human
auugcggacagccacggc

SEQ ID NO: 1183243 - RNA, 19 nt, Human
auugcggacagccacggcc

SEQ ID NO: 1183244 - RNA, 18 nt, Human
auugacaggauuauugga

SEQ ID NO: 1183245 - RNA, 13 nt, Human
auugaccugaggc

SEQ ID NO: 1183246 - RNA, 17 nt, Human
auugaccugaggcccuu

SEQ ID NO: 1183247 - RNA, 15 nt, Human
auugcaacaggcugg

SEQ ID NO: 1183248 - RNA, 16 nt, Human
auugcaacaggcuggg

SEQ ID NO: 1183249 - RNA, 21 nt, Human
auugcaacaggcugggcuuca

SEQ ID NO: 1183250 - RNA, 18 nt, Human
auucuccaccugccaggg

SEQ ID NO: 1183251 - RNA, 13 nt, Human
auucuacuuugag

SEQ ID NO: 1183252 - RNA, 16 nt, Human
auucuacuuugagugc

SEQ ID NO: 1183253 - RNA, 14 nt, Human
auucucagaaucuc

SEQ ID NO: 1183254 - RNA, 18 nt, Human
auucucagaaucucaaau

SEQ ID NO: 1183255 - RNA, 20 nt, Human
auucucagaaucucaaauaa

SEQ ID NO: 1183256 - RNA, 13 nt, Human
auucuccaccugc

SEQ ID NO: 1183257 - RNA, 16 nt, Human
auucuccaccugccag

SEQ ID NO: 1183258 - RNA, 17 nt, Human
auucuccaccugccagg

SEQ ID NO: 1183259 - RNA, 14 nt, Human
auugcuacuguccu

SEQ ID NO: 1183260 - RNA, 22 nt, Human
auuuacaacugggggaggguga

SEQ ID NO: 1183261 - RNA, 16 nt, Human
auuuacaaaugggaaa

SEQ ID NO: 1183262 - RNA, 19 nt, Human
auuuaauuuuuuugagaca

SEQ ID NO: 1183263 - RNA, 23 nt, Human
auuuaauuuuuuugagacagagu

SEQ ID NO: 1183264 - RNA, 21 nt, Human
auuguuuggggaugagaaagg

SEQ ID NO: 1183265 - RNA, 16 nt, Human
auuuaacagaaaugua

SEQ ID NO: 1183266 - RNA, 17 nt, Human
auuuaacagaaauguac

SEQ ID NO: 1183267 - RNA, 19 nt, Human
auuuaacagaaauguacag

SEQ ID NO: 1183268 - RNA, 20 nt, Human
auuuaacagaaauguacagc

SEQ ID NO: 1183269 - RNA, 15 nt, Human
auuguauuacaaauc

SEQ ID NO: 1183270 - RNA, 14 nt, Human
auuguauuacaaau

SEQ ID NO: 1183271 - RNA, 13 nt, Human
auugugccccugc

SEQ ID NO: 1183272 - RNA, 23 nt, Human
auuggcuuuggguugcaggaccu

SEQ ID NO: 1183273 - RNA, 13 nt, Human
auuuaaaagauac

SEQ ID NO: 1183274 - RNA, 23 nt, Human
auuucuuuugccguuauuaaaaa

SEQ ID NO: 1183275 - RNA, 20 nt, Human
auuuauuaaaugcccagccc

SEQ ID NO: 1183276 - RNA, 22 nt, Human
auuuauuacuguaagaaaauau

SEQ ID NO: 1183277 - RNA, 22 nt, Human
auuuauuaaaugcccagccccu

SEQ ID NO: 1183278 - RNA, 13 nt, Human
auuuauuauggca

SEQ ID NO: 1183279 - RNA, 16 nt, Human
auuuauuauggcacau

SEQ ID NO: 1183280 - RNA, 14 nt, Human
auuuccugugucuu

SEQ ID NO: 1183281 - RNA, 12 nt, Human
auuucuaaaucu

SEQ ID NO: 1183282 - RNA, 13 nt, Human
auuucuaaaucuc

SEQ ID NO: 1183283 - RNA, 21 nt, Human
auuucuaaaucuccaaaauaa

SEQ ID NO: 1183284 - RNA, 20 nt, Human
auuucuuuugccguuauuaa

SEQ ID NO: 1183285 - RNA, 17 nt, Human
auuugagcagggcucag

SEQ ID NO: 1183286 - RNA, 15 nt, Human
auuugaggucuguuc

SEQ ID NO: 1183287 - RNA, 23 nt, Human
auuugaggucuguucuuuccaaa

SEQ ID NO: 1183288 - RNA, 23 nt, Human
auuugguaaggggaauugaggac

SEQ ID NO: 1183289 - RNA, 17 nt, Human
auuuggugguuucagaa

SEQ ID NO: 1183290 - RNA, 18 nt, Human
auuuggugguuucagaaa

SEQ ID NO: 1183291 - RNA, 20 nt, Human
auuuggugguuucagaaaug

SEQ ID NO: 1183292 - RNA, 21 nt, Human
auuuggugguuucagaaaugu

SEQ ID NO: 1183293 - RNA, 18 nt, Human
auuuguaguguuggagaa

SEQ ID NO: 1183294 - RNA, 19 nt, Human
auuuguaguguuggagaag

SEQ ID NO: 1183295 - RNA, 14 nt, Human
auuuuaauaauguu

SEQ ID NO: 1183296 - RNA, 15 nt, Human
auuuuaauaauguuu

SEQ ID NO: 1183297 - RNA, 16 nt, Human
auuuuaauaauguuuc

SEQ ID NO: 1183298 - RNA, 21 nt, Human
auuuuacuuuaaaaggagcca

SEQ ID NO: 1183299 - RNA, 13 nt, Human
auuuuauuaugca

SEQ ID NO: 1183300 - RNA, 14 nt, Human
auuuuauuaugcau

SEQ ID NO: 1183301 - RNA, 15 nt, Human
auuuuauuaugcaug

SEQ ID NO: 1183302 - RNA, 17 nt, Human
auuuuauuaugcaugaa

SEQ ID NO: 1183303 - RNA, 21 nt, Human
cauaaugcgugcauaccacuu

SEQ ID NO: 1183304 - RNA, 23 nt, Human
cauaaugcgugcauaccacuuuu

SEQ ID NO: 1183305 - RNA, 15 nt, Human
cauacaauuccaaac

SEQ ID NO: 1183306 - RNA, 12 nt, Human
cauacacacaca

SEQ ID NO: 1183307 - RNA, 14 nt, Human
cauacacacacaca

SEQ ID NO: 1183308 - RNA, 15 nt, Human
cauacacacacacac

SEQ ID NO: 1183309 - RNA, 16 nt, Human
cauacacacacacaca

SEQ ID NO: 1183310 - RNA, 19 nt, Human
cauacacacacacacacag

SEQ ID NO: 1183311 - RNA, 20 nt, Human
cauacacacacacacacagc

SEQ ID NO: 1183312 - RNA, 22 nt, Human
cauauuaccacagacauacuaa

SEQ ID NO: 1183313 - RNA, 17 nt, Human
cauauuaccacagacau

SEQ ID NO: 1183314 - RNA, 20 nt, Human
cauauuaccacagacauacu

SEQ ID NO: 1183315 - RNA, 21 nt, Human
cauauuaccacagacauacua

SEQ ID NO: 1183316 - RNA, 21 nt, Human
caguuuguuaguaugaggcau

SEQ ID NO: 1183317 - RNA, 14 nt, Human
cauaaugcgugcau

SEQ ID NO: 1183318 - RNA, 17 nt, Human
cauaaugcgugcauacc

SEQ ID NO: 1183319 - RNA, 19 nt, Human
cagucaccccggccaccug

SEQ ID NO: 1183320 - RNA, 18 nt, Human
cagucaccccggccaccu

SEQ ID NO: 1183321 - RNA, 16 nt, Human
caugcugcccugugag

SEQ ID NO: 1183322 - RNA, 18 nt, Human
caugcugcccugugagua

SEQ ID NO: 1183323 - RNA, 17 nt, Human
caugcaaggucauuuuu

SEQ ID NO: 1183324 - RNA, 18 nt, Human
caugcaaggucauuuuuu

SEQ ID NO: 1183325 - RNA, 22 nt, Human
caugcaaggucauuuuuuuuaa

SEQ ID NO: 1183326 - RNA, 16 nt, Human
caugaauuaguuuuau

SEQ ID NO: 1183327 - RNA, 14 nt, Human
caugacacgaauau

SEQ ID NO: 1183328 - RNA, 17 nt, Human
caugacacgaauauugc

SEQ ID NO: 1183329 - RNA, 18 nt, Human
caugacacgaauauugcu

SEQ ID NO: 1183330 - RNA, 21 nt, Human
caugacacgaauauugcugau

SEQ ID NO: 1183331 - RNA, 18 nt, Human
caucugugaaaggaaaga

SEQ ID NO: 1183332 - RNA, 19 nt, Human
caucugugaaaggaaagag

SEQ ID NO: 1183333 - RNA, 21 nt, Human
caucuuagguuggcaaaaagg

SEQ ID NO: 1183334 - RNA, 22 nt, Human
caucuuagguuggcaaaaaggc

SEQ ID NO: 1183335 - RNA, 17 nt, Human
caucagcacgauuucug

SEQ ID NO: 1183336 - RNA, 18 nt, Human
caucagcacgauuucugu

SEQ ID NO: 1183337 - RNA, 19 nt, Human
caucagcacgauuucuguu

SEQ ID NO: 1183338 - RNA, 13 nt, Human
caucaggccaggc

SEQ ID NO: 1183339 - RNA, 14 nt, Human
caucaggccaggcc

SEQ ID NO: 1183340 - RNA, 21 nt, Human
caucaggccaggcccucugcc

SEQ ID NO: 1183341 - RNA, 22 nt, Human
caucaggccaggcccucugccc

SEQ ID NO: 1183342 - RNA, 23 nt, Human
caucaggccaggcccucugccca

SEQ ID NO: 1183343 - RNA, 13 nt, Human
caucccagcccca

SEQ ID NO: 1183344 - RNA, 14 nt, Human
caucccagccccaa

SEQ ID NO: 1183345 - RNA, 16 nt, Human
caucccagccccaaug

SEQ ID NO: 1183346 - RNA, 17 nt, Human
caucccagccccaauga

SEQ ID NO: 1183347 - RNA, 16 nt, Human
cauuuauucugcucac

SEQ ID NO: 1183348 - RNA, 12 nt, Human
cauuuccaagca

SEQ ID NO: 1183349 - RNA, 22 nt, Human
cauuuggugguuucagaaaugu

SEQ ID NO: 1183350 - RNA, 23 nt, Human
cauuuggugguuucagaaaugug

SEQ ID NO: 1183351 - RNA, 17 nt, Human
ccaaaacucuccucugc

SEQ ID NO: 1183352 - RNA, 14 nt, Human
cauugcggacagcc

SEQ ID NO: 1183353 - RNA, 15 nt, Human
cauugcggacagcca

SEQ ID NO: 1183354 - RNA, 17 nt, Human
cauugcggacagccacg

SEQ ID NO: 1183355 - RNA, 21 nt, Human
cauugcggacagccacggcca

SEQ ID NO: 1183356 - RNA, 18 nt, Human
cauugcugggcuugucug

SEQ ID NO: 1183357 - RNA, 18 nt, Human
cauuaucuagauacugua

SEQ ID NO: 1183358 - RNA, 16 nt, Human
cauucuccuuguguua

SEQ ID NO: 1183359 - RNA, 20 nt, Human
cauucuccuuguguuacuaa

SEQ ID NO: 1183360 - RNA, 22 nt, Human
cauggcugccaaugggagcuca

SEQ ID NO: 1183361 - RNA, 15 nt, Human
cauguucucugagga

SEQ ID NO: 1183362 - RNA, 15 nt, Human
cauuaggauggcuag

SEQ ID NO: 1183363 - RNA, 16 nt, Human
cauuaucuagauacug

SEQ ID NO: 1183364 - RNA, 17 nt, Human
cauuaucuagauacugu

SEQ ID NO: 1183365 - RNA, 20 nt, Human
ccaaaacucuccucugcugc

SEQ ID NO: 1183366 - RNA, 20 nt, Human
ccaauguucucucuucucca

SEQ ID NO: 1183367 - RNA, 20 nt, Human
ccaaugcacuuuguucuggc

SEQ ID NO: 1183368 - RNA, 22 nt, Human
ccaaugcacuuuguucuggcuc

SEQ ID NO: 1183369 - RNA, 23 nt, Human
ccaaugcacuuuguucuggcucu

SEQ ID NO: 1183370 - RNA, 18 nt, Human
ccaccgcagacaggacca

SEQ ID NO: 1183371 - RNA, 19 nt, Human
ccaccgcagacaggaccag

SEQ ID NO: 1183372 - RNA, 14 nt, Human
ccaccuuggcucaa

SEQ ID NO: 1183373 - RNA, 15 nt, Human
ccaccuuggcucaag

SEQ ID NO: 1183374 - RNA, 20 nt, Human
ccaccaucaagccaccaaca

SEQ ID NO: 1183375 - RNA, 18 nt, Human
ccaccaucaccagacagg

SEQ ID NO: 1183376 - RNA, 14 nt, Human
ccaccgcagacagg

SEQ ID NO: 1183377 - RNA, 17 nt, Human
ccaccgcagacaggacc

SEQ ID NO: 1183378 - RNA, 23 nt, Human
ccacagaaaagaaaguucaugcu

SEQ ID NO: 1183379 - RNA, 16 nt, Human
ccaccaucaagccacc

SEQ ID NO: 1183380 - RNA, 17 nt, Human
ccaccaucaagccacca

SEQ ID NO: 1183381 - RNA, 16 nt, Human
cagggagggcuucugc

SEQ ID NO: 1183382 - RNA, 20 nt, Human
cagggcucagcggggacagc

SEQ ID NO: 1183383 - RNA, 12 nt, Human
cagggcucagcg

SEQ ID NO: 1183384 - RNA, 15 nt, Human
cagggcucagcgggg

SEQ ID NO: 1183385 - RNA, 14 nt, Human
caggcugggcuuca

SEQ ID NO: 1183386 - RNA, 15 nt, Human
caggcugggcuucag

SEQ ID NO: 1183387 - RNA, 22 nt, Human
cagggaggacgcucucuggccu

SEQ ID NO: 1183388 - RNA, 20 nt, Human
caggccugggggcugggcag

SEQ ID NO: 1183389 - RNA, 22 nt, Human
caggccugggggcugggcagag

SEQ ID NO: 1183390 - RNA, 23 nt, Human
caggccugggggcugggcagagg

SEQ ID NO: 1183391 - RNA, 17 nt, Human
caggcuggcgugcagug

SEQ ID NO: 1183392 - RNA, 18 nt, Human
caggcuggcgugcagugg

SEQ ID NO: 1183393 - RNA, 19 nt, Human
caggcuggcgugcaguggu

SEQ ID NO: 1183394 - RNA, 16 nt, Human
caggcugggagagccu

SEQ ID NO: 1183395 - RNA, 18 nt, Human
caggcugggagagccuuc

SEQ ID NO: 1183396 - RNA, 19 nt, Human
caggcugggagagccuucc

SEQ ID NO: 1183397 - RNA, 20 nt, Human
caggcugggagagccuucca

SEQ ID NO: 1183398 - RNA, 23 nt, Human
cagguuuuuggucugacccacug

SEQ ID NO: 1183399 - RNA, 17 nt, Human
caggguuggccccugcc

SEQ ID NO: 1183400 - RNA, 21 nt, Human
caggguuggccccugcccggc

SEQ ID NO: 1183401 - RNA, 13 nt, Human
caggugcugccau

SEQ ID NO: 1183402 - RNA, 14 nt, Human
caggugcugccauc

SEQ ID NO: 1183403 - RNA, 18 nt, Human
caguaaaugggggugcau

SEQ ID NO: 1183404 - RNA, 19 nt, Human
caguaaaugggggugcauu

SEQ ID NO: 1183405 - RNA, 20 nt, Human
caguaaaugggggugcauuu

SEQ ID NO: 1183406 - RNA, 16 nt, Human
cagucaccccggccac

SEQ ID NO: 1183407 - RNA, 17 nt, Human
cagucaccccggccacc

SEQ ID NO: 1183408 - RNA, 23 nt, Human
cagggucucacucugucgcccag

SEQ ID NO: 1183409 - RNA, 21 nt, Human
cagggucucuaccauccccug

SEQ ID NO: 1183410 - RNA, 15 nt, Human
caggguuggccccug

SEQ ID NO: 1183411 - RNA, 16 nt, Human
caggguuggccccugc

SEQ ID NO: 1183412 - RNA, 21 nt, Human
caggcaaugcuggcuguuggc

SEQ ID NO: 1183413 - RNA, 14 nt, Human
caggaggccagccu

SEQ ID NO: 1183414 - RNA, 12 nt, Human
caggaggccagc

SEQ ID NO: 1183415 - RNA, 13 nt, Human
caggaggccagcc

SEQ ID NO: 1183416 - RNA, 19 nt, Human
caggcaaugcuggcuguug

SEQ ID NO: 1183417 - RNA, 20 nt, Human
caggcaaugcuggcuguugg

SEQ ID NO: 1183418 - RNA, 13 nt, Human
caggccagcugcu

SEQ ID NO: 1183419 - RNA, 15 nt, Human
caggccagcugcuug

SEQ ID NO: 1183420 - RNA, 17 nt, Human
caggccagcugcuuggg

SEQ ID NO: 1183421 - RNA, 13 nt, Human
caggccaggcccu

SEQ ID NO: 1183422 - RNA, 14 nt, Human
caggccaggcccuc

SEQ ID NO: 1183423 - RNA, 15 nt, Human
caggccaggcccucu

SEQ ID NO: 1183424 - RNA, 16 nt, Human
caggccaggcccucug

SEQ ID NO: 1183425 - RNA, 23 nt, Human
caggacagcccuucuuuccacag

SEQ ID NO: 1183426 - RNA, 24 nt, Human
caggacagcccuucuuuccacaga

SEQ ID NO: 1183427 - RNA, 13 nt, Human
caggaccagggau

SEQ ID NO: 1183428 - RNA, 21 nt, Human
caggaccagggauuuccauga

SEQ ID NO: 1183429 - RNA, 13 nt, Human
caggaccucaggu

SEQ ID NO: 1183430 - RNA, 15 nt, Human
cagcuguucagcugg

SEQ ID NO: 1183431 - RNA, 16 nt, Human
cagcuguucagcuggu

SEQ ID NO: 1183432 - RNA, 19 nt, Human
cagcuguucagcugguuga

SEQ ID NO: 1183433 - RNA, 16 nt, Human
cagcuuauucacaaga

SEQ ID NO: 1183434 - RNA, 17 nt, Human
cagcuuauucacaagac

SEQ ID NO: 1183435 - RNA, 19 nt, Human
caggaaaagcugcugacag

SEQ ID NO: 1183436 - RNA, 20 nt, Human
caggaaaagcugcugacagu

SEQ ID NO: 1183437 - RNA, 21 nt, Human
caggaaaggcuccaggagcag

SEQ ID NO: 1183438 - RNA, 22 nt, Human
caggaaaggcuccaggagcagc

SEQ ID NO: 1183439 - RNA, 23 nt, Human
caggaaaggcuccaggagcagcc

SEQ ID NO: 1183440 - RNA, 19 nt, Human
cagccccgugggguuccuc

SEQ ID NO: 1183441 - RNA, 19 nt, Human
cagccccauucugccugcc

SEQ ID NO: 1183442 - RNA, 20 nt, Human
cagccccauucugccugccc

SEQ ID NO: 1183443 - RNA, 22 nt, Human
cagccccauucugccugcccag

SEQ ID NO: 1183444 - RNA, 23 nt, Human
cagccccauucugccugcccagg

SEQ ID NO: 1183445 - RNA, 24 nt, Human
cagccccauucugccugcccaggc

SEQ ID NO: 1183446 - RNA, 14 nt, Human
cagcguuucuauga

SEQ ID NO: 1183447 - RNA, 16 nt, Human
cagcguuucuaugaca

SEQ ID NO: 1183448 - RNA, 19 nt, Human
cagcguuucuaugacacau

SEQ ID NO: 1183449 - RNA, 14 nt, Human
cagcggggacagcu

SEQ ID NO: 1183450 - RNA, 17 nt, Human
cagccucugaaaaccaa

SEQ ID NO: 1183451 - RNA, 23 nt, Human
cagccugagcgacagugagacuc

SEQ ID NO: 1183452 - RNA, 13 nt, Human
cagcccuuagcag

SEQ ID NO: 1183453 - RNA, 15 nt, Human
cagcccuuagcaggg

SEQ ID NO: 1183454 - RNA, 23 nt, Human
cagccgccaugcuccuggcccac

SEQ ID NO: 1183455 - RNA, 15 nt, Human
cagauuucacucucc

SEQ ID NO: 1183456 - RNA, 16 nt, Human
cagauuucacucuccu

SEQ ID NO: 1183457 - RNA, 18 nt, Human
cagauuucacucuccuug

SEQ ID NO: 1183458 - RNA, 19 nt, Human
cagauuucacucuccuugg

SEQ ID NO: 1183459 - RNA, 16 nt, Human
cagcauauucaggaag

SEQ ID NO: 1183460 - RNA, 17 nt, Human
cagcauauucaggaagc

SEQ ID NO: 1183461 - RNA, 18 nt, Human
cagcauauucaggaagcu

SEQ ID NO: 1183462 - RNA, 16 nt, Human
cagagguugcagugag

SEQ ID NO: 1183463 - RNA, 20 nt, Human
cagagacuccugcaggcagc

SEQ ID NO: 1183464 - RNA, 23 nt, Human
cagagacuccugcaggcagccag

SEQ ID NO: 1183465 - RNA, 21 nt, Human
cagagacuccugcaggcagcc

SEQ ID NO: 1183466 - RNA, 22 nt, Human
cagagacuccugcaggcagcca

SEQ ID NO: 1183467 - RNA, 16 nt, Human
cagagagggugggagu

SEQ ID NO: 1183468 - RNA, 20 nt, Human
cagagagggugggagugggc

SEQ ID NO: 1183469 - RNA, 22 nt, Human
cagagagggugggagugggccc

SEQ ID NO: 1183470 - RNA, 14 nt, Human
cagagccugcaguu

SEQ ID NO: 1183471 - RNA, 23 nt, Human
cagagagggugggagugggccca

SEQ ID NO: 1183472 - RNA, 17 nt, Human
cagagcuacacagggga

SEQ ID NO: 1183473 - RNA, 22 nt, Human
cagagcuacacaggggaaaaga

SEQ ID NO: 1183474 - RNA, 13 nt, Human
caagcucugcucc

SEQ ID NO: 1183475 - RNA, 12 nt, Human
caagcuccaagc

SEQ ID NO: 1183476 - RNA, 17 nt, Human
caagcuccaagcuccca

SEQ ID NO: 1183477 - RNA, 14 nt, Human
caagcucugcuccu

SEQ ID NO: 1183478 - RNA, 15 nt, Human
caagcucugcuccuc

SEQ ID NO: 1183479 - RNA, 14 nt, Human
caagcugcacccuc

SEQ ID NO: 1183480 - RNA, 18 nt, Human
caagcugcacccucaggc

SEQ ID NO: 1183481 - RNA, 20 nt, Human
caagcugcacccucaggcag

SEQ ID NO: 1183482 - RNA, 19 nt, Human
caaggccaaaggaagcaca

SEQ ID NO: 1183483 - RNA, 17 nt, Human
caaggccaaaggaagca

SEQ ID NO: 1183484 - RNA, 18 nt, Human
caaggccaaaggaagcac

SEQ ID NO: 1183485 - RNA, 15 nt, Human
caaggccaaaggaag

SEQ ID NO: 1183486 - RNA, 16 nt, Human
caaggccaaaggaagc

SEQ ID NO: 1183487 - RNA, 13 nt, Human
caagucaagugaa

SEQ ID NO: 1183488 - RNA, 17 nt, Human
caagucaagugaaaaag

SEQ ID NO: 1183489 - RNA, 19 nt, Human
caauaaagcagcguuucua

SEQ ID NO: 1183490 - RNA, 23 nt, Human
caaugcuguauuuuaaaagaaug

SEQ ID NO: 1183491 - RNA, 16 nt, Human
caaugcuguauuuuaa

SEQ ID NO: 1183492 - RNA, 17 nt, Human
caaugcuguauuuuaaa

SEQ ID NO: 1183493 - RNA, 15 nt, Human
caauucuugccaaau

SEQ ID NO: 1183494 - RNA, 11 nt, Human
caauggcagcc

SEQ ID NO: 1183495 - RNA, 12 nt, Human
caauggcagccu

SEQ ID NO: 1183496 - RNA, 13 nt, Human
caauuuauuaugg

SEQ ID NO: 1183497 - RNA, 14 nt, Human
cacaagagcccagg

SEQ ID NO: 1183498 - RNA, 16 nt, Human
cacaagagcccaggcc

SEQ ID NO: 1183499 - RNA, 14 nt, Human
cacaagcuccaagc

SEQ ID NO: 1183500 - RNA, 15 nt, Human
cacaagcuccaagcu

SEQ ID NO: 1183501 - RNA, 17 nt, Human
cacaagagcccaggccu

SEQ ID NO: 1183502 - RNA, 17 nt, Human
cacaagcuccaagcucc

SEQ ID NO: 1183503 - RNA, 23 nt, Human
cacaagcuccaagcucccaggca

SEQ ID NO: 1183504 - RNA, 17 nt, Human
cacaagcugcacccuca

SEQ ID NO: 1183505 - RNA, 23 nt, Human
cacaagcugcacccucaggcagg

SEQ ID NO: 1183506 - RNA, 17 nt, Human
cacacagcucuguccug

SEQ ID NO: 1183507 - RNA, 20 nt, Human
cacacagcucuguccuggga

SEQ ID NO: 1183508 - RNA, 17 nt, Human
cacagccucuuagaugc

SEQ ID NO: 1183509 - RNA, 21 nt, Human
cacagccucuuagaugcaguu

SEQ ID NO: 1183510 - RNA, 17 nt, Human
cacaggggaaaagagga

SEQ ID NO: 1183511 - RNA, 18 nt, Human
cacaggggaaaagaggag

SEQ ID NO: 1183512 - RNA, 19 nt, Human
cacaggggaaaagaggagu

SEQ ID NO: 1183513 - RNA, 13 nt, Human
cacaguccuuacc

SEQ ID NO: 1183514 - RNA, 20 nt, Human
cacaguauuacuucugcuac

SEQ ID NO: 1183515 - RNA, 21 nt, Human
cacaguauuacuucugcuaca

SEQ ID NO: 1183516 - RNA, 20 nt, Human
cacacaguauuacuucugcu

SEQ ID NO: 1183517 - RNA, 23 nt, Human
cacacaguauuacuucugcuaca

SEQ ID NO: 1183518 - RNA, 18 nt, Human
cacacagugagucgagga

SEQ ID NO: 1183519 - RNA, 21 nt, Human
cacacagugagucgaggacag

SEQ ID NO: 1183520 - RNA, 23 nt, Human
cacacagugagucgaggacaggg

SEQ ID NO: 1183521 - RNA, 15 nt, Human
cacacauacacacac

SEQ ID NO: 1183522 - RNA, 17 nt, Human
cacacaugaaguccaag

SEQ ID NO: 1183523 - RNA, 22 nt, Human
cacacaugaaguccaagcauuu

SEQ ID NO: 1183524 - RNA, 20 nt, Human
cacacaugagcaucaggcca

SEQ ID NO: 1183525 - RNA, 14 nt, Human
cacacaugcauaca

SEQ ID NO: 1183526 - RNA, 15 nt, Human
cacacaugcauacac

SEQ ID NO: 1183527 - RNA, 16 nt, Human
cacacaugcauacaca

SEQ ID NO: 1183528 - RNA, 17 nt, Human
cacacaugcauacacac

SEQ ID NO: 1183529 - RNA, 18 nt, Human
cacacaugcauacacaca

SEQ ID NO: 1183530 - RNA, 19 nt, Human
cacacaugcauacacacac

SEQ ID NO: 1183531 - RNA, 21 nt, Human
cacacaugagcaucaggccag

SEQ ID NO: 1183532 - RNA, 22 nt, Human
cacacaugagcaucaggccagg

SEQ ID NO: 1183533 - RNA, 18 nt, Human
cacagaaaauggaagaca

SEQ ID NO: 1183534 - RNA, 19 nt, Human
cacagaaaauggaagacag

SEQ ID NO: 1183535 - RNA, 20 nt, Human
cacagaaaauggaagacagc

SEQ ID NO: 1183536 - RNA, 22 nt, Human
cacagaaaauggaagacagcuc

SEQ ID NO: 1183537 - RNA, 23 nt, Human
cacagaaaauggaagacagcucu

SEQ ID NO: 1183538 - RNA, 19 nt, Human
cacagaaaauucuucucca

SEQ ID NO: 1183539 - RNA, 22 nt, Human
cacagaaaauauacuguaaaga

SEQ ID NO: 1183540 - RNA, 19 nt, Human
cacagacauacuaaccagc

SEQ ID NO: 1183541 - RNA, 21 nt, Human
cacagacauacuaaccagcag

SEQ ID NO: 1183542 - RNA, 13 nt, Human
cacagacccugcc

SEQ ID NO: 1183543 - RNA, 16 nt, Human
cacugcauguuuguga

SEQ ID NO: 1183544 - RNA, 13 nt, Human
cacugcagccuca

SEQ ID NO: 1183545 - RNA, 14 nt, Human
cacugcagccucaa

SEQ ID NO: 1183546 - RNA, 15 nt, Human
cacugcacuccagcc

SEQ ID NO: 1183547 - RNA, 16 nt, Human
cacugcacuccagccu

SEQ ID NO: 1183548 - RNA, 18 nt, Human
cacugcacuccagccugg

SEQ ID NO: 1183549 - RNA, 19 nt, Human
cacugcacuccagccuggg

SEQ ID NO: 1183550 - RNA, 20 nt, Human
cacugcacuccagccugggu

SEQ ID NO: 1183551 - RNA, 21 nt, Human
cacugcagaagacaguauggc

SEQ ID NO: 1183552 - RNA, 12 nt, Human
cacugcagccuc

SEQ ID NO: 1183553 - RNA, 22 nt, Human
cacugguucuucuuggucucag

SEQ ID NO: 1183554 - RNA, 18 nt, Human
cacuuacacuuuaugcac

SEQ ID NO: 1183555 - RNA, 16 nt, Human
cacuugucaauaaaau

SEQ ID NO: 1183556 - RNA, 19 nt, Human
cacuuguguuuugcaagcc

SEQ ID NO: 1183557 - RNA, 22 nt, Human
cacuuguguuuugcaagccaga

SEQ ID NO: 1183558 - RNA, 16 nt, Human
cacuccagugagacag

SEQ ID NO: 1183559 - RNA, 16 nt, Human
cacuccagccugggug

SEQ ID NO: 1183560 - RNA, 14 nt, Human
cacuaguauuucua

SEQ ID NO: 1183561 - RNA, 12 nt, Human
cacuccccugcu

SEQ ID NO: 1183562 - RNA, 13 nt, Human
cacuccccugcug

SEQ ID NO: 1183563 - RNA, 14 nt, Human
cacuccccugcugg

SEQ ID NO: 1183564 - RNA, 15 nt, Human
cacuccccugcuggg

SEQ ID NO: 1183565 - RNA, 14 nt, Human
caccuuggcugcag

SEQ ID NO: 1183566 - RNA, 15 nt, Human
caccuuggcucaagu

SEQ ID NO: 1183567 - RNA, 13 nt, Human
caccuuggcugca

SEQ ID NO: 1183568 - RNA, 17 nt, Human
caccugccuguugggcc

SEQ ID NO: 1183569 - RNA, 19 nt, Human
caccugccuguugggccag

SEQ ID NO: 1183570 - RNA, 24 nt, Human
caccugccuguugggccaggagcc

SEQ ID NO: 1183571 - RNA, 14 nt, Human
cacccucaggcagg

SEQ ID NO: 1183572 - RNA, 17 nt, Human
cacccugaaagcccuga

SEQ ID NO: 1183573 - RNA, 15 nt, Human
cacccuggggagaaa

SEQ ID NO: 1183574 - RNA, 16 nt, Human
cacccuggggagaaag

SEQ ID NO: 1183575 - RNA, 17 nt, Human
cacccuggggagaaagu

SEQ ID NO: 1183576 - RNA, 13 nt, Human
caccucagccucc

SEQ ID NO: 1183577 - RNA, 14 nt, Human
caccucagccuccc

SEQ ID NO: 1183578 - RNA, 14 nt, Human
caccugccccucaa

SEQ ID NO: 1183579 - RNA, 15 nt, Human
caccugccccucaac

SEQ ID NO: 1183580 - RNA, 16 nt, Human
caccugccccucaacu

SEQ ID NO: 1183581 - RNA, 12 nt, Human
caccccagcccc

SEQ ID NO: 1183582 - RNA, 11 nt, Human
caccccagccc

SEQ ID NO: 1183583 - RNA, 14 nt, Human
auuugcucauggaa

SEQ ID NO: 1183584 - RNA, 17 nt, Human
auuugcucauggaauug

SEQ ID NO: 1183585 - RNA, 13 nt, Human
auuugcuccuuuc

SEQ ID NO: 1183586 - RNA, 20 nt, Human
auuugugauacaaugcugug

SEQ ID NO: 1183587 - RNA, 17 nt, Human
auuugugauacaaugcu

SEQ ID NO: 1183588 - RNA, 19 nt, Human
auuuuauagcuacuaauuu

SEQ ID NO: 1183589 - RNA, 22 nt, Human
auuuguuugaacugauaaagau

SEQ ID NO: 1183590 - RNA, 23 nt, Human
auuuguuugaacugauaaagaug

SEQ ID NO: 1183591 - RNA, 20 nt, Human
caaaaaaaaaaaaaaauuag

SEQ ID NO: 1183592 - RNA, 16 nt, Human
caaaagaugcuucuca

SEQ ID NO: 1183593 - RNA, 18 nt, Human
caaaagaugcuucucacu

SEQ ID NO: 1183594 - RNA, 15 nt, Human
caaaaggcagaagca

SEQ ID NO: 1183595 - RNA, 21 nt, Human
caaaccaucauugaaaucuuu

SEQ ID NO: 1183596 - RNA, 20 nt, Human
caaagauauuuugcuuugug

SEQ ID NO: 1183597 - RNA, 22 nt, Human
caacacucacauuuauucugcu

SEQ ID NO: 1183598 - RNA, 15 nt, Human
caaauccuugaagau

SEQ ID NO: 1183599 - RNA, 20 nt, Human
caaauggaaaugggcagagc

SEQ ID NO: 1183600 - RNA, 21 nt, Human
caaauggaaaugggcagagca

SEQ ID NO: 1183601 - RNA, 22 nt, Human
caaauggaaaugggcagagcag

SEQ ID NO: 1183602 - RNA, 20 nt, Human
caacaccucugcacaagcug

SEQ ID NO: 1183603 - RNA, 22 nt, Human
caaagauauuuugcuuugugau

SEQ ID NO: 1183604 - RNA, 23 nt, Human
caaagauauuuugcuuugugauu

SEQ ID NO: 1183605 - RNA, 15 nt, Human
caaagcagugcaugc

SEQ ID NO: 1183606 - RNA, 17 nt, Human
caaagcagugcaugcug

SEQ ID NO: 1183607 - RNA, 14 nt, Human
caaaguagaagucu

SEQ ID NO: 1183608 - RNA, 21 nt, Human
caaaguagaagucuuagaugu

SEQ ID NO: 1183609 - RNA, 22 nt, Human
caaaguagaagucuuagaugua

SEQ ID NO: 1183610 - RNA, 13 nt, Human
caaagugcuggga

SEQ ID NO: 1183611 - RNA, 18 nt, Human
auguuugccucugccucu

SEQ ID NO: 1183612 - RNA, 17 nt, Human
auuacaggaaguacugg

SEQ ID NO: 1183613 - RNA, 22 nt, Human
auuacaagcgugagccacugca

SEQ ID NO: 1183614 - RNA, 18 nt, Human
auuaugaauuacauuugu

SEQ ID NO: 1183615 - RNA, 23 nt, Human
auuaugcaugaaguaauaugcac

SEQ ID NO: 1183616 - RNA, 16 nt, Human
auuaggugugacugaa

SEQ ID NO: 1183617 - RNA, 18 nt, Human
auuaggugugacugaauu

SEQ ID NO: 1183618 - RNA, 21 nt, Human
auuaggugugacugaauuucu

SEQ ID NO: 1183619 - RNA, 14 nt, Human
auuaugaauuacau

SEQ ID NO: 1183620 - RNA, 17 nt, Human
auuaugaauuacauuug

SEQ ID NO: 1183621 - RNA, 15 nt, Human
auucauaaugacuua

SEQ ID NO: 1183622 - RNA, 19 nt, Human
auucauaaugacuuaagca

SEQ ID NO: 1183623 - RNA, 19 nt, Human
auucauagcagcuuauuca

SEQ ID NO: 1183624 - RNA, 22 nt, Human
auucauagcagcuuauucacaa

SEQ ID NO: 1183625 - RNA, 15 nt, Human
auugcugauggugca

SEQ ID NO: 1183626 - RNA, 16 nt, Human
auugcugauggugcaa

SEQ ID NO: 1183627 - RNA, 18 nt, Human
auugcugauggugcaaug

SEQ ID NO: 1183628 - RNA, 19 nt, Human
auugcugauggugcaauga

SEQ ID NO: 1183629 - RNA, 23 nt, Human
auugcugauggugcaaugaccuu

SEQ ID NO: 1183630 - RNA, 12 nt, Human
auugcugcuuga

SEQ ID NO: 1183631 - RNA, 14 nt, Human
auugcuugagcuca

SEQ ID NO: 1183632 - RNA, 18 nt, Human
auugcuugagcucaggag

SEQ ID NO: 1183633 - RNA, 14 nt, Human
auuguaaaauggug

SEQ ID NO: 1183634 - RNA, 21 nt, Human
auugugucucuugguccugcu

SEQ ID NO: 1183635 - RNA, 23 nt, Human
auugugucucuugguccugcugc

SEQ ID NO: 1183636 - RNA, 16 nt, Human
auuguuagucucuuga

SEQ ID NO: 1183637 - RNA, 21 nt, Human
auugauaagaaccuuuugagu

SEQ ID NO: 1183638 - RNA, 17 nt, Human
auugauaugcuuauaca

SEQ ID NO: 1183639 - RNA, 15 nt, Human
auugcuacuguccua

SEQ ID NO: 1183640 - RNA, 20 nt, Human
auugcuacuguccuacccac

SEQ ID NO: 1183641 - RNA, 22 nt, Human
auugcuacuguccuacccaccc

SEQ ID NO: 1183642 - RNA, 11 nt, Human
auucuucugcu

SEQ ID NO: 1183643 - RNA, 12 nt, Human
auucuucugcuu

SEQ ID NO: 1183644 - RNA, 14 nt, Human
auucuucugcuuca

SEQ ID NO: 1183645 - RNA, 11 nt, Human
auucuuuccug

SEQ ID NO: 1183646 - RNA, 13 nt, Human
auucuuuccugag

SEQ ID NO: 1183647 - RNA, 18 nt, Human
ccuggcacccggccccug

SEQ ID NO: 1183648 - RNA, 13 nt, Human
ccuggaugcagcc

SEQ ID NO: 1183649 - RNA, 14 nt, Human
ccuggaugcagccu

SEQ ID NO: 1183650 - RNA, 17 nt, Human
ccuggaugcagccucac

SEQ ID NO: 1183651 - RNA, 19 nt, Human
ccuggaugcagccucacag

SEQ ID NO: 1183652 - RNA, 15 nt, Human
ccuggaguucugguu

SEQ ID NO: 1183653 - RNA, 16 nt, Human
ccuggaguucugguuc

SEQ ID NO: 1183654 - RNA, 17 nt, Human
ccuggaguucugguucc

SEQ ID NO: 1183655 - RNA, 14 nt, Human
ccugcccaggcccc

SEQ ID NO: 1183656 - RNA, 15 nt, Human
ccugcccaggccccu

SEQ ID NO: 1183657 - RNA, 16 nt, Human
ccugcccaggccccug

SEQ ID NO: 1183658 - RNA, 18 nt, Human
ccugcccaggccccugcc

SEQ ID NO: 1183659 - RNA, 12 nt, Human
ccugcugggugu

SEQ ID NO: 1183660 - RNA, 14 nt, Human
ccugcugggugugg

SEQ ID NO: 1183661 - RNA, 20 nt, Human
ccugcuggguguggcgcagc

SEQ ID NO: 1183662 - RNA, 21 nt, Human
ccugcuggguguggcgcagca

SEQ ID NO: 1183663 - RNA, 12 nt, Human
ccuggccucugc

SEQ ID NO: 1183664 - RNA, 14 nt, Human
ccuggccucugcac

SEQ ID NO: 1183665 - RNA, 15 nt, Human
ccuggccucugcacu

SEQ ID NO: 1183666 - RNA, 16 nt, Human
ccuggccucugcacuc

SEQ ID NO: 1183667 - RNA, 13 nt, Human
ccuggccugagcu

SEQ ID NO: 1183668 - RNA, 13 nt, Human
ccucuugagccuu

SEQ ID NO: 1183669 - RNA, 19 nt, Human
ccucuugagccuugaacuu

SEQ ID NO: 1183670 - RNA, 22 nt, Human
ccugcacuugcagacucuacag

SEQ ID NO: 1183671 - RNA, 22 nt, Human
ccucugccugaagucacacagu

SEQ ID NO: 1183672 - RNA, 13 nt, Human
ccucugcugcugg

SEQ ID NO: 1183673 - RNA, 14 nt, Human
ccucugcugcuggc

SEQ ID NO: 1183674 - RNA, 15 nt, Human
ccucugcugcuggcu

SEQ ID NO: 1183675 - RNA, 16 nt, Human
ccucugcugcuggcug

SEQ ID NO: 1183676 - RNA, 17 nt, Human
ccucugcugcuggcugg

SEQ ID NO: 1183677 - RNA, 18 nt, Human
ccucugcugcuggcuggu

SEQ ID NO: 1183678 - RNA, 13 nt, Human
ccucucucacucc

SEQ ID NO: 1183679 - RNA, 14 nt, Human
ccucucucacuccu

SEQ ID NO: 1183680 - RNA, 15 nt, Human
ccucucucacuccuu

SEQ ID NO: 1183681 - RNA, 17 nt, Human
ccucucucacuccuuga

SEQ ID NO: 1183682 - RNA, 12 nt, Human
ccucucucaggc

SEQ ID NO: 1183683 - RNA, 14 nt, Human
ccucucucaggcca

SEQ ID NO: 1183684 - RNA, 23 nt, Human
ccucagccucccaaagugcuggg

SEQ ID NO: 1183685 - RNA, 22 nt, Human
ccucagccucccgaauagcugg

SEQ ID NO: 1183686 - RNA, 20 nt, Human
ccucauguccacugguucuu

SEQ ID NO: 1183687 - RNA, 13 nt, Human
ccucauguucuua

SEQ ID NO: 1183688 - RNA, 18 nt, Human
ccucauuagcauuuugcu

SEQ ID NO: 1183689 - RNA, 19 nt, Human
ccucauguucuuaauucuu

SEQ ID NO: 1183690 - RNA, 22 nt, Human
ccucccaaggggcccaaauucu

SEQ ID NO: 1183691 - RNA, 15 nt, Human
ccucaacucuccucc

SEQ ID NO: 1183692 - RNA, 15 nt, Human
ccucaagagaaggca

SEQ ID NO: 1183693 - RNA, 19 nt, Human
ccucaacucuccuccagag

SEQ ID NO: 1183694 - RNA, 11 nt, Human
ccucagccucc

SEQ ID NO: 1183695 - RNA, 22 nt, Human
ccucagccucccaaagugcugg

SEQ ID NO: 1183696 - RNA, 16 nt, Human
ccguagguuauuuuca

SEQ ID NO: 1183697 - RNA, 12 nt, Human
ccggcuccaggc

SEQ ID NO: 1183698 - RNA, 23 nt, Human
ccuaggcauuugcugaauacaga

SEQ ID NO: 1183699 - RNA, 17 nt, Human
ccuagcacuuugggagg

SEQ ID NO: 1183700 - RNA, 14 nt, Human
cccuggcagccccu

SEQ ID NO: 1183701 - RNA, 16 nt, Human
cccuggcagccccugu

SEQ ID NO: 1183702 - RNA, 12 nt, Human
cccugcccugug

SEQ ID NO: 1183703 - RNA, 13 nt, Human
cccugcccugugg

SEQ ID NO: 1183704 - RNA, 14 nt, Human
cccugcccuguggg

SEQ ID NO: 1183705 - RNA, 15 nt, Human
cccugcccugugggc

SEQ ID NO: 1183706 - RNA, 16 nt, Human
cccugcccugugggcc

SEQ ID NO: 1183707 - RNA, 20 nt, Human
cccugcccugugggccccca

SEQ ID NO: 1183708 - RNA, 21 nt, Human
cccugcccugugggcccccaa

SEQ ID NO: 1183709 - RNA, 12 nt, Human
cccuggcagccc

SEQ ID NO: 1183710 - RNA, 13 nt, Human
cccuggcagcccc

SEQ ID NO: 1183711 - RNA, 16 nt, Human
ccgccaugcuccuggc

SEQ ID NO: 1183712 - RNA, 20 nt, Human
ccgcccaggcuuagucacug

SEQ ID NO: 1183713 - RNA, 17 nt, Human
cccuucuuuccacagaa

SEQ ID NO: 1183714 - RNA, 20 nt, Human
ccgaauagcugggacuacag

SEQ ID NO: 1183715 - RNA, 16 nt, Human
ccgacccuugccgucu

SEQ ID NO: 1183716 - RNA, 17 nt, Human
ccgccaaggcuggggga

SEQ ID NO: 1183717 - RNA, 16 nt, Human
cccuucuaccuuccug

SEQ ID NO: 1183718 - RNA, 16 nt, Human
cccuucgcuccugugu

SEQ ID NO: 1183719 - RNA, 18 nt, Human
cccuucgcuccugugucu

SEQ ID NO: 1183720 - RNA, 21 nt, Human
cccuucugacccaugcugccc

SEQ ID NO: 1183721 - RNA, 22 nt, Human
cccuucugacccaugcugcccu

SEQ ID NO: 1183722 - RNA, 23 nt, Human
cccuucugacccaugcugcccug

SEQ ID NO: 1183723 - RNA, 18 nt, Human
cccuauuagagaagagau

SEQ ID NO: 1183724 - RNA, 23 nt, Human
cccgggaggcagagguugcagug

SEQ ID NO: 1183725 - RNA, 17 nt, Human
cccggccaccugcggug

SEQ ID NO: 1183726 - RNA, 13 nt, Human
cccggccaccugc

SEQ ID NO: 1183727 - RNA, 14 nt, Human
cccggccaccugcg

SEQ ID NO: 1183728 - RNA, 12 nt, Human
cccggcuccagg

SEQ ID NO: 1183729 - RNA, 13 nt, Human
cccggcuccaggc

SEQ ID NO: 1183730 - RNA, 14 nt, Human
cccggcuccaggcu

SEQ ID NO: 1183731 - RNA, 15 nt, Human
cccggcuccaggcuc

SEQ ID NO: 1183732 - RNA, 16 nt, Human
cccggcuccaggcucc

SEQ ID NO: 1183733 - RNA, 14 nt, Human
cccgaauagcuggg

SEQ ID NO: 1183734 - RNA, 16 nt, Human
cccgaauagcugggac

SEQ ID NO: 1183735 - RNA, 22 nt, Human
ccccagcaagugagagcugggu

SEQ ID NO: 1183736 - RNA, 22 nt, Human
cccccaaauggaaaugggcaga

SEQ ID NO: 1183737 - RNA, 23 nt, Human
ccccaaaacucuccucugcugcu

SEQ ID NO: 1183738 - RNA, 22 nt, Human
cccauuguggucacaggaagua

SEQ ID NO: 1183739 - RNA, 23 nt, Human
cccauuguggucacaggaaguag

SEQ ID NO: 1183740 - RNA, 22 nt, Human
ccccaaaacucuccucugcugc

SEQ ID NO: 1183741 - RNA, 13 nt, Human
ccccggccaccug

SEQ ID NO: 1183742 - RNA, 23 nt, Human
ccccgaggccuucucugaaggac

SEQ ID NO: 1183743 - RNA, 12 nt, Human
cccacucccugc

SEQ ID NO: 1183744 - RNA, 12 nt, Human
cccacugcucug

SEQ ID NO: 1183745 - RNA, 13 nt, Human
cccacugcucugg

SEQ ID NO: 1183746 - RNA, 19 nt, Human
cccacugcuuuuggucugu

SEQ ID NO: 1183747 - RNA, 22 nt, Human
cccacugcuuuuggucugugug

SEQ ID NO: 1183748 - RNA, 20 nt, Human
cccacccaagggccuggccu

SEQ ID NO: 1183749 - RNA, 21 nt, Human
cccacccaagggccuggccug

SEQ ID NO: 1183750 - RNA, 22 nt, Human
cccacccaagggccuggccuga

SEQ ID NO: 1183751 - RNA, 17 nt, Human
cccacccccacccaagg

SEQ ID NO: 1183752 - RNA, 15 nt, Human
cccacccccacccaa

SEQ ID NO: 1183753 - RNA, 18 nt, Human
cccacccugaaagcccug

SEQ ID NO: 1183754 - RNA, 12 nt, Human
cccacuucugcc

SEQ ID NO: 1183755 - RNA, 15 nt, Human
cccaggaaaggcucc

SEQ ID NO: 1183756 - RNA, 13 nt, Human
cccaggcuggcgu

SEQ ID NO: 1183757 - RNA, 17 nt, Human
cccaggcuggcgugcag

SEQ ID NO: 1183758 - RNA, 20 nt, Human
cccauauuuguacaccaaua

SEQ ID NO: 1183759 - RNA, 13 nt, Human
cccauccucugua

SEQ ID NO: 1183760 - RNA, 23 nt, Human
cccagcucugguccauagagagc

SEQ ID NO: 1183761 - RNA, 20 nt, Human
ccaggcuccuuuagcgccca

SEQ ID NO: 1183762 - RNA, 21 nt, Human
ccaggcuccuuuagcgcccag

SEQ ID NO: 1183763 - RNA, 17 nt, Human
ccaggcuggcgugcagu

SEQ ID NO: 1183764 - RNA, 18 nt, Human
ccaggcuggcgugcagug

SEQ ID NO: 1183765 - RNA, 19 nt, Human
ccaggcuggcgugcagugg

SEQ ID NO: 1183766 - RNA, 19 nt, Human
ccaggggaaaaucagccug

SEQ ID NO: 1183767 - RNA, 20 nt, Human
ccaggggaaaaucagccugc

SEQ ID NO: 1183768 - RNA, 13 nt, Human
ccaggggugggac

SEQ ID NO: 1183769 - RNA, 14 nt, Human
ccaggggugggaca

SEQ ID NO: 1183770 - RNA, 17 nt, Human
ccaggggugggacaccc

SEQ ID NO: 1183771 - RNA, 21 nt, Human
ccaggggaaaaucagccugcu

SEQ ID NO: 1183772 - RNA, 19 nt, Human
ccaggggugggacacccug

SEQ ID NO: 1183773 - RNA, 21 nt, Human
ccaugagccucagcauccugg

SEQ ID NO: 1183774 - RNA, 23 nt, Human
ccaugagccucagcauccuggca

SEQ ID NO: 1183775 - RNA, 20 nt, Human
ccauggucggaaaacaugcu

SEQ ID NO: 1183776 - RNA, 23 nt, Human
ccaguuggguggaugccuggugg

SEQ ID NO: 1183777 - RNA, 23 nt, Human
ccaguuggucccccuuccaugga

SEQ ID NO: 1183778 - RNA, 14 nt, Human
ccaucccagcccca

SEQ ID NO: 1183779 - RNA, 15 nt, Human
ccaucccagccccaa

SEQ ID NO: 1183780 - RNA, 14 nt, Human
ccaucccugaaggc

SEQ ID NO: 1183781 - RNA, 15 nt, Human
ccaucccugaaggcc

SEQ ID NO: 1183782 - RNA, 17 nt, Human
ccaucccugaaggcccc

SEQ ID NO: 1183783 - RNA, 20 nt, Human
ccaucccugaaggccccgcc

SEQ ID NO: 1183784 - RNA, 19 nt, Human
ccaucccauaugccugggc

SEQ ID NO: 1183785 - RNA, 17 nt, Human
ccaguuggguggaugcc

SEQ ID NO: 1183786 - RNA, 19 nt, Human
ccaguuggguggaugccug

SEQ ID NO: 1183787 - RNA, 20 nt, Human
ccaguuggguggaugccugg

SEQ ID NO: 1183788 - RNA, 13 nt, Human
ccagcaggcucuc

SEQ ID NO: 1183789 - RNA, 15 nt, Human
ccagcaggcucucag

SEQ ID NO: 1183790 - RNA, 14 nt, Human
ccaggaagccagca

SEQ ID NO: 1183791 - RNA, 13 nt, Human
ccaggaagccagc

SEQ ID NO: 1183792 - RNA, 12 nt, Human
ccaggaagccag

SEQ ID NO: 1183793 - RNA, 14 nt, Human
ccaggaaaggcucc

SEQ ID NO: 1183794 - RNA, 15 nt, Human
ccaggaaaggcucca

SEQ ID NO: 1183795 - RNA, 16 nt, Human
ccaggaaaggcuccag

SEQ ID NO: 1183796 - RNA, 17 nt, Human
ccaggaaaggcuccagg

SEQ ID NO: 1183797 - RNA, 11 nt, Human
ccagccccugg

SEQ ID NO: 1183798 - RNA, 12 nt, Human
ccagccccugga

SEQ ID NO: 1183799 - RNA, 15 nt, Human
ccagcucaccagccc

SEQ ID NO: 1183800 - RNA, 16 nt, Human
ccagcucaccagcccc

SEQ ID NO: 1183801 - RNA, 22 nt, Human
ccagcucaccagccccagugcc

SEQ ID NO: 1183802 - RNA, 17 nt, Human
ccagcuguucagcuggu

SEQ ID NO: 1183803 - RNA, 19 nt, Human
ccagcuuaaaggggcuaga

SEQ ID NO: 1183804 - RNA, 16 nt, Human
ccagcuuaucucaggg

SEQ ID NO: 1183805 - RNA, 23 nt, Human
ccagaugcaccagcccuuagcag

SEQ ID NO: 1183806 - RNA, 18 nt, Human
ccagaugcaccagcccuu

SEQ ID NO: 1183807 - RNA, 17 nt, Human
ccagaugcaccagcccu

SEQ ID NO: 1183808 - RNA, 16 nt, Human
ccaccuuggcucaagu

SEQ ID NO: 1183809 - RNA, 17 nt, Human
ccagagggccugcaagg

SEQ ID NO: 1183810 - RNA, 18 nt, Human
ccagagggccugcaaggg

SEQ ID NO: 1183811 - RNA, 19 nt, Human
ccagagggccugcaaggga

SEQ ID NO: 1183812 - RNA, 20 nt, Human
ccagagggccugcaagggag

SEQ ID NO: 1183813 - RNA, 15 nt, Human
ccagauccuggaaau

SEQ ID NO: 1183814 - RNA, 23 nt, Human
cgaccagacaccuugacagggca

SEQ ID NO: 1183815 - RNA, 19 nt, Human
ccuuuuuuauacauaaaca

SEQ ID NO: 1183816 - RNA, 17 nt, Human
ccuuuuuuauacauaaa

SEQ ID NO: 1183817 - RNA, 18 nt, Human
ccuuuuuuauacauaaac

SEQ ID NO: 1183818 - RNA, 15 nt, Human
cgacagugagacucu

SEQ ID NO: 1183819 - RNA, 16 nt, Human
cgacagugagacucug

SEQ ID NO: 1183820 - RNA, 12 nt, Human
ccuuuuuuauac

SEQ ID NO: 1183821 - RNA, 14 nt, Human
ccuuuagcgcccag

SEQ ID NO: 1183822 - RNA, 20 nt, Human
ccuuuagcgcccaguugggu

SEQ ID NO: 1183823 - RNA, 20 nt, Human
ccuugccgucuaccugaggg

SEQ ID NO: 1183824 - RNA, 20 nt, Human
ccuucuguccuacucugugu

SEQ ID NO: 1183825 - RNA, 14 nt, Human
ccuggccugagcug

SEQ ID NO: 1183826 - RNA, 15 nt, Human
ccuggccugagcugg

SEQ ID NO: 1183827 - RNA, 20 nt, Human
ccuggccugagcugggauga

SEQ ID NO: 1183828 - RNA, 12 nt, Human
ccuucugaccca

SEQ ID NO: 1183829 - RNA, 16 nt, Human
ccuucugacccaugcu

SEQ ID NO: 1183830 - RNA, 17 nt, Human
ccuucugacccaugcug

SEQ ID NO: 1183831 - RNA, 20 nt, Human
ccuucugacccaugcugccc

SEQ ID NO: 1183832 - RNA, 21 nt, Human
ccuucugacccaugcugcccu

SEQ ID NO: 1183833 - RNA, 22 nt, Human
ccuucugacccaugcugcccug

SEQ ID NO: 1183834 - RNA, 23 nt, Human
ccuucugacccaugcugcccugu

SEQ ID NO: 1183835 - RNA, 22 nt, Human
ccuucuggaauaaggagaauga

SEQ ID NO: 1183836 - RNA, 14 nt, Human
cggagucccaccuu

SEQ ID NO: 1183837 - RNA, 19 nt, Human
cggcucacugcagccucaa

SEQ ID NO: 1183838 - RNA, 18 nt, Human
cggcucacugcagccuca

SEQ ID NO: 1183839 - RNA, 12 nt, Human
cgccaaggcugg

SEQ ID NO: 1183840 - RNA, 23 nt, Human
cgccaaggcugggggaagaagcu

SEQ ID NO: 1183841 - RNA, 13 nt, Human
cgccaaggcuggg

SEQ ID NO: 1183842 - RNA, 16 nt, Human
cgccaaggcuggggga

SEQ ID NO: 1183843 - RNA, 14 nt, Human
cgccuacaggagug

SEQ ID NO: 1183844 - RNA, 17 nt, Human
cgaguuacagacaaagc

SEQ ID NO: 1183845 - RNA, 18 nt, Human
cgaguuacagacaaagcg

SEQ ID NO: 1183846 - RNA, 14 nt, Human
cgaguagcugggac

SEQ ID NO: 1183847 - RNA, 15 nt, Human
cgaguagcugggacu

SEQ ID NO: 1183848 - RNA, 16 nt, Human
cgaguagcugggacua

SEQ ID NO: 1183849 - RNA, 18 nt, Human
cuaagugaggaugaaaaa

SEQ ID NO: 1183850 - RNA, 20 nt, Human
cuaagugauccucccaccuc

SEQ ID NO: 1183851 - RNA, 22 nt, Human
cuaagugauccucccaccucag

SEQ ID NO: 1183852 - RNA, 23 nt, Human
cuaagugauccucccaccucagc

SEQ ID NO: 1183853 - RNA, 18 nt, Human
cuacauacaauuccaaac

SEQ ID NO: 1183854 - RNA, 15 nt, Human
cuacaugagguacug

SEQ ID NO: 1183855 - RNA, 18 nt, Human
cuacaugagguacugaga

SEQ ID NO: 1183856 - RNA, 15 nt, Human
cuacaguccucccau

SEQ ID NO: 1183857 - RNA, 16 nt, Human
cuacaguccucccauc

SEQ ID NO: 1183858 - RNA, 17 nt, Human
cuacaguccucccaucu

SEQ ID NO: 1183859 - RNA, 18 nt, Human
cuacaguccucccaucuc

SEQ ID NO: 1183860 - RNA, 13 nt, Human
cuacaguugaaaa

SEQ ID NO: 1183861 - RNA, 19 nt, Human
cuacaguugaaaaacagcu

SEQ ID NO: 1183862 - RNA, 20 nt, Human
cuaagugaaauaagccagac

SEQ ID NO: 1183863 - RNA, 23 nt, Human
cuaagugaaauaagccagacauc

SEQ ID NO: 1183864 - RNA, 16 nt, Human
cuaacuucaccauauu

SEQ ID NO: 1183865 - RNA, 20 nt, Human
cuaacgaaguauccuucagc

SEQ ID NO: 1183866 - RNA, 15 nt, Human
cuaacuucaccauau

SEQ ID NO: 1183867 - RNA, 22 nt, Human
cuaguuccaccaucaagccacc

SEQ ID NO: 1183868 - RNA, 23 nt, Human
cuaguugaucagcuuauugucua

SEQ ID NO: 1183869 - RNA, 22 nt, Human
cuaguuguuugauucagacagc

SEQ ID NO: 1183870 - RNA, 19 nt, Human
cuagccugugccucuggga

SEQ ID NO: 1183871 - RNA, 19 nt, Human
cuagggaaaaaccagcgug

SEQ ID NO: 1183872 - RNA, 21 nt, Human
cuagggaaaaaccagcgugug

SEQ ID NO: 1183873 - RNA, 18 nt, Human
cuaguuccaccaucaagc

SEQ ID NO: 1183874 - RNA, 20 nt, Human
cuaguuccaccaucaagcca

SEQ ID NO: 1183875 - RNA, 19 nt, Human
cuagaaauuccccacccug

SEQ ID NO: 1183876 - RNA, 16 nt, Human
cuagaacucccuuuca

SEQ ID NO: 1183877 - RNA, 17 nt, Human
cuagaacucccuuucaa

SEQ ID NO: 1183878 - RNA, 18 nt, Human
cuagaacucccuuucaac

SEQ ID NO: 1183879 - RNA, 19 nt, Human
cuagaacucccuuucaaca

SEQ ID NO: 1183880 - RNA, 22 nt, Human
cuagcagcagggagggcuucug

SEQ ID NO: 1183881 - RNA, 23 nt, Human
cuagcagcagggagggcuucugc

SEQ ID NO: 1183882 - RNA, 16 nt, Human
cuagcauacguacaca

SEQ ID NO: 1183883 - RNA, 17 nt, Human
cuagcauggcugccaau

SEQ ID NO: 1183884 - RNA, 15 nt, Human
cuaccugaggggccu

SEQ ID NO: 1183885 - RNA, 11 nt, Human
cuaccugaggg

SEQ ID NO: 1183886 - RNA, 14 nt, Human
cuaccugaggggcc

SEQ ID NO: 1183887 - RNA, 16 nt, Human
cuccaagaccuucucc

SEQ ID NO: 1183888 - RNA, 17 nt, Human
cuccaagaccuucuccu

SEQ ID NO: 1183889 - RNA, 18 nt, Human
cuccaagaccuucuccuu

SEQ ID NO: 1183890 - RNA, 21 nt, Human
cuccaagaccuucuccuucac

SEQ ID NO: 1183891 - RNA, 22 nt, Human
cuccacuuucuagccagaggag

SEQ ID NO: 1183892 - RNA, 15 nt, Human
cuccagaauuuccca

SEQ ID NO: 1183893 - RNA, 18 nt, Human
cuccagaauuucccaaag

SEQ ID NO: 1183894 - RNA, 21 nt, Human
cuccagaauuucccaaagcag

SEQ ID NO: 1183895 - RNA, 17 nt, Human
cuccagacacaugucca

SEQ ID NO: 1183896 - RNA, 19 nt, Human
cuccagacacauguccaag

SEQ ID NO: 1183897 - RNA, 11 nt, Human
cuccaggugca

SEQ ID NO: 1183898 - RNA, 19 nt, Human
cuccgcuuucuacccagcg

SEQ ID NO: 1183899 - RNA, 21 nt, Human
cuccagugagacagcucugca

SEQ ID NO: 1183900 - RNA, 12 nt, Human
cucccaccucag

SEQ ID NO: 1183901 - RNA, 13 nt, Human
cucccaccucagc

SEQ ID NO: 1183902 - RNA, 14 nt, Human
cucauguucuuaau

SEQ ID NO: 1183903 - RNA, 18 nt, Human
cucauguucuuaauucuu

SEQ ID NO: 1183904 - RNA, 19 nt, Human
cucauguucuuaauucuua

SEQ ID NO: 1183905 - RNA, 17 nt, Human
cucagucuggcccuucc

SEQ ID NO: 1183906 - RNA, 18 nt, Human
cucagucuggcccuuccu

SEQ ID NO: 1183907 - RNA, 20 nt, Human
cucagucuggcccuuccuuu

SEQ ID NO: 1183908 - RNA, 13 nt, Human
cucagugccacua

SEQ ID NO: 1183909 - RNA, 13 nt, Human
cucagccucccaa

SEQ ID NO: 1183910 - RNA, 21 nt, Human
cucagccucccaaagugcugg

SEQ ID NO: 1183911 - RNA, 14 nt, Human
cucagccucccaaa

SEQ ID NO: 1183912 - RNA, 16 nt, Human
cucagccucccaaagu

SEQ ID NO: 1183913 - RNA, 22 nt, Human
cucagccucccaaagugcuggg

SEQ ID NO: 1183914 - RNA, 13 nt, Human
cucagccucccga

SEQ ID NO: 1183915 - RNA, 13 nt, Human
cucagcggggaca

SEQ ID NO: 1183916 - RNA, 13 nt, Human
cucaggccagcug

SEQ ID NO: 1183917 - RNA, 14 nt, Human
cucaggccagcugc

SEQ ID NO: 1183918 - RNA, 15 nt, Human
cucaggccagcugcu

SEQ ID NO: 1183919 - RNA, 21 nt, Human
cucaggccagcugcuugggcu

SEQ ID NO: 1183920 - RNA, 22 nt, Human
cucaggccagcugcuugggcuu

SEQ ID NO: 1183921 - RNA, 22 nt, Human
cucaggccugggggcugggcag

SEQ ID NO: 1183922 - RNA, 21 nt, Human
cucaggccugggggcugggca

SEQ ID NO: 1183923 - RNA, 14 nt, Human
cucaggccuggggg

SEQ ID NO: 1183924 - RNA, 20 nt, Human
cucaggccugggggcugggc

SEQ ID NO: 1183925 - RNA, 20 nt, Human
cuccgcuuucuacccagcga

SEQ ID NO: 1183926 - RNA, 12 nt, Human
cucucacuccuu

SEQ ID NO: 1183927 - RNA, 14 nt, Human
cucucacuccuuga

SEQ ID NO: 1183928 - RNA, 15 nt, Human
cucucacuccuugaa

SEQ ID NO: 1183929 - RNA, 19 nt, Human
cucucagauuguaccauug

SEQ ID NO: 1183930 - RNA, 15 nt, Human
cucuccccaugaugu

SEQ ID NO: 1183931 - RNA, 12 nt, Human
cucuccuccaga

SEQ ID NO: 1183932 - RNA, 11 nt, Human
cucucuggccu

SEQ ID NO: 1183933 - RNA, 12 nt, Human
cucucuggccuu

SEQ ID NO: 1183934 - RNA, 13 nt, Human
cucucuggccuuc

SEQ ID NO: 1183935 - RNA, 15 nt, Human
cucugaaggacauug

SEQ ID NO: 1183936 - RNA, 19 nt, Human
cucugguccauagagagca

SEQ ID NO: 1183937 - RNA, 16 nt, Human
cucugguccauagaga

SEQ ID NO: 1183938 - RNA, 18 nt, Human
cucugguccauagagagc

SEQ ID NO: 1183939 - RNA, 17 nt, Human
cucugcugacagacaca

SEQ ID NO: 1183940 - RNA, 18 nt, Human
cucugcugacagacacag

SEQ ID NO: 1183941 - RNA, 19 nt, Human
cucugcugacagacacagg

SEQ ID NO: 1183942 - RNA, 20 nt, Human
cucugcugacagacacaggc

SEQ ID NO: 1183943 - RNA, 15 nt, Human
cucuuagaugcaguu

SEQ ID NO: 1183944 - RNA, 13 nt, Human
cucuguacagagc

SEQ ID NO: 1183945 - RNA, 21 nt, Human
cucuguacagagcccacgccc

SEQ ID NO: 1183946 - RNA, 14 nt, Human
cucugcacuccccu

SEQ ID NO: 1183947 - RNA, 18 nt, Human
cucugcagcaauaaagca

SEQ ID NO: 1183948 - RNA, 19 nt, Human
cucugcagcaauaaagcag

SEQ ID NO: 1183949 - RNA, 23 nt, Human
cucugcagcaauaaagcagcguu

SEQ ID NO: 1183950 - RNA, 22 nt, Human
cucugaaggacauugcggacag

SEQ ID NO: 1183951 - RNA, 16 nt, Human
cugaaaauguaugugu

SEQ ID NO: 1183952 - RNA, 19 nt, Human
cugaaggacauugcggaca

SEQ ID NO: 1183953 - RNA, 20 nt, Human
cugaaggacauugcggacag

SEQ ID NO: 1183954 - RNA, 21 nt, Human
cugaaggacauugcggacagc

SEQ ID NO: 1183955 - RNA, 13 nt, Human
cugaaggccccgc

SEQ ID NO: 1183956 - RNA, 14 nt, Human
cugaaggccccgcc

SEQ ID NO: 1183957 - RNA, 17 nt, Human
cugaaggccccgcccag

SEQ ID NO: 1183958 - RNA, 18 nt, Human
cugaaggccccgcccagg

SEQ ID NO: 1183959 - RNA, 20 nt, Human
cucuuagaugcaguucugaa

SEQ ID NO: 1183960 - RNA, 21 nt, Human
cucuuagaugcaguucugaag

SEQ ID NO: 1183961 - RNA, 12 nt, Human
cugacagacaca

SEQ ID NO: 1183962 - RNA, 14 nt, Human
cugacagacacagg

SEQ ID NO: 1183963 - RNA, 15 nt, Human
cugacagacacaggc

SEQ ID NO: 1183964 - RNA, 18 nt, Human
cugacccaugcugcccug

SEQ ID NO: 1183965 - RNA, 19 nt, Human
cugacccaugcugcccugu

SEQ ID NO: 1183966 - RNA, 20 nt, Human
cugacccaugcugcccugug

SEQ ID NO: 1183967 - RNA, 12 nt, Human
cugccauccagg

SEQ ID NO: 1183968 - RNA, 11 nt, Human
cugccagggac

SEQ ID NO: 1183969 - RNA, 12 nt, Human
cugccagggaca

SEQ ID NO: 1183970 - RNA, 15 nt, Human
cugccagggacagag

SEQ ID NO: 1183971 - RNA, 21 nt, Human
cugccauauucuguuggccag

SEQ ID NO: 1183972 - RNA, 22 nt, Human
cugccauauucuguuggccagu

SEQ ID NO: 1183973 - RNA, 23 nt, Human
cugccauauucuguuggccagug

SEQ ID NO: 1183974 - RNA, 14 nt, Human
cugccccucaacuc

SEQ ID NO: 1183975 - RNA, 22 nt, Human
cugccccucaacucuccuccag

SEQ ID NO: 1183976 - RNA, 12 nt, Human
cugcccugugag

SEQ ID NO: 1183977 - RNA, 13 nt, Human
cugcccugugagu

SEQ ID NO: 1183978 - RNA, 15 nt, Human
cugcccugugggccc

SEQ ID NO: 1183979 - RNA, 16 nt, Human
cugcccugugggcccc

SEQ ID NO: 1183980 - RNA, 18 nt, Human
cugcccugugggccccca

SEQ ID NO: 1183981 - RNA, 15 nt, Human
cugccaaugggagcu

SEQ ID NO: 1183982 - RNA, 17 nt, Human
cugccaaugggagcuca

SEQ ID NO: 1183983 - RNA, 13 nt, Human
cugcauuggcuuu

SEQ ID NO: 1183984 - RNA, 20 nt, Human
cugcauuuaaaagauacagu

SEQ ID NO: 1183985 - RNA, 22 nt, Human
cugcauuuaaaagauacaguua

SEQ ID NO: 1183986 - RNA, 13 nt, Human
cugcauguuacau

SEQ ID NO: 1183987 - RNA, 15 nt, Human
cugcauguuugugau

SEQ ID NO: 1183988 - RNA, 17 nt, Human
cugagacucgcgacaau

SEQ ID NO: 1183989 - RNA, 19 nt, Human
cugagacucgcgacaaugc

SEQ ID NO: 1183990 - RNA, 20 nt, Human
cugagacucgcgacaaugca

SEQ ID NO: 1183991 - RNA, 19 nt, Human
cugcccugugggcccccaa

SEQ ID NO: 1183992 - RNA, 15 nt, Human
cugccucgaacuggc

SEQ ID NO: 1183993 - RNA, 17 nt, Human
cugccucgaacuggcug

SEQ ID NO: 1183994 - RNA, 18 nt, Human
cugccucgaacuggcugc

SEQ ID NO: 1183995 - RNA, 19 nt, Human
cugccucgaacuggcugca

SEQ ID NO: 1183996 - RNA, 23 nt, Human
cugccugggaucccucauccuca

SEQ ID NO: 1183997 - RNA, 14 nt, Human
cugccuguucagcu

SEQ ID NO: 1183998 - RNA, 15 nt, Human
cugccuguucagcuc

SEQ ID NO: 1183999 - RNA, 16 nt, Human
cugccuguugggccag

SEQ ID NO: 1184000 - RNA, 18 nt, Human
cugccuguugggccagga

SEQ ID NO: 1184001 - RNA, 19 nt, Human
cugccuguugggccaggag

SEQ ID NO: 1184002 - RNA, 20 nt, Human
cugccuguugggccaggagc

SEQ ID NO: 1184003 - RNA, 16 nt, Human
cugcuaauuccccaga

SEQ ID NO: 1184004 - RNA, 15 nt, Human
cugcuacagagcaga

SEQ ID NO: 1184005 - RNA, 15 nt, Human
cugcugacagacaca

SEQ ID NO: 1184006 - RNA, 18 nt, Human
cugcugacagacacaggc

SEQ ID NO: 1184007 - RNA, 19 nt, Human
cugcugacagacacaggcc

SEQ ID NO: 1184008 - RNA, 20 nt, Human
cugcugacagacacaggccc

SEQ ID NO: 1184009 - RNA, 21 nt, Human
cugcugacagacacaggcccg

SEQ ID NO: 1184010 - RNA, 23 nt, Human
cugcugacagacacaggcccggc

SEQ ID NO: 1184011 - RNA, 11 nt, Human
cugcugacagu

SEQ ID NO: 1184012 - RNA, 13 nt, Human
cugcuuaacuuca

SEQ ID NO: 1184013 - RNA, 15 nt, Human
cugcuuaacuucaca

SEQ ID NO: 1184014 - RNA, 17 nt, Human
cugcuuaacuucacaua

SEQ ID NO: 1184015 - RNA, 20 nt, Human
cugcuuaacuucacauauug

SEQ ID NO: 1184016 - RNA, 13 nt, Human
cugcuucagccuc

SEQ ID NO: 1184017 - RNA, 14 nt, Human
cugcuucagccucc

SEQ ID NO: 1184018 - RNA, 16 nt, Human
cugcuucagccucccg

SEQ ID NO: 1184019 - RNA, 22 nt, Human
cugcuuuuuaaagaaugcucuu

SEQ ID NO: 1184020 - RNA, 23 nt, Human
cugcuucagccucccgaguagcu

SEQ ID NO: 1184021 - RNA, 16 nt, Human
cuggaaauauuaagaa

SEQ ID NO: 1184022 - RNA, 21 nt, Human
cuggaaaucaggguuaguauu

SEQ ID NO: 1184023 - RNA, 17 nt, Human
cuggaacacuaaugagg

SEQ ID NO: 1184024 - RNA, 13 nt, Human
cugucgcccaguc

SEQ ID NO: 1184025 - RNA, 19 nt, Human
cugucgagaaacagccugu

SEQ ID NO: 1184026 - RNA, 15 nt, Human
cugucgcccagucug

SEQ ID NO: 1184027 - RNA, 15 nt, Human
cugugaagagaacca

SEQ ID NO: 1184028 - RNA, 16 nt, Human
cugugagaugcuagaa

SEQ ID NO: 1184029 - RNA, 21 nt, Human
cugugagaugcuagaacuccc

SEQ ID NO: 1184030 - RNA, 19 nt, Human
cugugcuccauggcugcca

SEQ ID NO: 1184031 - RNA, 14 nt, Human
cugugcucuggaca

SEQ ID NO: 1184032 - RNA, 15 nt, Human
cugugcucuggacag

SEQ ID NO: 1184033 - RNA, 20 nt, Human
cugucauuugagcagggcuc

SEQ ID NO: 1184034 - RNA, 17 nt, Human
cugucauuugagcaggg

SEQ ID NO: 1184035 - RNA, 18 nt, Human
cugucauuugagcagggc

SEQ ID NO: 1184036 - RNA, 18 nt, Human
cugucagccauuccuguu

SEQ ID NO: 1184037 - RNA, 21 nt, Human
cuguaggaagguuaauguuca

SEQ ID NO: 1184038 - RNA, 14 nt, Human
cuggguucacugca

SEQ ID NO: 1184039 - RNA, 15 nt, Human
cuggguucacugcaa

SEQ ID NO: 1184040 - RNA, 14 nt, Human
cuggguucuaccca

SEQ ID NO: 1184041 - RNA, 15 nt, Human
cuggugacuuuccuc

SEQ ID NO: 1184042 - RNA, 20 nt, Human
cuggugacuuuccucuuugg

SEQ ID NO: 1184043 - RNA, 21 nt, Human
cuggugacuuuccucuuuggu

SEQ ID NO: 1184044 - RNA, 23 nt, Human
cuggguggcaccagcagccugga

SEQ ID NO: 1184045 - RNA, 16 nt, Human
cuggguguggcgcagc

SEQ ID NO: 1184046 - RNA, 17 nt, Human
cuggguguggcgcagca

SEQ ID NO: 1184047 - RNA, 23 nt, Human
cuggugacuuuccucuuuggucu

SEQ ID NO: 1184048 - RNA, 18 nt, Human
cugggcagaaggaagacu

SEQ ID NO: 1184049 - RNA, 12 nt, Human
cugggcagagga

SEQ ID NO: 1184050 - RNA, 17 nt, Human
cugggcagaaggaagac

SEQ ID NO: 1184051 - RNA, 17 nt, Human
cuggccccucagggucc

SEQ ID NO: 1184052 - RNA, 18 nt, Human
cuggccccucaggguccc

SEQ ID NO: 1184053 - RNA, 20 nt, Human
cuggccccucagggucccug

SEQ ID NO: 1184054 - RNA, 21 nt, Human
cuggccccucagggucccugg

SEQ ID NO: 1184055 - RNA, 10 nt, Human
cugggacagg

SEQ ID NO: 1184056 - RNA, 12 nt, Human
cugggacacagu

SEQ ID NO: 1184057 - RNA, 13 nt, Human
cugggacacaguu

SEQ ID NO: 1184058 - RNA, 12 nt, Human
cuggcagcucag

SEQ ID NO: 1184059 - RNA, 13 nt, Human
cuggcagcucaga

SEQ ID NO: 1184060 - RNA, 14 nt, Human
cuggcagcucagag

SEQ ID NO: 1184061 - RNA, 15 nt, Human
cuggcagcucagaga

SEQ ID NO: 1184062 - RNA, 13 nt, Human
cuggccccucagg

SEQ ID NO: 1184063 - RNA, 16 nt, Human
cuuuugccguuauuaa

SEQ ID NO: 1184064 - RNA, 23 nt, Human
cuuuugcccacacuugggagcaa

SEQ ID NO: 1184065 - RNA, 18 nt, Human
cuuuugucuaugggacuc

SEQ ID NO: 1184066 - RNA, 12 nt, Human
cuuuugugcauu

SEQ ID NO: 1184067 - RNA, 13 nt, Human
cuuuugugcauua

SEQ ID NO: 1184068 - RNA, 21 nt, Human
gaaaauggaagacagcucuua

SEQ ID NO: 1184069 - RNA, 18 nt, Human
gaaaagaaaaaugagccu

SEQ ID NO: 1184070 - RNA, 14 nt, Human
gaaaaacugauuuu

SEQ ID NO: 1184071 - RNA, 19 nt, Human
gaaaauggacguguuauga

SEQ ID NO: 1184072 - RNA, 23 nt, Human
gaaaauggacguguuaugacucc

SEQ ID NO: 1184073 - RNA, 15 nt, Human
gaaaauguaugugua

SEQ ID NO: 1184074 - RNA, 14 nt, Human
gaaaauuuuaaaaa

SEQ ID NO: 1184075 - RNA, 22 nt, Human
gaaagggacuuggaagcuccgc

SEQ ID NO: 1184076 - RNA, 20 nt, Human
gaaagggacgcuacccggga

SEQ ID NO: 1184077 - RNA, 19 nt, Human
gaaagggacuuggaagcuc

SEQ ID NO: 1184078 - RNA, 17 nt, Human
gaaauauuuauuuuaau

SEQ ID NO: 1184079 - RNA, 18 nt, Human
gaaauauuuauuuuaaua

SEQ ID NO: 1184080 - RNA, 22 nt, Human
gaaauauuuauuuuaauaaugu

SEQ ID NO: 1184081 - RNA, 22 nt, Human
gaaaggcuccaggagcagccac

SEQ ID NO: 1184082 - RNA, 21 nt, Human
gaaaggcuccaggagcagcca

SEQ ID NO: 1184083 - RNA, 16 nt, Human
cuuucuagccagagga

SEQ ID NO: 1184084 - RNA, 15 nt, Human
cuuucuagccagagg

SEQ ID NO: 1184085 - RNA, 13 nt, Human
cuuuuauaaacuu

SEQ ID NO: 1184086 - RNA, 14 nt, Human
cuuuuauaaacuuu

SEQ ID NO: 1184087 - RNA, 23 nt, Human
cuuucagccaagaauucuuaaau

SEQ ID NO: 1184088 - RNA, 22 nt, Human
cuuuccugaggcugggcucccu

SEQ ID NO: 1184089 - RNA, 17 nt, Human
cuuccugcaacaccuug

SEQ ID NO: 1184090 - RNA, 15 nt, Human
cuucugccauauucu

SEQ ID NO: 1184091 - RNA, 21 nt, Human
cuucugacccaugcugcccug

SEQ ID NO: 1184092 - RNA, 22 nt, Human
cuucugacccaugcugcccugu

SEQ ID NO: 1184093 - RNA, 23 nt, Human
cuucugacccaugcugcccugug

SEQ ID NO: 1184094 - RNA, 19 nt, Human
cuugaauuguaaggaauga

SEQ ID NO: 1184095 - RNA, 14 nt, Human
cuugacagggcaca

SEQ ID NO: 1184096 - RNA, 15 nt, Human
cuugacagggcacac

SEQ ID NO: 1184097 - RNA, 20 nt, Human
cuugacagggcacaccgggc

SEQ ID NO: 1184098 - RNA, 17 nt, Human
cuugauauccucuuuga

SEQ ID NO: 1184099 - RNA, 12 nt, Human
cuugaugaagaa

SEQ ID NO: 1184100 - RNA, 13 nt, Human
cuugaugaagaag

SEQ ID NO: 1184101 - RNA, 12 nt, Human
cuuggcgcugcc

SEQ ID NO: 1184102 - RNA, 14 nt, Human
cuuggcgcugcccc

SEQ ID NO: 1184103 - RNA, 17 nt, Human
cuuggcgcugccccugg

SEQ ID NO: 1184104 - RNA, 20 nt, Human
cuuggcgcugccccuggcag

SEQ ID NO: 1184105 - RNA, 11 nt, Human
cuucccaccuc

SEQ ID NO: 1184106 - RNA, 21 nt, Human
cuucccaccucucucacuccu

SEQ ID NO: 1184107 - RNA, 23 nt, Human
cuucccaccucucucacuccuug

SEQ ID NO: 1184108 - RNA, 15 nt, Human
cuucacuguaaaaua

SEQ ID NO: 1184109 - RNA, 18 nt, Human
cuucagagacuccugcag

SEQ ID NO: 1184110 - RNA, 19 nt, Human
cuucagagacuccugcagg

SEQ ID NO: 1184111 - RNA, 20 nt, Human
cuucagagacuccugcaggc

SEQ ID NO: 1184112 - RNA, 21 nt, Human
cuuccagugaggcucugcccu

SEQ ID NO: 1184113 - RNA, 22 nt, Human
cuuccagugaggcucugcccuu

SEQ ID NO: 1184114 - RNA, 23 nt, Human
cuuccagugaggcucugcccuug

SEQ ID NO: 1184115 - RNA, 13 nt, Human
cuuauggaacacu

SEQ ID NO: 1184116 - RNA, 16 nt, Human
cuuauggaacacucug

SEQ ID NO: 1184117 - RNA, 17 nt, Human
cuuauggaacacucuga

SEQ ID NO: 1184118 - RNA, 19 nt, Human
cuuauggaacacucugaga

SEQ ID NO: 1184119 - RNA, 20 nt, Human
cuuauggaacacucugagac

SEQ ID NO: 1184120 - RNA, 21 nt, Human
cuuauggaacacucugagacu

SEQ ID NO: 1184121 - RNA, 12 nt, Human
cuuauugcccac

SEQ ID NO: 1184122 - RNA, 21 nt, Human
cuucaccuuuguccccaccgc

SEQ ID NO: 1184123 - RNA, 22 nt, Human
cuucaccuuuguccccaccgca

SEQ ID NO: 1184124 - RNA, 15 nt, Human
cuucacggaagagcc

SEQ ID NO: 1184125 - RNA, 19 nt, Human
cuucacggaagagccuugc

SEQ ID NO: 1184126 - RNA, 12 nt, Human
cugugcugaguc

SEQ ID NO: 1184127 - RNA, 14 nt, Human
cugugcugagucug

SEQ ID NO: 1184128 - RNA, 19 nt, Human
cugugcugagucugaaggc

SEQ ID NO: 1184129 - RNA, 23 nt, Human
gcaggcucucaggccagcugcuu

SEQ ID NO: 1184130 - RNA, 17 nt, Human
gcagcugcgguccaccc

SEQ ID NO: 1184131 - RNA, 19 nt, Human
gcagcugcgguccacccag

SEQ ID NO: 1184132 - RNA, 20 nt, Human
gcaggcucucaggccagcug

SEQ ID NO: 1184133 - RNA, 22 nt, Human
gcaggcucucaggccagcugcu

SEQ ID NO: 1184134 - RNA, 13 nt, Human
gcagggaaacagc

SEQ ID NO: 1184135 - RNA, 14 nt, Human
gcauacguacacau

SEQ ID NO: 1184136 - RNA, 17 nt, Human
gcauaccacuuuuguuc

SEQ ID NO: 1184137 - RNA, 20 nt, Human
gcauaccacuuuuguucuug

SEQ ID NO: 1184138 - RNA, 16 nt, Human
gcagccacauuccuga

SEQ ID NO: 1184139 - RNA, 14 nt, Human
gcagccacuauugu

SEQ ID NO: 1184140 - RNA, 12 nt, Human
gcagccaggcca

SEQ ID NO: 1184141 - RNA, 13 nt, Human
gcagccaggccac

SEQ ID NO: 1184142 - RNA, 14 nt, Human
gcagccaggccaca

SEQ ID NO: 1184143 - RNA, 16 nt, Human
gcagccaggccacaag

SEQ ID NO: 1184144 - RNA, 17 nt, Human
gcagccccauucugccu

SEQ ID NO: 1184145 - RNA, 22 nt, Human
gcacaagcugcacccucaggca

SEQ ID NO: 1184146 - RNA, 19 nt, Human
gcacaucagcacgauuucu

SEQ ID NO: 1184147 - RNA, 20 nt, Human
gcacaucagcacgauuucug

SEQ ID NO: 1184148 - RNA, 21 nt, Human
gcacaucagcacgauuucugu

SEQ ID NO: 1184149 - RNA, 13 nt, Human
gcacaugccucuc

SEQ ID NO: 1184150 - RNA, 14 nt, Human
gcacaugccucucu

SEQ ID NO: 1184151 - RNA, 17 nt, Human
gcacaugccucucucag

SEQ ID NO: 1184152 - RNA, 18 nt, Human
gcacaugccucucucagg

SEQ ID NO: 1184153 - RNA, 19 nt, Human
gcacaugccucucucaggc

SEQ ID NO: 1184154 - RNA, 20 nt, Human
gcacaugccucucucaggcc

SEQ ID NO: 1184155 - RNA, 21 nt, Human
gcacaugccucucucaggcca

SEQ ID NO: 1184156 - RNA, 22 nt, Human
gcacaugccucucucaggccaa

SEQ ID NO: 1184157 - RNA, 19 nt, Human
gcaccggcuggccuggccc

SEQ ID NO: 1184158 - RNA, 21 nt, Human
gcaccggcuggccuggccccu

SEQ ID NO: 1184159 - RNA, 23 nt, Human
gcaccggcuggccuggccccuca

SEQ ID NO: 1184160 - RNA, 14 nt, Human
gcaccgggccacag

SEQ ID NO: 1184161 - RNA, 13 nt, Human
gcaagugagagcu

SEQ ID NO: 1184162 - RNA, 15 nt, Human
gcaagugagagcugg

SEQ ID NO: 1184163 - RNA, 23 nt, Human
gcaauaaggggagaguaacccug

SEQ ID NO: 1184164 - RNA, 22 nt, Human
gcacaagcuccaagcucccagg

SEQ ID NO: 1184165 - RNA, 23 nt, Human
gcacaagcuccaagcucccaggc

SEQ ID NO: 1184166 - RNA, 14 nt, Human
gcacaagcugcacc

SEQ ID NO: 1184167 - RNA, 19 nt, Human
gcagagcaccuuagacagu

SEQ ID NO: 1184168 - RNA, 22 nt, Human
gcagagcaccuuagacaguccc

SEQ ID NO: 1184169 - RNA, 23 nt, Human
gcagagcaccuuagacagucccu

SEQ ID NO: 1184170 - RNA, 24 nt, Human
gcagagcaccuuagacagucccug

SEQ ID NO: 1184171 - RNA, 12 nt, Human
gcagagcagaga

SEQ ID NO: 1184172 - RNA, 14 nt, Human
gcagagcagagacc

SEQ ID NO: 1184173 - RNA, 15 nt, Human
gcagagcagagacca

SEQ ID NO: 1184174 - RNA, 19 nt, Human
gcagagcagagaccauccc

SEQ ID NO: 1184175 - RNA, 20 nt, Human
gcagagcagagaccaucccu

SEQ ID NO: 1184176 - RNA, 12 nt, Human
gcacugacauug

SEQ ID NO: 1184177 - RNA, 14 nt, Human
gauuaccagggacu

SEQ ID NO: 1184178 - RNA, 18 nt, Human
gaucucuugagccuggga

SEQ ID NO: 1184179 - RNA, 17 nt, Human
gaucucuugagccuggg

SEQ ID NO: 1184180 - RNA, 12 nt, Human
gaucucuugagc

SEQ ID NO: 1184181 - RNA, 16 nt, Human
gaucucuugagccugg

SEQ ID NO: 1184182 - RNA, 16 nt, Human
gauauuuugcuuugug

SEQ ID NO: 1184183 - RNA, 15 nt, Human
gauauuuuuuucuuu

SEQ ID NO: 1184184 - RNA, 17 nt, Human
gauauuuuuuucuuuuc

SEQ ID NO: 1184185 - RNA, 15 nt, Human
gaucucuaacuucac

SEQ ID NO: 1184186 - RNA, 20 nt, Human
gaugaucuuugcagacaggc

SEQ ID NO: 1184187 - RNA, 21 nt, Human
gaugaucuuugcagacaggca

SEQ ID NO: 1184188 - RNA, 21 nt, Human
gaugaugaaaugaggucagag

SEQ ID NO: 1184189 - RNA, 13 nt, Human
gauacccauccca

SEQ ID NO: 1184190 - RNA, 14 nt, Human
gauacccaucccau

SEQ ID NO: 1184191 - RNA, 11 nt, Human
gauacuacagu

SEQ ID NO: 1184192 - RNA, 16 nt, Human
gauacuacaguuuguu

SEQ ID NO: 1184193 - RNA, 20 nt, Human
gauauguaccuaacgaagua

SEQ ID NO: 1184194 - RNA, 13 nt, Human
gaggucuguucuu

SEQ ID NO: 1184195 - RNA, 14 nt, Human
gaggucuguucuuu

SEQ ID NO: 1184196 - RNA, 11 nt, Human
gaggugggagg

SEQ ID NO: 1184197 - RNA, 12 nt, Human
gaggugggaucc

SEQ ID NO: 1184198 - RNA, 13 nt, Human
gaggugggauccu

SEQ ID NO: 1184199 - RNA, 13 nt, Human
gagucaccaagcc

SEQ ID NO: 1184200 - RNA, 14 nt, Human
gagucaccaagccc

SEQ ID NO: 1184201 - RNA, 15 nt, Human
gagucaccaagccca

SEQ ID NO: 1184202 - RNA, 16 nt, Human
gagucccaccuuggcu

SEQ ID NO: 1184203 - RNA, 20 nt, Human
gagucccaccuuggcugcag

SEQ ID NO: 1184204 - RNA, 21 nt, Human
gagucccaccuuggcugcagg

SEQ ID NO: 1184205 - RNA, 12 nt, Human
gagugagcuggu

SEQ ID NO: 1184206 - RNA, 11 nt, Human
gagugcaguga

SEQ ID NO: 1184207 - RNA, 12 nt, Human
gagugcagugag

SEQ ID NO: 1184208 - RNA, 13 nt, Human
gagugcagugagc

SEQ ID NO: 1184209 - RNA, 16 nt, Human
gaguuguuacauuuuu

SEQ ID NO: 1184210 - RNA, 20 nt, Human
gaguuguuacauuuuuaagu

SEQ ID NO: 1184211 - RNA, 22 nt, Human
gaguuguuacauuuuuaagugc

SEQ ID NO: 1184212 - RNA, 16 nt, Human
gaguuuagcuggaaaa

SEQ ID NO: 1184213 - RNA, 20 nt, Human
gaguuugggguaugggagag

SEQ ID NO: 1184214 - RNA, 21 nt, Human
gagacccugucucaaaaaaag

SEQ ID NO: 1184215 - RNA, 14 nt, Human
gagaaucacuugaa

SEQ ID NO: 1184216 - RNA, 15 nt, Human
gagaaucacuugaac

SEQ ID NO: 1184217 - RNA, 12 nt, Human
gagaaggaagcc

SEQ ID NO: 1184218 - RNA, 13 nt, Human
gagaagcggcugg

SEQ ID NO: 1184219 - RNA, 15 nt, Human
gagaagcggcuggca

SEQ ID NO: 1184220 - RNA, 16 nt, Human
gagaagcggcuggcag

SEQ ID NO: 1184221 - RNA, 23 nt, Human
gacuuuucuuucagccaagaauu

SEQ ID NO: 1184222 - RNA, 21 nt, Human
gacuuuucuuuguggcuuccu

SEQ ID NO: 1184223 - RNA, 22 nt, Human
gacuaucuaaauguugaaagau

SEQ ID NO: 1184224 - RNA, 12 nt, Human
gacucugucuca

SEQ ID NO: 1184225 - RNA, 19 nt, Human
gacucugucucaaaaaaac

SEQ ID NO: 1184226 - RNA, 16 nt, Human
gacucuuaagaagacu

SEQ ID NO: 1184227 - RNA, 17 nt, Human
gacucuuaagaagacug

SEQ ID NO: 1184228 - RNA, 18 nt, Human
gacucuuaagaagacugc

SEQ ID NO: 1184229 - RNA, 18 nt, Human
gagcugggugucaagagg

SEQ ID NO: 1184230 - RNA, 14 nt, Human
gagccuuccagggg

SEQ ID NO: 1184231 - RNA, 15 nt, Human
gagccuuccaggggu

SEQ ID NO: 1184232 - RNA, 16 nt, Human
gagccuuccaggggug

SEQ ID NO: 1184233 - RNA, 17 nt, Human
gagccuuccaggggugg

SEQ ID NO: 1184234 - RNA, 22 nt, Human
gagccuugaacuuugaccucug

SEQ ID NO: 1184235 - RNA, 13 nt, Human
gagccccgaggcc

SEQ ID NO: 1184236 - RNA, 18 nt, Human
gagcggagaaaggaaggg

SEQ ID NO: 1184237 - RNA, 21 nt, Human
gagcggagaaaggaagggcug

SEQ ID NO: 1184238 - RNA, 13 nt, Human
gagcgacagugag

SEQ ID NO: 1184239 - RNA, 21 nt, Human
gagcugccuguucagcuccag

SEQ ID NO: 1184240 - RNA, 22 nt, Human
gagcugccuguucagcuccagc

SEQ ID NO: 1184241 - RNA, 14 nt, Human
gagcagggcucagc

SEQ ID NO: 1184242 - RNA, 21 nt, Human
gagcagggcucagcggggaca

SEQ ID NO: 1184243 - RNA, 12 nt, Human
gagcaucaggcc

SEQ ID NO: 1184244 - RNA, 22 nt, Human
gagcaugccuggauggggcugc

SEQ ID NO: 1184245 - RNA, 13 nt, Human
gagcaucaggcca

SEQ ID NO: 1184246 - RNA, 22 nt, Human
gagaggcauccaguaucuugaa

SEQ ID NO: 1184247 - RNA, 21 nt, Human
gagaugaugccaugggcccuc

SEQ ID NO: 1184248 - RNA, 15 nt, Human
gagacuccugcaggc

SEQ ID NO: 1184249 - RNA, 16 nt, Human
gagacuccugcaggca

SEQ ID NO: 1184250 - RNA, 17 nt, Human
gagacuccugcaggcag

SEQ ID NO: 1184251 - RNA, 18 nt, Human
gagacuccugcaggcagc

SEQ ID NO: 1184252 - RNA, 14 nt, Human
gagaggcauccagu

SEQ ID NO: 1184253 - RNA, 18 nt, Human
gagauugcaccacugcac

SEQ ID NO: 1184254 - RNA, 21 nt, Human
gagauugcaccacugcacucc

SEQ ID NO: 1184255 - RNA, 13 nt, Human
gagauuuacaacu

SEQ ID NO: 1184256 - RNA, 11 nt, Human
gacagcuccuu

SEQ ID NO: 1184257 - RNA, 20 nt, Human
gacaggguuuugccauguug

SEQ ID NO: 1184258 - RNA, 22 nt, Human
gacaggguuuugccauguuggc

SEQ ID NO: 1184259 - RNA, 14 nt, Human
gacagugaaagaaa

SEQ ID NO: 1184260 - RNA, 17 nt, Human
gacagucaccucaugga

SEQ ID NO: 1184261 - RNA, 13 nt, Human
gacacugaugggc

SEQ ID NO: 1184262 - RNA, 15 nt, Human
gacacugaugggcaa

SEQ ID NO: 1184263 - RNA, 16 nt, Human
gacacuuaaaaauggu

SEQ ID NO: 1184264 - RNA, 12 nt, Human
gacagacacagg

SEQ ID NO: 1184265 - RNA, 21 nt, Human
gacagcccgggcucugccucc

SEQ ID NO: 1184266 - RNA, 22 nt, Human
gacagcccgggcucugccuccc

SEQ ID NO: 1184267 - RNA, 23 nt, Human
gacagcccgggcucugccuccca

SEQ ID NO: 1184268 - RNA, 19 nt, Human
gaauuuuggcugugucucc

SEQ ID NO: 1184269 - RNA, 11 nt, Human
gaauuaguuuu

SEQ ID NO: 1184270 - RNA, 14 nt, Human
gacacacagcucug

SEQ ID NO: 1184271 - RNA, 15 nt, Human
gacacacagcucugu

SEQ ID NO: 1184272 - RNA, 17 nt, Human
gacacacagcucugucc

SEQ ID NO: 1184273 - RNA, 18 nt, Human
gacacacagcucuguccu

SEQ ID NO: 1184274 - RNA, 19 nt, Human
gacacacagcucuguccug

SEQ ID NO: 1184275 - RNA, 23 nt, Human
gaauuuuggcugugucucccuuc

SEQ ID NO: 1184276 - RNA, 20 nt, Human
gaauuuugugcccccaugua

SEQ ID NO: 1184277 - RNA, 21 nt, Human
gaauuuugugcccccauguaa

SEQ ID NO: 1184278 - RNA, 13 nt, Human
gacacacugaaga

SEQ ID NO: 1184279 - RNA, 21 nt, Human
gacacacagcucuguccuggg

SEQ ID NO: 1184280 - RNA, 12 nt, Human
gacacacaugaa

SEQ ID NO: 1184281 - RNA, 14 nt, Human
gacacacugaagaa

SEQ ID NO: 1184282 - RNA, 18 nt, Human
gaagucuuuguacagaca

SEQ ID NO: 1184283 - RNA, 19 nt, Human
gaagucuuuguacagacaa

SEQ ID NO: 1184284 - RNA, 20 nt, Human
gaagucuuuguacagacaac

SEQ ID NO: 1184285 - RNA, 19 nt, Human
gaagcuccgcuuucuaccc

SEQ ID NO: 1184286 - RNA, 16 nt, Human
gaaggcucgagcaugc

SEQ ID NO: 1184287 - RNA, 17 nt, Human
gaaggcucgagcaugcc

SEQ ID NO: 1184288 - RNA, 19 nt, Human
gaaggcucgagcaugccug

SEQ ID NO: 1184289 - RNA, 14 nt, Human
gaagcucagggccu

SEQ ID NO: 1184290 - RNA, 15 nt, Human
gaagcucagggccug

SEQ ID NO: 1184291 - RNA, 16 nt, Human
gaagcucagggccugg

SEQ ID NO: 1184292 - RNA, 17 nt, Human
gaagcucagggccuggc

SEQ ID NO: 1184293 - RNA, 18 nt, Human
gaagcucagggccuggcu

SEQ ID NO: 1184294 - RNA, 19 nt, Human
gaagcucagggccuggcuc

SEQ ID NO: 1184295 - RNA, 20 nt, Human
gaagcucagggccuggcuca

SEQ ID NO: 1184296 - RNA, 21 nt, Human
gaagcucagggccuggcucag

SEQ ID NO: 1184297 - RNA, 23 nt, Human
gaagcucagggccuggcucaggu

SEQ ID NO: 1184298 - RNA, 11 nt, Human
gaaugaauguc

SEQ ID NO: 1184299 - RNA, 14 nt, Human
gaaugaaugucagu

SEQ ID NO: 1184300 - RNA, 18 nt, Human
gaaugaaugucaguguga

SEQ ID NO: 1184301 - RNA, 22 nt, Human
gaaugaaugucagugugacuga

SEQ ID NO: 1184302 - RNA, 20 nt, Human
gaaugagagacacacugaag

SEQ ID NO: 1184303 - RNA, 22 nt, Human
gaaugagagacacacugaagaa

SEQ ID NO: 1184304 - RNA, 23 nt, Human
gaaugagagacacacugaagaag

SEQ ID NO: 1184305 - RNA, 21 nt, Human
gggacagcuccuucuguccua

SEQ ID NO: 1184306 - RNA, 20 nt, Human
gggacauuugcucauggaau

SEQ ID NO: 1184307 - RNA, 21 nt, Human
gggacauuugcucauggaauu

SEQ ID NO: 1184308 - RNA, 13 nt, Human
gggaaggauacaa

SEQ ID NO: 1184309 - RNA, 16 nt, Human
gggaaggauacaaaag

SEQ ID NO: 1184310 - RNA, 13 nt, Human
gggacagaggggg

SEQ ID NO: 1184311 - RNA, 22 nt, Human
gggacagaggggguggccuccc

SEQ ID NO: 1184312 - RNA, 23 nt, Human
gggacagaggggguggccuccca

SEQ ID NO: 1184313 - RNA, 14 nt, Human
aaaaaucucaaauu

SEQ ID NO: 1184314 - RNA, 17 nt, Human
aaaaaucucaaauuucu

SEQ ID NO: 1184315 - RNA, 22 nt, Human
aaaacugcugacuguuuucucu

SEQ ID NO: 1184316 - RNA, 23 nt, Human
aaaacugcugacuguuuucucuu

SEQ ID NO: 1184317 - RNA, 13 nt, Human
aaaagaugcuucu

SEQ ID NO: 1184318 - RNA, 15 nt, Human
gggauuacaggugug

SEQ ID NO: 1184319 - RNA, 16 nt, Human
gggauuguaaaauggu

SEQ ID NO: 1184320 - RNA, 17 nt, Human
gggauuguaaaauggug

SEQ ID NO: 1184321 - RNA, 23 nt, Human
gggcagagcagagaccaucccug

SEQ ID NO: 1184322 - RNA, 17 nt, Human
gggcagagcagagacca

SEQ ID NO: 1184323 - RNA, 22 nt, Human
gggcagagcagagaccaucccu

SEQ ID NO: 1184324 - RNA, 16 nt, Human
gggcaacccccagccu

SEQ ID NO: 1184325 - RNA, 18 nt, Human
gggcaacccccagccugc

SEQ ID NO: 1184326 - RNA, 20 nt, Human
gggcaacccccagccugcua

SEQ ID NO: 1184327 - RNA, 16 nt, Human
gggcagagcagagacc

SEQ ID NO: 1184328 - RNA, 19 nt, Human
aaaagguaugcaaucaaau

SEQ ID NO: 1184329 - RNA, 14 nt, Human
gggagggcuccaga

SEQ ID NO: 1184330 - RNA, 15 nt, Human
gggagggcuccagac

SEQ ID NO: 1184331 - RNA, 17 nt, Human
gggagggcuccagacac

SEQ ID NO: 1184332 - RNA, 18 nt, Human
gggagggcuccagacaca

SEQ ID NO: 1184333 - RNA, 17 nt, Human
gggaggucgaggcagga

SEQ ID NO: 1184334 - RNA, 18 nt, Human
gggaggucgaggcaggag

SEQ ID NO: 1184335 - RNA, 19 nt, Human
gggaggucgaggcaggagg

SEQ ID NO: 1184336 - RNA, 11 nt, Human
gggccaggagc

SEQ ID NO: 1184337 - RNA, 12 nt, Human
gggccaggagcc

SEQ ID NO: 1184338 - RNA, 14 nt, Human
gggccagugcucca

SEQ ID NO: 1184339 - RNA, 19 nt, Human
aaaaguauguuagugcaaa

SEQ ID NO: 1184340 - RNA, 14 nt, Human
aaaaugagccuggc

SEQ ID NO: 1184341 - RNA, 21 nt, Human
aaaaugagccuggcaagaaug

SEQ ID NO: 1184342 - RNA, 15 nt, Human
gggccuccugugugu

SEQ ID NO: 1184343 - RNA, 13 nt, Human
gggccuccugugu

SEQ ID NO: 1184344 - RNA, 20 nt, Human
gggccucuuaugggcugggu

SEQ ID NO: 1184345 - RNA, 21 nt, Human
gggcggugagaggggaacaga

SEQ ID NO: 1184346 - RNA, 15 nt, Human
gggcgggaggauguu

SEQ ID NO: 1184347 - RNA, 14 nt, Human
gggccaguuggucc

SEQ ID NO: 1184348 - RNA, 18 nt, Human
gggccaguuggucccccu

SEQ ID NO: 1184349 - RNA, 22 nt, Human
gggccaguuggucccccuucca

SEQ ID NO: 1184350 - RNA, 23 nt, Human
gggccaguuggucccccuuccau

SEQ ID NO: 1184351 - RNA, 18 nt, Human
gggccagugcuccagcca

SEQ ID NO: 1184352 - RNA, 12 nt, Human
gggcugggcaga

SEQ ID NO: 1184353 - RNA, 20 nt, Human
gggcuggguucuacccaggu

SEQ ID NO: 1184354 - RNA, 10 nt, Human
gggcucagca

SEQ ID NO: 1184355 - RNA, 18 nt, Human
gggcucagcaaaagaugc

SEQ ID NO: 1184356 - RNA, 18 nt, Human
gggcugcaugcgggcuuc

SEQ ID NO: 1184357 - RNA, 21 nt, Human
gggcugcaugcgggcuuccuc

SEQ ID NO: 1184358 - RNA, 22 nt, Human
gggcuggguucuacccaggugc

SEQ ID NO: 1184359 - RNA, 15 nt, Human
aaaaugugauaugua

SEQ ID NO: 1184360 - RNA, 12 nt, Human
ggggacagcucc

SEQ ID NO: 1184361 - RNA, 14 nt, Human
ggggacagcuccuu

SEQ ID NO: 1184362 - RNA, 20 nt, Human
ggggacagcuccuucugucc

SEQ ID NO: 1184363 - RNA, 16 nt, Human
aaacaugcuacacacu

SEQ ID NO: 1184364 - RNA, 20 nt, Human
aaacaagcacuaaacaaaga

SEQ ID NO: 1184365 - RNA, 16 nt, Human
aaacacauuuuucuua

SEQ ID NO: 1184366 - RNA, 20 nt, Human
aaacaagaccacguuucuaa

SEQ ID NO: 1184367 - RNA, 17 nt, Human
ggguggaugccuggugg

SEQ ID NO: 1184368 - RNA, 15 nt, Human
ggguggcaccagcag

SEQ ID NO: 1184369 - RNA, 19 nt, Human
ggguggcaccagcagccug

SEQ ID NO: 1184370 - RNA, 20 nt, Human
ggguggggaccucaggccug

SEQ ID NO: 1184371 - RNA, 12 nt, Human
ggguggugaccu

SEQ ID NO: 1184372 - RNA, 17 nt, Human
ggguguggcgcagcaua

SEQ ID NO: 1184373 - RNA, 17 nt, Human
ggguuucuaaagcugcc

SEQ ID NO: 1184374 - RNA, 14 nt, Human
gguaacaggcagau

SEQ ID NO: 1184375 - RNA, 20 nt, Human
gguaacaggcagauacagga

SEQ ID NO: 1184376 - RNA, 18 nt, Human
gguaacuagggaagauaa

SEQ ID NO: 1184377 - RNA, 22 nt, Human
gguaugaucacggcucacugca

SEQ ID NO: 1184378 - RNA, 14 nt, Human
gguaugcaaucaaa

SEQ ID NO: 1184379 - RNA, 12 nt, Human
gguccacccagg

SEQ ID NO: 1184380 - RNA, 13 nt, Human
gguccacccagga

SEQ ID NO: 1184381 - RNA, 15 nt, Human
gguccacccaggagc

SEQ ID NO: 1184382 - RNA, 16 nt, Human
gguccacccaggagcc

SEQ ID NO: 1184383 - RNA, 17 nt, Human
gguccacccaggagccc

SEQ ID NO: 1184384 - RNA, 19 nt, Human
gguccacccaggagccccg

SEQ ID NO: 1184385 - RNA, 12 nt, Human
aaacuuuacuau

SEQ ID NO: 1184386 - RNA, 18 nt, Human
aaacuuuacuauggcccu

SEQ ID NO: 1184387 - RNA, 15 nt, Human
gguccauagagagca

SEQ ID NO: 1184388 - RNA, 22 nt, Human
aaacuuuaccuuuuuuauacau

SEQ ID NO: 1184389 - RNA, 17 nt, Human
aaagacuaucuaaaugu

SEQ ID NO: 1184390 - RNA, 16 nt, Human
aaagaaugauuaugaa

SEQ ID NO: 1184391 - RNA, 21 nt, Human
gguccugcugcaguugccagu

SEQ ID NO: 1184392 - RNA, 23 nt, Human
gguccugcugcaguugccaguca

SEQ ID NO: 1184393 - RNA, 13 nt, Human
aaagcaaaggaga

SEQ ID NO: 1184394 - RNA, 14 nt, Human
ggucggaaaacaug

SEQ ID NO: 1184395 - RNA, 17 nt, Human
ggucuacacugugcuga

SEQ ID NO: 1184396 - RNA, 13 nt, Human
ggucggaaaacau

SEQ ID NO: 1184397 - RNA, 18 nt, Human
ggugcaaugaccuuucaa

SEQ ID NO: 1184398 - RNA, 19 nt, Human
ggugcaaugaccuuucaau

SEQ ID NO: 1184399 - RNA, 20 nt, Human
ggugcaaugaccuuucaaua

SEQ ID NO: 1184400 - RNA, 21 nt, Human
ggucuugaacuccuggccuca

SEQ ID NO: 1184401 - RNA, 16 nt, Human
ggugcacaagcuccaa

SEQ ID NO: 1184402 - RNA, 14 nt, Human
gguggaugccuggu

SEQ ID NO: 1184403 - RNA, 21 nt, Human
gguggaugccugguggcagcu

SEQ ID NO: 1184404 - RNA, 16 nt, Human
aaagcagcguuucuau

SEQ ID NO: 1184405 - RNA, 18 nt, Human
aaagcagcguuucuauga

SEQ ID NO: 1184406 - RNA, 22 nt, Human
aaagcagcguuucuaugacaca

SEQ ID NO: 1184407 - RNA, 17 nt, Human
aaagcagggacuugaac

SEQ ID NO: 1184408 - RNA, 22 nt, Human
gguucccuuugacgccauccca

SEQ ID NO: 1184409 - RNA, 21 nt, Human
gguucccuuugacgccauccc

SEQ ID NO: 1184410 - RNA, 21 nt, Human
ggugugcggccuuuggcuuca

SEQ ID NO: 1184411 - RNA, 13 nt, Human
ggugugcucugau

SEQ ID NO: 1184412 - RNA, 12 nt, Human
gguguggaagag

SEQ ID NO: 1184413 - RNA, 12 nt, Human
gguguggagaag

SEQ ID NO: 1184414 - RNA, 18 nt, Human
gguucaggguuggccccu

SEQ ID NO: 1184415 - RNA, 21 nt, Human
gguucaggguuggccccugcc

SEQ ID NO: 1184416 - RNA, 22 nt, Human
gguucaggguuggccccugccc

SEQ ID NO: 1184417 - RNA, 12 nt, Human
gguuucagaaau

SEQ ID NO: 1184418 - RNA, 13 nt, Human
gguuucagaaaug

SEQ ID NO: 1184419 - RNA, 14 nt, Human
gguuucagaaaugu

SEQ ID NO: 1184420 - RNA, 15 nt, Human
gguuucagaaaugug

SEQ ID NO: 1184421 - RNA, 20 nt, Human
ggugggaggauugcuugagc

SEQ ID NO: 1184422 - RNA, 14 nt, Human
ggugggauccucca

SEQ ID NO: 1184423 - RNA, 15 nt, Human
ggugggauccuccag

SEQ ID NO: 1184424 - RNA, 19 nt, Human
ggugggauccuccaggugc

SEQ ID NO: 1184425 - RNA, 13 nt, Human
gguggggcagcuu

SEQ ID NO: 1184426 - RNA, 17 nt, Human
gguggggcagcuugagg

SEQ ID NO: 1184427 - RNA, 15 nt, Human
gguggggucacucug

SEQ ID NO: 1184428 - RNA, 23 nt, Human
gguggggucacucuggcagcuca

SEQ ID NO: 1184429 - RNA, 13 nt, Human
ggugucgggcaug

SEQ ID NO: 1184430 - RNA, 16 nt, Human
ggugucgggcaugaca

SEQ ID NO: 1184431 - RNA, 16 nt, Human
ggugugaccacugcag

SEQ ID NO: 1184432 - RNA, 16 nt, Human
ggugugacugaauuuc

SEQ ID NO: 1184433 - RNA, 18 nt, Human
ggugugagucaccaagcc

SEQ ID NO: 1184434 - RNA, 21 nt, Human
aaaguuucucuuuucaaaaca

SEQ ID NO: 1184435 - RNA, 23 nt, Human
aaaguuucucuuuucaaaacauu

SEQ ID NO: 1184436 - RNA, 12 nt, Human
aaauaaugugaa

SEQ ID NO: 1184437 - RNA, 13 nt, Human
aaauaaugugaaa

SEQ ID NO: 1184438 - RNA, 18 nt, Human
aaauaauuuuuauauuug

SEQ ID NO: 1184439 - RNA, 20 nt, Human
aaauaauuuuuauauuugaa

SEQ ID NO: 1184440 - RNA, 14 nt, Human
aaauaaugugaaac

SEQ ID NO: 1184441 - RNA, 21 nt, Human
aaauaauuuuuauauuugaaa

SEQ ID NO: 1184442 - RNA, 17 nt, Human
ggcucacugcagccuca

SEQ ID NO: 1184443 - RNA, 16 nt, Human
ggcucacugcagccuc

SEQ ID NO: 1184444 - RNA, 19 nt, Human
ggcgugcaguggugcgauc

SEQ ID NO: 1184445 - RNA, 23 nt, Human
ggcucagcaaaagaugcuucuca

SEQ ID NO: 1184446 - RNA, 21 nt, Human
ggcucagcggggacagcuccu

SEQ ID NO: 1184447 - RNA, 22 nt, Human
ggcucagcggggacagcuccuu

SEQ ID NO: 1184448 - RNA, 23 nt, Human
ggcucagcggggacagcuccuuc

SEQ ID NO: 1184449 - RNA, 15 nt, Human
ggccugagcugggau

SEQ ID NO: 1184450 - RNA, 13 nt, Human
ggccuccauccug

SEQ ID NO: 1184451 - RNA, 21 nt, Human
ggccuggccagaugcaccagc

SEQ ID NO: 1184452 - RNA, 21 nt, Human
ggccugugucuaguuguuuga

SEQ ID NO: 1184453 - RNA, 23 nt, Human
ggccuucggccuccauccugagg

SEQ ID NO: 1184454 - RNA, 12 nt, Human
ggccuucucuga

SEQ ID NO: 1184455 - RNA, 15 nt, Human
ggccuucucugaagg

SEQ ID NO: 1184456 - RNA, 16 nt, Human
ggccuucucugaagga

SEQ ID NO: 1184457 - RNA, 13 nt, Human
ggccuuuggcuuc

SEQ ID NO: 1184458 - RNA, 14 nt, Human
ggccuuuggcuuca

SEQ ID NO: 1184459 - RNA, 16 nt, Human
ggcccuucucuccagc

SEQ ID NO: 1184460 - RNA, 17 nt, Human
ggcccuucucuccagcc

SEQ ID NO: 1184461 - RNA, 19 nt, Human
ggcccuucucuccagcccc

SEQ ID NO: 1184462 - RNA, 18 nt, Human
ggcccuucucuccagccc

SEQ ID NO: 1184463 - RNA, 17 nt, Human
ggcagugggagcugccu

SEQ ID NO: 1184464 - RNA, 15 nt, Human
ggcaccagcagccug

SEQ ID NO: 1184465 - RNA, 16 nt, Human
ggcaccagcagccugg

SEQ ID NO: 1184466 - RNA, 24 nt, Human
ggcacugcuuccagugaggcucug

SEQ ID NO: 1184467 - RNA, 18 nt, Human
ggcagugggagcugccug

SEQ ID NO: 1184468 - RNA, 19 nt, Human
ggcagugggagcugccugu

SEQ ID NO: 1184469 - RNA, 18 nt, Human
ggcauccaguaucuugaa

SEQ ID NO: 1184470 - RNA, 17 nt, Human
ggccaaacucaccugcc

SEQ ID NO: 1184471 - RNA, 21 nt, Human
ggccaaacucaccugccccuc

SEQ ID NO: 1184472 - RNA, 14 nt, Human
ggccaggcuggucu

SEQ ID NO: 1184473 - RNA, 16 nt, Human
ggccaggcuggucuca

SEQ ID NO: 1184474 - RNA, 18 nt, Human
ggccaggcuggucucaaa

SEQ ID NO: 1184475 - RNA, 13 nt, Human
ggccagugcucca

SEQ ID NO: 1184476 - RNA, 15 nt, Human
ggccagugcuccagc

SEQ ID NO: 1184477 - RNA, 16 nt, Human
ggccagugugacaagg

SEQ ID NO: 1184478 - RNA, 24 nt, Human
ggcacagaaaauggaagacagcuc

SEQ ID NO: 1184479 - RNA, 15 nt, Human
ggauguucugggaca

SEQ ID NO: 1184480 - RNA, 16 nt, Human
ggauguucugggacac

SEQ ID NO: 1184481 - RNA, 22 nt, Human
ggauguugaaaaaguucugcag

SEQ ID NO: 1184482 - RNA, 14 nt, Human
ggaguggccacaga

SEQ ID NO: 1184483 - RNA, 15 nt, Human
ggaguucugguuccu

SEQ ID NO: 1184484 - RNA, 16 nt, Human
ggauggggcugcaccg

SEQ ID NO: 1184485 - RNA, 18 nt, Human
ggauggauuuccagccaa

SEQ ID NO: 1184486 - RNA, 18 nt, Human
ggauacaaaagcauguga

SEQ ID NO: 1184487 - RNA, 15 nt, Human
ggauccuccaggugc

SEQ ID NO: 1184488 - RNA, 13 nt, Human
ggauccugagcca

SEQ ID NO: 1184489 - RNA, 14 nt, Human
ggauccugagccag

SEQ ID NO: 1184490 - RNA, 15 nt, Human
ggauccugagccaga

SEQ ID NO: 1184491 - RNA, 16 nt, Human
ggagccccgaggccuu

SEQ ID NO: 1184492 - RNA, 22 nt, Human
ggagccccgaggccuucucuga

SEQ ID NO: 1184493 - RNA, 12 nt, Human
ggagcugccugu

SEQ ID NO: 1184494 - RNA, 21 nt, Human
ggagcugccuguucagcucca

SEQ ID NO: 1184495 - RNA, 22 nt, Human
ggagcugccuguucagcuccag

SEQ ID NO: 1184496 - RNA, 20 nt, Human
ggaggaaggaaacccagcuc

SEQ ID NO: 1184497 - RNA, 23 nt, Human
ggaggaaggaaacccagcucugg

SEQ ID NO: 1184498 - RNA, 11 nt, Human
ggaggccagcc

SEQ ID NO: 1184499 - RNA, 12 nt, Human
ggaggccagccu

SEQ ID NO: 1184500 - RNA, 16 nt, Human
ggaggggggagguggg

SEQ ID NO: 1184501 - RNA, 20 nt, Human
ggaggucaaggcugcaguga

SEQ ID NO: 1184502 - RNA, 14 nt, Human
ggaggucgaggcag

SEQ ID NO: 1184503 - RNA, 14 nt, Human
ggaggugaccccag

SEQ ID NO: 1184504 - RNA, 15 nt, Human
ggaacaaggcaaggc

SEQ ID NO: 1184505 - RNA, 17 nt, Human
ggaacaaggcaaggcug

SEQ ID NO: 1184506 - RNA, 21 nt, Human
ggaacaaggcaaggcugucaa

SEQ ID NO: 1184507 - RNA, 14 nt, Human
ggaaaugggcagag

SEQ ID NO: 1184508 - RNA, 16 nt, Human
ggaaaugggcagagca

SEQ ID NO: 1184509 - RNA, 17 nt, Human
ggaaaugggcagagcag

SEQ ID NO: 1184510 - RNA, 18 nt, Human
ggaaaugggcagagcaga

SEQ ID NO: 1184511 - RNA, 22 nt, Human
ggaaaugggcagagcagagacc

SEQ ID NO: 1184512 - RNA, 23 nt, Human
ggaacaaggcaaggcugucaauu

SEQ ID NO: 1184513 - RNA, 15 nt, Human
ggaacacuccuucac

SEQ ID NO: 1184514 - RNA, 19 nt, Human
ggaacacuccuucacagau

SEQ ID NO: 1184515 - RNA, 14 nt, Human
ggaagacaauguga

SEQ ID NO: 1184516 - RNA, 16 nt, Human
ggaagacaaugugaaa

SEQ ID NO: 1184517 - RNA, 12 nt, Human
ggaagacuuugg

SEQ ID NO: 1184518 - RNA, 22 nt, Human
ggaagacaaugugaaaagaaaa

SEQ ID NO: 1184519 - RNA, 17 nt, Human
ggaagacuucaucccuc

SEQ ID NO: 1184520 - RNA, 20 nt, Human
ggaagacuucaucccucugg

SEQ ID NO: 1184521 - RNA, 15 nt, Human
gcuuuuggucugugu

SEQ ID NO: 1184522 - RNA, 18 nt, Human
gcuuuugucuaugggacu

SEQ ID NO: 1184523 - RNA, 12 nt, Human
gcuuuugugcau

SEQ ID NO: 1184524 - RNA, 18 nt, Human
ggaaaauuuuaaaaauac

SEQ ID NO: 1184525 - RNA, 16 nt, Human
ggaaacccagcucugg

SEQ ID NO: 1184526 - RNA, 14 nt, Human
gcuuugaucccuuc

SEQ ID NO: 1184527 - RNA, 17 nt, Human
gcuuugaucccuucuua

SEQ ID NO: 1184528 - RNA, 18 nt, Human
gcuuguaaauagcucagg

SEQ ID NO: 1184529 - RNA, 19 nt, Human
gcuuguaaauagcucaggu

SEQ ID NO: 1184530 - RNA, 23 nt, Human
gcuugaccgugaggccagagaca

SEQ ID NO: 1184531 - RNA, 18 nt, Human
gcuugaccuuuaagagaa

SEQ ID NO: 1184532 - RNA, 16 nt, Human
gcuugaccgugaggcc

SEQ ID NO: 1184533 - RNA, 22 nt, Human
gcuugaccuuuaagagaaauga

SEQ ID NO: 1184534 - RNA, 17 nt, Human
gcuuguaaauagcucag

SEQ ID NO: 1184535 - RNA, 23 nt, Human
gcuuccagugaggcucugcccuu

SEQ ID NO: 1184536 - RNA, 19 nt, Human
gcuuccuggcaauagucaa

SEQ ID NO: 1184537 - RNA, 12 nt, Human
gcuucuucagag

SEQ ID NO: 1184538 - RNA, 15 nt, Human
gcuucuucagagacu

SEQ ID NO: 1184539 - RNA, 13 nt, Human
gcuguuggcuggg

SEQ ID NO: 1184540 - RNA, 14 nt, Human
gcuguuggcugggg

SEQ ID NO: 1184541 - RNA, 14 nt, Human
gcuucaaggauccu

SEQ ID NO: 1184542 - RNA, 18 nt, Human
gcuucaaggauccugagc

SEQ ID NO: 1184543 - RNA, 14 nt, Human
gcuucaguggcagc

SEQ ID NO: 1184544 - RNA, 15 nt, Human
gcuucaguggcagcu

SEQ ID NO: 1184545 - RNA, 14 nt, Human
gcuggagcucugcc

SEQ ID NO: 1184546 - RNA, 23 nt, Human
gcugguucaggguuggccccugc

SEQ ID NO: 1184547 - RNA, 12 nt, Human
gcuguauuuuaa

SEQ ID NO: 1184548 - RNA, 13 nt, Human
gcuguauuuuaaa

SEQ ID NO: 1184549 - RNA, 18 nt, Human
gcuguauuuuaaaagaau

SEQ ID NO: 1184550 - RNA, 13 nt, Human
gcugcacccucag

SEQ ID NO: 1184551 - RNA, 15 nt, Human
gcugcacccucaggc

SEQ ID NO: 1184552 - RNA, 16 nt, Human
gcugcacccucaggca

SEQ ID NO: 1184553 - RNA, 12 nt, Human
gcugccauccag

SEQ ID NO: 1184554 - RNA, 13 nt, Human
gcugccauccagg

SEQ ID NO: 1184555 - RNA, 12 nt, Human
gcugcugacagu

SEQ ID NO: 1184556 - RNA, 17 nt, Human
gcugccauccagguuca

SEQ ID NO: 1184557 - RNA, 13 nt, Human
gcugccccuggca

SEQ ID NO: 1184558 - RNA, 15 nt, Human
gcugccccuggcagc

SEQ ID NO: 1184559 - RNA, 16 nt, Human
gcugccccuggcagcc

SEQ ID NO: 1184560 - RNA, 17 nt, Human
gcugccccuggcagccc

SEQ ID NO: 1184561 - RNA, 17 nt, Human
gcugaauacagaggcaa

SEQ ID NO: 1184562 - RNA, 22 nt, Human
gcugaauacagaggcaacugca

SEQ ID NO: 1184563 - RNA, 13 nt, Human
gcugacagacaca

SEQ ID NO: 1184564 - RNA, 14 nt, Human
gcucuguccuggga

SEQ ID NO: 1184565 - RNA, 20 nt, Human
gcucugaucauccacugugc

SEQ ID NO: 1184566 - RNA, 21 nt, Human
gcucugaucauccacugugcc

SEQ ID NO: 1184567 - RNA, 22 nt, Human
gcucugaucauccacugugcca

SEQ ID NO: 1184568 - RNA, 23 nt, Human
gcucugaucauccacugugccau

SEQ ID NO: 1184569 - RNA, 15 nt, Human
gcucugcccauccug

SEQ ID NO: 1184570 - RNA, 21 nt, Human
gcucugcccauccugccccug

SEQ ID NO: 1184571 - RNA, 15 nt, Human
gcuccucuccccagc

SEQ ID NO: 1184572 - RNA, 13 nt, Human
gcuccagcucacc

SEQ ID NO: 1184573 - RNA, 14 nt, Human
gcuccagcucacca

SEQ ID NO: 1184574 - RNA, 17 nt, Human
gcuccagcucaccagcc

SEQ ID NO: 1184575 - RNA, 20 nt, Human
gcuccacuuggucugugaga

SEQ ID NO: 1184576 - RNA, 9 nt, Human
gcuccagac

SEQ ID NO: 1184577 - RNA, 18 nt, Human
gcuccagacacaugucca

SEQ ID NO: 1184578 - RNA, 21 nt, Human
gcuccagacacauguccaaga

SEQ ID NO: 1184579 - RNA, 23 nt, Human
gcuccagacacauguccaagaag

SEQ ID NO: 1184580 - RNA, 17 nt, Human
gcucucaggccagcugc

SEQ ID NO: 1184581 - RNA, 18 nt, Human
gcucucaggccagcugcu

SEQ ID NO: 1184582 - RNA, 19 nt, Human
gcucucaggccagcugcuu

SEQ ID NO: 1184583 - RNA, 20 nt, Human
gcucucaggccagcugcuug

SEQ ID NO: 1184584 - RNA, 16 nt, Human
gcuccucuccccagca

SEQ ID NO: 1184585 - RNA, 19 nt, Human
gcuccucuccccagcaagu

SEQ ID NO: 1184586 - RNA, 19 nt, Human
gcucuacugaggugcuaug

SEQ ID NO: 1184587 - RNA, 18 nt, Human
gcucucaaguuaucaggg

SEQ ID NO: 1184588 - RNA, 17 nt, Human
gccugcuaauuccccag

SEQ ID NO: 1184589 - RNA, 23 nt, Human
gccugcuaauuccccagauugca

SEQ ID NO: 1184590 - RNA, 13 nt, Human
gccugcuccagcu

SEQ ID NO: 1184591 - RNA, 19 nt, Human
gccuccuuugugaggaagc

SEQ ID NO: 1184592 - RNA, 20 nt, Human
gccuccuuugugaggaagcc

SEQ ID NO: 1184593 - RNA, 21 nt, Human
gccuccuuugugaggaagccg

SEQ ID NO: 1184594 - RNA, 16 nt, Human
gccuccauccugaggc

SEQ ID NO: 1184595 - RNA, 20 nt, Human
gccuccauccugaggcucca

SEQ ID NO: 1184596 - RNA, 14 nt, Human
gcgauucuucugcu

SEQ ID NO: 1184597 - RNA, 17 nt, Human
gcgauucuucugcuuca

SEQ ID NO: 1184598 - RNA, 15 nt, Human
gcgagcccugguggc

SEQ ID NO: 1184599 - RNA, 13 nt, Human
gcgauucuucugc

SEQ ID NO: 1184600 - RNA, 16 nt, Human
gcggccuuuggcuuca

SEQ ID NO: 1184601 - RNA, 14 nt, Human
gcgugcacacacca

SEQ ID NO: 1184602 - RNA, 18 nt, Human
gcgugcacacaccagagc

SEQ ID NO: 1184603 - RNA, 19 nt, Human
gcgugcacacaccagagcc

SEQ ID NO: 1184604 - RNA, 20 nt, Human
gcgugguggacaugcacagc

SEQ ID NO: 1184605 - RNA, 17 nt, Human
gcguuucuaugacacau

SEQ ID NO: 1184606 - RNA, 18 nt, Human
gcguuucuaugacacaug

SEQ ID NO: 1184607 - RNA, 16 nt, Human
gcuaauuuuucauuuu

SEQ ID NO: 1184608 - RNA, 19 nt, Human
gcuacuguccuacccaccc

SEQ ID NO: 1184609 - RNA, 20 nt, Human
gcuacuguccuacccacccu

SEQ ID NO: 1184610 - RNA, 17 nt, Human
gcuacuugggaggcuga

SEQ ID NO: 1184611 - RNA, 15 nt, Human
gccccuggaugcagc

SEQ ID NO: 1184612 - RNA, 22 nt, Human
gccccugcugguucaggguugg

SEQ ID NO: 1184613 - RNA, 14 nt, Human
gccaugugccaggu

SEQ ID NO: 1184614 - RNA, 22 nt, Human
gccaugugcuaguaauuggaaa

SEQ ID NO: 1184615 - RNA, 13 nt, Human
gcccaggcagguc

SEQ ID NO: 1184616 - RNA, 14 nt, Human
gcccaggcaggucu

SEQ ID NO: 1184617 - RNA, 16 nt, Human
gcccaggcaggucuug

SEQ ID NO: 1184618 - RNA, 15 nt, Human
gcccaggccccugcc

SEQ ID NO: 1184619 - RNA, 17 nt, Human
gcccaggccccugccac

SEQ ID NO: 1184620 - RNA, 18 nt, Human
gcccaggccccugccacc

SEQ ID NO: 1184621 - RNA, 13 nt, Human
gccaggccacaag

SEQ ID NO: 1184622 - RNA, 18 nt, Human
gccaggccacaagacccu

SEQ ID NO: 1184623 - RNA, 21 nt, Human
gccaggccacaagacccuugu

SEQ ID NO: 1184624 - RNA, 15 nt, Human
gccaggccagaggga

SEQ ID NO: 1184625 - RNA, 22 nt, Human
gccaggccagagggagugacag

SEQ ID NO: 1184626 - RNA, 23 nt, Human
gccaggccacaagacccuugugg

SEQ ID NO: 1184627 - RNA, 13 nt, Human
gccaggcccucug

SEQ ID NO: 1184628 - RNA, 14 nt, Human
gccaggcccucugc

SEQ ID NO: 1184629 - RNA, 15 nt, Human
gccaggcccucugcc

SEQ ID NO: 1184630 - RNA, 16 nt, Human
gccauaugaaaaggcu

SEQ ID NO: 1184631 - RNA, 16 nt, Human
gccaguuggucccccu

SEQ ID NO: 1184632 - RNA, 18 nt, Human
gccaguuggucccccuuc

SEQ ID NO: 1184633 - RNA, 20 nt, Human
gccaguuggucccccuucca

SEQ ID NO: 1184634 - RNA, 21 nt, Human
gccaguuggucccccuuccau

SEQ ID NO: 1184635 - RNA, 22 nt, Human
gccaguuggucccccuuccaug

SEQ ID NO: 1184636 - RNA, 23 nt, Human
gccaguuggucccccuuccaugg

SEQ ID NO: 1184637 - RNA, 15 nt, Human
gccagugcuccagcc

SEQ ID NO: 1184638 - RNA, 13 nt, Human
gccagugugacaa

SEQ ID NO: 1184639 - RNA, 13 nt, Human
gccaguugguccc

SEQ ID NO: 1184640 - RNA, 18 nt, Human
accucaggugagaagcag

SEQ ID NO: 1184641 - RNA, 14 nt, Human
accucaggccuggg

SEQ ID NO: 1184642 - RNA, 22 nt, Human
accucaggccugggggcugggc

SEQ ID NO: 1184643 - RNA, 16 nt, Human
accgugaggccagaga

SEQ ID NO: 1184644 - RNA, 17 nt, Human
accgugaggccagagac

SEQ ID NO: 1184645 - RNA, 12 nt, Human
accucaggccug

SEQ ID NO: 1184646 - RNA, 13 nt, Human
accucaggccugg

SEQ ID NO: 1184647 - RNA, 17 nt, Human
acccuguuaccauuuug

SEQ ID NO: 1184648 - RNA, 14 nt, Human
acccaugcugcccu

SEQ ID NO: 1184649 - RNA, 15 nt, Human
acccaugcugcccug

SEQ ID NO: 1184650 - RNA, 16 nt, Human
acccaugcugcccugu

SEQ ID NO: 1184651 - RNA, 16 nt, Human
accccacacacgccag

SEQ ID NO: 1184652 - RNA, 22 nt, Human
acccugugauggggcccugccu

SEQ ID NO: 1184653 - RNA, 17 nt, Human
accccacacacgccaga

SEQ ID NO: 1184654 - RNA, 14 nt, Human
accggcuggccugg

SEQ ID NO: 1184655 - RNA, 15 nt, Human
accggcuggccuggc

SEQ ID NO: 1184656 - RNA, 17 nt, Human
accggcuggccuggccc

SEQ ID NO: 1184657 - RNA, 18 nt, Human
accggcuggccuggcccc

SEQ ID NO: 1184658 - RNA, 19 nt, Human
accggcuggccuggccccu

SEQ ID NO: 1184659 - RNA, 15 nt, Human
accgggccacagaga

SEQ ID NO: 1184660 - RNA, 19 nt, Human
accgggccacagagaaagu

SEQ ID NO: 1184661 - RNA, 20 nt, Human
accgggccacagagaaagua

SEQ ID NO: 1184662 - RNA, 14 nt, Human
accgugaggccaga

SEQ ID NO: 1184663 - RNA, 20 nt, Human
accucugccucagaaaacaa

SEQ ID NO: 1184664 - RNA, 11 nt, Human
accugccaggg

SEQ ID NO: 1184665 - RNA, 12 nt, Human
accugccaggga

SEQ ID NO: 1184666 - RNA, 13 nt, Human
accugccagggac

SEQ ID NO: 1184667 - RNA, 15 nt, Human
accugccagggacag

SEQ ID NO: 1184668 - RNA, 16 nt, Human
accugccagggacaga

SEQ ID NO: 1184669 - RNA, 18 nt, Human
accugccagggacagagg

SEQ ID NO: 1184670 - RNA, 17 nt, Human
accucugccucagaaaa

SEQ ID NO: 1184671 - RNA, 18 nt, Human
accucugccucagaaaac

SEQ ID NO: 1184672 - RNA, 19 nt, Human
accucuugagccuugaacu

SEQ ID NO: 1184673 - RNA, 20 nt, Human
accucuugagccuugaacuu

SEQ ID NO: 1184674 - RNA, 21 nt, Human
accucuugagccuugaacuuu

SEQ ID NO: 1184675 - RNA, 11 nt, Human
acguggcugcu

SEQ ID NO: 1184676 - RNA, 15 nt, Human
acuaauagacaauuu

SEQ ID NO: 1184677 - RNA, 23 nt, Human
acgucugacaggcaaugcuggcu

SEQ ID NO: 1184678 - RNA, 12 nt, Human
acgucugugcca

SEQ ID NO: 1184679 - RNA, 19 nt, Human
acgcuggagugcagugagc

SEQ ID NO: 1184680 - RNA, 15 nt, Human
acggaauaguuggcu

SEQ ID NO: 1184681 - RNA, 19 nt, Human
acggacgaaccuugaaaac

SEQ ID NO: 1184682 - RNA, 15 nt, Human
acggaagagccuugc

SEQ ID NO: 1184683 - RNA, 16 nt, Human
acggaagagccuugcg

SEQ ID NO: 1184684 - RNA, 11 nt, Human
accugugucuc

SEQ ID NO: 1184685 - RNA, 17 nt, Human
acuagggaagauaauau

SEQ ID NO: 1184686 - RNA, 18 nt, Human
acuaguauuucuaugaaa

SEQ ID NO: 1184687 - RNA, 19 nt, Human
acuaguauuucuaugaaau

SEQ ID NO: 1184688 - RNA, 16 nt, Human
acuauuguuagucucu

SEQ ID NO: 1184689 - RNA, 15 nt, Human
acugcccggcagggu

SEQ ID NO: 1184690 - RNA, 22 nt, Human
acugcccggcaggguccuagaa

SEQ ID NO: 1184691 - RNA, 14 nt, Human
acugccaugccagc

SEQ ID NO: 1184692 - RNA, 15 nt, Human
acugcuuuuggucug

SEQ ID NO: 1184693 - RNA, 16 nt, Human
acugcuuuuggucugu

SEQ ID NO: 1184694 - RNA, 20 nt, Human
acugcuuuuggucuguguga

SEQ ID NO: 1184695 - RNA, 19 nt, Human
acucugucucaaaaaaaca

SEQ ID NO: 1184696 - RNA, 15 nt, Human
acucugucucagucc

SEQ ID NO: 1184697 - RNA, 17 nt, Human
acucugucucaguccau

SEQ ID NO: 1184698 - RNA, 21 nt, Human
acucugugucagguggggcag

SEQ ID NO: 1184699 - RNA, 14 nt, Human
acucuuaagaagac

SEQ ID NO: 1184700 - RNA, 15 nt, Human
acucuuaagaagacu

SEQ ID NO: 1184701 - RNA, 20 nt, Human
acucuuaagaagacugcauu

SEQ ID NO: 1184702 - RNA, 16 nt, Human
acugaaugaaaccccc

SEQ ID NO: 1184703 - RNA, 19 nt, Human
acugaaugaaacccccaca

SEQ ID NO: 1184704 - RNA, 21 nt, Human
acugaaugaaacccccacaca

SEQ ID NO: 1184705 - RNA, 22 nt, Human
acugaaugaaacccccacacac

SEQ ID NO: 1184706 - RNA, 23 nt, Human
acugacauuguuggccaaagcca

SEQ ID NO: 1184707 - RNA, 13 nt, Human
acugaucucucgu

SEQ ID NO: 1184708 - RNA, 22 nt, Human
acugauggcuaauguacugcau

SEQ ID NO: 1184709 - RNA, 12 nt, Human
acugaugggcaa

SEQ ID NO: 1184710 - RNA, 22 nt, Human
acugaugggcaacccccagccu

SEQ ID NO: 1184711 - RNA, 23 nt, Human
acugaugggcaacccccagccug

SEQ ID NO: 1184712 - RNA, 21 nt, Human
acugauuuuuuuuuccuucag

SEQ ID NO: 1184713 - RNA, 22 nt, Human
acugauuuuuuuuuccuucagu

SEQ ID NO: 1184714 - RNA, 23 nt, Human
acugauuuuuuuuuccuucagug

SEQ ID NO: 1184715 - RNA, 12 nt, Human
acuuuaugcuaa

SEQ ID NO: 1184716 - RNA, 17 nt, Human
acuuuaugcuaagugaa

SEQ ID NO: 1184717 - RNA, 22 nt, Human
acuugggaggcugagaugggag

SEQ ID NO: 1184718 - RNA, 14 nt, Human
acuuaaauaaugug

SEQ ID NO: 1184719 - RNA, 15 nt, Human
acuuaaauaauguga

SEQ ID NO: 1184720 - RNA, 21 nt, Human
acuuaaaaaugguuuaaaugg

SEQ ID NO: 1184721 - RNA, 13 nt, Human
acuuaaaaauggu

SEQ ID NO: 1184722 - RNA, 14 nt, Human
acuuaaaaaugguu

SEQ ID NO: 1184723 - RNA, 20 nt, Human
acuucugccauauucuguug

SEQ ID NO: 1184724 - RNA, 19 nt, Human
acuucagcgguuuauauaa

SEQ ID NO: 1184725 - RNA, 20 nt, Human
acuucaaauccuugaagauu

SEQ ID NO: 1184726 - RNA, 18 nt, Human
acuucagcgguuuauaua

SEQ ID NO: 1184727 - RNA, 17 nt, Human
acuucuuauacauuuga

SEQ ID NO: 1184728 - RNA, 18 nt, Human
acuucuuauacauuugau

SEQ ID NO: 1184729 - RNA, 23 nt, Human
acagugagucgaggacagggagg

SEQ ID NO: 1184730 - RNA, 21 nt, Human
acagugauuaccagggacuga

SEQ ID NO: 1184731 - RNA, 13 nt, Human
acagcugccuggg

SEQ ID NO: 1184732 - RNA, 20 nt, Human
acaggcaagcaccuccugcc

SEQ ID NO: 1184733 - RNA, 23 nt, Human
acaggcaagcaccuccugccucg

SEQ ID NO: 1184734 - RNA, 16 nt, Human
acagcucuguccuggg

SEQ ID NO: 1184735 - RNA, 17 nt, Human
acagcucuguccuggga

SEQ ID NO: 1184736 - RNA, 17 nt, Human
acagaggggguggccuc

SEQ ID NO: 1184737 - RNA, 18 nt, Human
acagaggggguggccucc

SEQ ID NO: 1184738 - RNA, 19 nt, Human
acagaggggguggccuccc

SEQ ID NO: 1184739 - RNA, 21 nt, Human
acagaggggguggccucccaa

SEQ ID NO: 1184740 - RNA, 16 nt, Human
acagcuccuucugucc

SEQ ID NO: 1184741 - RNA, 18 nt, Human
acagcuccuucuguccua

SEQ ID NO: 1184742 - RNA, 23 nt, Human
acagcuccuucuguccuacucug

SEQ ID NO: 1184743 - RNA, 14 nt, Human
acagcucuguccug

SEQ ID NO: 1184744 - RNA, 22 nt, Human
acagugagucgaggacagggag

SEQ ID NO: 1184745 - RNA, 19 nt, Human
acaggugugaaccaccaca

SEQ ID NO: 1184746 - RNA, 23 nt, Human
acaggugugagucaccaagccca

SEQ ID NO: 1184747 - RNA, 14 nt, Human
acaggcaaugcugg

SEQ ID NO: 1184748 - RNA, 16 nt, Human
acauaagauaaaugug

SEQ ID NO: 1184749 - RNA, 16 nt, Human
acaugcaaggucauuu

SEQ ID NO: 1184750 - RNA, 17 nt, Human
acaugcaaggucauuuu

SEQ ID NO: 1184751 - RNA, 18 nt, Human
acaugcaaggucauuuuu

SEQ ID NO: 1184752 - RNA, 15 nt, Human
acaugccucucucag

SEQ ID NO: 1184753 - RNA, 16 nt, Human
acaugccucucucagg

SEQ ID NO: 1184754 - RNA, 17 nt, Human
acaugccucucucaggc

SEQ ID NO: 1184755 - RNA, 18 nt, Human
acaugccucucucaggcc

SEQ ID NO: 1184756 - RNA, 14 nt, Human
accaucaagccacc

SEQ ID NO: 1184757 - RNA, 15 nt, Human
accaucaagccacca

SEQ ID NO: 1184758 - RNA, 15 nt, Human
accaucauugaaauc

SEQ ID NO: 1184759 - RNA, 23 nt, Human
accaucauugaaaucuuuuugcu

SEQ ID NO: 1184760 - RNA, 16 nt, Human
accaucccugaaggcc

SEQ ID NO: 1184761 - RNA, 15 nt, Human
acccacccccaccca

SEQ ID NO: 1184762 - RNA, 17 nt, Human
acccacccccacccaag

SEQ ID NO: 1184763 - RNA, 15 nt, Human
acccacccuccuuuc

SEQ ID NO: 1184764 - RNA, 13 nt, Human
acccaugcugccc

SEQ ID NO: 1184765 - RNA, 20 nt, Human
accaaggcugauuaaaccaa

SEQ ID NO: 1184766 - RNA, 19 nt, Human
accaaggcugauuaaacca

SEQ ID NO: 1184767 - RNA, 18 nt, Human
accagccccagugcccac

SEQ ID NO: 1184768 - RNA, 19 nt, Human
accagccccagugcccaca

SEQ ID NO: 1184769 - RNA, 20 nt, Human
accagccccagugcccacag

SEQ ID NO: 1184770 - RNA, 12 nt, Human
accagcagagca

SEQ ID NO: 1184771 - RNA, 13 nt, Human
accagcagagcac

SEQ ID NO: 1184772 - RNA, 13 nt, Human
accagcagccugg

SEQ ID NO: 1184773 - RNA, 16 nt, Human
accagccccagugccc

SEQ ID NO: 1184774 - RNA, 17 nt, Human
accagccccagugccca

SEQ ID NO: 1184775 - RNA, 19 nt, Human
acaugccucucucaggcca

SEQ ID NO: 1184776 - RNA, 20 nt, Human
acaugccucucucaggccaa

SEQ ID NO: 1184777 - RNA, 23 nt, Human
acaugucuuuucuugcaugaggc

SEQ ID NO: 1184778 - RNA, 14 nt, Human
acauuuauucugcu

SEQ ID NO: 1184779 - RNA, 15 nt, Human
acaagaaaugaaagc

SEQ ID NO: 1184780 - RNA, 16 nt, Human
acaagaaaugaaagca

SEQ ID NO: 1184781 - RNA, 22 nt, Human
acaagaaaugaaagcagggacu

SEQ ID NO: 1184782 - RNA, 21 nt, Human
acaaggaugaauuaaguuuuu

SEQ ID NO: 1184783 - RNA, 13 nt, Human
acaaaaugaaacg

SEQ ID NO: 1184784 - RNA, 22 nt, Human
acaaaaugaaacgcaaccacca

SEQ ID NO: 1184785 - RNA, 14 nt, Human
aauuuugauguuuu

SEQ ID NO: 1184786 - RNA, 17 nt, Human
aauuuugugaagcaaaa

SEQ ID NO: 1184787 - RNA, 18 nt, Human
aauuuugugaagcaaaau

SEQ ID NO: 1184788 - RNA, 16 nt, Human
aauuuugugcccccau

SEQ ID NO: 1184789 - RNA, 16 nt, Human
aaugucacaggcaggu

SEQ ID NO: 1184790 - RNA, 19 nt, Human
aaugucacaggcaggucca

SEQ ID NO: 1184791 - RNA, 12 nt, Human
aauuguaaggaa

SEQ ID NO: 1184792 - RNA, 16 nt, Human
aauuguaaggaaugau

SEQ ID NO: 1184793 - RNA, 23 nt, Human
aauugugugaaagguacuucaaa

SEQ ID NO: 1184794 - RNA, 20 nt, Human
aauuuauuuaugggauccug

SEQ ID NO: 1184795 - RNA, 22 nt, Human
acacugugcugagucugaaggc

SEQ ID NO: 1184796 - RNA, 16 nt, Human
acagaagcuccaggua

SEQ ID NO: 1184797 - RNA, 14 nt, Human
acagacaaagcgug

SEQ ID NO: 1184798 - RNA, 11 nt, Human
acagacacagg

SEQ ID NO: 1184799 - RNA, 13 nt, Human
acagaggcagccc

SEQ ID NO: 1184800 - RNA, 14 nt, Human
acagaggcagcccc

SEQ ID NO: 1184801 - RNA, 17 nt, Human
acagaggccaugggccu

SEQ ID NO: 1184802 - RNA, 21 nt, Human
acagaggccaugggccuccug

SEQ ID NO: 1184803 - RNA, 23 nt, Human
acagaggccaugggccuccugug

SEQ ID NO: 1184804 - RNA, 15 nt, Human
acacgaauauugcug

SEQ ID NO: 1184805 - RNA, 21 nt, Human
acacgaauauugcugauggug

SEQ ID NO: 1184806 - RNA, 21 nt, Human
acaccacuacauucuguuaau

SEQ ID NO: 1184807 - RNA, 19 nt, Human
acacaaaaguuucucuuuu

SEQ ID NO: 1184808 - RNA, 20 nt, Human
acacagcucuucuccaggcu

SEQ ID NO: 1184809 - RNA, 21 nt, Human
acacagcucuucuccaggcug

SEQ ID NO: 1184810 - RNA, 22 nt, Human
acacagcucuucuccaggcugu

SEQ ID NO: 1184811 - RNA, 14 nt, Human
acacauuuuuuaaa

SEQ ID NO: 1184812 - RNA, 16 nt, Human
acacauuuuuuaaaug

SEQ ID NO: 1184813 - RNA, 18 nt, Human
acacauuuuuuaaaugca

SEQ ID NO: 1184814 - RNA, 19 nt, Human
acacauuuuuuaaaugcac

SEQ ID NO: 1184815 - RNA, 15 nt, Human
acaccacuacauucu

SEQ ID NO: 1184816 - RNA, 17 nt, Human
acaccacuacauucugu

SEQ ID NO: 1184817 - RNA, 20 nt, Human
acaccacuacauucuguuaa

SEQ ID NO: 1184818 - RNA, 14 nt, Human
acacgaauauugcu

SEQ ID NO: 1184819 - RNA, 20 nt, Human
acaaggaugaucuaggaaga

SEQ ID NO: 1184820 - RNA, 16 nt, Human
acaaggauugcuacug

SEQ ID NO: 1184821 - RNA, 13 nt, Human
acaauuuauuaug

SEQ ID NO: 1184822 - RNA, 14 nt, Human
acaauuuauuaugg

SEQ ID NO: 1184823 - RNA, 23 nt, Human
aaugcgugcauaccacuuuuguu

SEQ ID NO: 1184824 - RNA, 23 nt, Human
aaugcucuuuacuucauggacuu

SEQ ID NO: 1184825 - RNA, 13 nt, Human
aaugggacacuaa

SEQ ID NO: 1184826 - RNA, 14 nt, Human
aaugggagcucaug

SEQ ID NO: 1184827 - RNA, 15 nt, Human
aaugggggugcauuu

SEQ ID NO: 1184828 - RNA, 17 nt, Human
aaugggggugcauuuga

SEQ ID NO: 1184829 - RNA, 13 nt, Human
aaugggcagagca

SEQ ID NO: 1184830 - RNA, 15 nt, Human
aaugauagcuacugu

SEQ ID NO: 1184831 - RNA, 16 nt, Human
aaugauuaauuaaaac

SEQ ID NO: 1184832 - RNA, 12 nt, Human
aaugauuaauua

SEQ ID NO: 1184833 - RNA, 13 nt, Human
aaugauuaauuaa

SEQ ID NO: 1184834 - RNA, 15 nt, Human
aaugauaacuggaaa

SEQ ID NO: 1184835 - RNA, 16 nt, Human
aaugauaacuggaaac

SEQ ID NO: 1184836 - RNA, 17 nt, Human
aaugauaacuggaaacu

SEQ ID NO: 1184837 - RNA, 16 nt, Human
aauccauacauuugug

SEQ ID NO: 1184838 - RNA, 17 nt, Human
aauccauacauuugugu

SEQ ID NO: 1184839 - RNA, 17 nt, Human
aauccagacccggcugc

SEQ ID NO: 1184840 - RNA, 22 nt, Human
aaguugauaugccuuuucccaa

SEQ ID NO: 1184841 - RNA, 13 nt, Human
aagugcugcauuu

SEQ ID NO: 1184842 - RNA, 14 nt, Human
aagugcugcauuua

SEQ ID NO: 1184843 - RNA, 14 nt, Human
aauaauguuucaaa

SEQ ID NO: 1184844 - RNA, 19 nt, Human
aauaauguuucaaacauau

SEQ ID NO: 1184845 - RNA, 12 nt, Human
aauaauguuuca

SEQ ID NO: 1184846 - RNA, 16 nt, Human
aauauaggaacuuaaa

SEQ ID NO: 1184847 - RNA, 13 nt, Human
aaggacacuagaa

SEQ ID NO: 1184848 - RNA, 20 nt, Human
aaggcagcucuaaaugucaa

SEQ ID NO: 1184849 - RNA, 21 nt, Human
aagcgugagccacugcaccgg

SEQ ID NO: 1184850 - RNA, 17 nt, Human
aagcgugagccacugca

SEQ ID NO: 1184851 - RNA, 20 nt, Human
aagcgugagccacugcaccg

SEQ ID NO: 1184852 - RNA, 11 nt, Human
aagcugccagc

SEQ ID NO: 1184853 - RNA, 12 nt, Human
aagcugccagcc

SEQ ID NO: 1184854 - RNA, 22 nt, Human
aagcugccagccgagauagcca

SEQ ID NO: 1184855 - RNA, 16 nt, Human
aagcugcugacagugu

SEQ ID NO: 1184856 - RNA, 23 nt, Human
aaggaaugauuaauuaaaacaca

SEQ ID NO: 1184857 - RNA, 19 nt, Human
aagccagcaggcucucagg

SEQ ID NO: 1184858 - RNA, 18 nt, Human
aagccagcaggcucucag

SEQ ID NO: 1184859 - RNA, 15 nt, Human
aagccagcaggcucu

SEQ ID NO: 1184860 - RNA, 21 nt, Human
aagccaccaacauacucccau

SEQ ID NO: 1184861 - RNA, 15 nt, Human
aagcgauucuucugc

SEQ ID NO: 1184862 - RNA, 16 nt, Human
aagcgauucuucugcu

SEQ ID NO: 1184863 - RNA, 17 nt, Human
aagcgauucuucugcuu

SEQ ID NO: 1184864 - RNA, 20 nt, Human
aagggacuuggaagcuccgc

SEQ ID NO: 1184865 - RNA, 12 nt, Human
aaguagaggagg

SEQ ID NO: 1184866 - RNA, 20 nt, Human
aagauucauauuuacuucuu

SEQ ID NO: 1184867 - RNA, 19 nt, Human
aagauuuugaaauuuuuau

SEQ ID NO: 1184868 - RNA, 19 nt, Human
aagccaccaacauacuccc

SEQ ID NO: 1184869 - RNA, 23 nt, Human
aagacagugaaagaaaauaacaa

SEQ ID NO: 1184870 - RNA, 16 nt, Human
aagacuuuggaaagag

SEQ ID NO: 1184871 - RNA, 19 nt, Human
aagagagaaaauaaaaagu

SEQ ID NO: 1184872 - RNA, 20 nt, Human
aagagagaaaauaaaaaguu

SEQ ID NO: 1184873 - RNA, 21 nt, Human
aagagagaaaauaaaaaguua

SEQ ID NO: 1184874 - RNA, 22 nt, Human
aagagagaaaauaaaaaguuaa

SEQ ID NO: 1184875 - RNA, 23 nt, Human
aagagagaaaauaaaaaguuaaa

SEQ ID NO: 1184876 - RNA, 17 nt, Human
aagacuuuuccaacccu

SEQ ID NO: 1184877 - RNA, 15 nt, Human
aagagaacuuccaga

SEQ ID NO: 1184878 - RNA, 22 nt, Human
aaaaucccuuaccucggugccu

SEQ ID NO: 1184879 - RNA, 19 nt, Human
aaaauccauacauuugugu

SEQ ID NO: 1184880 - RNA, 15 nt, Human
aaaauuagccaagug

SEQ ID NO: 1184881 - RNA, 12 nt, Human
aaaauaaaaagu

SEQ ID NO: 1184882 - RNA, 13 nt, Human
aaaauaaaaaguu

SEQ ID NO: 1184883 - RNA, 14 nt, Human
aaaauaaaaaguua

SEQ ID NO: 1184884 - RNA, 17 nt, Human
aaacagcuaaugggaca

SEQ ID NO: 1184885 - RNA, 15 nt, Human
aaacagccugugucu

SEQ ID NO: 1184886 - RNA, 11 nt, Human
aaauaaauuau

SEQ ID NO: 1184887 - RNA, 15 nt, Human
aaagccaaagcuagg

SEQ ID NO: 1184888 - RNA, 17 nt, Human
aaaggcuaccuuuguau

SEQ ID NO: 1184889 - RNA, 14 nt, Human
aaaggcuccaggag

SEQ ID NO: 1184890 - RNA, 15 nt, Human
aaaggcuccaggagc

SEQ ID NO: 1184891 - RNA, 21 nt, Human
aaaggcuccaggagcagccac

SEQ ID NO: 1184892 - RNA, 22 nt, Human
aaaggcuccaggagcagccaca

SEQ ID NO: 1184893 - RNA, 17 nt, Human
aaaccccaucucuacaa

SEQ ID NO: 1184894 - RNA, 15 nt, Human
aaacccccacacaca

SEQ ID NO: 1184895 - RNA, 16 nt, Human
aaacccccacacacac

SEQ ID NO: 1184896 - RNA, 22 nt, Human
aaacccccacacacacacacau

SEQ ID NO: 1184897 - RNA, 21 nt, Human
aaacccugucucuacuaaaaa

SEQ ID NO: 1184898 - RNA, 14 nt, Human
aaacccuucagugc

SEQ ID NO: 1184899 - RNA, 19 nt, Human
aaacccuugccaugugcua

SEQ ID NO: 1184900 - RNA, 17 nt, Human
aaacucuugaccucagg

SEQ ID NO: 1184901 - RNA, 13 nt, Human
aaacugauuuuuu

SEQ ID NO: 1184902 - RNA, 19 nt, Human
aaacugauuuuuuuuuccu

SEQ ID NO: 1184903 - RNA, 20 nt, Human
aaacugauuuuuuuuuccuu

SEQ ID NO: 1184904 - RNA, 22 nt, Human
aaacugauuuuuuuuuccuuca

SEQ ID NO: 1184905 - RNA, 13 nt, Human
aaagaaacauuug

SEQ ID NO: 1184906 - RNA, 15 nt, Human
aaagauacaguuacu

SEQ ID NO: 1184907 - RNA, 11 nt, Human
aaagagguuuu

SEQ ID NO: 1184908 - RNA, 16 nt, Human
aacagcuaaugggaca

SEQ ID NO: 1184909 - RNA, 13 nt, Human
aacccuucagugc

SEQ ID NO: 1184910 - RNA, 19 nt, Human
aaccaguguuguggauuua

SEQ ID NO: 1184911 - RNA, 15 nt, Human
aacauggaaguacua

SEQ ID NO: 1184912 - RNA, 13 nt, Human
aacgucugugcca

SEQ ID NO: 1184913 - RNA, 17 nt, Human
aacucaaacucuuaaaa

SEQ ID NO: 1184914 - RNA, 16 nt, Human
aacucaccccagcccc

SEQ ID NO: 1184915 - RNA, 17 nt, Human
aacucaccccagcccca

SEQ ID NO: 1184916 - RNA, 18 nt, Human
aacucaccccagccccaa

SEQ ID NO: 1184917 - RNA, 18 nt, Human
aacugaaugaaaccccca

SEQ ID NO: 1184918 - RNA, 23 nt, Human
aacugaaugaaacccccacacac

SEQ ID NO: 1184919 - RNA, 14 nt, Human
aaauggacguguua

SEQ ID NO: 1184920 - RNA, 15 nt, Human
aaauggacguguuau

SEQ ID NO: 1184921 - RNA, 17 nt, Human
aaauggacguguuauga

SEQ ID NO: 1184922 - RNA, 22 nt, Human
aaaucuccaaaauaaaacuuuu

SEQ ID NO: 1184923 - RNA, 18 nt, Human
aaaucugcuuuuuaaaga

SEQ ID NO: 1184924 - RNA, 21 nt, Human
aacacauacaggaagguagaa

SEQ ID NO: 1184925 - RNA, 22 nt, Human
aacaaaccuguuucugcagcca

SEQ ID NO: 1184926 - RNA, 19 nt, Human
aacaccucugcacaagcug

SEQ ID NO: 1184927 - RNA, 12 nt, Human
aaauuaacuuuu

SEQ ID NO: 1184928 - RNA, 13 nt, Human
aaauuaacuuuua

SEQ ID NO: 1184929 - RNA, 14 nt, Human
aaauuaacuuuuau

SEQ ID NO: 1184930 - RNA, 19 nt, Human
aaauuaacuuuuauaaacu

SEQ ID NO: 1184931 - RNA, 20 nt, Human
aaauguucaucaaugaauga

SEQ ID NO: 1184932 - RNA, 22 nt, Human
agugggcccaaugcacuuuguu

SEQ ID NO: 1184933 - RNA, 19 nt, Human
agugucaaugcagccccca

SEQ ID NO: 1184934 - RNA, 14 nt, Human
agugauucuccugc

SEQ ID NO: 1184935 - RNA, 15 nt, Human
agugauucuccugcc

SEQ ID NO: 1184936 - RNA, 17 nt, Human
agugauucuccugccuc

SEQ ID NO: 1184937 - RNA, 18 nt, Human
agugccuuacacaauggu

SEQ ID NO: 1184938 - RNA, 14 nt, Human
agugauccucccac

SEQ ID NO: 1184939 - RNA, 15 nt, Human
agugauccucccacc

SEQ ID NO: 1184940 - RNA, 18 nt, Human
agugauccucccaccuca

SEQ ID NO: 1184941 - RNA, 19 nt, Human
agugauccucccaccucag

SEQ ID NO: 1184942 - RNA, 24 nt, Human
agugauccucccaccucagccucc

SEQ ID NO: 1184943 - RNA, 10 nt, Human
agugccuuau

SEQ ID NO: 1184944 - RNA, 13 nt, Human
agugccuuaugga

SEQ ID NO: 1184945 - RNA, 14 nt, Human
agugccuuauggaa

SEQ ID NO: 1184946 - RNA, 15 nt, Human
agugccuuauggaac

SEQ ID NO: 1184947 - RNA, 16 nt, Human
agugccuuauggaaca

SEQ ID NO: 1184948 - RNA, 18 nt, Human
agugccuuauggaacacu

SEQ ID NO: 1184949 - RNA, 18 nt, Human
aguucagguaacaggcag

SEQ ID NO: 1184950 - RNA, 13 nt, Human
aguucaucuugaa

SEQ ID NO: 1184951 - RNA, 15 nt, Human
aguucaucuugaauu

SEQ ID NO: 1184952 - RNA, 19 nt, Human
aguucaucuugaauuguaa

SEQ ID NO: 1184953 - RNA, 22 nt, Human
aguucaucuugaauuguaagga

SEQ ID NO: 1184954 - RNA, 16 nt, Human
aguugauacuacaguu

SEQ ID NO: 1184955 - RNA, 14 nt, Human
aguugauagcacag

SEQ ID NO: 1184956 - RNA, 19 nt, Human
aguccucuuuucugagagg

SEQ ID NO: 1184957 - RNA, 22 nt, Human
aguccucuuuucugagaggacu

SEQ ID NO: 1184958 - RNA, 20 nt, Human
aguccuuaccagcagagcac

SEQ ID NO: 1184959 - RNA, 15 nt, Human
aguaucucagggccu

SEQ ID NO: 1184960 - RNA, 20 nt, Human
aguaugaggcauuuguuuga

SEQ ID NO: 1184961 - RNA, 21 nt, Human
aguaugaggcauuuguuugaa

SEQ ID NO: 1184962 - RNA, 23 nt, Human
aguaugaggcauuuguuugaacu

SEQ ID NO: 1184963 - RNA, 22 nt, Human
agucacacaguauuacuucugc

SEQ ID NO: 1184964 - RNA, 23 nt, Human
agucacacaguauuacuucugcu

SEQ ID NO: 1184965 - RNA, 13 nt, Human
aggucuguucuuu

SEQ ID NO: 1184966 - RNA, 15 nt, Human
aggucuguucuuucc

SEQ ID NO: 1184967 - RNA, 16 nt, Human
aggucuguucuuucca

SEQ ID NO: 1184968 - RNA, 18 nt, Human
aggucuguucuuuccaaa

SEQ ID NO: 1184969 - RNA, 18 nt, Human
aguaaaugggggugcauu

SEQ ID NO: 1184970 - RNA, 15 nt, Human
aguacguugugcauu

SEQ ID NO: 1184971 - RNA, 16 nt, Human
aguacguugugcauuu

SEQ ID NO: 1184972 - RNA, 17 nt, Human
aguacguugugcauuug

SEQ ID NO: 1184973 - RNA, 18 nt, Human
aguacguugugcauuugg

SEQ ID NO: 1184974 - RNA, 19 nt, Human
aguacuacaguccucccau

SEQ ID NO: 1184975 - RNA, 22 nt, Human
aguacuacaguccucccaucuc

SEQ ID NO: 1184976 - RNA, 14 nt, Human
aguacuauaauuua

SEQ ID NO: 1184977 - RNA, 20 nt, Human
aguaagccgugauuuucauu

SEQ ID NO: 1184978 - RNA, 12 nt, Human
aguacuauguau

SEQ ID NO: 1184979 - RNA, 14 nt, Human
aguacuauguauca

SEQ ID NO: 1184980 - RNA, 13 nt, Human
aguacucauacau

SEQ ID NO: 1184981 - RNA, 17 nt, Human
aguacuucuccacccug

SEQ ID NO: 1184982 - RNA, 19 nt, Human
aguacuucuccacccugcu

SEQ ID NO: 1184983 - RNA, 12 nt, Human
aguacuucuuuu

SEQ ID NO: 1184984 - RNA, 15 nt, Human
auagccuaggugaca

SEQ ID NO: 1184985 - RNA, 17 nt, Human
auagccuaggugacaga

SEQ ID NO: 1184986 - RNA, 17 nt, Human
auagcacagacccugcc

SEQ ID NO: 1184987 - RNA, 18 nt, Human
auagcacagacccugccc

SEQ ID NO: 1184988 - RNA, 15 nt, Human
auagcagcuuauuca

SEQ ID NO: 1184989 - RNA, 18 nt, Human
auagcagcuuauucacaa

SEQ ID NO: 1184990 - RNA, 14 nt, Human
auauuauguuaaaa

SEQ ID NO: 1184991 - RNA, 16 nt, Human
auauuauguuaaaacu

SEQ ID NO: 1184992 - RNA, 19 nt, Human
auauucaggaagcucaggg

SEQ ID NO: 1184993 - RNA, 17 nt, Human
auaugcucugcauguua

SEQ ID NO: 1184994 - RNA, 20 nt, Human
auaugcucugcauguuacau

SEQ ID NO: 1184995 - RNA, 13 nt, Human
auauuauguuaaa

SEQ ID NO: 1184996 - RNA, 14 nt, Human
auaauguaagcucu

SEQ ID NO: 1184997 - RNA, 13 nt, Human
auaauguuucaaa

SEQ ID NO: 1184998 - RNA, 18 nt, Human
auaaggguaucuggugac

SEQ ID NO: 1184999 - RNA, 21 nt, Human
auaagccagacaucaacagau

SEQ ID NO: 1185000 - RNA, 22 nt, Human
auaagccagacaucaacagaua

SEQ ID NO: 1185001 - RNA, 17 nt, Human
auaccugucccccugac

SEQ ID NO: 1185002 - RNA, 14 nt, Human
auaccugucccccu

SEQ ID NO: 1185003 - RNA, 15 nt, Human
auaccugucccccug

SEQ ID NO: 1185004 - RNA, 16 nt, Human
auaccugucccccuga

SEQ ID NO: 1185005 - RNA, 17 nt, Human
auacccacccccaccca

SEQ ID NO: 1185006 - RNA, 14 nt, Human
auacccacccccac

SEQ ID NO: 1185007 - RNA, 16 nt, Human
auacccacccccaccc

SEQ ID NO: 1185008 - RNA, 18 nt, Human
auaauguuucaaacauau

SEQ ID NO: 1185009 - RNA, 23 nt, Human
auaauguuucaaacauauauaac

SEQ ID NO: 1185010 - RNA, 14 nt, Human
auacaaugcugugc

SEQ ID NO: 1185011 - RNA, 17 nt, Human
auacaaugcugugcccu

SEQ ID NO: 1185012 - RNA, 22 nt, Human
auacacuuacacuuuaugcaca

SEQ ID NO: 1185013 - RNA, 14 nt, Human
auaacaaugaaagu

SEQ ID NO: 1185014 - RNA, 15 nt, Human
auaacaaugcuguau

SEQ ID NO: 1185015 - RNA, 17 nt, Human
auaacaaugcuguauuu

SEQ ID NO: 1185016 - RNA, 19 nt, Human
auaacaaugcuguauuuua

SEQ ID NO: 1185017 - RNA, 20 nt, Human
auaacaaugcuguauuuuaa

SEQ ID NO: 1185018 - RNA, 21 nt, Human
auaacaaugcuguauuuuaaa

SEQ ID NO: 1185019 - RNA, 20 nt, Human
auaacauguaauuaaguacu

SEQ ID NO: 1185020 - RNA, 13 nt, Human
auaacauguaauu

SEQ ID NO: 1185021 - RNA, 18 nt, Human
auaacauguaauuaagua

SEQ ID NO: 1185022 - RNA, 20 nt, Human
aguuguuacauuuuuaagug

SEQ ID NO: 1185023 - RNA, 22 nt, Human
aguuguuacauuuuuaagugcu

SEQ ID NO: 1185024 - RNA, 18 nt, Human
aguuugagaucagccugg

SEQ ID NO: 1185025 - RNA, 19 nt, Human
aguuugagaucagccuggg

SEQ ID NO: 1185026 - RNA, 20 nt, Human
aguuugagaucagccugggc

SEQ ID NO: 1185027 - RNA, 17 nt, Human
aguuugauuaaauucuu

SEQ ID NO: 1185028 - RNA, 18 nt, Human
aguuugauuaaauucuug

SEQ ID NO: 1185029 - RNA, 20 nt, Human
aguuugauuaaauucuugca

SEQ ID NO: 1185030 - RNA, 22 nt, Human
aguuugauuaaauucuugcaaa

SEQ ID NO: 1185031 - RNA, 23 nt, Human
aguuugauuaaauucuugcaaag

SEQ ID NO: 1185032 - RNA, 11 nt, Human
auaaaacuuuu

SEQ ID NO: 1185033 - RNA, 16 nt, Human
augcugcccugugagu

SEQ ID NO: 1185034 - RNA, 13 nt, Human
augcugcccugug

SEQ ID NO: 1185035 - RNA, 14 nt, Human
augcugcccuguga

SEQ ID NO: 1185036 - RNA, 15 nt, Human
augcugcccugugag

SEQ ID NO: 1185037 - RNA, 16 nt, Human
augcuuguacauaaug

SEQ ID NO: 1185038 - RNA, 18 nt, Human
auggcuuuugugcauuau

SEQ ID NO: 1185039 - RNA, 16 nt, Human
auggcuuuugugcauu

SEQ ID NO: 1185040 - RNA, 17 nt, Human
auggcuuuugugcauua

SEQ ID NO: 1185041 - RNA, 18 nt, Human
augaugaaaugaggucag

SEQ ID NO: 1185042 - RNA, 23 nt, Human
augaugaaaugaggucagagccu

SEQ ID NO: 1185043 - RNA, 15 nt, Human
augaugauccuaggc

SEQ ID NO: 1185044 - RNA, 17 nt, Human
augaucuuugcagacag

SEQ ID NO: 1185045 - RNA, 18 nt, Human
augaucuuugcagacagg

SEQ ID NO: 1185046 - RNA, 19 nt, Human
augaucuuugcagacaggc

SEQ ID NO: 1185047 - RNA, 21 nt, Human
augaucuuugcagacaggcaa

SEQ ID NO: 1185048 - RNA, 13 nt, Human
augcacacauuuu

SEQ ID NO: 1185049 - RNA, 14 nt, Human
augcacacauuuuu

SEQ ID NO: 1185050 - RNA, 15 nt, Human
augcacacauuuuuu

SEQ ID NO: 1185051 - RNA, 19 nt, Human
augcacagaguuguuacau

SEQ ID NO: 1185052 - RNA, 21 nt, Human
augcacagaguuguuacauuu

SEQ ID NO: 1185053 - RNA, 22 nt, Human
augcacagaguuguuacauuuu

SEQ ID NO: 1185054 - RNA, 23 nt, Human
augcacagaguuguuacauuuuu

SEQ ID NO: 1185055 - RNA, 19 nt, Human
augccuggauggggcugca

SEQ ID NO: 1185056 - RNA, 20 nt, Human
augccuggauggggcugcac

SEQ ID NO: 1185057 - RNA, 21 nt, Human
augccuggauggggcugcacc

SEQ ID NO: 1185058 - RNA, 13 nt, Human
auguguaaguauu

SEQ ID NO: 1185059 - RNA, 14 nt, Human
auguguaaguauuc

SEQ ID NO: 1185060 - RNA, 17 nt, Human
auguucucucuucucca

SEQ ID NO: 1185061 - RNA, 13 nt, Human
auguucucugagg

SEQ ID NO: 1185062 - RNA, 17 nt, Human
auguucucugaggacac

SEQ ID NO: 1185063 - RNA, 14 nt, Human
auguucugggacac

SEQ ID NO: 1185064 - RNA, 15 nt, Human
auguucugggacaca

SEQ ID NO: 1185065 - RNA, 14 nt, Human
auguucuuaauucu

SEQ ID NO: 1185066 - RNA, 15 nt, Human
auguuugccucugcc

SEQ ID NO: 1185067 - RNA, 17 nt, Human
auguuugccucugccuc

SEQ ID NO: 1185068 - RNA, 21 nt, Human
augggugcuuggaggaaggaa

SEQ ID NO: 1185069 - RNA, 23 nt, Human
augggugcuuggaggaaggaaac

SEQ ID NO: 1185070 - RNA, 14 nt, Human
augucacaggcagg

SEQ ID NO: 1185071 - RNA, 19 nt, Human
augucacaggcagguccag

SEQ ID NO: 1185072 - RNA, 21 nt, Human
augucaaucagccuaguugau

SEQ ID NO: 1185073 - RNA, 13 nt, Human
augucacaggcag

SEQ ID NO: 1185074 - RNA, 19 nt, Human
auccagacccggcugcgug

SEQ ID NO: 1185075 - RNA, 19 nt, Human
aucccaugagccucagcau

SEQ ID NO: 1185076 - RNA, 19 nt, Human
auccucaguuuuugugaaa

SEQ ID NO: 1185077 - RNA, 15 nt, Human
aucccuacuguaauu

SEQ ID NO: 1185078 - RNA, 17 nt, Human
auccucauacccacccc

SEQ ID NO: 1185079 - RNA, 13 nt, Human
aucagcuuauugu

SEQ ID NO: 1185080 - RNA, 17 nt, Human
aucaugaauuaguuuua

SEQ ID NO: 1185081 - RNA, 21 nt, Human
aucaugaauuaguuuuauaug

SEQ ID NO: 1185082 - RNA, 14 nt, Human
aucaugucuggcua

SEQ ID NO: 1185083 - RNA, 23 nt, Human
aucaaagagguuuuaaaaaaauc

SEQ ID NO: 1185084 - RNA, 13 nt, Human
aucacagccucug

SEQ ID NO: 1185085 - RNA, 13 nt, Human
aucaccagacagg

SEQ ID NO: 1185086 - RNA, 23 nt, Human
aucacccgcuaagagggagggag

SEQ ID NO: 1185087 - RNA, 17 nt, Human
aucuggguucacugcaa

SEQ ID NO: 1185088 - RNA, 21 nt, Human
augaaguacucauacauguua

SEQ ID NO: 1185089 - RNA, 20 nt, Human
augaaguccaagcauuuaga

SEQ ID NO: 1185090 - RNA, 23 nt, Human
augaaguccaagcauuuagaugu

SEQ ID NO: 1185091 - RNA, 14 nt, Human
augaggcauuuguu

SEQ ID NO: 1185092 - RNA, 21 nt, Human
augaggcauuuguuugaacug

SEQ ID NO: 1185093 - RNA, 22 nt, Human
augaggcauuuguuugaacuga

SEQ ID NO: 1185094 - RNA, 14 nt, Human
augaaaacacauuu

SEQ ID NO: 1185095 - RNA, 15 nt, Human
augaaaacacauuuu

SEQ ID NO: 1185096 - RNA, 16 nt, Human
augaaaacacauuuuu

SEQ ID NO: 1185097 - RNA, 13 nt, Human
agcgagcccuggu

SEQ ID NO: 1185098 - RNA, 19 nt, Human
agcgagcccugguggcagu

SEQ ID NO: 1185099 - RNA, 12 nt, Human
agccugggaggu

SEQ ID NO: 1185100 - RNA, 20 nt, Human
agccugggaggucaaggcug

SEQ ID NO: 1185101 - RNA, 12 nt, Human
agcuacaaaugc

SEQ ID NO: 1185102 - RNA, 16 nt, Human
agcucaccagccccag

SEQ ID NO: 1185103 - RNA, 19 nt, Human
agcucaccagccccagugc

SEQ ID NO: 1185104 - RNA, 20 nt, Human
agcucaccagccccagugcc

SEQ ID NO: 1185105 - RNA, 12 nt, Human
agcucaccucuc

SEQ ID NO: 1185106 - RNA, 15 nt, Human
agcucaccucucccu

SEQ ID NO: 1185107 - RNA, 18 nt, Human
agcucaccucucccuugg

SEQ ID NO: 1185108 - RNA, 19 nt, Human
agcucaccucucccuugga

SEQ ID NO: 1185109 - RNA, 12 nt, Human
agcucagagagg

SEQ ID NO: 1185110 - RNA, 14 nt, Human
agcucagagagggu

SEQ ID NO: 1185111 - RNA, 18 nt, Human
agcucagagaggguggga

SEQ ID NO: 1185112 - RNA, 15 nt, Human
agcugaaccugggua

SEQ ID NO: 1185113 - RNA, 13 nt, Human
agcugcgguccac

SEQ ID NO: 1185114 - RNA, 16 nt, Human
agcugcgguccaccca

SEQ ID NO: 1185115 - RNA, 17 nt, Human
agcugcgguccacccag

SEQ ID NO: 1185116 - RNA, 18 nt, Human
agcugcgguccacccagg

SEQ ID NO: 1185117 - RNA, 19 nt, Human
agcugcgguccacccagga

SEQ ID NO: 1185118 - RNA, 20 nt, Human
agcugcgguccacccaggag

SEQ ID NO: 1185119 - RNA, 21 nt, Human
agcugcgguccacccaggagc

SEQ ID NO: 1185120 - RNA, 12 nt, Human
agcugcugacag

SEQ ID NO: 1185121 - RNA, 13 nt, Human
agcugcugacagu

SEQ ID NO: 1185122 - RNA, 14 nt, Human
agcugcugacagug

SEQ ID NO: 1185123 - RNA, 17 nt, Human
agcuggucccacucagu

SEQ ID NO: 1185124 - RNA, 18 nt, Human
agcuggucccacucaguc

SEQ ID NO: 1185125 - RNA, 19 nt, Human
agcuggucccacucagucc

SEQ ID NO: 1185126 - RNA, 22 nt, Human
agcugguuuuuagcggagacgg

SEQ ID NO: 1185127 - RNA, 23 nt, Human
agcuuuguuuguugucagcugaa

SEQ ID NO: 1185128 - RNA, 19 nt, Human
agcuucauuuccugugucu

SEQ ID NO: 1185129 - RNA, 18 nt, Human
agcuucacuguaaaauaa

SEQ ID NO: 1185130 - RNA, 18 nt, Human
agcuucauuuccuguguc

SEQ ID NO: 1185131 - RNA, 23 nt, Human
aggaacuuaaauaaugugaaacu

SEQ ID NO: 1185132 - RNA, 15 nt, Human
aggaauaccuguccc

SEQ ID NO: 1185133 - RNA, 18 nt, Human
aggaauaccugucccccu

SEQ ID NO: 1185134 - RNA, 22 nt, Human
aggaauaccugucccccugaca

SEQ ID NO: 1185135 - RNA, 12 nt, Human
aggaacaaggca

SEQ ID NO: 1185136 - RNA, 13 nt, Human
aggaacaaggcaa

SEQ ID NO: 1185137 - RNA, 16 nt, Human
aggaacaaggcaaggc

SEQ ID NO: 1185138 - RNA, 17 nt, Human
aggaacaaggcaaggcu

SEQ ID NO: 1185139 - RNA, 19 nt, Human
aggaacaaggcaaggcugu

SEQ ID NO: 1185140 - RNA, 20 nt, Human
aggaacaaggcaaggcuguc

SEQ ID NO: 1185141 - RNA, 23 nt, Human
aggaacaaggcaaggcugucaau

SEQ ID NO: 1185142 - RNA, 21 nt, Human
aggaacuuaaauaaugugaaa

SEQ ID NO: 1185143 - RNA, 12 nt, Human
aggcccuucucu

SEQ ID NO: 1185144 - RNA, 15 nt, Human
aggcccuucucucca

SEQ ID NO: 1185145 - RNA, 19 nt, Human
aggcccuucucuccagccc

SEQ ID NO: 1185146 - RNA, 21 nt, Human
aggccaugggcacugugggua

SEQ ID NO: 1185147 - RNA, 23 nt, Human
aggccaugggcacuguggguaga

SEQ ID NO: 1185148 - RNA, 22 nt, Human
aggcccucugcccacucccugc

SEQ ID NO: 1185149 - RNA, 23 nt, Human
aggcccucugcccacucccugca

SEQ ID NO: 1185150 - RNA, 19 nt, Human
aggcauuccccaggaggcc

SEQ ID NO: 1185151 - RNA, 20 nt, Human
aggcauuccccaggaggcca

SEQ ID NO: 1185152 - RNA, 21 nt, Human
aggcauuccccaggaggccag

SEQ ID NO: 1185153 - RNA, 13 nt, Human
aggccaggcccuc

SEQ ID NO: 1185154 - RNA, 14 nt, Human
aggccaggcccucu

SEQ ID NO: 1185155 - RNA, 15 nt, Human
aggccaggcccucug

SEQ ID NO: 1185156 - RNA, 16 nt, Human
aggccaggcccucugc

SEQ ID NO: 1185157 - RNA, 14 nt, Human
aggagaggggcaca

SEQ ID NO: 1185158 - RNA, 15 nt, Human
aggcaugguggccca

SEQ ID NO: 1185159 - RNA, 17 nt, Human
aggcaugugaugagagg

SEQ ID NO: 1185160 - RNA, 19 nt, Human
aggcaugugaugagaggaa

SEQ ID NO: 1185161 - RNA, 20 nt, Human
aggcaugugaugagaggaaa

SEQ ID NO: 1185162 - RNA, 21 nt, Human
aggcaugugaugagaggaaau

SEQ ID NO: 1185163 - RNA, 17 nt, Human
aggcauguucucugagg

SEQ ID NO: 1185164 - RNA, 18 nt, Human
aggcauguucucugagga

SEQ ID NO: 1185165 - RNA, 19 nt, Human
aggcauguucucugaggac

SEQ ID NO: 1185166 - RNA, 18 nt, Human
aggcauuccccaggaggc

SEQ ID NO: 1185167 - RNA, 18 nt, Human
aggcuggguucugauccu

SEQ ID NO: 1185168 - RNA, 13 nt, Human
aggcuaccuuugu

SEQ ID NO: 1185169 - RNA, 14 nt, Human
aggcuaccuuugua

SEQ ID NO: 1185170 - RNA, 15 nt, Human
aggcuaccuuuguau

SEQ ID NO: 1185171 - RNA, 20 nt, Human
aggcuguaucccaugagccu

SEQ ID NO: 1185172 - RNA, 21 nt, Human
aggcuguaucccaugagccuc

SEQ ID NO: 1185173 - RNA, 22 nt, Human
aggcuguaucccaugagccuca

SEQ ID NO: 1185174 - RNA, 23 nt, Human
aggcuguaucccaugagccucag

SEQ ID NO: 1185175 - RNA, 17 nt, Human
aggcuuagucacugaga

SEQ ID NO: 1185176 - RNA, 15 nt, Human
agggacugaggggag

SEQ ID NO: 1185177 - RNA, 15 nt, Human
agggacccuccacca

SEQ ID NO: 1185178 - RNA, 18 nt, Human
aggcuuagucacugagac

SEQ ID NO: 1185179 - RNA, 21 nt, Human
aggcuuagucacugagacagc

SEQ ID NO: 1185180 - RNA, 21 nt, Human
aggguaucuggugacuuuccu

SEQ ID NO: 1185181 - RNA, 13 nt, Human
aggguauuccaga

SEQ ID NO: 1185182 - RNA, 14 nt, Human
agggucccuggugg

SEQ ID NO: 1185183 - RNA, 16 nt, Human
agggucccugguggca

SEQ ID NO: 1185184 - RNA, 17 nt, Human
agggucccugguggcag

SEQ ID NO: 1185185 - RNA, 20 nt, Human
agggucccugguggcagcuc

SEQ ID NO: 1185186 - RNA, 22 nt, Human
agggucccugguggcagcucac

SEQ ID NO: 1185187 - RNA, 14 nt, Human
agggccuggccuga

SEQ ID NO: 1185188 - RNA, 14 nt, Human
agggccugcaaggg

SEQ ID NO: 1185189 - RNA, 15 nt, Human
agggccugcaaggga

SEQ ID NO: 1185190 - RNA, 12 nt, Human
agggccuggccu

SEQ ID NO: 1185191 - RNA, 13 nt, Human
agggccuggccug

SEQ ID NO: 1185192 - RNA, 13 nt, Human
agguacucuccug

SEQ ID NO: 1185193 - RNA, 14 nt, Human
agguacucuccugg

SEQ ID NO: 1185194 - RNA, 13 nt, Human
agguaacaggcag

SEQ ID NO: 1185195 - RNA, 14 nt, Human
agguaacaggcaga

SEQ ID NO: 1185196 - RNA, 16 nt, Human
agguaacaggcagaua

SEQ ID NO: 1185197 - RNA, 22 nt, Human
aggguuuugccauguuggccag

SEQ ID NO: 1185198 - RNA, 23 nt, Human
aggguuuugccauguuggccagg

SEQ ID NO: 1185199 - RNA, 20 nt, Human
agggucucacuauguugccc

SEQ ID NO: 1185200 - RNA, 23 nt, Human
agaggacuuuucuuuguggcuuc

SEQ ID NO: 1185201 - RNA, 21 nt, Human
agaggacuuuucuuuguggcu

SEQ ID NO: 1185202 - RNA, 22 nt, Human
agaggacuuuucuuuguggcuu

SEQ ID NO: 1185203 - RNA, 13 nt, Human
agagggccugcaa

SEQ ID NO: 1185204 - RNA, 16 nt, Human
agagggccugcaaggg

SEQ ID NO: 1185205 - RNA, 17 nt, Human
agaggggguggccuccc

SEQ ID NO: 1185206 - RNA, 19 nt, Human
agaggggguggccucccaa

SEQ ID NO: 1185207 - RNA, 13 nt, Human
agaggaaugaagu

SEQ ID NO: 1185208 - RNA, 16 nt, Human
agacgcugugcugccc

SEQ ID NO: 1185209 - RNA, 18 nt, Human
agacucugucucagucca

SEQ ID NO: 1185210 - RNA, 20 nt, Human
agacugaguacguugugcau

SEQ ID NO: 1185211 - RNA, 22 nt, Human
agacugaguacguugugcauuu

SEQ ID NO: 1185212 - RNA, 23 nt, Human
agacugaguacguugugcauuug

SEQ ID NO: 1185213 - RNA, 18 nt, Human
agacucugucucaaaaaa

SEQ ID NO: 1185214 - RNA, 16 nt, Human
agagagaccacuuuuc

SEQ ID NO: 1185215 - RNA, 16 nt, Human
agacuggaagcacagc

SEQ ID NO: 1185216 - RNA, 13 nt, Human
agagcccaccuug

SEQ ID NO: 1185217 - RNA, 21 nt, Human
acuuuccucuuuggucuacac

SEQ ID NO: 1185218 - RNA, 13 nt, Human
agaagacacugau

SEQ ID NO: 1185219 - RNA, 21 nt, Human
agaagacacugaugggcaacc

SEQ ID NO: 1185220 - RNA, 18 nt, Human
agaagacugcauuauauu

SEQ ID NO: 1185221 - RNA, 21 nt, Human
agaagagauugugguuucauu

SEQ ID NO: 1185222 - RNA, 14 nt, Human
agaaguaacuuacu

SEQ ID NO: 1185223 - RNA, 21 nt, Human
agaagugaaaaucuacacucc

SEQ ID NO: 1185224 - RNA, 18 nt, Human
agaaugaaagggcccaga

SEQ ID NO: 1185225 - RNA, 17 nt, Human
agaaugagagacacacu

SEQ ID NO: 1185226 - RNA, 22 nt, Human
agaaugagagacacacugaaga

SEQ ID NO: 1185227 - RNA, 19 nt, Human
agaaugcacaaacagaggc

SEQ ID NO: 1185228 - RNA, 22 nt, Human
agaaugcacaaacagaggccgc

SEQ ID NO: 1185229 - RNA, 20 nt, Human
agacaaugacuuacuguaca

SEQ ID NO: 1185230 - RNA, 21 nt, Human
agacaaugacuuacuguacau

SEQ ID NO: 1185231 - RNA, 22 nt, Human
agacaaugacuuacuguacaug

SEQ ID NO: 1185232 - RNA, 23 nt, Human
agacaaugacuuacuguacauga

SEQ ID NO: 1185233 - RNA, 15 nt, Human
agacagagcuacaca

SEQ ID NO: 1185234 - RNA, 11 nt, Human
agacagagucu

SEQ ID NO: 1185235 - RNA, 19 nt, Human
agacagagucucacuguug

SEQ ID NO: 1185236 - RNA, 20 nt, Human
agacagagucucacuguugc

SEQ ID NO: 1185237 - RNA, 21 nt, Human
agacagagucucacuguugcc

SEQ ID NO: 1185238 - RNA, 23 nt, Human
agacagagucucacuguugccca

SEQ ID NO: 1185239 - RNA, 19 nt, Human
agacccaaaaggcagaagc

SEQ ID NO: 1185240 - RNA, 20 nt, Human
agccccauucugccugccca

SEQ ID NO: 1185241 - RNA, 18 nt, Human
agcccgggcucugccucc

SEQ ID NO: 1185242 - RNA, 20 nt, Human
agcccgggcucugccuccca

SEQ ID NO: 1185243 - RNA, 21 nt, Human
agcccgggcucugccucccau

SEQ ID NO: 1185244 - RNA, 15 nt, Human
agccccauccucugu

SEQ ID NO: 1185245 - RNA, 17 nt, Human
agccccauccucuguac

SEQ ID NO: 1185246 - RNA, 23 nt, Human
agccccauccucuguacagagcc

SEQ ID NO: 1185247 - RNA, 18 nt, Human
agccccauucugccugcc

SEQ ID NO: 1185248 - RNA, 19 nt, Human
agccccauucugccugccc

SEQ ID NO: 1185249 - RNA, 14 nt, Human
agcccacgccccca

SEQ ID NO: 1185250 - RNA, 15 nt, Human
agcccacgcccccac

SEQ ID NO: 1185251 - RNA, 23 nt, Human
agcccacgcccccacuggugaca

SEQ ID NO: 1185252 - RNA, 16 nt, Human
agccagcaggcucuca

SEQ ID NO: 1185253 - RNA, 17 nt, Human
agccagcaggcucucag

SEQ ID NO: 1185254 - RNA, 15 nt, Human
agcccaccccucaac

SEQ ID NO: 1185255 - RNA, 16 nt, Human
agcccaccuuggcuca

SEQ ID NO: 1185256 - RNA, 14 nt, Human
agcauccuggcacc

SEQ ID NO: 1185257 - RNA, 17 nt, Human
agcauccuggcacccgg

SEQ ID NO: 1185258 - RNA, 18 nt, Human
agcauccuggcacccggc

SEQ ID NO: 1185259 - RNA, 16 nt, Human
agccaaagcuaggccu

SEQ ID NO: 1185260 - RNA, 18 nt, Human
agccaaagcuaggccugg

SEQ ID NO: 1185261 - RNA, 20 nt, Human
agccaaggccaaaggaagca

SEQ ID NO: 1185262 - RNA, 13 nt, Human
agccagaggagag

SEQ ID NO: 1185263 - RNA, 15 nt, Human
agccagaggagagag

SEQ ID NO: 1185264 - RNA, 17 nt, Human
agccagaggagagagga

SEQ ID NO: 1185265 - RNA, 18 nt, Human
agccagaggagagaggac

SEQ ID NO: 1185266 - RNA, 14 nt, Human
agccagcaggcucu

SEQ ID NO: 1185267 - RNA, 20 nt, Human
agcaaaggagauuggaagga

SEQ ID NO: 1185268 - RNA, 19 nt, Human
agauucuuuccugaggcug

SEQ ID NO: 1185269 - RNA, 21 nt, Human
agauucuuuccugaggcuggg

SEQ ID NO: 1185270 - RNA, 20 nt, Human
agauugcaacaggcugggcu

SEQ ID NO: 1185271 - RNA, 21 nt, Human
agauugcaacaggcugggcuu

SEQ ID NO: 1185272 - RNA, 23 nt, Human
agauugcaacaggcugggcuuca

SEQ ID NO: 1185273 - RNA, 18 nt, Human
agcaaaagaugcuucuca

SEQ ID NO: 1185274 - RNA, 24 nt, Human
agcaaaauuuuuucucuaggaaau

SEQ ID NO: 1185275 - RNA, 19 nt, Human
agauguagaggagaaacug

SEQ ID NO: 1185276 - RNA, 14 nt, Human
agaugagugagcau

SEQ ID NO: 1185277 - RNA, 23 nt, Human
agaggggguggccucccaacuca

SEQ ID NO: 1185278 - RNA, 17 nt, Human
agcacagacccugcccu

SEQ ID NO: 1185279 - RNA, 16 nt, Human
agcacagacccugccc

SEQ ID NO: 1185280 - RNA, 19 nt, Human
agcacgauuucuguuuaga

SEQ ID NO: 1185281 - RNA, 21 nt, Human
agcacgauuucuguuuagaua

SEQ ID NO: 1185282 - RNA, 14 nt, Human
agcacagacccugc

SEQ ID NO: 1185283 - RNA, 15 nt, Human
agcacagacccugcc

SEQ ID NO: 1185284 - RNA, 22 nt, Human
cagugguuccuaauccucuagg

SEQ ID NO: 1185285 - RNA, 12 nt, Human
caguggcagcug

SEQ ID NO: 1185286 - RNA, 13 nt, Human
caguggcagcugc

SEQ ID NO: 1185287 - RNA, 14 nt, Human
caguggcagcugcu

SEQ ID NO: 1185288 - RNA, 15 nt, Human
caguggcagcugcuu

SEQ ID NO: 1185289 - RNA, 16 nt, Human
caguggcagcugcuuu

SEQ ID NO: 1185290 - RNA, 16 nt, Human
caguguacauggaaua

SEQ ID NO: 1185291 - RNA, 20 nt, Human
caguguacauggaauaacau

SEQ ID NO: 1185292 - RNA, 23 nt, Human
caguguacauggaauaacaugua

SEQ ID NO: 1185293 - RNA, 14 nt, Human
cagugucaaugcag

SEQ ID NO: 1185294 - RNA, 14 nt, Human
cagugugacaagga

SEQ ID NO: 1185295 - RNA, 12 nt, Human
cagugugacuga

SEQ ID NO: 1185296 - RNA, 13 nt, Human
caguuaagagaaa

SEQ ID NO: 1185297 - RNA, 14 nt, Human
caguuaagagaaau

SEQ ID NO: 1185298 - RNA, 21 nt, Human
caguuaccucugccucagaaa

SEQ ID NO: 1185299 - RNA, 14 nt, Human
caguuacucagaau

SEQ ID NO: 1185300 - RNA, 19 nt, Human
caguguuguggauuuaaca

SEQ ID NO: 1185301 - RNA, 20 nt, Human
caguguuguggauuuaacag

SEQ ID NO: 1185302 - RNA, 22 nt, Human
caguguuguggauuuaacagaa

SEQ ID NO: 1185303 - RNA, 12 nt, Human
caguugaaaaac

SEQ ID NO: 1185304 - RNA, 18 nt, Human
caguugaaaaacagcuga

SEQ ID NO: 1185305 - RNA, 19 nt, Human
caguugaaaaacagcugag

SEQ ID NO: 1185306 - RNA, 22 nt, Human
caguucggugagcuacaaaugc

SEQ ID NO: 1185307 - RNA, 13 nt, Human
caguucucuccuu

SEQ ID NO: 1185308 - RNA, 14 nt, Human
caguucucuccuuc

SEQ ID NO: 1185309 - RNA, 15 nt, Human
caguucucuccuucu

SEQ ID NO: 1185310 - RNA, 22 nt, Human
caguucucuccuucuucccccc

SEQ ID NO: 1185311 - RNA, 12 nt, Human
caguucugaaga

SEQ ID NO: 1185312 - RNA, 13 nt, Human
caguucugaagaa

SEQ ID NO: 1185313 - RNA, 14 nt, Human
caguucugaagaag

SEQ ID NO: 1185314 - RNA, 15 nt, Human
caguucugaagaaga

SEQ ID NO: 1185315 - RNA, 16 nt, Human
caguucugaagaagau

SEQ ID NO: 1185316 - RNA, 22 nt, Human
caguucugaagaagaugguacc

SEQ ID NO: 1185317 - RNA, 19 nt, Human
cauaccacuuuuguucuug

SEQ ID NO: 1185318 - RNA, 11 nt, Human
cauacccaccc

SEQ ID NO: 1185319 - RNA, 12 nt, Human
cauacccacccc

SEQ ID NO: 1185320 - RNA, 13 nt, Human
cauaccacuuuug

SEQ ID NO: 1185321 - RNA, 14 nt, Human
cauaccacuuuugu

SEQ ID NO: 1185322 - RNA, 15 nt, Human
cauaccacuuuuguu

SEQ ID NO: 1185323 - RNA, 18 nt, Human
cauaccacuuuuguucuu

SEQ ID NO: 1185324 - RNA, 14 nt, Human
cauaagauaaaugu

SEQ ID NO: 1185325 - RNA, 21 nt, Human
cauaaaaauuagccaagugug

SEQ ID NO: 1185326 - RNA, 20 nt, Human
cauaaacaagaccacguuuc

SEQ ID NO: 1185327 - RNA, 21 nt, Human
cauaaacaagaccacguuucu

SEQ ID NO: 1185328 - RNA, 22 nt, Human
cauaaacaagaccacguuucua

SEQ ID NO: 1185329 - RNA, 16 nt, Human
cauaaccuagccuuag

SEQ ID NO: 1185330 - RNA, 23 nt, Human
caguugccagucaccccggccac

SEQ ID NO: 1185331 - RNA, 16 nt, Human
caguuggguggaugcc

SEQ ID NO: 1185332 - RNA, 18 nt, Human
caguuggguggaugccug

SEQ ID NO: 1185333 - RNA, 19 nt, Human
caguuggguggaugccugg

SEQ ID NO: 1185334 - RNA, 18 nt, Human
caguuggucccccuucca

SEQ ID NO: 1185335 - RNA, 19 nt, Human
caguuggucccccuuccau

SEQ ID NO: 1185336 - RNA, 20 nt, Human
caguuggucccccuuccaug

SEQ ID NO: 1185337 - RNA, 21 nt, Human
caguuggucccccuuccaugg

SEQ ID NO: 1185338 - RNA, 22 nt, Human
caguuggucccccuuccaugga

SEQ ID NO: 1185339 - RNA, 17 nt, Human
caguuguuagugugucu

SEQ ID NO: 1185340 - RNA, 18 nt, Human
caguuguuagugugucuu

SEQ ID NO: 1185341 - RNA, 15 nt, Human
cauacucccaucugu

SEQ ID NO: 1185342 - RNA, 14 nt, Human
cauacccaccccca

SEQ ID NO: 1185343 - RNA, 17 nt, Human
cauacccacccccaccc

SEQ ID NO: 1185344 - RNA, 18 nt, Human
cauacccacccccaccca

SEQ ID NO: 1185345 - RNA, 21 nt, Human
cauacccacccccacccaagg

SEQ ID NO: 1185346 - RNA, 13 nt, Human
cauacguacacau

SEQ ID NO: 1185347 - RNA, 15 nt, Human
cauacguacacauuu

SEQ ID NO: 1185348 - RNA, 16 nt, Human
cauacguacacauuuu

SEQ ID NO: 1185349 - RNA, 17 nt, Human
cauacguacacauuuua

SEQ ID NO: 1185350 - RNA, 18 nt, Human
cauacguacacauuuuau

SEQ ID NO: 1185351 - RNA, 14 nt, Human
cauacuaaccagca

SEQ ID NO: 1185352 - RNA, 21 nt, Human
cauacuaaccagcagaaaugc

SEQ ID NO: 1185353 - RNA, 15 nt, Human
cauccagguucagcu

SEQ ID NO: 1185354 - RNA, 17 nt, Human
cauccagguucagcuug

SEQ ID NO: 1185355 - RNA, 19 nt, Human
caucccucuggggcuguuc

SEQ ID NO: 1185356 - RNA, 11 nt, Human
caucccugaag

SEQ ID NO: 1185357 - RNA, 13 nt, Human
caucccugaaggc

SEQ ID NO: 1185358 - RNA, 15 nt, Human
caucaccaacgucug

SEQ ID NO: 1185359 - RNA, 20 nt, Human
caucaccaacgucugugcca

SEQ ID NO: 1185360 - RNA, 13 nt, Human
caucauugaaauc

SEQ ID NO: 1185361 - RNA, 14 nt, Human
caucauugaaaucu

SEQ ID NO: 1185362 - RNA, 15 nt, Human
caucauugaaaucuu

SEQ ID NO: 1185363 - RNA, 20 nt, Human
caucauugaaaucuuuuugc

SEQ ID NO: 1185364 - RNA, 21 nt, Human
caucauugaaaucuuuuugcu

SEQ ID NO: 1185365 - RNA, 22 nt, Human
caucccugaaggccccgcccag

SEQ ID NO: 1185366 - RNA, 17 nt, Human
caucccugaaggccccg

SEQ ID NO: 1185367 - RNA, 18 nt, Human
caucccugaaggccccgc

SEQ ID NO: 1185368 - RNA, 19 nt, Human
caucccugaaggccccgcc

SEQ ID NO: 1185369 - RNA, 21 nt, Human
caucccugaaggccccgccca

SEQ ID NO: 1185370 - RNA, 15 nt, Human
cauccucauacccac

SEQ ID NO: 1185371 - RNA, 16 nt, Human
cauccucauacccacc

SEQ ID NO: 1185372 - RNA, 11 nt, Human
cauccuccuca

SEQ ID NO: 1185373 - RNA, 12 nt, Human
cauccuccucag

SEQ ID NO: 1185374 - RNA, 15 nt, Human
cauccuccucagauc

SEQ ID NO: 1185375 - RNA, 16 nt, Human
cauccuccucagaucu

SEQ ID NO: 1185376 - RNA, 18 nt, Human
cauccuccucagaucuuc

SEQ ID NO: 1185377 - RNA, 19 nt, Human
cauccuccucagaucuucu

SEQ ID NO: 1185378 - RNA, 17 nt, Human
cauccucauacccaccc

SEQ ID NO: 1185379 - RNA, 18 nt, Human
cauccucauacccacccc

SEQ ID NO: 1185380 - RNA, 21 nt, Human
cauccucauacccacccccac

SEQ ID NO: 1185381 - RNA, 22 nt, Human
cauccucauacccacccccacc

SEQ ID NO: 1185382 - RNA, 13 nt, Human
cauccucccaagg

SEQ ID NO: 1185383 - RNA, 20 nt, Human
caucucacacaugagcauca

SEQ ID NO: 1185384 - RNA, 16 nt, Human
caucucaccuccugcu

SEQ ID NO: 1185385 - RNA, 17 nt, Human
caucucaccuccugcug

SEQ ID NO: 1185386 - RNA, 18 nt, Human
caucucaccuccugcugg

SEQ ID NO: 1185387 - RNA, 22 nt, Human
caucuagugagcagucaggaaa

SEQ ID NO: 1185388 - RNA, 16 nt, Human
caucucacacaugagc

SEQ ID NO: 1185389 - RNA, 17 nt, Human
caucucacacaugagca

SEQ ID NO: 1185390 - RNA, 15 nt, Human
cauccucuguacaga

SEQ ID NO: 1185391 - RNA, 18 nt, Human
cauccucuguacagagcc

SEQ ID NO: 1185392 - RNA, 19 nt, Human
cauccucuguacagagccc

SEQ ID NO: 1185393 - RNA, 21 nt, Human
cauccucuguacagagcccac

SEQ ID NO: 1185394 - RNA, 15 nt, Human
caucuacccuccgau

SEQ ID NO: 1185395 - RNA, 14 nt, Human
caucuagugagcag

SEQ ID NO: 1185396 - RNA, 22 nt, Human
caucuuccaaggguacuaagga

SEQ ID NO: 1185397 - RNA, 13 nt, Human
caucuugcucugc

SEQ ID NO: 1185398 - RNA, 14 nt, Human
caucuugcucugcu

SEQ ID NO: 1185399 - RNA, 15 nt, Human
caucuugcucugcug

SEQ ID NO: 1185400 - RNA, 20 nt, Human
caucuugcucugcugacaga

SEQ ID NO: 1185401 - RNA, 22 nt, Human
caucaagucuuucacauuuaaa

SEQ ID NO: 1185402 - RNA, 14 nt, Human
caucaagaugugac

SEQ ID NO: 1185403 - RNA, 18 nt, Human
caucaaugaaugaaugaa

SEQ ID NO: 1185404 - RNA, 13 nt, Human
cauaugccugggc

SEQ ID NO: 1185405 - RNA, 14 nt, Human
cauauuuacuucuu

SEQ ID NO: 1185406 - RNA, 16 nt, Human
cauauuuacuucuuau

SEQ ID NO: 1185407 - RNA, 17 nt, Human
cauauuuacuucuuaua

SEQ ID NO: 1185408 - RNA, 20 nt, Human
cauauuuacuucuuauacau

SEQ ID NO: 1185409 - RNA, 22 nt, Human
cauaguggcuuaaaacaacacu

SEQ ID NO: 1185410 - RNA, 20 nt, Human
cauaguaugguggcuggguu

SEQ ID NO: 1185411 - RNA, 18 nt, Human
cauaguaugguggcuggg

SEQ ID NO: 1185412 - RNA, 19 nt, Human
cauaguaugguggcugggu

SEQ ID NO: 1185413 - RNA, 22 nt, Human
cauauauauguuuuaagaggca

SEQ ID NO: 1185414 - RNA, 23 nt, Human
cauauauauguuuuaagaggcag

SEQ ID NO: 1185415 - RNA, 23 nt, Human
cauagagagcaagacgcugugcu

SEQ ID NO: 1185416 - RNA, 19 nt, Human
cauagagagcaagacgcug

SEQ ID NO: 1185417 - RNA, 21 nt, Human
cauagagagcaagacgcugug

SEQ ID NO: 1185418 - RNA, 16 nt, Human
cauacucccaucugug

SEQ ID NO: 1185419 - RNA, 18 nt, Human
cauacucccaucugugaa

SEQ ID NO: 1185420 - RNA, 20 nt, Human
cauacucccaucugugaaag

SEQ ID NO: 1185421 - RNA, 11 nt, Human
cauacucugcu

SEQ ID NO: 1185422 - RNA, 18 nt, Human
cauguaauuaaguacuau

SEQ ID NO: 1185423 - RNA, 21 nt, Human
cauguaauuaaguacuaugua

SEQ ID NO: 1185424 - RNA, 14 nt, Human
caugucuuuucuug

SEQ ID NO: 1185425 - RNA, 19 nt, Human
caugucuuuucuugcauga

SEQ ID NO: 1185426 - RNA, 21 nt, Human
caugucuuuucuugcaugagg

SEQ ID NO: 1185427 - RNA, 23 nt, Human
caugucuuuucuugcaugaggcu

SEQ ID NO: 1185428 - RNA, 16 nt, Human
cauggucggaaaacau

SEQ ID NO: 1185429 - RNA, 21 nt, Human
caugugccagguuuuuggucu

SEQ ID NO: 1185430 - RNA, 22 nt, Human
caugugccagguuuuuggucug

SEQ ID NO: 1185431 - RNA, 23 nt, Human
cauguuugauguaucugagcagg

SEQ ID NO: 1185432 - RNA, 15 nt, Human
cauguuuuguuuacg

SEQ ID NO: 1185433 - RNA, 18 nt, Human
cauguuuuucuucucccu

SEQ ID NO: 1185434 - RNA, 11 nt, Human
caugcauacac

SEQ ID NO: 1185435 - RNA, 12 nt, Human
caugcauacaca

SEQ ID NO: 1185436 - RNA, 13 nt, Human
caugcauacacac

SEQ ID NO: 1185437 - RNA, 14 nt, Human
caugcauacacaca

SEQ ID NO: 1185438 - RNA, 15 nt, Human
caugcauacacacac

SEQ ID NO: 1185439 - RNA, 16 nt, Human
caugcauacacacaca

SEQ ID NO: 1185440 - RNA, 23 nt, Human
caugcauacacacacacacacag

SEQ ID NO: 1185441 - RNA, 19 nt, Human
caugccagcuuaucucagg

SEQ ID NO: 1185442 - RNA, 20 nt, Human
caugccagcuuaucucaggg

SEQ ID NO: 1185443 - RNA, 13 nt, Human
caugccccugaac

SEQ ID NO: 1185444 - RNA, 14 nt, Human
caugccucucucag

SEQ ID NO: 1185445 - RNA, 15 nt, Human
caugccucucucagg

SEQ ID NO: 1185446 - RNA, 16 nt, Human
caugccucucucaggc

SEQ ID NO: 1185447 - RNA, 17 nt, Human
caugccucucucaggcc

SEQ ID NO: 1185448 - RNA, 18 nt, Human
caugccucucucaggcca

SEQ ID NO: 1185449 - RNA, 19 nt, Human
caugccucucucaggccaa

SEQ ID NO: 1185450 - RNA, 13 nt, Human
caugccuggaugg

SEQ ID NO: 1185451 - RNA, 18 nt, Human
caugccuggauggggcug

SEQ ID NO: 1185452 - RNA, 21 nt, Human
caugccuggauggggcugcac

SEQ ID NO: 1185453 - RNA, 23 nt, Human
caugccuggauggggcugcaccg

SEQ ID NO: 1185454 - RNA, 22 nt, Human
caugcugucccuuacgugaguc

SEQ ID NO: 1185455 - RNA, 23 nt, Human
caugcugucuacacuaagagaga

SEQ ID NO: 1185456 - RNA, 20 nt, Human
cauggaaguacuauaauuua

SEQ ID NO: 1185457 - RNA, 22 nt, Human
cauggaaguacuauaauuuacc

SEQ ID NO: 1185458 - RNA, 16 nt, Human
cauggaauaacaugua

SEQ ID NO: 1185459 - RNA, 18 nt, Human
cauggacaugaucuucuu

SEQ ID NO: 1185460 - RNA, 11 nt, Human
cauggacuuug

SEQ ID NO: 1185461 - RNA, 13 nt, Human
cauggacuuuguu

SEQ ID NO: 1185462 - RNA, 17 nt, Human
cauggagguuugaagau

SEQ ID NO: 1185463 - RNA, 16 nt, Human
cauggaguauauguca

SEQ ID NO: 1185464 - RNA, 18 nt, Human
caugggaaugaaugucag

SEQ ID NO: 1185465 - RNA, 22 nt, Human
caugggaaugaaugucagugug

SEQ ID NO: 1185466 - RNA, 17 nt, Human
caugggacagggaggac

SEQ ID NO: 1185467 - RNA, 23 nt, Human
caugggacagggaggacgcucuc

SEQ ID NO: 1185468 - RNA, 15 nt, Human
caugggccuccugug

SEQ ID NO: 1185469 - RNA, 16 nt, Human
caugggccuccugugu

SEQ ID NO: 1185470 - RNA, 17 nt, Human
caugggccuccugugug

SEQ ID NO: 1185471 - RNA, 18 nt, Human
caugggccuccugugugu

SEQ ID NO: 1185472 - RNA, 17 nt, Human
cauggucggaaaacaug

SEQ ID NO: 1185473 - RNA, 15 nt, Human
ccaacccucaucacc

SEQ ID NO: 1185474 - RNA, 15 nt, Human
ccaagaccuucuccu

SEQ ID NO: 1185475 - RNA, 15 nt, Human
ccaaauucuuucagu

SEQ ID NO: 1185476 - RNA, 22 nt, Human
ccaaauucuuucaguggcuacc

SEQ ID NO: 1185477 - RNA, 19 nt, Human
ccaaagcagugcaugcugu

SEQ ID NO: 1185478 - RNA, 14 nt, Human
ccaacauacuccca

SEQ ID NO: 1185479 - RNA, 16 nt, Human
ccaacauacucccauc

SEQ ID NO: 1185480 - RNA, 16 nt, Human
ccaacaucaacaucuu

SEQ ID NO: 1185481 - RNA, 13 nt, Human
ccaaagaugcagc

SEQ ID NO: 1185482 - RNA, 14 nt, Human
ccaaagaugcagcc

SEQ ID NO: 1185483 - RNA, 14 nt, Human
ccaagcaggacaug

SEQ ID NO: 1185484 - RNA, 12 nt, Human
ccaagcucccag

SEQ ID NO: 1185485 - RNA, 13 nt, Human
ccaagcucccagg

SEQ ID NO: 1185486 - RNA, 14 nt, Human
ccaagcucccaggc

SEQ ID NO: 1185487 - RNA, 18 nt, Human
ccaaggcuagaaccaccu

SEQ ID NO: 1185488 - RNA, 19 nt, Human
ccaaggcugauuaaaccaa

SEQ ID NO: 1185489 - RNA, 14 nt, Human
ccaaggcuggggga

SEQ ID NO: 1185490 - RNA, 20 nt, Human
ccaauauucauagcagcuua

SEQ ID NO: 1185491 - RNA, 18 nt, Human
ccacaaaggagagcuagc

SEQ ID NO: 1185492 - RNA, 16 nt, Human
ccacaagaaaugaaag

SEQ ID NO: 1185493 - RNA, 22 nt, Human
ccacaagaaaugaaagcaggga

SEQ ID NO: 1185494 - RNA, 16 nt, Human
ccacaagacccuugug

SEQ ID NO: 1185495 - RNA, 13 nt, Human
ccacaagagccca

SEQ ID NO: 1185496 - RNA, 16 nt, Human
ccacaagagcccaggc

SEQ ID NO: 1185497 - RNA, 17 nt, Human
ccacaagagcccaggcc

SEQ ID NO: 1185498 - RNA, 18 nt, Human
ccacaagagcccaggccu

SEQ ID NO: 1185499 - RNA, 19 nt, Human
ccacaagagcccaggccuc

SEQ ID NO: 1185500 - RNA, 20 nt, Human
ccacaagagcccaggccucc

SEQ ID NO: 1185501 - RNA, 21 nt, Human
ccacaagagcccaggccuccu

SEQ ID NO: 1185502 - RNA, 15 nt, Human
ccacaaguuaaauaa

SEQ ID NO: 1185503 - RNA, 20 nt, Human
ccacaaguuaaauaaaucau

SEQ ID NO: 1185504 - RNA, 11 nt, Human
ccacacacaca

SEQ ID NO: 1185505 - RNA, 13 nt, Human
ccacacacacaca

SEQ ID NO: 1185506 - RNA, 14 nt, Human
ccacacacacacac

SEQ ID NO: 1185507 - RNA, 15 nt, Human
ccacacacacacaca

SEQ ID NO: 1185508 - RNA, 17 nt, Human
ccacacacacacacaug

SEQ ID NO: 1185509 - RNA, 21 nt, Human
ccacacacacacacaugcaua

SEQ ID NO: 1185510 - RNA, 24 nt, Human
ccacacacacacacaugcauacac

SEQ ID NO: 1185511 - RNA, 12 nt, Human
ccacacacacag

SEQ ID NO: 1185512 - RNA, 17 nt, Human
ccacacacacagaaaau

SEQ ID NO: 1185513 - RNA, 19 nt, Human
cauuuuauuuuauuaugca

SEQ ID NO: 1185514 - RNA, 21 nt, Human
cauuuuauuuuauuaugcaug

SEQ ID NO: 1185515 - RNA, 22 nt, Human
cauuuuauuuuauuaugcauga

SEQ ID NO: 1185516 - RNA, 15 nt, Human
cauuugcucauggaa

SEQ ID NO: 1185517 - RNA, 16 nt, Human
cauuugcucauggaau

SEQ ID NO: 1185518 - RNA, 22 nt, Human
cauuugaggucuguucuuucca

SEQ ID NO: 1185519 - RNA, 18 nt, Human
cauuugcucauggaauug

SEQ ID NO: 1185520 - RNA, 18 nt, Human
cauuuugcuaaaugugaa

SEQ ID NO: 1185521 - RNA, 21 nt, Human
cauuuugcuaaaugugaauga

SEQ ID NO: 1185522 - RNA, 24 nt, Human
cauuuugcuaaaugugaaugauga

SEQ ID NO: 1185523 - RNA, 20 nt, Human
cauuuugggguacccacugc

SEQ ID NO: 1185524 - RNA, 21 nt, Human
cauuuugggguacccacugcu

SEQ ID NO: 1185525 - RNA, 22 nt, Human
cauuuugggguacccacugcuc

SEQ ID NO: 1185526 - RNA, 23 nt, Human
cauuuugggguacccacugcucu

SEQ ID NO: 1185527 - RNA, 15 nt, Human
cauuuuuaagugcug

SEQ ID NO: 1185528 - RNA, 20 nt, Human
cauuuuuaagugcugcauuu

SEQ ID NO: 1185529 - RNA, 21 nt, Human
cauuuuuaagugcugcauuua

SEQ ID NO: 1185530 - RNA, 19 nt, Human
cauuuuuaguagagacagg

SEQ ID NO: 1185531 - RNA, 20 nt, Human
cauuuuuaguagagacaggg

SEQ ID NO: 1185532 - RNA, 18 nt, Human
ccaaaauaaaacuuuuua

SEQ ID NO: 1185533 - RNA, 21 nt, Human
ccaaaauaaaacuuuuuaaaa

SEQ ID NO: 1185534 - RNA, 17 nt, Human
ccaaacucaccugcccc

SEQ ID NO: 1185535 - RNA, 23 nt, Human
cauuucuuccacaagagcccagg

SEQ ID NO: 1185536 - RNA, 14 nt, Human
cauuugagcagggc

SEQ ID NO: 1185537 - RNA, 16 nt, Human
cauuugagcagggcuc

SEQ ID NO: 1185538 - RNA, 17 nt, Human
cauuugaggucuguucu

SEQ ID NO: 1185539 - RNA, 18 nt, Human
cauuugaggucuguucuu

SEQ ID NO: 1185540 - RNA, 19 nt, Human
cauuugaggucuguucuuu

SEQ ID NO: 1185541 - RNA, 17 nt, Human
cauuuacuuuguguuca

SEQ ID NO: 1185542 - RNA, 21 nt, Human
cauuuacuuuguguucaccuu

SEQ ID NO: 1185543 - RNA, 21 nt, Human
cauuucuuccacaagagccca

SEQ ID NO: 1185544 - RNA, 19 nt, Human
cauugaaaucuuuuugcuu

SEQ ID NO: 1185545 - RNA, 13 nt, Human
cauugaccugagg

SEQ ID NO: 1185546 - RNA, 22 nt, Human
cauugaccugaggcccuucucu

SEQ ID NO: 1185547 - RNA, 14 nt, Human
cauugaccugaggc

SEQ ID NO: 1185548 - RNA, 20 nt, Human
ccagcugcuugggcuucauc

SEQ ID NO: 1185549 - RNA, 16 nt, Human
ccagcugcuugggcuu

SEQ ID NO: 1185550 - RNA, 18 nt, Human
ccagcugcuugggcuuca

SEQ ID NO: 1185551 - RNA, 15 nt, Human
ccagcugcuugggcu

SEQ ID NO: 1185552 - RNA, 18 nt, Human
ccagcugugcucuggaca

SEQ ID NO: 1185553 - RNA, 20 nt, Human
ccagcugugcucuggacagg

SEQ ID NO: 1185554 - RNA, 21 nt, Human
ccagcugugcucuggacaggc

SEQ ID NO: 1185555 - RNA, 19 nt, Human
ccagccugagcgacaguga

SEQ ID NO: 1185556 - RNA, 13 nt, Human
ccacacacacaga

SEQ ID NO: 1185557 - RNA, 14 nt, Human
ccacacacacagaa

SEQ ID NO: 1185558 - RNA, 15 nt, Human
ccacacacacagaaa

SEQ ID NO: 1185559 - RNA, 16 nt, Human
ccacacacacagaaaa

SEQ ID NO: 1185560 - RNA, 22 nt, Human
ccagcugugcucuggacaggca

SEQ ID NO: 1185561 - RNA, 23 nt, Human
ccagcugugcucuggacaggcau

SEQ ID NO: 1185562 - RNA, 16 nt, Human
ccagcuguucagcugg

SEQ ID NO: 1185563 - RNA, 15 nt, Human
ccaggaagccagcag

SEQ ID NO: 1185564 - RNA, 17 nt, Human
ccaggaagccagcaggc

SEQ ID NO: 1185565 - RNA, 19 nt, Human
ccaggaagccagcaggcuc

SEQ ID NO: 1185566 - RNA, 20 nt, Human
ccaggaagccagcaggcucu

SEQ ID NO: 1185567 - RNA, 12 nt, Human
ccaggagcagcc

SEQ ID NO: 1185568 - RNA, 13 nt, Human
ccaggagcagcca

SEQ ID NO: 1185569 - RNA, 14 nt, Human
ccaggagcagccac

SEQ ID NO: 1185570 - RNA, 15 nt, Human
ccaggagcagccaca

SEQ ID NO: 1185571 - RNA, 14 nt, Human
ccaggccagaggga

SEQ ID NO: 1185572 - RNA, 21 nt, Human
ccaggccagagggagugacag

SEQ ID NO: 1185573 - RNA, 21 nt, Human
ccaggccccugccacccuggg

SEQ ID NO: 1185574 - RNA, 23 nt, Human
ccaggccccugccacccugggga

SEQ ID NO: 1185575 - RNA, 17 nt, Human
ccaggcccucugcccac

SEQ ID NO: 1185576 - RNA, 18 nt, Human
ccaggcccucugcccacu

SEQ ID NO: 1185577 - RNA, 19 nt, Human
ccaggcccucugcccacuc

SEQ ID NO: 1185578 - RNA, 20 nt, Human
ccaggcccucugcccacucc

SEQ ID NO: 1185579 - RNA, 13 nt, Human
ccaggccuccuac

SEQ ID NO: 1185580 - RNA, 18 nt, Human
ccaggccuccuacagcuu

SEQ ID NO: 1185581 - RNA, 19 nt, Human
ccaggccuccuacagcuug

SEQ ID NO: 1185582 - RNA, 14 nt, Human
ccagggacagaggg

SEQ ID NO: 1185583 - RNA, 23 nt, Human
ccagggacagaggggguggccuc

SEQ ID NO: 1185584 - RNA, 19 nt, Human
ccaucucaccuccugcugg

SEQ ID NO: 1185585 - RNA, 21 nt, Human
ccaucucaccuccugcugggc

SEQ ID NO: 1185586 - RNA, 23 nt, Human
ccaucucaccuccugcugggcag

SEQ ID NO: 1185587 - RNA, 16 nt, Human
ccaucaugucuggcua

SEQ ID NO: 1185588 - RNA, 21 nt, Human
ccauccucuguacagagccca

SEQ ID NO: 1185589 - RNA, 15 nt, Human
ccauccugaggcucc

SEQ ID NO: 1185590 - RNA, 16 nt, Human
ccauccugaggcucca

SEQ ID NO: 1185591 - RNA, 22 nt, Human
ccagugguuccuaauccucuag

SEQ ID NO: 1185592 - RNA, 23 nt, Human
ccauagagagcaagacgcugugc

SEQ ID NO: 1185593 - RNA, 15 nt, Human
ccauauucuguuggc

SEQ ID NO: 1185594 - RNA, 18 nt, Human
ccauauucuguuggccag

SEQ ID NO: 1185595 - RNA, 19 nt, Human
ccauauucuguuggccagu

SEQ ID NO: 1185596 - RNA, 12 nt, Human
ccaucaagccac

SEQ ID NO: 1185597 - RNA, 12 nt, Human
ccaucacccgcu

SEQ ID NO: 1185598 - RNA, 16 nt, Human
ccaugcugcccuguga

SEQ ID NO: 1185599 - RNA, 17 nt, Human
ccaugcugcccugugag

SEQ ID NO: 1185600 - RNA, 15 nt, Human
ccaugcuccuggccc

SEQ ID NO: 1185601 - RNA, 18 nt, Human
ccaugcuccuggcccacu

SEQ ID NO: 1185602 - RNA, 23 nt, Human
ccauggcacucuauguucuaaga

SEQ ID NO: 1185603 - RNA, 13 nt, Human
ccaugugccaggu

SEQ ID NO: 1185604 - RNA, 13 nt, Human
ccauguuggccag

SEQ ID NO: 1185605 - RNA, 14 nt, Human
ccauguuggccagg

SEQ ID NO: 1185606 - RNA, 16 nt, Human
ccauguuggccaggcu

SEQ ID NO: 1185607 - RNA, 15 nt, Human
ccauguuggccaggc

SEQ ID NO: 1185608 - RNA, 19 nt, Human
ccauguuggccaggcuggu

SEQ ID NO: 1185609 - RNA, 21 nt, Human
ccauguuggccaggcuggucu

SEQ ID NO: 1185610 - RNA, 12 nt, Human
cccaccuggccu

SEQ ID NO: 1185611 - RNA, 15 nt, Human
cccaccuggccucug

SEQ ID NO: 1185612 - RNA, 16 nt, Human
cccaccuggccucugc

SEQ ID NO: 1185613 - RNA, 17 nt, Human
cccaccuuggcugcagg

SEQ ID NO: 1185614 - RNA, 19 nt, Human
cccaccuuggcugcaggga

SEQ ID NO: 1185615 - RNA, 20 nt, Human
cccaccuuggcugcagggag

SEQ ID NO: 1185616 - RNA, 13 nt, Human
cccacgcccccac

SEQ ID NO: 1185617 - RNA, 14 nt, Human
cccacgcccccacu

SEQ ID NO: 1185618 - RNA, 15 nt, Human
cccacgcccccacug

SEQ ID NO: 1185619 - RNA, 16 nt, Human
cccagcaagugagagc

SEQ ID NO: 1185620 - RNA, 17 nt, Human
cccagccccaaugaaca

SEQ ID NO: 1185621 - RNA, 11 nt, Human
cccagccccau

SEQ ID NO: 1185622 - RNA, 12 nt, Human
cccagccccauc

SEQ ID NO: 1185623 - RNA, 18 nt, Human
cccagccccauccucugu

SEQ ID NO: 1185624 - RNA, 19 nt, Human
cccagccccauccucugua

SEQ ID NO: 1185625 - RNA, 13 nt, Human
cccagccccaucc

SEQ ID NO: 1185626 - RNA, 14 nt, Human
cccagccccauccc

SEQ ID NO: 1185627 - RNA, 14 nt, Human
cccagccccauccu

SEQ ID NO: 1185628 - RNA, 15 nt, Human
cccagccccauccuc

SEQ ID NO: 1185629 - RNA, 14 nt, Human
cccagcgagcccug

SEQ ID NO: 1185630 - RNA, 15 nt, Human
cccagcgagcccugg

SEQ ID NO: 1185631 - RNA, 12 nt, Human
cccagcucuggu

SEQ ID NO: 1185632 - RNA, 13 nt, Human
cccagcucugguc

SEQ ID NO: 1185633 - RNA, 14 nt, Human
cccagcucuggucc

SEQ ID NO: 1185634 - RNA, 15 nt, Human
cccagcucuggucca

SEQ ID NO: 1185635 - RNA, 16 nt, Human
cccagcucugguccau

SEQ ID NO: 1185636 - RNA, 18 nt, Human
cccagcucugguccauag

SEQ ID NO: 1185637 - RNA, 13 nt, Human
cccaggagccccg

SEQ ID NO: 1185638 - RNA, 14 nt, Human
cccaggagccccga

SEQ ID NO: 1185639 - RNA, 18 nt, Human
cccaggagccccgaggcc

SEQ ID NO: 1185640 - RNA, 14 nt, Human
cccaggaggccagc

SEQ ID NO: 1185641 - RNA, 18 nt, Human
cccaggaggccagccuug

SEQ ID NO: 1185642 - RNA, 17 nt, Human
cccaggcauuccccagg

SEQ ID NO: 1185643 - RNA, 18 nt, Human
cccaggcauuccccagga

SEQ ID NO: 1185644 - RNA, 15 nt, Human
cccaggaggccagcc

SEQ ID NO: 1185645 - RNA, 16 nt, Human
cccaggaggccagccu

SEQ ID NO: 1185646 - RNA, 23 nt, Human
cccaggcaggucuugaacuccug

SEQ ID NO: 1185647 - RNA, 15 nt, Human
cccaggcauucccca

SEQ ID NO: 1185648 - RNA, 10 nt, Human
cccagucugg

SEQ ID NO: 1185649 - RNA, 18 nt, Human
cccagucuggaaugcagu

SEQ ID NO: 1185650 - RNA, 19 nt, Human
cccagucuggaaugcagug

SEQ ID NO: 1185651 - RNA, 15 nt, Human
cccagugccgagaag

SEQ ID NO: 1185652 - RNA, 17 nt, Human
cccagugccgagaagga

SEQ ID NO: 1185653 - RNA, 20 nt, Human
cccagugguuccuaauccuc

SEQ ID NO: 1185654 - RNA, 14 nt, Human
cccaguuagcucuc

SEQ ID NO: 1185655 - RNA, 21 nt, Human
ccccaaauggaaaugggcaga

SEQ ID NO: 1185656 - RNA, 13 nt, Human
cccaucucacaca

SEQ ID NO: 1185657 - RNA, 18 nt, Human
cccaucucacacaugagc

SEQ ID NO: 1185658 - RNA, 20 nt, Human
cccaucugugaaaggaaaga

SEQ ID NO: 1185659 - RNA, 16 nt, Human
cccaugagccucagca

SEQ ID NO: 1185660 - RNA, 20 nt, Human
cccaugagccucagcauccu

SEQ ID NO: 1185661 - RNA, 12 nt, Human
cccaugcugccc

SEQ ID NO: 1185662 - RNA, 13 nt, Human
cccaugcugcccu

SEQ ID NO: 1185663 - RNA, 14 nt, Human
cccaugcugcccug

SEQ ID NO: 1185664 - RNA, 22 nt, Human
cccaugagccucagcauccugg

SEQ ID NO: 1185665 - RNA, 13 nt, Human
ccccaggaggcca

SEQ ID NO: 1185666 - RNA, 15 nt, Human
ccccagccccauccu

SEQ ID NO: 1185667 - RNA, 13 nt, Human
ccccagccugcua

SEQ ID NO: 1185668 - RNA, 12 nt, Human
ccccaggaggcc

SEQ ID NO: 1185669 - RNA, 22 nt, Human
ccccaggugguuauggagaggg

SEQ ID NO: 1185670 - RNA, 12 nt, Human
ccccuggcagcc

SEQ ID NO: 1185671 - RNA, 14 nt, Human
ccccuggcagcccc

SEQ ID NO: 1185672 - RNA, 15 nt, Human
ccccuggcagccccu

SEQ ID NO: 1185673 - RNA, 22 nt, Human
ccccuguccccgcacugggcuu

SEQ ID NO: 1185674 - RNA, 22 nt, Human
cccgcuaagagggagggagggc

SEQ ID NO: 1185675 - RNA, 15 nt, Human
cccgaggccuucucu

SEQ ID NO: 1185676 - RNA, 20 nt, Human
cccgaggccuucucugaagg

SEQ ID NO: 1185677 - RNA, 21 nt, Human
cccgaggccuucucugaagga

SEQ ID NO: 1185678 - RNA, 16 nt, Human
cccggcaggguccuag

SEQ ID NO: 1185679 - RNA, 17 nt, Human
cccuaaaguguauuuuu

SEQ ID NO: 1185680 - RNA, 22 nt, Human
cccuaaaguguauuuuuuuacu

SEQ ID NO: 1185681 - RNA, 15 nt, Human
cccucagggucccug

SEQ ID NO: 1185682 - RNA, 16 nt, Human
cccucagggucccugg

SEQ ID NO: 1185683 - RNA, 17 nt, Human
cccucagggucccuggu

SEQ ID NO: 1185684 - RNA, 18 nt, Human
cccucagggucccuggug

SEQ ID NO: 1185685 - RNA, 19 nt, Human
cccucagggucccuggugg

SEQ ID NO: 1185686 - RNA, 21 nt, Human
cccucagggucccugguggca

SEQ ID NO: 1185687 - RNA, 20 nt, Human
cccucagucuggcccuuccu

SEQ ID NO: 1185688 - RNA, 22 nt, Human
cccucaucaccaacgucugugc

SEQ ID NO: 1185689 - RNA, 17 nt, Human
cccucauccucauaccc

SEQ ID NO: 1185690 - RNA, 20 nt, Human
cccucauccucauacccacc

SEQ ID NO: 1185691 - RNA, 21 nt, Human
cccuccaagaccuucuccuuc

SEQ ID NO: 1185692 - RNA, 22 nt, Human
cccucauccucauacccacccc

SEQ ID NO: 1185693 - RNA, 17 nt, Human
cccuccaugugggcuag

SEQ ID NO: 1185694 - RNA, 23 nt, Human
cccucccucuuucccucccuucc

SEQ ID NO: 1185695 - RNA, 13 nt, Human
cccucccucuuuc

SEQ ID NO: 1185696 - RNA, 14 nt, Human
cccugguggcagcu

SEQ ID NO: 1185697 - RNA, 19 nt, Human
cccugcugguucaggguug

SEQ ID NO: 1185698 - RNA, 20 nt, Human
cccugcugguucaggguugg

SEQ ID NO: 1185699 - RNA, 13 nt, Human
cccugcugguuca

SEQ ID NO: 1185700 - RNA, 22 nt, Human
cccugguggcagugggagcugc

SEQ ID NO: 1185701 - RNA, 22 nt, Human
cccugcaaccugauugugucuc

SEQ ID NO: 1185702 - RNA, 12 nt, Human
cccugcagaggg

SEQ ID NO: 1185703 - RNA, 18 nt, Human
cccugcagagggcacaga

SEQ ID NO: 1185704 - RNA, 20 nt, Human
cccugcagagggcacagaaa

SEQ ID NO: 1185705 - RNA, 12 nt, Human
cccugccacccu

SEQ ID NO: 1185706 - RNA, 14 nt, Human
cccugccacccugg

SEQ ID NO: 1185707 - RNA, 15 nt, Human
cccugccacccuggg

SEQ ID NO: 1185708 - RNA, 17 nt, Human
cccugccacccugggga

SEQ ID NO: 1185709 - RNA, 18 nt, Human
cccugccacccuggggag

SEQ ID NO: 1185710 - RNA, 13 nt, Human
cccugcccaccug

SEQ ID NO: 1185711 - RNA, 16 nt, Human
cccugccuccuuugug

SEQ ID NO: 1185712 - RNA, 23 nt, Human
cccugccuccuuugugaggaagc

SEQ ID NO: 1185713 - RNA, 12 nt, Human
cccuucccaccu

SEQ ID NO: 1185714 - RNA, 13 nt, Human
cccuucccaccuc

SEQ ID NO: 1185715 - RNA, 17 nt, Human
cccuuggauuguccccg

SEQ ID NO: 1185716 - RNA, 22 nt, Human
cccuugguuaggcauuguggga

SEQ ID NO: 1185717 - RNA, 23 nt, Human
cccuugguuaggcauugugggaa

SEQ ID NO: 1185718 - RNA, 22 nt, Human
cccuuguggucccaccccacac

SEQ ID NO: 1185719 - RNA, 17 nt, Human
ccgggaagggggcuggg

SEQ ID NO: 1185720 - RNA, 20 nt, Human
ccgggaagggggcugggaca

SEQ ID NO: 1185721 - RNA, 22 nt, Human
ccgggaggcagagguugcagug

SEQ ID NO: 1185722 - RNA, 21 nt, Human
ccuagaaauuccccacccuga

SEQ ID NO: 1185723 - RNA, 13 nt, Human
ccuaggugacaga

SEQ ID NO: 1185724 - RNA, 18 nt, Human
ccuacaggagugagcacu

SEQ ID NO: 1185725 - RNA, 13 nt, Human
ccuacccacccuc

SEQ ID NO: 1185726 - RNA, 18 nt, Human
ccuacccacccuccuuuc

SEQ ID NO: 1185727 - RNA, 19 nt, Human
ccuacuguaauuugugaua

SEQ ID NO: 1185728 - RNA, 13 nt, Human
ccuaaacauauga

SEQ ID NO: 1185729 - RNA, 16 nt, Human
ccuaaaauucagugga

SEQ ID NO: 1185730 - RNA, 19 nt, Human
ccuacagcuugaccgugag

SEQ ID NO: 1185731 - RNA, 22 nt, Human
ccuacaguugaaaaacagcuga

SEQ ID NO: 1185732 - RNA, 12 nt, Human
ccguuauuaaaa

SEQ ID NO: 1185733 - RNA, 16 nt, Human
ccucagaucuucugug

SEQ ID NO: 1185734 - RNA, 14 nt, Human
ccucagcauccugg

SEQ ID NO: 1185735 - RNA, 16 nt, Human
ccucagggucccuggu

SEQ ID NO: 1185736 - RNA, 17 nt, Human
ccucagggucccuggug

SEQ ID NO: 1185737 - RNA, 20 nt, Human
ccucagggucccugguggca

SEQ ID NO: 1185738 - RNA, 22 nt, Human
ccucagggucccugguggcagc

SEQ ID NO: 1185739 - RNA, 15 nt, Human
ccuaggugacagagu

SEQ ID NO: 1185740 - RNA, 18 nt, Human
ccuaggugacagagugag

SEQ ID NO: 1185741 - RNA, 16 nt, Human
ccuauuagagaagaga

SEQ ID NO: 1185742 - RNA, 17 nt, Human
ccuauuagagaagagau

SEQ ID NO: 1185743 - RNA, 24 nt, Human
ccucacaguccuuaccagcagagc

SEQ ID NO: 1185744 - RNA, 22 nt, Human
ccucaggugagaagcagaggaa

SEQ ID NO: 1185745 - RNA, 14 nt, Human
ccuccauccugagg

SEQ ID NO: 1185746 - RNA, 12 nt, Human
ccuccauccuga

SEQ ID NO: 1185747 - RNA, 13 nt, Human
ccuccauccugag

SEQ ID NO: 1185748 - RNA, 12 nt, Human
ccuccauguggg

SEQ ID NO: 1185749 - RNA, 15 nt, Human
ccuccaugugggcua

SEQ ID NO: 1185750 - RNA, 17 nt, Human
ccucccaaagugcuggg

SEQ ID NO: 1185751 - RNA, 14 nt, Human
ccucccaacucacc

SEQ ID NO: 1185752 - RNA, 11 nt, Human
ccuccaggugc

SEQ ID NO: 1185753 - RNA, 12 nt, Human
ccuccaggugca

SEQ ID NO: 1185754 - RNA, 17 nt, Human
ccuccaggugcacaagc

SEQ ID NO: 1185755 - RNA, 18 nt, Human
ccucaggugagaagcaga

SEQ ID NO: 1185756 - RNA, 20 nt, Human
ccucaggugagaagcagagg

SEQ ID NO: 1185757 - RNA, 12 nt, Human
ccucauacccac

SEQ ID NO: 1185758 - RNA, 18 nt, Human
ccucccgaauagcuggga

SEQ ID NO: 1185759 - RNA, 15 nt, Human
ccucccaacucaccc

SEQ ID NO: 1185760 - RNA, 19 nt, Human
ccucccgaauagcugggac

SEQ ID NO: 1185761 - RNA, 20 nt, Human
ccucccgaauagcugggacu

SEQ ID NO: 1185762 - RNA, 17 nt, Human
ccucccgaguagcuggg

SEQ ID NO: 1185763 - RNA, 18 nt, Human
ccucccgaguagcuggga

SEQ ID NO: 1185764 - RNA, 19 nt, Human
ccucccgaguagcugggac

SEQ ID NO: 1185765 - RNA, 13 nt, Human
ccucccucuuucc

SEQ ID NO: 1185766 - RNA, 11 nt, Human
ccuccucagau

SEQ ID NO: 1185767 - RNA, 12 nt, Human
ccuccuccagcc

SEQ ID NO: 1185768 - RNA, 14 nt, Human
ccuccucagaucuu

SEQ ID NO: 1185769 - RNA, 21 nt, Human
ccucccgaauagcugggacua

SEQ ID NO: 1185770 - RNA, 21 nt, Human
ccuccuccagccgccaugcuc

SEQ ID NO: 1185771 - RNA, 15 nt, Human
ccucuccccagcaag

SEQ ID NO: 1185772 - RNA, 20 nt, Human
ccucuccccagcaagugaga

SEQ ID NO: 1185773 - RNA, 13 nt, Human
ccucucccuugga

SEQ ID NO: 1185774 - RNA, 22 nt, Human
ccucucccuuggauuguccccg

SEQ ID NO: 1185775 - RNA, 11 nt, Human
ccucugcacaa

SEQ ID NO: 1185776 - RNA, 16 nt, Human
ccucugcacuccccug

SEQ ID NO: 1185777 - RNA, 17 nt, Human
ccucugcacuccccugc

SEQ ID NO: 1185778 - RNA, 18 nt, Human
ccucugcacuccccugcu

SEQ ID NO: 1185779 - RNA, 14 nt, Human
ccucugcagcaaua

SEQ ID NO: 1185780 - RNA, 18 nt, Human
ccucugcagcaauaaagc

SEQ ID NO: 1185781 - RNA, 19 nt, Human
ccucugcagcaauaaagca

SEQ ID NO: 1185782 - RNA, 19 nt, Human
ccucugcacuccccugcug

SEQ ID NO: 1185783 - RNA, 13 nt, Human
ccucugcccacuc

SEQ ID NO: 1185784 - RNA, 16 nt, Human
ccucugcccacucccu

SEQ ID NO: 1185785 - RNA, 13 nt, Human
ccucugacacaca

SEQ ID NO: 1185786 - RNA, 14 nt, Human
ccucugacacacag

SEQ ID NO: 1185787 - RNA, 15 nt, Human
ccucugacacacagc

SEQ ID NO: 1185788 - RNA, 19 nt, Human
ccucugacacacagcucug

SEQ ID NO: 1185789 - RNA, 20 nt, Human
ccucugacacacagcucugu

SEQ ID NO: 1185790 - RNA, 21 nt, Human
ccucugacacacagcucuguc

SEQ ID NO: 1185791 - RNA, 12 nt, Human
cgcccagucugg

SEQ ID NO: 1185792 - RNA, 22 nt, Human
cgcccaggcuuagucacugaga

SEQ ID NO: 1185793 - RNA, 17 nt, Human
ccucugcccacucccug

SEQ ID NO: 1185794 - RNA, 19 nt, Human
ccucugcccacucccugca

SEQ ID NO: 1185795 - RNA, 20 nt, Human
ccucugcccacucccugcaa

SEQ ID NO: 1185796 - RNA, 23 nt, Human
cgccaggggaaaaucagccugcu

SEQ ID NO: 1185797 - RNA, 14 nt, Human
cgccaucccagccc

SEQ ID NO: 1185798 - RNA, 16 nt, Human
cgccaucccagcccca

SEQ ID NO: 1185799 - RNA, 17 nt, Human
cgccaucccagccccaa

SEQ ID NO: 1185800 - RNA, 17 nt, Human
cgcuacccgggaagggg

SEQ ID NO: 1185801 - RNA, 16 nt, Human
cgcuacccgggaaggg

SEQ ID NO: 1185802 - RNA, 15 nt, Human
cgcucucuggccuuc

SEQ ID NO: 1185803 - RNA, 22 nt, Human
cgcuaagagggagggagggcuc

SEQ ID NO: 1185804 - RNA, 18 nt, Human
cgcucucuggccuucggc

SEQ ID NO: 1185805 - RNA, 22 nt, Human
cgcugucagccauuccuguucc

SEQ ID NO: 1185806 - RNA, 15 nt, Human
cgcugugcugcccug

SEQ ID NO: 1185807 - RNA, 16 nt, Human
cgcugugcugcccugc

SEQ ID NO: 1185808 - RNA, 17 nt, Human
cgcugugcugcccugcc

SEQ ID NO: 1185809 - RNA, 18 nt, Human
cgcugugcugcccugccc

SEQ ID NO: 1185810 - RNA, 15 nt, Human
cggaaaacaugcuac

SEQ ID NO: 1185811 - RNA, 20 nt, Human
cggaaaacaugcuacacacu

SEQ ID NO: 1185812 - RNA, 12 nt, Human
cggccuccaucc

SEQ ID NO: 1185813 - RNA, 14 nt, Human
cggccuccauccug

SEQ ID NO: 1185814 - RNA, 13 nt, Human
cggccccugcugg

SEQ ID NO: 1185815 - RNA, 18 nt, Human
cggccccugcugguucag

SEQ ID NO: 1185816 - RNA, 19 nt, Human
cggccccugcugguucagg

SEQ ID NO: 1185817 - RNA, 13 nt, Human
cggaagagccuug

SEQ ID NO: 1185818 - RNA, 14 nt, Human
cggaauaguuggcu

SEQ ID NO: 1185819 - RNA, 11 nt, Human
cggccaccugc

SEQ ID NO: 1185820 - RNA, 15 nt, Human
cggccaccugcggug

SEQ ID NO: 1185821 - RNA, 16 nt, Human
cggccaccugcggugc

SEQ ID NO: 1185822 - RNA, 17 nt, Human
cggccaccugcggugcu

SEQ ID NO: 1185823 - RNA, 14 nt, Human
cggcuggcagccca

SEQ ID NO: 1185824 - RNA, 22 nt, Human
cggcuggccuggccccucaggg

SEQ ID NO: 1185825 - RNA, 23 nt, Human
cggcuggccuggccccucagggu

SEQ ID NO: 1185826 - RNA, 18 nt, Human
cgggaggucgaggcagga

SEQ ID NO: 1185827 - RNA, 20 nt, Human
cgggaggucgaggcaggagg

SEQ ID NO: 1185828 - RNA, 14 nt, Human
cgggcacucagaag

SEQ ID NO: 1185829 - RNA, 22 nt, Human
cgggcacucagaagacacugau

SEQ ID NO: 1185830 - RNA, 23 nt, Human
cggggacagcuccuucuguccua

SEQ ID NO: 1185831 - RNA, 15 nt, Human
cgggggcagagaggg

SEQ ID NO: 1185832 - RNA, 14 nt, Human
cgguccacccagga

SEQ ID NO: 1185833 - RNA, 15 nt, Human
cgguccacccaggag

SEQ ID NO: 1185834 - RNA, 16 nt, Human
cgguccacccaggagc

SEQ ID NO: 1185835 - RNA, 20 nt, Human
cgguccacccaggagccccg

SEQ ID NO: 1185836 - RNA, 17 nt, Human
cggugagcuacaaaugc

SEQ ID NO: 1185837 - RNA, 20 nt, Human
cggugagaggggaacagacu

SEQ ID NO: 1185838 - RNA, 21 nt, Human
cggugagaggggaacagacug

SEQ ID NO: 1185839 - RNA, 16 nt, Human
cgucucauacucaccu

SEQ ID NO: 1185840 - RNA, 18 nt, Human
cggugcuaucucccccag

SEQ ID NO: 1185841 - RNA, 20 nt, Human
cggugcuaucucccccagcc

SEQ ID NO: 1185842 - RNA, 21 nt, Human
cggugcuaucucccccagccc

SEQ ID NO: 1185843 - RNA, 22 nt, Human
cggugcuaucucccccagcccc

SEQ ID NO: 1185844 - RNA, 20 nt, Human
cgucugacaggcaaugcugg

SEQ ID NO: 1185845 - RNA, 21 nt, Human
cgucugacaggcaaugcuggc

SEQ ID NO: 1185846 - RNA, 22 nt, Human
cgucugacaggcaaugcuggcu

SEQ ID NO: 1185847 - RNA, 16 nt, Human
cgugcacacaccagag

SEQ ID NO: 1185848 - RNA, 18 nt, Human
cgugcacacaccagagcc

SEQ ID NO: 1185849 - RNA, 19 nt, Human
cgugcacacaccagagccc

SEQ ID NO: 1185850 - RNA, 20 nt, Human
cgugcacacaccagagccca

SEQ ID NO: 1185851 - RNA, 21 nt, Human
cgugcaguggugcgaucuggg

SEQ ID NO: 1185852 - RNA, 22 nt, Human
cgugcaguggugcgaucugggu

SEQ ID NO: 1185853 - RNA, 20 nt, Human
cuaaaucuccaaaauaaaac

SEQ ID NO: 1185854 - RNA, 15 nt, Human
cuaaauggaaccacu

SEQ ID NO: 1185855 - RNA, 16 nt, Human
cuaaauggaaccacuc

SEQ ID NO: 1185856 - RNA, 17 nt, Human
cuaaauggaaccacucu

SEQ ID NO: 1185857 - RNA, 18 nt, Human
cuaaauggaaccacucua

SEQ ID NO: 1185858 - RNA, 16 nt, Human
cuaaauguugaaagau

SEQ ID NO: 1185859 - RNA, 16 nt, Human
cuaaauucaugcugcu

SEQ ID NO: 1185860 - RNA, 15 nt, Human
cuaacauggaaguac

SEQ ID NO: 1185861 - RNA, 17 nt, Human
cuaacauggaaguacua

SEQ ID NO: 1185862 - RNA, 22 nt, Human
cuaagcuauucaguaauaacuc

SEQ ID NO: 1185863 - RNA, 15 nt, Human
cuaaggugugcucug

SEQ ID NO: 1185864 - RNA, 19 nt, Human
cuaagcuauucaguaauaa

SEQ ID NO: 1185865 - RNA, 21 nt, Human
cuaagcuauucaguaauaacu

SEQ ID NO: 1185866 - RNA, 17 nt, Human
cuaaccacgcuggaccu

SEQ ID NO: 1185867 - RNA, 16 nt, Human
cuaaccagcagaaaug

SEQ ID NO: 1185868 - RNA, 17 nt, Human
cuaaccagcagaaaugc

SEQ ID NO: 1185869 - RNA, 14 nt, Human
cuaagcaaaaugug

SEQ ID NO: 1185870 - RNA, 15 nt, Human
cuaagcaaaauguga

SEQ ID NO: 1185871 - RNA, 18 nt, Human
cuaagcaaaaugugauau

SEQ ID NO: 1185872 - RNA, 16 nt, Human
cuaaggugugcucuga

SEQ ID NO: 1185873 - RNA, 21 nt, Human
cuaauaaaauuuaaaagucuu

SEQ ID NO: 1185874 - RNA, 14 nt, Human
cuaauguacugcau

SEQ ID NO: 1185875 - RNA, 16 nt, Human
cuaauguacugcauau

SEQ ID NO: 1185876 - RNA, 13 nt, Human
cuacacacugcau

SEQ ID NO: 1185877 - RNA, 15 nt, Human
cuacacacugcaugu

SEQ ID NO: 1185878 - RNA, 21 nt, Human
cuacacacugcauguuuguga

SEQ ID NO: 1185879 - RNA, 16 nt, Human
cuacacuccagugaga

SEQ ID NO: 1185880 - RNA, 17 nt, Human
cuacacuccagugagac

SEQ ID NO: 1185881 - RNA, 15 nt, Human
cuacagaggccaugg

SEQ ID NO: 1185882 - RNA, 17 nt, Human
cuacagaggccaugggc

SEQ ID NO: 1185883 - RNA, 18 nt, Human
cuaccauccccuguagag

SEQ ID NO: 1185884 - RNA, 17 nt, Human
cuacccacccuccuuuc

SEQ ID NO: 1185885 - RNA, 22 nt, Human
cuacccacccuccuuucaccac

SEQ ID NO: 1185886 - RNA, 20 nt, Human
cuacccagcgagcccuggug

SEQ ID NO: 1185887 - RNA, 12 nt, Human
cuacccaggugc

SEQ ID NO: 1185888 - RNA, 15 nt, Human
cuacuugggaggcug

SEQ ID NO: 1185889 - RNA, 18 nt, Human
cuacuugggaggcugaga

SEQ ID NO: 1185890 - RNA, 19 nt, Human
cuacuugggaggcugagau

SEQ ID NO: 1185891 - RNA, 14 nt, Human
cuacccgggaaggg

SEQ ID NO: 1185892 - RNA, 15 nt, Human
cuacccgggaagggg

SEQ ID NO: 1185893 - RNA, 20 nt, Human
cuacccgggaagggggcugg

SEQ ID NO: 1185894 - RNA, 21 nt, Human
cuacccgggaagggggcuggg

SEQ ID NO: 1185895 - RNA, 16 nt, Human
cuacucugugucaggu

SEQ ID NO: 1185896 - RNA, 21 nt, Human
cuacucugugucagguggggc

SEQ ID NO: 1185897 - RNA, 14 nt, Human
cuacugaggugcua

SEQ ID NO: 1185898 - RNA, 16 nt, Human
cuacuguaauuuguga

SEQ ID NO: 1185899 - RNA, 17 nt, Human
cuacuguaauuugugau

SEQ ID NO: 1185900 - RNA, 20 nt, Human
cuagacgagcaggcuucuuc

SEQ ID NO: 1185901 - RNA, 21 nt, Human
cuagacgagcaggcuucuucc

SEQ ID NO: 1185902 - RNA, 15 nt, Human
cuagagguucaaaga

SEQ ID NO: 1185903 - RNA, 17 nt, Human
cuagagugaacuugggc

SEQ ID NO: 1185904 - RNA, 21 nt, Human
cuagagugaacuugggccacu

SEQ ID NO: 1185905 - RNA, 17 nt, Human
cuagcacuuugggaggc

SEQ ID NO: 1185906 - RNA, 21 nt, Human
cuacuguaauuugugauacaa

SEQ ID NO: 1185907 - RNA, 13 nt, Human
cuaggaacacucc

SEQ ID NO: 1185908 - RNA, 15 nt, Human
cuaggaacacuccuu

SEQ ID NO: 1185909 - RNA, 21 nt, Human
cuaggaagacuuuggaaagag

SEQ ID NO: 1185910 - RNA, 12 nt, Human
cuagcagcaggg

SEQ ID NO: 1185911 - RNA, 22 nt, Human
cuaggaccccuccaugugggcu

SEQ ID NO: 1185912 - RNA, 17 nt, Human
cuaggaggucucuaaga

SEQ ID NO: 1185913 - RNA, 23 nt, Human
cuagugugguguuuccuggcacu

SEQ ID NO: 1185914 - RNA, 21 nt, Human
cuagugugguguuuccuggca

SEQ ID NO: 1185915 - RNA, 22 nt, Human
cuagugugguguuuccuggcac

SEQ ID NO: 1185916 - RNA, 19 nt, Human
cuagugugguguuuccugg

SEQ ID NO: 1185917 - RNA, 22 nt, Human
cuaguauuucuaugaaauauua

SEQ ID NO: 1185918 - RNA, 19 nt, Human
cuaguauuucuaugaaaua

SEQ ID NO: 1185919 - RNA, 20 nt, Human
cuaguauuucuaugaaauau

SEQ ID NO: 1185920 - RNA, 15 nt, Human
cuaguaucaaaagaa

SEQ ID NO: 1185921 - RNA, 17 nt, Human
cuaguaucaaaagaaag

SEQ ID NO: 1185922 - RNA, 23 nt, Human
cuaguaucaaaagaaagaaaauc

SEQ ID NO: 1185923 - RNA, 21 nt, Human
cuaggcauuugcugaauacag

SEQ ID NO: 1185924 - RNA, 14 nt, Human
cuaguuccaccauc

SEQ ID NO: 1185925 - RNA, 19 nt, Human
cuauauuguuugcuaagca

SEQ ID NO: 1185926 - RNA, 22 nt, Human
cuauauuguuuucaguguacau

SEQ ID NO: 1185927 - RNA, 23 nt, Human
cuauauuguuuucaguguacaug

SEQ ID NO: 1185928 - RNA, 20 nt, Human
cuauauuuuuuguuaaauga

SEQ ID NO: 1185929 - RNA, 22 nt, Human
cuauauuuuuuguuaaaugauu

SEQ ID NO: 1185930 - RNA, 20 nt, Human
cuaucaaguauuauaccuuu

SEQ ID NO: 1185931 - RNA, 13 nt, Human
cuaugaaauauua

SEQ ID NO: 1185932 - RNA, 18 nt, Human
cuaugaaauauuauguua

SEQ ID NO: 1185933 - RNA, 14 nt, Human
cuaugacacaugca

SEQ ID NO: 1185934 - RNA, 13 nt, Human
cucaaauuucuaa

SEQ ID NO: 1185935 - RNA, 20 nt, Human
cucaacucuccuccagaguc

SEQ ID NO: 1185936 - RNA, 21 nt, Human
cucaacucuccuccagaguca

SEQ ID NO: 1185937 - RNA, 14 nt, Human
cuaugcauuugaaa

SEQ ID NO: 1185938 - RNA, 17 nt, Human
cucaccccuugccauaa

SEQ ID NO: 1185939 - RNA, 16 nt, Human
cucacuauguugccca

SEQ ID NO: 1185940 - RNA, 17 nt, Human
cucacuauguugcccag

SEQ ID NO: 1185941 - RNA, 12 nt, Human
cucaccccagcc

SEQ ID NO: 1185942 - RNA, 13 nt, Human
cucaccccagccc

SEQ ID NO: 1185943 - RNA, 14 nt, Human
cucaccccagcccc

SEQ ID NO: 1185944 - RNA, 13 nt, Human
cucacauuuauau

SEQ ID NO: 1185945 - RNA, 20 nt, Human
cucaccagccccagugccca

SEQ ID NO: 1185946 - RNA, 21 nt, Human
cucaccagccccagugcccac

SEQ ID NO: 1185947 - RNA, 18 nt, Human
cucaagugauucuccugc

SEQ ID NO: 1185948 - RNA, 19 nt, Human
cucaagugauucuccugcc

SEQ ID NO: 1185949 - RNA, 20 nt, Human
cucaagugauucuccugccu

SEQ ID NO: 1185950 - RNA, 21 nt, Human
cucaagugauucuccugccuc

SEQ ID NO: 1185951 - RNA, 11 nt, Human
cuaugcauuug

SEQ ID NO: 1185952 - RNA, 12 nt, Human
cuaugcauuuga

SEQ ID NO: 1185953 - RNA, 21 nt, Human
cuaugcauuugaaaauuuuga

SEQ ID NO: 1185954 - RNA, 17 nt, Human
cucccaaagugcuggga

SEQ ID NO: 1185955 - RNA, 13 nt, Human
cuccaugugggcu

SEQ ID NO: 1185956 - RNA, 18 nt, Human
cucacuauguugcccagg

SEQ ID NO: 1185957 - RNA, 19 nt, Human
cucacuauguugcccaggc

SEQ ID NO: 1185958 - RNA, 11 nt, Human
cuccauccuga

SEQ ID NO: 1185959 - RNA, 16 nt, Human
cuccauccugaggcuc

SEQ ID NO: 1185960 - RNA, 18 nt, Human
cuccauccugaggcucca

SEQ ID NO: 1185961 - RNA, 20 nt, Human
cuccauccugaggcuccacu

SEQ ID NO: 1185962 - RNA, 18 nt, Human
cucccaaagugcugggau

SEQ ID NO: 1185963 - RNA, 14 nt, Human
cuccaugugggcua

SEQ ID NO: 1185964 - RNA, 23 nt, Human
cucccaaagugcugggauuacag

SEQ ID NO: 1185965 - RNA, 17 nt, Human
cucccaacucaccccag

SEQ ID NO: 1185966 - RNA, 22 nt, Human
cucccaacucaccccagcccca

SEQ ID NO: 1185967 - RNA, 11 nt, Human
cucccaucugu

SEQ ID NO: 1185968 - RNA, 14 nt, Human
cucccaucugugaa

SEQ ID NO: 1185969 - RNA, 15 nt, Human
cucccaucugugaaa

SEQ ID NO: 1185970 - RNA, 18 nt, Human
cucccaucugugaaagga

SEQ ID NO: 1185971 - RNA, 23 nt, Human
cucccaucugugaaaggaaagag

SEQ ID NO: 1185972 - RNA, 19 nt, Human
cucccgaauagcugggacu

SEQ ID NO: 1185973 - RNA, 18 nt, Human
cucccgaguagcugggac

SEQ ID NO: 1185974 - RNA, 13 nt, Human
cuccccugcuggg

SEQ ID NO: 1185975 - RNA, 14 nt, Human
cuccccugcugggu

SEQ ID NO: 1185976 - RNA, 17 nt, Human
cucccgaauagcuggga

SEQ ID NO: 1185977 - RNA, 18 nt, Human
cucccgaauagcugggac

SEQ ID NO: 1185978 - RNA, 16 nt, Human
cucccgaguagcuggg

SEQ ID NO: 1185979 - RNA, 17 nt, Human
cucccgaguagcuggga

SEQ ID NO: 1185980 - RNA, 12 nt, Human
cuccccagcaag

SEQ ID NO: 1185981 - RNA, 20 nt, Human
cuccccagcaagugagagcu

SEQ ID NO: 1185982 - RNA, 21 nt, Human
cuccccagcaagugagagcug

SEQ ID NO: 1185983 - RNA, 12 nt, Human
cuccccugcugg

SEQ ID NO: 1185984 - RNA, 20 nt, Human
cucccuuuuaauccuggcug

SEQ ID NO: 1185985 - RNA, 19 nt, Human
cucccuuuuaauccuggcu

SEQ ID NO: 1185986 - RNA, 15 nt, Human
cuccgaccagacacc

SEQ ID NO: 1185987 - RNA, 16 nt, Human
cuccugccucagccuc

SEQ ID NO: 1185988 - RNA, 15 nt, Human
cuccugccucagccu

SEQ ID NO: 1185989 - RNA, 16 nt, Human
cuccugugugugcgcc

SEQ ID NO: 1185990 - RNA, 19 nt, Human
cuccugugugugcgccuac

SEQ ID NO: 1185991 - RNA, 11 nt, Human
cuccugcaggc

SEQ ID NO: 1185992 - RNA, 12 nt, Human
cuccugcaggca

SEQ ID NO: 1185993 - RNA, 17 nt, Human
cuccugcaggcagccag

SEQ ID NO: 1185994 - RNA, 18 nt, Human
cuccugcaggcagccagg

SEQ ID NO: 1185995 - RNA, 20 nt, Human
cuccugcaggcagccaggcc

SEQ ID NO: 1185996 - RNA, 21 nt, Human
cuccugcaggcagccaggcca

SEQ ID NO: 1185997 - RNA, 11 nt, Human
cuccugcccuu

SEQ ID NO: 1185998 - RNA, 13 nt, Human
cuccugccucagc

SEQ ID NO: 1185999 - RNA, 14 nt, Human
cuccugccucagcc

SEQ ID NO: 1186000 - RNA, 20 nt, Human
cuccugugugugcgccuaca

SEQ ID NO: 1186001 - RNA, 15 nt, Human
cuccugugucuugca

SEQ ID NO: 1186002 - RNA, 16 nt, Human
cuccuucacagauggg

SEQ ID NO: 1186003 - RNA, 17 nt, Human
cuccuucacagaugggu

SEQ ID NO: 1186004 - RNA, 19 nt, Human
cuccuucacagaugggugc

SEQ ID NO: 1186005 - RNA, 13 nt, Human
cuccuucaccuuu

SEQ ID NO: 1186006 - RNA, 19 nt, Human
cucuacagaggccaugggc

SEQ ID NO: 1186007 - RNA, 14 nt, Human
cucuacagaggcca

SEQ ID NO: 1186008 - RNA, 16 nt, Human
cucuacagaggccaug

SEQ ID NO: 1186009 - RNA, 13 nt, Human
cucuacagaggcc

SEQ ID NO: 1186010 - RNA, 13 nt, Human
cucuacaaaaagc

SEQ ID NO: 1186011 - RNA, 20 nt, Human
cucuaccauccccuguagag

SEQ ID NO: 1186012 - RNA, 13 nt, Human
cucuacccuggca

SEQ ID NO: 1186013 - RNA, 15 nt, Human
cucuaggaaauauuu

SEQ ID NO: 1186014 - RNA, 17 nt, Human
cucuaggaaauauuuau

SEQ ID NO: 1186015 - RNA, 23 nt, Human
cucuagggaaaaaccagcgugug

SEQ ID NO: 1186016 - RNA, 14 nt, Human
cucuccagccccug

SEQ ID NO: 1186017 - RNA, 15 nt, Human
cucuccagccccugg

SEQ ID NO: 1186018 - RNA, 16 nt, Human
cucuccagccccugga

SEQ ID NO: 1186019 - RNA, 17 nt, Human
cucuccagccccuggau

SEQ ID NO: 1186020 - RNA, 18 nt, Human
cucuccagccccuggaug

SEQ ID NO: 1186021 - RNA, 17 nt, Human
cucucaggccagcugcu

SEQ ID NO: 1186022 - RNA, 18 nt, Human
cucucaggccagcugcuu

SEQ ID NO: 1186023 - RNA, 19 nt, Human
cucucaggccagcugcuug

SEQ ID NO: 1186024 - RNA, 21 nt, Human
cucucaggccagcugcuuggg

SEQ ID NO: 1186025 - RNA, 22 nt, Human
cucucaggccagcugcuugggc

SEQ ID NO: 1186026 - RNA, 15 nt, Human
cucuaguuugauuaa

SEQ ID NO: 1186027 - RNA, 19 nt, Human
cucuaguuugauuaaauuc

SEQ ID NO: 1186028 - RNA, 20 nt, Human
cucuaguuugauuaaauucu

SEQ ID NO: 1186029 - RNA, 21 nt, Human
cucuaguuugauuaaauucuu

SEQ ID NO: 1186030 - RNA, 12 nt, Human
cucucaggccaa

SEQ ID NO: 1186031 - RNA, 20 nt, Human
cucucaggccaaacucaccu

SEQ ID NO: 1186032 - RNA, 21 nt, Human
cucucaggccaaacucaccug

SEQ ID NO: 1186033 - RNA, 22 nt, Human
cucucaggccaaacucaccugc

SEQ ID NO: 1186034 - RNA, 23 nt, Human
cucucaggccaaacucaccugcc

SEQ ID NO: 1186035 - RNA, 13 nt, Human
cucucaggccagc

SEQ ID NO: 1186036 - RNA, 15 nt, Human
cucucaggccagcug

SEQ ID NO: 1186037 - RNA, 19 nt, Human
cucuccagccccuggaugc

SEQ ID NO: 1186038 - RNA, 14 nt, Human
cucuccccagcaag

SEQ ID NO: 1186039 - RNA, 22 nt, Human
cucuccccagcaagugagagcu

SEQ ID NO: 1186040 - RNA, 24 nt, Human
cucuccccagcaagugagagcugg

SEQ ID NO: 1186041 - RNA, 13 nt, Human
cucuccucugcug

SEQ ID NO: 1186042 - RNA, 14 nt, Human
cucuccucugcugc

SEQ ID NO: 1186043 - RNA, 15 nt, Human
cucuccucugcugcu

SEQ ID NO: 1186044 - RNA, 18 nt, Human
cucuccucugcugcuggc

SEQ ID NO: 1186045 - RNA, 12 nt, Human
cucucucacucc

SEQ ID NO: 1186046 - RNA, 14 nt, Human
cucucucacuccuu

SEQ ID NO: 1186047 - RNA, 19 nt, Human
cucuggccuucggccucca

SEQ ID NO: 1186048 - RNA, 15 nt, Human
cucuggcagcucaga

SEQ ID NO: 1186049 - RNA, 16 nt, Human
cucuggcagcucagag

SEQ ID NO: 1186050 - RNA, 12 nt, Human
cucuggccuucg

SEQ ID NO: 1186051 - RNA, 16 nt, Human
cucuggacaggcaugu

SEQ ID NO: 1186052 - RNA, 22 nt, Human
cucuggacaggcauguucucug

SEQ ID NO: 1186053 - RNA, 12 nt, Human
cucuggcagcuc

SEQ ID NO: 1186054 - RNA, 14 nt, Human
cucuggcagcucag

SEQ ID NO: 1186055 - RNA, 13 nt, Human
cucucuccucccu

SEQ ID NO: 1186056 - RNA, 21 nt, Human
cucugccugaagucacacagu

SEQ ID NO: 1186057 - RNA, 22 nt, Human
cucugccugaagucacacagug

SEQ ID NO: 1186058 - RNA, 15 nt, Human
cucuggacaggcaug

SEQ ID NO: 1186059 - RNA, 15 nt, Human
cucugugucaggugg

SEQ ID NO: 1186060 - RNA, 19 nt, Human
cucugugucagguggggca

SEQ ID NO: 1186061 - RNA, 13 nt, Human
cucuuagaaaaac

SEQ ID NO: 1186062 - RNA, 15 nt, Human
cucuuagaaaaacca

SEQ ID NO: 1186063 - RNA, 13 nt, Human
cucuuccaggcug

SEQ ID NO: 1186064 - RNA, 14 nt, Human
cucuuccaggcugg

SEQ ID NO: 1186065 - RNA, 15 nt, Human
cucuuccaggcuggg

SEQ ID NO: 1186066 - RNA, 19 nt, Human
cucuuggguucaagcgauu

SEQ ID NO: 1186067 - RNA, 21 nt, Human
cucuuggguucaagcgauucu

SEQ ID NO: 1186068 - RNA, 22 nt, Human
cucuugaaauauaggaacuuaa

SEQ ID NO: 1186069 - RNA, 21 nt, Human
cucuuccaggcugggagagcc

SEQ ID NO: 1186070 - RNA, 13 nt, Human
cucuugguccugc

SEQ ID NO: 1186071 - RNA, 15 nt, Human
cucuugguccugcug

SEQ ID NO: 1186072 - RNA, 16 nt, Human
cucuugguccugcugc

SEQ ID NO: 1186073 - RNA, 17 nt, Human
cucuugguccugcugca

SEQ ID NO: 1186074 - RNA, 18 nt, Human
cucuuuaaugucacaggc

SEQ ID NO: 1186075 - RNA, 20 nt, Human
cucuuuaaugucacaggcag

SEQ ID NO: 1186076 - RNA, 21 nt, Human
cucuuuaaugucacaggcagg

SEQ ID NO: 1186077 - RNA, 22 nt, Human
cucuuuaaugucacaggcaggu

SEQ ID NO: 1186078 - RNA, 23 nt, Human
cucuuuaaugucacaggcagguc

SEQ ID NO: 1186079 - RNA, 17 nt, Human
cucuuucccucccuucc

SEQ ID NO: 1186080 - RNA, 23 nt, Human
cugaaagcccugagcuuucugcu

SEQ ID NO: 1186081 - RNA, 16 nt, Human
cugaaagcccugagcu

SEQ ID NO: 1186082 - RNA, 17 nt, Human
cugaaagcccugagcuu

SEQ ID NO: 1186083 - RNA, 18 nt, Human
cugaaagcccugagcuuu

SEQ ID NO: 1186084 - RNA, 19 nt, Human
cugaaagcccugagcuuuc

SEQ ID NO: 1186085 - RNA, 17 nt, Human
cucuuucuauuguuucu

SEQ ID NO: 1186086 - RNA, 15 nt, Human
cugaaagcccugagc

SEQ ID NO: 1186087 - RNA, 23 nt, Human
cugaagaagcaccaaucaugaau

SEQ ID NO: 1186088 - RNA, 19 nt, Human
cugaagaauugaaaaacca

SEQ ID NO: 1186089 - RNA, 19 nt, Human
cugagacagcccgggcucu

SEQ ID NO: 1186090 - RNA, 16 nt, Human
cugagacagcccgggc

SEQ ID NO: 1186091 - RNA, 17 nt, Human
cugagacagcccgggcu

SEQ ID NO: 1186092 - RNA, 18 nt, Human
cugagacagcccgggcuc

SEQ ID NO: 1186093 - RNA, 17 nt, Human
cugagccagauuucacu

SEQ ID NO: 1186094 - RNA, 18 nt, Human
cugagccagauuucacuc

SEQ ID NO: 1186095 - RNA, 19 nt, Human
cugagccagauuucacucu

SEQ ID NO: 1186096 - RNA, 20 nt, Human
cugagccagauuucacucuc

SEQ ID NO: 1186097 - RNA, 21 nt, Human
cugagccagauuucacucucc

SEQ ID NO: 1186098 - RNA, 16 nt, Human
cugagcgacagugaga

SEQ ID NO: 1186099 - RNA, 20 nt, Human
cugagcgacagugagacucu

SEQ ID NO: 1186100 - RNA, 12 nt, Human
cugaggcccaga

SEQ ID NO: 1186101 - RNA, 13 nt, Human
cugaggcccagag

SEQ ID NO: 1186102 - RNA, 14 nt, Human
cugaggcccagagg

SEQ ID NO: 1186103 - RNA, 15 nt, Human
cugaggcccagaggg

SEQ ID NO: 1186104 - RNA, 16 nt, Human
cugaggcccagagggc

SEQ ID NO: 1186105 - RNA, 17 nt, Human
cugaggcccagagggcc

SEQ ID NO: 1186106 - RNA, 18 nt, Human
cugaggcccagagggccu

SEQ ID NO: 1186107 - RNA, 19 nt, Human
cugaggcccagagggccug

SEQ ID NO: 1186108 - RNA, 21 nt, Human
cugaggcccagagggccugca

SEQ ID NO: 1186109 - RNA, 23 nt, Human
cugaggcccagagggccugcaag

SEQ ID NO: 1186110 - RNA, 14 nt, Human
cugaggcccuucuc

SEQ ID NO: 1186111 - RNA, 15 nt, Human
cugaggcccuucucu

SEQ ID NO: 1186112 - RNA, 18 nt, Human
cugaggcccuucucucca

SEQ ID NO: 1186113 - RNA, 19 nt, Human
cugaggcccuucucuccag

SEQ ID NO: 1186114 - RNA, 20 nt, Human
cugaggcccuucucuccagc

SEQ ID NO: 1186115 - RNA, 19 nt, Human
cugaagacucauucuucug

SEQ ID NO: 1186116 - RNA, 22 nt, Human
cugacauuguuggccaaagcca

SEQ ID NO: 1186117 - RNA, 13 nt, Human
cugacccacugcu

SEQ ID NO: 1186118 - RNA, 14 nt, Human
cugacccacugcuu

SEQ ID NO: 1186119 - RNA, 14 nt, Human
cugacccaugcugc

SEQ ID NO: 1186120 - RNA, 15 nt, Human
cugacccaugcugcc

SEQ ID NO: 1186121 - RNA, 16 nt, Human
cugacccaugcugccc

SEQ ID NO: 1186122 - RNA, 17 nt, Human
cugacccaugcugcccu

SEQ ID NO: 1186123 - RNA, 17 nt, Human
cugacucuuaagaagac

SEQ ID NO: 1186124 - RNA, 16 nt, Human
cugacuguuuucucuu

SEQ ID NO: 1186125 - RNA, 18 nt, Human
cugacuguuuucucuuga

SEQ ID NO: 1186126 - RNA, 14 nt, Human
cugagacagcccgg

SEQ ID NO: 1186127 - RNA, 15 nt, Human
cugagacagcccggg

SEQ ID NO: 1186128 - RNA, 16 nt, Human
cugcccaggccccugc

SEQ ID NO: 1186129 - RNA, 18 nt, Human
cugcccaggccccugcca

SEQ ID NO: 1186130 - RNA, 19 nt, Human
cugcccaggccccugccac

SEQ ID NO: 1186131 - RNA, 20 nt, Human
cugcccaggccccugccacc

SEQ ID NO: 1186132 - RNA, 15 nt, Human
cugccauuucugaga

SEQ ID NO: 1186133 - RNA, 16 nt, Human
cugccauuucugagau

SEQ ID NO: 1186134 - RNA, 12 nt, Human
cugcccaccugg

SEQ ID NO: 1186135 - RNA, 13 nt, Human
cugcccaccuggc

SEQ ID NO: 1186136 - RNA, 14 nt, Human
cugcccaggccccu

SEQ ID NO: 1186137 - RNA, 15 nt, Human
cugcccaggccccug

SEQ ID NO: 1186138 - RNA, 18 nt, Human
cugccccuggcagccccu

SEQ ID NO: 1186139 - RNA, 19 nt, Human
cugccccuggcagccccug

SEQ ID NO: 1186140 - RNA, 13 nt, Human
cugcccggcaggg

SEQ ID NO: 1186141 - RNA, 20 nt, Human
cugcccggcaggguccuaga

SEQ ID NO: 1186142 - RNA, 15 nt, Human
cugcauaugaaagga

SEQ ID NO: 1186143 - RNA, 20 nt, Human
cugcaucaagaugugacaug

SEQ ID NO: 1186144 - RNA, 12 nt, Human
cugccacccugg

SEQ ID NO: 1186145 - RNA, 14 nt, Human
cugccacccugggg

SEQ ID NO: 1186146 - RNA, 21 nt, Human
cugccacccuggggagaaagu

SEQ ID NO: 1186147 - RNA, 13 nt, Human
cugccaggaagcc

SEQ ID NO: 1186148 - RNA, 14 nt, Human
cugccaggaagcca

SEQ ID NO: 1186149 - RNA, 20 nt, Human
cugccaggaagccagcaggc

SEQ ID NO: 1186150 - RNA, 21 nt, Human
cugccaggaagccagcaggcu

SEQ ID NO: 1186151 - RNA, 22 nt, Human
cugccaggaagccagcaggcuc

SEQ ID NO: 1186152 - RNA, 21 nt, Human
cugccauccagguucagcuug

SEQ ID NO: 1186153 - RNA, 15 nt, Human
cugccauccucccaa

SEQ ID NO: 1186154 - RNA, 20 nt, Human
cugccaucucaccuccugcu

SEQ ID NO: 1186155 - RNA, 24 nt, Human
cugaggcccuucucuccagccccu

SEQ ID NO: 1186156 - RNA, 14 nt, Human
cugcaccggcuggc

SEQ ID NO: 1186157 - RNA, 22 nt, Human
cugaggcccuucucuccagccc

SEQ ID NO: 1186158 - RNA, 23 nt, Human
cugaggcccuucucuccagcccc

SEQ ID NO: 1186159 - RNA, 15 nt, Human
cugcaccggcuggcc

SEQ ID NO: 1186160 - RNA, 16 nt, Human
cugcaccggcuggccu

SEQ ID NO: 1186161 - RNA, 15 nt, Human
cugcaccgggccaca

SEQ ID NO: 1186162 - RNA, 18 nt, Human
cugcaccgggccacagag

SEQ ID NO: 1186163 - RNA, 20 nt, Human
cugcaccgggccacagagaa

SEQ ID NO: 1186164 - RNA, 20 nt, Human
cugcacuccagccuggguga

SEQ ID NO: 1186165 - RNA, 13 nt, Human
cugcacuccccug

SEQ ID NO: 1186166 - RNA, 14 nt, Human
cugcacuccccugc

SEQ ID NO: 1186167 - RNA, 19 nt, Human
cugcacuccccugcugggu

SEQ ID NO: 1186168 - RNA, 20 nt, Human
cugcacuccccugcugggug

SEQ ID NO: 1186169 - RNA, 21 nt, Human
cugcacuccccugcugggugu

SEQ ID NO: 1186170 - RNA, 10 nt, Human
cugcagaggg

SEQ ID NO: 1186171 - RNA, 13 nt, Human
cugcagagggcac

SEQ ID NO: 1186172 - RNA, 15 nt, Human
cugcagcaauaaagc

SEQ ID NO: 1186173 - RNA, 16 nt, Human
cugcagcaauaaagca

SEQ ID NO: 1186174 - RNA, 17 nt, Human
cugcagcaauaaagcag

SEQ ID NO: 1186175 - RNA, 13 nt, Human
cugcaguugccag

SEQ ID NO: 1186176 - RNA, 16 nt, Human
cugcaguugccaguca

SEQ ID NO: 1186177 - RNA, 17 nt, Human
cugcaguugccagucac

SEQ ID NO: 1186178 - RNA, 19 nt, Human
cugccugaagucacacagu

SEQ ID NO: 1186179 - RNA, 23 nt, Human
cugccugaagucacacagugagu

SEQ ID NO: 1186180 - RNA, 20 nt, Human
cugcccugcccaccuggccu

SEQ ID NO: 1186181 - RNA, 21 nt, Human
cugcccugcccaccuggccuc

SEQ ID NO: 1186182 - RNA, 18 nt, Human
cugccugaagucacacag

SEQ ID NO: 1186183 - RNA, 23 nt, Human
cugcgguccacccaggagccccg

SEQ ID NO: 1186184 - RNA, 18 nt, Human
cugcggugcuaucucccc

SEQ ID NO: 1186185 - RNA, 19 nt, Human
cugcggugcuaucuccccc

SEQ ID NO: 1186186 - RNA, 12 nt, Human
cugcucugguua

SEQ ID NO: 1186187 - RNA, 10 nt, Human
cugcugcagu

SEQ ID NO: 1186188 - RNA, 13 nt, Human
cugcugcaguugc

SEQ ID NO: 1186189 - RNA, 14 nt, Human
cugcugcaguugcc

SEQ ID NO: 1186190 - RNA, 15 nt, Human
cugcugcaguugcca

SEQ ID NO: 1186191 - RNA, 20 nt, Human
cugcggugcuaucuccccca

SEQ ID NO: 1186192 - RNA, 21 nt, Human
cugcggugcuaucucccccag

SEQ ID NO: 1186193 - RNA, 22 nt, Human
cugcggugcuaucucccccagc

SEQ ID NO: 1186194 - RNA, 23 nt, Human
cugcggugcuaucucccccagcc

SEQ ID NO: 1186195 - RNA, 19 nt, Human
cugcuccucuccccagcaa

SEQ ID NO: 1186196 - RNA, 20 nt, Human
cugcuccucuccccagcaag

SEQ ID NO: 1186197 - RNA, 23 nt, Human
cugcuccucuccccagcaaguga

SEQ ID NO: 1186198 - RNA, 15 nt, Human
cugcucuccgaccag

SEQ ID NO: 1186199 - RNA, 19 nt, Human
cugcucuccgaccagacac

SEQ ID NO: 1186200 - RNA, 14 nt, Human
cugcugcuggcugg

SEQ ID NO: 1186201 - RNA, 12 nt, Human
cugcugcuggcu

SEQ ID NO: 1186202 - RNA, 13 nt, Human
cugcugcuggcug

SEQ ID NO: 1186203 - RNA, 14 nt, Human
cugcuggguguggc

SEQ ID NO: 1186204 - RNA, 15 nt, Human
cugcuggguguggcg

SEQ ID NO: 1186205 - RNA, 17 nt, Human
cugcuggguguggcgca

SEQ ID NO: 1186206 - RNA, 13 nt, Human
cugcuugaggcaa

SEQ ID NO: 1186207 - RNA, 20 nt, Human
cugcuugaggcaacucaucu

SEQ ID NO: 1186208 - RNA, 21 nt, Human
cugcuugaggcaacucaucuu

SEQ ID NO: 1186209 - RNA, 15 nt, Human
cugcuuuuggucugu

SEQ ID NO: 1186210 - RNA, 17 nt, Human
cugcuuuuggucugugu

SEQ ID NO: 1186211 - RNA, 19 nt, Human
cugcuuuugucuaugggac

SEQ ID NO: 1186212 - RNA, 22 nt, Human
cugcuugaggcaacucaucuua

SEQ ID NO: 1186213 - RNA, 20 nt, Human
cugcuugcuugcuuuuuaau

SEQ ID NO: 1186214 - RNA, 13 nt, Human
cugcuugggcuuc

SEQ ID NO: 1186215 - RNA, 15 nt, Human
cugcuugggcuucau

SEQ ID NO: 1186216 - RNA, 17 nt, Human
cugcuugggcuucaucc

SEQ ID NO: 1186217 - RNA, 18 nt, Human
cugcuugggcuucauccu

SEQ ID NO: 1186218 - RNA, 19 nt, Human
cugcuugggcuucauccuc

SEQ ID NO: 1186219 - RNA, 19 nt, Human
cugcuugugaaaggaaaga

SEQ ID NO: 1186220 - RNA, 16 nt, Human
cuggcacccggccccu

SEQ ID NO: 1186221 - RNA, 17 nt, Human
cuggcacccggccccug

SEQ ID NO: 1186222 - RNA, 18 nt, Human
cuggcacccggccccugc

SEQ ID NO: 1186223 - RNA, 19 nt, Human
cuggcacccggccccugcu

SEQ ID NO: 1186224 - RNA, 18 nt, Human
cuggaauauauaaccagu

SEQ ID NO: 1186225 - RNA, 14 nt, Human
cuggaaugcagugg

SEQ ID NO: 1186226 - RNA, 14 nt, Human
cuggcaagaaugug

SEQ ID NO: 1186227 - RNA, 15 nt, Human
cuggcacuauaaugu

SEQ ID NO: 1186228 - RNA, 16 nt, Human
cuggcacuauaaugua

SEQ ID NO: 1186229 - RNA, 22 nt, Human
cuggcacuauaauguaagcucu

SEQ ID NO: 1186230 - RNA, 16 nt, Human
cuggcaugggaaugaa

SEQ ID NO: 1186231 - RNA, 18 nt, Human
cuggcaugggaaugaaug

SEQ ID NO: 1186232 - RNA, 19 nt, Human
cuggcaugggaaugaaugu

SEQ ID NO: 1186233 - RNA, 22 nt, Human
cuggcaugggaaugaaugucag

SEQ ID NO: 1186234 - RNA, 24 nt, Human
cuggcaugggaaugaaugucagug

SEQ ID NO: 1186235 - RNA, 23 nt, Human
cuggccucaagugauucuccugc

SEQ ID NO: 1186236 - RNA, 12 nt, Human
cuggccucugca

SEQ ID NO: 1186237 - RNA, 13 nt, Human
cuggccucugcac

SEQ ID NO: 1186238 - RNA, 14 nt, Human
cuggccucugcacu

SEQ ID NO: 1186239 - RNA, 16 nt, Human
cuggccucugcacucc

SEQ ID NO: 1186240 - RNA, 16 nt, Human
cuggccugagcuggga

SEQ ID NO: 1186241 - RNA, 18 nt, Human
cuggccugagcugggaug

SEQ ID NO: 1186242 - RNA, 14 nt, Human
cuggccuggccccu

SEQ ID NO: 1186243 - RNA, 16 nt, Human
cuggccuggccccuca

SEQ ID NO: 1186244 - RNA, 17 nt, Human
cuggccuggccccucag

SEQ ID NO: 1186245 - RNA, 19 nt, Human
cuggccuggccccucaggg

SEQ ID NO: 1186246 - RNA, 15 nt, Human
cuggccuucggccuc

SEQ ID NO: 1186247 - RNA, 16 nt, Human
cuggccuucggccucc

SEQ ID NO: 1186248 - RNA, 17 nt, Human
cuggccuucggccucca

SEQ ID NO: 1186249 - RNA, 18 nt, Human
cuggccuucggccuccau

SEQ ID NO: 1186250 - RNA, 21 nt, Human
cuggccuucggccuccauccu

SEQ ID NO: 1186251 - RNA, 18 nt, Human
cuggcuguuggcuggggg

SEQ ID NO: 1186252 - RNA, 17 nt, Human
cugggagagccuuccag

SEQ ID NO: 1186253 - RNA, 18 nt, Human
cugggagagccuuccagg

SEQ ID NO: 1186254 - RNA, 19 nt, Human
cugggagagccuuccaggg

SEQ ID NO: 1186255 - RNA, 20 nt, Human
cugggagagccuuccagggg

SEQ ID NO: 1186256 - RNA, 21 nt, Human
cugggagagccuuccaggggu

SEQ ID NO: 1186257 - RNA, 20 nt, Human
cuggcugguuagagguuccc

SEQ ID NO: 1186258 - RNA, 13 nt, Human
cuggcugucgaga

SEQ ID NO: 1186259 - RNA, 16 nt, Human
cuggcuguuggcuggg

SEQ ID NO: 1186260 - RNA, 17 nt, Human
cuggcuguuggcugggg

SEQ ID NO: 1186261 - RNA, 19 nt, Human
cugggaggucaaggcugca

SEQ ID NO: 1186262 - RNA, 21 nt, Human
cugggaggucaaggcugcagu

SEQ ID NO: 1186263 - RNA, 20 nt, Human
cugggauuacaggugugaac

SEQ ID NO: 1186264 - RNA, 17 nt, Human
cugggauuacaggugug

SEQ ID NO: 1186265 - RNA, 12 nt, Human
cugggagugagc

SEQ ID NO: 1186266 - RNA, 20 nt, Human
cugggaucccucauccucau

SEQ ID NO: 1186267 - RNA, 18 nt, Human
cugggaugauuggagggg

SEQ ID NO: 1186268 - RNA, 13 nt, Human
cuggucccacuca

SEQ ID NO: 1186269 - RNA, 14 nt, Human
cuggucccacucag

SEQ ID NO: 1186270 - RNA, 23 nt, Human
cuggucucaaacucuugaccuca

SEQ ID NO: 1186271 - RNA, 20 nt, Human
cugggcucccuucccaccuc

SEQ ID NO: 1186272 - RNA, 21 nt, Human
cugggcucccuucccaccucu

SEQ ID NO: 1186273 - RNA, 22 nt, Human
cugggcucccuucccaccucuc

SEQ ID NO: 1186274 - RNA, 16 nt, Human
cuggguacuuguggac

SEQ ID NO: 1186275 - RNA, 18 nt, Human
cuggguacuuguggacac

SEQ ID NO: 1186276 - RNA, 19 nt, Human
cuggguacuuguggacaca

SEQ ID NO: 1186277 - RNA, 12 nt, Human
cugguggcagcu

SEQ ID NO: 1186278 - RNA, 13 nt, Human
cugguggcagcuc

SEQ ID NO: 1186279 - RNA, 14 nt, Human
cugguggcagcuca

SEQ ID NO: 1186280 - RNA, 16 nt, Human
cugguggcagcucacc

SEQ ID NO: 1186281 - RNA, 20 nt, Human
cugguucaggguuggccccu

SEQ ID NO: 1186282 - RNA, 16 nt, Human
cugguuccauggccuc

SEQ ID NO: 1186283 - RNA, 18 nt, Human
cuguaauuugugauacaa

SEQ ID NO: 1186284 - RNA, 21 nt, Human
cuguaauuugugauacaaugc

SEQ ID NO: 1186285 - RNA, 22 nt, Human
cuguaauuugugauacaaugcu

SEQ ID NO: 1186286 - RNA, 23 nt, Human
cuguacagagcccacgcccccac

SEQ ID NO: 1186287 - RNA, 22 nt, Human
cuguacaugaaaacacauuuuu

SEQ ID NO: 1186288 - RNA, 23 nt, Human
cuguacaugaaaacacauuuuuc

SEQ ID NO: 1186289 - RNA, 21 nt, Human
cuguaccucuugagccuugaa

SEQ ID NO: 1186290 - RNA, 22 nt, Human
cugucccagugccgagaaggaa

SEQ ID NO: 1186291 - RNA, 13 nt, Human
cuguauuuuaaaa

SEQ ID NO: 1186292 - RNA, 16 nt, Human
cuguauuuuaaaagaa

SEQ ID NO: 1186293 - RNA, 19 nt, Human
cuguauuuuaaaagaauga

SEQ ID NO: 1186294 - RNA, 22 nt, Human
cuguaccucuugagccuugaac

SEQ ID NO: 1186295 - RNA, 15 nt, Human
cuguaucccaugagc

SEQ ID NO: 1186296 - RNA, 18 nt, Human
cuguaucccaugagccuc

SEQ ID NO: 1186297 - RNA, 15 nt, Human
cuguaugauucccag

SEQ ID NO: 1186298 - RNA, 19 nt, Human
cuguaucccaugagccuca

SEQ ID NO: 1186299 - RNA, 21 nt, Human
cuguccuacucugugucaggu

SEQ ID NO: 1186300 - RNA, 14 nt, Human
cuguccgagcuuug

SEQ ID NO: 1186301 - RNA, 22 nt, Human
cugucucaaaaaaagaaaaaga

SEQ ID NO: 1186302 - RNA, 18 nt, Human
cugucucuacuaaaaaua

SEQ ID NO: 1186303 - RNA, 13 nt, Human
cugucccccugac

SEQ ID NO: 1186304 - RNA, 14 nt, Human
cugucccccugaca

SEQ ID NO: 1186305 - RNA, 17 nt, Human
cuguccccgcacugggc

SEQ ID NO: 1186306 - RNA, 16 nt, Human
cuguccuacucugugu

SEQ ID NO: 1186307 - RNA, 17 nt, Human
cuguccuacucuguguc

SEQ ID NO: 1186308 - RNA, 18 nt, Human
cuguccuacucuguguca

SEQ ID NO: 1186309 - RNA, 20 nt, Human
cuguccuacucugugucagg

SEQ ID NO: 1186310 - RNA, 19 nt, Human
cuugaaauauaggaacuua

SEQ ID NO: 1186311 - RNA, 13 nt, Human
cuucuuuccacag

SEQ ID NO: 1186312 - RNA, 19 nt, Human
cuucuuuccacagaagcuc

SEQ ID NO: 1186313 - RNA, 19 nt, Human
cuugaacccgggaggcaga

SEQ ID NO: 1186314 - RNA, 20 nt, Human
cuugaacccgggaggcagag

SEQ ID NO: 1186315 - RNA, 14 nt, Human
cuugaacuccuggc

SEQ ID NO: 1186316 - RNA, 15 nt, Human
cuugaacuccuggcc

SEQ ID NO: 1186317 - RNA, 17 nt, Human
cuugaacuccuggccuc

SEQ ID NO: 1186318 - RNA, 18 nt, Human
cuugaacuccuggccuca

SEQ ID NO: 1186319 - RNA, 19 nt, Human
cuugaacuccuggccucaa

SEQ ID NO: 1186320 - RNA, 16 nt, Human
cuugaacuggguacuu

SEQ ID NO: 1186321 - RNA, 18 nt, Human
cuugaacuggguacuugu

SEQ ID NO: 1186322 - RNA, 20 nt, Human
cuugaacuggguacuugugg

SEQ ID NO: 1186323 - RNA, 15 nt, Human
cuugaacuuugaccu

SEQ ID NO: 1186324 - RNA, 18 nt, Human
cuugcagacucuacagag

SEQ ID NO: 1186325 - RNA, 20 nt, Human
cuugcagacucuacagaggc

SEQ ID NO: 1186326 - RNA, 21 nt, Human
cuugcaugaggcuaguguggu

SEQ ID NO: 1186327 - RNA, 21 nt, Human
cuugcaugguuuagaaagcuu

SEQ ID NO: 1186328 - RNA, 22 nt, Human
cuugcaaaguaucccuacugua

SEQ ID NO: 1186329 - RNA, 18 nt, Human
cuugaguugauucagcuc

SEQ ID NO: 1186330 - RNA, 14 nt, Human
cuugcaauggcagc

SEQ ID NO: 1186331 - RNA, 15 nt, Human
cuugcaauggcagcc

SEQ ID NO: 1186332 - RNA, 17 nt, Human
cuugaccauucuccacc

SEQ ID NO: 1186333 - RNA, 20 nt, Human
cuugaccauucuccaccugc

SEQ ID NO: 1186334 - RNA, 21 nt, Human
cuugaccauucuccaccugcc

SEQ ID NO: 1186335 - RNA, 19 nt, Human
cuugagccuugaacuuuga

SEQ ID NO: 1186336 - RNA, 20 nt, Human
cuugagccuugaacuuugac

SEQ ID NO: 1186337 - RNA, 22 nt, Human
cuugagccuugaacuuugaccu

SEQ ID NO: 1186338 - RNA, 13 nt, Human
cuugagcucagga

SEQ ID NO: 1186339 - RNA, 20 nt, Human
cuuggggaccagagcugcca

SEQ ID NO: 1186340 - RNA, 18 nt, Human
cuuguaaaggaauuuaaa

SEQ ID NO: 1186341 - RNA, 14 nt, Human
cuuggcugcaggga

SEQ ID NO: 1186342 - RNA, 17 nt, Human
cuuggggaccagagcug

SEQ ID NO: 1186343 - RNA, 18 nt, Human
cuuggggaccagagcugc

SEQ ID NO: 1186344 - RNA, 19 nt, Human
cuuggggaccagagcugcc

SEQ ID NO: 1186345 - RNA, 17 nt, Human
cuuguggacacagcucu

SEQ ID NO: 1186346 - RNA, 18 nt, Human
cuuguggacacagcucuu

SEQ ID NO: 1186347 - RNA, 17 nt, Human
cuugccaaauauaaaua

SEQ ID NO: 1186348 - RNA, 13 nt, Human
cuuggauuguccc

SEQ ID NO: 1186349 - RNA, 14 nt, Human
cuuggauugucccc

SEQ ID NO: 1186350 - RNA, 23 nt, Human
cuuggcucaaguccucuuuucug

SEQ ID NO: 1186351 - RNA, 12 nt, Human
cuuggcugcagg

SEQ ID NO: 1186352 - RNA, 13 nt, Human
cuuggcugcaggg

SEQ ID NO: 1186353 - RNA, 15 nt, Human
cuuuccaggaaggcu

SEQ ID NO: 1186354 - RNA, 19 nt, Human
cuuuccucaaaacuucaga

SEQ ID NO: 1186355 - RNA, 16 nt, Human
cuuuccaaaguacacu

SEQ ID NO: 1186356 - RNA, 22 nt, Human
cuuuccaaaguacacuguuuca

SEQ ID NO: 1186357 - RNA, 16 nt, Human
cuuuccaaaugcccag

SEQ ID NO: 1186358 - RNA, 14 nt, Human
cuuuccaggaaggc

SEQ ID NO: 1186359 - RNA, 21 nt, Human
cuuguggacacagcucuucuc

SEQ ID NO: 1186360 - RNA, 20 nt, Human
cuuguguguuuauugucaaa

SEQ ID NO: 1186361 - RNA, 17 nt, Human
cuuuccugaggcugggc

SEQ ID NO: 1186362 - RNA, 20 nt, Human
cuuuccugaggcugggcucc

SEQ ID NO: 1186363 - RNA, 21 nt, Human
cuuuccugaggcugggcuccc

SEQ ID NO: 1186364 - RNA, 14 nt, Human
cuuugcagacaggc

SEQ ID NO: 1186365 - RNA, 15 nt, Human
cuuugcagacaggca

SEQ ID NO: 1186366 - RNA, 16 nt, Human
cuuugcagacaggcaa

SEQ ID NO: 1186367 - RNA, 23 nt, Human
cuuuggaaagaguaggaagacuu

SEQ ID NO: 1186368 - RNA, 15 nt, Human
cuuuuaauccuggcu

SEQ ID NO: 1186369 - RNA, 22 nt, Human
cuuuucauuuaggugaggaagc

SEQ ID NO: 1186370 - RNA, 13 nt, Human
cuuuuccaacccu

SEQ ID NO: 1186371 - RNA, 23 nt, Human
cuuuuccaacccucaucaccaac

SEQ ID NO: 1186372 - RNA, 20 nt, Human
cuuuucgcaggauucuuccu

SEQ ID NO: 1186373 - RNA, 21 nt, Human
cuuuucgcaggauucuuccuc

SEQ ID NO: 1186374 - RNA, 22 nt, Human
cuuuuuaauauugauaugcuua

SEQ ID NO: 1186375 - RNA, 17 nt, Human
cuuuucuuucagccaag

SEQ ID NO: 1186376 - RNA, 13 nt, Human
cuuuucuuuucuu

SEQ ID NO: 1186377 - RNA, 15 nt, Human
cuuuuuuauacauaa

SEQ ID NO: 1186378 - RNA, 16 nt, Human
cuuuuuuauacauaaa

SEQ ID NO: 1186379 - RNA, 17 nt, Human
cuuuuuuauacauaaac

SEQ ID NO: 1186380 - RNA, 18 nt, Human
cuuuuuuauacauaaaca

SEQ ID NO: 1186381 - RNA, 15 nt, Human
cuuuuuucacuacau

SEQ ID NO: 1186382 - RNA, 11 nt, Human
gaaaaagaaaa

SEQ ID NO: 1186383 - RNA, 16 nt, Human
gaaaaagaaaaaauau

SEQ ID NO: 1186384 - RNA, 16 nt, Human
gaaagaucaaaagguu

SEQ ID NO: 1186385 - RNA, 13 nt, Human
gaaagcagaacag

SEQ ID NO: 1186386 - RNA, 14 nt, Human
gaaagcagaacagu

SEQ ID NO: 1186387 - RNA, 17 nt, Human
gaaagacuguacaaagu

SEQ ID NO: 1186388 - RNA, 11 nt, Human
gaaagagagaa

SEQ ID NO: 1186389 - RNA, 12 nt, Human
gaaagagagaaa

SEQ ID NO: 1186390 - RNA, 13 nt, Human
gaaagagagaaaa

SEQ ID NO: 1186391 - RNA, 14 nt, Human
gaaagagagaaaau

SEQ ID NO: 1186392 - RNA, 15 nt, Human
gaaagagagaaaaua

SEQ ID NO: 1186393 - RNA, 16 nt, Human
gaaagagagaaaauaa

SEQ ID NO: 1186394 - RNA, 17 nt, Human
gaaagagagaaaauaaa

SEQ ID NO: 1186395 - RNA, 18 nt, Human
gaaagagagaaaauaaaa

SEQ ID NO: 1186396 - RNA, 20 nt, Human
gaaagagagaaaauaaaaag

SEQ ID NO: 1186397 - RNA, 21 nt, Human
gaaagagagaaaauaaaaagu

SEQ ID NO: 1186398 - RNA, 22 nt, Human
gaaagagagaaaauaaaaaguu

SEQ ID NO: 1186399 - RNA, 23 nt, Human
gaaagagagaaaauaaaaaguua

SEQ ID NO: 1186400 - RNA, 16 nt, Human
gaaaaaugagccuggc

SEQ ID NO: 1186401 - RNA, 13 nt, Human
gaaaguucaugcu

SEQ ID NO: 1186402 - RNA, 11 nt, Human
gaaaggaaaga

SEQ ID NO: 1186403 - RNA, 16 nt, Human
gaaaggaaagaggcuc

SEQ ID NO: 1186404 - RNA, 18 nt, Human
gaaauaucugaaaaugua

SEQ ID NO: 1186405 - RNA, 19 nt, Human
gaaauaucugaaaauguau

SEQ ID NO: 1186406 - RNA, 20 nt, Human
gaaauaucugaaaauguaug

SEQ ID NO: 1186407 - RNA, 13 nt, Human
gaaauauuuauuu

SEQ ID NO: 1186408 - RNA, 15 nt, Human
gaaauauuuauuuua

SEQ ID NO: 1186409 - RNA, 16 nt, Human
gaaauauuuauuuuaa

SEQ ID NO: 1186410 - RNA, 11 nt, Human
gaaaugagcug

SEQ ID NO: 1186411 - RNA, 18 nt, Human
gaaaugaggucagagccu

SEQ ID NO: 1186412 - RNA, 16 nt, Human
gaaaugggcagagcag

SEQ ID NO: 1186413 - RNA, 17 nt, Human
gaaaugggcagagcaga

SEQ ID NO: 1186414 - RNA, 19 nt, Human
gaaaugggcagagcagaga

SEQ ID NO: 1186415 - RNA, 17 nt, Human
gaaauguacagcaagga

SEQ ID NO: 1186416 - RNA, 15 nt, Human
gaacacuccuucaca

SEQ ID NO: 1186417 - RNA, 16 nt, Human
gaacacuccuucacag

SEQ ID NO: 1186418 - RNA, 17 nt, Human
gaacacuccuucacaga

SEQ ID NO: 1186419 - RNA, 13 nt, Human
gaacacucugaga

SEQ ID NO: 1186420 - RNA, 20 nt, Human
gaacagacuggaagcacagc

SEQ ID NO: 1186421 - RNA, 22 nt, Human
gaacagacuggaagcacagcuu

SEQ ID NO: 1186422 - RNA, 24 nt, Human
gaacaguuaccucugccucagaaa

SEQ ID NO: 1186423 - RNA, 16 nt, Human
gaacucccuuucaaca

SEQ ID NO: 1186424 - RNA, 14 nt, Human
gaaccacaagacug

SEQ ID NO: 1186425 - RNA, 15 nt, Human
gaaccacaagacugc

SEQ ID NO: 1186426 - RNA, 18 nt, Human
gaaccacaucuugcucug

SEQ ID NO: 1186427 - RNA, 20 nt, Human
gaaccacaucuugcucugcu

SEQ ID NO: 1186428 - RNA, 14 nt, Human
gaacuuaaauaaug

SEQ ID NO: 1186429 - RNA, 17 nt, Human
gaacuuaaauaauguga

SEQ ID NO: 1186430 - RNA, 12 nt, Human
gaacuugguucc

SEQ ID NO: 1186431 - RNA, 17 nt, Human
gaacuuuccaggaaggc

SEQ ID NO: 1186432 - RNA, 18 nt, Human
gaacuuggcgcugccccu

SEQ ID NO: 1186433 - RNA, 17 nt, Human
gaacuugggccacugug

SEQ ID NO: 1186434 - RNA, 16 nt, Human
gaacuuugaccucugc

SEQ ID NO: 1186435 - RNA, 22 nt, Human
gaacuuugaccucugcagcaau

SEQ ID NO: 1186436 - RNA, 17 nt, Human
gaagauguagaggagaa

SEQ ID NO: 1186437 - RNA, 23 nt, Human
gaagauuuugaaauuuuuauuaa

SEQ ID NO: 1186438 - RNA, 15 nt, Human
gaagacuucaucccu

SEQ ID NO: 1186439 - RNA, 16 nt, Human
gaagacuucaucccuc

SEQ ID NO: 1186440 - RNA, 17 nt, Human
gaagacuucaucccucu

SEQ ID NO: 1186441 - RNA, 19 nt, Human
gaagacuucaucccucugg

SEQ ID NO: 1186442 - RNA, 12 nt, Human
gaagagccuugc

SEQ ID NO: 1186443 - RNA, 19 nt, Human
gaaggacauugcggacagc

SEQ ID NO: 1186444 - RNA, 20 nt, Human
gaaggacauugcggacagcc

SEQ ID NO: 1186445 - RNA, 21 nt, Human
gaaggacauugcggacagcca

SEQ ID NO: 1186446 - RNA, 21 nt, Human
gaaggaaacccagcucugguc

SEQ ID NO: 1186447 - RNA, 22 nt, Human
gaaggaaacccagcucuggucc

SEQ ID NO: 1186448 - RNA, 15 nt, Human
gaaggaacguccccu

SEQ ID NO: 1186449 - RNA, 19 nt, Human
gaaggaagacuucaucccu

SEQ ID NO: 1186450 - RNA, 14 nt, Human
gaagccgcuggggc

SEQ ID NO: 1186451 - RNA, 18 nt, Human
gaagccgcuggggccagu

SEQ ID NO: 1186452 - RNA, 20 nt, Human
gaagccgcuggggccaguug

SEQ ID NO: 1186453 - RNA, 21 nt, Human
gaagccgcuggggccaguugg

SEQ ID NO: 1186454 - RNA, 20 nt, Human
gaaggaaacccagcucuggu

SEQ ID NO: 1186455 - RNA, 15 nt, Human
gaagggggcugggac

SEQ ID NO: 1186456 - RNA, 13 nt, Human
gaagggggcuggg

SEQ ID NO: 1186457 - RNA, 23 nt, Human
gaaguccaagcauuuagauguau

SEQ ID NO: 1186458 - RNA, 19 nt, Human
gaaguaauaugcacacauu

SEQ ID NO: 1186459 - RNA, 20 nt, Human
gaaguaauaugcacacauuu

SEQ ID NO: 1186460 - RNA, 21 nt, Human
gaaguaauaugcacacauuuu

SEQ ID NO: 1186461 - RNA, 13 nt, Human
gaagucacacagu

SEQ ID NO: 1186462 - RNA, 18 nt, Human
gacacaggcccggcucca

SEQ ID NO: 1186463 - RNA, 12 nt, Human
gacacccuguga

SEQ ID NO: 1186464 - RNA, 13 nt, Human
gacacccugugau

SEQ ID NO: 1186465 - RNA, 22 nt, Human
gacacccugugauggggcccug

SEQ ID NO: 1186466 - RNA, 23 nt, Human
gacacccugugauggggcccugc

SEQ ID NO: 1186467 - RNA, 15 nt, Human
gacaccuugacaggg

SEQ ID NO: 1186468 - RNA, 17 nt, Human
gacaccuugacagggca

SEQ ID NO: 1186469 - RNA, 18 nt, Human
gacaccuugacagggcac

SEQ ID NO: 1186470 - RNA, 20 nt, Human
gacaccuugacagggcacac

SEQ ID NO: 1186471 - RNA, 15 nt, Human
gacacgaauauugcu

SEQ ID NO: 1186472 - RNA, 17 nt, Human
gacacgaauauugcuga

SEQ ID NO: 1186473 - RNA, 18 nt, Human
gacacgaauauugcugau

SEQ ID NO: 1186474 - RNA, 19 nt, Human
gacacgaauauugcugaug

SEQ ID NO: 1186475 - RNA, 15 nt, Human
gacacuaaccacgcu

SEQ ID NO: 1186476 - RNA, 16 nt, Human
gacacuaaccacgcug

SEQ ID NO: 1186477 - RNA, 17 nt, Human
gacacuaaccacgcugg

SEQ ID NO: 1186478 - RNA, 18 nt, Human
gacacuaaccacgcugga

SEQ ID NO: 1186479 - RNA, 14 nt, Human
gaagucuuuguaca

SEQ ID NO: 1186480 - RNA, 16 nt, Human
gaagucuuuguacaga

SEQ ID NO: 1186481 - RNA, 15 nt, Human
gacaagcucacagac

SEQ ID NO: 1186482 - RNA, 22 nt, Human
gacaaggauugcuacuguccua

SEQ ID NO: 1186483 - RNA, 16 nt, Human
gacaaugacccagugg

SEQ ID NO: 1186484 - RNA, 17 nt, Human
gacaaugacuuacugua

SEQ ID NO: 1186485 - RNA, 20 nt, Human
gacaaugacuuacuguacau

SEQ ID NO: 1186486 - RNA, 21 nt, Human
gacaaugacuuacuguacaug

SEQ ID NO: 1186487 - RNA, 12 nt, Human
gacaaugcaaac

SEQ ID NO: 1186488 - RNA, 16 nt, Human
gacaaugcaaaccauc

SEQ ID NO: 1186489 - RNA, 18 nt, Human
gacaaugcaaaccaucau

SEQ ID NO: 1186490 - RNA, 12 nt, Human
gacaauuuauua

SEQ ID NO: 1186491 - RNA, 13 nt, Human
gacaauuuauuau

SEQ ID NO: 1186492 - RNA, 19 nt, Human
gacaauuuauuauggcaca

SEQ ID NO: 1186493 - RNA, 13 nt, Human
gacacacagcucu

SEQ ID NO: 1186494 - RNA, 15 nt, Human
gacacaggcccggcu

SEQ ID NO: 1186495 - RNA, 17 nt, Human
gacacaggcccggcucc

SEQ ID NO: 1186496 - RNA, 17 nt, Human
gacagacacaggcccgg

SEQ ID NO: 1186497 - RNA, 15 nt, Human
gacagacacaggccc

SEQ ID NO: 1186498 - RNA, 16 nt, Human
gacagacacaggcccg

SEQ ID NO: 1186499 - RNA, 20 nt, Human
gacacuaaccacgcuggacc

SEQ ID NO: 1186500 - RNA, 21 nt, Human
gacacuaaccacgcuggaccu

SEQ ID NO: 1186501 - RNA, 14 nt, Human
gacagacacaggcc

SEQ ID NO: 1186502 - RNA, 13 nt, Human
gacagccacggcc

SEQ ID NO: 1186503 - RNA, 13 nt, Human
gacagcugccugg

SEQ ID NO: 1186504 - RNA, 14 nt, Human
gacagcugccuggg

SEQ ID NO: 1186505 - RNA, 15 nt, Human
gacagcugccuggga

SEQ ID NO: 1186506 - RNA, 23 nt, Human
gacaggaugguucccuugaugaa

SEQ ID NO: 1186507 - RNA, 14 nt, Human
gacaggcaaugcug

SEQ ID NO: 1186508 - RNA, 16 nt, Human
gacaggcaaugcuggc

SEQ ID NO: 1186509 - RNA, 17 nt, Human
gacaggcaaugcuggcu

SEQ ID NO: 1186510 - RNA, 18 nt, Human
gacaggcaaugcuggcug

SEQ ID NO: 1186511 - RNA, 18 nt, Human
gacaggcauguucucuga

SEQ ID NO: 1186512 - RNA, 19 nt, Human
gacaggcauguucucugag

SEQ ID NO: 1186513 - RNA, 20 nt, Human
gacaggcauguucucugagg

SEQ ID NO: 1186514 - RNA, 15 nt, Human
gacauacuaaccagc

SEQ ID NO: 1186515 - RNA, 16 nt, Human
gacauacuaaccagca

SEQ ID NO: 1186516 - RNA, 23 nt, Human
gacauacuaaccagcagaaaugc

SEQ ID NO: 1186517 - RNA, 14 nt, Human
gacaucaacagaua

SEQ ID NO: 1186518 - RNA, 22 nt, Human
gacaugggacauuugcucaugg

SEQ ID NO: 1186519 - RNA, 17 nt, Human
gacaugucuuuucuugc

SEQ ID NO: 1186520 - RNA, 21 nt, Human
gacaugucuuuucuugcauga

SEQ ID NO: 1186521 - RNA, 13 nt, Human
gaccccuccaugu

SEQ ID NO: 1186522 - RNA, 19 nt, Human
gacccugaggcccagaggg

SEQ ID NO: 1186523 - RNA, 20 nt, Human
gacccugaggcccagagggc

SEQ ID NO: 1186524 - RNA, 21 nt, Human
gacccugaggcccagagggcc

SEQ ID NO: 1186525 - RNA, 22 nt, Human
gacccugaggcccagagggccu

SEQ ID NO: 1186526 - RNA, 13 nt, Human
gacccugcccugu

SEQ ID NO: 1186527 - RNA, 15 nt, Human
gacccugcccugugg

SEQ ID NO: 1186528 - RNA, 16 nt, Human
gacccugcccuguggg

SEQ ID NO: 1186529 - RNA, 11 nt, Human
gacccacugcu

SEQ ID NO: 1186530 - RNA, 12 nt, Human
gacccacugcuu

SEQ ID NO: 1186531 - RNA, 14 nt, Human
gacccaugcugccc

SEQ ID NO: 1186532 - RNA, 15 nt, Human
gacccaugcugcccu

SEQ ID NO: 1186533 - RNA, 16 nt, Human
gacccaugcugcccug

SEQ ID NO: 1186534 - RNA, 17 nt, Human
gacccaugcugcccugu

SEQ ID NO: 1186535 - RNA, 23 nt, Human
gaccugauuucugagcauuuaau

SEQ ID NO: 1186536 - RNA, 11 nt, Human
gaccucaggcc

SEQ ID NO: 1186537 - RNA, 12 nt, Human
gaccucaggccu

SEQ ID NO: 1186538 - RNA, 13 nt, Human
gaccucaggccug

SEQ ID NO: 1186539 - RNA, 15 nt, Human
gaccugaggcccuuc

SEQ ID NO: 1186540 - RNA, 18 nt, Human
gaccugaggcccuucucu

SEQ ID NO: 1186541 - RNA, 21 nt, Human
gaccugaggcccuucucucca

SEQ ID NO: 1186542 - RNA, 17 nt, Human
gacccugcccugugggc

SEQ ID NO: 1186543 - RNA, 14 nt, Human
gaccgugaggccag

SEQ ID NO: 1186544 - RNA, 15 nt, Human
gaccgugaggccaga

SEQ ID NO: 1186545 - RNA, 22 nt, Human
gaccuuuaagagaaaugagcug

SEQ ID NO: 1186546 - RNA, 21 nt, Human
gaccuuucaauaggaaaaacu

SEQ ID NO: 1186547 - RNA, 21 nt, Human
gacggagucccaccuuggcug

SEQ ID NO: 1186548 - RNA, 23 nt, Human
gacggagucccaccuuggcugca

SEQ ID NO: 1186549 - RNA, 18 nt, Human
gacggagucccaccuugg

SEQ ID NO: 1186550 - RNA, 17 nt, Human
gacguguuaugacucca

SEQ ID NO: 1186551 - RNA, 20 nt, Human
gacguguuaugacuccagaa

SEQ ID NO: 1186552 - RNA, 14 nt, Human
gacucauucuucug

SEQ ID NO: 1186553 - RNA, 15 nt, Human
gacuccugcaggcag

SEQ ID NO: 1186554 - RNA, 16 nt, Human
gacuccugcaggcagc

SEQ ID NO: 1186555 - RNA, 22 nt, Human
gacguguuaugacuccagaauu

SEQ ID NO: 1186556 - RNA, 12 nt, Human
gacuacaggcac

SEQ ID NO: 1186557 - RNA, 17 nt, Human
gacuacucccccaggug

SEQ ID NO: 1186558 - RNA, 14 nt, Human
gagacucugucuca

SEQ ID NO: 1186559 - RNA, 12 nt, Human
gagaccaucccu

SEQ ID NO: 1186560 - RNA, 16 nt, Human
gagacucgcgacaaug

SEQ ID NO: 1186561 - RNA, 18 nt, Human
gagacucgcgacaaugca

SEQ ID NO: 1186562 - RNA, 14 nt, Human
gagacagcccgggc

SEQ ID NO: 1186563 - RNA, 17 nt, Human
gagacagcccgggcucu

SEQ ID NO: 1186564 - RNA, 18 nt, Human
gagacagcccgggcucug

SEQ ID NO: 1186565 - RNA, 19 nt, Human
gagacagcccgggcucugc

SEQ ID NO: 1186566 - RNA, 20 nt, Human
gagacagcccgggcucugcc

SEQ ID NO: 1186567 - RNA, 21 nt, Human
gagacagcccgggcucugccu

SEQ ID NO: 1186568 - RNA, 22 nt, Human
gagacagcccgggcucugccuc

SEQ ID NO: 1186569 - RNA, 23 nt, Human
gagacagcccgggcucugccucc

SEQ ID NO: 1186570 - RNA, 24 nt, Human
gagacagcccgggcucugccuccc

SEQ ID NO: 1186571 - RNA, 13 nt, Human
gagacagcucugc

SEQ ID NO: 1186572 - RNA, 15 nt, Human
gagacagcucugcau

SEQ ID NO: 1186573 - RNA, 18 nt, Human
gagacagcucugcauacu

SEQ ID NO: 1186574 - RNA, 19 nt, Human
gagagugaacaaauuuaca

SEQ ID NO: 1186575 - RNA, 17 nt, Human
gagauacagaauuuuau

SEQ ID NO: 1186576 - RNA, 15 nt, Human
gagagugaacaaauu

SEQ ID NO: 1186577 - RNA, 13 nt, Human
gagagccuuccag

SEQ ID NO: 1186578 - RNA, 14 nt, Human
gagagccuuccagg

SEQ ID NO: 1186579 - RNA, 13 nt, Human
gagaggggaacag

SEQ ID NO: 1186580 - RNA, 18 nt, Human
gagaggggaacagacugg

SEQ ID NO: 1186581 - RNA, 21 nt, Human
gagagggugggagugggccca

SEQ ID NO: 1186582 - RNA, 11 nt, Human
gagagaaaaua

SEQ ID NO: 1186583 - RNA, 12 nt, Human
gagagaaaauaa

SEQ ID NO: 1186584 - RNA, 17 nt, Human
gagagaagagaaugcac

SEQ ID NO: 1186585 - RNA, 14 nt, Human
gagagaaaauaaaa

SEQ ID NO: 1186586 - RNA, 13 nt, Human
gagagaaaauaaa

SEQ ID NO: 1186587 - RNA, 19 nt, Human
gagagacacacugaagaag

SEQ ID NO: 1186588 - RNA, 17 nt, Human
gacuccugcaggcagcc

SEQ ID NO: 1186589 - RNA, 18 nt, Human
gacuccugcaggcagcca

SEQ ID NO: 1186590 - RNA, 19 nt, Human
gacucgcgacaaugcaaac

SEQ ID NO: 1186591 - RNA, 14 nt, Human
gacuuggaagcucc

SEQ ID NO: 1186592 - RNA, 15 nt, Human
gacuuggaagcuccg

SEQ ID NO: 1186593 - RNA, 16 nt, Human
gacuuggaagcuccgc

SEQ ID NO: 1186594 - RNA, 19 nt, Human
gacuugugacgguguaccu

SEQ ID NO: 1186595 - RNA, 18 nt, Human
gagaaaauaaaaaguuaa

SEQ ID NO: 1186596 - RNA, 21 nt, Human
gagaaaauggacguguuauga

SEQ ID NO: 1186597 - RNA, 19 nt, Human
gagaaaauaaaaaguuaaa

SEQ ID NO: 1186598 - RNA, 16 nt, Human
gagaaacagccugugu

SEQ ID NO: 1186599 - RNA, 23 nt, Human
gagaaaguacuucuccacccugc

SEQ ID NO: 1186600 - RNA, 14 nt, Human
gagaagaacugaaa

SEQ ID NO: 1186601 - RNA, 16 nt, Human
gagaagaacugaaauc

SEQ ID NO: 1186602 - RNA, 20 nt, Human
gagaaugcacaaacagaggc

SEQ ID NO: 1186603 - RNA, 21 nt, Human
gagaaugcacaaacagaggcc

SEQ ID NO: 1186604 - RNA, 22 nt, Human
gagaaugcacaaacagaggccg

SEQ ID NO: 1186605 - RNA, 15 nt, Human
gagacacaagccuuc

SEQ ID NO: 1186606 - RNA, 17 nt, Human
gagacacaagccuucgg

SEQ ID NO: 1186607 - RNA, 18 nt, Human
gagacacacugaagaagc

SEQ ID NO: 1186608 - RNA, 19 nt, Human
gagacagaguuuucacucu

SEQ ID NO: 1186609 - RNA, 12 nt, Human
gagacagcccgg

SEQ ID NO: 1186610 - RNA, 19 nt, Human
gagccucagcauccuggca

SEQ ID NO: 1186611 - RNA, 17 nt, Human
gagccucagcauccugg

SEQ ID NO: 1186612 - RNA, 14 nt, Human
gagccucagcaucc

SEQ ID NO: 1186613 - RNA, 15 nt, Human
gagccucagcauccu

SEQ ID NO: 1186614 - RNA, 13 nt, Human
gagccucagcauc

SEQ ID NO: 1186615 - RNA, 13 nt, Human
gagccuccugccc

SEQ ID NO: 1186616 - RNA, 12 nt, Human
gagccugcaguu

SEQ ID NO: 1186617 - RNA, 11 nt, Human
gagcccacgcc

SEQ ID NO: 1186618 - RNA, 14 nt, Human
gagccagggucuca

SEQ ID NO: 1186619 - RNA, 19 nt, Human
gagccgagaucacgccacu

SEQ ID NO: 1186620 - RNA, 20 nt, Human
gagccgagaucacgccacug

SEQ ID NO: 1186621 - RNA, 21 nt, Human
gagccgagaucacgccacugc

SEQ ID NO: 1186622 - RNA, 22 nt, Human
gagccgagaucacgccacugca

SEQ ID NO: 1186623 - RNA, 20 nt, Human
gagauagccaaggccaaagg

SEQ ID NO: 1186624 - RNA, 21 nt, Human
gagauagccaaggccaaagga

SEQ ID NO: 1186625 - RNA, 17 nt, Human
gagcagagaccaucccu

SEQ ID NO: 1186626 - RNA, 18 nt, Human
gagcagagaccaucccug

SEQ ID NO: 1186627 - RNA, 19 nt, Human
gagcagagaccaucccuga

SEQ ID NO: 1186628 - RNA, 21 nt, Human
gagcagagaccaucccugaag

SEQ ID NO: 1186629 - RNA, 23 nt, Human
gagcagagaccaucccugaaggc

SEQ ID NO: 1186630 - RNA, 22 nt, Human
gagcagccacauuccugaugcu

SEQ ID NO: 1186631 - RNA, 18 nt, Human
gagccacugcaccgggcc

SEQ ID NO: 1186632 - RNA, 19 nt, Human
gagccacugcaccgggcca

SEQ ID NO: 1186633 - RNA, 20 nt, Human
gagccacugcaccgggccac

SEQ ID NO: 1186634 - RNA, 15 nt, Human
gagccagauuucacu

SEQ ID NO: 1186635 - RNA, 18 nt, Human
gagccagauuucacucuc

SEQ ID NO: 1186636 - RNA, 19 nt, Human
gagccagauuucacucucc

SEQ ID NO: 1186637 - RNA, 20 nt, Human
gagccagauuucacucuccu

SEQ ID NO: 1186638 - RNA, 13 nt, Human
gagcccaccuugg

SEQ ID NO: 1186639 - RNA, 15 nt, Human
gagcccaccuuggcu

SEQ ID NO: 1186640 - RNA, 17 nt, Human
gagcccaccuuggcuca

SEQ ID NO: 1186641 - RNA, 16 nt, Human
gaggaaagcaaaggag

SEQ ID NO: 1186642 - RNA, 17 nt, Human
gaggaaagcaaaggaga

SEQ ID NO: 1186643 - RNA, 15 nt, Human
gagcugccuguucag

SEQ ID NO: 1186644 - RNA, 22 nt, Human
gagcuuucugcuaucaaagagg

SEQ ID NO: 1186645 - RNA, 20 nt, Human
gagcuuugaaaauucagugg

SEQ ID NO: 1186646 - RNA, 14 nt, Human
gaggaacaaggcaa

SEQ ID NO: 1186647 - RNA, 16 nt, Human
gaggaacaaggcaagg

SEQ ID NO: 1186648 - RNA, 17 nt, Human
gaggaagagaaaaaaua

SEQ ID NO: 1186649 - RNA, 13 nt, Human
gaggaagccgcug

SEQ ID NO: 1186650 - RNA, 14 nt, Human
gaggaagccgcugg

SEQ ID NO: 1186651 - RNA, 17 nt, Human
gaggaagccgcuggggc

SEQ ID NO: 1186652 - RNA, 18 nt, Human
gaggaagccgcuggggcc

SEQ ID NO: 1186653 - RNA, 15 nt, Human
gagccugcaguuauu

SEQ ID NO: 1186654 - RNA, 15 nt, Human
gagcuagcagcaggg

SEQ ID NO: 1186655 - RNA, 17 nt, Human
gagcuagcagcagggag

SEQ ID NO: 1186656 - RNA, 16 nt, Human
gagcucgugggacagu

SEQ ID NO: 1186657 - RNA, 15 nt, Human
gagcugaguggggga

SEQ ID NO: 1186658 - RNA, 18 nt, Human
gauaauacaccacuacau

SEQ ID NO: 1186659 - RNA, 21 nt, Human
gauaauacaccacuacauucu

SEQ ID NO: 1186660 - RNA, 22 nt, Human
gauaauacaccacuacauucug

SEQ ID NO: 1186661 - RNA, 18 nt, Human
gauacaggaaaagcugcu

SEQ ID NO: 1186662 - RNA, 19 nt, Human
gauacaggaaaagcugcug

SEQ ID NO: 1186663 - RNA, 21 nt, Human
gauagcacagacccugcccug

SEQ ID NO: 1186664 - RNA, 22 nt, Human
gauagcacagacccugcccugu

SEQ ID NO: 1186665 - RNA, 13 nt, Human
gaggaaggaaacc

SEQ ID NO: 1186666 - RNA, 19 nt, Human
gaggaaggaaacccagcuc

SEQ ID NO: 1186667 - RNA, 20 nt, Human
gaggaaggaaacccagcucu

SEQ ID NO: 1186668 - RNA, 21 nt, Human
gaggaaggaaacccagcucug

SEQ ID NO: 1186669 - RNA, 22 nt, Human
gauaaauaguuuaugauuccac

SEQ ID NO: 1186670 - RNA, 17 nt, Human
gaucauccacugugcca

SEQ ID NO: 1186671 - RNA, 19 nt, Human
gaucauccacugugccaug

SEQ ID NO: 1186672 - RNA, 21 nt, Human
gaucauccacugugccaugug

SEQ ID NO: 1186673 - RNA, 18 nt, Human
gaucacgccacugcacua

SEQ ID NO: 1186674 - RNA, 12 nt, Human
gaucacggcuca

SEQ ID NO: 1186675 - RNA, 12 nt, Human
gaucagccuggg

SEQ ID NO: 1186676 - RNA, 15 nt, Human
gaucagccugggcaa

SEQ ID NO: 1186677 - RNA, 22 nt, Human
gaucagucugauucccaagcuc

SEQ ID NO: 1186678 - RNA, 18 nt, Human
gaucuuugcagacaggca

SEQ ID NO: 1186679 - RNA, 15 nt, Human
gaucccucauccuca

SEQ ID NO: 1186680 - RNA, 16 nt, Human
gaucccucauccucau

SEQ ID NO: 1186681 - RNA, 22 nt, Human
gauccugagccagauuucacuc

SEQ ID NO: 1186682 - RNA, 13 nt, Human
gauccuggaaauc

SEQ ID NO: 1186683 - RNA, 21 nt, Human
gauggcuaguaucaaaagaaa

SEQ ID NO: 1186684 - RNA, 13 nt, Human
gauggggcccugc

SEQ ID NO: 1186685 - RNA, 14 nt, Human
gauggggcccugcc

SEQ ID NO: 1186686 - RNA, 22 nt, Human
gauggggcccugccuccuuugu

SEQ ID NO: 1186687 - RNA, 18 nt, Human
gaugccugguggcagcug

SEQ ID NO: 1186688 - RNA, 19 nt, Human
gaugccugguggcagcugc

SEQ ID NO: 1186689 - RNA, 20 nt, Human
gaugccugguggcagcugcg

SEQ ID NO: 1186690 - RNA, 22 nt, Human
gauggauuuccagccaaagccu

SEQ ID NO: 1186691 - RNA, 22 nt, Human
gaugcacagaguuguuacauuu

SEQ ID NO: 1186692 - RNA, 13 nt, Human
gaugcaccagccc

SEQ ID NO: 1186693 - RNA, 14 nt, Human
gaugcaccagcccu

SEQ ID NO: 1186694 - RNA, 12 nt, Human
gaugcagccuca

SEQ ID NO: 1186695 - RNA, 14 nt, Human
gaugcagccucaca

SEQ ID NO: 1186696 - RNA, 19 nt, Human
gaugcagccucacaguccu

SEQ ID NO: 1186697 - RNA, 17 nt, Human
gauucauauuuacuucu

SEQ ID NO: 1186698 - RNA, 18 nt, Human
gauucauauuuacuucuu

SEQ ID NO: 1186699 - RNA, 19 nt, Human
gauucauauuuacuucuua

SEQ ID NO: 1186700 - RNA, 24 nt, Human
gauggggcccugccuccuuuguga

SEQ ID NO: 1186701 - RNA, 23 nt, Human
gauggggcugcaccggcuggccu

SEQ ID NO: 1186702 - RNA, 19 nt, Human
gauucagacagcugccugg

SEQ ID NO: 1186703 - RNA, 13 nt, Human
gauucagcucugc

SEQ ID NO: 1186704 - RNA, 15 nt, Human
gauucagcucugcaa

SEQ ID NO: 1186705 - RNA, 19 nt, Human
gauucccaagcucugcucc

SEQ ID NO: 1186706 - RNA, 20 nt, Human
gauucccaagcucugcuccu

SEQ ID NO: 1186707 - RNA, 21 nt, Human
gauucccaagcucugcuccuc

SEQ ID NO: 1186708 - RNA, 16 nt, Human
gauucuuuccugaggc

SEQ ID NO: 1186709 - RNA, 17 nt, Human
gauucuuuccugaggcu

SEQ ID NO: 1186710 - RNA, 18 nt, Human
gauucuuuccugaggcug

SEQ ID NO: 1186711 - RNA, 20 nt, Human
gauugcaacaggcugggcuu

SEQ ID NO: 1186712 - RNA, 21 nt, Human
gauugcaacaggcugggcuuc

SEQ ID NO: 1186713 - RNA, 19 nt, Human
gauucuuuccugaggcugg

SEQ ID NO: 1186714 - RNA, 16 nt, Human
gauugcaccacugcac

SEQ ID NO: 1186715 - RNA, 23 nt, Human
gauugcaccacugcacuccagcc

SEQ ID NO: 1186716 - RNA, 15 nt, Human
gauuuccguuaaaau

SEQ ID NO: 1186717 - RNA, 18 nt, Human
gauuuccguuaaaauacc

SEQ ID NO: 1186718 - RNA, 11 nt, Human
gauuucuguuu

SEQ ID NO: 1186719 - RNA, 19 nt, Human
gauuucuguuuagauaaua

SEQ ID NO: 1186720 - RNA, 21 nt, Human
gauuucuguuuagauaauaca

SEQ ID NO: 1186721 - RNA, 19 nt, Human
gauuuguuaaugauagcua

SEQ ID NO: 1186722 - RNA, 15 nt, Human
gauuuuccugaaaac

SEQ ID NO: 1186723 - RNA, 16 nt, Human
gcaaaguaucccuacu

SEQ ID NO: 1186724 - RNA, 17 nt, Human
gcaagaauugaagcagg

SEQ ID NO: 1186725 - RNA, 14 nt, Human
gcaagacgcugugc

SEQ ID NO: 1186726 - RNA, 20 nt, Human
gcaagacgcugugcugcccu

SEQ ID NO: 1186727 - RNA, 21 nt, Human
gcaagacgcugugcugcccug

SEQ ID NO: 1186728 - RNA, 22 nt, Human
gcaagacgcugugcugcccugc

SEQ ID NO: 1186729 - RNA, 23 nt, Human
gcaagacgcugugcugcccugcc

SEQ ID NO: 1186730 - RNA, 10 nt, Human
gcaagccaga

SEQ ID NO: 1186731 - RNA, 18 nt, Human
gcaaggagauuuacaacu

SEQ ID NO: 1186732 - RNA, 11 nt, Human
gcaaggcuguc

SEQ ID NO: 1186733 - RNA, 13 nt, Human
gcaaggcugucaa

SEQ ID NO: 1186734 - RNA, 14 nt, Human
gcaaggucauuuuu

SEQ ID NO: 1186735 - RNA, 15 nt, Human
gcaaucaaaucugcu

SEQ ID NO: 1186736 - RNA, 17 nt, Human
gcaaucaaaucugcuuu

SEQ ID NO: 1186737 - RNA, 17 nt, Human
gcaaugaccuuucaaua

SEQ ID NO: 1186738 - RNA, 20 nt, Human
gcaaugaccuuucaauagga

SEQ ID NO: 1186739 - RNA, 22 nt, Human
gcaaugaccuuucaauaggaaa

SEQ ID NO: 1186740 - RNA, 23 nt, Human
gcaaugaccuuucaauaggaaaa

SEQ ID NO: 1186741 - RNA, 13 nt, Human
gcaaugcuggcug

SEQ ID NO: 1186742 - RNA, 14 nt, Human
gcaaugcuggcugu

SEQ ID NO: 1186743 - RNA, 22 nt, Human
gcaaugcuggcuguuggcuggg

SEQ ID NO: 1186744 - RNA, 23 nt, Human
gcaaugcuggcuguuggcugggg

SEQ ID NO: 1186745 - RNA, 22 nt, Human
gcacugcuuccagugaggcucu

SEQ ID NO: 1186746 - RNA, 20 nt, Human
gcacugcuuccagugaggcu

SEQ ID NO: 1186747 - RNA, 16 nt, Human
gcacugcuuccaguga

SEQ ID NO: 1186748 - RNA, 18 nt, Human
gcacugcuuccagugagg

SEQ ID NO: 1186749 - RNA, 12 nt, Human
gcagacaggacc

SEQ ID NO: 1186750 - RNA, 13 nt, Human
gcagacaggacca

SEQ ID NO: 1186751 - RNA, 15 nt, Human
gcagacaggaccagg

SEQ ID NO: 1186752 - RNA, 18 nt, Human
gcagacaggaccagggau

SEQ ID NO: 1186753 - RNA, 19 nt, Human
gcagacaggcaagcaccuc

SEQ ID NO: 1186754 - RNA, 23 nt, Human
gcagacaggcaagcaccuccugc

SEQ ID NO: 1186755 - RNA, 12 nt, Human
gcaauggcagcc

SEQ ID NO: 1186756 - RNA, 13 nt, Human
gcaauggcagccu

SEQ ID NO: 1186757 - RNA, 14 nt, Human
gcaauggcagccuu

SEQ ID NO: 1186758 - RNA, 21 nt, Human
gcaccacugcacuccagccug

SEQ ID NO: 1186759 - RNA, 22 nt, Human
gcaccacugcacuccagccugg

SEQ ID NO: 1186760 - RNA, 15 nt, Human
gcaccagcagccugg

SEQ ID NO: 1186761 - RNA, 16 nt, Human
gcaccagcagccugga

SEQ ID NO: 1186762 - RNA, 22 nt, Human
gcacccaccaucaugucuggcu

SEQ ID NO: 1186763 - RNA, 19 nt, Human
gcacccggccccugcuggu

SEQ ID NO: 1186764 - RNA, 15 nt, Human
gcacccucaggcagg

SEQ ID NO: 1186765 - RNA, 16 nt, Human
gcacccucaggcaggu

SEQ ID NO: 1186766 - RNA, 21 nt, Human
gcaccuggaauauauaaccag

SEQ ID NO: 1186767 - RNA, 22 nt, Human
gcaccuggaauauauaaccagu

SEQ ID NO: 1186768 - RNA, 14 nt, Human
gcaccuuagacagu

SEQ ID NO: 1186769 - RNA, 17 nt, Human
gcaccuuagacaguccc

SEQ ID NO: 1186770 - RNA, 18 nt, Human
gcaccuuagacagucccu

SEQ ID NO: 1186771 - RNA, 19 nt, Human
gcaccuuagacagucccug

SEQ ID NO: 1186772 - RNA, 12 nt, Human
gcacgauuucug

SEQ ID NO: 1186773 - RNA, 13 nt, Human
gcacgauuucugu

SEQ ID NO: 1186774 - RNA, 14 nt, Human
gcagcccugcagag

SEQ ID NO: 1186775 - RNA, 15 nt, Human
gcagcccugcagagg

SEQ ID NO: 1186776 - RNA, 16 nt, Human
gcagcccugcagaggg

SEQ ID NO: 1186777 - RNA, 17 nt, Human
gcagcccugcagagggc

SEQ ID NO: 1186778 - RNA, 15 nt, Human
gcagccuuggcaaac

SEQ ID NO: 1186779 - RNA, 14 nt, Human
gcagcucaccucuc

SEQ ID NO: 1186780 - RNA, 15 nt, Human
gcagcucaccucucc

SEQ ID NO: 1186781 - RNA, 23 nt, Human
gcaggaggaucacuugaguccag

SEQ ID NO: 1186782 - RNA, 12 nt, Human
gcaggcagccag

SEQ ID NO: 1186783 - RNA, 13 nt, Human
gcaggcagccagg

SEQ ID NO: 1186784 - RNA, 14 nt, Human
gcaggcagccaggc

SEQ ID NO: 1186785 - RNA, 20 nt, Human
gcagccccgugggguuccuc

SEQ ID NO: 1186786 - RNA, 20 nt, Human
gcagccccuguucuggcaga

SEQ ID NO: 1186787 - RNA, 21 nt, Human
gcagccccuguucuggcagag

SEQ ID NO: 1186788 - RNA, 13 nt, Human
gcagcccugcaga

SEQ ID NO: 1186789 - RNA, 16 nt, Human
gcagcaauaaagcagc

SEQ ID NO: 1186790 - RNA, 23 nt, Human
gcagcaauaaagcagcguuucua

SEQ ID NO: 1186791 - RNA, 18 nt, Human
gcagccccauucugccug

SEQ ID NO: 1186792 - RNA, 19 nt, Human
gcagccccauucugccugc

SEQ ID NO: 1186793 - RNA, 21 nt, Human
gcagccccauucugccugccc

SEQ ID NO: 1186794 - RNA, 24 nt, Human
gcagccccauucugccugcccagg

SEQ ID NO: 1186795 - RNA, 17 nt, Human
gcagacaguuaagagaa

SEQ ID NO: 1186796 - RNA, 21 nt, Human
gcagaguugaagacagagcua

SEQ ID NO: 1186797 - RNA, 18 nt, Human
gcagauaaacaguaguga

SEQ ID NO: 1186798 - RNA, 22 nt, Human
gcagauacaggaaaagcugcug

SEQ ID NO: 1186799 - RNA, 15 nt, Human
gcauguucucugagg

SEQ ID NO: 1186800 - RNA, 21 nt, Human
gcauguucucugaggacacua

SEQ ID NO: 1186801 - RNA, 22 nt, Human
gcauguucucugaggacacuaa

SEQ ID NO: 1186802 - RNA, 13 nt, Human
gcauuauauuuau

SEQ ID NO: 1186803 - RNA, 18 nt, Human
gcaugcgggcuuccuccu

SEQ ID NO: 1186804 - RNA, 18 nt, Human
gcaugaaguaauaugcac

SEQ ID NO: 1186805 - RNA, 19 nt, Human
gcauuaucuagauacugua

SEQ ID NO: 1186806 - RNA, 17 nt, Human
gcauuaucuagauacug

SEQ ID NO: 1186807 - RNA, 13 nt, Human
gcauuugcugaau

SEQ ID NO: 1186808 - RNA, 14 nt, Human
gcauuugcugaaua

SEQ ID NO: 1186809 - RNA, 17 nt, Human
gcauuugcugaauacag

SEQ ID NO: 1186810 - RNA, 16 nt, Human
gcauuuguuugaacug

SEQ ID NO: 1186811 - RNA, 18 nt, Human
gcauuuguuugaacugau

SEQ ID NO: 1186812 - RNA, 14 nt, Human
gccaaacucaccug

SEQ ID NO: 1186813 - RNA, 16 nt, Human
gccaaacucaccugcc

SEQ ID NO: 1186814 - RNA, 19 nt, Human
gccaaacucaccugccccu

SEQ ID NO: 1186815 - RNA, 20 nt, Human
gccaaagccaaagcuaggcc

SEQ ID NO: 1186816 - RNA, 16 nt, Human
gccaaagccuccucca

SEQ ID NO: 1186817 - RNA, 19 nt, Human
gccaaagccuccuccagcc

SEQ ID NO: 1186818 - RNA, 16 nt, Human
gccaaagcuaggccug

SEQ ID NO: 1186819 - RNA, 22 nt, Human
gccaaagcuaggccuggccaga

SEQ ID NO: 1186820 - RNA, 12 nt, Human
gccaaaggaagc

SEQ ID NO: 1186821 - RNA, 17 nt, Human
gcauagguuuaauaauu

SEQ ID NO: 1186822 - RNA, 13 nt, Human
gcauagaaguaaa

SEQ ID NO: 1186823 - RNA, 17 nt, Human
gcaguucugaagaagau

SEQ ID NO: 1186824 - RNA, 17 nt, Human
gcaguuauuaacacuaa

SEQ ID NO: 1186825 - RNA, 15 nt, Human
gcaguucugaagaag

SEQ ID NO: 1186826 - RNA, 13 nt, Human
gcagugggagcug

SEQ ID NO: 1186827 - RNA, 14 nt, Human
gcagugggagcugc

SEQ ID NO: 1186828 - RNA, 15 nt, Human
gcagugggagcugcc

SEQ ID NO: 1186829 - RNA, 23 nt, Human
gcaguggugguuuucuguucuuu

SEQ ID NO: 1186830 - RNA, 15 nt, Human
gcaggcagccaggcc

SEQ ID NO: 1186831 - RNA, 16 nt, Human
gcaggcagccaggcca

SEQ ID NO: 1186832 - RNA, 17 nt, Human
gcaggcagccaggccac

SEQ ID NO: 1186833 - RNA, 19 nt, Human
gcagggcucagcggggaca

SEQ ID NO: 1186834 - RNA, 21 nt, Human
gcagggcucagcggggacagc

SEQ ID NO: 1186835 - RNA, 22 nt, Human
gcagggcucagcggggacagcu

SEQ ID NO: 1186836 - RNA, 18 nt, Human
gcagggucucacucuguc

SEQ ID NO: 1186837 - RNA, 22 nt, Human
gcagguccaggguuugaguuca

SEQ ID NO: 1186838 - RNA, 19 nt, Human
gcaggucuugaacuccugg

SEQ ID NO: 1186839 - RNA, 20 nt, Human
gcaggucuugaacuccuggc

SEQ ID NO: 1186840 - RNA, 15 nt, Human
gcagugcaugcuguc

SEQ ID NO: 1186841 - RNA, 16 nt, Human
gcagugcaugcugucc

SEQ ID NO: 1186842 - RNA, 24 nt, Human
gccaaggccaaaggaagcacaugc

SEQ ID NO: 1186843 - RNA, 20 nt, Human
gccaaggccaaaggaagcac

SEQ ID NO: 1186844 - RNA, 20 nt, Human
gccacugcaccgggccacag

SEQ ID NO: 1186845 - RNA, 21 nt, Human
gccacugcaccgggccacaga

SEQ ID NO: 1186846 - RNA, 22 nt, Human
gccacugcaccgggccacagag

SEQ ID NO: 1186847 - RNA, 21 nt, Human
gccagagacacaagccuucgg

SEQ ID NO: 1186848 - RNA, 22 nt, Human
gccagagacacaagccuucggc

SEQ ID NO: 1186849 - RNA, 17 nt, Human
gccagagggagugacag

SEQ ID NO: 1186850 - RNA, 14 nt, Human
gccagaugcaccag

SEQ ID NO: 1186851 - RNA, 15 nt, Human
gccagaugcaccagc

SEQ ID NO: 1186852 - RNA, 20 nt, Human
gccagauucuuuccugaggc

SEQ ID NO: 1186853 - RNA, 24 nt, Human
gccagauucuuuccugaggcuggg

SEQ ID NO: 1186854 - RNA, 13 nt, Human
gccagauuucacu

SEQ ID NO: 1186855 - RNA, 16 nt, Human
gccagauuucacucuc

SEQ ID NO: 1186856 - RNA, 22 nt, Human
gccagccgagauagccaaggcc

SEQ ID NO: 1186857 - RNA, 17 nt, Human
gccagcugcuugggcuu

SEQ ID NO: 1186858 - RNA, 18 nt, Human
gccagcugcuugggcuuc

SEQ ID NO: 1186859 - RNA, 20 nt, Human
gccagcugcuugggcuucau

SEQ ID NO: 1186860 - RNA, 12 nt, Human
gccaggaagcca

SEQ ID NO: 1186861 - RNA, 13 nt, Human
gccaggaagccag

SEQ ID NO: 1186862 - RNA, 14 nt, Human
gccaggaagccagc

SEQ ID NO: 1186863 - RNA, 15 nt, Human
gccaggaagccagca

SEQ ID NO: 1186864 - RNA, 14 nt, Human
gccaggagccuccu

SEQ ID NO: 1186865 - RNA, 16 nt, Human
gccaggagccuccugc

SEQ ID NO: 1186866 - RNA, 19 nt, Human
gccaggagccuccugcccu

SEQ ID NO: 1186867 - RNA, 20 nt, Human
gccaggagccuccugcccuu

SEQ ID NO: 1186868 - RNA, 24 nt, Human
gccaugcuccuggcccacugcauc

SEQ ID NO: 1186869 - RNA, 15 nt, Human
gccaugggccuccug

SEQ ID NO: 1186870 - RNA, 16 nt, Human
gccaugggccuccugu

SEQ ID NO: 1186871 - RNA, 15 nt, Human
gcccaccuggccucu

SEQ ID NO: 1186872 - RNA, 16 nt, Human
gcccaccuggccucug

SEQ ID NO: 1186873 - RNA, 17 nt, Human
gcccaccuggccucugc

SEQ ID NO: 1186874 - RNA, 20 nt, Human
gcccaccuggccucugcacu

SEQ ID NO: 1186875 - RNA, 21 nt, Human
gcccaccuggccucugcacuc

SEQ ID NO: 1186876 - RNA, 24 nt, Human
gcccaccuggccucugcacucccc

SEQ ID NO: 1186877 - RNA, 13 nt, Human
gcccaccuuggcu

SEQ ID NO: 1186878 - RNA, 15 nt, Human
gcccaccuuggcuca

SEQ ID NO: 1186879 - RNA, 16 nt, Human
gcccaccuuggcucaa

SEQ ID NO: 1186880 - RNA, 17 nt, Human
gcccaccuuggcucaag

SEQ ID NO: 1186881 - RNA, 13 nt, Human
gccaggcuggucu

SEQ ID NO: 1186882 - RNA, 15 nt, Human
gccaggcuggucuca

SEQ ID NO: 1186883 - RNA, 23 nt, Human
gccaguaaaugggggugcauuug

SEQ ID NO: 1186884 - RNA, 14 nt, Human
gccauccagguuca

SEQ ID NO: 1186885 - RNA, 14 nt, Human
gccaugcuccuggc

SEQ ID NO: 1186886 - RNA, 13 nt, Human
gcccaggccuccu

SEQ ID NO: 1186887 - RNA, 21 nt, Human
gcccagagaggguggugaccu

SEQ ID NO: 1186888 - RNA, 23 nt, Human
gcccaggccccugccacccuggg

SEQ ID NO: 1186889 - RNA, 12 nt, Human
gcccaggcuggc

SEQ ID NO: 1186890 - RNA, 18 nt, Human
gccccaucccaaacccuu

SEQ ID NO: 1186891 - RNA, 13 nt, Human
gccccagugccca

SEQ ID NO: 1186892 - RNA, 14 nt, Human
gccccagugcccac

SEQ ID NO: 1186893 - RNA, 15 nt, Human
gccccagugcccaca

SEQ ID NO: 1186894 - RNA, 12 nt, Human
gccccagugccc

SEQ ID NO: 1186895 - RNA, 13 nt, Human
gccccauccucug

SEQ ID NO: 1186896 - RNA, 14 nt, Human
gccccauccucugu

SEQ ID NO: 1186897 - RNA, 22 nt, Human
gccccauccucuguacagagcc

SEQ ID NO: 1186898 - RNA, 14 nt, Human
gccccauucugccu

SEQ ID NO: 1186899 - RNA, 15 nt, Human
gccccauucugccug

SEQ ID NO: 1186900 - RNA, 17 nt, Human
gccccuguucuggcaga

SEQ ID NO: 1186901 - RNA, 16 nt, Human
gccccucagggucccu

SEQ ID NO: 1186902 - RNA, 18 nt, Human
gccccucagggucccugg

SEQ ID NO: 1186903 - RNA, 15 nt, Human
gccccgaggccuucu

SEQ ID NO: 1186904 - RNA, 18 nt, Human
gccccgaggccuucucug

SEQ ID NO: 1186905 - RNA, 22 nt, Human
gccccgaggccuucucugaagg

SEQ ID NO: 1186906 - RNA, 14 nt, Human
gccccucagggucc

SEQ ID NO: 1186907 - RNA, 22 nt, Human
gcccuccaagaccuucuccuuc

SEQ ID NO: 1186908 - RNA, 23 nt, Human
gcccuccaagaccuucuccuuca

SEQ ID NO: 1186909 - RNA, 12 nt, Human
gcccgggcucug

SEQ ID NO: 1186910 - RNA, 19 nt, Human
gcccuccaagaccuucucc

SEQ ID NO: 1186911 - RNA, 21 nt, Human
gcccuccaagaccuucuccuu

SEQ ID NO: 1186912 - RNA, 13 nt, Human
gcccucugcccac

SEQ ID NO: 1186913 - RNA, 16 nt, Human
gcccucugcccacucc

SEQ ID NO: 1186914 - RNA, 18 nt, Human
gcccucugcccacucccu

SEQ ID NO: 1186915 - RNA, 19 nt, Human
gcccucugcccacucccug

SEQ ID NO: 1186916 - RNA, 14 nt, Human
gcccugagcuuucu

SEQ ID NO: 1186917 - RNA, 13 nt, Human
gcccugcagaggg

SEQ ID NO: 1186918 - RNA, 14 nt, Human
gcccugcagagggc

SEQ ID NO: 1186919 - RNA, 15 nt, Human
gcccugcagagggca

SEQ ID NO: 1186920 - RNA, 16 nt, Human
gcccugcagagggcac

SEQ ID NO: 1186921 - RNA, 21 nt, Human
gccgggcgcgguggcucacgc

SEQ ID NO: 1186922 - RNA, 20 nt, Human
gccgggcgugguggugagug

SEQ ID NO: 1186923 - RNA, 20 nt, Human
gccgagaucacgccacugca

SEQ ID NO: 1186924 - RNA, 21 nt, Human
gccgagaucacgccacugcac

SEQ ID NO: 1186925 - RNA, 22 nt, Human
gccgagaucacgccacugcacu

SEQ ID NO: 1186926 - RNA, 17 nt, Human
gccgagauugcaccacu

SEQ ID NO: 1186927 - RNA, 11 nt, Human
gccgcagcccu

SEQ ID NO: 1186928 - RNA, 12 nt, Human
gccgcagcccug

SEQ ID NO: 1186929 - RNA, 13 nt, Human
gccgcagcccugc

SEQ ID NO: 1186930 - RNA, 14 nt, Human
gcccuucucuccag

SEQ ID NO: 1186931 - RNA, 16 nt, Human
gcccuucucuccagcc

SEQ ID NO: 1186932 - RNA, 17 nt, Human
gcccuucucuccagccc

SEQ ID NO: 1186933 - RNA, 18 nt, Human
gcccuucucuccagcccc

SEQ ID NO: 1186934 - RNA, 18 nt, Human
gccgucuaccugaggggc

SEQ ID NO: 1186935 - RNA, 20 nt, Human
gccguguaaccauggaccca

SEQ ID NO: 1186936 - RNA, 15 nt, Human
gccgucuaccugagg

SEQ ID NO: 1186937 - RNA, 16 nt, Human
gccgucuaccugaggg

SEQ ID NO: 1186938 - RNA, 17 nt, Human
gccgucuaccugagggg

SEQ ID NO: 1186939 - RNA, 18 nt, Human
gccucaaccuccugggcu

SEQ ID NO: 1186940 - RNA, 19 nt, Human
gccucaaccuccugggcua

SEQ ID NO: 1186941 - RNA, 13 nt, Human
gccucacaguccu

SEQ ID NO: 1186942 - RNA, 17 nt, Human
gccucacaguccuuacc

SEQ ID NO: 1186943 - RNA, 17 nt, Human
gccucccaucacccgcu

SEQ ID NO: 1186944 - RNA, 18 nt, Human
gccucccgaguagcuggg

SEQ ID NO: 1186945 - RNA, 19 nt, Human
gccucccgaguagcuggga

SEQ ID NO: 1186946 - RNA, 20 nt, Human
gccucccgaguagcugggac

SEQ ID NO: 1186947 - RNA, 18 nt, Human
gccucacaguccuuacca

SEQ ID NO: 1186948 - RNA, 21 nt, Human
gccucacaguccuuaccagca

SEQ ID NO: 1186949 - RNA, 15 nt, Human
gccucagcauccugg

SEQ ID NO: 1186950 - RNA, 16 nt, Human
gccucagcauccuggc

SEQ ID NO: 1186951 - RNA, 17 nt, Human
gccucagcauccuggca

SEQ ID NO: 1186952 - RNA, 19 nt, Human
gccucccaaagugcuggga

SEQ ID NO: 1186953 - RNA, 13 nt, Human
gccucccaacuca

SEQ ID NO: 1186954 - RNA, 16 nt, Human
gccucccaacucaccc

SEQ ID NO: 1186955 - RNA, 17 nt, Human
gccucccaacucacccc

SEQ ID NO: 1186956 - RNA, 18 nt, Human
gccucccaacucacccca

SEQ ID NO: 1186957 - RNA, 19 nt, Human
gccucccaacucaccccag

SEQ ID NO: 1186958 - RNA, 21 nt, Human
gccucccaacucaccccagcc

SEQ ID NO: 1186959 - RNA, 14 nt, Human
gccucccaucaccc

SEQ ID NO: 1186960 - RNA, 16 nt, Human
gccucccaucacccgc

SEQ ID NO: 1186961 - RNA, 13 nt, Human
gccucucucaggc

SEQ ID NO: 1186962 - RNA, 14 nt, Human
gccucucucaggcc

SEQ ID NO: 1186963 - RNA, 16 nt, Human
gccucucucaggccaa

SEQ ID NO: 1186964 - RNA, 17 nt, Human
gccucugacacacagcu

SEQ ID NO: 1186965 - RNA, 18 nt, Human
gccucugacacacagcuc

SEQ ID NO: 1186966 - RNA, 19 nt, Human
gccucugacacacagcucu

SEQ ID NO: 1186967 - RNA, 20 nt, Human
gccucugacacacagcucug

SEQ ID NO: 1186968 - RNA, 21 nt, Human
gccucugacacacagcucugu

SEQ ID NO: 1186969 - RNA, 14 nt, Human
gccucugcacuccc

SEQ ID NO: 1186970 - RNA, 15 nt, Human
gccucugcacucccc

SEQ ID NO: 1186971 - RNA, 12 nt, Human
gccucugccucu

SEQ ID NO: 1186972 - RNA, 13 nt, Human
gccucugccucug

SEQ ID NO: 1186973 - RNA, 18 nt, Human
gccucugccucugacaca

SEQ ID NO: 1186974 - RNA, 13 nt, Human
gccugcaagggag

SEQ ID NO: 1186975 - RNA, 15 nt, Human
gccugcaagggagug

SEQ ID NO: 1186976 - RNA, 12 nt, Human
gccuuccagggg

SEQ ID NO: 1186977 - RNA, 16 nt, Human
gccuuauggaacacuc

SEQ ID NO: 1186978 - RNA, 18 nt, Human
gccuuauggaacacucug

SEQ ID NO: 1186979 - RNA, 19 nt, Human
gccuuauggaacacucuga

SEQ ID NO: 1186980 - RNA, 20 nt, Human
gccuuauggaacacucugag

SEQ ID NO: 1186981 - RNA, 15 nt, Human
gccuuccaggggugg

SEQ ID NO: 1186982 - RNA, 16 nt, Human
gccuuccagggguggg

SEQ ID NO: 1186983 - RNA, 21 nt, Human
gccuuccaggggugggacacc

SEQ ID NO: 1186984 - RNA, 13 nt, Human
gccuuuggcuuca

SEQ ID NO: 1186985 - RNA, 23 nt, Human
gcgacaaugcaaaccaucauuga

SEQ ID NO: 1186986 - RNA, 22 nt, Human
gccugggggcugggcagaggaa

SEQ ID NO: 1186987 - RNA, 13 nt, Human
gccugguggcagc

SEQ ID NO: 1186988 - RNA, 14 nt, Human
gccugguggcagcu

SEQ ID NO: 1186989 - RNA, 19 nt, Human
gccugguggcagcugcggu

SEQ ID NO: 1186990 - RNA, 21 nt, Human
gccugguggcagcugcggucc

SEQ ID NO: 1186991 - RNA, 20 nt, Human
gccuuacacaaugguuuucu

SEQ ID NO: 1186992 - RNA, 21 nt, Human
gccuuacacaaugguuuucuu

SEQ ID NO: 1186993 - RNA, 18 nt, Human
gccuuacccucauguucu

SEQ ID NO: 1186994 - RNA, 17 nt, Human
gccuuagaagucacaca

SEQ ID NO: 1186995 - RNA, 18 nt, Human
gccuuagaagucacacag

SEQ ID NO: 1186996 - RNA, 19 nt, Human
gccuuagaagucacacagu

SEQ ID NO: 1186997 - RNA, 19 nt, Human
gccuuacccucauguucuu

SEQ ID NO: 1186998 - RNA, 20 nt, Human
gccuuagaagucacacagua

SEQ ID NO: 1186999 - RNA, 10 nt, Human
gccuuaugga

SEQ ID NO: 1187000 - RNA, 14 nt, Human
gccuuauggaacac

SEQ ID NO: 1187001 - RNA, 15 nt, Human
gcggacagccacggc

SEQ ID NO: 1187002 - RNA, 16 nt, Human
gcggacagccacggcc

SEQ ID NO: 1187003 - RNA, 19 nt, Human
gcgucucauacucaccuca

SEQ ID NO: 1187004 - RNA, 12 nt, Human
gcgacagugaga

SEQ ID NO: 1187005 - RNA, 22 nt, Human
gcgacagugagacucugucuca

SEQ ID NO: 1187006 - RNA, 15 nt, Human
gcgccuacaggagug

SEQ ID NO: 1187007 - RNA, 18 nt, Human
gcgccuacaggagugagc

SEQ ID NO: 1187008 - RNA, 11 nt, Human
gcggacagcca

SEQ ID NO: 1187009 - RNA, 13 nt, Human
gcggacagccacg

SEQ ID NO: 1187010 - RNA, 15 nt, Human
gcuaggaacacuccu

SEQ ID NO: 1187011 - RNA, 16 nt, Human
gcuaggaacacuccuu

SEQ ID NO: 1187012 - RNA, 16 nt, Human
gcuaccuuuguauucu

SEQ ID NO: 1187013 - RNA, 20 nt, Human
gcuaccuuuguauucucucc

SEQ ID NO: 1187014 - RNA, 19 nt, Human
gcuagaacucccuuucaac

SEQ ID NO: 1187015 - RNA, 13 nt, Human
gcuaagagggagg

SEQ ID NO: 1187016 - RNA, 20 nt, Human
gcuaagagggagggagggcu

SEQ ID NO: 1187017 - RNA, 21 nt, Human
gcuaagagggagggagggcuc

SEQ ID NO: 1187018 - RNA, 13 nt, Human
gcuacacacugca

SEQ ID NO: 1187019 - RNA, 20 nt, Human
gcuacacacugcauguuugu

SEQ ID NO: 1187020 - RNA, 14 nt, Human
gcuacacaggggaa

SEQ ID NO: 1187021 - RNA, 22 nt, Human
gcuacacaggggaaaagaggag

SEQ ID NO: 1187022 - RNA, 16 nt, Human
guaggguuauaauaau

SEQ ID NO: 1187023 - RNA, 14 nt, Human
guagucaggugccu

SEQ ID NO: 1187024 - RNA, 14 nt, Human
guaguguuggagaa

SEQ ID NO: 1187025 - RNA, 15 nt, Human
guaguguuggagaag

SEQ ID NO: 1187026 - RNA, 17 nt, Human
guaguguuggagaagaa

SEQ ID NO: 1187027 - RNA, 16 nt, Human
guagggcgggaggaug

SEQ ID NO: 1187028 - RNA, 21 nt, Human
guagggcgggaggauguucug

SEQ ID NO: 1187029 - RNA, 22 nt, Human
guagggcgggaggauguucugg

SEQ ID NO: 1187030 - RNA, 23 nt, Human
guagggcgggaggauguucuggg

SEQ ID NO: 1187031 - RNA, 22 nt, Human
guauaugucaagccauaauugu

SEQ ID NO: 1187032 - RNA, 12 nt, Human
guaucugagcag

SEQ ID NO: 1187033 - RNA, 12 nt, Human
guaucuggugac

SEQ ID NO: 1187034 - RNA, 19 nt, Human
guaucuggugacuuuccuc

SEQ ID NO: 1187035 - RNA, 13 nt, Human
guaugaggcauuu

SEQ ID NO: 1187036 - RNA, 15 nt, Human
guaugaggcauuugu

SEQ ID NO: 1187037 - RNA, 22 nt, Human
guaugaucacggcucacugcag

SEQ ID NO: 1187038 - RNA, 21 nt, Human
guaugaucacggcucacugca

SEQ ID NO: 1187039 - RNA, 17 nt, Human
guauguuagugcaaauu

SEQ ID NO: 1187040 - RNA, 20 nt, Human
guaugaucacggcucacugc

SEQ ID NO: 1187041 - RNA, 17 nt, Human
guaugaggcauuuguuu

SEQ ID NO: 1187042 - RNA, 20 nt, Human
guaugaggcauuuguuugaa

SEQ ID NO: 1187043 - RNA, 14 nt, Human
gucagagccugcag

SEQ ID NO: 1187044 - RNA, 15 nt, Human
gucagagccugcagu

SEQ ID NO: 1187045 - RNA, 16 nt, Human
gucagagccugcaguu

SEQ ID NO: 1187046 - RNA, 17 nt, Human
gucaccccggccaccug

SEQ ID NO: 1187047 - RNA, 18 nt, Human
gucaccccggccaccugc

SEQ ID NO: 1187048 - RNA, 22 nt, Human
gucaccccggccaccugcggug

SEQ ID NO: 1187049 - RNA, 12 nt, Human
gucacucuggca

SEQ ID NO: 1187050 - RNA, 13 nt, Human
gucacucuggcag

SEQ ID NO: 1187051 - RNA, 14 nt, Human
gucacucuggcagc

SEQ ID NO: 1187052 - RNA, 16 nt, Human
gucacucuggcagcuc

SEQ ID NO: 1187053 - RNA, 17 nt, Human
gucacucuggcagcuca

SEQ ID NO: 1187054 - RNA, 19 nt, Human
gucacucuggcagcucaga

SEQ ID NO: 1187055 - RNA, 22 nt, Human
gucacucuggcagcucagagag

SEQ ID NO: 1187056 - RNA, 19 nt, Human
guauuuuguuuuugucuua

SEQ ID NO: 1187057 - RNA, 15 nt, Human
gucaagugaaaaagg

SEQ ID NO: 1187058 - RNA, 23 nt, Human
gucaauaaaauccauacauuugu

SEQ ID NO: 1187059 - RNA, 15 nt, Human
gucaaugcagccccc

SEQ ID NO: 1187060 - RNA, 20 nt, Human
guauuuuaaaagaaugauua

SEQ ID NO: 1187061 - RNA, 13 nt, Human
guauuuuaaucac

SEQ ID NO: 1187062 - RNA, 14 nt, Human
guauuuuacuaaua

SEQ ID NO: 1187063 - RNA, 23 nt, Human
gucccaccuuggcugcagggagu

SEQ ID NO: 1187064 - RNA, 17 nt, Human
guccccaccgcagacag

SEQ ID NO: 1187065 - RNA, 16 nt, Human
gucccugcacuugcag

SEQ ID NO: 1187066 - RNA, 19 nt, Human
gucccugcacuugcagacu

SEQ ID NO: 1187067 - RNA, 21 nt, Human
gucccugcacuugcagacucu

SEQ ID NO: 1187068 - RNA, 13 nt, Human
gucaggaaagaga

SEQ ID NO: 1187069 - RNA, 12 nt, Human
guccacccagga

SEQ ID NO: 1187070 - RNA, 13 nt, Human
guccacccaggag

SEQ ID NO: 1187071 - RNA, 23 nt, Human
guccacccaggagccccgaggcc

SEQ ID NO: 1187072 - RNA, 21 nt, Human
gucccaccuuggcugcaggga

SEQ ID NO: 1187073 - RNA, 13 nt, Human
gucucuugguccu

SEQ ID NO: 1187074 - RNA, 13 nt, Human
gucucacuguugc

SEQ ID NO: 1187075 - RNA, 22 nt, Human
gucucacucugucgcccagucu

SEQ ID NO: 1187076 - RNA, 15 nt, Human
gucucacucugucgc

SEQ ID NO: 1187077 - RNA, 16 nt, Human
gucucacucugucgcc

SEQ ID NO: 1187078 - RNA, 18 nt, Human
gucucacucugucgccca

SEQ ID NO: 1187079 - RNA, 19 nt, Human
gucucacucugucgcccag

SEQ ID NO: 1187080 - RNA, 18 nt, Human
gucgucaaagcugaaaug

SEQ ID NO: 1187081 - RNA, 18 nt, Human
gucucacuauguugccca

SEQ ID NO: 1187082 - RNA, 19 nt, Human
gucucacuauguugcccag

SEQ ID NO: 1187083 - RNA, 11 nt, Human
gucccugccaa

SEQ ID NO: 1187084 - RNA, 14 nt, Human
gucccugccaaugg

SEQ ID NO: 1187085 - RNA, 15 nt, Human
gucccugccaaugga

SEQ ID NO: 1187086 - RNA, 19 nt, Human
guccuuaccagcagagcac

SEQ ID NO: 1187087 - RNA, 21 nt, Human
guccuuaccagcagagcaccu

SEQ ID NO: 1187088 - RNA, 21 nt, Human
gucggaaaacaugcuacacac

SEQ ID NO: 1187089 - RNA, 16 nt, Human
gucgggcaugacacga

SEQ ID NO: 1187090 - RNA, 14 nt, Human
gucuguucuuucca

SEQ ID NO: 1187091 - RNA, 17 nt, Human
gucuguucuuuccaaag

SEQ ID NO: 1187092 - RNA, 15 nt, Human
gucugugagaugcua

SEQ ID NO: 1187093 - RNA, 16 nt, Human
gucugugagaugcuag

SEQ ID NO: 1187094 - RNA, 17 nt, Human
gucugugagaugcuaga

SEQ ID NO: 1187095 - RNA, 21 nt, Human
gucugugagaugcuagaacuc

SEQ ID NO: 1187096 - RNA, 22 nt, Human
gucugugagaugcuagaacucc

SEQ ID NO: 1187097 - RNA, 23 nt, Human
gucugugagaugcuagaacuccc

SEQ ID NO: 1187098 - RNA, 18 nt, Human
gucugugccauuuuguau

SEQ ID NO: 1187099 - RNA, 21 nt, Human
gucuuaaaaaguggaaaaaua

SEQ ID NO: 1187100 - RNA, 16 nt, Human
gucuugaacuccuggc

SEQ ID NO: 1187101 - RNA, 17 nt, Human
gucuugaacuccuggcc

SEQ ID NO: 1187102 - RNA, 18 nt, Human
gucuugaacuccuggccu

SEQ ID NO: 1187103 - RNA, 20 nt, Human
gucuugaacuccuggccuca

SEQ ID NO: 1187104 - RNA, 21 nt, Human
gucuugaacuccuggccucaa

SEQ ID NO: 1187105 - RNA, 16 nt, Human
gucuugcaauggcagc

SEQ ID NO: 1187106 - RNA, 17 nt, Human
gucuugcaauggcagcc

SEQ ID NO: 1187107 - RNA, 18 nt, Human
gucuugcaauggcagccu

SEQ ID NO: 1187108 - RNA, 19 nt, Human
gucuugcaauggcagccuu

SEQ ID NO: 1187109 - RNA, 20 nt, Human
gucuugcaauggcagccuug

SEQ ID NO: 1187110 - RNA, 21 nt, Human
gucuugcaauggcagccuugg

SEQ ID NO: 1187111 - RNA, 23 nt, Human
gucuugcaauggcagccuuggca

SEQ ID NO: 1187112 - RNA, 23 nt, Human
gugauccacccaccucagccucc

SEQ ID NO: 1187113 - RNA, 24 nt, Human
gugauccacccaccucagccuccc

SEQ ID NO: 1187114 - RNA, 12 nt, Human
gugauuuucauu

SEQ ID NO: 1187115 - RNA, 13 nt, Human
gugauuuuuguaa

SEQ ID NO: 1187116 - RNA, 18 nt, Human
gugauuuuuguaauuuuu

SEQ ID NO: 1187117 - RNA, 22 nt, Human
gugcauaccacuuuuguucuug

SEQ ID NO: 1187118 - RNA, 20 nt, Human
gugcaguggugcgaucuggg

SEQ ID NO: 1187119 - RNA, 23 nt, Human
gugcaguggugcgaucuggguuc

SEQ ID NO: 1187120 - RNA, 20 nt, Human
gugccagguuuuuggucuga

SEQ ID NO: 1187121 - RNA, 14 nt, Human
gugccaugugccag

SEQ ID NO: 1187122 - RNA, 16 nt, Human
gugccaugugccaggu

SEQ ID NO: 1187123 - RNA, 21 nt, Human
gugcgaucuggguucacugca

SEQ ID NO: 1187124 - RNA, 14 nt, Human
gugcgccuacagga

SEQ ID NO: 1187125 - RNA, 14 nt, Human
gugcggccuuuggc

SEQ ID NO: 1187126 - RNA, 14 nt, Human
gugagcuacaaaug

SEQ ID NO: 1187127 - RNA, 19 nt, Human
gugagccgagaucacgcca

SEQ ID NO: 1187128 - RNA, 17 nt, Human
gugaggaugaaaaaaua

SEQ ID NO: 1187129 - RNA, 15 nt, Human
gugagccacugcacc

SEQ ID NO: 1187130 - RNA, 20 nt, Human
gugagccacugcaccgggcc

SEQ ID NO: 1187131 - RNA, 17 nt, Human
gugaguugauagcacag

SEQ ID NO: 1187132 - RNA, 15 nt, Human
gugauacaaugcugu

SEQ ID NO: 1187133 - RNA, 17 nt, Human
gugauacaaugcugugc

SEQ ID NO: 1187134 - RNA, 21 nt, Human
gugaacaaauuuacagagaca

SEQ ID NO: 1187135 - RNA, 21 nt, Human
gugaaugaugauccuaggcau

SEQ ID NO: 1187136 - RNA, 20 nt, Human
gugacaaggauugcuacugu

SEQ ID NO: 1187137 - RNA, 12 nt, Human
gugacagaggca

SEQ ID NO: 1187138 - RNA, 13 nt, Human
gugacagaggcag

SEQ ID NO: 1187139 - RNA, 14 nt, Human
gugacagaggcagc

SEQ ID NO: 1187140 - RNA, 15 nt, Human
gugacagaggcagcc

SEQ ID NO: 1187141 - RNA, 13 nt, Human
gugaccucugccu

SEQ ID NO: 1187142 - RNA, 14 nt, Human
gugaccucugccug

SEQ ID NO: 1187143 - RNA, 15 nt, Human
gugaccucugccuga

SEQ ID NO: 1187144 - RNA, 12 nt, Human
guggcugcuuca

SEQ ID NO: 1187145 - RNA, 14 nt, Human
guggcugcuucaag

SEQ ID NO: 1187146 - RNA, 14 nt, Human
guggcucacgccug

SEQ ID NO: 1187147 - RNA, 22 nt, Human
guggcuuaaaacaacacucaca

SEQ ID NO: 1187148 - RNA, 15 nt, Human
guggcugcuucaagg

SEQ ID NO: 1187149 - RNA, 16 nt, Human
guggcugcuucaagga

SEQ ID NO: 1187150 - RNA, 19 nt, Human
guggcugcuucaaggaucc

SEQ ID NO: 1187151 - RNA, 22 nt, Human
guggcugcuucaaggauccuga

SEQ ID NO: 1187152 - RNA, 23 nt, Human
guggcugcuucaaggauccugag

SEQ ID NO: 1187153 - RNA, 19 nt, Human
guggcuggguuggagggug

SEQ ID NO: 1187154 - RNA, 15 nt, Human
gugggcuaguugggc

SEQ ID NO: 1187155 - RNA, 17 nt, Human
gugggcccaaugcacuu

SEQ ID NO: 1187156 - RNA, 15 nt, Human
guggggaccucaggc

SEQ ID NO: 1187157 - RNA, 18 nt, Human
guggggaccucaggccug

SEQ ID NO: 1187158 - RNA, 23 nt, Human
guggguuucuaaagcugccagcc

SEQ ID NO: 1187159 - RNA, 13 nt, Human
guggggcagcuug

SEQ ID NO: 1187160 - RNA, 17 nt, Human
guggggcagcuugaggg

SEQ ID NO: 1187161 - RNA, 13 nt, Human
gugucccugcacu

SEQ ID NO: 1187162 - RNA, 16 nt, Human
gugucccugcacuugc

SEQ ID NO: 1187163 - RNA, 18 nt, Human
gugucccugcacuugcag

SEQ ID NO: 1187164 - RNA, 17 nt, Human
guguacauggaauaaca

SEQ ID NO: 1187165 - RNA, 22 nt, Human
guguacauggaauaacauguaa

SEQ ID NO: 1187166 - RNA, 14 nt, Human
guggugaccucugc

SEQ ID NO: 1187167 - RNA, 17 nt, Human
guggugaccucugccug

SEQ ID NO: 1187168 - RNA, 21 nt, Human
guggugagaggcauccaguau

SEQ ID NO: 1187169 - RNA, 19 nt, Human
guggugcgaucuggguuca

SEQ ID NO: 1187170 - RNA, 21 nt, Human
guguaaguagauaggccaugg

SEQ ID NO: 1187171 - RNA, 21 nt, Human
guguaaguauucuuauuuaau

SEQ ID NO: 1187172 - RNA, 19 nt, Human
gugguaugaucacggcuca

SEQ ID NO: 1187173 - RNA, 17 nt, Human
gugguagagugugccug

SEQ ID NO: 1187174 - RNA, 14 nt, Human
guggucccacccca

SEQ ID NO: 1187175 - RNA, 15 nt, Human
guggucccaccccac

SEQ ID NO: 1187176 - RNA, 16 nt, Human
guggucccaccccaca

SEQ ID NO: 1187177 - RNA, 17 nt, Human
guggucccaccccacac

SEQ ID NO: 1187178 - RNA, 18 nt, Human
gugguccuaaucuucuga

SEQ ID NO: 1187179 - RNA, 13 nt, Human
guguggagaagcg

SEQ ID NO: 1187180 - RNA, 21 nt, Human
guguggagaagcggcuggcag

SEQ ID NO: 1187181 - RNA, 12 nt, Human
gugugcucugau

SEQ ID NO: 1187182 - RNA, 15 nt, Human
gugugcucugaucau

SEQ ID NO: 1187183 - RNA, 22 nt, Human
gugugcucugaucauccacugu

SEQ ID NO: 1187184 - RNA, 23 nt, Human
gugucccugcacuugcagacucu

SEQ ID NO: 1187185 - RNA, 14 nt, Human
guguccggucccug

SEQ ID NO: 1187186 - RNA, 15 nt, Human
gugucgggcaugaca

SEQ ID NO: 1187187 - RNA, 17 nt, Human
gugucucccuucauccu

SEQ ID NO: 1187188 - RNA, 14 nt, Human
gugucucuuggucc

SEQ ID NO: 1187189 - RNA, 18 nt, Human
gugucucuugguccugcu

SEQ ID NO: 1187190 - RNA, 19 nt, Human
gugucucuugguccugcug

SEQ ID NO: 1187191 - RNA, 20 nt, Human
gugucucuugguccugcugc

SEQ ID NO: 1187192 - RNA, 21 nt, Human
gugucucuugguccugcugca

SEQ ID NO: 1187193 - RNA, 22 nt, Human
gugucucuugguccugcugcag

SEQ ID NO: 1187194 - RNA, 15 nt, Human
guuacacuaaaaggu

SEQ ID NO: 1187195 - RNA, 16 nt, Human
guuacacuaaaaggug

SEQ ID NO: 1187196 - RNA, 13 nt, Human
guuacagacaaag

SEQ ID NO: 1187197 - RNA, 22 nt, Human
guuaaaauaccagccaguaaau

SEQ ID NO: 1187198 - RNA, 12 nt, Human
guguuacuaagu

SEQ ID NO: 1187199 - RNA, 14 nt, Human
guguuacuaaguuu

SEQ ID NO: 1187200 - RNA, 18 nt, Human
guguuaugacuccagaau

SEQ ID NO: 1187201 - RNA, 20 nt, Human
guucaagcgauucuucugcu

SEQ ID NO: 1187202 - RNA, 16 nt, Human
guucaauucucauuug

SEQ ID NO: 1187203 - RNA, 23 nt, Human
guucaauucucauuugucacaca

SEQ ID NO: 1187204 - RNA, 17 nt, Human
guuauuauauuuacaaa

SEQ ID NO: 1187205 - RNA, 19 nt, Human
guucaagcgauucuucugc

SEQ ID NO: 1187206 - RNA, 19 nt, Human
guuauuaaaaaucucaaau

SEQ ID NO: 1187207 - RNA, 21 nt, Human
guuaugacuccagaauuuccc

SEQ ID NO: 1187208 - RNA, 15 nt, Human
guuacucagaauucu

SEQ ID NO: 1187209 - RNA, 22 nt, Human
guuacuaaguuuuuauggcuuu

SEQ ID NO: 1187210 - RNA, 16 nt, Human
guuaguuucuccaagc

SEQ ID NO: 1187211 - RNA, 19 nt, Human
guuaguuucuccaagcagg

SEQ ID NO: 1187212 - RNA, 22 nt, Human
guuaguuucuccaagcaggaca

SEQ ID NO: 1187213 - RNA, 15 nt, Human
guuacagacaaagcg

SEQ ID NO: 1187214 - RNA, 17 nt, Human
guuacagacaaagcgug

SEQ ID NO: 1187215 - RNA, 18 nt, Human
guuacauaagauaaaugu

SEQ ID NO: 1187216 - RNA, 19 nt, Human
guuacauaagauaaaugug

SEQ ID NO: 1187217 - RNA, 21 nt, Human
guuacauuuuuaagugcugca

SEQ ID NO: 1187218 - RNA, 23 nt, Human
guuaccauuuugggguacccacu

SEQ ID NO: 1187219 - RNA, 23 nt, Human
guuaccucugccucagaaaacaa

SEQ ID NO: 1187220 - RNA, 19 nt, Human
guucacugcaaccuccgcc

SEQ ID NO: 1187221 - RNA, 16 nt, Human
guucaucaaugaauga

SEQ ID NO: 1187222 - RNA, 17 nt, Human
guucaucauccuaagcu

SEQ ID NO: 1187223 - RNA, 12 nt, Human
guucaucuugaa

SEQ ID NO: 1187224 - RNA, 13 nt, Human
guucaucuugaau

SEQ ID NO: 1187225 - RNA, 18 nt, Human
guucaucuugaauuguaa

SEQ ID NO: 1187226 - RNA, 17 nt, Human
guuccaccaucaagcca

SEQ ID NO: 1187227 - RNA, 20 nt, Human
guuccaccaucaagccacca

SEQ ID NO: 1187228 - RNA, 14 nt, Human
guuccuaauccucu

SEQ ID NO: 1187229 - RNA, 22 nt, Human
guuccucauuagcauuuugcua

SEQ ID NO: 1187230 - RNA, 19 nt, Human
guucugauccuaguuccac

SEQ ID NO: 1187231 - RNA, 12 nt, Human
guucugaagaag

SEQ ID NO: 1187232 - RNA, 13 nt, Human
guucugaagaaga

SEQ ID NO: 1187233 - RNA, 14 nt, Human
guucugaagaagau

SEQ ID NO: 1187234 - RNA, 15 nt, Human
guucugaagaagaug

SEQ ID NO: 1187235 - RNA, 13 nt, Human
guucuuuccaaag

SEQ ID NO: 1187236 - RNA, 14 nt, Human
guucuuuccaaagu

SEQ ID NO: 1187237 - RNA, 18 nt, Human
guucuuuccaaaguacac

SEQ ID NO: 1187238 - RNA, 20 nt, Human
guucuuuccaaaguacacug

SEQ ID NO: 1187239 - RNA, 17 nt, Human
guugaaaaacagcugag

SEQ ID NO: 1187240 - RNA, 23 nt, Human
guucuggcagaguugaagacaga

SEQ ID NO: 1187241 - RNA, 12 nt, Human
guucuggcucuu

SEQ ID NO: 1187242 - RNA, 16 nt, Human
guucuggcucuuccag

SEQ ID NO: 1187243 - RNA, 20 nt, Human
guucuggcucuuccaggcug

SEQ ID NO: 1187244 - RNA, 11 nt, Human
guucugggaca

SEQ ID NO: 1187245 - RNA, 12 nt, Human
guucugggacac

SEQ ID NO: 1187246 - RNA, 14 nt, Human
guucugggacacag

SEQ ID NO: 1187247 - RNA, 15 nt, Human
guucugggacacagu

SEQ ID NO: 1187248 - RNA, 16 nt, Human
guucugggacacaguu

SEQ ID NO: 1187249 - RNA, 23 nt, Human
guucugggacacaguucaauucu

SEQ ID NO: 1187250 - RNA, 18 nt, Human
guucuuucacccuuuucu

SEQ ID NO: 1187251 - RNA, 20 nt, Human
guugauggugguauguuuuc

SEQ ID NO: 1187252 - RNA, 21 nt, Human
guugauggugguauguuuuca

SEQ ID NO: 1187253 - RNA, 16 nt, Human
guugaagacagagcua

SEQ ID NO: 1187254 - RNA, 15 nt, Human
guugcaggaccucag

SEQ ID NO: 1187255 - RNA, 13 nt, Human
guuggccaggcug

SEQ ID NO: 1187256 - RNA, 14 nt, Human
guuggccaggcugg

SEQ ID NO: 1187257 - RNA, 15 nt, Human
guuggccaggcuggu

SEQ ID NO: 1187258 - RNA, 17 nt, Human
guuggccaggcuggucu

SEQ ID NO: 1187259 - RNA, 19 nt, Human
guuggccaggcuggucuca

SEQ ID NO: 1187260 - RNA, 14 nt, Human
guuggccaguguga

SEQ ID NO: 1187261 - RNA, 14 nt, Human
guuggcaaaaaggc

SEQ ID NO: 1187262 - RNA, 18 nt, Human
guuggcaaaaaggcagga

SEQ ID NO: 1187263 - RNA, 23 nt, Human
guuggccaaagccaaagcuaggc

SEQ ID NO: 1187264 - RNA, 13 nt, Human
guugccagucacc

SEQ ID NO: 1187265 - RNA, 14 nt, Human
guugccagucaccc

SEQ ID NO: 1187266 - RNA, 16 nt, Human
guugccagucaccccg

SEQ ID NO: 1187267 - RNA, 17 nt, Human
guugccagucaccccgg

SEQ ID NO: 1187268 - RNA, 18 nt, Human
guugccagucaccccggc

SEQ ID NO: 1187269 - RNA, 23 nt, Human
guugccagucaccccggccaccu

SEQ ID NO: 1187270 - RNA, 12 nt, Human
guugcccaggca

SEQ ID NO: 1187271 - RNA, 14 nt, Human
guugcccaggcagg

SEQ ID NO: 1187272 - RNA, 15 nt, Human
guugcccaggcaggu

SEQ ID NO: 1187273 - RNA, 22 nt, Human
guuguggauuuaacagaaaugu

SEQ ID NO: 1187274 - RNA, 14 nt, Human
guugugguuaaucu

SEQ ID NO: 1187275 - RNA, 12 nt, Human
guuggcuggggg

SEQ ID NO: 1187276 - RNA, 13 nt, Human
guuggccccugcc

SEQ ID NO: 1187277 - RNA, 14 nt, Human
guuggccccugccc

SEQ ID NO: 1187278 - RNA, 20 nt, Human
guuggccccugcccggcugc

SEQ ID NO: 1187279 - RNA, 19 nt, Human
guuggcugggggccucagu

SEQ ID NO: 1187280 - RNA, 23 nt, Human
guuggcugggggccucagugcca

SEQ ID NO: 1187281 - RNA, 12 nt, Human
guugucagcuga

SEQ ID NO: 1187282 - RNA, 14 nt, Human
guuuagauaauaca

SEQ ID NO: 1187283 - RNA, 15 nt, Human
guuuagauaauacac

SEQ ID NO: 1187284 - RNA, 14 nt, Human
guuguuacauuuuu

SEQ ID NO: 1187285 - RNA, 15 nt, Human
guuguuacauuuuua

SEQ ID NO: 1187286 - RNA, 20 nt, Human
guuguuugauucagacagcu

SEQ ID NO: 1187287 - RNA, 21 nt, Human
guuuagcuggaaaaguauguu

SEQ ID NO: 1187288 - RNA, 20 nt, Human
guuuaggauguugaaaaagu

SEQ ID NO: 1187289 - RNA, 20 nt, Human
guuuauauaagcuuguauuc

SEQ ID NO: 1187290 - RNA, 16 nt, Human
guuugauucagacagc

SEQ ID NO: 1187291 - RNA, 20 nt, Human
guuugauucagacagcugcc

SEQ ID NO: 1187292 - RNA, 21 nt, Human
guuugauucagacagcugccu

SEQ ID NO: 1187293 - RNA, 17 nt, Human
guuugagaucagccugg

SEQ ID NO: 1187294 - RNA, 18 nt, Human
guuugagaucagccuggg

SEQ ID NO: 1187295 - RNA, 19 nt, Human
guuuuccaugaguccccug

SEQ ID NO: 1187296 - RNA, 20 nt, Human
guuuuccaugaguccccugu

SEQ ID NO: 1187297 - RNA, 13 nt, Human
guuuuccugaaga

SEQ ID NO: 1187298 - RNA, 20 nt, Human
guuuguuucugaaagggacg

SEQ ID NO: 1187299 - RNA, 17 nt, Human
guuuucaaaauaaaaau

SEQ ID NO: 1187300 - RNA, 11 nt, Human
guuuucacucu

SEQ ID NO: 1187301 - RNA, 12 nt, Human
guuuucacucuu

SEQ ID NO: 1187302 - RNA, 18 nt, Human
uaaaaaugguuuaaaugg

SEQ ID NO: 1187303 - RNA, 19 nt, Human
uaaaaaugguuuaaauggu

SEQ ID NO: 1187304 - RNA, 17 nt, Human
uaaaacacaacaucuuu

SEQ ID NO: 1187305 - RNA, 22 nt, Human
uaaaacacaacaucuuuuucua

SEQ ID NO: 1187306 - RNA, 23 nt, Human
uaaaacacaacaucuuuuucuac

SEQ ID NO: 1187307 - RNA, 22 nt, Human
uaaaacaagcacuaaacaaaga

SEQ ID NO: 1187308 - RNA, 15 nt, Human
uaaaacaacacucac

SEQ ID NO: 1187309 - RNA, 14 nt, Human
uaaaagauacaguu

SEQ ID NO: 1187310 - RNA, 17 nt, Human
uaaaagauacaguuacu

SEQ ID NO: 1187311 - RNA, 20 nt, Human
uaaaagauacaguuacucag

SEQ ID NO: 1187312 - RNA, 21 nt, Human
uaaaagauacaguuacucaga

SEQ ID NO: 1187313 - RNA, 12 nt, Human
uaaaaggagcca

SEQ ID NO: 1187314 - RNA, 21 nt, Human
uaaaagguaugcaaucaaauc

SEQ ID NO: 1187315 - RNA, 12 nt, Human
uaaaaggugacc

SEQ ID NO: 1187316 - RNA, 19 nt, Human
uaaaaggugaccaaugaug

SEQ ID NO: 1187317 - RNA, 15 nt, Human
uaaaauccauacauu

SEQ ID NO: 1187318 - RNA, 17 nt, Human
uaaaauccauacauuug

SEQ ID NO: 1187319 - RNA, 18 nt, Human
uaaaauccauacauuugu

SEQ ID NO: 1187320 - RNA, 20 nt, Human
uaaacaagaccacguuucua

SEQ ID NO: 1187321 - RNA, 21 nt, Human
uaaacaagaccacguuucuaa

SEQ ID NO: 1187322 - RNA, 22 nt, Human
uaaacaagaccacguuucuaaa

SEQ ID NO: 1187323 - RNA, 23 nt, Human
uaaacaagaccacguuucuaaag

SEQ ID NO: 1187324 - RNA, 19 nt, Human
uaaaccaaggcuagaacca

SEQ ID NO: 1187325 - RNA, 13 nt, Human
uaaacuuaaucua

SEQ ID NO: 1187326 - RNA, 22 nt, Human
uaaacuugguuuuuaaaaaacu

SEQ ID NO: 1187327 - RNA, 14 nt, Human
uaaaguguuugaaa

SEQ ID NO: 1187328 - RNA, 17 nt, Human
uaaaggcuaccuuugua

SEQ ID NO: 1187329 - RNA, 19 nt, Human
uaaaggcuaccuuuguauu

SEQ ID NO: 1187330 - RNA, 14 nt, Human
uaaaggaauuuaaa

SEQ ID NO: 1187331 - RNA, 15 nt, Human
uaaaggcuaccuuug

SEQ ID NO: 1187332 - RNA, 12 nt, Human
uaaagaaaacug

SEQ ID NO: 1187333 - RNA, 12 nt, Human
uaaagaaagaga

SEQ ID NO: 1187334 - RNA, 13 nt, Human
uaaagaaagagag

SEQ ID NO: 1187335 - RNA, 14 nt, Human
uaaagaaagagaga

SEQ ID NO: 1187336 - RNA, 16 nt, Human
uaaagcagcguuucua

SEQ ID NO: 1187337 - RNA, 17 nt, Human
uaaagcagcguuucuau

SEQ ID NO: 1187338 - RNA, 19 nt, Human
uaaagcagcguuucuauga

SEQ ID NO: 1187339 - RNA, 15 nt, Human
uaagugcugcauuua

SEQ ID NO: 1187340 - RNA, 16 nt, Human
uaagugcugcauuuaa

SEQ ID NO: 1187341 - RNA, 18 nt, Human
uaagugcugcauuuaaaa

SEQ ID NO: 1187342 - RNA, 22 nt, Human
uaagugcugcauuuaaaagaua

SEQ ID NO: 1187343 - RNA, 13 nt, Human
uaagugaaauaag

SEQ ID NO: 1187344 - RNA, 12 nt, Human
uaagugagagag

SEQ ID NO: 1187345 - RNA, 23 nt, Human
uaagugaggaugaaaaaauaaca

SEQ ID NO: 1187346 - RNA, 14 nt, Human
uaagugcugcauuu

SEQ ID NO: 1187347 - RNA, 20 nt, Human
uaagguggguacgggagggu

SEQ ID NO: 1187348 - RNA, 15 nt, Human
uaaggugugcucuga

SEQ ID NO: 1187349 - RNA, 17 nt, Human
uaaggguaucuggugac

SEQ ID NO: 1187350 - RNA, 12 nt, Human
uaagaggcaggg

SEQ ID NO: 1187351 - RNA, 15 nt, Human
uaagaggcagggucu

SEQ ID NO: 1187352 - RNA, 22 nt, Human
uaagaggcagggucucacucug

SEQ ID NO: 1187353 - RNA, 14 nt, Human
uaagcuauucagua

SEQ ID NO: 1187354 - RNA, 20 nt, Human
uaauauuaaggaagacaaug

SEQ ID NO: 1187355 - RNA, 20 nt, Human
uaauccucuaggaggucucu

SEQ ID NO: 1187356 - RNA, 13 nt, Human
uaaucuaaaugga

SEQ ID NO: 1187357 - RNA, 14 nt, Human
uaauaauguuucaa

SEQ ID NO: 1187358 - RNA, 15 nt, Human
uaauaugcacacauu

SEQ ID NO: 1187359 - RNA, 16 nt, Human
uaauaugcacacauuu

SEQ ID NO: 1187360 - RNA, 17 nt, Human
uaauaugcacacauuuu

SEQ ID NO: 1187361 - RNA, 18 nt, Human
uaauaugcacacauuuuu

SEQ ID NO: 1187362 - RNA, 19 nt, Human
uaauaugcacacauuuuuu

SEQ ID NO: 1187363 - RNA, 14 nt, Human
uaauuaaguacuau

SEQ ID NO: 1187364 - RNA, 17 nt, Human
uaauuaaguacuaugua

SEQ ID NO: 1187365 - RNA, 20 nt, Human
uaauuaaguacuauguauca

SEQ ID NO: 1187366 - RNA, 17 nt, Human
uaaugauaacuggaaac

SEQ ID NO: 1187367 - RNA, 22 nt, Human
uaaugauaacuggaaacuucag

SEQ ID NO: 1187368 - RNA, 23 nt, Human
uaaugauaacuggaaacuucagc

SEQ ID NO: 1187369 - RNA, 15 nt, Human
uaaugcgugcauacc

SEQ ID NO: 1187370 - RNA, 19 nt, Human
uaaugcgugcauaccacuu

SEQ ID NO: 1187371 - RNA, 22 nt, Human
uaaugcgugcauaccacuuuug

SEQ ID NO: 1187372 - RNA, 23 nt, Human
uaaugcgugcauaccacuuuugu

SEQ ID NO: 1187373 - RNA, 15 nt, Human
uaauggggcggugag

SEQ ID NO: 1187374 - RNA, 11 nt, Human
uaacagaaaug

SEQ ID NO: 1187375 - RNA, 12 nt, Human
uaacagaaaugu

SEQ ID NO: 1187376 - RNA, 16 nt, Human
uaaccacuucagcuga

SEQ ID NO: 1187377 - RNA, 23 nt, Human
uaaccaguguuguggauuuaaca

SEQ ID NO: 1187378 - RNA, 15 nt, Human
uaacuggaaacuuca

SEQ ID NO: 1187379 - RNA, 16 nt, Human
uaagaaaaaggaugca

SEQ ID NO: 1187380 - RNA, 18 nt, Human
uaagaaaaaggaugcaca

SEQ ID NO: 1187381 - RNA, 19 nt, Human
uaagaaaaaggaugcacag

SEQ ID NO: 1187382 - RNA, 23 nt, Human
uaagaaaaaggaugcacagaguu

SEQ ID NO: 1187383 - RNA, 21 nt, Human
uaagaaaauaucacuugucaa

SEQ ID NO: 1187384 - RNA, 24 nt, Human
uaagaaagacuaucuaaauguuga

SEQ ID NO: 1187385 - RNA, 19 nt, Human
uaagaaccuuuugagugcc

SEQ ID NO: 1187386 - RNA, 13 nt, Human
uaagagagaauga

SEQ ID NO: 1187387 - RNA, 14 nt, Human
uaagagagaaugag

SEQ ID NO: 1187388 - RNA, 23 nt, Human
uaagagagaaugagagacacacu

SEQ ID NO: 1187389 - RNA, 22 nt, Human
uaagaaccuuuugagugccuua

SEQ ID NO: 1187390 - RNA, 16 nt, Human
uaaauucuugcaaagu

SEQ ID NO: 1187391 - RNA, 17 nt, Human
uaaauucuugcaaagua

SEQ ID NO: 1187392 - RNA, 18 nt, Human
uaaauucuugcaaaguau

SEQ ID NO: 1187393 - RNA, 22 nt, Human
uaaauucuugcaaaguaucccu

SEQ ID NO: 1187394 - RNA, 20 nt, Human
uaaauugacacuuaaaaaug

SEQ ID NO: 1187395 - RNA, 23 nt, Human
uaaauugacacuuaaaaaugguu

SEQ ID NO: 1187396 - RNA, 18 nt, Human
uaacaccaugauuaacca

SEQ ID NO: 1187397 - RNA, 13 nt, Human
uaaaugcccagcc

SEQ ID NO: 1187398 - RNA, 14 nt, Human
uaaaugcccagccc

SEQ ID NO: 1187399 - RNA, 15 nt, Human
uaaaugcccagcccc

SEQ ID NO: 1187400 - RNA, 16 nt, Human
uaaaugcccagccccu

SEQ ID NO: 1187401 - RNA, 17 nt, Human
uaaaugcccagccccuu

SEQ ID NO: 1187402 - RNA, 17 nt, Human
uaaaugcugcuuuuucu

SEQ ID NO: 1187403 - RNA, 11 nt, Human
uaaaugcugcu

SEQ ID NO: 1187404 - RNA, 16 nt, Human
uaaauggaaccacucu

SEQ ID NO: 1187405 - RNA, 20 nt, Human
uaaauggcuuccuggcaaua

SEQ ID NO: 1187406 - RNA, 14 nt, Human
uaaaugggggugca

SEQ ID NO: 1187407 - RNA, 17 nt, Human
uaaaugggggugcauuu

SEQ ID NO: 1187408 - RNA, 18 nt, Human
uaaaugggggugcauuug

SEQ ID NO: 1187409 - RNA, 19 nt, Human
uaaaugggggugcauuuga

SEQ ID NO: 1187410 - RNA, 20 nt, Human
uaaaugucuaguuguaacac

SEQ ID NO: 1187411 - RNA, 22 nt, Human
uaaaugucucuuuaaugucaca

SEQ ID NO: 1187412 - RNA, 14 nt, Human
uacacuguuucaaa

SEQ ID NO: 1187413 - RNA, 22 nt, Human
uacacuguuucaaacuuuacua

SEQ ID NO: 1187414 - RNA, 16 nt, Human
uacacuuacacuuuau

SEQ ID NO: 1187415 - RNA, 22 nt, Human
uacacugugcugagucugaagg

SEQ ID NO: 1187416 - RNA, 23 nt, Human
uacacugugcugagucugaaggc

SEQ ID NO: 1187417 - RNA, 20 nt, Human
uacacuguuucaaacuuuac

SEQ ID NO: 1187418 - RNA, 20 nt, Human
uacagcuugaccgugaggcc

SEQ ID NO: 1187419 - RNA, 18 nt, Human
uacaggaagguagaaaua

SEQ ID NO: 1187420 - RNA, 13 nt, Human
uacaggaaguacu

SEQ ID NO: 1187421 - RNA, 23 nt, Human
uacaguucggugagcuacaaaug

SEQ ID NO: 1187422 - RNA, 14 nt, Human
uacaggauuugaaa

SEQ ID NO: 1187423 - RNA, 14 nt, Human
uacaggaaguacug

SEQ ID NO: 1187424 - RNA, 15 nt, Human
uacaggaaguacugg

SEQ ID NO: 1187425 - RNA, 22 nt, Human
uacaggaaguacuggagaaaau

SEQ ID NO: 1187426 - RNA, 15 nt, Human
uacaggagugagcac

SEQ ID NO: 1187427 - RNA, 21 nt, Human
uacagcuugaccgugaggcca

SEQ ID NO: 1187428 - RNA, 17 nt, Human
uacaguugaaaaacagc

SEQ ID NO: 1187429 - RNA, 19 nt, Human
uacaguugaaaaacagcug

SEQ ID NO: 1187430 - RNA, 20 nt, Human
uacaguugaaaaacagcuga

SEQ ID NO: 1187431 - RNA, 18 nt, Human
uacaguuuguuaguauga

SEQ ID NO: 1187432 - RNA, 19 nt, Human
uacaguuuguuaguaugag

SEQ ID NO: 1187433 - RNA, 21 nt, Human
uacaguuuguuaguaugaggc

SEQ ID NO: 1187434 - RNA, 16 nt, Human
uacauaaacaaguccu

SEQ ID NO: 1187435 - RNA, 16 nt, Human
uacauaagauaaaugu

SEQ ID NO: 1187436 - RNA, 17 nt, Human
uacauaagauaaaugug

SEQ ID NO: 1187437 - RNA, 16 nt, Human
uacaugaaaacacauu

SEQ ID NO: 1187438 - RNA, 17 nt, Human
uacaugaaaacacauuu

SEQ ID NO: 1187439 - RNA, 18 nt, Human
uacaugaaaacacauuuu

SEQ ID NO: 1187440 - RNA, 19 nt, Human
uacaugaaaacacauuuuu

SEQ ID NO: 1187441 - RNA, 23 nt, Human
uacaugaaaacacauuuuucuua

SEQ ID NO: 1187442 - RNA, 14 nt, Human
uacauggaauaaca

SEQ ID NO: 1187443 - RNA, 18 nt, Human
uacauggaauaacaugua

SEQ ID NO: 1187444 - RNA, 19 nt, Human
uacauggaauaacauguaa

SEQ ID NO: 1187445 - RNA, 22 nt, Human
uacauggaauaacauguaauua

SEQ ID NO: 1187446 - RNA, 14 nt, Human
uacauuuuuaagug

SEQ ID NO: 1187447 - RNA, 19 nt, Human
uacauuuuuaagugcugca

SEQ ID NO: 1187448 - RNA, 22 nt, Human
uacauuuuuaagugcugcauuu

SEQ ID NO: 1187449 - RNA, 18 nt, Human
uaauuuugugaagcaaaa

SEQ ID NO: 1187450 - RNA, 12 nt, Human
uaauuuuuauau

SEQ ID NO: 1187451 - RNA, 16 nt, Human
uaauuuuuauauuuga

SEQ ID NO: 1187452 - RNA, 17 nt, Human
uaauuuuuauauuugaa

SEQ ID NO: 1187453 - RNA, 14 nt, Human
uacaaaguagaagu

SEQ ID NO: 1187454 - RNA, 18 nt, Human
uacaaaguagaagucuua

SEQ ID NO: 1187455 - RNA, 11 nt, Human
uacacacacac

SEQ ID NO: 1187456 - RNA, 12 nt, Human
uacacacacaca

SEQ ID NO: 1187457 - RNA, 13 nt, Human
uacacacacacac

SEQ ID NO: 1187458 - RNA, 14 nt, Human
uacacacacacaca

SEQ ID NO: 1187459 - RNA, 16 nt, Human
uacacacacacacaca

SEQ ID NO: 1187460 - RNA, 17 nt, Human
uacacacacacacacag

SEQ ID NO: 1187461 - RNA, 18 nt, Human
uacacacacacacacagc

SEQ ID NO: 1187462 - RNA, 19 nt, Human
uacacacacacacacagcc

SEQ ID NO: 1187463 - RNA, 20 nt, Human
uacacacacacacacagcca

SEQ ID NO: 1187464 - RNA, 21 nt, Human
uacacacacacacacagccac

SEQ ID NO: 1187465 - RNA, 15 nt, Human
uacacacugcauguu

SEQ ID NO: 1187466 - RNA, 17 nt, Human
uacacacugcauguuug

SEQ ID NO: 1187467 - RNA, 19 nt, Human
uacacauuuuauuuuauua

SEQ ID NO: 1187468 - RNA, 21 nt, Human
uacacugugcugagucugaag

SEQ ID NO: 1187469 - RNA, 16 nt, Human
uacccagcgagcccug

SEQ ID NO: 1187470 - RNA, 22 nt, Human
uaccuaacgaaguauccuucag

SEQ ID NO: 1187471 - RNA, 23 nt, Human
uacauuuuuaagugcugcauuua

SEQ ID NO: 1187472 - RNA, 22 nt, Human
uaccaaaaaucucaauauuuca

SEQ ID NO: 1187473 - RNA, 15 nt, Human
uaccuacauacaauu

SEQ ID NO: 1187474 - RNA, 13 nt, Human
uaccuuuuuuaga

SEQ ID NO: 1187475 - RNA, 19 nt, Human
uaccuuuuuuagaguugau

SEQ ID NO: 1187476 - RNA, 22 nt, Human
uaccuuuuuuagaguugauacu

SEQ ID NO: 1187477 - RNA, 18 nt, Human
uaccucggugccuuccuc

SEQ ID NO: 1187478 - RNA, 21 nt, Human
uaccucuugagccuugaacuu

SEQ ID NO: 1187479 - RNA, 13 nt, Human
uaccuuuuuuaua

SEQ ID NO: 1187480 - RNA, 16 nt, Human
uaccuuuuuuauacau

SEQ ID NO: 1187481 - RNA, 17 nt, Human
uaccuuuuuuauacaua

SEQ ID NO: 1187482 - RNA, 18 nt, Human
uacgaaaagaggggaaga

SEQ ID NO: 1187483 - RNA, 21 nt, Human
uacgaaaagaggggaagagac

SEQ ID NO: 1187484 - RNA, 17 nt, Human
uacuaaccagcagaaau

SEQ ID NO: 1187485 - RNA, 14 nt, Human
uacuaaggaaucuu

SEQ ID NO: 1187486 - RNA, 22 nt, Human
uacuaauaaaauuuaaaagucu

SEQ ID NO: 1187487 - RNA, 21 nt, Human
uacuaauagacaauuuauuau

SEQ ID NO: 1187488 - RNA, 22 nt, Human
uacucgaguuacagacaaagcg

SEQ ID NO: 1187489 - RNA, 12 nt, Human
uacucccaucug

SEQ ID NO: 1187490 - RNA, 22 nt, Human
uacuacaguccucccaucucac

SEQ ID NO: 1187491 - RNA, 13 nt, Human
uacuacaguuugu

SEQ ID NO: 1187492 - RNA, 14 nt, Human
uacuacaguuuguu

SEQ ID NO: 1187493 - RNA, 20 nt, Human
uacuacaguuuguuaguaug

SEQ ID NO: 1187494 - RNA, 16 nt, Human
uacucuacccucuuag

SEQ ID NO: 1187495 - RNA, 13 nt, Human
uacuuguggacac

SEQ ID NO: 1187496 - RNA, 16 nt, Human
uacuguccuacccacc

SEQ ID NO: 1187497 - RNA, 21 nt, Human
uacugucuucaguaagccgug

SEQ ID NO: 1187498 - RNA, 11 nt, Human
uagagacaggg

SEQ ID NO: 1187499 - RNA, 14 nt, Human
uagagguucaaaga

SEQ ID NO: 1187500 - RNA, 15 nt, Human
uagagguucaaagau

SEQ ID NO: 1187501 - RNA, 16 nt, Human
uagagguucaaagaua

SEQ ID NO: 1187502 - RNA, 12 nt, Human
uagagugggagc

SEQ ID NO: 1187503 - RNA, 14 nt, Human
uagaguugauacua

SEQ ID NO: 1187504 - RNA, 17 nt, Human
uagaguugauacuacag

SEQ ID NO: 1187505 - RNA, 15 nt, Human
uagaauuaacacaug

SEQ ID NO: 1187506 - RNA, 16 nt, Human
uagaauuaacacauga

SEQ ID NO: 1187507 - RNA, 18 nt, Human
uagaauuaacacaugauc

SEQ ID NO: 1187508 - RNA, 14 nt, Human
uacuuguggacaca

SEQ ID NO: 1187509 - RNA, 23 nt, Human
uagaauaccacaggaaccacaag

SEQ ID NO: 1187510 - RNA, 22 nt, Human
uagcucauucuccuuguguuac

SEQ ID NO: 1187511 - RNA, 15 nt, Human
uagcugggacuacag

SEQ ID NO: 1187512 - RNA, 17 nt, Human
uagcugggacuacaggc

SEQ ID NO: 1187513 - RNA, 19 nt, Human
uagcugggacuacaggcac

SEQ ID NO: 1187514 - RNA, 18 nt, Human
uagccugugccucuggga

SEQ ID NO: 1187515 - RNA, 20 nt, Human
uagccugugccucugggacu

SEQ ID NO: 1187516 - RNA, 20 nt, Human
uagcucaggugucccugcac

SEQ ID NO: 1187517 - RNA, 21 nt, Human
uagcucaggugucccugcacu

SEQ ID NO: 1187518 - RNA, 12 nt, Human
uagcucauucuc

SEQ ID NO: 1187519 - RNA, 16 nt, Human
uagccuaggugacaga

SEQ ID NO: 1187520 - RNA, 16 nt, Human
uagauacuguaucaug

SEQ ID NO: 1187521 - RNA, 14 nt, Human
uagauaggccaugg

SEQ ID NO: 1187522 - RNA, 17 nt, Human
uagauaggccaugggca

SEQ ID NO: 1187523 - RNA, 11 nt, Human
uagcagggaaa

SEQ ID NO: 1187524 - RNA, 17 nt, Human
uagcauacguacacauu

SEQ ID NO: 1187525 - RNA, 18 nt, Human
uagcauacguacacauuu

SEQ ID NO: 1187526 - RNA, 19 nt, Human
uagcauacguacacauuuu

SEQ ID NO: 1187527 - RNA, 14 nt, Human
uaucaaaagaaaga

SEQ ID NO: 1187528 - RNA, 19 nt, Human
uaucaggugcugccaucca

SEQ ID NO: 1187529 - RNA, 20 nt, Human
uaucaggugcugccauccag

SEQ ID NO: 1187530 - RNA, 21 nt, Human
uauauuuuuuguuaaaugauu

SEQ ID NO: 1187531 - RNA, 16 nt, Human
uauaugcuucuguuuu

SEQ ID NO: 1187532 - RNA, 17 nt, Human
uauauaacaaugcugua

SEQ ID NO: 1187533 - RNA, 19 nt, Human
uauauaacaaugcuguauu

SEQ ID NO: 1187534 - RNA, 20 nt, Human
uaguuguuugauucagacag

SEQ ID NO: 1187535 - RNA, 21 nt, Human
uaguuguuugauucagacagc

SEQ ID NO: 1187536 - RNA, 22 nt, Human
uaguuguuugauucagacagcu

SEQ ID NO: 1187537 - RNA, 16 nt, Human
uaguauuucuaugaaa

SEQ ID NO: 1187538 - RNA, 20 nt, Human
uaguggcuuaaaacaacacu

SEQ ID NO: 1187539 - RNA, 17 nt, Human
uaguauuguccaggucu

SEQ ID NO: 1187540 - RNA, 16 nt, Human
uaguaugguggcuggg

SEQ ID NO: 1187541 - RNA, 15 nt, Human
uaguuugauuaaauu

SEQ ID NO: 1187542 - RNA, 16 nt, Human
uaguuugauuaaauuc

SEQ ID NO: 1187543 - RNA, 21 nt, Human
uaguuugauuaaauucuugca

SEQ ID NO: 1187544 - RNA, 11 nt, Human
uauaaacuuua

SEQ ID NO: 1187545 - RNA, 13 nt, Human
uauaaacuuuacc

SEQ ID NO: 1187546 - RNA, 14 nt, Human
uauaaacuuuaccu

SEQ ID NO: 1187547 - RNA, 15 nt, Human
uauaaacuuuaccuu

SEQ ID NO: 1187548 - RNA, 16 nt, Human
uauaaacuuuaccuuu

SEQ ID NO: 1187549 - RNA, 17 nt, Human
uauaaacuuuaccuuuu

SEQ ID NO: 1187550 - RNA, 18 nt, Human
uauaaacuuuaccuuuuu

SEQ ID NO: 1187551 - RNA, 17 nt, Human
uaguaugaggcauuugu

SEQ ID NO: 1187552 - RNA, 18 nt, Human
uaguaugaggcauuuguu

SEQ ID NO: 1187553 - RNA, 13 nt, Human
uagguguggggga

SEQ ID NO: 1187554 - RNA, 17 nt, Human
uaggugugggggaagca

SEQ ID NO: 1187555 - RNA, 19 nt, Human
uaggugugacugaauuucu

SEQ ID NO: 1187556 - RNA, 21 nt, Human
uaggugugacugaauuucuuu

SEQ ID NO: 1187557 - RNA, 23 nt, Human
uaggugugacugaauuucuuuug

SEQ ID NO: 1187558 - RNA, 11 nt, Human
uagggaaaaac

SEQ ID NO: 1187559 - RNA, 11 nt, Human
uaggugacaga

SEQ ID NO: 1187560 - RNA, 16 nt, Human
uaggugacagagugag

SEQ ID NO: 1187561 - RNA, 15 nt, Human
ucaguccauagcaga

SEQ ID NO: 1187562 - RNA, 18 nt, Human
ucaguccaugaagaugua

SEQ ID NO: 1187563 - RNA, 17 nt, Human
ucagguggggucacucu

SEQ ID NO: 1187564 - RNA, 20 nt, Human
ucagguggggucacucuggc

SEQ ID NO: 1187565 - RNA, 21 nt, Human
ucagguggggucacucuggca

SEQ ID NO: 1187566 - RNA, 18 nt, Human
ucaggugcugccauccag

SEQ ID NO: 1187567 - RNA, 20 nt, Human
ucaggugcugccauccaggu

SEQ ID NO: 1187568 - RNA, 14 nt, Human
ucagguggggcagc

SEQ ID NO: 1187569 - RNA, 15 nt, Human
ucagguggggcagcu

SEQ ID NO: 1187570 - RNA, 16 nt, Human
ucagguggggcagcuu

SEQ ID NO: 1187571 - RNA, 17 nt, Human
ucagguggggcagcuug

SEQ ID NO: 1187572 - RNA, 17 nt, Human
ucagucugauucccaag

SEQ ID NO: 1187573 - RNA, 19 nt, Human
ucagucugauucccaagcu

SEQ ID NO: 1187574 - RNA, 18 nt, Human
ucagugugacugaucucu

SEQ ID NO: 1187575 - RNA, 14 nt, Human
ucaucauccuaagc

SEQ ID NO: 1187576 - RNA, 21 nt, Human
ucauggaauuggagcucgugg

SEQ ID NO: 1187577 - RNA, 15 nt, Human
ucagaucucuaacuu

SEQ ID NO: 1187578 - RNA, 15 nt, Human
ucagcacgauuucug

SEQ ID NO: 1187579 - RNA, 16 nt, Human
ucagcacgauuucugu

SEQ ID NO: 1187580 - RNA, 17 nt, Human
ucagcacgauuucuguu

SEQ ID NO: 1187581 - RNA, 18 nt, Human
ucagcacgauuucuguuu

SEQ ID NO: 1187582 - RNA, 15 nt, Human
ucagcauccuggcac

SEQ ID NO: 1187583 - RNA, 16 nt, Human
ucagcauccuggcacc

SEQ ID NO: 1187584 - RNA, 17 nt, Human
ucagcauccuggcaccc

SEQ ID NO: 1187585 - RNA, 18 nt, Human
ucagcauccuggcacccg

SEQ ID NO: 1187586 - RNA, 12 nt, Human
ucagccucccaa

SEQ ID NO: 1187587 - RNA, 13 nt, Human
ucagccucccaaa

SEQ ID NO: 1187588 - RNA, 22 nt, Human
ucagccucccaaagugcuggga

SEQ ID NO: 1187589 - RNA, 12 nt, Human
ucagccucccga

SEQ ID NO: 1187590 - RNA, 20 nt, Human
ucagccucccgaauagcugg

SEQ ID NO: 1187591 - RNA, 16 nt, Human
ucagccugcuccagcu

SEQ ID NO: 1187592 - RNA, 18 nt, Human
ucagccugcuccagcugu

SEQ ID NO: 1187593 - RNA, 18 nt, Human
ucagcuccagcucaccag

SEQ ID NO: 1187594 - RNA, 21 nt, Human
ucagcuccagcucaccagccc

SEQ ID NO: 1187595 - RNA, 22 nt, Human
ucagcuccagcucaccagcccc

SEQ ID NO: 1187596 - RNA, 15 nt, Human
ucagcugcuacuacu

SEQ ID NO: 1187597 - RNA, 22 nt, Human
uccacugugccaugugccaggu

SEQ ID NO: 1187598 - RNA, 14 nt, Human
uccacccugcucuc

SEQ ID NO: 1187599 - RNA, 21 nt, Human
uccacccugcucuccgaccag

SEQ ID NO: 1187600 - RNA, 19 nt, Human
uccacuuucuagccagagg

SEQ ID NO: 1187601 - RNA, 14 nt, Human
uccacuuucuagcc

SEQ ID NO: 1187602 - RNA, 14 nt, Human
uccaagaagcccag

SEQ ID NO: 1187603 - RNA, 15 nt, Human
uccaagaagcccagg

SEQ ID NO: 1187604 - RNA, 16 nt, Human
uccaagaagcccagga

SEQ ID NO: 1187605 - RNA, 19 nt, Human
uccaagaagcccaggaaag

SEQ ID NO: 1187606 - RNA, 20 nt, Human
uccaagaccuucuccuucac

SEQ ID NO: 1187607 - RNA, 14 nt, Human
uccaagcaggacau

SEQ ID NO: 1187608 - RNA, 22 nt, Human
uccaagcaggacauggacaagg

SEQ ID NO: 1187609 - RNA, 20 nt, Human
uccacaagagcccaggccuc

SEQ ID NO: 1187610 - RNA, 21 nt, Human
uccacaagagcccaggccucc

SEQ ID NO: 1187611 - RNA, 12 nt, Human
uccauacauuug

SEQ ID NO: 1187612 - RNA, 17 nt, Human
uccauagagagcaagac

SEQ ID NO: 1187613 - RNA, 20 nt, Human
uccauagagagcaagacgcu

SEQ ID NO: 1187614 - RNA, 19 nt, Human
ucccaacucaccccagccc

SEQ ID NO: 1187615 - RNA, 21 nt, Human
ucccaacucaccccagcccca

SEQ ID NO: 1187616 - RNA, 13 nt, Human
ucccaacucaccc

SEQ ID NO: 1187617 - RNA, 18 nt, Human
ucccaacucaccccagcc

SEQ ID NO: 1187618 - RNA, 19 nt, Human
ucccaggcauuccccagga

SEQ ID NO: 1187619 - RNA, 15 nt, Human
ucccaugagccucag

SEQ ID NO: 1187620 - RNA, 16 nt, Human
ucccaugagccucagc

SEQ ID NO: 1187621 - RNA, 17 nt, Human
ucccaggcauuccccag

SEQ ID NO: 1187622 - RNA, 18 nt, Human
ucccaggcauuccccagg

SEQ ID NO: 1187623 - RNA, 18 nt, Human
ucccaccucagccucccg

SEQ ID NO: 1187624 - RNA, 14 nt, Human
ucccaccucucuca

SEQ ID NO: 1187625 - RNA, 17 nt, Human
ucccaccucucucacuc

SEQ ID NO: 1187626 - RNA, 18 nt, Human
ucccaccucucucacucc

SEQ ID NO: 1187627 - RNA, 20 nt, Human
ucccaccucucucacuccuu

SEQ ID NO: 1187628 - RNA, 19 nt, Human
ucccaccuuggcugcaggg

SEQ ID NO: 1187629 - RNA, 21 nt, Human
ucccaccuuggcugcagggag

SEQ ID NO: 1187630 - RNA, 14 nt, Human
ucccacucagucca

SEQ ID NO: 1187631 - RNA, 17 nt, Human
ucccaugagccucagca

SEQ ID NO: 1187632 - RNA, 22 nt, Human
ucccaugagccucagcauccug

SEQ ID NO: 1187633 - RNA, 13 nt, Human
ucccucuggggcu

SEQ ID NO: 1187634 - RNA, 17 nt, Human
ucccucuggggcuguuc

SEQ ID NO: 1187635 - RNA, 14 nt, Human
ucccugccaaugga

SEQ ID NO: 1187636 - RNA, 16 nt, Human
ucccugccaauggacu

SEQ ID NO: 1187637 - RNA, 16 nt, Human
ucccuucccaccucuc

SEQ ID NO: 1187638 - RNA, 17 nt, Human
ucccuucccaccucucu

SEQ ID NO: 1187639 - RNA, 21 nt, Human
ucccuucccacuggaggcaug

SEQ ID NO: 1187640 - RNA, 21 nt, Human
uccgaaagggacuuggaagcu

SEQ ID NO: 1187641 - RNA, 22 nt, Human
uccgaaagggacuuggaagcuc

SEQ ID NO: 1187642 - RNA, 21 nt, Human
uccgcuuucuacccagcgagc

SEQ ID NO: 1187643 - RNA, 21 nt, Human
uccuccuuuucacaguucucu

SEQ ID NO: 1187644 - RNA, 21 nt, Human
uccucuaggaggucucuaaga

SEQ ID NO: 1187645 - RNA, 15 nt, Human
uccucuggccugugu

SEQ ID NO: 1187646 - RNA, 13 nt, Human
uccucuguacaga

SEQ ID NO: 1187647 - RNA, 15 nt, Human
uccucuguacagagc

SEQ ID NO: 1187648 - RNA, 17 nt, Human
uccugagccagauuuca

SEQ ID NO: 1187649 - RNA, 23 nt, Human
uccucuguacagagcccacgccc

SEQ ID NO: 1187650 - RNA, 21 nt, Human
uccugagccagauuucacucu

SEQ ID NO: 1187651 - RNA, 15 nt, Human
uccugaggcuccacu

SEQ ID NO: 1187652 - RNA, 18 nt, Human
uccugagccagauuucac

SEQ ID NO: 1187653 - RNA, 19 nt, Human
uccugagccagauuucacu

SEQ ID NO: 1187654 - RNA, 16 nt, Human
uccugaggcuccacuu

SEQ ID NO: 1187655 - RNA, 17 nt, Human
uccugaggcuccacuug

SEQ ID NO: 1187656 - RNA, 12 nt, Human
uccugaggcugg

SEQ ID NO: 1187657 - RNA, 15 nt, Human
uccugaggcugggcu

SEQ ID NO: 1187658 - RNA, 16 nt, Human
uccugaggcugggcuc

SEQ ID NO: 1187659 - RNA, 17 nt, Human
uccugaggcugggcucc

SEQ ID NO: 1187660 - RNA, 19 nt, Human
uccugaggcugggcucccu

SEQ ID NO: 1187661 - RNA, 21 nt, Human
uccuaguuccaccaucaagcc

SEQ ID NO: 1187662 - RNA, 22 nt, Human
uccuaguuccaccaucaagcca

SEQ ID NO: 1187663 - RNA, 16 nt, Human
uccuaagcuauucagu

SEQ ID NO: 1187664 - RNA, 18 nt, Human
uccuaagcuauucaguaa

SEQ ID NO: 1187665 - RNA, 14 nt, Human
uccuaguuccacca

SEQ ID NO: 1187666 - RNA, 17 nt, Human
uccuaguuccaccauca

SEQ ID NO: 1187667 - RNA, 20 nt, Human
uccucaaaacuucagacaua

SEQ ID NO: 1187668 - RNA, 12 nt, Human
uccuccaggugc

SEQ ID NO: 1187669 - RNA, 13 nt, Human
uccuccaggugca

SEQ ID NO: 1187670 - RNA, 14 nt, Human
uccuccaggugcac

SEQ ID NO: 1187671 - RNA, 18 nt, Human
uccuccaggugcacaagc

SEQ ID NO: 1187672 - RNA, 20 nt, Human
uccuccaggugcacaagcuc

SEQ ID NO: 1187673 - RNA, 22 nt, Human
uccuccaggugcacaagcucca

SEQ ID NO: 1187674 - RNA, 12 nt, Human
uccuccucagau

SEQ ID NO: 1187675 - RNA, 22 nt, Human
uccuugaaaacacuguucucug

SEQ ID NO: 1187676 - RNA, 23 nt, Human
uccuugaaaacacuguucucugc

SEQ ID NO: 1187677 - RNA, 21 nt, Human
uccuuaccagcagagcaccuu

SEQ ID NO: 1187678 - RNA, 18 nt, Human
uccuuggugucgggcaug

SEQ ID NO: 1187679 - RNA, 21 nt, Human
uccuuggugucgggcaugaca

SEQ ID NO: 1187680 - RNA, 22 nt, Human
uccuuggugucgggcaugacac

SEQ ID NO: 1187681 - RNA, 17 nt, Human
uccuuugugaggaagcc

SEQ ID NO: 1187682 - RNA, 18 nt, Human
uccuuugugaggaagccg

SEQ ID NO: 1187683 - RNA, 22 nt, Human
uccuuugugaggaagccgcugg

SEQ ID NO: 1187684 - RNA, 22 nt, Human
uccuuuucgcaggauucuuccu

SEQ ID NO: 1187685 - RNA, 17 nt, Human
ucgcaggauucuuccuc

SEQ ID NO: 1187686 - RNA, 21 nt, Human
ucgcaggauucuuccucccuc

SEQ ID NO: 1187687 - RNA, 23 nt, Human
ucgcaggauucuuccucccuccc

SEQ ID NO: 1187688 - RNA, 14 nt, Human
ucgcccagucugga

SEQ ID NO: 1187689 - RNA, 19 nt, Human
ucgcccagucuggaaugca

SEQ ID NO: 1187690 - RNA, 23 nt, Human
ucgcccagucuggaaugcagugg

SEQ ID NO: 1187691 - RNA, 15 nt, Human
ucggaaaacaugcua

SEQ ID NO: 1187692 - RNA, 18 nt, Human
ucggaaaacaugcuacac

SEQ ID NO: 1187693 - RNA, 15 nt, Human
ucggccuccauccug

SEQ ID NO: 1187694 - RNA, 16 nt, Human
ucggccuccauccuga

SEQ ID NO: 1187695 - RNA, 17 nt, Human
ucggccuccauccugag

SEQ ID NO: 1187696 - RNA, 15 nt, Human
ucuacuaaaaauaca

SEQ ID NO: 1187697 - RNA, 19 nt, Human
ucuacuaaaaauacaaaaa

SEQ ID NO: 1187698 - RNA, 12 nt, Human
ucuagggaaaaa

SEQ ID NO: 1187699 - RNA, 19 nt, Human
ucuagggaaaaaccagcgu

SEQ ID NO: 1187700 - RNA, 20 nt, Human
ucuacucgaguuacagacaa

SEQ ID NO: 1187701 - RNA, 21 nt, Human
ucuacucgaguuacagacaaa

SEQ ID NO: 1187702 - RNA, 18 nt, Human
ucuacucuagggaaaaac

SEQ ID NO: 1187703 - RNA, 13 nt, Human
ucucaaauuucua

SEQ ID NO: 1187704 - RNA, 14 nt, Human
ucucaaauuucuaa

SEQ ID NO: 1187705 - RNA, 16 nt, Human
ucucaaauuucuaaau

SEQ ID NO: 1187706 - RNA, 23 nt, Human
ucucacacaugagcaucaggcca

SEQ ID NO: 1187707 - RNA, 20 nt, Human
ucucacugccaugccagcuu

SEQ ID NO: 1187708 - RNA, 21 nt, Human
ucucacacaugagcaucaggc

SEQ ID NO: 1187709 - RNA, 23 nt, Human
ucucacucugucgcccagucugg

SEQ ID NO: 1187710 - RNA, 18 nt, Human
ucucaaauuucuaaaucu

SEQ ID NO: 1187711 - RNA, 13 nt, Human
ucuaugaaauauu

SEQ ID NO: 1187712 - RNA, 16 nt, Human
ucucacacaugagcau

SEQ ID NO: 1187713 - RNA, 14 nt, Human
ucucacuguugccc

SEQ ID NO: 1187714 - RNA, 15 nt, Human
ucucacuguugccca

SEQ ID NO: 1187715 - RNA, 17 nt, Human
ucucacuguugcccagg

SEQ ID NO: 1187716 - RNA, 15 nt, Human
ucugccucugacaca

SEQ ID NO: 1187717 - RNA, 18 nt, Human
ucugccucugacacacag

SEQ ID NO: 1187718 - RNA, 16 nt, Human
ucugccucccaucacc

SEQ ID NO: 1187719 - RNA, 17 nt, Human
ucugccucccaucaccc

SEQ ID NO: 1187720 - RNA, 20 nt, Human
ucugccucccaucacccgcu

SEQ ID NO: 1187721 - RNA, 21 nt, Human
ucugccucccaucacccgcua

SEQ ID NO: 1187722 - RNA, 21 nt, Human
ucugccucugacacacagcuc

SEQ ID NO: 1187723 - RNA, 22 nt, Human
ucugccucugacacacagcucu

SEQ ID NO: 1187724 - RNA, 23 nt, Human
ucugccucugacacacagcucug

SEQ ID NO: 1187725 - RNA, 19 nt, Human
ucugccugaagucacacag

SEQ ID NO: 1187726 - RNA, 20 nt, Human
ucugccugaagucacacagu

SEQ ID NO: 1187727 - RNA, 22 nt, Human
ucugccauauucuguuggccag

SEQ ID NO: 1187728 - RNA, 23 nt, Human
ucugccauauucuguuggccagu

SEQ ID NO: 1187729 - RNA, 12 nt, Human
ucugcccacucc

SEQ ID NO: 1187730 - RNA, 13 nt, Human
ucugcccacuccc

SEQ ID NO: 1187731 - RNA, 14 nt, Human
ucugcccacucccu

SEQ ID NO: 1187732 - RNA, 16 nt, Human
ucugcccacucccugc

SEQ ID NO: 1187733 - RNA, 12 nt, Human
ucugccucccau

SEQ ID NO: 1187734 - RNA, 13 nt, Human
ucugccucccauc

SEQ ID NO: 1187735 - RNA, 15 nt, Human
ucugccucccaucac

SEQ ID NO: 1187736 - RNA, 20 nt, Human
ucugacccaugcugcccugu

SEQ ID NO: 1187737 - RNA, 22 nt, Human
ucugacccaugcugcccuguga

SEQ ID NO: 1187738 - RNA, 23 nt, Human
ucugacccaugcugcccugugag

SEQ ID NO: 1187739 - RNA, 18 nt, Human
ucugagaggacuuuucuu

SEQ ID NO: 1187740 - RNA, 24 nt, Human
ucugagaucaaaacgguuuuacug

SEQ ID NO: 1187741 - RNA, 18 nt, Human
ucugaggaauccagaccc

SEQ ID NO: 1187742 - RNA, 21 nt, Human
ucugaggaauccagacccggc

SEQ ID NO: 1187743 - RNA, 22 nt, Human
ucugaggaauccagacccggcu

SEQ ID NO: 1187744 - RNA, 23 nt, Human
ucugaggaauccagacccggcug

SEQ ID NO: 1187745 - RNA, 13 nt, Human
ucugcacuccccu

SEQ ID NO: 1187746 - RNA, 17 nt, Human
ucugcugacagacacag

SEQ ID NO: 1187747 - RNA, 11 nt, Human
ucugcugcugg

SEQ ID NO: 1187748 - RNA, 13 nt, Human
ucugcugcuggcu

SEQ ID NO: 1187749 - RNA, 13 nt, Human
ucugccugcccag

SEQ ID NO: 1187750 - RNA, 17 nt, Human
ucugccugcccaggccc

SEQ ID NO: 1187751 - RNA, 18 nt, Human
ucugccugcccaggcccc

SEQ ID NO: 1187752 - RNA, 20 nt, Human
ucugccugcccaggccccug

SEQ ID NO: 1187753 - RNA, 21 nt, Human
ucugccugcccaggccccugc

SEQ ID NO: 1187754 - RNA, 14 nt, Human
ucugcugcuggcug

SEQ ID NO: 1187755 - RNA, 15 nt, Human
ucugcugcuggcugg

SEQ ID NO: 1187756 - RNA, 17 nt, Human
ucugcugcuggcugguu

SEQ ID NO: 1187757 - RNA, 16 nt, Human
ucuggugacuuuccuc

SEQ ID NO: 1187758 - RNA, 14 nt, Human
ucuguacagagccc

SEQ ID NO: 1187759 - RNA, 15 nt, Human
ucuguacagagccca

SEQ ID NO: 1187760 - RNA, 23 nt, Human
ucuguacagagcccacgccccca

SEQ ID NO: 1187761 - RNA, 12 nt, Human
ucuguccuggga

SEQ ID NO: 1187762 - RNA, 17 nt, Human
ucugucgcccagucugg

SEQ ID NO: 1187763 - RNA, 21 nt, Human
ucuguccugggagugagcugg

SEQ ID NO: 1187764 - RNA, 13 nt, Human
ucugucuaggaau

SEQ ID NO: 1187765 - RNA, 14 nt, Human
ucugucucagucca

SEQ ID NO: 1187766 - RNA, 15 nt, Human
ucuucagaucucuaa

SEQ ID NO: 1187767 - RNA, 16 nt, Human
ucuuaguggauguucu

SEQ ID NO: 1187768 - RNA, 14 nt, Human
ucuuauacauuuga

SEQ ID NO: 1187769 - RNA, 22 nt, Human
ucuuauccaacaucaacaucuu

SEQ ID NO: 1187770 - RNA, 21 nt, Human
ucuucagagacuccugcaggc

SEQ ID NO: 1187771 - RNA, 14 nt, Human
ucuucagaucucua

SEQ ID NO: 1187772 - RNA, 14 nt, Human
ucuuauaauuuaaa

SEQ ID NO: 1187773 - RNA, 13 nt, Human
ucuuauaauuuaa

SEQ ID NO: 1187774 - RNA, 20 nt, Human
ucuuagguuggcaaaaaggc

SEQ ID NO: 1187775 - RNA, 23 nt, Human
ucuuagguuggcaaaaaggcagg

SEQ ID NO: 1187776 - RNA, 17 nt, Human
ucugugucagguggggc

SEQ ID NO: 1187777 - RNA, 20 nt, Human
ucugugucagguggggcagc

SEQ ID NO: 1187778 - RNA, 22 nt, Human
ucugugucagguggggcagcuu

SEQ ID NO: 1187779 - RNA, 15 nt, Human
ucuuagauguauaua

SEQ ID NO: 1187780 - RNA, 19 nt, Human
ucuugccaaauauaaauaa

SEQ ID NO: 1187781 - RNA, 14 nt, Human
ucuugcucugcuga

SEQ ID NO: 1187782 - RNA, 15 nt, Human
ucuugcucugcugac

SEQ ID NO: 1187783 - RNA, 23 nt, Human
ucuugcucugcugacagacacag

SEQ ID NO: 1187784 - RNA, 16 nt, Human
ucuucuuggucucagu

SEQ ID NO: 1187785 - RNA, 20 nt, Human
ucuugaaauauaggaacuua

SEQ ID NO: 1187786 - RNA, 21 nt, Human
ucuugaaauauaggaacuuaa

SEQ ID NO: 1187787 - RNA, 13 nt, Human
ucuugaagacuuu

SEQ ID NO: 1187788 - RNA, 22 nt, Human
ucuugaagacuuuucuuucagc

SEQ ID NO: 1187789 - RNA, 20 nt, Human
ugaaaagaaaaaugagccug

SEQ ID NO: 1187790 - RNA, 22 nt, Human
ugaaaagaaaaaugagccuggc

SEQ ID NO: 1187791 - RNA, 19 nt, Human
ugaaaagaaaaaugagccu

SEQ ID NO: 1187792 - RNA, 14 nt, Human
ugaaaauucagugg

SEQ ID NO: 1187793 - RNA, 12 nt, Human
ugaaaauuuuga

SEQ ID NO: 1187794 - RNA, 21 nt, Human
ugaaaacacauuuuucuuagg

SEQ ID NO: 1187795 - RNA, 17 nt, Human
ugaaaacacuguucucu

SEQ ID NO: 1187796 - RNA, 20 nt, Human
ugaaaacacuguucucugcc

SEQ ID NO: 1187797 - RNA, 21 nt, Human
ugaaaacacuguucucugccc

SEQ ID NO: 1187798 - RNA, 22 nt, Human
ugaaaacacuguucucugcccu

SEQ ID NO: 1187799 - RNA, 23 nt, Human
ugaaaacacuguucucugcccuc

SEQ ID NO: 1187800 - RNA, 13 nt, Human
ucuuguguguuua

SEQ ID NO: 1187801 - RNA, 23 nt, Human
ucuuuccaaaguacacuguuuca

SEQ ID NO: 1187802 - RNA, 17 nt, Human
ucuuuccacagaagcuc

SEQ ID NO: 1187803 - RNA, 19 nt, Human
ucuuuccacagaagcucca

SEQ ID NO: 1187804 - RNA, 12 nt, Human
ucuuucccuccc

SEQ ID NO: 1187805 - RNA, 13 nt, Human
ucuuucccucccu

SEQ ID NO: 1187806 - RNA, 23 nt, Human
ucuuucccucccuuccucuuucc

SEQ ID NO: 1187807 - RNA, 23 nt, Human
ucuuugagugaagcugggagaac

SEQ ID NO: 1187808 - RNA, 13 nt, Human
ucuuugcagacag

SEQ ID NO: 1187809 - RNA, 14 nt, Human
ucuuugcagacagg

SEQ ID NO: 1187810 - RNA, 17 nt, Human
ucuuugcagacaggcaa

SEQ ID NO: 1187811 - RNA, 13 nt, Human
ucuuuggacccug

SEQ ID NO: 1187812 - RNA, 14 nt, Human
ucuuuggacccuga

SEQ ID NO: 1187813 - RNA, 15 nt, Human
ucuuuggacccugag

SEQ ID NO: 1187814 - RNA, 16 nt, Human
ucuuuggacccugagg

SEQ ID NO: 1187815 - RNA, 15 nt, Human
ugaaugaauggcuaa

SEQ ID NO: 1187816 - RNA, 20 nt, Human
ugaaugaauggcuaagcaaa

SEQ ID NO: 1187817 - RNA, 20 nt, Human
ugaaggcuggguucugaucc

SEQ ID NO: 1187818 - RNA, 21 nt, Human
ugaaggcuggguucugauccu

SEQ ID NO: 1187819 - RNA, 19 nt, Human
ugaagacucauucuucugu

SEQ ID NO: 1187820 - RNA, 20 nt, Human
ugaagacucauucuucugua

SEQ ID NO: 1187821 - RNA, 18 nt, Human
ugaaggccccgcccaggc

SEQ ID NO: 1187822 - RNA, 19 nt, Human
ugaaggccccgcccaggcu

SEQ ID NO: 1187823 - RNA, 20 nt, Human
ugaaggccccgcccaggcuu

SEQ ID NO: 1187824 - RNA, 23 nt, Human
ugacaacacucauugaccugagg

SEQ ID NO: 1187825 - RNA, 13 nt, Human
ugacaacacucau

SEQ ID NO: 1187826 - RNA, 14 nt, Human
ugaauuaaguuuuu

SEQ ID NO: 1187827 - RNA, 13 nt, Human
ugaauuacauuug

SEQ ID NO: 1187828 - RNA, 14 nt, Human
ugaauuacauuugu

SEQ ID NO: 1187829 - RNA, 13 nt, Human
ugaauuguaagga

SEQ ID NO: 1187830 - RNA, 21 nt, Human
ugaauuguaaggaaugauuaa

SEQ ID NO: 1187831 - RNA, 23 nt, Human
ugacaaggauugcuacuguccua

SEQ ID NO: 1187832 - RNA, 14 nt, Human
ugacacacagcucu

SEQ ID NO: 1187833 - RNA, 15 nt, Human
ugacacacagcucug

SEQ ID NO: 1187834 - RNA, 16 nt, Human
ugacacacagcucugu

SEQ ID NO: 1187835 - RNA, 13 nt, Human
ugacagacacagg

SEQ ID NO: 1187836 - RNA, 14 nt, Human
ugacagacacaggc

SEQ ID NO: 1187837 - RNA, 16 nt, Human
ugacagacacaggccc

SEQ ID NO: 1187838 - RNA, 13 nt, Human
ugacagaggcagc

SEQ ID NO: 1187839 - RNA, 17 nt, Human
ugacagacacaggcccg

SEQ ID NO: 1187840 - RNA, 18 nt, Human
ugacagacacaggcccgg

SEQ ID NO: 1187841 - RNA, 20 nt, Human
ugacagacacaggcccggcu

SEQ ID NO: 1187842 - RNA, 22 nt, Human
ugacagagcaagugagacccug

SEQ ID NO: 1187843 - RNA, 23 nt, Human
ugacaucaacugcaucaagaugu

SEQ ID NO: 1187844 - RNA, 16 nt, Human
ugacaugggacauuug

SEQ ID NO: 1187845 - RNA, 16 nt, Human
ugaccacugcagaaga

SEQ ID NO: 1187846 - RNA, 17 nt, Human
ugaccacugcagaagac

SEQ ID NO: 1187847 - RNA, 18 nt, Human
ugaccacugcagaagaca

SEQ ID NO: 1187848 - RNA, 13 nt, Human
ugacauguuuuau

SEQ ID NO: 1187849 - RNA, 14 nt, Human
ugagaccaaccugg

SEQ ID NO: 1187850 - RNA, 14 nt, Human
ugagaggggaacag

SEQ ID NO: 1187851 - RNA, 18 nt, Human
ugagaggggaacagacug

SEQ ID NO: 1187852 - RNA, 19 nt, Human
ugagaggggaacagacugg

SEQ ID NO: 1187853 - RNA, 12 nt, Human
ugagcagggcuc

SEQ ID NO: 1187854 - RNA, 15 nt, Human
ugagaaauaaaguuu

SEQ ID NO: 1187855 - RNA, 22 nt, Human
ugacuuuucuguccgagcuuug

SEQ ID NO: 1187856 - RNA, 13 nt, Human
ugaccauucucca

SEQ ID NO: 1187857 - RNA, 14 nt, Human
ugaccauucuccac

SEQ ID NO: 1187858 - RNA, 14 nt, Human
ugacucuuaagaag

SEQ ID NO: 1187859 - RNA, 15 nt, Human
ugacucuuaagaaga

SEQ ID NO: 1187860 - RNA, 16 nt, Human
ugacucuuaagaagac

SEQ ID NO: 1187861 - RNA, 21 nt, Human
ugacucuuucuauuguuucuu

SEQ ID NO: 1187862 - RNA, 16 nt, Human
ugacuuuccucuuugg

SEQ ID NO: 1187863 - RNA, 11 nt, Human
ugagcucagga

SEQ ID NO: 1187864 - RNA, 19 nt, Human
ugagcucaggaguuugaga

SEQ ID NO: 1187865 - RNA, 20 nt, Human
ugagcagggcucagcgggga

SEQ ID NO: 1187866 - RNA, 22 nt, Human
ugagcagggcucagcggggaca

SEQ ID NO: 1187867 - RNA, 23 nt, Human
ugagcagggcucagcggggacag

SEQ ID NO: 1187868 - RNA, 22 nt, Human
ugagccgagaucacgccacugc

SEQ ID NO: 1187869 - RNA, 23 nt, Human
ugagccgagaucacgccacugca

SEQ ID NO: 1187870 - RNA, 15 nt, Human
ugagcagucaggaaa

SEQ ID NO: 1187871 - RNA, 22 nt, Human
ugaggaugaaaaaauaacacug

SEQ ID NO: 1187872 - RNA, 15 nt, Human
ugaggugcuauguuc

SEQ ID NO: 1187873 - RNA, 21 nt, Human
ugaggcugggcucccuuccca

SEQ ID NO: 1187874 - RNA, 18 nt, Human
ugaggucagagccugcag

SEQ ID NO: 1187875 - RNA, 19 nt, Human
ugaggucagagccugcagu

SEQ ID NO: 1187876 - RNA, 16 nt, Human
ugaggcucugcccuug

SEQ ID NO: 1187877 - RNA, 18 nt, Human
ugaggcucugcccuuggu

SEQ ID NO: 1187878 - RNA, 15 nt, Human
ugaggcugggcuccc

SEQ ID NO: 1187879 - RNA, 16 nt, Human
ugaggcugggcucccu

SEQ ID NO: 1187880 - RNA, 23 nt, Human
ugcagcaauaaagcagcguuucu

SEQ ID NO: 1187881 - RNA, 12 nt, Human
ugcacuuuguuc

SEQ ID NO: 1187882 - RNA, 14 nt, Human
ugcacuuuguucug

SEQ ID NO: 1187883 - RNA, 19 nt, Human
ugaguccccuguuuguuuc

SEQ ID NO: 1187884 - RNA, 23 nt, Human
ugcaccggcuggccuggccccuc

SEQ ID NO: 1187885 - RNA, 14 nt, Human
ugcaccgggccaca

SEQ ID NO: 1187886 - RNA, 15 nt, Human
ugcaccgggccacag

SEQ ID NO: 1187887 - RNA, 17 nt, Human
ugcaccgggccacagag

SEQ ID NO: 1187888 - RNA, 22 nt, Human
ugcaccgggccacagagaaagu

SEQ ID NO: 1187889 - RNA, 20 nt, Human
ugaguccccuguuuguuucu

SEQ ID NO: 1187890 - RNA, 15 nt, Human
ugcaguugccaguca

SEQ ID NO: 1187891 - RNA, 19 nt, Human
ugcaguucugaagaagaug

SEQ ID NO: 1187892 - RNA, 22 nt, Human
ugcaguucugaagaagauggua

SEQ ID NO: 1187893 - RNA, 13 nt, Human
ugcaguugccagu

SEQ ID NO: 1187894 - RNA, 14 nt, Human
ugcaguugccaguc

SEQ ID NO: 1187895 - RNA, 22 nt, Human
ugcagugguaugaucacggcuc

SEQ ID NO: 1187896 - RNA, 20 nt, Human
ugcaguggugcgaucugggu

SEQ ID NO: 1187897 - RNA, 15 nt, Human
ugcaguucugaagaa

SEQ ID NO: 1187898 - RNA, 16 nt, Human
ugcaguucugaagaag

SEQ ID NO: 1187899 - RNA, 17 nt, Human
ugcaguucugaagaaga

SEQ ID NO: 1187900 - RNA, 18 nt, Human
ugcaguucugaagaagau

SEQ ID NO: 1187901 - RNA, 13 nt, Human
ugcaggcagccag

SEQ ID NO: 1187902 - RNA, 14 nt, Human
ugcaggcagccagg

SEQ ID NO: 1187903 - RNA, 15 nt, Human
ugcaggcagccaggc

SEQ ID NO: 1187904 - RNA, 16 nt, Human
ugcagugcuuccaagg

SEQ ID NO: 1187905 - RNA, 23 nt, Human
ugccccucaacucuccuccagag

SEQ ID NO: 1187906 - RNA, 24 nt, Human
ugccagguuuuuggucugacccac

SEQ ID NO: 1187907 - RNA, 21 nt, Human
ugccauccagguucagcuugu

SEQ ID NO: 1187908 - RNA, 13 nt, Human
ugcccaccuggcc

SEQ ID NO: 1187909 - RNA, 14 nt, Human
ugcccaccuggccu

SEQ ID NO: 1187910 - RNA, 14 nt, Human
ugcccacucccugc

SEQ ID NO: 1187911 - RNA, 15 nt, Human
ugcccacucccugca

SEQ ID NO: 1187912 - RNA, 16 nt, Human
ugcccacucccugcaa

SEQ ID NO: 1187913 - RNA, 11 nt, Human
ugcccaggcug

SEQ ID NO: 1187914 - RNA, 21 nt, Human
ugcccacucccugcaaccuga

SEQ ID NO: 1187915 - RNA, 13 nt, Human
ugcccaggcuggc

SEQ ID NO: 1187916 - RNA, 20 nt, Human
ugccacccuggggagaaagu

SEQ ID NO: 1187917 - RNA, 22 nt, Human
ugccacuacggaauaguuggcu

SEQ ID NO: 1187918 - RNA, 19 nt, Human
ugccacccuggggagaaag

SEQ ID NO: 1187919 - RNA, 10 nt, Human
ugccaggcau

SEQ ID NO: 1187920 - RNA, 18 nt, Human
ugccagguuuuuggucug

SEQ ID NO: 1187921 - RNA, 19 nt, Human
ugccagguuuuuggucuga

SEQ ID NO: 1187922 - RNA, 22 nt, Human
ugccagguuuuuggucugaccc

SEQ ID NO: 1187923 - RNA, 22 nt, Human
ugccaaauauaaauaaaaauaa

SEQ ID NO: 1187924 - RNA, 19 nt, Human
ugccaaauauaaauaaaaa

SEQ ID NO: 1187925 - RNA, 14 nt, Human
ugcaucaagaugug

SEQ ID NO: 1187926 - RNA, 19 nt, Human
ugcaucaagaugugacaug

SEQ ID NO: 1187927 - RNA, 18 nt, Human
ugccaaauauaaauaaaa

SEQ ID NO: 1187928 - RNA, 17 nt, Human
ugccaaauauaaauaaa

SEQ ID NO: 1187929 - RNA, 14 nt, Human
ugccugguggcagc

SEQ ID NO: 1187930 - RNA, 15 nt, Human
ugccugguggcagcu

SEQ ID NO: 1187931 - RNA, 16 nt, Human
ugccugguggcagcug

SEQ ID NO: 1187932 - RNA, 18 nt, Human
ugccuguaaucacagcua

SEQ ID NO: 1187933 - RNA, 21 nt, Human
ugccugggaucccucauccuc

SEQ ID NO: 1187934 - RNA, 18 nt, Human
ugccugggcagaaggaag

SEQ ID NO: 1187935 - RNA, 18 nt, Human
ugccccuggcagccccug

SEQ ID NO: 1187936 - RNA, 18 nt, Human
ugccucgaacuggcugca

SEQ ID NO: 1187937 - RNA, 19 nt, Human
ugccucgaacuggcugcaa

SEQ ID NO: 1187938 - RNA, 20 nt, Human
ugccucgaacuggcugcaaa

SEQ ID NO: 1187939 - RNA, 17 nt, Human
ugccugaagucacacag

SEQ ID NO: 1187940 - RNA, 15 nt, Human
ugccuucucaacucc

SEQ ID NO: 1187941 - RNA, 17 nt, Human
ugccuucucaacuccaa

SEQ ID NO: 1187942 - RNA, 14 nt, Human
ugcgaucuggguuc

SEQ ID NO: 1187943 - RNA, 15 nt, Human
ugcgaucuggguuca

SEQ ID NO: 1187944 - RNA, 19 nt, Human
ugcgaucuggguucacugc

SEQ ID NO: 1187945 - RNA, 20 nt, Human
ugcgaucuggguucacugca

SEQ ID NO: 1187946 - RNA, 21 nt, Human
ugcgaucuggguucacugcaa

SEQ ID NO: 1187947 - RNA, 15 nt, Human
ugcuaaaugugaaug

SEQ ID NO: 1187948 - RNA, 14 nt, Human
ugcgccuacaggag

SEQ ID NO: 1187949 - RNA, 16 nt, Human
ugcgccuacaggagug

SEQ ID NO: 1187950 - RNA, 22 nt, Human
ugcgccuacaggagugagcacu

SEQ ID NO: 1187951 - RNA, 15 nt, Human
ugcgugcauaccacu

SEQ ID NO: 1187952 - RNA, 17 nt, Human
ugcuccucuccccagca

SEQ ID NO: 1187953 - RNA, 18 nt, Human
ugcuccucuccccagcaa

SEQ ID NO: 1187954 - RNA, 18 nt, Human
ugcuccuuucuuguuuua

SEQ ID NO: 1187955 - RNA, 15 nt, Human
ugcuaagcauuccaa

SEQ ID NO: 1187956 - RNA, 19 nt, Human
ugcuaagcauuccaacuau

SEQ ID NO: 1187957 - RNA, 15 nt, Human
ugcucacauaucugu

SEQ ID NO: 1187958 - RNA, 16 nt, Human
ugcucacauaucuguc

SEQ ID NO: 1187959 - RNA, 17 nt, Human
ugcucacauaucuguca

SEQ ID NO: 1187960 - RNA, 14 nt, Human
ugcuccucucccca

SEQ ID NO: 1187961 - RNA, 12 nt, Human
ugcugaaggcuc

SEQ ID NO: 1187962 - RNA, 13 nt, Human
ugcugaaggcucg

SEQ ID NO: 1187963 - RNA, 21 nt, Human
ugcugaaggcucgagcaugcc

SEQ ID NO: 1187964 - RNA, 22 nt, Human
ugcugacagacacaggcccggc

SEQ ID NO: 1187965 - RNA, 23 nt, Human
ugcugacagacacaggcccggcu

SEQ ID NO: 1187966 - RNA, 13 nt, Human
ugcugauggugca

SEQ ID NO: 1187967 - RNA, 15 nt, Human
ugcugauggugcaau

SEQ ID NO: 1187968 - RNA, 17 nt, Human
ugcugauggugcaauga

SEQ ID NO: 1187969 - RNA, 18 nt, Human
ugcugauggugcaaugac

SEQ ID NO: 1187970 - RNA, 18 nt, Human
ugcugcaguugccaguca

SEQ ID NO: 1187971 - RNA, 23 nt, Human
ugcugcaguugccagucaccccg

SEQ ID NO: 1187972 - RNA, 14 nt, Human
ugcugcauuuaaaa

SEQ ID NO: 1187973 - RNA, 13 nt, Human
ugcugcuggcugg

SEQ ID NO: 1187974 - RNA, 23 nt, Human
uggaaacuucagcgguuuauaua

SEQ ID NO: 1187975 - RNA, 21 nt, Human
uggaaagacuuuuccaacccu

SEQ ID NO: 1187976 - RNA, 20 nt, Human
uggaaagaguaggaagacuu

SEQ ID NO: 1187977 - RNA, 20 nt, Human
uggaaaaauagccugccucu

SEQ ID NO: 1187978 - RNA, 13 nt, Human
uggacaugcacag

SEQ ID NO: 1187979 - RNA, 19 nt, Human
uggacaugcacagcuaaca

SEQ ID NO: 1187980 - RNA, 22 nt, Human
uggaauaauccuaaacauauga

SEQ ID NO: 1187981 - RNA, 17 nt, Human
uggaauaaggagaauga

SEQ ID NO: 1187982 - RNA, 15 nt, Human
uggaauauauaacca

SEQ ID NO: 1187983 - RNA, 16 nt, Human
uggaauauauaaccag

SEQ ID NO: 1187984 - RNA, 14 nt, Human
uggaauaacaugua

SEQ ID NO: 1187985 - RNA, 15 nt, Human
uggaauaacauguaa

SEQ ID NO: 1187986 - RNA, 19 nt, Human
uggaauaacauguaauuaa

SEQ ID NO: 1187987 - RNA, 12 nt, Human
uggaggaaggaa

SEQ ID NO: 1187988 - RNA, 18 nt, Human
uggaggaaggaaacccag

SEQ ID NO: 1187989 - RNA, 20 nt, Human
uggaggaaggaaacccagcu

SEQ ID NO: 1187990 - RNA, 11 nt, Human
uggagggaagc

SEQ ID NO: 1187991 - RNA, 20 nt, Human
uggauuuaacagaaauguac

SEQ ID NO: 1187992 - RNA, 24 nt, Human
uggauuuaacagaaauguacagca

SEQ ID NO: 1187993 - RNA, 13 nt, Human
uggcagcugcuuu

SEQ ID NO: 1187994 - RNA, 21 nt, Human
uggcacccggccccugcuggu

SEQ ID NO: 1187995 - RNA, 13 nt, Human
uggcagugggagc

SEQ ID NO: 1187996 - RNA, 21 nt, Human
uggccagaugcaccagcccuu

SEQ ID NO: 1187997 - RNA, 15 nt, Human
ugggcagaggaaagc

SEQ ID NO: 1187998 - RNA, 18 nt, Human
ugggauccuccaggugca

SEQ ID NO: 1187999 - RNA, 13 nt, Human
ugggauccuggag

SEQ ID NO: 1188000 - RNA, 16 nt, Human
ugggauuacaggugug

SEQ ID NO: 1188001 - RNA, 17 nt, Human
ugggagcugccuguuca

SEQ ID NO: 1188002 - RNA, 21 nt, Human
ugggagcugccuguucagcuc

SEQ ID NO: 1188003 - RNA, 22 nt, Human
ugggagcugccuguucagcucc

SEQ ID NO: 1188004 - RNA, 23 nt, Human
ugggagcugccuguucagcucca

SEQ ID NO: 1188005 - RNA, 15 nt, Human
ugggagugagcuggu

SEQ ID NO: 1188006 - RNA, 15 nt, Human
ugggauccuccaggu

SEQ ID NO: 1188007 - RNA, 12 nt, Human
ugggacacccug

SEQ ID NO: 1188008 - RNA, 15 nt, Human
uggcuuuugugcauu

SEQ ID NO: 1188009 - RNA, 13 nt, Human
ugggacacccugu

SEQ ID NO: 1188010 - RNA, 13 nt, Human
ugggagcaaaaga

SEQ ID NO: 1188011 - RNA, 12 nt, Human
ugggagcugccu

SEQ ID NO: 1188012 - RNA, 13 nt, Human
ugggagcugccug

SEQ ID NO: 1188013 - RNA, 14 nt, Human
ugggagcugccugu

SEQ ID NO: 1188014 - RNA, 21 nt, Human
uggcuugaguuuaaauuguaa

SEQ ID NO: 1188015 - RNA, 14 nt, Human
uggcuuuugugcau

SEQ ID NO: 1188016 - RNA, 16 nt, Human
uggcuuccuggcaaua

SEQ ID NO: 1188017 - RNA, 21 nt, Human
uggcugggggccucagugcca

SEQ ID NO: 1188018 - RNA, 21 nt, Human
uggcugcuucaaggauccuga

SEQ ID NO: 1188019 - RNA, 22 nt, Human
uggguucuacccaggugcuagg

SEQ ID NO: 1188020 - RNA, 16 nt, Human
uggguucuacccaggu

SEQ ID NO: 1188021 - RNA, 19 nt, Human
ugggguuuaucagaauucu

SEQ ID NO: 1188022 - RNA, 16 nt, Human
uggguaacuagggaag

SEQ ID NO: 1188023 - RNA, 17 nt, Human
uggguuucuaaagcugc

SEQ ID NO: 1188024 - RNA, 18 nt, Human
uggguuucuaaagcugcc

SEQ ID NO: 1188025 - RNA, 21 nt, Human
uggguuucuaaagcugccagc

SEQ ID NO: 1188026 - RNA, 18 nt, Human
ugguaugaucacggcuca

SEQ ID NO: 1188027 - RNA, 23 nt, Human
ugguauuggcuagagguucaaag

SEQ ID NO: 1188028 - RNA, 16 nt, Human
ugggcagaggaaagca

SEQ ID NO: 1188029 - RNA, 22 nt, Human
ugggcuaagugauccucccacc

SEQ ID NO: 1188030 - RNA, 16 nt, Human
ugggcuaguugggcuu

SEQ ID NO: 1188031 - RNA, 17 nt, Human
ugggcuggugucaccug

SEQ ID NO: 1188032 - RNA, 15 nt, Human
ugggcuucaguggca

SEQ ID NO: 1188033 - RNA, 17 nt, Human
ugggcuucaguggcagc

SEQ ID NO: 1188034 - RNA, 21 nt, Human
ugggggaucacagccucugaa

SEQ ID NO: 1188035 - RNA, 17 nt, Human
ugggggcugggcagagg

SEQ ID NO: 1188036 - RNA, 18 nt, Human
ugggggcugggcagagga

SEQ ID NO: 1188037 - RNA, 19 nt, Human
ugggggcugggcagaggaa

SEQ ID NO: 1188038 - RNA, 12 nt, Human
ugggggugcauu

SEQ ID NO: 1188039 - RNA, 15 nt, Human
ugggggugcauuuga

SEQ ID NO: 1188040 - RNA, 17 nt, Human
uguaauuaaguacuaug

SEQ ID NO: 1188041 - RNA, 16 nt, Human
uguacagagcccacgc

SEQ ID NO: 1188042 - RNA, 17 nt, Human
uguacagagcccacgcc

SEQ ID NO: 1188043 - RNA, 18 nt, Human
uguacagagcccacgccc

SEQ ID NO: 1188044 - RNA, 21 nt, Human
uguacagagcccacgccccca

SEQ ID NO: 1188045 - RNA, 16 nt, Human
uguaccgcaaugugac

SEQ ID NO: 1188046 - RNA, 17 nt, Human
uggucacaggaaguaga

SEQ ID NO: 1188047 - RNA, 14 nt, Human
uguaaucacagcua

SEQ ID NO: 1188048 - RNA, 14 nt, Human
uguaccucuugagc

SEQ ID NO: 1188049 - RNA, 15 nt, Human
uguacgucugacagg

SEQ ID NO: 1188050 - RNA, 16 nt, Human
uguacgucugacaggc

SEQ ID NO: 1188051 - RNA, 17 nt, Human
ugucacacacuuuggcu

SEQ ID NO: 1188052 - RNA, 12 nt, Human
ugucacaggcag

SEQ ID NO: 1188053 - RNA, 13 nt, Human
ugucacaggcagg

SEQ ID NO: 1188054 - RNA, 15 nt, Human
uguaugauucccagc

SEQ ID NO: 1188055 - RNA, 22 nt, Human
uguauucucuccuguaccucuu

SEQ ID NO: 1188056 - RNA, 16 nt, Human
uguaugauucccagcc

SEQ ID NO: 1188057 - RNA, 16 nt, Human
ugucauuugagcaggg

SEQ ID NO: 1188058 - RNA, 19 nt, Human
ugucauuugagcagggcuc

SEQ ID NO: 1188059 - RNA, 13 nt, Human
ugucaccugaaga

SEQ ID NO: 1188060 - RNA, 18 nt, Human
uguccccaccgcagacag

SEQ ID NO: 1188061 - RNA, 19 nt, Human
uguccccaccgcagacagg

SEQ ID NO: 1188062 - RNA, 22 nt, Human
uguccccaccgcagacaggacc

SEQ ID NO: 1188063 - RNA, 16 nt, Human
uguccccgacccuugc

SEQ ID NO: 1188064 - RNA, 17 nt, Human
uguccccgacccuugcc

SEQ ID NO: 1188065 - RNA, 20 nt, Human
uguccuacccacccuccuuu

SEQ ID NO: 1188066 - RNA, 12 nt, Human
uguccuacucug

SEQ ID NO: 1188067 - RNA, 17 nt, Human
uguccuacucuguguca

SEQ ID NO: 1188068 - RNA, 16 nt, Human
ugucuuuuuucacuac

SEQ ID NO: 1188069 - RNA, 23 nt, Human
ugucuuuucuugcaugaggcuag

SEQ ID NO: 1188070 - RNA, 17 nt, Human
ugucuuuggacccugag

SEQ ID NO: 1188071 - RNA, 23 nt, Human
ugugaaaagaaaaaugagccugg

SEQ ID NO: 1188072 - RNA, 14 nt, Human
ugucuuuggacccu

SEQ ID NO: 1188073 - RNA, 16 nt, Human
ugucuuuggacccuga

SEQ ID NO: 1188074 - RNA, 13 nt, Human
ugugaggaagccg

SEQ ID NO: 1188075 - RNA, 18 nt, Human
ugugaggaagccgcuggg

SEQ ID NO: 1188076 - RNA, 20 nt, Human
ugugaggaagccgcuggggc

SEQ ID NO: 1188077 - RNA, 17 nt, Human
ugugagucaccaagccc

SEQ ID NO: 1188078 - RNA, 19 nt, Human
ugugagucaccaagcccag

SEQ ID NO: 1188079 - RNA, 21 nt, Human
ugugagucaccaagcccaguu

SEQ ID NO: 1188080 - RNA, 14 nt, Human
ugugcgccuacagg

SEQ ID NO: 1188081 - RNA, 19 nt, Human
ugugcgccuacaggaguga

SEQ ID NO: 1188082 - RNA, 19 nt, Human
ugugcuaguaauuggaaag

SEQ ID NO: 1188083 - RNA, 16 nt, Human
ugugcacaugcacgug

SEQ ID NO: 1188084 - RNA, 14 nt, Human
ugugcauuaucuag

SEQ ID NO: 1188085 - RNA, 16 nt, Human
ugugcauuaucuagau

SEQ ID NO: 1188086 - RNA, 19 nt, Human
ugugcauuaucuagauacu

SEQ ID NO: 1188087 - RNA, 20 nt, Human
ugugcauuaucuagauacug

SEQ ID NO: 1188088 - RNA, 21 nt, Human
ugugcauuaucuagauacugu

SEQ ID NO: 1188089 - RNA, 23 nt, Human
ugugcauuaucuagauacuguau

SEQ ID NO: 1188090 - RNA, 23 nt, Human
ugugcauuuggugguuucagaaa

SEQ ID NO: 1188091 - RNA, 23 nt, Human
uguggcgcagcauauucaggaag

SEQ ID NO: 1188092 - RNA, 18 nt, Human
uguggacacagcucuucu

SEQ ID NO: 1188093 - RNA, 19 nt, Human
uguggacacagcucuucuc

SEQ ID NO: 1188094 - RNA, 13 nt, Human
uguggacacagcu

SEQ ID NO: 1188095 - RNA, 22 nt, Human
ugugggcuaguugggcuuccuc

SEQ ID NO: 1188096 - RNA, 12 nt, Human
uguguagggcgg

SEQ ID NO: 1188097 - RNA, 16 nt, Human
uguguagggcgggagg

SEQ ID NO: 1188098 - RNA, 21 nt, Human
ugugugaaagguacuucaaau

SEQ ID NO: 1188099 - RNA, 22 nt, Human
ugugugaaagguacuucaaauc

SEQ ID NO: 1188100 - RNA, 19 nt, Human
ugugugcacguacacacac

SEQ ID NO: 1188101 - RNA, 16 nt, Human
uguguuuauugucaaa

SEQ ID NO: 1188102 - RNA, 13 nt, Human
uguguuuugcaag

SEQ ID NO: 1188103 - RNA, 19 nt, Human
uguguuuugcaagccagau

SEQ ID NO: 1188104 - RNA, 14 nt, Human
uguuacuaaguuuu

SEQ ID NO: 1188105 - RNA, 14 nt, Human
uguuagugcaaauu

SEQ ID NO: 1188106 - RNA, 17 nt, Human
uguuaguaugaggcauu

SEQ ID NO: 1188107 - RNA, 19 nt, Human
uguuaguaugaggcauuug

SEQ ID NO: 1188108 - RNA, 20 nt, Human
uguuaguaugaggcauuugu

SEQ ID NO: 1188109 - RNA, 20 nt, Human
uguucagcuccagcucacca

SEQ ID NO: 1188110 - RNA, 21 nt, Human
uguucagcuccagcucaccag

SEQ ID NO: 1188111 - RNA, 22 nt, Human
uguucagcuccagcucaccagc

SEQ ID NO: 1188112 - RNA, 14 nt, Human
uguucagcuccagc

SEQ ID NO: 1188113 - RNA, 12 nt, Human
uguucugggaca

SEQ ID NO: 1188114 - RNA, 21 nt, Human
uguucuggcucuuccaggcug

SEQ ID NO: 1188115 - RNA, 17 nt, Human
uguucuggcucuuccag

SEQ ID NO: 1188116 - RNA, 20 nt, Human
uguucuggcucuuccaggcu

SEQ ID NO: 1188117 - RNA, 20 nt, Human
uguugacaugggacauuugc

SEQ ID NO: 1188118 - RNA, 19 nt, Human
uguucaucauccuaagcua

SEQ ID NO: 1188119 - RNA, 15 nt, Human
uguucucucuucucc

SEQ ID NO: 1188120 - RNA, 16 nt, Human
uguucucucuucucca

SEQ ID NO: 1188121 - RNA, 13 nt, Human
uguucucugcccu

SEQ ID NO: 1188122 - RNA, 14 nt, Human
uguucucugcccuc

SEQ ID NO: 1188123 - RNA, 15 nt, Human
uguucucugcccucc

SEQ ID NO: 1188124 - RNA, 16 nt, Human
uguucucugcccucca

SEQ ID NO: 1188125 - RNA, 13 nt, Human
uguucucugagga

SEQ ID NO: 1188126 - RNA, 12 nt, Human
uguucuggcucu

SEQ ID NO: 1188127 - RNA, 13 nt, Human
uguucuggcucuu

SEQ ID NO: 1188128 - RNA, 16 nt, Human
uguucuggcucuucca

SEQ ID NO: 1188129 - RNA, 15 nt, Human
uguuggccaaagcca

SEQ ID NO: 1188130 - RNA, 15 nt, Human
uguuggccaggcugg

SEQ ID NO: 1188131 - RNA, 16 nt, Human
uguuggccaggcuggu

SEQ ID NO: 1188132 - RNA, 19 nt, Human
uguuggagaagaacugaaa

SEQ ID NO: 1188133 - RNA, 20 nt, Human
uguuggagaagaacugaaau

SEQ ID NO: 1188134 - RNA, 14 nt, Human
uguuggagaagaac

SEQ ID NO: 1188135 - RNA, 16 nt, Human
uguuggagaagaacug

SEQ ID NO: 1188136 - RNA, 17 nt, Human
uguuggagaagaacuga

SEQ ID NO: 1188137 - RNA, 17 nt, Human
uguuggcugggggccuc

SEQ ID NO: 1188138 - RNA, 19 nt, Human
uguuggcugggggccucag

SEQ ID NO: 1188139 - RNA, 13 nt, Human
uuacacuuuaugc

SEQ ID NO: 1188140 - RNA, 20 nt, Human
uuacacuuuaugcacaaaau

SEQ ID NO: 1188141 - RNA, 20 nt, Human
uuacagagacagaaagcaga

SEQ ID NO: 1188142 - RNA, 12 nt, Human
uuacauuuuuaa

SEQ ID NO: 1188143 - RNA, 17 nt, Human
uuacauuuuuaagugcu

SEQ ID NO: 1188144 - RNA, 17 nt, Human
uuaaaugcccagccccu

SEQ ID NO: 1188145 - RNA, 12 nt, Human
uuaacuuuuaua

SEQ ID NO: 1188146 - RNA, 13 nt, Human
uuaacuuuuauaa

SEQ ID NO: 1188147 - RNA, 14 nt, Human
uuaacuuuuauaaa

SEQ ID NO: 1188148 - RNA, 16 nt, Human
uuaauaauguuucaaa

SEQ ID NO: 1188149 - RNA, 15 nt, Human
uguuuccuggcacug

SEQ ID NO: 1188150 - RNA, 16 nt, Human
uguuuguugucagcug

SEQ ID NO: 1188151 - RNA, 16 nt, Human
uguuuuaagaggcagg

SEQ ID NO: 1188152 - RNA, 17 nt, Human
uguuuuaagaggcaggg

SEQ ID NO: 1188153 - RNA, 20 nt, Human
uguuuuaagaggcagggucu

SEQ ID NO: 1188154 - RNA, 22 nt, Human
uguuuuaaggaugcuuguacau

SEQ ID NO: 1188155 - RNA, 23 nt, Human
uguuuuaaggaugcuuguacaua

SEQ ID NO: 1188156 - RNA, 13 nt, Human
uguuuuugucuua

SEQ ID NO: 1188157 - RNA, 22 nt, Human
uuaaaaaaaaaccugagcccca

SEQ ID NO: 1188158 - RNA, 11 nt, Human
uuaaaugcacc

SEQ ID NO: 1188159 - RNA, 14 nt, Human
uuaaaugcccagcc

SEQ ID NO: 1188160 - RNA, 15 nt, Human
uuaaaugcccagccc

SEQ ID NO: 1188161 - RNA, 16 nt, Human
uuaaaugcccagcccc

SEQ ID NO: 1188162 - RNA, 16 nt, Human
uuuccugaggcugggc

SEQ ID NO: 1188163 - RNA, 14 nt, Human
uuaccacagacaua

SEQ ID NO: 1188164 - RNA, 17 nt, Human
uuaccacagacauacua

SEQ ID NO: 1188165 - RNA, 20 nt, Human
uuucuaaaggcuaccuuugu

SEQ ID NO: 1188166 - RNA, 21 nt, Human
uuucuaaaggcuaccuuugua

SEQ ID NO: 1188167 - RNA, 20 nt, Human
uuucuguucuuucuggcuau

SEQ ID NO: 1188168 - RNA, 12 nt, Human
uuucuucucccu

SEQ ID NO: 1188169 - RNA, 13 nt, Human
uuucuucucccuc

SEQ ID NO: 1188170 - RNA, 18 nt, Human
uuucuuagggaaggauac

SEQ ID NO: 1188171 - RNA, 23 nt, Human
uuucuuagggaaggauacaaaag

SEQ ID NO: 1188172 - RNA, 18 nt, Human
uuugaaucaucaagucuu

SEQ ID NO: 1188173 - RNA, 22 nt, Human
uuugaagaugccgcauuuggau

SEQ ID NO: 1188174 - RNA, 14 nt, Human
uuugaacucuucaa

SEQ ID NO: 1188175 - RNA, 15 nt, Human
uuugaacugauaaag

SEQ ID NO: 1188176 - RNA, 17 nt, Human
uuugaacugauaaagau

SEQ ID NO: 1188177 - RNA, 19 nt, Human
uuugaacugauaaagauga

SEQ ID NO: 1188178 - RNA, 21 nt, Human
uuuggaauuuugugcccccau

SEQ ID NO: 1188179 - RNA, 19 nt, Human
uuuggugguuucagaaaug

SEQ ID NO: 1188180 - RNA, 13 nt, Human
uuuguauaaaaua

SEQ ID NO: 1188181 - RNA, 14 nt, Human
uuuguauaaaauaa

SEQ ID NO: 1188182 - RNA, 16 nt, Human
uuuguauaaaauaauu

SEQ ID NO: 1188183 - RNA, 15 nt, Human
uuugcuuugugauuu

SEQ ID NO: 1188184 - RNA, 16 nt, Human
uuugcuuugugauuuu

SEQ ID NO: 1188185 - RNA, 12 nt, Human
uuuggaaaauaa

SEQ ID NO: 1188186 - RNA, 14 nt, Human
uuuggaauuuugug

SEQ ID NO: 1188187 - RNA, 21 nt, Human
uuuguucuggcucuuccaggc

SEQ ID NO: 1188188 - RNA, 21 nt, Human
uuuuaaaagaaugauuaugaa

SEQ ID NO: 1188189 - RNA, 17 nt, Human
uuuuaaagaaugcucuu

SEQ ID NO: 1188190 - RNA, 11 nt, Human
uuuuaaaugca

SEQ ID NO: 1188191 - RNA, 12 nt, Human
uuuuaaaugcac

SEQ ID NO: 1188192 - RNA, 21 nt, Human
uuuuaaaugcaccuggaauau

SEQ ID NO: 1188193 - RNA, 19 nt, Human
uuuuuccuucagugccuua

SEQ ID NO: 1188194 - RNA, 19 nt, Human
uuuuucucuaggaaauauu

SEQ ID NO: 1188195 - RNA, 11 nt, Human
uuuuuccuuca

SEQ ID NO: 1188196 - RNA, 11 nt, Human
uuuuuaaaugc

SEQ ID NO: 1188197 - RNA, 15 nt, Human
uuuuugaagcuguau

SEQ ID NO: 1188198 - RNA, 20 nt, Human
uuuugacaaggggcaguggu

SEQ ID NO: 1188199 - RNA, 14 nt, Human
uuuuggcugcugaa

SEQ ID NO: 1188200 - RNA, 18 nt, Human
uuuuggucuggagggaag

SEQ ID NO: 1188201 - RNA, 15 nt, Human
uuuuggucuguguga

SEQ ID NO: 1188202 - RNA, 14 nt, Human
uuuuccugaaaacc

SEQ ID NO: 1188203 - RNA, 19 nt, Human
uuuuguagagccagggucu

SEQ ID NO: 1188204 - RNA, 16 nt, Human
uuuugucauauaagau

SEQ ID NO: 1188205 - RNA, 18 nt, Human
uuuuuaaaaaagaaacau

SEQ ID NO: 1188206 - RNA, 21 nt, Human
cuggacaauugcuucaagcau

SEQ ID NO: 1188207 - RNA, 18 nt, Human
cugacccucaucuuucuu

SEQ ID NO: 1188208 - RNA, 13 nt, Human
cgugucuggcaca

SEQ ID NO: 1188209 - RNA, 15 nt, Human
cuaggcuaggguggg

SEQ ID NO: 1188210 - RNA, 14 nt, Human
cuaguucugccagg

SEQ ID NO: 1188211 - RNA, 15 nt, Human
cuaguucugccagga

SEQ ID NO: 1188212 - RNA, 16 nt, Human
cuaguucugccaggag

SEQ ID NO: 1188213 - RNA, 15 nt, Human
cuaggguggggagag

SEQ ID NO: 1188214 - RNA, 13 nt, Human
cuaguucugccag

SEQ ID NO: 1188215 - RNA, 21 nt, Human
ccugucucccuccucugcccg

SEQ ID NO: 1188216 - RNA, 18 nt, Human
ccuggugguggcucggga

SEQ ID NO: 1188217 - RNA, 21 nt, Human
ccuggugguggcucgggaggc

SEQ ID NO: 1188218 - RNA, 18 nt, Human
ccugacccucaucuuucu

SEQ ID NO: 1188219 - RNA, 19 nt, Human
ccugacccucaucuuucuu

SEQ ID NO: 1188220 - RNA, 22 nt, Human
ccugacccucaucuuucuucca

SEQ ID NO: 1188221 - RNA, 12 nt, Human
ccauucuuuccc

SEQ ID NO: 1188222 - RNA, 14 nt, Human
ccauucuuucccaa

SEQ ID NO: 1188223 - RNA, 20 nt, Human
ccauucuuucccaacaccuc

SEQ ID NO: 1188224 - RNA, 17 nt, Human
caccuaggcuagggugg

SEQ ID NO: 1188225 - RNA, 18 nt, Human
cagucugagagaggccau

SEQ ID NO: 1188226 - RNA, 20 nt, Human
cugugccuugucacgccaga

SEQ ID NO: 1188227 - RNA, 19 nt, Human
cuucuaguucugccaggag

SEQ ID NO: 1188228 - RNA, 16 nt, Human
cuucuaguucugccag

SEQ ID NO: 1188229 - RNA, 17 nt, Human
cuucuaguucugccagg

SEQ ID NO: 1188230 - RNA, 18 nt, Human
cuucuaguucugccagga

SEQ ID NO: 1188231 - RNA, 15 nt, Human
gacccucaucuuucu

SEQ ID NO: 1188232 - RNA, 19 nt, Human
gacccucaucuuucuucca

SEQ ID NO: 1188233 - RNA, 20 nt, Human
gacccucaucuuucuuccaa

SEQ ID NO: 1188234 - RNA, 18 nt, Human
gcauuucccuuccuuccu

SEQ ID NO: 1188235 - RNA, 23 nt, Human
gccuccauccuacccccugugcc

SEQ ID NO: 1188236 - RNA, 16 nt, Human
gcucaggaaccgaggc

SEQ ID NO: 1188237 - RNA, 19 nt, Human
gcucaggaaccgaggcagg

SEQ ID NO: 1188238 - RNA, 20 nt, Human
gcucaggaaccgaggcaggg

SEQ ID NO: 1188239 - RNA, 21 nt, Human
gcucaggaaccgaggcaggga

SEQ ID NO: 1188240 - RNA, 16 nt, Human
gcuucuaguucugcca

SEQ ID NO: 1188241 - RNA, 17 nt, Human
gcuucuaguucugccag

SEQ ID NO: 1188242 - RNA, 15 nt, Human
ggagagacgggcccu

SEQ ID NO: 1188243 - RNA, 20 nt, Human
ggcucagaggguguccugca

SEQ ID NO: 1188244 - RNA, 22 nt, Human
gggacaccuaggcuaggguggg

SEQ ID NO: 1188245 - RNA, 22 nt, Human
ggugcuucuaguucugccagga

SEQ ID NO: 1188246 - RNA, 14 nt, Human
ggguggggagagac

SEQ ID NO: 1188247 - RNA, 18 nt, Human
ggguggggagagacgggc

SEQ ID NO: 1188248 - RNA, 18 nt, Human
gggggcgcggcugggagg

SEQ ID NO: 1188249 - RNA, 17 nt, Human
ggggccgggggcagucu

SEQ ID NO: 1188250 - RNA, 16 nt, Human
auuucccuuccuuccu

SEQ ID NO: 1188251 - RNA, 20 nt, Human
auuucccuuccuuccucucc

SEQ ID NO: 1188252 - RNA, 21 nt, Human
augugacucuuuccaaccggc

SEQ ID NO: 1188253 - RNA, 12 nt, Human
augugacucuuu

SEQ ID NO: 1188254 - RNA, 16 nt, Human
augugacucuuuccaa

SEQ ID NO: 1188255 - RNA, 14 nt, Human
auccuacccccugu

SEQ ID NO: 1188256 - RNA, 16 nt, Human
auccuacccccugugc

SEQ ID NO: 1188257 - RNA, 11 nt, Human
aucccaacacu

SEQ ID NO: 1188258 - RNA, 13 nt, Human
uucugccaggaga

SEQ ID NO: 1188259 - RNA, 21 nt, Human
agugauuuuuaugccaccuga

SEQ ID NO: 1188260 - RNA, 16 nt, Human
agugauuuuuaugcca

SEQ ID NO: 1188261 - RNA, 20 nt, Human
agugauuuuuaugccaccug

SEQ ID NO: 1188262 - RNA, 20 nt, Human
uguagugauuuuuaugccac

SEQ ID NO: 1188263 - RNA, 21 nt, Human
uguagugauuuuuaugccacc

SEQ ID NO: 1188264 - RNA, 17 nt, Human
uggcuguggcauccaga

SEQ ID NO: 1188265 - RNA, 20 nt, Human
uggcuguggccuaaccugcc

SEQ ID NO: 1188266 - RNA, 18 nt, Human
aggcucagaggguguccu

SEQ ID NO: 1188267 - RNA, 19 nt, Human
aggcucagaggguguccug

SEQ ID NO: 1188268 - RNA, 20 nt, Human
aggcucagaggguguccugc

SEQ ID NO: 1188269 - RNA, 18 nt, Human
aggcgaagcguuguccuc

SEQ ID NO: 1188270 - RNA, 20 nt, Human
uggcauccagagucccugcc

SEQ ID NO: 1188271 - RNA, 21 nt, Human
uggcauccagagucccugccu

SEQ ID NO: 1188272 - RNA, 22 nt, Human
uggcauccagagucccugccug

SEQ ID NO: 1188273 - RNA, 14 nt, Human
aggccauucuuucc

SEQ ID NO: 1188274 - RNA, 15 nt, Human
aggccauucuuuccc

SEQ ID NO: 1188275 - RNA, 22 nt, Human
uggcacagccuggcuguggccu

SEQ ID NO: 1188276 - RNA, 19 nt, Human
agccugacccucaucuuuc

SEQ ID NO: 1188277 - RNA, 16 nt, Human
acuggggcaggggccg

SEQ ID NO: 1188278 - RNA, 14 nt, Human
acuggggcaggggc

SEQ ID NO: 1188279 - RNA, 23 nt, Human
ucgagaucccaacacugccagca

SEQ ID NO: 1188280 - RNA, 20 nt, Human
uccugcaccggggccugggc

SEQ ID NO: 1188281 - RNA, 21 nt, Human
uccugcaccggggccugggca

SEQ ID NO: 1188282 - RNA, 11 nt, Human
uccucagcccc

SEQ ID NO: 1188283 - RNA, 15 nt, Human
acucaugugacucuu

SEQ ID NO: 1188284 - RNA, 16 nt, Human
acucaugugacucuuu

SEQ ID NO: 1188285 - RNA, 17 nt, Human
acucaugugacucuuuc

SEQ ID NO: 1188286 - RNA, 18 nt, Human
acucaugugacucuuucc

SEQ ID NO: 1188287 - RNA, 18 nt, Human
accugaauaaagaaugaa

SEQ ID NO: 1188288 - RNA, 18 nt, Human
ucaggaaccgaggcaggg

SEQ ID NO: 1188289 - RNA, 16 nt, Human
ucagccccgcguggaa

SEQ ID NO: 1188290 - RNA, 20 nt, Human
accagagaaaaagggagggg

SEQ ID NO: 1188291 - RNA, 12 nt, Human
acagccuggcug

SEQ ID NO: 1188292 - RNA, 20 nt, Human
acaccuaggcuagggugggg

SEQ ID NO: 1188293 - RNA, 23 nt, Human
acaccuaggcuaggguggggaga

SEQ ID NO: 1188294 - RNA, 13 nt, Human
uaguucugccagg

SEQ ID NO: 1188295 - RNA, 14 nt, Human
uaguucugccagga

SEQ ID NO: 1188296 - RNA, 19 nt, Human
uaccagagaaaaagggagg

SEQ ID NO: 1188297 - RNA, 14 nt, Human
gugguggcucggga

SEQ ID NO: 1188298 - RNA, 17 nt, Human
guggcacuggggcaggg

SEQ ID NO: 1188299 - RNA, 18 nt, Human
guggcacuggggcagggg

SEQ ID NO: 1188300 - RNA, 15 nt, Human
guccugcaccggggc

SEQ ID NO: 1188301 - RNA, 19 nt, Human
guccugcaccggggccugg

SEQ ID NO: 1188302 - RNA, 20 nt, Human
guccugcaccggggccuggg

SEQ ID NO: 1188303 - RNA, 22 nt, Human
gucccgggacaccuaggcuagg

SEQ ID NO: 1188304 - RNA, 19 nt, Human
augagcuccuuaaggcucu

SEQ ID NO: 1188305 - RNA, 14 nt, Human
agccgggagccuga

SEQ ID NO: 1188306 - RNA, 14 nt, Human
agcugcuccccacg

SEQ ID NO: 1188307 - RNA, 17 nt, Human
agcugcuccccacguca

SEQ ID NO: 1188308 - RNA, 22 nt, Human
agcuccuuaaggcucuuuugua

SEQ ID NO: 1188309 - RNA, 13 nt, Human
acccccugugccu

SEQ ID NO: 1188310 - RNA, 11 nt, Human
acacugccagc

SEQ ID NO: 1188311 - RNA, 16 nt, Human
accugccgagagucca

SEQ ID NO: 1188312 - RNA, 23 nt, Human
accugccgagaguccaucagccu

SEQ ID NO: 1188313 - RNA, 12 nt, Human
acugccagcauu

SEQ ID NO: 1188314 - RNA, 13 nt, Human
aagggagggggag

SEQ ID NO: 1188315 - RNA, 16 nt, Human
caccccgacuuuuguu

SEQ ID NO: 1188316 - RNA, 14 nt, Human
uuuaugccaccuga

SEQ ID NO: 1188317 - RNA, 16 nt, Human
uuaugccaccugaaua

SEQ ID NO: 1188318 - RNA, 13 nt, Human
uuaugccaccuga

SEQ ID NO: 1188319 - RNA, 20 nt, Human
uggggaguuuaggguggggg

SEQ ID NO: 1188320 - RNA, 13 nt, Human
ugggcaggaggga

SEQ ID NO: 1188321 - RNA, 15 nt, Human
ugggcaggagggagg

SEQ ID NO: 1188322 - RNA, 16 nt, Human
ugggcaggagggaggu

SEQ ID NO: 1188323 - RNA, 18 nt, Human
ugggcaggagggaggugc

SEQ ID NO: 1188324 - RNA, 15 nt, Human
uggaccagccucucc

SEQ ID NO: 1188325 - RNA, 16 nt, Human
uggaccagccucucca

SEQ ID NO: 1188326 - RNA, 17 nt, Human
ugcccgggagcucagga

SEQ ID NO: 1188327 - RNA, 19 nt, Human
ugagcuccuuaaggcucuu

SEQ ID NO: 1188328 - RNA, 21 nt, Human
ugagcuccuuaaggcucuuuu

SEQ ID NO: 1188329 - RNA, 18 nt, Human
ucucccuccucugcccgg

SEQ ID NO: 1188330 - RNA, 15 nt, Human
uccugucucccuccu

SEQ ID NO: 1188331 - RNA, 23 nt, Human
uccugucucccuccucugcccgg

SEQ ID NO: 1188332 - RNA, 13 nt, Human
uccuacccccugu

SEQ ID NO: 1188333 - RNA, 15 nt, Human
uccuacccccugugc

SEQ ID NO: 1188334 - RNA, 16 nt, Human
uccuacccccugugcc

SEQ ID NO: 1188335 - RNA, 17 nt, Human
uccuacccccugugccu

SEQ ID NO: 1188336 - RNA, 18 nt, Human
uccagagucccugccugg

SEQ ID NO: 1188337 - RNA, 19 nt, Human
uccagagucccugccugga

SEQ ID NO: 1188338 - RNA, 20 nt, Human
uccagagucccugccuggac

SEQ ID NO: 1188339 - RNA, 21 nt, Human
uccagagucccugccuggacc

SEQ ID NO: 1188340 - RNA, 12 nt, Human
ucaucuuucuuc

SEQ ID NO: 1188341 - RNA, 14 nt, Human
uccaaacaggcuca

SEQ ID NO: 1188342 - RNA, 16 nt, Human
uaggcuagggugggga

SEQ ID NO: 1188343 - RNA, 14 nt, Human
guggcauccagagu

SEQ ID NO: 1188344 - RNA, 18 nt, Human
guggcucgggaggcgaag

SEQ ID NO: 1188345 - RNA, 20 nt, Human
gugcuucuaguucugccagg

SEQ ID NO: 1188346 - RNA, 21 nt, Human
gugcuucuaguucugccagga

SEQ ID NO: 1188347 - RNA, 22 nt, Human
gugcuucuaguucugccaggag

SEQ ID NO: 1188348 - RNA, 19 nt, Human
gugccuugucacgccagac

SEQ ID NO: 1188349 - RNA, 16 nt, Human
gugauuuuuaugccac

SEQ ID NO: 1188350 - RNA, 17 nt, Human
gugauuuuuaugccacc

SEQ ID NO: 1188351 - RNA, 19 nt, Human
gugauuuuuaugccaccug

SEQ ID NO: 1188352 - RNA, 20 nt, Human
gugauuuuuaugccaccuga

SEQ ID NO: 1188353 - RNA, 21 nt, Human
gugauuuuuaugccaccugaa

SEQ ID NO: 1188354 - RNA, 12 nt, Human
gugacucuuucc

SEQ ID NO: 1188355 - RNA, 20 nt, Human
gucccugccuggaccagccu

SEQ ID NO: 1188356 - RNA, 21 nt, Human
gucccugccuggaccagccuc

SEQ ID NO: 1188357 - RNA, 22 nt, Human
gucccugccuggaccagccucu

SEQ ID NO: 1188358 - RNA, 23 nt, Human
gucccugccuggaccagccucuc

SEQ ID NO: 1188359 - RNA, 12 nt, Human
guccucagcccc

SEQ ID NO: 1188360 - RNA, 14 nt, Human
gucacgccagacuu

SEQ ID NO: 1188361 - RNA, 18 nt, Human
ggggaguuuagggugggg

SEQ ID NO: 1188362 - RNA, 15 nt, Human
ggggcagucugagag

SEQ ID NO: 1188363 - RNA, 14 nt, Human
gggcgcggcuggga

SEQ ID NO: 1188364 - RNA, 16 nt, Human
ggcgcggcugggagga

SEQ ID NO: 1188365 - RNA, 14 nt, Human
ggccugggcaggag

SEQ ID NO: 1188366 - RNA, 13 nt, Human
ggccugggcagga

SEQ ID NO: 1188367 - RNA, 16 nt, Human
ggcuaggguggggaga

SEQ ID NO: 1188368 - RNA, 22 nt, Human
ggccuaaccugccgagagucca

SEQ ID NO: 1188369 - RNA, 20 nt, Human
ggccauucuuucccaacacc

SEQ ID NO: 1188370 - RNA, 22 nt, Human
ggaaggaucccaugagcuccuu

SEQ ID NO: 1188371 - RNA, 14 nt, Human
gcuuuguggcacug

SEQ ID NO: 1188372 - RNA, 22 nt, Human
gcuuuguggcacuggggcaggg

SEQ ID NO: 1188373 - RNA, 17 nt, Human
gccugacccucaucuuu

SEQ ID NO: 1188374 - RNA, 23 nt, Human
gcccuggugguggcucgggaggc

SEQ ID NO: 1188375 - RNA, 23 nt, Human
gcacuggggcaggggccgggggc

SEQ ID NO: 1188376 - RNA, 15 nt, Human
gcacuggggcagggg

SEQ ID NO: 1188377 - RNA, 18 nt, Human
gcacuggggcaggggccg

SEQ ID NO: 1188378 - RNA, 21 nt, Human
gagucccugccuggaccagcc

SEQ ID NO: 1188379 - RNA, 23 nt, Human
gagucccugccuggaccagccuc

SEQ ID NO: 1188380 - RNA, 13 nt, Human
gaggguguccugc

SEQ ID NO: 1188381 - RNA, 14 nt, Human
gagggggagagggc

SEQ ID NO: 1188382 - RNA, 20 nt, Human
gaggcgaagcguuguccuca

SEQ ID NO: 1188383 - RNA, 21 nt, Human
gaggcgaagcguuguccucag

SEQ ID NO: 1188384 - RNA, 14 nt, Human
gaggcagggaagga

SEQ ID NO: 1188385 - RNA, 18 nt, Human
gagaucccaacacugcca

SEQ ID NO: 1188386 - RNA, 19 nt, Human
gagaucccaacacugccag

SEQ ID NO: 1188387 - RNA, 20 nt, Human
gagaucccaacacugccagc

SEQ ID NO: 1188388 - RNA, 13 nt, Human
gagagacgggccc

SEQ ID NO: 1188389 - RNA, 14 nt, Human
gaccagccucucca

SEQ ID NO: 1188390 - RNA, 14 nt, Human
cuuuguggcacugg

SEQ ID NO: 1188391 - RNA, 13 nt, Human
cuugucacgccag

SEQ ID NO: 1188392 - RNA, 16 nt, Human
cuugucacgccagacu

SEQ ID NO: 1188393 - RNA, 18 nt, Human
cuugucacgccagacuuc

SEQ ID NO: 1188394 - RNA, 13 nt, Human
cuuucccaacacc

SEQ ID NO: 1188395 - RNA, 21 nt, Human
cugucucccuccucugcccgg

SEQ ID NO: 1188396 - RNA, 14 nt, Human
cuggaccagccucu

SEQ ID NO: 1188397 - RNA, 18 nt, Human
cuggaccagccucuccac

SEQ ID NO: 1188398 - RNA, 22 nt, Human
cugccgagaguccaucagccuc

SEQ ID NO: 1188399 - RNA, 23 nt, Human
cugccgagaguccaucagccucc

SEQ ID NO: 1188400 - RNA, 20 nt, Human
cuccccacgucagcugggac

SEQ ID NO: 1188401 - RNA, 16 nt, Human
cuccacucaugugacu

SEQ ID NO: 1188402 - RNA, 22 nt, Human
cuccacucaugugacucuuucc

SEQ ID NO: 1188403 - RNA, 17 nt, Human
cucaggaaccgaggcag

SEQ ID NO: 1188404 - RNA, 18 nt, Human
cucaggaaccgaggcagg

SEQ ID NO: 1188405 - RNA, 19 nt, Human
cucaggaaccgaggcaggg

SEQ ID NO: 1188406 - RNA, 17 nt, Human
cucagccccgcguggaa

SEQ ID NO: 1188407 - RNA, 16 nt, Human
cucagaggguguccug

SEQ ID NO: 1188408 - RNA, 13 nt, Human
cuacccccugugc

SEQ ID NO: 1188409 - RNA, 12 nt, Human
cuaaccugccga

SEQ ID NO: 1188410 - RNA, 18 nt, Human
cgggacaccuaggcuagg

SEQ ID NO: 1188411 - RNA, 19 nt, Human
cgggacaccuaggcuaggg

SEQ ID NO: 1188412 - RNA, 16 nt, Human
cgcggcugggaggagg

SEQ ID NO: 1188413 - RNA, 12 nt, Human
cgcggcugggag

SEQ ID NO: 1188414 - RNA, 15 nt, Human
cgaagcguuguccuc

SEQ ID NO: 1188415 - RNA, 16 nt, Human
cgaagcguuguccuca

SEQ ID NO: 1188416 - RNA, 17 nt, Human
cgaagcguuguccucag

SEQ ID NO: 1188417 - RNA, 21 nt, Human
cgaagcguuguccucagcccc

SEQ ID NO: 1188418 - RNA, 14 nt, Human
ccugccgagagucc

SEQ ID NO: 1188419 - RNA, 22 nt, Human
ccugccgagaguccaucagccu

SEQ ID NO: 1188420 - RNA, 23 nt, Human
ccugccgagaguccaucagccuc

SEQ ID NO: 1188421 - RNA, 15 nt, Human
ccugcaccggggccu

SEQ ID NO: 1188422 - RNA, 17 nt, Human
ccugcaccggggccugg

SEQ ID NO: 1188423 - RNA, 16 nt, Human
ccuaggcuaggguggg

SEQ ID NO: 1188424 - RNA, 12 nt, Human
ccuaaccugccg

SEQ ID NO: 1188425 - RNA, 13 nt, Human
ccuaaccugccga

SEQ ID NO: 1188426 - RNA, 23 nt, Human
ccguggcuguggcauccagaguc

SEQ ID NO: 1188427 - RNA, 20 nt, Human
ccggggccugggcaggaggg

SEQ ID NO: 1188428 - RNA, 21 nt, Human
ccgggggcagucugagagagg

SEQ ID NO: 1188429 - RNA, 21 nt, Human
ccgagaguccaucagccucca

SEQ ID NO: 1188430 - RNA, 20 nt, Human
ccgagaguccaucagccucc

SEQ ID NO: 1188431 - RNA, 14 nt, Human
ccccugugccuugu

SEQ ID NO: 1188432 - RNA, 22 nt, Human
cccccugugccuugucacgcca

SEQ ID NO: 1188433 - RNA, 13 nt, Human
cccaugagcuccu

SEQ ID NO: 1188434 - RNA, 14 nt, Human
cccaugagcuccuu

SEQ ID NO: 1188435 - RNA, 15 nt, Human
cccaugagcuccuua

SEQ ID NO: 1188436 - RNA, 22 nt, Human
cccaugagcuccuuaaggcucu

SEQ ID NO: 1188437 - RNA, 15 nt, Human
cccacggcuccucga

SEQ ID NO: 1188438 - RNA, 15 nt, Human
cccacgucagcuggg

SEQ ID NO: 1188439 - RNA, 14 nt, Human
cccaacacugccag

SEQ ID NO: 1188440 - RNA, 15 nt, Human
cccaacacugccagc

SEQ ID NO: 1188441 - RNA, 16 nt, Human
cccaacacugccagca

SEQ ID NO: 1188442 - RNA, 13 nt, Human
caaccggcuuugu

SEQ ID NO: 1188443 - RNA, 22 nt, Human
caaccggcuuuguggcacuggg

SEQ ID NO: 1188444 - RNA, 12 nt, Human
caacacugccag

SEQ ID NO: 1188445 - RNA, 13 nt, Human
caacacugccagc

SEQ ID NO: 1188446 - RNA, 14 nt, Human
caacacugccagca

SEQ ID NO: 1188447 - RNA, 15 nt, Human
cuuccucuccugucu

SEQ ID NO: 1188448 - RNA, 19 nt, Human
cuuccucuccugucucccu

SEQ ID NO: 1188449 - RNA, 16 nt, Human
gagacgggcccuggug

SEQ ID NO: 1188450 - RNA, 17 nt, Human
gaucccaacacugccag

SEQ ID NO: 1188451 - RNA, 18 nt, Human
gaucccaacacugccagc

SEQ ID NO: 1188452 - RNA, 19 nt, Human
gaucccaacacugccagca

SEQ ID NO: 1188453 - RNA, 15 nt, Human
gaucccaugagcucc

SEQ ID NO: 1188454 - RNA, 21 nt, Human
gcauccagagucccugccugg

SEQ ID NO: 1188455 - RNA, 22 nt, Human
gcauccagagucccugccugga

SEQ ID NO: 1188456 - RNA, 23 nt, Human
gcauccagagucccugccuggac

SEQ ID NO: 1188457 - RNA, 17 nt, Human
gcaucggggagccggga

SEQ ID NO: 1188458 - RNA, 19 nt, Human
gccauucuuucccaacacc

SEQ ID NO: 1188459 - RNA, 18 nt, Human
gcucagaggguguccugc

SEQ ID NO: 1188460 - RNA, 19 nt, Human
gcucagaggguguccugca

SEQ ID NO: 1188461 - RNA, 21 nt, Human
gcucagaggguguccugcacc

SEQ ID NO: 1188462 - RNA, 17 nt, Human
gcuaggguggggagaga

SEQ ID NO: 1188463 - RNA, 18 nt, Human
gcuaggguggggagagac

SEQ ID NO: 1188464 - RNA, 21 nt, Human
gcguggaacucgugucuggca

SEQ ID NO: 1188465 - RNA, 13 nt, Human
gcggcugggagga

SEQ ID NO: 1188466 - RNA, 23 nt, Human
gcugggacaccccgacuuuuguu

SEQ ID NO: 1188467 - RNA, 16 nt, Human
ggacaccccgacuuuu

SEQ ID NO: 1188468 - RNA, 16 nt, Human
ggacaccuaggcuagg

SEQ ID NO: 1188469 - RNA, 14 nt, Human
ggagggggagaggg

SEQ ID NO: 1188470 - RNA, 14 nt, Human
ggcaggagggaggu

SEQ ID NO: 1188471 - RNA, 12 nt, Human
ggcaggggccgg

SEQ ID NO: 1188472 - RNA, 23 nt, Human
ggcaucggggagccgggagccug

SEQ ID NO: 1188473 - RNA, 22 nt, Human
ggcaucggggagccgggagccu

SEQ ID NO: 1188474 - RNA, 16 nt, Human
ggcauccagagucccu

SEQ ID NO: 1188475 - RNA, 18 nt, Human
ggcauccagagucccugc

SEQ ID NO: 1188476 - RNA, 22 nt, Human
gguggggggggggcgcggcugg

SEQ ID NO: 1188477 - RNA, 21 nt, Human
gguggggagagacgggcccug

SEQ ID NO: 1188478 - RNA, 17 nt, Human
ggguguccugcaccggg

SEQ ID NO: 1188479 - RNA, 21 nt, Human
ggguguccugcaccggggccu

SEQ ID NO: 1188480 - RNA, 22 nt, Human
gggggcagucugagagaggcca

SEQ ID NO: 1188481 - RNA, 17 nt, Human
ccauccuacccccugug

SEQ ID NO: 1188482 - RNA, 13 nt, Human
cugagagaggcca

SEQ ID NO: 1188483 - RNA, 14 nt, Human
cugagagaggccau

SEQ ID NO: 1188484 - RNA, 21 nt, Human
cugagagaggccauucuuucc

SEQ ID NO: 1188485 - RNA, 22 nt, Human
cugagagaggccauucuuuccc

SEQ ID NO: 1188486 - RNA, 15 nt, Human
cucgugucuggcaca

SEQ ID NO: 1188487 - RNA, 18 nt, Human
cucaugugacucuuucca

SEQ ID NO: 1188488 - RNA, 17 nt, Human
cagucugagagaggcca

SEQ ID NO: 1188489 - RNA, 17 nt, Human
cagaggguguccugcac

SEQ ID NO: 1188490 - RNA, 18 nt, Human
caacaccucuuggggagu

SEQ ID NO: 1188491 - RNA, 13 nt, Human
cacuggggcaggg

SEQ ID NO: 1188492 - RNA, 15 nt, Human
cacuggggcaggggc

SEQ ID NO: 1188493 - RNA, 19 nt, Human
cacuggggcaggggccggg

SEQ ID NO: 1188494 - RNA, 16 nt, Human
uuuuguuuaccagaga

SEQ ID NO: 1188495 - RNA, 13 nt, Human
uugucacgccaga

SEQ ID NO: 1188496 - RNA, 20 nt, Human
uugucacgccagacuuccca

SEQ ID NO: 1188497 - RNA, 22 nt, Human
uuguccucagccccgcguggaa

SEQ ID NO: 1188498 - RNA, 16 nt, Human
aucggggagccgggag

SEQ ID NO: 1188499 - RNA, 18 nt, Human
aucggggagccgggagcc

SEQ ID NO: 1188500 - RNA, 13 nt, Human
agucccugccugg

SEQ ID NO: 1188501 - RNA, 16 nt, Human
aguccaucagccucca

SEQ ID NO: 1188502 - RNA, 13 nt, Human
aguccaucagccu

SEQ ID NO: 1188503 - RNA, 14 nt, Human
aguccaucagccuc

SEQ ID NO: 1188504 - RNA, 17 nt, Human
aggccauucuuucccaa

SEQ ID NO: 1188505 - RNA, 18 nt, Human
aggccauucuuucccaac

SEQ ID NO: 1188506 - RNA, 19 nt, Human
aggccauucuuucccaaca

SEQ ID NO: 1188507 - RNA, 22 nt, Human
uggaccagccucuccacucaug

SEQ ID NO: 1188508 - RNA, 13 nt, Human
ugcuccccacguc

SEQ ID NO: 1188509 - RNA, 13 nt, Human
ugagagaggccau

SEQ ID NO: 1188510 - RNA, 17 nt, Human
ucuaguucugccaggag

SEQ ID NO: 1188511 - RNA, 15 nt, Human
ucuaguucugccagg

SEQ ID NO: 1188512 - RNA, 16 nt, Human
ucuaguucugccagga

SEQ ID NO: 1188513 - RNA, 18 nt, Human
uccugcaccggggccugg

SEQ ID NO: 1188514 - RNA, 19 nt, Human
uccugcaccggggccuggg

SEQ ID NO: 1188515 - RNA, 12 nt, Human
accuaggcuagg

SEQ ID NO: 1188516 - RNA, 17 nt, Human
accuaggcuaggguggg

SEQ ID NO: 1188517 - RNA, 14 nt, Human
ucaugugacucuuu

SEQ ID NO: 1188518 - RNA, 17 nt, Human
ucaugugacucuuucca

SEQ ID NO: 1188519 - RNA, 18 nt, Human
ucaugugacucuuuccaa

SEQ ID NO: 1188520 - RNA, 19 nt, Human
ucaugugacucuuuccaac

SEQ ID NO: 1188521 - RNA, 13 nt, Human
accgaggcaggga

SEQ ID NO: 1188522 - RNA, 16 nt, Human
acaccucuuggggagu

SEQ ID NO: 1188523 - RNA, 15 nt, Human
guccaucagccucca

SEQ ID NO: 1188524 - RNA, 21 nt, Human
aggugcuucuaguucugccag

SEQ ID NO: 1188525 - RNA, 22 nt, Human
aggugcuucuaguucugccagg

SEQ ID NO: 1188526 - RNA, 23 nt, Human
aggugcuucuaguucugccagga

SEQ ID NO: 1188527 - RNA, 17 nt, Human
aggggccgggggcaguc

SEQ ID NO: 1188528 - RNA, 14 nt, Human
agacgggcccuggu

SEQ ID NO: 1188529 - RNA, 16 nt, Human
agaggguguccugcac

SEQ ID NO: 1188530 - RNA, 16 nt, Human
acgccagacuucccac

SEQ ID NO: 1188531 - RNA, 22 nt, Human
acgccagacuucccacggcucc

SEQ ID NO: 1188532 - RNA, 12 nt, Human
accccgacuuuu

SEQ ID NO: 1188533 - RNA, 15 nt, Human
accccgacuuuuguu

SEQ ID NO: 1188534 - RNA, 15 nt, Human
acagguuagcugcuc

SEQ ID NO: 1188535 - RNA, 19 nt, Human
uuuccaaccggcuuugugg

SEQ ID NO: 1188536 - RNA, 18 nt, Human
uguccugcaccggggccu

SEQ ID NO: 1188537 - RNA, 13 nt, Human
uguccucagcccc

SEQ ID NO: 1188538 - RNA, 21 nt, Human
uguccucagccccgcguggaa

SEQ ID NO: 1188539 - RNA, 14 nt, Human
ugggaggagggcag

SEQ ID NO: 1188540 - RNA, 17 nt, Human
ugggaggagggcaggca

SEQ ID NO: 1188541 - RNA, 18 nt, Human
ugggaggagggcaggcau

SEQ ID NO: 1188542 - RNA, 23 nt, Human
uggccuaaccugccgagagucca

SEQ ID NO: 1188543 - RNA, 18 nt, Human
ugcccgggagcucaggaa

SEQ ID NO: 1188544 - RNA, 18 nt, Human
ugauuuuuaugccaccug

SEQ ID NO: 1188545 - RNA, 15 nt, Human
ucugccaggagacag

SEQ ID NO: 1188546 - RNA, 14 nt, Human
ucgugucuggcaca

SEQ ID NO: 1188547 - RNA, 21 nt, Human
ucgugucuggcacagccuggc

SEQ ID NO: 1188548 - RNA, 16 nt, Human
ucccuccucugcccgg

SEQ ID NO: 1188549 - RNA, 16 nt, Human
ucccuuccuuccucuc

SEQ ID NO: 1188550 - RNA, 19 nt, Human
ucccuuccuuccucuccug

SEQ ID NO: 1188551 - RNA, 13 nt, Human
ucccugccuggac

SEQ ID NO: 1188552 - RNA, 19 nt, Human
ucagaggguguccugcacc

SEQ ID NO: 1188553 - RNA, 16 nt, Human
gggaggagggcaggca

SEQ ID NO: 1188554 - RNA, 12 nt, Human
gggaggagggca

SEQ ID NO: 1188555 - RNA, 13 nt, Human
gggagccgggagc

SEQ ID NO: 1188556 - RNA, 23 nt, Human
gggagcucaggaaccgaggcagg

SEQ ID NO: 1188557 - RNA, 12 nt, Human
gggagcucagga

SEQ ID NO: 1188558 - RNA, 22 nt, Human
gggagcucaggaaccgaggcag

SEQ ID NO: 1188559 - RNA, 14 nt, Human
gggacaccuaggcu

SEQ ID NO: 1188560 - RNA, 21 nt, Human
ggcuguggcauccagaguccc

SEQ ID NO: 1188561 - RNA, 23 nt, Human
ggcuguggcauccagagucccug

SEQ ID NO: 1188562 - RNA, 13 nt, Human
ggcugggaggagg

SEQ ID NO: 1188563 - RNA, 20 nt, Human
ggcugggaggagggcaggca

SEQ ID NO: 1188564 - RNA, 21 nt, Human
ggcugggaggagggcaggcau

SEQ ID NO: 1188565 - RNA, 15 nt, Human
ggccugggcaggagg

SEQ ID NO: 1188566 - RNA, 17 nt, Human
ggccugggcaggaggga

SEQ ID NO: 1188567 - RNA, 19 nt, Human
ggccugggcaggagggagg

SEQ ID NO: 1188568 - RNA, 15 nt, Human
ggccuaaccugccga

SEQ ID NO: 1188569 - RNA, 16 nt, Human
ggccuaaccugccgag

SEQ ID NO: 1188570 - RNA, 21 nt, Human
ggccuaaccugccgagagucc

SEQ ID NO: 1188571 - RNA, 21 nt, Human
ggagcucaggaaccgaggcag

SEQ ID NO: 1188572 - RNA, 19 nt, Human
ggagacagguuagcugcuc

SEQ ID NO: 1188573 - RNA, 12 nt, Human
ggaccagccucu

SEQ ID NO: 1188574 - RNA, 19 nt, Human
gcuguggccuaaccugccg

SEQ ID NO: 1188575 - RNA, 20 nt, Human
gcuguggccuaaccugccga

SEQ ID NO: 1188576 - RNA, 21 nt, Human
gcugggaggagggcaggcauc

SEQ ID NO: 1188577 - RNA, 15 nt, Human
gcuccuuaaggcucu

SEQ ID NO: 1188578 - RNA, 17 nt, Human
gcuccuuaaggcucuuu

SEQ ID NO: 1188579 - RNA, 21 nt, Human
gcuccuuaaggcucuuuugua

SEQ ID NO: 1188580 - RNA, 15 nt, Human
gccuugucacgccag

SEQ ID NO: 1188581 - RNA, 16 nt, Human
gccuugucacgccaga

SEQ ID NO: 1188582 - RNA, 17 nt, Human
gccuugucacgccagac

SEQ ID NO: 1188583 - RNA, 17 nt, Human
gcgaagcguuguccuca

SEQ ID NO: 1188584 - RNA, 16 nt, Human
gccugggcaggaggga

SEQ ID NO: 1188585 - RNA, 16 nt, Human
gccuggaccagccucu

SEQ ID NO: 1188586 - RNA, 17 nt, Human
gccuggaccagccucuc

SEQ ID NO: 1188587 - RNA, 21 nt, Human
gccagacuucccacggcuccu

SEQ ID NO: 1188588 - RNA, 16 nt, Human
gccaccugaauaaaga

SEQ ID NO: 1188589 - RNA, 21 nt, Human
gcaggcaucggggagccggga

SEQ ID NO: 1188590 - RNA, 22 nt, Human
gcaggcaucggggagccgggag

SEQ ID NO: 1188591 - RNA, 23 nt, Human
gcaggcaucggggagccgggagc

SEQ ID NO: 1188592 - RNA, 16 nt, Human
gagucccugccuggac

SEQ ID NO: 1188593 - RNA, 19 nt, Human
gagucccugccuggaccag

SEQ ID NO: 1188594 - RNA, 14 nt, Human
gagucccugccugg

SEQ ID NO: 1188595 - RNA, 15 nt, Human
gagucccugccugga

SEQ ID NO: 1188596 - RNA, 13 nt, Human
gaggagggcaggc

SEQ ID NO: 1188597 - RNA, 14 nt, Human
gaggagggcaggca

SEQ ID NO: 1188598 - RNA, 15 nt, Human
gaggagggcaggcau

SEQ ID NO: 1188599 - RNA, 23 nt, Human
gagcucaggaaccgaggcaggga

SEQ ID NO: 1188600 - RNA, 20 nt, Human
gagcuccuuaaggcucuuuu

SEQ ID NO: 1188601 - RNA, 17 nt, Human
gaauaaagaaugaaugg

SEQ ID NO: 1188602 - RNA, 19 nt, Human
gaaggaucccaugagcucc

SEQ ID NO: 1188603 - RNA, 17 nt, Human
cuuucccaacaccucuu

SEQ ID NO: 1188604 - RNA, 19 nt, Human
cuuccaaacaggcucagag

SEQ ID NO: 1188605 - RNA, 15 nt, Human
cuuaaggcucuuuug

SEQ ID NO: 1188606 - RNA, 18 nt, Human
cuguggccuaaccugccg

SEQ ID NO: 1188607 - RNA, 14 nt, Human
cuggugguggcucg

SEQ ID NO: 1188608 - RNA, 22 nt, Human
cuggugguggcucgggaggcga

SEQ ID NO: 1188609 - RNA, 17 nt, Human
cugccuggaccagccuc

SEQ ID NO: 1188610 - RNA, 14 nt, Human
cucugcccgggagc

SEQ ID NO: 1188611 - RNA, 20 nt, Human
cucugcccgggagcucagga

SEQ ID NO: 1188612 - RNA, 13 nt, Human
cucgagaucccaa

SEQ ID NO: 1188613 - RNA, 21 nt, Human
cucgagaucccaacacugcca

SEQ ID NO: 1188614 - RNA, 22 nt, Human
cucgagaucccaacacugccag

SEQ ID NO: 1188615 - RNA, 23 nt, Human
cucgagaucccaacacugccagc

SEQ ID NO: 1188616 - RNA, 22 nt, Human
cgagaucccaacacugccagca

SEQ ID NO: 1188617 - RNA, 13 nt, Human
cgagaucccaaca

SEQ ID NO: 1188618 - RNA, 15 nt, Human
cgagaucccaacacu

SEQ ID NO: 1188619 - RNA, 21 nt, Human
cgagaucccaacacugccagc

SEQ ID NO: 1188620 - RNA, 15 nt, Human
ccuugucacgccaga

SEQ ID NO: 1188621 - RNA, 18 nt, Human
ccuugucacgccagacuu

SEQ ID NO: 1188622 - RNA, 13 nt, Human
ccuuaaggcucuu

SEQ ID NO: 1188623 - RNA, 16 nt, Human
ccuuaaggcucuuuug

SEQ ID NO: 1188624 - RNA, 18 nt, Human
ccuuaaggcucuuuugua

SEQ ID NO: 1188625 - RNA, 12 nt, Human
ccugggcaggag

SEQ ID NO: 1188626 - RNA, 14 nt, Human
ccugggcaggaggg

SEQ ID NO: 1188627 - RNA, 18 nt, Human
ccucuccacucaugugac

SEQ ID NO: 1188628 - RNA, 20 nt, Human
ccgggacaccuaggcuaggg

SEQ ID NO: 1188629 - RNA, 19 nt, Human
ccgggacaccuaggcuagg

SEQ ID NO: 1188630 - RNA, 16 nt, Human
ccggcuuuguggcacu

SEQ ID NO: 1188631 - RNA, 15 nt, Human
ccgaggcagggaagg

SEQ ID NO: 1188632 - RNA, 18 nt, Human
ccauccuacccccugugc

SEQ ID NO: 1188633 - RNA, 13 nt, Human
ccaggagacaggu

SEQ ID NO: 1188634 - RNA, 16 nt, Human
ccagcauuucccuucc

SEQ ID NO: 1188635 - RNA, 21 nt, Human
ccagcauuucccuuccuuccu

SEQ ID NO: 1188636 - RNA, 19 nt, Human
ccacucaugugacucuuuc

SEQ ID NO: 1188637 - RNA, 22 nt, Human
ccacucaugugacucuuuccaa

SEQ ID NO: 1188638 - RNA, 20 nt, Human
ccaccugaauaaagaaugaa

SEQ ID NO: 1188639 - RNA, 12 nt, Human
cauucuuuccca

SEQ ID NO: 1188640 - RNA, 14 nt, Human
cauucuuucccaac

SEQ ID NO: 1188641 - RNA, 14 nt, Human
caugugacucuuuc

SEQ ID NO: 1188642 - RNA, 16 nt, Human
caugugacucuuucca

SEQ ID NO: 1188643 - RNA, 17 nt, Human
caugugacucuuuccaa

SEQ ID NO: 1188644 - RNA, 23 nt, Human
caugagcuccuuaaggcucuuuu

SEQ ID NO: 1188645 - RNA, 18 nt, Human
cauccuacccccugugcc

SEQ ID NO: 1188646 - RNA, 19 nt, Human
cauccuacccccugugccu

SEQ ID NO: 1188647 - RNA, 15 nt, Human
cauccuacccccugu

SEQ ID NO: 1188648 - RNA, 21 nt, Human
cauccagagucccugccugga

SEQ ID NO: 1188649 - RNA, 13 nt, Human
cauccagaguccc

SEQ ID NO: 1188650 - RNA, 17 nt, Human
cauccagagucccugcc

SEQ ID NO: 1188651 - RNA, 18 nt, Human
cauccagagucccugccu

SEQ ID NO: 1188652 - RNA, 20 nt, Human
cauccagagucccugccugg

SEQ ID NO: 1188653 - RNA, 13 nt, Human
cagggaaggaucc

SEQ ID NO: 1188654 - RNA, 18 nt, Human
cagggaaggaucccauga

SEQ ID NO: 1188655 - RNA, 11 nt, Human
caggcucagag

SEQ ID NO: 1188656 - RNA, 15 nt, Human
caggcucagagggug

SEQ ID NO: 1188657 - RNA, 20 nt, Human
caggcaucggggagccggga

SEQ ID NO: 1188658 - RNA, 21 nt, Human
caggcaucggggagccgggag

SEQ ID NO: 1188659 - RNA, 23 nt, Human
caggagacagguuagcugcuccc

SEQ ID NO: 1188660 - RNA, 15 nt, Human
caggaaccgaggcag

SEQ ID NO: 1188661 - RNA, 17 nt, Human
caggaaccgaggcaggg

SEQ ID NO: 1188662 - RNA, 18 nt, Human
caggaaccgaggcaggga

SEQ ID NO: 1188663 - RNA, 23 nt, Human
cagccucuccacucaugugacuc

SEQ ID NO: 1188664 - RNA, 23 nt, Human
cagccuggcuguggccuaaccug

SEQ ID NO: 1188665 - RNA, 21 nt, Human
cagccuccauccuacccccug

SEQ ID NO: 1188666 - RNA, 18 nt, Human
cagccuccauccuacccc

SEQ ID NO: 1188667 - RNA, 15 nt, Human
cagcauuucccuucc

SEQ ID NO: 1188668 - RNA, 18 nt, Human
cagagucccugccuggac

SEQ ID NO: 1188669 - RNA, 14 nt, Human
cagagucccugccu

SEQ ID NO: 1188670 - RNA, 12 nt, Human
cagagaaaaagg

SEQ ID NO: 1188671 - RNA, 17 nt, Human
cagagaaaaagggaggg

SEQ ID NO: 1188672 - RNA, 18 nt, Human
cagagaaaaagggagggg

SEQ ID NO: 1188673 - RNA, 12 nt, Human
cagacuucccac

SEQ ID NO: 1188674 - RNA, 22 nt, Human
cagacuucccacggcuccucga

SEQ ID NO: 1188675 - RNA, 22 nt, Human
cacucaugugacucuuuccaac

SEQ ID NO: 1188676 - RNA, 16 nt, Human
cacucaugugacucuu

SEQ ID NO: 1188677 - RNA, 20 nt, Human
cacggcuccucgagauccca

SEQ ID NO: 1188678 - RNA, 22 nt, Human
cacggcuccucgagaucccaac

SEQ ID NO: 1188679 - RNA, 14 nt, Human
caccggggccuggg

SEQ ID NO: 1188680 - RNA, 21 nt, Human
caccggggccugggcaggagg

SEQ ID NO: 1188681 - RNA, 22 nt, Human
caccggggccugggcaggaggg

SEQ ID NO: 1188682 - RNA, 10 nt, Human
agagggcugc

SEQ ID NO: 1188683 - RNA, 16 nt, Human
aggaaccgaggcaggg

SEQ ID NO: 1188684 - RNA, 16 nt, Human
agcuccuuaaggcucu

SEQ ID NO: 1188685 - RNA, 17 nt, Human
agcuccuuaaggcucuu

SEQ ID NO: 1188686 - RNA, 18 nt, Human
agcuccuuaaggcucuuu

SEQ ID NO: 1188687 - RNA, 19 nt, Human
auccagagucccugccugg

SEQ ID NO: 1188688 - RNA, 20 nt, Human
auccagagucccugccugga

SEQ ID NO: 1188689 - RNA, 21 nt, Human
auccagagucccugccuggac

SEQ ID NO: 1188690 - RNA, 16 nt, Human
agucugagagaggcca

SEQ ID NO: 1188691 - RNA, 23 nt, Human
agucugagagaggccauucuuuc

SEQ ID NO: 1188692 - RNA, 14 nt, Human
gcggcugggaggag

SEQ ID NO: 1188693 - RNA, 17 nt, Human
gcggcugggaggagggc

SEQ ID NO: 1188694 - RNA, 18 nt, Human
gcggcugggaggagggca

SEQ ID NO: 1188695 - RNA, 19 nt, Human
gcggcugggaggagggcag

SEQ ID NO: 1188696 - RNA, 22 nt, Human
gcggcugggaggagggcaggca

SEQ ID NO: 1188697 - RNA, 18 nt, Human
gcuccucgagaucccaac

SEQ ID NO: 1188698 - RNA, 13 nt, Human
gcugcuccccacg

SEQ ID NO: 1188699 - RNA, 22 nt, Human
gcugcuccccacgucagcuggg

SEQ ID NO: 1188700 - RNA, 12 nt, Human
ggcacagccugg

SEQ ID NO: 1188701 - RNA, 13 nt, Human
ggcacagccuggc

SEQ ID NO: 1188702 - RNA, 22 nt, Human
ggcauccagagucccugccugg

SEQ ID NO: 1188703 - RNA, 15 nt, Human
ggcacuggggcaggg

SEQ ID NO: 1188704 - RNA, 22 nt, Human
ggcgaagcguuguccucagccc

SEQ ID NO: 1188705 - RNA, 21 nt, Human
ggugcuucuaguucugccagg

SEQ ID NO: 1188706 - RNA, 23 nt, Human
ggguguccugcaccggggccugg

SEQ ID NO: 1188707 - RNA, 13 nt, Human
ggguggggagaga

SEQ ID NO: 1188708 - RNA, 22 nt, Human
gggcccuggugguggcucggga

SEQ ID NO: 1188709 - RNA, 14 nt, Human
aaaagggaggggga

SEQ ID NO: 1188710 - RNA, 16 nt, Human
gacagguuagcugcuc

SEQ ID NO: 1188711 - RNA, 14 nt, Human
gaguuuaggguggg

SEQ ID NO: 1188712 - RNA, 15 nt, Human
gaguuuagggugggg

SEQ ID NO: 1188713 - RNA, 13 nt, Human
gaguccaucagcc

SEQ ID NO: 1188714 - RNA, 14 nt, Human
gaguccaucagccu

SEQ ID NO: 1188715 - RNA, 15 nt, Human
gaguccaucagccuc

SEQ ID NO: 1188716 - RNA, 16 nt, Human
gaguccaucagccucc

SEQ ID NO: 1188717 - RNA, 12 nt, Human
gaucccaacacu

SEQ ID NO: 1188718 - RNA, 16 nt, Human
gaucccaacacugcca

SEQ ID NO: 1188719 - RNA, 20 nt, Human
gcaccggggccugggcagga

SEQ ID NO: 1188720 - RNA, 16 nt, Human
cucaucuuucuuccaa

SEQ ID NO: 1188721 - RNA, 13 nt, Human
cucccuccucugc

SEQ ID NO: 1188722 - RNA, 14 nt, Human
cucccuccucugcc

SEQ ID NO: 1188723 - RNA, 19 nt, Human
cuaaccugccgagagucca

SEQ ID NO: 1188724 - RNA, 21 nt, Human
cuaaccugccgagaguccauc

SEQ ID NO: 1188725 - RNA, 14 nt, Human
cgugucuggcacag

SEQ ID NO: 1188726 - RNA, 21 nt, Human
cgugucuggcacagccuggcu

SEQ ID NO: 1188727 - RNA, 23 nt, Human
cggcuccucgagaucccaacacu

SEQ ID NO: 1188728 - RNA, 16 nt, Human
ccagagucccugccug

SEQ ID NO: 1188729 - RNA, 17 nt, Human
ccagagucccugccugg

SEQ ID NO: 1188730 - RNA, 18 nt, Human
ccagagucccugccugga

SEQ ID NO: 1188731 - RNA, 19 nt, Human
ccagagucccugccuggac

SEQ ID NO: 1188732 - RNA, 22 nt, Human
ccagagucccugccuggaccag

SEQ ID NO: 1188733 - RNA, 12 nt, Human
ccaugagcuccu

SEQ ID NO: 1188734 - RNA, 14 nt, Human
ccccgacuuuuguu

SEQ ID NO: 1188735 - RNA, 14 nt, Human
cccgggagcucagg

SEQ ID NO: 1188736 - RNA, 15 nt, Human
cccugugccuuguca

SEQ ID NO: 1188737 - RNA, 20 nt, Human
cccugugccuugucacgcca

SEQ ID NO: 1188738 - RNA, 22 nt, Human
cccugugccuugucacgccaga

SEQ ID NO: 1188739 - RNA, 16 nt, Human
auucuuucccaacacc

SEQ ID NO: 1188740 - RNA, 19 nt, Human
auucuuucccaacaccucu

SEQ ID NO: 1188741 - RNA, 14 nt, Human
caaacaggcucaga

SEQ ID NO: 1188742 - RNA, 15 nt, Human
caaacaggcucagag

SEQ ID NO: 1188743 - RNA, 18 nt, Human
cacugccagcauuucccu

SEQ ID NO: 1188744 - RNA, 22 nt, Human
cacugccagcauuucccuuccu

SEQ ID NO: 1188745 - RNA, 24 nt, Human
cagccucuccacucaugugacucu

SEQ ID NO: 1188746 - RNA, 24 nt, Human
cagccccgcguggaacucgugucu

SEQ ID NO: 1188747 - RNA, 15 nt, Human
uucuaguucugccag

SEQ ID NO: 1188748 - RNA, 16 nt, Human
uucuaguucugccagg

SEQ ID NO: 1188749 - RNA, 19 nt, Human
uguggcacuggggcagggg

SEQ ID NO: 1188750 - RNA, 14 nt, Human
agucccugccugga

SEQ ID NO: 1188751 - RNA, 15 nt, Human
agucccugccuggac

SEQ ID NO: 1188752 - RNA, 21 nt, Human
agucccugccuggaccagccu

SEQ ID NO: 1188753 - RNA, 22 nt, Human
agucccugccuggaccagccuc

SEQ ID NO: 1188754 - RNA, 23 nt, Human
agucccugccuggaccagccucu

SEQ ID NO: 1188755 - RNA, 15 nt, Human
agggggagagggcug

SEQ ID NO: 1188756 - RNA, 16 nt, Human
agggggagagggcugc

SEQ ID NO: 1188757 - RNA, 18 nt, Human
uggggaguuuaggguggg

SEQ ID NO: 1188758 - RNA, 19 nt, Human
uggggaguuuagggugggg

SEQ ID NO: 1188759 - RNA, 16 nt, Human
uggccuaaccugccga

SEQ ID NO: 1188760 - RNA, 21 nt, Human
agcugggacaccccgacuuuu

SEQ ID NO: 1188761 - RNA, 20 nt, Human
agcucaggaaccgaggcagg

SEQ ID NO: 1188762 - RNA, 21 nt, Human
agcucaggaaccgaggcaggg

SEQ ID NO: 1188763 - RNA, 22 nt, Human
agcucaggaaccgaggcaggga

SEQ ID NO: 1188764 - RNA, 18 nt, Human
agccugacccucaucuuu

SEQ ID NO: 1188765 - RNA, 17 nt, Human
agcauuucccuuccuuc

SEQ ID NO: 1188766 - RNA, 21 nt, Human
ugacccucaucuuucuuccaa

SEQ ID NO: 1188767 - RNA, 17 nt, Human
agagacgggcccuggug

SEQ ID NO: 1188768 - RNA, 22 nt, Human
ucuuggggaguuuagggugggg

SEQ ID NO: 1188769 - RNA, 23 nt, Human
ucuuggggaguuuaggguggggg

SEQ ID NO: 1188770 - RNA, 22 nt, Human
ucuggcacagccuggcuguggc

SEQ ID NO: 1188771 - RNA, 14 nt, Human
ucuaguucugccag

SEQ ID NO: 1188772 - RNA, 20 nt, Human
ucggggagccgggagccuga

SEQ ID NO: 1188773 - RNA, 16 nt, Human
uccucugcccgggagc

SEQ ID NO: 1188774 - RNA, 22 nt, Human
uccucugcccgggagcucagga

SEQ ID NO: 1188775 - RNA, 13 nt, Human
uccucuccugucu

SEQ ID NO: 1188776 - RNA, 22 nt, Human
acucgugucuggcacagccugg

SEQ ID NO: 1188777 - RNA, 23 nt, Human
acucgugucuggcacagccuggc

SEQ ID NO: 1188778 - RNA, 16 nt, Human
uccauccuacccccug

SEQ ID NO: 1188779 - RNA, 20 nt, Human
uccauccuacccccugugcc

SEQ ID NO: 1188780 - RNA, 20 nt, Human
uaugccaccugaauaaagaa

SEQ ID NO: 1188781 - RNA, 15 nt, Human
uacccccugugccuu

SEQ ID NO: 1188782 - RNA, 14 nt, Human
aaggcucuuuugua

SEQ ID NO: 1188783 - RNA, 21 nt, Human
guggccuaaccugccgagagu

SEQ ID NO: 1188784 - RNA, 22 nt, Human
guggccuaaccugccgagaguc

SEQ ID NO: 1188785 - RNA, 17 nt, Human
gucuggcacagccuggc

SEQ ID NO: 1188786 - RNA, 19 nt, Human
gucuggcacagccuggcug

SEQ ID NO: 1188787 - RNA, 19 nt, Human
aacucgugucuggcacagc

SEQ ID NO: 1188788 - RNA, 19 nt, Human
gucucccuccucugcccgg

SEQ ID NO: 1188789 - RNA, 15 nt, Human
uguggccuaaccugc

SEQ ID NO: 1188790 - RNA, 17 nt, Human
ugugccuugucacgcca

SEQ ID NO: 1188791 - RNA, 19 nt, Human
ugugccuugucacgccaga

SEQ ID NO: 1188792 - RNA, 20 nt, Human
ugugccuugucacgccagac

SEQ ID NO: 1188793 - RNA, 17 nt, Human
ugucuggcacagccugg

SEQ ID NO: 1188794 - RNA, 14 nt, Human
ugucacgccagacu

SEQ ID NO: 1188795 - RNA, 21 nt, Human
ugggacaccccgacuuuuguu

SEQ ID NO: 1188796 - RNA, 18 nt, Human
uggaacucgugucuggca

SEQ ID NO: 1188797 - RNA, 12 nt, Human
ugcaccggggcc

SEQ ID NO: 1188798 - RNA, 16 nt, Human
ugcaccggggccuggg

SEQ ID NO: 1188799 - RNA, 22 nt, Human
ugcaccggggccugggcaggag

SEQ ID NO: 1188800 - RNA, 14 nt, Human
ugacucuuuccaac

SEQ ID NO: 1188801 - RNA, 16 nt, Human
ugacucuuuccaaccg

SEQ ID NO: 1188802 - RNA, 13 nt, Human
ugacucuuuccaa

SEQ ID NO: 1188803 - RNA, 19 nt, Human
ugacucuuuccaaccggcu

SEQ ID NO: 1188804 - RNA, 19 nt, Human
ucuuuccaaccggcuuugu

SEQ ID NO: 1188805 - RNA, 16 nt, Human
uccucgagaucccaac

SEQ ID NO: 1188806 - RNA, 23 nt, Human
uccucgagaucccaacacugcca

SEQ ID NO: 1188807 - RNA, 23 nt, Human
ucccaugagcuccuuaaggcucu

SEQ ID NO: 1188808 - RNA, 16 nt, Human
ucccaacacugccagc

SEQ ID NO: 1188809 - RNA, 14 nt, Human
ucccaacacugcca

SEQ ID NO: 1188810 - RNA, 15 nt, Human
ucccaacacugccag

SEQ ID NO: 1188811 - RNA, 15 nt, Human
uccagagucccugcc

SEQ ID NO: 1188812 - RNA, 23 nt, Human
ucagccuccauccuacccccugu

SEQ ID NO: 1188813 - RNA, 14 nt, Human
ucaucuuucuucca

SEQ ID NO: 1188814 - RNA, 17 nt, Human
ucaucuuucuuccaaac

SEQ ID NO: 1188815 - RNA, 17 nt, Human
guuguccucagccccgc

SEQ ID NO: 1188816 - RNA, 23 nt, Human
guuguccucagccccgcguggaa

SEQ ID NO: 1188817 - RNA, 12 nt, Human
guucugccagga

SEQ ID NO: 1188818 - RNA, 13 nt, Human
guucugccaggag

SEQ ID NO: 1188819 - RNA, 14 nt, Human
guucugccaggaga

SEQ ID NO: 1188820 - RNA, 17 nt, Human
gugucuggcacagccug

SEQ ID NO: 1188821 - RNA, 21 nt, Human
guguccugcaccggggccugg

SEQ ID NO: 1188822 - RNA, 21 nt, Human
guggggagagacgggcccugg

SEQ ID NO: 1188823 - RNA, 16 nt, Human
guggcucgggaggcga

SEQ ID NO: 1188824 - RNA, 13 nt, Human
gucugagagaggc

SEQ ID NO: 1188825 - RNA, 14 nt, Human
gucugagagaggcc

SEQ ID NO: 1188826 - RNA, 15 nt, Human
gucugagagaggcca

SEQ ID NO: 1188827 - RNA, 18 nt, Human
gucugagagaggccauuc

SEQ ID NO: 1188828 - RNA, 14 nt, Human
gucccugccuggac

SEQ ID NO: 1188829 - RNA, 13 nt, Human
gucccugccugga

SEQ ID NO: 1188830 - RNA, 22 nt, Human
gucagcugggacaccccgacuu

SEQ ID NO: 1188831 - RNA, 19 nt, Human
guagugauuuuuaugccac

SEQ ID NO: 1188832 - RNA, 12 nt, Human
gcgcggcuggga

SEQ ID NO: 1188833 - RNA, 18 nt, Human
gcgcggcugggaggaggg

SEQ ID NO: 1188834 - RNA, 18 nt, Human
gccuuuggacuugucccg

SEQ ID NO: 1188835 - RNA, 21 nt, Human
gccucuccacucaugugacuc

SEQ ID NO: 1188836 - RNA, 24 nt, Human
gccucuccacucaugugacucuuu

SEQ ID NO: 1188837 - RNA, 17 nt, Human
gccuaaccugccgagag

SEQ ID NO: 1188838 - RNA, 15 nt, Human
gcccgggagcucagg

SEQ ID NO: 1188839 - RNA, 17 nt, Human
gcccgggagcucaggaa

SEQ ID NO: 1188840 - RNA, 19 nt, Human
gcccgggagcucaggaacc

SEQ ID NO: 1188841 - RNA, 19 nt, Human
gcaggggccgggggcaguc

SEQ ID NO: 1188842 - RNA, 20 nt, Human
gcaggggccgggggcagucu

SEQ ID NO: 1188843 - RNA, 17 nt, Human
gaucccaugagcuccuu

SEQ ID NO: 1188844 - RNA, 20 nt, Human
gagcucaggaaccgaggcag

SEQ ID NO: 1188845 - RNA, 21 nt, Human
gagcucaggaaccgaggcagg

SEQ ID NO: 1188846 - RNA, 22 nt, Human
gagcucaggaaccgaggcaggg

SEQ ID NO: 1188847 - RNA, 21 nt, Human
gagccugacccucaucuuucu

SEQ ID NO: 1188848 - RNA, 18 nt, Human
gacuugucccgggacacc

SEQ ID NO: 1188849 - RNA, 13 nt, Human
gagagaggccauu

SEQ ID NO: 1188850 - RNA, 21 nt, Human
gagagaggccauucuuuccca

SEQ ID NO: 1188851 - RNA, 15 nt, Human
gacaccuaggcuagg

SEQ ID NO: 1188852 - RNA, 16 nt, Human
gacaccuaggcuaggg

SEQ ID NO: 1188853 - RNA, 20 nt, Human
gacaccuaggcuaggguggg

SEQ ID NO: 1188854 - RNA, 21 nt, Human
gaaggaucccaugagcuccuu

SEQ ID NO: 1188855 - RNA, 12 nt, Human
cuuuggacuugu

SEQ ID NO: 1188856 - RNA, 13 nt, Human
cuuucuuccaaac

SEQ ID NO: 1188857 - RNA, 19 nt, Human
cuuucuuccaaacaggcuc

SEQ ID NO: 1188858 - RNA, 22 nt, Human
cuuucuuccaaacaggcucaga

SEQ ID NO: 1188859 - RNA, 23 nt, Human
cuugucacgccagacuucccacg

SEQ ID NO: 1188860 - RNA, 20 nt, Human
cuuggggaguuuaggguggg

SEQ ID NO: 1188861 - RNA, 21 nt, Human
cuuggggaguuuagggugggg

SEQ ID NO: 1188862 - RNA, 19 nt, Human
cugggaggagggcaggcau

SEQ ID NO: 1188863 - RNA, 18 nt, Human
cuggcuguggccuaaccu

SEQ ID NO: 1188864 - RNA, 23 nt, Human
cuggcacagccuggcuguggccu

SEQ ID NO: 1188865 - RNA, 16 nt, Human
cuggcacagccuggcu

SEQ ID NO: 1188866 - RNA, 21 nt, Human
cuggcacagccuggcuguggc

SEQ ID NO: 1188867 - RNA, 11 nt, Human
cugccaggaga

SEQ ID NO: 1188868 - RNA, 19 nt, Human
cugcccgggagcucaggaa

SEQ ID NO: 1188869 - RNA, 23 nt, Human
cucuuggggaguuuagggugggg

SEQ ID NO: 1188870 - RNA, 15 nt, Human
cucuccugucucccu

SEQ ID NO: 1188871 - RNA, 17 nt, Human
cucuccugucucccucc

SEQ ID NO: 1188872 - RNA, 18 nt, Human
cucuccugucucccuccu

SEQ ID NO: 1188873 - RNA, 22 nt, Human
cucuccacucaugugacucuuu

SEQ ID NO: 1188874 - RNA, 21 nt, Human
cucuccacucaugugacucuu

SEQ ID NO: 1188875 - RNA, 17 nt, Human
cuccucgagaucccaac

SEQ ID NO: 1188876 - RNA, 21 nt, Human
cuccucgagaucccaacacug

SEQ ID NO: 1188877 - RNA, 24 nt, Human
cuccucgagaucccaacacugcca

SEQ ID NO: 1188878 - RNA, 23 nt, Human
cuccauccuacccccugugccuu

SEQ ID NO: 1188879 - RNA, 20 nt, Human
cuccauccuacccccugugc

SEQ ID NO: 1188880 - RNA, 22 nt, Human
cuccauccuacccccugugccu

SEQ ID NO: 1188881 - RNA, 18 nt, Human
cuccauccuacccccugu

SEQ ID NO: 1188882 - RNA, 14 nt, Human
cuacccccugugcc

SEQ ID NO: 1188883 - RNA, 16 nt, Human
cguuguccucagcccc

SEQ ID NO: 1188884 - RNA, 23 nt, Human
cguggcuguggcauccagagucc

SEQ ID NO: 1188885 - RNA, 17 nt, Human
cgggggcagucugagag

SEQ ID NO: 1188886 - RNA, 18 nt, Human
cgggggcagucugagaga

SEQ ID NO: 1188887 - RNA, 21 nt, Human
cgggggcagucugagagaggc

SEQ ID NO: 1188888 - RNA, 17 nt, Human
cggggccugggcaggag

SEQ ID NO: 1188889 - RNA, 19 nt, Human
cggggccugggcaggaggg

SEQ ID NO: 1188890 - RNA, 12 nt, Human
cggcugggagga

SEQ ID NO: 1188891 - RNA, 17 nt, Human
cgggagccugacccuca

SEQ ID NO: 1188892 - RNA, 18 nt, Human
cggcugggaggagggcag

SEQ ID NO: 1188893 - RNA, 11 nt, Human
cgcggcuggga

SEQ ID NO: 1188894 - RNA, 17 nt, Human
ccuccauccuacccccu

SEQ ID NO: 1188895 - RNA, 22 nt, Human
ccuccauccuacccccugugcc

SEQ ID NO: 1188896 - RNA, 23 nt, Human
ccuccauccuacccccugugccu

SEQ ID NO: 1188897 - RNA, 18 nt, Human
ccucagccccgcguggaa

SEQ ID NO: 1188898 - RNA, 13 nt, Human
ccgggagcucagg

SEQ ID NO: 1188899 - RNA, 15 nt, Human
ccgggagcucaggaa

SEQ ID NO: 1188900 - RNA, 15 nt, Human
ccggggccugggcag

SEQ ID NO: 1188901 - RNA, 19 nt, Human
ccggggccugggcaggagg

SEQ ID NO: 1188902 - RNA, 17 nt, Human
ccggcuuuguggcacug

SEQ ID NO: 1188903 - RNA, 19 nt, Human
ccggcuuuguggcacuggg

SEQ ID NO: 1188904 - RNA, 12 nt, Human
cccugccuggac

SEQ ID NO: 1188905 - RNA, 13 nt, Human
cccugccuggacc

SEQ ID NO: 1188906 - RNA, 18 nt, Human
cccugccuggaccagccu

SEQ ID NO: 1188907 - RNA, 14 nt, Human
cccucaucuuucuu

SEQ ID NO: 1188908 - RNA, 14 nt, Human
cugcaccggggccu

SEQ ID NO: 1188909 - RNA, 16 nt, Human
cugcaccggggccugg

SEQ ID NO: 1188910 - RNA, 18 nt, Human
cugcaccggggccugggc

SEQ ID NO: 1188911 - RNA, 19 nt, Human
cugcaccggggccugggca

SEQ ID NO: 1188912 - RNA, 13 nt, Human
cugggcaggaggg

SEQ ID NO: 1188913 - RNA, 12 nt, Human
gaaccgaggcag

SEQ ID NO: 1188914 - RNA, 15 nt, Human
gaaccgaggcaggga

SEQ ID NO: 1188915 - RNA, 17 nt, Human
gaguccaucagccucca

SEQ ID NO: 1188916 - RNA, 22 nt, Human
gaggugcuucuaguucugccag

SEQ ID NO: 1188917 - RNA, 23 nt, Human
gaggugcuucuaguucugccagg

SEQ ID NO: 1188918 - RNA, 9 nt, Human
gagggcugc

SEQ ID NO: 1188919 - RNA, 16 nt, Human
gagggcugccuuugga

SEQ ID NO: 1188920 - RNA, 14 nt, Human
gcaccggggccugg

SEQ ID NO: 1188921 - RNA, 16 nt, Human
gcaccggggccugggc

SEQ ID NO: 1188922 - RNA, 19 nt, Human
gcaccggggccugggcagg

SEQ ID NO: 1188923 - RNA, 12 nt, Human
gccauucuuucc

SEQ ID NO: 1188924 - RNA, 17 nt, Human
ggagagacgggcccugg

SEQ ID NO: 1188925 - RNA, 23 nt, Human
ggcaggcaucggggagccgggag

SEQ ID NO: 1188926 - RNA, 20 nt, Human
ggcuccucgagaucccaaca

SEQ ID NO: 1188927 - RNA, 15 nt, Human
aaaaagggaggggga

SEQ ID NO: 1188928 - RNA, 14 nt, Human
gggagggggagagg

SEQ ID NO: 1188929 - RNA, 12 nt, Human
ggggccugggca

SEQ ID NO: 1188930 - RNA, 15 nt, Human
ggggccugggcagga

SEQ ID NO: 1188931 - RNA, 15 nt, Human
ggggcgcggcuggga

SEQ ID NO: 1188932 - RNA, 18 nt, Human
caccuaggcuaggguggg

SEQ ID NO: 1188933 - RNA, 19 nt, Human
caccuaggcuagggugggg

SEQ ID NO: 1188934 - RNA, 17 nt, Human
auuuuuaugccaccuga

SEQ ID NO: 1188935 - RNA, 13 nt, Human
auucuuucccaac

SEQ ID NO: 1188936 - RNA, 23 nt, Human
ccagacuucccacggcuccucga

SEQ ID NO: 1188937 - RNA, 18 nt, Human
ccagagaaaaagggaggg

SEQ ID NO: 1188938 - RNA, 21 nt, Human
ccccgcguggaacucgugucu

SEQ ID NO: 1188939 - RNA, 21 nt, Human
ccaugagcuccuuaaggcucu

SEQ ID NO: 1188940 - RNA, 12 nt, Human
ccugccuggacc

SEQ ID NO: 1188941 - RNA, 19 nt, Human
ccugccuggaccagccucu

SEQ ID NO: 1188942 - RNA, 23 nt, Human
ccucuuggggaguuuaggguggg

SEQ ID NO: 1188943 - RNA, 22 nt, Human
ccucuuggggaguuuagggugg

SEQ ID NO: 1188944 - RNA, 21 nt, Human
ccucugcccgggagcucagga

SEQ ID NO: 1188945 - RNA, 22 nt, Human
ccucugcccgggagcucaggaa

SEQ ID NO: 1188946 - RNA, 16 nt, Human
cuccugucucccuccu

SEQ ID NO: 1188947 - RNA, 22 nt, Human
cuccucugcccgggagcucagg

SEQ ID NO: 1188948 - RNA, 24 nt, Human
cuccucugcccgggagcucaggaa

SEQ ID NO: 1188949 - RNA, 14 nt, Human
cucaugugacucuu

SEQ ID NO: 1188950 - RNA, 22 nt, Human
uuuguagugauuuuuaugccac

SEQ ID NO: 1188951 - RNA, 15 nt, Human
uuuguagugauuuuu

SEQ ID NO: 1188952 - RNA, 18 nt, Human
uuuguaagguuuuuguag

SEQ ID NO: 1188953 - RNA, 19 nt, Human
uuucccuuccuuccucucc

SEQ ID NO: 1188954 - RNA, 16 nt, Human
uuggacuugucccggg

SEQ ID NO: 1188955 - RNA, 17 nt, Human
uucuaguucugccagga

SEQ ID NO: 1188956 - RNA, 12 nt, Human
uucugccaggag

SEQ ID NO: 1188957 - RNA, 15 nt, Human
aucccaacacugcca

SEQ ID NO: 1188958 - RNA, 16 nt, Human
aucccaacacugccag

SEQ ID NO: 1188959 - RNA, 17 nt, Human
aucccaacacugccagc

SEQ ID NO: 1188960 - RNA, 12 nt, Human
aguuuagggugg

SEQ ID NO: 1188961 - RNA, 13 nt, Human
aguuuaggguggg

SEQ ID NO: 1188962 - RNA, 14 nt, Human
aguuuagggugggg

SEQ ID NO: 1188963 - RNA, 13 nt, Human
aguucugccagga

SEQ ID NO: 1188964 - RNA, 14 nt, Human
aguucugccaggag

SEQ ID NO: 1188965 - RNA, 20 nt, Human
aguucugccaggagacaggu

SEQ ID NO: 1188966 - RNA, 12 nt, Human
aguucugccagg

SEQ ID NO: 1188967 - RNA, 16 nt, Human
uguggcauccagaguc

SEQ ID NO: 1188968 - RNA, 19 nt, Human
uguggcauccagagucccu

SEQ ID NO: 1188969 - RNA, 21 nt, Human
uguggcauccagagucccugc

SEQ ID NO: 1188970 - RNA, 12 nt, Human
ugugacucuuuc

SEQ ID NO: 1188971 - RNA, 14 nt, Human
ugugacucuuucca

SEQ ID NO: 1188972 - RNA, 15 nt, Human
ugugacucuuuccaa

SEQ ID NO: 1188973 - RNA, 17 nt, Human
ugugacucuuuccaacc

SEQ ID NO: 1188974 - RNA, 19 nt, Human
agguuuuuguagugauuuu

SEQ ID NO: 1188975 - RNA, 21 nt, Human
aggguggggggggggcgcggc

SEQ ID NO: 1188976 - RNA, 13 nt, Human
uggggagagacgg

SEQ ID NO: 1188977 - RNA, 15 nt, Human
agggaaggaucccau

SEQ ID NO: 1188978 - RNA, 22 nt, Human
agggaaggaucccaugagcucc

SEQ ID NO: 1188979 - RNA, 23 nt, Human
agggaaggaucccaugagcuccu

SEQ ID NO: 1188980 - RNA, 19 nt, Human
aggaucccaugagcuccuu

SEQ ID NO: 1188981 - RNA, 15 nt, Human
ugccuugucacgcca

SEQ ID NO: 1188982 - RNA, 17 nt, Human
ugccuugucacgccaga

SEQ ID NO: 1188983 - RNA, 22 nt, Human
ugccgagaguccaucagccucc

SEQ ID NO: 1188984 - RNA, 16 nt, Human
agccucuccacucaug

SEQ ID NO: 1188985 - RNA, 23 nt, Human
agccccgcguggaacucgugucu

SEQ ID NO: 1188986 - RNA, 18 nt, Human
agaucccaacacugccag

SEQ ID NO: 1188987 - RNA, 19 nt, Human
agaucccaacacugccagc

SEQ ID NO: 1188988 - RNA, 20 nt, Human
agaucccaacacugccagca

SEQ ID NO: 1188989 - RNA, 23 nt, Human
agaguccaucagccuccauccua

SEQ ID NO: 1188990 - RNA, 14 nt, Human
agagucccugccug

SEQ ID NO: 1188991 - RNA, 17 nt, Human
agagucccugccuggac

SEQ ID NO: 1188992 - RNA, 21 nt, Human
agaggccauucuuucccaaca

SEQ ID NO: 1188993 - RNA, 19 nt, Human
agacuucccacggcuccuc

SEQ ID NO: 1188994 - RNA, 13 nt, Human
ucuuucuuccaaa

SEQ ID NO: 1188995 - RNA, 14 nt, Human
ucugagagaggcca

SEQ ID NO: 1188996 - RNA, 20 nt, Human
ucugagagaggccauucuuu

SEQ ID NO: 1188997 - RNA, 23 nt, Human
acuugucccgggacaccuaggcu

SEQ ID NO: 1188998 - RNA, 17 nt, Human
ucgagaucccaacacug

SEQ ID NO: 1188999 - RNA, 22 nt, Human
ucgagaucccaacacugccagc

SEQ ID NO: 1189000 - RNA, 18 nt, Human
ucgagaucccaacacugc

SEQ ID NO: 1189001 - RNA, 21 nt, Human
ucgagaucccaacacugccag

SEQ ID NO: 1189002 - RNA, 19 nt, Human
acucaugugacucuuucca

SEQ ID NO: 1189003 - RNA, 21 nt, Human
ucccgggacaccuaggcuagg

SEQ ID NO: 1189004 - RNA, 14 nt, Human
uccacucaugugac

SEQ ID NO: 1189005 - RNA, 21 nt, Human
uccacucaugugacucuuucc

SEQ ID NO: 1189006 - RNA, 21 nt, Human
uccaaccggcuuuguggcacu

SEQ ID NO: 1189007 - RNA, 17 nt, Human
ucaggaaccgaggcagg

SEQ ID NO: 1189008 - RNA, 18 nt, Human
accagagaaaaagggagg

SEQ ID NO: 1189009 - RNA, 17 nt, Human
acaccccgacuuuuguu

SEQ ID NO: 1189010 - RNA, 23 nt, Human
guggggggggggcgcggcuggga

SEQ ID NO: 1189011 - RNA, 14 nt, Human
guggcacuggggca

SEQ ID NO: 1189012 - RNA, 12 nt, Human
gucucccuccuc

SEQ ID NO: 1189013 - RNA, 16 nt, Human
gucucccuccucugcc

SEQ ID NO: 1189014 - RNA, 12 nt, Human
aacacugccagc

SEQ ID NO: 1189015 - RNA, 22 nt, Human
aacacugccagcauuucccuuc

SEQ ID NO: 1189016 - RNA, 15 nt, Human
aggagggcaggcauc

SEQ ID NO: 1189017 - RNA, 15 nt, Human
aggagggaggugcuu

SEQ ID NO: 1189018 - RNA, 13 nt, Human
aggagggcaggca

SEQ ID NO: 1189019 - RNA, 20 nt, Human
aggagacagguuagcugcuc

SEQ ID NO: 1189020 - RNA, 19 nt, Human
aggcaucggggagccggga

SEQ ID NO: 1189021 - RNA, 14 nt, Human
aggcuagggugggg

SEQ ID NO: 1189022 - RNA, 15 nt, Human
aggcuagggugggga

SEQ ID NO: 1189023 - RNA, 16 nt, Human
aggcuaggguggggag

SEQ ID NO: 1189024 - RNA, 19 nt, Human
aggcuaggguggggagaga

SEQ ID NO: 1189025 - RNA, 22 nt, Human
agagaggccauucuuucccaac

SEQ ID NO: 1189026 - RNA, 23 nt, Human
agagaggccauucuuucccaaca

SEQ ID NO: 1189027 - RNA, 12 nt, Human
agagaggccauu

SEQ ID NO: 1189028 - RNA, 13 nt, Human
acccucaucuuuc

SEQ ID NO: 1189029 - RNA, 14 nt, Human
acccucaucuuucu

SEQ ID NO: 1189030 - RNA, 16 nt, Human
acccucaucuuucuuc

SEQ ID NO: 1189031 - RNA, 19 nt, Human
acccucaucuuucuuccaa

SEQ ID NO: 1189032 - RNA, 19 nt, Human
accggggccugggcaggag

SEQ ID NO: 1189033 - RNA, 13 nt, Human
accggggccuggg

SEQ ID NO: 1189034 - RNA, 14 nt, Human
aacaggcucagagg

SEQ ID NO: 1189035 - RNA, 16 nt, Human
uggggcaggggccggg

SEQ ID NO: 1189036 - RNA, 18 nt, Human
uggggcaggggccggggg

SEQ ID NO: 1189037 - RNA, 20 nt, Human
ugcuucuaguucugccagga

SEQ ID NO: 1189038 - RNA, 18 nt, Human
ugcuucuaguucugccag

SEQ ID NO: 1189039 - RNA, 19 nt, Human
ugcuucuaguucugccagg

SEQ ID NO: 1189040 - RNA, 19 nt, Human
ucuuuuguaagguuuuugu

SEQ ID NO: 1189041 - RNA, 16 nt, Human
uccuuaaggcucuuuu

SEQ ID NO: 1189042 - RNA, 19 nt, Human
uccuuaaggcucuuuugua

SEQ ID NO: 1189043 - RNA, 18 nt, Human
ucacgccagacuucccac

SEQ ID NO: 1189044 - RNA, 15 nt, Human
uaggcuagggugggg

SEQ ID NO: 1189045 - RNA, 13 nt, Human
uaggcuagggugg

SEQ ID NO: 1189046 - RNA, 20 nt, Human
uagugauuuuuaugccaccu

SEQ ID NO: 1189047 - RNA, 21 nt, Human
uagugauuuuuaugccaccug

SEQ ID NO: 1189048 - RNA, 22 nt, Human
uagugauuuuuaugccaccuga

SEQ ID NO: 1189049 - RNA, 15 nt, Human
ggugguggcucggga

SEQ ID NO: 1189050 - RNA, 21 nt, Human
gguguccugcaccggggccug

SEQ ID NO: 1189051 - RNA, 15 nt, Human
gggggagagggcugc

SEQ ID NO: 1189052 - RNA, 18 nt, Human
ggggcagucugagagagg

SEQ ID NO: 1189053 - RNA, 19 nt, Human
ggggcagucugagagaggc

SEQ ID NO: 1189054 - RNA, 16 nt, Human
ggggcgcggcugggag

SEQ ID NO: 1189055 - RNA, 16 nt, Human
gggccugggcaggagg

SEQ ID NO: 1189056 - RNA, 17 nt, Human
gggccugggcaggaggg

SEQ ID NO: 1189057 - RNA, 12 nt, Human
gggccugggcag

SEQ ID NO: 1189058 - RNA, 13 nt, Human
gggccugggcagg

SEQ ID NO: 1189059 - RNA, 15 nt, Human
gggccugggcaggag

SEQ ID NO: 1189060 - RNA, 20 nt, Human
gggcagucugagagaggcca

SEQ ID NO: 1189061 - RNA, 21 nt, Human
gggcagucugagagaggccau

SEQ ID NO: 1189062 - RNA, 16 nt, Human
gggaguuuaggguggg

SEQ ID NO: 1189063 - RNA, 23 nt, Human
gggaggugcuucuaguucugcca

SEQ ID NO: 1189064 - RNA, 17 nt, Human
gggcagucugagagagg

SEQ ID NO: 1189065 - RNA, 18 nt, Human
gggcagucugagagaggc

SEQ ID NO: 1189066 - RNA, 19 nt, Human
gggcagucugagagaggcc

SEQ ID NO: 1189067 - RNA, 15 nt, Human
gggaaggaucccaug

SEQ ID NO: 1189068 - RNA, 20 nt, Human
ggcagucugagagaggccau

SEQ ID NO: 1189069 - RNA, 17 nt, Human
ggaucccaugagcuccu

SEQ ID NO: 1189070 - RNA, 20 nt, Human
ggaucccaugagcuccuuaa

SEQ ID NO: 1189071 - RNA, 13 nt, Human
ggagggcaggcau

SEQ ID NO: 1189072 - RNA, 14 nt, Human
ggagggcaggcauc

SEQ ID NO: 1189073 - RNA, 16 nt, Human
ggagccgggagccuga

SEQ ID NO: 1189074 - RNA, 14 nt, Human
ggaggagggcaggc

SEQ ID NO: 1189075 - RNA, 15 nt, Human
ggaggagggcaggca

SEQ ID NO: 1189076 - RNA, 20 nt, Human
ggaggagggcaggcaucggg

SEQ ID NO: 1189077 - RNA, 17 nt, Human
ggaaggaucccaugagc

SEQ ID NO: 1189078 - RNA, 17 nt, Human
ggaacucgugucuggca

SEQ ID NO: 1189079 - RNA, 15 nt, Human
ggaaccgaggcaggg

SEQ ID NO: 1189080 - RNA, 16 nt, Human
ggaaccgaggcaggga

SEQ ID NO: 1189081 - RNA, 20 nt, Human
ggaaccgaggcagggaagga

SEQ ID NO: 1189082 - RNA, 21 nt, Human
gcuucuaguucugccaggaga

SEQ ID NO: 1189083 - RNA, 19 nt, Human
gcuucuaguucugccagga

SEQ ID NO: 1189084 - RNA, 20 nt, Human
gcuucuaguucugccaggag

SEQ ID NO: 1189085 - RNA, 18 nt, Human
gcuucuaguucugccagg

SEQ ID NO: 1189086 - RNA, 17 nt, Human
gcugggaggagggcagg

SEQ ID NO: 1189087 - RNA, 19 nt, Human
gcugggaggagggcaggca

SEQ ID NO: 1189088 - RNA, 15 nt, Human
gcugccuuuggacuu

SEQ ID NO: 1189089 - RNA, 20 nt, Human
gcugccuuuggacuuguccc

SEQ ID NO: 1189090 - RNA, 13 nt, Human
gccgggagccuga

SEQ ID NO: 1189091 - RNA, 14 nt, Human
gccgggagccugac

SEQ ID NO: 1189092 - RNA, 19 nt, Human
gccgggagccugacccuca

SEQ ID NO: 1189093 - RNA, 21 nt, Human
gccgagaguccaucagccucc

SEQ ID NO: 1189094 - RNA, 13 nt, Human
gccccgcguggaa

SEQ ID NO: 1189095 - RNA, 15 nt, Human
gcaggagggaggugc

SEQ ID NO: 1189096 - RNA, 12 nt, Human
gcacagccuggc

SEQ ID NO: 1189097 - RNA, 19 nt, Human
gcacagccuggcuguggcc

SEQ ID NO: 1189098 - RNA, 18 nt, Human
gacuucccacggcuccuc

SEQ ID NO: 1189099 - RNA, 13 nt, Human
gaagcguuguccu

SEQ ID NO: 1189100 - RNA, 19 nt, Human
gaagcguuguccucagccc

SEQ ID NO: 1189101 - RNA, 20 nt, Human
gaagcguuguccucagcccc

SEQ ID NO: 1189102 - RNA, 14 nt, Human
cuuccuuccucucc

SEQ ID NO: 1189103 - RNA, 14 nt, Human
cuggcacagccugg

SEQ ID NO: 1189104 - RNA, 15 nt, Human
cuggcacagccuggc

SEQ ID NO: 1189105 - RNA, 12 nt, Human
cuggaccagccu

SEQ ID NO: 1189106 - RNA, 18 nt, Human
cugcccgggagcucagga

SEQ ID NO: 1189107 - RNA, 16 nt, Human
cugccaggagacaggu

SEQ ID NO: 1189108 - RNA, 20 nt, Human
cugccagcauuucccuuccu

SEQ ID NO: 1189109 - RNA, 21 nt, Human
cucuuggggaguuuagggugg

SEQ ID NO: 1189110 - RNA, 19 nt, Human
cucuccacucaugugacuc

SEQ ID NO: 1189111 - RNA, 13 nt, Human
cuccuuaaggcuc

SEQ ID NO: 1189112 - RNA, 22 nt, Human
cuccuuaaggcucuuuuguaag

SEQ ID NO: 1189113 - RNA, 19 nt, Human
cgucagcugggacaccccg

SEQ ID NO: 1189114 - RNA, 16 nt, Human
cgggagcucaggaacc

SEQ ID NO: 1189115 - RNA, 22 nt, Human
cggcugggaggagggcaggcau

SEQ ID NO: 1189116 - RNA, 23 nt, Human
cggcugggaggagggcaggcauc

SEQ ID NO: 1189117 - RNA, 14 nt, Human
ccuggaccagccuc

SEQ ID NO: 1189118 - RNA, 15 nt, Human
ccuggaccagccucu

SEQ ID NO: 1189119 - RNA, 16 nt, Human
ccuggaccagccucuc

SEQ ID NO: 1189120 - RNA, 23 nt, Human
ccucuccacucaugugacucuuu

SEQ ID NO: 1189121 - RNA, 14 nt, Human
ccuccucugcccgg

SEQ ID NO: 1189122 - RNA, 15 nt, Human
ccuccucugcccggg

SEQ ID NO: 1189123 - RNA, 22 nt, Human
ccgacuuuuguuuaccagagaa

SEQ ID NO: 1189124 - RNA, 13 nt, Human
cccaacaccucuu

SEQ ID NO: 1189125 - RNA, 13 nt, Human
ccaucagccucca

SEQ ID NO: 1189126 - RNA, 21 nt, Human
ccacgucagcugggacacccc

SEQ ID NO: 1189127 - RNA, 13 nt, Human
ccaacacugccag

SEQ ID NO: 1189128 - RNA, 14 nt, Human
ccaacacugccagc

SEQ ID NO: 1189129 - RNA, 15 nt, Human
ccaacacugccagca

SEQ ID NO: 1189130 - RNA, 16 nt, Human
ccaacacugccagcau

SEQ ID NO: 1189131 - RNA, 16 nt, Human
ccaaacaggcucagag

SEQ ID NO: 1189132 - RNA, 15 nt, Colorado tick fever virus
gggcugcgcagugug

SEQ ID NO: 1189133 - RNA, 15 nt, Colorado tick fever virus
ucagguggaggcugc

SEQ ID NO: 1189134 - RNA, 18 nt, Colorado tick fever virus
acugcuugcuuaaaggug

SEQ ID NO: 1189135 - RNA, 17 nt, Colorado tick fever virus
gcuuacggaaugaugac

SEQ ID NO: 1189136 - RNA, 13 nt, Colorado tick fever virus
acggguaauugca

SEQ ID NO: 1189137 - RNA, 14 nt, Colorado tick fever virus
ugaguggggcugcg

SEQ ID NO: 1189138 - RNA, 16 nt, Colorado tick fever virus
ugaguugaaggucggg

SEQ ID NO: 1189139 - RNA, 24 nt, Colorado tick fever virus
cccucauauagggaauccuugcag

SEQ ID NO: 1189140 - RNA, 20 nt, Colorado tick fever virus
cugcggcuuaccaggcgggc

SEQ ID NO: 1189141 - RNA, 14 nt, Colorado tick fever virus
ucgagagugcaggc

SEQ ID NO: 1189142 - RNA, 20 nt, Colorado tick fever virus
gcacgcuugauuaccagggu

SEQ ID NO: 1189143 - RNA, 14 nt, Colorado tick fever virus
aucucccuugcagu

SEQ ID NO: 1189144 - RNA, 19 nt, Colorado tick fever virus
cgccauacacaauugcagu

SEQ ID NO: 1189145 - RNA, 15 nt, Colorado tick fever virus
auucuugaugugaag

SEQ ID NO: 1189146 - RNA, 20 nt, Colorado tick fever virus
ugaugugaagacaaugcagu

SEQ ID NO: 1189147 - RNA, 23 nt, Colorado tick fever virus
ggaugcugaucucccuugcaguc

SEQ ID NO: 1189148 - RNA, 16 nt, Colorado tick fever virus
cggggaauuugcaguc

SEQ ID NO: 1189149 - RNA, 14 nt, Colorado tick fever virus
acugcuugcuuaaa

SEQ ID NO: 1189150 - RNA, 18 nt, Colorado tick fever virus
ugugaaaaucaauugucg

SEQ ID NO: 1189151 - RNA, 15 nt, Colorado tick fever virus
cacgagugacugaug

SEQ ID NO: 1189152 - RNA, 20 nt, Colorado tick fever virus
uggguagaacgguugcaguc

SEQ ID NO: 1189153 - RNA, 17 nt, Colorado tick fever virus
ggacaucguuguugaug

SEQ ID NO: 1189154 - RNA, 14 nt, Colorado tick fever virus
uacacaauugcagu

SEQ ID NO: 1189155 - RNA, 12 nt, Colorado tick fever virus
aagacugcuugc

SEQ ID NO: 1189156 - RNA, 13 nt, Colorado tick fever virus
gcgaguugcaguc

SEQ ID NO: 1189157 - RNA, 22 nt, Colorado tick fever virus
uugaugugaagacaaugcaguc

SEQ ID NO: 1189158 - RNA, 19 nt, Colorado tick fever virus
cuguguucggaugcaugca

SEQ ID NO: 1189159 - RNA, 17 nt, Colorado tick fever virus
uucccagggugcauucu

SEQ ID NO: 1189160 - RNA, 16 nt, Colorado tick fever virus
agcucuccaucgcuuu

SEQ ID NO: 1189161 - RNA, 23 nt, Colorado tick fever virus
agggugcauucuugaugugaaga

SEQ ID NO: 1189162 - RNA, 16 nt, Colorado tick fever virus
gaguggggcugcgcag

SEQ ID NO: 1189163 - RNA, 15 nt, Colorado tick fever virus
ucagcagcagaggcg

SEQ ID NO: 1189164 - RNA, 23 nt, Colorado tick fever virus
ggugcaggaugcugaucucccuu

SEQ ID NO: 1189165 - RNA, 17 nt, Colorado tick fever virus
auugagagcggagccuu

SEQ ID NO: 1189166 - RNA, 14 nt, Colorado tick fever virus
cggaugcaugcagu

SEQ ID NO: 1189167 - RNA, 19 nt, Colorado tick fever virus
gugcacacgauugagcaca

SEQ ID NO: 1189168 - RNA, 18 nt, Colorado tick fever virus
uugcuuaaaggugugaaa

SEQ ID NO: 1189169 - RNA, 16 nt, Colorado tick fever virus
gcuugcuuaaaggugu

SEQ ID NO: 1189170 - RNA, 21 nt, Colorado tick fever virus
ccaauggugucuaugguuaua

SEQ ID NO: 1189171 - RNA, 20 nt, Colorado tick fever virus
cgccuuuggugaaggaugca

SEQ ID NO: 1189172 - RNA, 22 nt, Colorado tick fever virus
ugggauuggugaccggugcagg

SEQ ID NO: 1189173 - RNA, 15 nt, Colorado tick fever virus
cggggaauuugcagu

SEQ ID NO: 1189174 - RNA, 13 nt, Colorado tick fever virus
ugaugugacacac

SEQ ID NO: 1189175 - RNA, 15 nt, Colorado tick fever virus
cuugaugugaagaca

SEQ ID NO: 1189176 - RNA, 20 nt, Colorado tick fever virus
uucauucccagggugcauuc

SEQ ID NO: 1189177 - RNA, 12 nt, Colorado tick fever virus
gcgaguugcagu

SEQ ID NO: 1189178 - RNA, 11 nt, Colorado tick fever virus
gagagugcagg

SEQ ID NO: 1189179 - RNA, 19 nt, Colorado tick fever virus
gucgcugaggaccucgccg

SEQ ID NO: 1189180 - RNA, 18 nt, Colorado tick fever virus
ggccuggauacaaaugca

SEQ ID NO: 1189181 - RNA, 14 nt, Colorado tick fever virus
cgcagggguucagu

SEQ ID NO: 1189182 - RNA, 22 nt, Colorado tick fever virus
ucuugaugugaagacaaugcag

SEQ ID NO: 1189183 - RNA, 14 nt, Colorado tick fever virus
cccgggacggguaa

SEQ ID NO: 1189184 - RNA, 15 nt, Colorado tick fever virus
cacggggaauuugca

SEQ ID NO: 1189185 - RNA, 16 nt, Colorado tick fever virus
guguucggaugcaugc

SEQ ID NO: 1189186 - RNA, 15 nt, Colorado tick fever virus
ggcgcgugagcaggu

SEQ ID NO: 1189187 - RNA, 15 nt, Colorado tick fever virus
ggugcaggaugcuga

SEQ ID NO: 1189188 - RNA, 23 nt, Colorado tick fever virus
guguuggccuggugagcuguacc

SEQ ID NO: 1189189 - RNA, 22 nt, Colorado tick fever virus
ucccgggacggguaauugcagu

SEQ ID NO: 1189190 - RNA, 15 nt, Colorado tick fever virus
ucuguuuggauguca

SEQ ID NO: 1189191 - RNA, 16 nt, Colorado tick fever virus
uucuugaugugaagac

SEQ ID NO: 1189192 - RNA, 14 nt, Colorado tick fever virus
uuguugcaggcuuu

SEQ ID NO: 1189193 - RNA, 17 nt, Colorado tick fever virus
ggauauuuucuaagacu

SEQ ID NO: 1189194 - RNA, 11 nt, Colorado tick fever virus
aucuucaauuu

SEQ ID NO: 1189195 - RNA, 17 nt, Colorado tick fever virus
augugaagacaaugcag

SEQ ID NO: 1189196 - RNA, 22 nt, Colorado tick fever virus
auauuuucuaagacugcuugcu

SEQ ID NO: 1189197 - RNA, 13 nt, Colorado tick fever virus
ggcugcgcagugu

SEQ ID NO: 1189198 - RNA, 13 nt, Colorado tick fever virus
gugggagugcuca

SEQ ID NO: 1189199 - RNA, 16 nt, Colorado tick fever virus
gagguacuggcagaug

SEQ ID NO: 1189200 - RNA, 19 nt, Colorado tick fever virus
augcugaucucccuugcag

SEQ ID NO: 1189201 - RNA, 22 nt, Colorado tick fever virus
uugacacagucugucaaagacg

SEQ ID NO: 1189202 - RNA, 18 nt, Colorado tick fever virus
cggugggagugcucaagu

SEQ ID NO: 1189203 - RNA, 22 nt, Colorado tick fever virus
caguauuacguugacacagucu

SEQ ID NO: 1189204 - RNA, 13 nt, Colorado tick fever virus
augacguccuagc

SEQ ID NO: 1189205 - RNA, 14 nt, Colorado tick fever virus
gugcauucuugaug

SEQ ID NO: 1189206 - RNA, 22 nt, Colorado tick fever virus
cugugcacacgauugagcacaa

SEQ ID NO: 1189207 - RNA, 19 nt, Colorado tick fever virus
gcaccacgccauacacaau

SEQ ID NO: 1189208 - RNA, 21 nt, Colorado tick fever virus
caccacgccauacacaauugc

SEQ ID NO: 1189209 - RNA, 13 nt, Colorado tick fever virus
gcagggguucagu

SEQ ID NO: 1189210 - RNA, 20 nt, Colorado tick fever virus
guagugaaugggcuggagaa

SEQ ID NO: 1189211 - RNA, 14 nt, Colorado tick fever virus
agcaucauucuccc

SEQ ID NO: 1189212 - RNA, 13 nt, Colorado tick fever virus
gaauccuugcagu

SEQ ID NO: 1189213 - RNA, 14 nt, Colorado tick fever virus
ggaugcaugcaguc

SEQ ID NO: 1189214 - RNA, 12 nt, Colorado tick fever virus
cgaguugcaguc

SEQ ID NO: 1189215 - RNA, 14 nt, Colorado tick fever virus
cauucauucccagg

SEQ ID NO: 1189216 - RNA, 11 nt, Colorado tick fever virus
ccaaacuccaa

SEQ ID NO: 1189217 - RNA, 22 nt, Colorado tick fever virus
ugaccggugcaggaugcugauc

SEQ ID NO: 1189218 - RNA, 15 nt, Colorado tick fever virus
ugcuuaaagguguga

SEQ ID NO: 1189219 - RNA, 16 nt, Colorado tick fever virus
acggguaauugcaguc

SEQ ID NO: 1189220 - RNA, 11 nt, Colorado tick fever virus
accggugcagg

SEQ ID NO: 1189221 - RNA, 23 nt, Colorado tick fever virus
gagcucuccaucgcuuugcaguc

SEQ ID NO: 1189222 - RNA, 19 nt, Colorado tick fever virus
ucuaagacugcuugcuuaa

SEQ ID NO: 1189223 - RNA, 23 nt, Colorado tick fever virus
auugagagcggagccuuuaaggu

SEQ ID NO: 1189224 - RNA, 22 nt, Colorado tick fever virus
gacguccuagcaucauucuccc

SEQ ID NO: 1189225 - RNA, 22 nt, Colorado tick fever virus
gcggagccuuuaagguguagug

SEQ ID NO: 1189226 - RNA, 21 nt, Colorado tick fever virus
acgccauacacaauugcaguc

SEQ ID NO: 1189227 - RNA, 21 nt, Colorado tick fever virus
ccucgccggcuuacggaauga

SEQ ID NO: 1189228 - RNA, 19 nt, Colorado tick fever virus
caggcgggcuuuuugcgug

SEQ ID NO: 1189229 - RNA, 14 nt, Colorado tick fever virus
gguuguugcaggcu

SEQ ID NO: 1189230 - RNA, 15 nt, Colorado tick fever virus
gcaggaugcugaucu

SEQ ID NO: 1189231 - RNA, 22 nt, Colorado tick fever virus
augcaaguggucgaccacgagu

SEQ ID NO: 1189232 - RNA, 19 nt, Colorado tick fever virus
gcaucuucaauuuguuaac

SEQ ID NO: 1189233 - RNA, 23 nt, Colorado tick fever virus
ucucgcgcacggggaauuugcag

SEQ ID NO: 1189234 - RNA, 20 nt, Colorado tick fever virus
cuagcaucauucucccggga

SEQ ID NO: 1189235 - RNA, 23 nt, Colorado tick fever virus
gaccucgccggcuuacggaauga

SEQ ID NO: 1189236 - RNA, 21 nt, Colorado tick fever virus
cacgccauacacaauugcagu

SEQ ID NO: 1189237 - RNA, 12 nt, Colorado tick fever virus
aaggagcuucag

SEQ ID NO: 1189238 - RNA, 17 nt, Colorado tick fever virus
gaccagacguaugaggc

SEQ ID NO: 1189239 - RNA, 18 nt, Colorado tick fever virus
ucauucucccgggacggg

SEQ ID NO: 1189240 - RNA, 12 nt, Colorado tick fever virus
gucacuaugggg

SEQ ID NO: 1189241 - RNA, 16 nt, Colorado tick fever virus
ucuccgcgaguugcag

SEQ ID NO: 1189242 - RNA, 17 nt, Colorado tick fever virus
uggaugaguggggcugc

SEQ ID NO: 1189243 - RNA, 14 nt, Colorado tick fever virus
cuuuggugaaggau

SEQ ID NO: 1189244 - RNA, 16 nt, Colorado tick fever virus
gcugaggaccucgccg

SEQ ID NO: 1189245 - RNA, 19 nt, Colorado tick fever virus
aaaggugugaaaaucaauu

SEQ ID NO: 1189246 - RNA, 16 nt, Colorado tick fever virus
cucaguuaggcggugc

SEQ ID NO: 1189247 - RNA, 15 nt, Colorado tick fever virus
aaguaugauugaguc

SEQ ID NO: 1189248 - RNA, 18 nt, Colorado tick fever virus
cucauauagggaauccuu

SEQ ID NO: 1189249 - RNA, 18 nt, Colorado tick fever virus
uggggcugcgcagugugu

SEQ ID NO: 1189250 - RNA, 22 nt, Colorado tick fever virus
gugggauuggugaccggugcag

SEQ ID NO: 1189251 - RNA, 17 nt, Colorado tick fever virus
ucaauugucgguguaau

SEQ ID NO: 1189252 - RNA, 17 nt, Colorado tick fever virus
caucguuguugaugcug

SEQ ID NO: 1189253 - RNA, 17 nt, Colorado tick fever virus
cgccggcuuacggaaug

SEQ ID NO: 1189254 - RNA, 12 nt, Colorado tick fever virus
ucuucaauuugu

SEQ ID NO: 1189255 - RNA, 12 nt, Colorado tick fever virus
gacgggcagggu

SEQ ID NO: 1189256 - RNA, 14 nt, Colorado tick fever virus
ucggaugcaugcag

SEQ ID NO: 1189257 - RNA, 11 nt, Colorado tick fever virus
ugaugugaaga

SEQ ID NO: 1189258 - RNA, 22 nt, Colorado tick fever virus
auuggauauuuucuaagacugc

SEQ ID NO: 1189259 - RNA, 18 nt, Colorado tick fever virus
cgccggcuuacggaauga

SEQ ID NO: 1189260 - RNA, 21 nt, Colorado tick fever virus
gugacgggcaggguagucgcu

SEQ ID NO: 1189261 - RNA, 20 nt, Colorado tick fever virus
aguggggcugcgcagugugu

SEQ ID NO: 1189262 - RNA, 24 nt, Colorado tick fever virus
auaguauccacaugaugugacaca

SEQ ID NO: 1189263 - RNA, 22 nt, Colorado tick fever virus
cauauagggaauccuugcaguc

SEQ ID NO: 1189264 - RNA, 19 nt, Colorado tick fever virus
gcagugugugacgaguggg

SEQ ID NO: 1189265 - RNA, 17 nt, Colorado tick fever virus
uucggaugcaugcaguc

SEQ ID NO: 1189266 - RNA, 20 nt, Colorado tick fever virus
ugaacggggcuaaggccugg

SEQ ID NO: 1189267 - RNA, 14 nt, Colorado tick fever virus
augagaguugcagu

SEQ ID NO: 1189268 - RNA, 19 nt, Colorado tick fever virus
gcacgcuugauuaccaggg

SEQ ID NO: 1189269 - RNA, 13 nt, Colorado tick fever virus
ugccgcaucuuca

SEQ ID NO: 1189270 - RNA, 17 nt, Colorado tick fever virus
ccacaugaugugacaca

SEQ ID NO: 1189271 - RNA, 18 nt, Colorado tick fever virus
gaugcugaucucccuugc

SEQ ID NO: 1189272 - RNA, 20 nt, Colorado tick fever virus
ucauucccagggugcauucu

SEQ ID NO: 1189273 - RNA, 17 nt, Colorado tick fever virus
cccgggacggguaauug

SEQ ID NO: 1189274 - RNA, 20 nt, Colorado tick fever virus
agugcaggcuuucgugaagg

SEQ ID NO: 1189275 - RNA, 19 nt, Colorado tick fever virus
agacugcuugcuuaaaggu

SEQ ID NO: 1189276 - RNA, 13 nt, Colorado tick fever virus
ggagggcagaugg

SEQ ID NO: 1189277 - RNA, 14 nt, Colorado tick fever virus
uagaaguaugauug

SEQ ID NO: 1189278 - RNA, 19 nt, Colorado tick fever virus
agcuucagcggcugcggcu

SEQ ID NO: 1189279 - RNA, 17 nt, Colorado tick fever virus
ucuccaucgcuuugcag

SEQ ID NO: 1189280 - RNA, 21 nt, Colorado tick fever virus
aagcgagugcgggagcuugag

SEQ ID NO: 1189281 - RNA, 22 nt, Colorado tick fever virus
gggauuggugaccggugcagga

SEQ ID NO: 1189282 - RNA, 11 nt, Colorado tick fever virus
ugucugaauac

SEQ ID NO: 1189283 - RNA, 18 nt, Colorado tick fever virus
cucggagggugagguacu

SEQ ID NO: 1189284 - RNA, 18 nt, Colorado tick fever virus
auucauucccagggugca

SEQ ID NO: 1189285 - RNA, 17 nt, Colorado tick fever virus
uggugaccggugcagga

SEQ ID NO: 1189286 - RNA, 17 nt, Colorado tick fever virus
augaugacguccuagca

SEQ ID NO: 1189287 - RNA, 21 nt, Colorado tick fever virus
agcggcugcggcuuaccaggc

SEQ ID NO: 1189288 - RNA, 14 nt, Colorado tick fever virus
cauucccagggugc

SEQ ID NO: 1189289 - RNA, 13 nt, Colorado tick fever virus
ggaugcaugcagu

SEQ ID NO: 1189290 - RNA, 21 nt, Colorado tick fever virus
cugagagcgggguuguuuauc

SEQ ID NO: 1189291 - RNA, 22 nt, Colorado tick fever virus
uggaugaguggggcugcgcagu

SEQ ID NO: 1189292 - RNA, 23 nt, Colorado tick fever virus
cugagcucuccaucgcuuugcag

SEQ ID NO: 1189293 - RNA, 16 nt, Colorado tick fever virus
uggugaccggugcagg

SEQ ID NO: 1189294 - RNA, 19 nt, Colorado tick fever virus
cugaggaccucgccggcuu

SEQ ID NO: 1189295 - RNA, 18 nt, Colorado tick fever virus
ucaauuuguuaacaauga

SEQ ID NO: 1189296 - RNA, 19 nt, Colorado tick fever virus
caggaugcugaucucccuu

SEQ ID NO: 1189297 - RNA, 18 nt, Colorado tick fever virus
gugucuuaugugccagag

SEQ ID NO: 1189298 - RNA, 15 nt, Colorado tick fever virus
cgggcuuuuugcgug

SEQ ID NO: 1189299 - RNA, 19 nt, Colorado tick fever virus
ggugaccggugcaggaugc

SEQ ID NO: 1189300 - RNA, 16 nt, Colorado tick fever virus
acggggaauuugcagu

SEQ ID NO: 1189301 - RNA, 18 nt, Colorado tick fever virus
augacguccuagcaucau

SEQ ID NO: 1189302 - RNA, 17 nt, Colorado tick fever virus
ucgagagugcaggcuuu

SEQ ID NO: 1189303 - RNA, 21 nt, Colorado tick fever virus
ugccagaggagguuguugcag

SEQ ID NO: 1189304 - RNA, 13 nt, Colorado tick fever virus
ggaauuugcaguc

SEQ ID NO: 1189305 - RNA, 15 nt, Colorado tick fever virus
caggguagucgcuga

SEQ ID NO: 1189306 - RNA, 20 nt, Colorado tick fever virus
agcgagugcgggagcuugag

SEQ ID NO: 1189307 - RNA, 19 nt, Colorado tick fever virus
cgauugagagcggagccuu

SEQ ID NO: 1189308 - RNA, 19 nt, Colorado tick fever virus
gacugcuugcuuaaaggug

SEQ ID NO: 1189309 - RNA, 15 nt, Colorado tick fever virus
uacacaauugcaguc

SEQ ID NO: 1189310 - RNA, 23 nt, Colorado tick fever virus
gaccuacccccaauggugucuau

SEQ ID NO: 1189311 - RNA, 16 nt, Colorado tick fever virus
gggaauccuugcaguc

SEQ ID NO: 1189312 - RNA, 13 nt, Colorado tick fever virus
cuaaggccuggau

SEQ ID NO: 1189313 - RNA, 21 nt, Colorado tick fever virus
cuugaugugaagacaaugcag

SEQ ID NO: 1189314 - RNA, 20 nt, Colorado tick fever virus
gcugaccagacguaugaggc

SEQ ID NO: 1189315 - RNA, 22 nt, Colorado tick fever virus
guaugugacauucauucccagg

SEQ ID NO: 1189316 - RNA, 19 nt, Colorado tick fever virus
auuuucuaagacugcuugc

SEQ ID NO: 1189317 - RNA, 14 nt, Colorado tick fever virus
uucccagggugcau

SEQ ID NO: 1189318 - RNA, 14 nt, Colorado tick fever virus
gcaucauucucccg

SEQ ID NO: 1189319 - RNA, 15 nt, Colorado tick fever virus
aggaugcugaucucc

SEQ ID NO: 1189320 - RNA, 19 nt, Colorado tick fever virus
gacauucauucccagggug

SEQ ID NO: 1189321 - RNA, 15 nt, Colorado tick fever virus
ugggcuggagaacca

SEQ ID NO: 1189322 - RNA, 18 nt, Colorado tick fever virus
auauagggaauccuugca

SEQ ID NO: 1189323 - RNA, 16 nt, Colorado tick fever virus
accggugcaggaugcu

SEQ ID NO: 1189324 - RNA, 20 nt, Colorado tick fever virus
cgggacggguaauugcaguc

SEQ ID NO: 1189325 - RNA, 12 nt, Colorado tick fever virus
ugaugugaagac

SEQ ID NO: 1189326 - RNA, 20 nt, Colorado tick fever virus
ccggugcaggaugcugaucu

SEQ ID NO: 1189327 - RNA, 14 nt, Colorado tick fever virus
gguggaggcugcuc

SEQ ID NO: 1189328 - RNA, 19 nt, Colorado tick fever virus
acgcagggguucagucugu

SEQ ID NO: 1189329 - RNA, 17 nt, Colorado tick fever virus
gagguacuggcagaugg

SEQ ID NO: 1189330 - RNA, 19 nt, Colorado tick fever virus
cuagcaucauucucccggg

SEQ ID NO: 1189331 - RNA, 15 nt, Colorado tick fever virus
gugaccggugcagga

SEQ ID NO: 1189332 - RNA, 12 nt, Colorado tick fever virus
cggaaugaugac

SEQ ID NO: 1189333 - RNA, 22 nt, Colorado tick fever virus
cacgauugagcacaaaauccau

SEQ ID NO: 1189334 - RNA, 22 nt, Colorado tick fever virus
aggcuuuaagcgagugcgggag

SEQ ID NO: 1189335 - RNA, 16 nt, Colorado tick fever virus
gcugcgcaguguguga

SEQ ID NO: 1189336 - RNA, 20 nt, Colorado tick fever virus
augaugacguccuagcauca

SEQ ID NO: 1189337 - RNA, 15 nt, Colorado tick fever virus
cauacacaauugcag

SEQ ID NO: 1189338 - RNA, 15 nt, Colorado tick fever virus
gguucagucuguguu

SEQ ID NO: 1189339 - RNA, 22 nt, Colorado tick fever virus
gcaggguagucgcugaggaccu

SEQ ID NO: 1189340 - RNA, 12 nt, Colorado tick fever virus
cggaugcaugca

SEQ ID NO: 1189341 - RNA, 15 nt, Colorado tick fever virus
aaaggugugaaaauc

SEQ ID NO: 1189342 - RNA, 17 nt, Colorado tick fever virus
ggugaccggugcaggau

SEQ ID NO: 1189343 - RNA, 14 nt, Colorado tick fever virus
aggaccucgccggc

SEQ ID NO: 1189344 - RNA, 14 nt, Colorado tick fever virus
ucuaagacugcuug

SEQ ID NO: 1189345 - RNA, 23 nt, Colorado tick fever virus
ucuugaugugaagacaaugcagu

SEQ ID NO: 1189346 - RNA, 18 nt, Colorado tick fever virus
acaucgagagugcaggcu

SEQ ID NO: 1189347 - RNA, 20 nt, Colorado tick fever virus
gcagggguucagucuguguu

SEQ ID NO: 1189348 - RNA, 24 nt, Colorado tick fever virus
agagcgggguuguuuaucaggugg

SEQ ID NO: 1189349 - RNA, 16 nt, Colorado tick fever virus
ugaucucccuugcagu

SEQ ID NO: 1189350 - RNA, 14 nt, Colorado tick fever virus
cagggugcauucuu

SEQ ID NO: 1189351 - RNA, 17 nt, Colorado tick fever virus
auuuguuaacaaugagu

SEQ ID NO: 1189352 - RNA, 11 nt, Colorado tick fever virus
acgggcagggu

SEQ ID NO: 1189353 - RNA, 15 nt, Colorado tick fever virus
accggugcaggaugc

SEQ ID NO: 1189354 - RNA, 23 nt, Colorado tick fever virus
cguggaugaguggggcugcgcag

SEQ ID NO: 1189355 - RNA, 14 nt, Colorado tick fever virus
uccgcgaguugcag

SEQ ID NO: 1189356 - RNA, 12 nt, Colorado tick fever virus
acauucauuccc

SEQ ID NO: 1189357 - RNA, 20 nt, Colorado tick fever virus
gaguggggcugcgcagugug

SEQ ID NO: 1189358 - RNA, 21 nt, Colorado tick fever virus
uugaugugaagacaaugcagu

SEQ ID NO: 1189359 - RNA, 18 nt, Colorado tick fever virus
uucuugaugugaagacaa

SEQ ID NO: 1189360 - RNA, 14 nt, Colorado tick fever virus
aggcgcgugagcag

SEQ ID NO: 1189361 - RNA, 16 nt, Colorado tick fever virus
gggucacuauggggcu

SEQ ID NO: 1189362 - RNA, 19 nt, Colorado tick fever virus
gccauacacaauugcaguc

SEQ ID NO: 1189363 - RNA, 23 nt, Colorado tick fever virus
gcccugucgggaaaaaucggugg

SEQ ID NO: 1189364 - RNA, 20 nt, Colorado tick fever virus
gaacggggcuaaggccugga

SEQ ID NO: 1189365 - RNA, 21 nt, Colorado tick fever virus
gcaggcuuuaagcgagugcgg

SEQ ID NO: 1189366 - RNA, 16 nt, Colorado tick fever virus
ugacauucauucccag

SEQ ID NO: 1189367 - RNA, 19 nt, Colorado tick fever virus
uggugaccggugcaggaug

SEQ ID NO: 1189368 - RNA, 17 nt, Colorado tick fever virus
gaggagguuguugcagg

SEQ ID NO: 1189369 - RNA, 21 nt, Colorado tick fever virus
ugucgguguaaucugacgcag

SEQ ID NO: 1189370 - RNA, 23 nt, Colorado tick fever virus
ucagcggcugcggcuuaccaggc

SEQ ID NO: 1189371 - RNA, 17 nt, Colorado tick fever virus
ugugaagacaaugcagu

SEQ ID NO: 1189372 - RNA, 11 nt, Colorado tick fever virus
gauaugcucag

SEQ ID NO: 1189373 - RNA, 16 nt, Colorado tick fever virus
gucgcugaggaccucg

SEQ ID NO: 1189374 - RNA, 23 nt, Colorado tick fever virus
gcaggaugcugaucucccuugca

SEQ ID NO: 1189375 - RNA, 21 nt, Colorado tick fever virus
cgcagggguucagucuguguu

SEQ ID NO: 1189376 - RNA, 19 nt, Colorado tick fever virus
ugaugugaagacaaugcag

SEQ ID NO: 1189377 - RNA, 21 nt, Colorado tick fever virus
ggauuggugaccggugcagga

SEQ ID NO: 1189378 - RNA, 23 nt, Colorado tick fever virus
ugcaggaugcugaucucccuugc

SEQ ID NO: 1189379 - RNA, 18 nt, Colorado tick fever virus
cguugacacagucuguca

SEQ ID NO: 1189380 - RNA, 13 nt, Colorado tick fever virus
acggaaugaugac

SEQ ID NO: 1189381 - RNA, 15 nt, Colorado tick fever virus
ggagguuguugcagg

SEQ ID NO: 1189382 - RNA, 16 nt, Colorado tick fever virus
gucuuuggaugauggg

SEQ ID NO: 1189383 - RNA, 15 nt, Colorado tick fever virus
uauccacaugaugug

SEQ ID NO: 1189384 - RNA, 14 nt, Colorado tick fever virus
ugaugaaaauggcg

SEQ ID NO: 1189385 - RNA, 16 nt, Colorado tick fever virus
ccggcuuacggaauga

SEQ ID NO: 1189386 - RNA, 18 nt, Colorado tick fever virus
ccggcuuacggaaugaug

SEQ ID NO: 1189387 - RNA, 23 nt, Colorado tick fever virus
auggguugagguggcugugcaca

SEQ ID NO: 1189388 - RNA, 18 nt, Colorado tick fever virus
cauucccagggugcauuc

SEQ ID NO: 1189389 - RNA, 18 nt, Colorado tick fever virus
uccgccuuuggugaagga

SEQ ID NO: 1189390 - RNA, 13 nt, Colorado tick fever virus
uccauuggcgcaa

SEQ ID NO: 1189391 - RNA, 21 nt, Colorado tick fever virus
gcaggcuuucgugaaggagcu

SEQ ID NO: 1189392 - RNA, 17 nt, Colorado tick fever virus
guagucgcugaggaccu

SEQ ID NO: 1189393 - RNA, 20 nt, Colorado tick fever virus
agcgggguuguuuaucaggu

SEQ ID NO: 1189394 - RNA, 21 nt, Colorado tick fever virus
cgcagugugugacgagugggu

SEQ ID NO: 1189395 - RNA, 17 nt, Colorado tick fever virus
ggacggguaauugcagu

SEQ ID NO: 1189396 - RNA, 11 nt, Colorado tick fever virus
caauugcaguc

SEQ ID NO: 1189397 - RNA, 13 nt, Colorado tick fever virus
ccacgccauacac

SEQ ID NO: 1189398 - RNA, 23 nt, Colorado tick fever virus
ugacacacccucauauagggaau

SEQ ID NO: 1189399 - RNA, 16 nt, Colorado tick fever virus
gaucucccuugcaguc

SEQ ID NO: 1189400 - RNA, 17 nt, Colorado tick fever virus
ggugggauuggugaccg

SEQ ID NO: 1189401 - RNA, 16 nt, Colorado tick fever virus
ugaaugggcuggagaa

SEQ ID NO: 1189402 - RNA, 13 nt, Colorado tick fever virus
aucgcuuugcagu

SEQ ID NO: 1189403 - RNA, 17 nt, Colorado tick fever virus
cugcuugcuuaaaggug

SEQ ID NO: 1189404 - RNA, 13 nt, Colorado tick fever virus
ugaggaccucgcc

SEQ ID NO: 1189405 - RNA, 14 nt, Colorado tick fever virus
ggcuauggugucuu

SEQ ID NO: 1189406 - RNA, 15 nt, Colorado tick fever virus
gugacgggcagggua

SEQ ID NO: 1189407 - RNA, 19 nt, Colorado tick fever virus
gcugaucucccuugcaguc

SEQ ID NO: 1189408 - RNA, 17 nt, Colorado tick fever virus
gcugaucucccuugcag

SEQ ID NO: 1189409 - RNA, 23 nt, Colorado tick fever virus
gauauuuucuaagacugcuugcu

SEQ ID NO: 1189410 - RNA, 13 nt, Colorado tick fever virus
cuugaugugaaga

SEQ ID NO: 1189411 - RNA, 16 nt, Colorado tick fever virus
gacguccuagcaucau

SEQ ID NO: 1189412 - RNA, 23 nt, Colorado tick fever virus
ugacgggcaggguagucgcugag

SEQ ID NO: 1189413 - RNA, 18 nt, Colorado tick fever virus
aaugaugacguccuagca

SEQ ID NO: 1189414 - RNA, 21 nt, Colorado tick fever virus
ugcauucuugaugugaagaca

SEQ ID NO: 1189415 - RNA, 13 nt, Colorado tick fever virus
ccagggugcauuc

SEQ ID NO: 1189416 - RNA, 18 nt, Colorado tick fever virus
auucagcagcagaggcgc

SEQ ID NO: 1189417 - RNA, 13 nt, Colorado tick fever virus
guaugaggcucuu

SEQ ID NO: 1189418 - RNA, 22 nt, Colorado tick fever virus
ggcaggguagucgcugaggacc

SEQ ID NO: 1189419 - RNA, 18 nt, Colorado tick fever virus
caaagacggcugcuggcu

SEQ ID NO: 1189420 - RNA, 15 nt, Colorado tick fever virus
ucauucccagggugc

SEQ ID NO: 1189421 - RNA, 17 nt, Colorado tick fever virus
uaugugccagaggaggu

SEQ ID NO: 1189422 - RNA, 14 nt, Colorado tick fever virus
gggaauuugcaguc

SEQ ID NO: 1189423 - RNA, 14 nt, Colorado tick fever virus
acacaauugcaguc

SEQ ID NO: 1189424 - RNA, 18 nt, Colorado tick fever virus
cuugcuuaaaggugugaa

SEQ ID NO: 1189425 - RNA, 15 nt, Colorado tick fever virus
acggguaauugcagu

SEQ ID NO: 1189426 - RNA, 23 nt, Colorado tick fever virus
aggaugcugaucucccuugcagu

SEQ ID NO: 1189427 - RNA, 14 nt, Colorado tick fever virus
agaacgguugcagu

SEQ ID NO: 1189428 - RNA, 22 nt, Colorado tick fever virus
aguuaggcggugcuuuuacgau

SEQ ID NO: 1189429 - RNA, 20 nt, Colorado tick fever virus
uguguucggaugcaugcagu

SEQ ID NO: 1189430 - RNA, 19 nt, Colorado tick fever virus
cgggacggguaauugcagu

SEQ ID NO: 1189431 - RNA, 17 nt, Colorado tick fever virus
ggcgggcuuuuugcgug

SEQ ID NO: 1189432 - RNA, 19 nt, Colorado tick fever virus
aggguagucgcugaggacc

SEQ ID NO: 1189433 - RNA, 20 nt, Colorado tick fever virus
ugaaaauggcguaguaguga

SEQ ID NO: 1189434 - RNA, 18 nt, Colorado tick fever virus
cuccaucgcuuugcaguc

SEQ ID NO: 1189435 - RNA, 21 nt, Colorado tick fever virus
ggagcuucagcggcugcggcu

SEQ ID NO: 1189436 - RNA, 20 nt, Colorado tick fever virus
gugcuuuuuaugggugucug

SEQ ID NO: 1189437 - RNA, 22 nt, Colorado tick fever virus
ucugacgcagggguucagucug

SEQ ID NO: 1189438 - RNA, 11 nt, Colorado tick fever virus
cuaagacugcu

SEQ ID NO: 1189439 - RNA, 13 nt, Colorado tick fever virus
ucggagggugagg

SEQ ID NO: 1189440 - RNA, 14 nt, Colorado tick fever virus
ggguaauugcaguc

SEQ ID NO: 1189441 - RNA, 15 nt, Colorado tick fever virus
gcgagugcgggagcu

SEQ ID NO: 1189442 - RNA, 19 nt, Colorado tick fever virus
gugaggagggcagauggca

SEQ ID NO: 1189443 - RNA, 15 nt, Colorado tick fever virus
cugaucucccuugca

SEQ ID NO: 1189444 - RNA, 17 nt, Colorado tick fever virus
ugacauucauucccagg

SEQ ID NO: 1189445 - RNA, 14 nt, Colorado tick fever virus
uucggaugcaugca

SEQ ID NO: 1189446 - RNA, 12 nt, Colorado tick fever virus
gacggcugcugg

SEQ ID NO: 1189447 - RNA, 23 nt, Colorado tick fever virus
cucccgggacggguaauugcagu

SEQ ID NO: 1189448 - RNA, 20 nt, Colorado tick fever virus
cuugaugugaagacaaugca

SEQ ID NO: 1189449 - RNA, 18 nt, Colorado tick fever virus
ccagacguaugaggcucu

SEQ ID NO: 1189450 - RNA, 18 nt, Colorado tick fever virus
auagggaauccuugcagu

SEQ ID NO: 1189451 - RNA, 17 nt, Colorado tick fever virus
gggguucagucuguguu

SEQ ID NO: 1189452 - RNA, 23 nt, Colorado tick fever virus
auuggugaccggugcaggaugcu

SEQ ID NO: 1189453 - RNA, 13 nt, Colorado tick fever virus
ugagaguugcagu

SEQ ID NO: 1189454 - RNA, 17 nt, Colorado tick fever virus
gaacgacgcgagugagg

SEQ ID NO: 1189455 - RNA, 23 nt, Colorado tick fever virus
auuuucuaagacugcuugcuuaa

SEQ ID NO: 1189456 - RNA, 17 nt, Colorado tick fever virus
guuggccuggugagcug

SEQ ID NO: 1189457 - RNA, 16 nt, Colorado tick fever virus
gggugagguacuggca

SEQ ID NO: 1189458 - RNA, 16 nt, Colorado tick fever virus
uucggaugcaugcagu

SEQ ID NO: 1189459 - RNA, 18 nt, Colorado tick fever virus
ucuuaugugccagaggag

SEQ ID NO: 1189460 - RNA, 16 nt, Colorado tick fever virus
uagaacgguugcaguc

SEQ ID NO: 1189461 - RNA, 11 nt, Colorado tick fever virus
uccuugcaguc

SEQ ID NO: 1189462 - RNA, 18 nt, Colorado tick fever virus
aaguaugauugagucuau

SEQ ID NO: 1189463 - RNA, 18 nt, Colorado tick fever virus
gaccuaagauaugcucag

SEQ ID NO: 1189464 - RNA, 22 nt, Colorado tick fever virus
guagucuccgcgaguugcaguc

SEQ ID NO: 1189465 - RNA, 22 nt, Colorado tick fever virus
guggaugaguggggcugcgcag

SEQ ID NO: 1189466 - RNA, 13 nt, Colorado tick fever virus
auggggcugacca

SEQ ID NO: 1189467 - RNA, 23 nt, Colorado tick fever virus
cguagucuccgcgaguugcaguc

SEQ ID NO: 1189468 - RNA, 17 nt, Colorado tick fever virus
aggugugaaaaucaauu

SEQ ID NO: 1189469 - RNA, 20 nt, Colorado tick fever virus
agugacccuggagccgugcc

SEQ ID NO: 1189470 - RNA, 18 nt, Colorado tick fever virus
cgcagggguucagucugu

SEQ ID NO: 1189471 - RNA, 21 nt, Colorado tick fever virus
cugucaaagacggcugcuggc

SEQ ID NO: 1189472 - RNA, 20 nt, Colorado tick fever virus
gugcauucuugaugugaaga

SEQ ID NO: 1189473 - RNA, 23 nt, Colorado tick fever virus
gaaguaugauugagucuaugggg

SEQ ID NO: 1189474 - RNA, 23 nt, Colorado tick fever virus
acacgauugagcacaaaauccau

SEQ ID NO: 1189475 - RNA, 21 nt, Colorado tick fever virus
gcugaccagacguaugaggcu

SEQ ID NO: 1189476 - RNA, 17 nt, Colorado tick fever virus
aauuuguuaacaaugag

SEQ ID NO: 1189477 - RNA, 24 nt, Colorado tick fever virus
gauauuuucuaagacugcuugcuu

SEQ ID NO: 1189478 - RNA, 18 nt, Colorado tick fever virus
uuaaaggugugaaaauca

SEQ ID NO: 1189479 - RNA, 13 nt, Colorado tick fever virus
cucccuugcaguc

SEQ ID NO: 1189480 - RNA, 16 nt, Colorado tick fever virus
aggagguuguugcagg

SEQ ID NO: 1189481 - RNA, 21 nt, Colorado tick fever virus
gugacauucauucccagggug

SEQ ID NO: 1189482 - RNA, 15 nt, Colorado tick fever virus
ggggaauuugcaguc

SEQ ID NO: 1189483 - RNA, 17 nt, Colorado tick fever virus
cuaagacugcuugcuua

SEQ ID NO: 1189484 - RNA, 19 nt, Colorado tick fever virus
gcuuuuuaugggugucuga

SEQ ID NO: 1189485 - RNA, 18 nt, Colorado tick fever virus
ugaggagggcagauggca

SEQ ID NO: 1189486 - RNA, 22 nt, Colorado tick fever virus
agggugcauucuugaugugaag

SEQ ID NO: 1189487 - RNA, 14 nt, Colorado tick fever virus
uaaucugacgcagg

SEQ ID NO: 1189488 - RNA, 20 nt, Colorado tick fever virus
gcuugcuuaaaggugugaaa

SEQ ID NO: 1189489 - RNA, 13 nt, Colorado tick fever virus
agaggcgcgugag

SEQ ID NO: 1189490 - RNA, 24 nt, Colorado tick fever virus
cgcguagucuccgcgaguugcagu

SEQ ID NO: 1189491 - RNA, 18 nt, Colorado tick fever virus
gcaggguagucgcugagg

SEQ ID NO: 1189492 - RNA, 12 nt, Colorado tick fever virus
guacuggcagau

SEQ ID NO: 1189493 - RNA, 14 nt, Colorado tick fever virus
agggugcauucuug

SEQ ID NO: 1189494 - RNA, 14 nt, Colorado tick fever virus
aguccaaacuccaa

SEQ ID NO: 1189495 - RNA, 12 nt, Colorado tick fever virus
cagggguucagu

SEQ ID NO: 1189496 - RNA, 14 nt, Colorado tick fever virus
uagucgcugaggac

SEQ ID NO: 1189497 - RNA, 14 nt, Colorado tick fever virus
cagguggaggcugc

SEQ ID NO: 1189498 - RNA, 23 nt, Colorado tick fever virus
caggaugcugaucucccuugcag

SEQ ID NO: 1189499 - RNA, 14 nt, Colorado tick fever virus
gacgcagggguuca

SEQ ID NO: 1189500 - RNA, 18 nt, Colorado tick fever virus
uguucggaugcaugcagu

SEQ ID NO: 1189501 - RNA, 14 nt, Colorado tick fever virus
augacguccuagca

SEQ ID NO: 1189502 - RNA, 11 nt, Colorado tick fever virus
uucagcagcag

SEQ ID NO: 1189503 - RNA, 18 nt, Colorado tick fever virus
gguagaacgguugcaguc

SEQ ID NO: 1189504 - RNA, 12 nt, Colorado tick fever virus
acaauugcaguc

SEQ ID NO: 1189505 - RNA, 15 nt, Colorado tick fever virus
ccggugcaggaugcu

SEQ ID NO: 1189506 - RNA, 13 nt, Colorado tick fever virus
cggagggugaggu

SEQ ID NO: 1189507 - RNA, 16 nt, Colorado tick fever virus
ugaugacguccuagca

SEQ ID NO: 1189508 - RNA, 13 nt, Colorado tick fever virus
uagucgcugagga

SEQ ID NO: 1189509 - RNA, 14 nt, Colorado tick fever virus
gaggagggcagaug

SEQ ID NO: 1189510 - RNA, 20 nt, Colorado tick fever virus
gugcaggcuuucgugaagga

SEQ ID NO: 1189511 - RNA, 17 nt, Colorado tick fever virus
ucuccgcgaguugcagu

SEQ ID NO: 1189512 - RNA, 21 nt, Colorado tick fever virus
uguuggcgugcgcgacgcauc

SEQ ID NO: 1189513 - RNA, 16 nt, Colorado tick fever virus
uaagacugcuugcuua

SEQ ID NO: 1189514 - RNA, 14 nt, Colorado tick fever virus
gugcaggaugcuga

SEQ ID NO: 1189515 - RNA, 18 nt, Colorado tick fever virus
agcaucauucucccggga

SEQ ID NO: 1189516 - RNA, 17 nt, Colorado tick fever virus
agggaauccuugcaguc

SEQ ID NO: 1189517 - RNA, 16 nt, Colorado tick fever virus
caucauucucccggga

SEQ ID NO: 1189518 - RNA, 20 nt, Colorado tick fever virus
agcagaggcgcgugagcagg

SEQ ID NO: 1189519 - RNA, 16 nt, Colorado tick fever virus
aucagguggaggcugc

SEQ ID NO: 1189520 - RNA, 17 nt, Colorado tick fever virus
cuccgcgaguugcaguc

SEQ ID NO: 1189521 - RNA, 14 nt, Colorado tick fever virus
augggcuggagaac

SEQ ID NO: 1189522 - RNA, 14 nt, Colorado tick fever virus
gcugaucucccuug

SEQ ID NO: 1189523 - RNA, 18 nt, Colorado tick fever virus
gggcgaaacuacuccauu

SEQ ID NO: 1189524 - RNA, 19 nt, Colorado tick fever virus
aaggugugaaaaucaauug

SEQ ID NO: 1189525 - RNA, 20 nt, Colorado tick fever virus
uugggucacuauggggcuga

SEQ ID NO: 1189526 - RNA, 13 nt, Colorado tick fever virus
gguggcugugcac

SEQ ID NO: 1189527 - RNA, 21 nt, Colorado tick fever virus
gccggcuuacggaaugaugac

SEQ ID NO: 1189528 - RNA, 17 nt, Colorado tick fever virus
uggugaaggaugcaagu

SEQ ID NO: 1189529 - RNA, 22 nt, Colorado tick fever virus
auuggugaccggugcaggaugc

SEQ ID NO: 1189530 - RNA, 23 nt, Colorado tick fever virus
ugcaaguggucgaccacgaguga

SEQ ID NO: 1189531 - RNA, 15 nt, Colorado tick fever virus
caucgcuuugcaguc

SEQ ID NO: 1189532 - RNA, 14 nt, Colorado tick fever virus
gaaguaugauugag

SEQ ID NO: 1189533 - RNA, 16 nt, Colorado tick fever virus
cauauagggaauccuu

SEQ ID NO: 1189534 - RNA, 20 nt, Colorado tick fever virus
gccuggauacaaaugcagug

SEQ ID NO: 1189535 - RNA, 14 nt, Colorado tick fever virus
ugcugccugaauug

SEQ ID NO: 1189536 - RNA, 23 nt, Colorado tick fever virus
ucccgggacggguaauugcaguc

SEQ ID NO: 1189537 - RNA, 18 nt, Colorado tick fever virus
gggauuggugaccggugc

SEQ ID NO: 1189538 - RNA, 15 nt, Colorado tick fever virus
ucagucuguguucgg

SEQ ID NO: 1189539 - RNA, 17 nt, Colorado tick fever virus
gugaccggugcaggaug

SEQ ID NO: 1189540 - RNA, 16 nt, Colorado tick fever virus
gcaucauucucccggg

SEQ ID NO: 1189541 - RNA, 19 nt, Colorado tick fever virus
gggacggguaauugcaguc

SEQ ID NO: 1189542 - RNA, 13 nt, Colorado tick fever virus
augugaagacaau

SEQ ID NO: 1189543 - RNA, 15 nt, Colorado tick fever virus
acacagucugucaaa

SEQ ID NO: 1189544 - RNA, 18 nt, Colorado tick fever virus
gugacauucauucccagg

SEQ ID NO: 1189545 - RNA, 21 nt, Colorado tick fever virus
gcaucuccguuaacugagagc

SEQ ID NO: 1189546 - RNA, 18 nt, Colorado tick fever virus
aggcgggcuuuuugcgug

SEQ ID NO: 1189547 - RNA, 20 nt, Colorado tick fever virus
accggugcaggaugcugauc

SEQ ID NO: 1189548 - RNA, 13 nt, Colorado tick fever virus
gcacggggaauuu

SEQ ID NO: 1189549 - RNA, 16 nt, Colorado tick fever virus
ggggcugcgcagugug

SEQ ID NO: 1189550 - RNA, 20 nt, Colorado tick fever virus
gugcaccacgccauacacaa

SEQ ID NO: 1189551 - RNA, 20 nt, Colorado tick fever virus
aucggugggagugcucaagu

SEQ ID NO: 1189552 - RNA, 16 nt, Colorado tick fever virus
ggaugcugaucucccu

SEQ ID NO: 1189553 - RNA, 20 nt, Colorado tick fever virus
gggaaaaaucggugggagug

SEQ ID NO: 1189554 - RNA, 13 nt, Colorado tick fever virus
cuagcaucauucu

SEQ ID NO: 1189555 - RNA, 18 nt, Colorado tick fever virus
cgguguaaucugacgcag

SEQ ID NO: 1189556 - RNA, 15 nt, Colorado tick fever virus
cggggcuaaggccug

SEQ ID NO: 1189557 - RNA, 18 nt, Colorado tick fever virus
cugaucucccuugcaguc

SEQ ID NO: 1189558 - RNA, 16 nt, Colorado tick fever virus
cggcugcuggcugucc

SEQ ID NO: 1189559 - RNA, 16 nt, Colorado tick fever virus
guggggcugcgcagug

SEQ ID NO: 1189560 - RNA, 21 nt, Colorado tick fever virus
ggugcauucuugaugugaaga

SEQ ID NO: 1189561 - RNA, 20 nt, Colorado tick fever virus
aaugaugacguccuagcauc

SEQ ID NO: 1189562 - RNA, 14 nt, Colorado tick fever virus
auuuucuaagacug

SEQ ID NO: 1189563 - RNA, 22 nt, Colorado tick fever virus
cgcgcacggggaauuugcaguc

SEQ ID NO: 1189564 - RNA, 17 nt, Colorado tick fever virus
cuguguucggaugcaug

SEQ ID NO: 1189565 - RNA, 15 nt, Colorado tick fever virus
uccuagcaucauucu

SEQ ID NO: 1189566 - RNA, 12 nt, Colorado tick fever virus
ggguaauugcag

SEQ ID NO: 1189567 - RNA, 17 nt, Colorado tick fever virus
aggcuuucgugaaggag

SEQ ID NO: 1189568 - RNA, 17 nt, Colorado tick fever virus
gacggguaauugcaguc

SEQ ID NO: 1189569 - RNA, 19 nt, Colorado tick fever virus
cagguggaggcugcucagu

SEQ ID NO: 1189570 - RNA, 15 nt, Colorado tick fever virus
uagaacgguugcagu

SEQ ID NO: 1189571 - RNA, 19 nt, Colorado tick fever virus
ucugacgcagggguucagu

SEQ ID NO: 1189572 - RNA, 19 nt, Colorado tick fever virus
cagaggagguuguugcagg

SEQ ID NO: 1189573 - RNA, 14 nt, Colorado tick fever virus
ccagaggagguugu

SEQ ID NO: 1189574 - RNA, 12 nt, Colorado tick fever virus
aauggugucuau

SEQ ID NO: 1189575 - RNA, 23 nt, Colorado tick fever virus
uugcuuaaaggugugaaaaucaa

SEQ ID NO: 1189576 - RNA, 18 nt, Colorado tick fever virus
gcucaagugauuguugug

SEQ ID NO: 1189577 - RNA, 12 nt, Colorado tick fever virus
ccgcgaguugca

SEQ ID NO: 1189578 - RNA, 22 nt, Colorado tick fever virus
gugaaaaucaauugucggugua

SEQ ID NO: 1189579 - RNA, 18 nt, Colorado tick fever virus
ccuggauacaaaugcagu

SEQ ID NO: 1189580 - RNA, 13 nt, Colorado tick fever virus
ucauucucccggg

SEQ ID NO: 1189581 - RNA, 21 nt, Colorado tick fever virus
gaggagguuguugcaggcuuu

SEQ ID NO: 1189582 - RNA, 15 nt, Colorado tick fever virus
cagggugcauucuug

SEQ ID NO: 1189583 - RNA, 19 nt, Colorado tick fever virus
uuaaaggugugaaaaucaa

SEQ ID NO: 1189584 - RNA, 19 nt, Colorado tick fever virus
auauagggaauccuugcag

SEQ ID NO: 1189585 - RNA, 18 nt, Colorado tick fever virus
gacugcuugcuuaaaggu

SEQ ID NO: 1189586 - RNA, 21 nt, Colorado tick fever virus
gugggagugcucaagugauug

SEQ ID NO: 1189587 - RNA, 23 nt, Colorado tick fever virus
ccaaacuccaaagguugcugccu

SEQ ID NO: 1189588 - RNA, 18 nt, Colorado tick fever virus
cugcauaguauccacaug

SEQ ID NO: 1189589 - RNA, 15 nt, Colorado tick fever virus
uguguaucauuuuga

SEQ ID NO: 1189590 - RNA, 17 nt, Colorado tick fever virus
ggguugagguggcugug

SEQ ID NO: 1189591 - RNA, 19 nt, Colorado tick fever virus
aggaugcugaucucccuug

SEQ ID NO: 1189592 - RNA, 13 nt, Colorado tick fever virus
cucguaauccuca

SEQ ID NO: 1189593 - RNA, 22 nt, Colorado tick fever virus
ucauucccagggugcauucuug

SEQ ID NO: 1189594 - RNA, 22 nt, Colorado tick fever virus
ccacgccauacacaauugcagu

SEQ ID NO: 1189595 - RNA, 21 nt, Colorado tick fever virus
gcgcacggggaauuugcaguc

SEQ ID NO: 1189596 - RNA, 16 nt, Colorado tick fever virus
cuaagauaugcucagu

SEQ ID NO: 1189597 - RNA, 22 nt, Colorado tick fever virus
caggguagucgcugaggaccuc

SEQ ID NO: 1189598 - RNA, 18 nt, Colorado tick fever virus
augugacauucauuccca

SEQ ID NO: 1189599 - RNA, 20 nt, Colorado tick fever virus
gggguauugauguuggcgug

SEQ ID NO: 1189600 - RNA, 12 nt, Colorado tick fever virus
cgcaucuucaau

SEQ ID NO: 1189601 - RNA, 14 nt, Colorado tick fever virus
auucauucccaggg

SEQ ID NO: 1189602 - RNA, 19 nt, Colorado tick fever virus
cuacccccaauggugucua

SEQ ID NO: 1189603 - RNA, 19 nt, Colorado tick fever virus
agucuguguucggaugcau

SEQ ID NO: 1189604 - RNA, 13 nt, Colorado tick fever virus
agacggcugcugg

SEQ ID NO: 1189605 - RNA, 21 nt, Colorado tick fever virus
gcugugcacacgauugagcac

SEQ ID NO: 1189606 - RNA, 15 nt, Colorado tick fever virus
gagagugcaggcuuu

SEQ ID NO: 1189607 - RNA, 15 nt, Colorado tick fever virus
uuguuaacaaugagu

SEQ ID NO: 1189608 - RNA, 17 nt, Colorado tick fever virus
cauacacaauugcaguc

SEQ ID NO: 1189609 - RNA, 20 nt, Colorado tick fever virus
cagcagaggcgcgugagcag

SEQ ID NO: 1189610 - RNA, 20 nt, Colorado tick fever virus
uggauucggaaaaacauauu

SEQ ID NO: 1189611 - RNA, 15 nt, Colorado tick fever virus
agggaauccuugcag

SEQ ID NO: 1189612 - RNA, 13 nt, Colorado tick fever virus
cauccgugcucgu

SEQ ID NO: 1189613 - RNA, 22 nt, Colorado tick fever virus
cugacgcagggguucagucugu

SEQ ID NO: 1189614 - RNA, 17 nt, Colorado tick fever virus
agguggaggcugcucag

SEQ ID NO: 1189615 - RNA, 13 nt, Colorado tick fever virus
gagguacuggcag

SEQ ID NO: 1189616 - RNA, 15 nt, Colorado tick fever virus
agaacgguugcaguc

SEQ ID NO: 1189617 - RNA, 18 nt, Colorado tick fever virus
aucugacgcagggguuca

SEQ ID NO: 1189618 - RNA, 17 nt, Colorado tick fever virus
uugcuuaaaggugugaa

SEQ ID NO: 1189619 - RNA, 16 nt, Colorado tick fever virus
gugaccggugcaggau

SEQ ID NO: 1189620 - RNA, 23 nt, Colorado tick fever virus
uucuaagacugcuugcuuaaagg

SEQ ID NO: 1189621 - RNA, 17 nt, Colorado tick fever virus
ugaccggugcaggaugc

SEQ ID NO: 1189622 - RNA, 12 nt, Colorado tick fever virus
cccagggugcau

SEQ ID NO: 1189623 - RNA, 20 nt, Colorado tick fever virus
gcaggaugcugaucucccuu

SEQ ID NO: 1189624 - RNA, 20 nt, Colorado tick fever virus
cucuucgcgucaguuccaug

SEQ ID NO: 1189625 - RNA, 15 nt, Colorado tick fever virus
cggguaauugcaguc

SEQ ID NO: 1189626 - RNA, 21 nt, Colorado tick fever virus
ucaaagacggcugcuggcugu

SEQ ID NO: 1189627 - RNA, 22 nt, Colorado tick fever virus
augugacauucauucccagggu

SEQ ID NO: 1189628 - RNA, 16 nt, Colorado tick fever virus
ccgggacggguaauug

SEQ ID NO: 1189629 - RNA, 15 nt, Colorado tick fever virus
acugagagcgggguu

SEQ ID NO: 1189630 - RNA, 14 nt, Colorado tick fever virus
uugaugugaagaca

SEQ ID NO: 1189631 - RNA, 15 nt, Colorado tick fever virus
ugcucguaauccuca

SEQ ID NO: 1189632 - RNA, 16 nt, Colorado tick fever virus
acauucauucccaggg

SEQ ID NO: 1189633 - RNA, 11 nt, Colorado tick fever virus
agugaggaggg

SEQ ID NO: 1189634 - RNA, 16 nt, Colorado tick fever virus
gcgggcuuuuugcgug

SEQ ID NO: 1189635 - RNA, 10 nt, Colorado tick fever virus
accggugcag

SEQ ID NO: 1189636 - RNA, 19 nt, Colorado tick fever virus
gucaaagacggcugcuggc

SEQ ID NO: 1189637 - RNA, 16 nt, Colorado tick fever virus
gcgcacggggaauuug

SEQ ID NO: 1189638 - RNA, 21 nt, Colorado tick fever virus
auuggugaccggugcaggaug

SEQ ID NO: 1189639 - RNA, 17 nt, Colorado tick fever virus
aggguagucgcugagga

SEQ ID NO: 1189640 - RNA, 19 nt, Colorado tick fever virus
ugaguggggcugcgcagug

SEQ ID NO: 1189641 - RNA, 22 nt, Colorado tick fever virus
acugcuugcuuaaaggugugaa

SEQ ID NO: 1189642 - RNA, 21 nt, Colorado tick fever virus
cucaaugcucguaauccucag

SEQ ID NO: 1189643 - RNA, 14 nt, Colorado tick fever virus
gugaccggugcagg

SEQ ID NO: 1189644 - RNA, 21 nt, Colorado tick fever virus
ggauauuuucuaagacugcuu

SEQ ID NO: 1189645 - RNA, 13 nt, Colorado tick fever virus
gcuuaaaggugug

SEQ ID NO: 1189646 - RNA, 22 nt, Colorado tick fever virus
cguagucuccgcgaguugcagu

SEQ ID NO: 1189647 - RNA, 18 nt, Colorado tick fever virus
gucuccgcgaguugcagu

SEQ ID NO: 1189648 - RNA, 15 nt, Colorado tick fever virus
uucuaagacugcuug

SEQ ID NO: 1189649 - RNA, 20 nt, Colorado tick fever virus
ugcugaucucccuugcaguc

SEQ ID NO: 1189650 - RNA, 23 nt, Colorado tick fever virus
auguucauccgugcucgugaagu

SEQ ID NO: 1189651 - RNA, 17 nt, Colorado tick fever virus
ucaaagacggcugcugg

SEQ ID NO: 1189652 - RNA, 14 nt, Colorado tick fever virus
gacggguaauugca

SEQ ID NO: 1189653 - RNA, 13 nt, Colorado tick fever virus
accaggcgggcuu

SEQ ID NO: 1189654 - RNA, 14 nt, Colorado tick fever virus
gaagacaaugcagu

SEQ ID NO: 1189655 - RNA, 17 nt, Colorado tick fever virus
acggggaauuugcaguc

SEQ ID NO: 1189656 - RNA, 21 nt, Colorado tick fever virus
augaugacguccuagcaucau

SEQ ID NO: 1189657 - RNA, 18 nt, Colorado tick fever virus
acgcagggguucagucug

SEQ ID NO: 1189658 - RNA, 14 nt, Colorado tick fever virus
gaauccuugcaguc

SEQ ID NO: 1189659 - RNA, 13 nt, Colorado tick fever virus
gugccagaggagg

SEQ ID NO: 1189660 - RNA, 14 nt, Colorado tick fever virus
cgugacgggcaggg

SEQ ID NO: 1189661 - RNA, 17 nt, Colorado tick fever virus
uggggcugcgcagugug

SEQ ID NO: 1189662 - RNA, 16 nt, Colorado tick fever virus
uggauacaaaugcagu

SEQ ID NO: 1189663 - RNA, 21 nt, Colorado tick fever virus
uccuagcaucauucucccggg

SEQ ID NO: 1189664 - RNA, 13 nt, Colorado tick fever virus
ugacgagugggua

SEQ ID NO: 1189665 - RNA, 22 nt, Colorado tick fever virus
cucgugaagucggcuggcgcaa

SEQ ID NO: 1189666 - RNA, 15 nt, Colorado tick fever virus
uccaucgcuuugcag

SEQ ID NO: 1189667 - RNA, 17 nt, Colorado tick fever virus
auucccagggugcauuc

SEQ ID NO: 1189668 - RNA, 15 nt, Colorado tick fever virus
ggaauccuugcaguc

SEQ ID NO: 1189669 - RNA, 17 nt, Colorado tick fever virus
uggagaaccaucccuac

SEQ ID NO: 1189670 - RNA, 19 nt, Colorado tick fever virus
augcgugacgggcagggua

SEQ ID NO: 1189671 - RNA, 22 nt, Colorado tick fever virus
ggggguauugauguuggcgugc

SEQ ID NO: 1189672 - RNA, 22 nt, Colorado tick fever virus
uguguaucauuuugauccuacc

SEQ ID NO: 1189673 - RNA, 13 nt, Colorado tick fever virus
cgcugaggaccuc

SEQ ID NO: 1189674 - RNA, 21 nt, Colorado tick fever virus
auauagggaauccuugcaguc

SEQ ID NO: 1189675 - RNA, 15 nt, Colorado tick fever virus
gguggaggcugcuca

SEQ ID NO: 1189676 - RNA, 14 nt, Colorado tick fever virus
guacuggcagaugg

SEQ ID NO: 1189677 - RNA, 16 nt, Colorado tick fever virus
gaacgacgcgagugag

SEQ ID NO: 1189678 - RNA, 18 nt, Colorado tick fever virus
ucagguggaggcugcuca

SEQ ID NO: 1189679 - RNA, 20 nt, Colorado tick fever virus
gauuggugaccggugcagga

SEQ ID NO: 1189680 - RNA, 13 nt, Colorado tick fever virus
cccaauggugucu

SEQ ID NO: 1189681 - RNA, 18 nt, Colorado tick fever virus
agggugagguacuggcag

SEQ ID NO: 1189682 - RNA, 20 nt, Colorado tick fever virus
guggaugaguggggcugcgc

SEQ ID NO: 1189683 - RNA, 19 nt, Colorado tick fever virus
ucaauugucgguguaaucu

SEQ ID NO: 1189684 - RNA, 23 nt, Colorado tick fever virus
cgggcaggguagucgcugaggac

SEQ ID NO: 1189685 - RNA, 19 nt, Colorado tick fever virus
ggguagaacgguugcaguc

SEQ ID NO: 1189686 - RNA, 14 nt, Colorado tick fever virus
cacgauugagcaca

SEQ ID NO: 1189687 - RNA, 18 nt, Colorado tick fever virus
caauugucgguguaaucu

SEQ ID NO: 1189688 - RNA, 16 nt, Colorado tick fever virus
agguggaggcugcuca

SEQ ID NO: 1189689 - RNA, 18 nt, Colorado tick fever virus
gguugagguggcugugca

SEQ ID NO: 1189690 - RNA, 14 nt, Colorado tick fever virus
ugaucucccuugca

SEQ ID NO: 1189691 - RNA, 19 nt, Colorado tick fever virus
uaaggccuggauacaaaug

SEQ ID NO: 1189692 - RNA, 22 nt, Human
cugagagaggccauucuuuccc

SEQ ID NO: 1189693 - RNA, 21 nt, Human
cugagagaggccauucuuucc

SEQ ID NO: 1189694 - RNA, 14 nt, Human
cugagagaggccau

SEQ ID NO: 1189695 - RNA, 13 nt, Human
cugagagaggcca

SEQ ID NO: 1189696 - RNA, 12 nt, Human
cugagaggccac

SEQ ID NO: 1189697 - RNA, 18 nt, Human
cucaugugacucuuucca

SEQ ID NO: 1189698 - RNA, 15 nt, Human
cucgugucuggcaca

SEQ ID NO: 1189699 - RNA, 21 nt, Human
cuaauucuuugaccuguuggg

SEQ ID NO: 1189700 - RNA, 22 nt, Human
cuaauucuuugaccuguuggga

SEQ ID NO: 1189701 - RNA, 17 nt, Human
ccauccuacccccugug

SEQ ID NO: 1189702 - RNA, 19 nt, Human
cacuggggcaggggccggg

SEQ ID NO: 1189703 - RNA, 15 nt, Human
cacuggggcaggggc

SEQ ID NO: 1189704 - RNA, 13 nt, Human
cacuggggcaggg

SEQ ID NO: 1189705 - RNA, 18 nt, Human
caacaccucuuggggagu

SEQ ID NO: 1189706 - RNA, 19 nt, Human
auucuuugaccuguuggga

SEQ ID NO: 1189707 - RNA, 17 nt, Human
auucauggccuggggga

SEQ ID NO: 1189708 - RNA, 17 nt, Human
cagaggguguccugcac

SEQ ID NO: 1189709 - RNA, 23 nt, Human
cagaucauuaucagccugugcca

SEQ ID NO: 1189710 - RNA, 17 nt, Human
cagucugagagaggcca

SEQ ID NO: 1189711 - RNA, 16 nt, Human
cagggcugaggccucu

SEQ ID NO: 1189712 - RNA, 18 nt, Human
cagggcugaggccucuca

SEQ ID NO: 1189713 - RNA, 23 nt, Human
cuggcccuaugcuuccggccucc

SEQ ID NO: 1189714 - RNA, 14 nt, Human
cuuuugucccagaa

SEQ ID NO: 1189715 - RNA, 19 nt, Human
cuuccucuccugucucccu

SEQ ID NO: 1189716 - RNA, 15 nt, Human
cuuccucuccugucu

SEQ ID NO: 1189717 - RNA, 17 nt, Human
cuucuaccucuuggcug

SEQ ID NO: 1189718 - RNA, 22 nt, Human
gaggacaguauuuguggggagg

SEQ ID NO: 1189719 - RNA, 16 nt, Human
gagacgggcccuggug

SEQ ID NO: 1189720 - RNA, 13 nt, Human
gauggaaugaugg

SEQ ID NO: 1189721 - RNA, 15 nt, Human
gaucccaugagcucc

SEQ ID NO: 1189722 - RNA, 19 nt, Human
gaucccaacacugccagca

SEQ ID NO: 1189723 - RNA, 18 nt, Human
gaucccaacacugccagc

SEQ ID NO: 1189724 - RNA, 17 nt, Human
gaucccaacacugccag

SEQ ID NO: 1189725 - RNA, 21 nt, Human
gcauccagagucccugccugg

SEQ ID NO: 1189726 - RNA, 23 nt, Human
gcauccagagucccugccuggac

SEQ ID NO: 1189727 - RNA, 22 nt, Human
gcauccagagucccugccugga

SEQ ID NO: 1189728 - RNA, 17 nt, Human
gcaucggggagccggga

SEQ ID NO: 1189729 - RNA, 19 nt, Human
gccauucuuucccaacacc

SEQ ID NO: 1189730 - RNA, 21 nt, Human
gcucagaggguguccugcacc

SEQ ID NO: 1189731 - RNA, 19 nt, Human
gcucagaggguguccugca

SEQ ID NO: 1189732 - RNA, 18 nt, Human
gcucagaggguguccugc

SEQ ID NO: 1189733 - RNA, 18 nt, Human
gcuaggguggggagagac

SEQ ID NO: 1189734 - RNA, 17 nt, Human
gcuaggguggggagaga

SEQ ID NO: 1189735 - RNA, 13 nt, Human
gcggcugggagga

SEQ ID NO: 1189736 - RNA, 21 nt, Human
gcguggaacucgugucuggca

SEQ ID NO: 1189737 - RNA, 23 nt, Human
gcugggacaccccgacuuuuguu

SEQ ID NO: 1189738 - RNA, 20 nt, Human
gcugggaauaagugccagga

SEQ ID NO: 1189739 - RNA, 22 nt, Human
gcuuuuccucaaagggagagag

SEQ ID NO: 1189740 - RNA, 16 nt, Human
ggacaccuaggcuagg

SEQ ID NO: 1189741 - RNA, 19 nt, Human
ggacaguauuuguggggag

SEQ ID NO: 1189742 - RNA, 18 nt, Human
ggacaguauuugugggga

SEQ ID NO: 1189743 - RNA, 16 nt, Human
ggacaccccgacuuuu

SEQ ID NO: 1189744 - RNA, 11 nt, Human
ggaguguguaa

SEQ ID NO: 1189745 - RNA, 22 nt, Human
ggaguguguaauuuaaaauugu

SEQ ID NO: 1189746 - RNA, 14 nt, Human
ggagggggagaggg

SEQ ID NO: 1189747 - RNA, 12 nt, Human
ggcaggggccgg

SEQ ID NO: 1189748 - RNA, 14 nt, Human
ggcaggagggaggu

SEQ ID NO: 1189749 - RNA, 18 nt, Human
ggcauccagagucccugc

SEQ ID NO: 1189750 - RNA, 16 nt, Human
ggcauccagagucccu

SEQ ID NO: 1189751 - RNA, 22 nt, Human
ggcaucggggagccgggagccu

SEQ ID NO: 1189752 - RNA, 23 nt, Human
ggcaucggggagccgggagccug

SEQ ID NO: 1189753 - RNA, 22 nt, Human
gggggcagucugagagaggcca

SEQ ID NO: 1189754 - RNA, 21 nt, Human
gggucaucuguaccucugccu

SEQ ID NO: 1189755 - RNA, 18 nt, Human
gggucauucauggccugg

SEQ ID NO: 1189756 - RNA, 21 nt, Human
ggguguccugcaccggggccu

SEQ ID NO: 1189757 - RNA, 17 nt, Human
ggguguccugcaccggg

SEQ ID NO: 1189758 - RNA, 18 nt, Human
gguaggaacugcugggcu

SEQ ID NO: 1189759 - RNA, 21 nt, Human
gguggggagagacgggcccug

SEQ ID NO: 1189760 - RNA, 22 nt, Human
gguggggggggggcgcggcugg

SEQ ID NO: 1189761 - RNA, 22 nt, Human
gguuuguuuagaagaagugugu

SEQ ID NO: 1189762 - RNA, 15 nt, Human
guccaucagccucca

SEQ ID NO: 1189763 - RNA, 10 nt, Human
gugauguguc

SEQ ID NO: 1189764 - RNA, 15 nt, Human
uaaaauugugaugug

SEQ ID NO: 1189765 - RNA, 16 nt, Human
uaaaauugugaugugu

SEQ ID NO: 1189766 - RNA, 20 nt, Human
aagugugggucugugugugu

SEQ ID NO: 1189767 - RNA, 10 nt, Human
aagugugggu

SEQ ID NO: 1189768 - RNA, 17 nt, Human
aagugugggucugugug

SEQ ID NO: 1189769 - RNA, 18 nt, Human
aagugugggucugugugu

SEQ ID NO: 1189770 - RNA, 21 nt, Human
aagucacuggccaguggcugg

SEQ ID NO: 1189771 - RNA, 13 nt, Human
guguauguggggg

SEQ ID NO: 1189772 - RNA, 21 nt, Human
guguaugugggggucugugug

SEQ ID NO: 1189773 - RNA, 16 nt, Human
acaccucuuggggagu

SEQ ID NO: 1189774 - RNA, 12 nt, Human
uauguggaagug

SEQ ID NO: 1189775 - RNA, 16 nt, Human
uauguggaaguguggg

SEQ ID NO: 1189776 - RNA, 20 nt, Human
uauggggauagaugugugga

SEQ ID NO: 1189777 - RNA, 22 nt, Human
uaacuuaaaagaacauguauau

SEQ ID NO: 1189778 - RNA, 13 nt, Human
accgaggcaggga

SEQ ID NO: 1189779 - RNA, 16 nt, Human
ucauaaauuuaugguu

SEQ ID NO: 1189780 - RNA, 12 nt, Human
ucaguaugugga

SEQ ID NO: 1189781 - RNA, 14 nt, Human
ucaguauguggaag

SEQ ID NO: 1189782 - RNA, 16 nt, Human
ucaguauguggaagug

SEQ ID NO: 1189783 - RNA, 19 nt, Human
ucaugugacucuuuccaac

SEQ ID NO: 1189784 - RNA, 18 nt, Human
ucaugugacucuuuccaa

SEQ ID NO: 1189785 - RNA, 17 nt, Human
ucauguuuacagaggac

SEQ ID NO: 1189786 - RNA, 17 nt, Human
ucaugugacucuuucca

SEQ ID NO: 1189787 - RNA, 14 nt, Human
ucaugugacucuuu

SEQ ID NO: 1189788 - RNA, 17 nt, Human
accuaggcuaggguggg

SEQ ID NO: 1189789 - RNA, 12 nt, Human
accuaggcuagg

SEQ ID NO: 1189790 - RNA, 17 nt, Human
ucagauuugccuuauug

SEQ ID NO: 1189791 - RNA, 22 nt, Human
ucagauuugccuuauuggcagc

SEQ ID NO: 1189792 - RNA, 23 nt, Human
ucacagcaagucacuggccagug

SEQ ID NO: 1189793 - RNA, 19 nt, Human
uccugcaccggggccuggg

SEQ ID NO: 1189794 - RNA, 18 nt, Human
uccugcaccggggccugg

SEQ ID NO: 1189795 - RNA, 16 nt, Human
ucuaguucugccagga

SEQ ID NO: 1189796 - RNA, 15 nt, Human
ucuaguucugccagg

SEQ ID NO: 1189797 - RNA, 17 nt, Human
ucuaguucugccaggag

SEQ ID NO: 1189798 - RNA, 13 nt, Human
agaaugucaguau

SEQ ID NO: 1189799 - RNA, 13 nt, Human
ugagagaggccau

SEQ ID NO: 1189800 - RNA, 13 nt, Human
ugcuccccacguc

SEQ ID NO: 1189801 - RNA, 22 nt, Human
ugcuauuguagagccagagguc

SEQ ID NO: 1189802 - RNA, 15 nt, Human
ugcuguagacauuug

SEQ ID NO: 1189803 - RNA, 22 nt, Human
uggaccagccucuccacucaug

SEQ ID NO: 1189804 - RNA, 16 nt, Human
uggaccagccucucca

SEQ ID NO: 1189805 - RNA, 19 nt, Human
aggccauucuuucccaaca

SEQ ID NO: 1189806 - RNA, 18 nt, Human
aggccauucuuucccaac

SEQ ID NO: 1189807 - RNA, 17 nt, Human
aggccauucuuucccaa

SEQ ID NO: 1189808 - RNA, 21 nt, Human
aggccucucauuccagaggaa

SEQ ID NO: 1189809 - RNA, 14 nt, Human
uggccaguggcugg

SEQ ID NO: 1189810 - RNA, 15 nt, Human
uggccaguggcugga

SEQ ID NO: 1189811 - RNA, 16 nt, Human
uggccaguggcuggau

SEQ ID NO: 1189812 - RNA, 23 nt, Human
uggccaguggcuggaucugugag

SEQ ID NO: 1189813 - RNA, 22 nt, Human
uggaccuuuccugaggaagagg

SEQ ID NO: 1189814 - RNA, 22 nt, Human
uggcugccuugugaaggaauua

SEQ ID NO: 1189815 - RNA, 14 nt, Human
agcugccugugccu

SEQ ID NO: 1189816 - RNA, 14 nt, Human
aguccaucagccuc

SEQ ID NO: 1189817 - RNA, 13 nt, Human
aguccaucagccu

SEQ ID NO: 1189818 - RNA, 16 nt, Human
aguccaucagccucca

SEQ ID NO: 1189819 - RNA, 21 nt, Human
uguaugugggggucugugugu

SEQ ID NO: 1189820 - RNA, 22 nt, Human
uguaugugggggucuguguguu

SEQ ID NO: 1189821 - RNA, 22 nt, Human
uguauccauccauggggcugau

SEQ ID NO: 1189822 - RNA, 13 nt, Human
agucccugccugg

SEQ ID NO: 1189823 - RNA, 11 nt, Human
ugugauguguc

SEQ ID NO: 1189824 - RNA, 15 nt, Human
ugggucugugugugu

SEQ ID NO: 1189825 - RNA, 23 nt, Human
ugggaauaagugccaggauggaa

SEQ ID NO: 1189826 - RNA, 14 nt, Human
uuaucaacauuugu

SEQ ID NO: 1189827 - RNA, 18 nt, Human
uguugggagugaggaugu

SEQ ID NO: 1189828 - RNA, 18 nt, Human
aucggggagccgggagcc

SEQ ID NO: 1189829 - RNA, 16 nt, Human
aucggggagccgggag

SEQ ID NO: 1189830 - RNA, 20 nt, Human
auccauggggcugauuguau

SEQ ID NO: 1189831 - RNA, 20 nt, Human
aucauuaucagccugugcca

SEQ ID NO: 1189832 - RNA, 16 nt, Human
uucagauuugccuuau

SEQ ID NO: 1189833 - RNA, 22 nt, Human
uuguccucagccccgcguggaa

SEQ ID NO: 1189834 - RNA, 18 nt, Human
uugucccugaagagaagg

SEQ ID NO: 1189835 - RNA, 20 nt, Human
uugucacgccagacuuccca

SEQ ID NO: 1189836 - RNA, 13 nt, Human
uugucacgccaga

SEQ ID NO: 1189837 - RNA, 10 nt, Human
uugugugugg

SEQ ID NO: 1189838 - RNA, 13 nt, Human
uugugugugggag

SEQ ID NO: 1189839 - RNA, 16 nt, Human
uugugugugggagugu

SEQ ID NO: 1189840 - RNA, 20 nt, Human
uugcuaugagcuggggaugu

SEQ ID NO: 1189841 - RNA, 16 nt, Human
uuuuguuuaccagaga

SEQ ID NO: 1189842 - RNA, 13 nt, Human
auguggaagugug

SEQ ID NO: 1189843 - RNA, 15 nt, Human
auguggaaguguggg

SEQ ID NO: 1189844 - RNA, 16 nt, Human
auguggaagugugggu

SEQ ID NO: 1189845 - RNA, 22 nt, Human
auguggaagugugggucugugu

SEQ ID NO: 1189846 - RNA, 23 nt, Human
auguggaagugugggucugugug

SEQ ID NO: 1189847 - RNA, 10 nt, Human
augugugugu

SEQ ID NO: 1189848 - RNA, 18 nt, Human
auguguguguguugugug

SEQ ID NO: 1189849 - RNA, 13 nt, Human
auugugauguguc

SEQ ID NO: 1189850 - RNA, 14 nt, Human
auugugaugugucc

SEQ ID NO: 1189851 - RNA, 15 nt, Human
auugugauguguccu

SEQ ID NO: 1189852 - RNA, 12 nt, Human
auugguguugac

SEQ ID NO: 1189853 - RNA, 15 nt, Human
acagguuagcugcuc

SEQ ID NO: 1189854 - RNA, 15 nt, Human
accccgacuuuuguu

SEQ ID NO: 1189855 - RNA, 12 nt, Human
accccgacuuuu

SEQ ID NO: 1189856 - RNA, 22 nt, Human
acgccagacuucccacggcucc

SEQ ID NO: 1189857 - RNA, 16 nt, Human
acgccagacuucccac

SEQ ID NO: 1189858 - RNA, 13 nt, Human
acucagucuuuaa

SEQ ID NO: 1189859 - RNA, 16 nt, Human
aaugucaguaugugga

SEQ ID NO: 1189860 - RNA, 22 nt, Human
aaugucaguauguggaagugug

SEQ ID NO: 1189861 - RNA, 16 nt, Human
agaggguguccugcac

SEQ ID NO: 1189862 - RNA, 14 nt, Human
agacgggcccuggu

SEQ ID NO: 1189863 - RNA, 13 nt, Human
agccagaggucug

SEQ ID NO: 1189864 - RNA, 17 nt, Human
aggggccgggggcaguc

SEQ ID NO: 1189865 - RNA, 23 nt, Human
aggugcuucuaguucugccagga

SEQ ID NO: 1189866 - RNA, 22 nt, Human
aggugcuucuaguucugccagg

SEQ ID NO: 1189867 - RNA, 21 nt, Human
aggugcuucuaguucugccag

SEQ ID NO: 1189868 - RNA, 19 nt, Human
aggcuauggggauagaugu

SEQ ID NO: 1189869 - RNA, 21 nt, Human
aggcuauggggauagaugugu

SEQ ID NO: 1189870 - RNA, 22 nt, Human
aggcuauggggauagaugugug

SEQ ID NO: 1189871 - RNA, 16 nt, Human
aggaacugcugggcuu

SEQ ID NO: 1189872 - RNA, 17 nt, Human
augugggggucugugug

SEQ ID NO: 1189873 - RNA, 18 nt, Human
augugggggucugugugu

SEQ ID NO: 1189874 - RNA, 16 nt, Human
augugggggucugugu

SEQ ID NO: 1189875 - RNA, 20 nt, Human
aguuguaucagcacgugugg

SEQ ID NO: 1189876 - RNA, 23 nt, Human
aguuguaucagcacguguggccu

SEQ ID NO: 1189877 - RNA, 14 nt, Human
caacacugccagca

SEQ ID NO: 1189878 - RNA, 13 nt, Human
caacacugccagc

SEQ ID NO: 1189879 - RNA, 12 nt, Human
caacacugccag

SEQ ID NO: 1189880 - RNA, 22 nt, Human
caaccggcuuuguggcacuggg

SEQ ID NO: 1189881 - RNA, 13 nt, Human
caaccggcuuugu

SEQ ID NO: 1189882 - RNA, 22 nt, Human
caccggggccugggcaggaggg

SEQ ID NO: 1189883 - RNA, 21 nt, Human
caccggggccugggcaggagg

SEQ ID NO: 1189884 - RNA, 14 nt, Human
caccggggccuggg

SEQ ID NO: 1189885 - RNA, 22 nt, Human
cacggcuccucgagaucccaac

SEQ ID NO: 1189886 - RNA, 20 nt, Human
cacggcuccucgagauccca

SEQ ID NO: 1189887 - RNA, 19 nt, Human
cacguguggccuguucuuc

SEQ ID NO: 1189888 - RNA, 16 nt, Human
cacucaugugacucuu

SEQ ID NO: 1189889 - RNA, 22 nt, Human
cacucaugugacucuuuccaac

SEQ ID NO: 1189890 - RNA, 22 nt, Human
cagacuucccacggcuccucga

SEQ ID NO: 1189891 - RNA, 12 nt, Human
cagacuucccac

SEQ ID NO: 1189892 - RNA, 18 nt, Human
cagagaaaaagggagggg

SEQ ID NO: 1189893 - RNA, 17 nt, Human
cagagaaaaagggaggg

SEQ ID NO: 1189894 - RNA, 12 nt, Human
cagagaaaaagg

SEQ ID NO: 1189895 - RNA, 14 nt, Human
cagagucccugccu

SEQ ID NO: 1189896 - RNA, 18 nt, Human
cagagucccugccuggac

SEQ ID NO: 1189897 - RNA, 22 nt, Human
cagaggacaguauuugugggga

SEQ ID NO: 1189898 - RNA, 15 nt, Human
cagcauuucccuucc

SEQ ID NO: 1189899 - RNA, 18 nt, Human
cagccuccauccuacccc

SEQ ID NO: 1189900 - RNA, 21 nt, Human
cagccuccauccuacccccug

SEQ ID NO: 1189901 - RNA, 23 nt, Human
cagccuggcuguggccuaaccug

SEQ ID NO: 1189902 - RNA, 23 nt, Human
cagccucuccacucaugugacuc

SEQ ID NO: 1189903 - RNA, 18 nt, Human
caggaaccgaggcaggga

SEQ ID NO: 1189904 - RNA, 17 nt, Human
caggaaccgaggcaggg

SEQ ID NO: 1189905 - RNA, 15 nt, Human
caggaaccgaggcag

SEQ ID NO: 1189906 - RNA, 23 nt, Human
caggagacagguuagcugcuccc

SEQ ID NO: 1189907 - RNA, 14 nt, Human
caggagucccugcc

SEQ ID NO: 1189908 - RNA, 15 nt, Human
caggagucccugcca

SEQ ID NO: 1189909 - RNA, 21 nt, Human
caggagucccugccaucaugu

SEQ ID NO: 1189910 - RNA, 21 nt, Human
caggcaucggggagccgggag

SEQ ID NO: 1189911 - RNA, 20 nt, Human
caggcaucggggagccggga

SEQ ID NO: 1189912 - RNA, 15 nt, Human
caggcucagagggug

SEQ ID NO: 1189913 - RNA, 11 nt, Human
caggcucagag

SEQ ID NO: 1189914 - RNA, 18 nt, Human
cagggaaggaucccauga

SEQ ID NO: 1189915 - RNA, 13 nt, Human
cagggaaggaucc

SEQ ID NO: 1189916 - RNA, 22 nt, Human
cagucuuuaaucugagaggcca

SEQ ID NO: 1189917 - RNA, 12 nt, Human
caguauguggaa

SEQ ID NO: 1189918 - RNA, 12 nt, Human
cagguguucuuc

SEQ ID NO: 1189919 - RNA, 20 nt, Human
cauccagagucccugccugg

SEQ ID NO: 1189920 - RNA, 18 nt, Human
cauccagagucccugccu

SEQ ID NO: 1189921 - RNA, 17 nt, Human
cauccagagucccugcc

SEQ ID NO: 1189922 - RNA, 13 nt, Human
cauccagaguccc

SEQ ID NO: 1189923 - RNA, 21 nt, Human
cauccagagucccugccugga

SEQ ID NO: 1189924 - RNA, 13 nt, Human
caucauguuuaca

SEQ ID NO: 1189925 - RNA, 19 nt, Human
caucauguuuacagaggac

SEQ ID NO: 1189926 - RNA, 21 nt, Human
caucauguuuacagaggacag

SEQ ID NO: 1189927 - RNA, 15 nt, Human
cauccuacccccugu

SEQ ID NO: 1189928 - RNA, 19 nt, Human
cauccuacccccugugccu

SEQ ID NO: 1189929 - RNA, 18 nt, Human
cauccuacccccugugcc

SEQ ID NO: 1189930 - RNA, 23 nt, Human
caugagcuccuuaaggcucuuuu

SEQ ID NO: 1189931 - RNA, 19 nt, Human
caugaguuggcugggaaua

SEQ ID NO: 1189932 - RNA, 17 nt, Human
caugugacucuuuccaa

SEQ ID NO: 1189933 - RNA, 16 nt, Human
caugugacucuuucca

SEQ ID NO: 1189934 - RNA, 14 nt, Human
caugugacucuuuc

SEQ ID NO: 1189935 - RNA, 14 nt, Human
cauucuuucccaac

SEQ ID NO: 1189936 - RNA, 12 nt, Human
cauucuuuccca

SEQ ID NO: 1189937 - RNA, 14 nt, Human
cauuccagaggaag

SEQ ID NO: 1189938 - RNA, 13 nt, Human
cauuccagaggaa

SEQ ID NO: 1189939 - RNA, 20 nt, Human
ccaccugaauaaagaaugaa

SEQ ID NO: 1189940 - RNA, 22 nt, Human
ccacucaugugacucuuuccaa

SEQ ID NO: 1189941 - RNA, 19 nt, Human
ccacucaugugacucuuuc

SEQ ID NO: 1189942 - RNA, 21 nt, Human
ccagcauuucccuuccuuccu

SEQ ID NO: 1189943 - RNA, 16 nt, Human
ccagcauuucccuucc

SEQ ID NO: 1189944 - RNA, 13 nt, Human
ccaggagacaggu

SEQ ID NO: 1189945 - RNA, 18 nt, Human
ccauccuacccccugugc

SEQ ID NO: 1189946 - RNA, 15 nt, Human
ccgaggcagggaagg

SEQ ID NO: 1189947 - RNA, 16 nt, Human
ccggcuuuguggcacu

SEQ ID NO: 1189948 - RNA, 19 nt, Human
ccgggacaccuaggcuagg

SEQ ID NO: 1189949 - RNA, 20 nt, Human
ccgggacaccuaggcuaggg

SEQ ID NO: 1189950 - RNA, 18 nt, Human
ccucuccacucaugugac

SEQ ID NO: 1189951 - RNA, 18 nt, Human
ccucucauuccagaggaa

SEQ ID NO: 1189952 - RNA, 14 nt, Human
ccugggcaggaggg

SEQ ID NO: 1189953 - RNA, 12 nt, Human
ccugggcaggag

SEQ ID NO: 1189954 - RNA, 19 nt, Human
ccugaggaagagggacugu

SEQ ID NO: 1189955 - RNA, 18 nt, Human
ccuuaaggcucuuuugua

SEQ ID NO: 1189956 - RNA, 16 nt, Human
ccuuaaggcucuuuug

SEQ ID NO: 1189957 - RNA, 13 nt, Human
ccuuaaggcucuu

SEQ ID NO: 1189958 - RNA, 18 nt, Human
ccuugucacgccagacuu

SEQ ID NO: 1189959 - RNA, 15 nt, Human
ccuugucacgccaga

SEQ ID NO: 1189960 - RNA, 21 nt, Human
cgagaucccaacacugccagc

SEQ ID NO: 1189961 - RNA, 15 nt, Human
cgagaucccaacacu

SEQ ID NO: 1189962 - RNA, 13 nt, Human
cgagaucccaaca

SEQ ID NO: 1189963 - RNA, 22 nt, Human
cgagaucccaacacugccagca

SEQ ID NO: 1189964 - RNA, 23 nt, Human
cucgagaucccaacacugccagc

SEQ ID NO: 1189965 - RNA, 22 nt, Human
cucgagaucccaacacugccag

SEQ ID NO: 1189966 - RNA, 21 nt, Human
cucgagaucccaacacugcca

SEQ ID NO: 1189967 - RNA, 13 nt, Human
cucgagaucccaa

SEQ ID NO: 1189968 - RNA, 14 nt, Human
cuauuguagagcca

SEQ ID NO: 1189969 - RNA, 20 nt, Human
cucugcccgggagcucagga

SEQ ID NO: 1189970 - RNA, 14 nt, Human
cucugcccgggagc

SEQ ID NO: 1189971 - RNA, 12 nt, Human
cugagcaggugu

SEQ ID NO: 1189972 - RNA, 17 nt, Human
cugccuggaccagccuc

SEQ ID NO: 1189973 - RNA, 13 nt, Human
cugauuguauuua

SEQ ID NO: 1189974 - RNA, 22 nt, Human
cuggugguggcucgggaggcga

SEQ ID NO: 1189975 - RNA, 14 nt, Human
cuggugguggcucg

SEQ ID NO: 1189976 - RNA, 18 nt, Human
cuguggccuaaccugccg

SEQ ID NO: 1189977 - RNA, 14 nt, Human
cuguguguguguau

SEQ ID NO: 1189978 - RNA, 15 nt, Human
cuguguguguguaug

SEQ ID NO: 1189979 - RNA, 16 nt, Human
cuguguguguguaugu

SEQ ID NO: 1189980 - RNA, 18 nt, Human
cuguguguguguaugugg

SEQ ID NO: 1189981 - RNA, 20 nt, Human
cuguguguguguaugugggg

SEQ ID NO: 1189982 - RNA, 20 nt, Human
cuguguguuuaugugugugu

SEQ ID NO: 1189983 - RNA, 21 nt, Human
cuguguguguguauguggggg

SEQ ID NO: 1189984 - RNA, 15 nt, Human
cuuaaggcucuuuug

SEQ ID NO: 1189985 - RNA, 19 nt, Human
cuuccaaacaggcucagag

SEQ ID NO: 1189986 - RNA, 17 nt, Human
cuuucccaacaccucuu

SEQ ID NO: 1189987 - RNA, 19 nt, Human
gaaggaucccaugagcucc

SEQ ID NO: 1189988 - RNA, 17 nt, Human
gaauaaagaaugaaugg

SEQ ID NO: 1189989 - RNA, 20 nt, Human
gaauaagugccaggauggaa

SEQ ID NO: 1189990 - RNA, 14 nt, Human
gaaugccuccugca

SEQ ID NO: 1189991 - RNA, 13 nt, Human
gaacuauuagagc

SEQ ID NO: 1189992 - RNA, 20 nt, Human
gagcuccuuaaggcucuuuu

SEQ ID NO: 1189993 - RNA, 23 nt, Human
gagcucaggaaccgaggcaggga

SEQ ID NO: 1189994 - RNA, 15 nt, Human
gaggagggcaggcau

SEQ ID NO: 1189995 - RNA, 14 nt, Human
gaggagggcaggca

SEQ ID NO: 1189996 - RNA, 13 nt, Human
gaggagggcaggc

SEQ ID NO: 1189997 - RNA, 15 nt, Human
gaggaugucugggcc

SEQ ID NO: 1189998 - RNA, 15 nt, Human
gagucccugccugga

SEQ ID NO: 1189999 - RNA, 14 nt, Human
gagucccugccugg

SEQ ID NO: 1190000 - RNA, 14 nt, Human
gagucccugccauc

SEQ ID NO: 1190001 - RNA, 19 nt, Human
gagucccugccuggaccag

SEQ ID NO: 1190002 - RNA, 16 nt, Human
gagucccugccuggac

SEQ ID NO: 1190003 - RNA, 22 nt, Human
gagguuuguuuagaagaagugu

SEQ ID NO: 1190004 - RNA, 21 nt, Human
gauguguccugauaagcugag

SEQ ID NO: 1190005 - RNA, 23 nt, Human
gcaggcaucggggagccgggagc

SEQ ID NO: 1190006 - RNA, 22 nt, Human
gcaggcaucggggagccgggag

SEQ ID NO: 1190007 - RNA, 21 nt, Human
gcaggcaucggggagccggga

SEQ ID NO: 1190008 - RNA, 16 nt, Human
gccaccugaauaaaga

SEQ ID NO: 1190009 - RNA, 15 nt, Human
gccacgauugcagga

SEQ ID NO: 1190010 - RNA, 21 nt, Human
gccagacuucccacggcuccu

SEQ ID NO: 1190011 - RNA, 17 nt, Human
gccuggaccagccucuc

SEQ ID NO: 1190012 - RNA, 16 nt, Human
gccuggaccagccucu

SEQ ID NO: 1190013 - RNA, 16 nt, Human
gccugggcaggaggga

SEQ ID NO: 1190014 - RNA, 17 nt, Human
gcgaagcguuguccuca

SEQ ID NO: 1190015 - RNA, 17 nt, Human
gccuugucacgccagac

SEQ ID NO: 1190016 - RNA, 16 nt, Human
gccuugucacgccaga

SEQ ID NO: 1190017 - RNA, 15 nt, Human
gccuugucacgccag

SEQ ID NO: 1190018 - RNA, 21 nt, Human
gcuccuuaaggcucuuuugua

SEQ ID NO: 1190019 - RNA, 17 nt, Human
gcuccuuaaggcucuuu

SEQ ID NO: 1190020 - RNA, 15 nt, Human
gcuccuuaaggcucu

SEQ ID NO: 1190021 - RNA, 21 nt, Human
gcugggaggagggcaggcauc

SEQ ID NO: 1190022 - RNA, 22 nt, Human
gcugggcuuggcagcccggguc

SEQ ID NO: 1190023 - RNA, 14 nt, Human
gcuggggaugucuc

SEQ ID NO: 1190024 - RNA, 20 nt, Human
gcuguggccuaaccugccga

SEQ ID NO: 1190025 - RNA, 19 nt, Human
gcuguggccuaaccugccg

SEQ ID NO: 1190026 - RNA, 14 nt, Human
gcugauuguauuua

SEQ ID NO: 1190027 - RNA, 12 nt, Human
ggaccagccucu

SEQ ID NO: 1190028 - RNA, 19 nt, Human
ggagacagguuagcugcuc

SEQ ID NO: 1190029 - RNA, 21 nt, Human
ggagcucaggaaccgaggcag

SEQ ID NO: 1190030 - RNA, 21 nt, Human
ggccuaaccugccgagagucc

SEQ ID NO: 1190031 - RNA, 16 nt, Human
ggccuaaccugccgag

SEQ ID NO: 1190032 - RNA, 15 nt, Human
ggccuaaccugccga

SEQ ID NO: 1190033 - RNA, 20 nt, Human
ggccucucauuccagaggaa

SEQ ID NO: 1190034 - RNA, 19 nt, Human
ggccugggcaggagggagg

SEQ ID NO: 1190035 - RNA, 17 nt, Human
ggccugggcaggaggga

SEQ ID NO: 1190036 - RNA, 15 nt, Human
ggccugggcaggagg

SEQ ID NO: 1190037 - RNA, 16 nt, Human
ggccugacucucagca

SEQ ID NO: 1190038 - RNA, 21 nt, Human
ggcugggaggagggcaggcau

SEQ ID NO: 1190039 - RNA, 20 nt, Human
ggcugggaggagggcaggca

SEQ ID NO: 1190040 - RNA, 13 nt, Human
ggcugggaggagg

SEQ ID NO: 1190041 - RNA, 23 nt, Human
ggcuguggcauccagagucccug

SEQ ID NO: 1190042 - RNA, 21 nt, Human
ggcuguggcauccagaguccc

SEQ ID NO: 1190043 - RNA, 14 nt, Human
gggacaccuaggcu

SEQ ID NO: 1190044 - RNA, 20 nt, Human
gggacaccaagccuuggcuc

SEQ ID NO: 1190045 - RNA, 22 nt, Human
gggagcucaggaaccgaggcag

SEQ ID NO: 1190046 - RNA, 12 nt, Human
gggagcucagga

SEQ ID NO: 1190047 - RNA, 23 nt, Human
gggagcucaggaaccgaggcagg

SEQ ID NO: 1190048 - RNA, 13 nt, Human
gggagccgggagc

SEQ ID NO: 1190049 - RNA, 12 nt, Human
gggaggagggca

SEQ ID NO: 1190050 - RNA, 16 nt, Human
gggaggagggcaggca

SEQ ID NO: 1190051 - RNA, 19 nt, Human
ucagaggguguccugcacc

SEQ ID NO: 1190052 - RNA, 14 nt, Human
ucauuccagaggaa

SEQ ID NO: 1190053 - RNA, 12 nt, Human
uauucccaugag

SEQ ID NO: 1190054 - RNA, 13 nt, Human
ucccugccuggac

SEQ ID NO: 1190055 - RNA, 19 nt, Human
ucccuuccuuccucuccug

SEQ ID NO: 1190056 - RNA, 16 nt, Human
ucccuuccuuccucuc

SEQ ID NO: 1190057 - RNA, 16 nt, Human
ucccuccucugcccgg

SEQ ID NO: 1190058 - RNA, 21 nt, Human
ucgugucuggcacagccuggc

SEQ ID NO: 1190059 - RNA, 14 nt, Human
ucgugucuggcaca

SEQ ID NO: 1190060 - RNA, 15 nt, Human
ucugccaggagacag

SEQ ID NO: 1190061 - RNA, 18 nt, Human
ugauuuuuaugccaccug

SEQ ID NO: 1190062 - RNA, 18 nt, Human
ugcccgggagcucaggaa

SEQ ID NO: 1190063 - RNA, 22 nt, Human
ugccaucauguuuacagaggac

SEQ ID NO: 1190064 - RNA, 21 nt, Human
ugcauuauauuuguaaauuua

SEQ ID NO: 1190065 - RNA, 14 nt, Human
ugaguuggcuggga

SEQ ID NO: 1190066 - RNA, 16 nt, Human
ugaguuggcugggaau

SEQ ID NO: 1190067 - RNA, 17 nt, Human
ugaguuggcugggaaua

SEQ ID NO: 1190068 - RNA, 23 nt, Human
uggccuaaccugccgagagucca

SEQ ID NO: 1190069 - RNA, 20 nt, Human
uggcuccauugguguugaca

SEQ ID NO: 1190070 - RNA, 18 nt, Human
ugggaggagggcaggcau

SEQ ID NO: 1190071 - RNA, 17 nt, Human
ugggaggagggcaggca

SEQ ID NO: 1190072 - RNA, 14 nt, Human
ugggaggagggcag

SEQ ID NO: 1190073 - RNA, 21 nt, Human
uguccucagccccgcguggaa

SEQ ID NO: 1190074 - RNA, 13 nt, Human
uguccucagcccc

SEQ ID NO: 1190075 - RNA, 18 nt, Human
uguccugcaccggggccu

SEQ ID NO: 1190076 - RNA, 17 nt, Human
uguaaauuuaugugaug

SEQ ID NO: 1190077 - RNA, 19 nt, Human
uuuccaaccggcuuugugg

SEQ ID NO: 1190078 - RNA, 21 nt, Human
uuccugaggaagagggacugu

SEQ ID NO: 1190079 - RNA, 21 nt, Human
uuuuauuuuucucaugaugag

SEQ ID NO: 1190080 - RNA, 18 nt, Human
cugacccucaucuuucuu

SEQ ID NO: 1190081 - RNA, 18 nt, Human
cugaggaagagggacugu

SEQ ID NO: 1190082 - RNA, 23 nt, Human
cugaggaagagggacuguucuuu

SEQ ID NO: 1190083 - RNA, 13 nt, Human
cuaguucugccag

SEQ ID NO: 1190084 - RNA, 15 nt, Human
cuaggguggggagag

SEQ ID NO: 1190085 - RNA, 16 nt, Human
cuaguucugccaggag

SEQ ID NO: 1190086 - RNA, 15 nt, Human
cuaguucugccagga

SEQ ID NO: 1190087 - RNA, 14 nt, Human
cuaguucugccagg

SEQ ID NO: 1190088 - RNA, 15 nt, Human
cuaggcuaggguggg

SEQ ID NO: 1190089 - RNA, 13 nt, Human
cgugucuggcaca

SEQ ID NO: 1190090 - RNA, 20 nt, Human
ccauucuuucccaacaccuc

SEQ ID NO: 1190091 - RNA, 14 nt, Human
ccauucuuucccaa

SEQ ID NO: 1190092 - RNA, 12 nt, Human
ccauucuuuccc

SEQ ID NO: 1190093 - RNA, 22 nt, Human
ccugacccucaucuuucuucca

SEQ ID NO: 1190094 - RNA, 19 nt, Human
ccugacccucaucuuucuu

SEQ ID NO: 1190095 - RNA, 18 nt, Human
ccugacccucaucuuucu

SEQ ID NO: 1190096 - RNA, 18 nt, Human
ccugccaucauguuuaca

SEQ ID NO: 1190097 - RNA, 20 nt, Human
ccugccaucauguuuacaga

SEQ ID NO: 1190098 - RNA, 21 nt, Human
ccuggugguggcucgggaggc

SEQ ID NO: 1190099 - RNA, 18 nt, Human
ccuggugguggcucggga

SEQ ID NO: 1190100 - RNA, 21 nt, Human
ccugucucccuccucugcccg

SEQ ID NO: 1190101 - RNA, 18 nt, Human
cagucugagagaggccau

SEQ ID NO: 1190102 - RNA, 15 nt, Human
caggccugacucuca

SEQ ID NO: 1190103 - RNA, 19 nt, Human
cauccauggggcugauugu

SEQ ID NO: 1190104 - RNA, 17 nt, Human
caccuaggcuagggugg

SEQ ID NO: 1190105 - RNA, 16 nt, Human
cuggggaugucucuca

SEQ ID NO: 1190106 - RNA, 17 nt, Human
cuggggaugucucucau

SEQ ID NO: 1190107 - RNA, 18 nt, Human
cugggaauaagugccagg

SEQ ID NO: 1190108 - RNA, 15 nt, Human
cuuaggccagcacca

SEQ ID NO: 1190109 - RNA, 20 nt, Human
cugugccuugucacgccaga

SEQ ID NO: 1190110 - RNA, 16 nt, Human
cugugccuuuugccau

SEQ ID NO: 1190111 - RNA, 14 nt, Human
cuuugaccuguugg

SEQ ID NO: 1190112 - RNA, 18 nt, Human
cuucuaguucugccagga

SEQ ID NO: 1190113 - RNA, 17 nt, Human
cuucuaguucugccagg

SEQ ID NO: 1190114 - RNA, 16 nt, Human
cuucuaguucugccag

SEQ ID NO: 1190115 - RNA, 19 nt, Human
cuucuaguucugccaggag

SEQ ID NO: 1190116 - RNA, 15 nt, Human
gacuauggagcugag

SEQ ID NO: 1190117 - RNA, 20 nt, Human
gacccucaucuuucuuccaa

SEQ ID NO: 1190118 - RNA, 19 nt, Human
gacccucaucuuucuucca

SEQ ID NO: 1190119 - RNA, 15 nt, Human
gacccucaucuuucu

SEQ ID NO: 1190120 - RNA, 18 nt, Human
gcauuucccuuccuuccu

SEQ ID NO: 1190121 - RNA, 23 nt, Human
gccuccauccuacccccugugcc

SEQ ID NO: 1190122 - RNA, 22 nt, Human
gcuaauucuuugaccuguuggg

SEQ ID NO: 1190123 - RNA, 21 nt, Human
gcucaggaaccgaggcaggga

SEQ ID NO: 1190124 - RNA, 20 nt, Human
gcucaggaaccgaggcaggg

SEQ ID NO: 1190125 - RNA, 19 nt, Human
gcucaggaaccgaggcagg

SEQ ID NO: 1190126 - RNA, 16 nt, Human
gcucaggaaccgaggc

SEQ ID NO: 1190127 - RNA, 20 nt, Human
ggaacugcugggcuuggcag

SEQ ID NO: 1190128 - RNA, 12 nt, Human
ggaagugugggu

SEQ ID NO: 1190129 - RNA, 21 nt, Human
ggaagugugggucugugugug

SEQ ID NO: 1190130 - RNA, 22 nt, Human
ggaagugugggucugugugugu

SEQ ID NO: 1190131 - RNA, 17 nt, Human
gcuucuaguucugccag

SEQ ID NO: 1190132 - RNA, 16 nt, Human
gcuucuaguucugcca

SEQ ID NO: 1190133 - RNA, 15 nt, Human
ggcagggcugaggcc

SEQ ID NO: 1190134 - RNA, 20 nt, Human
ggcucagaggguguccugca

SEQ ID NO: 1190135 - RNA, 14 nt, Human
ggcucagagugggg

SEQ ID NO: 1190136 - RNA, 22 nt, Human
gggacaccuaggcuaggguggg

SEQ ID NO: 1190137 - RNA, 17 nt, Human
ggggccgggggcagucu

SEQ ID NO: 1190138 - RNA, 18 nt, Human
gggggcgcggcugggagg

SEQ ID NO: 1190139 - RNA, 18 nt, Human
ggguggggagagacgggc

SEQ ID NO: 1190140 - RNA, 14 nt, Human
ggguggggagagac

SEQ ID NO: 1190141 - RNA, 22 nt, Human
ggugcuucuaguucugccagga

SEQ ID NO: 1190142 - RNA, 23 nt, Human
guaauuuaaaauugugauguguc

SEQ ID NO: 1190143 - RNA, 19 nt, Human
guaauuuaaaauugugaug

SEQ ID NO: 1190144 - RNA, 20 nt, Human
guaauuuaaaauugugaugu

SEQ ID NO: 1190145 - RNA, 15 nt, Human
guagagccagagguc

SEQ ID NO: 1190146 - RNA, 22 nt, Human
gucccgggacaccuaggcuagg

SEQ ID NO: 1190147 - RNA, 20 nt, Human
guccugcaccggggccuggg

SEQ ID NO: 1190148 - RNA, 19 nt, Human
guccugcaccggggccugg

SEQ ID NO: 1190149 - RNA, 15 nt, Human
guccugcaccggggc

SEQ ID NO: 1190150 - RNA, 18 nt, Human
guggcacuggggcagggg

SEQ ID NO: 1190151 - RNA, 17 nt, Human
guggcacuggggcaggg

SEQ ID NO: 1190152 - RNA, 14 nt, Human
gugguggcucggga

SEQ ID NO: 1190153 - RNA, 14 nt, Human
gugggggucugugu

SEQ ID NO: 1190154 - RNA, 15 nt, Human
gugggggucugugug

SEQ ID NO: 1190155 - RNA, 16 nt, Human
gugggggucugugugu

SEQ ID NO: 1190156 - RNA, 13 nt, Human
guguguguaugug

SEQ ID NO: 1190157 - RNA, 14 nt, Human
guguguguaugugg

SEQ ID NO: 1190158 - RNA, 17 nt, Human
guguguguugugugugg

SEQ ID NO: 1190159 - RNA, 17 nt, Human
aauaagugccaggaugg

SEQ ID NO: 1190160 - RNA, 14 nt, Human
guugggagaauguc

SEQ ID NO: 1190161 - RNA, 21 nt, Human
guugggagaaugucaguaugu

SEQ ID NO: 1190162 - RNA, 12 nt, Human
guguuuaugugu

SEQ ID NO: 1190163 - RNA, 16 nt, Human
guguuuaugugugugu

SEQ ID NO: 1190164 - RNA, 19 nt, Human
uaccagagaaaaagggagg

SEQ ID NO: 1190165 - RNA, 14 nt, Human
aauuuaugugaugg

SEQ ID NO: 1190166 - RNA, 18 nt, Human
aauucuuugaccuguugg

SEQ ID NO: 1190167 - RNA, 22 nt, Human
aauucuuugaccuguugggagu

SEQ ID NO: 1190168 - RNA, 14 nt, Human
uaguucugccagga

SEQ ID NO: 1190169 - RNA, 13 nt, Human
uaguucugccagg

SEQ ID NO: 1190170 - RNA, 23 nt, Human
acaccuaggcuaggguggggaga

SEQ ID NO: 1190171 - RNA, 20 nt, Human
acaccuaggcuagggugggg

SEQ ID NO: 1190172 - RNA, 12 nt, Human
acagccuggcug

SEQ ID NO: 1190173 - RNA, 19 nt, Human
uauggggauagaugugugg

SEQ ID NO: 1190174 - RNA, 17 nt, Human
uauggggauagaugugu

SEQ ID NO: 1190175 - RNA, 18 nt, Human
uauggggauagaugugug

SEQ ID NO: 1190176 - RNA, 21 nt, Human
acagacacucccacuuggcau

SEQ ID NO: 1190177 - RNA, 23 nt, Human
uauguguguguguuguguguggg

SEQ ID NO: 1190178 - RNA, 11 nt, Human
uaugugugugu

SEQ ID NO: 1190179 - RNA, 14 nt, Human
uauguguguguguu

SEQ ID NO: 1190180 - RNA, 22 nt, Human
uauguguguguguugugugugg

SEQ ID NO: 1190181 - RNA, 20 nt, Human
accagagaaaaagggagggg

SEQ ID NO: 1190182 - RNA, 16 nt, Human
ucagccccgcguggaa

SEQ ID NO: 1190183 - RNA, 22 nt, Human
acccagcuaugguucucucgca

SEQ ID NO: 1190184 - RNA, 18 nt, Human
ucaggaaccgaggcaggg

SEQ ID NO: 1190185 - RNA, 15 nt, Human
ucaggccgaaggagg

SEQ ID NO: 1190186 - RNA, 18 nt, Human
accugaauaaagaaugaa

SEQ ID NO: 1190187 - RNA, 22 nt, Human
ucaugauagaaggcuaugggga

SEQ ID NO: 1190188 - RNA, 18 nt, Human
acucaugugacucuuucc

SEQ ID NO: 1190189 - RNA, 17 nt, Human
acucaugugacucuuuc

SEQ ID NO: 1190190 - RNA, 16 nt, Human
acucaugugacucuuu

SEQ ID NO: 1190191 - RNA, 15 nt, Human
acucaugugacucuu

SEQ ID NO: 1190192 - RNA, 11 nt, Human
uccucagcccc

SEQ ID NO: 1190193 - RNA, 21 nt, Human
acucuggagguuuguuuagaa

SEQ ID NO: 1190194 - RNA, 21 nt, Human
uccugcaccggggccugggca

SEQ ID NO: 1190195 - RNA, 20 nt, Human
uccugcaccggggccugggc

SEQ ID NO: 1190196 - RNA, 23 nt, Human
ucgagaucccaacacugccagca

SEQ ID NO: 1190197 - RNA, 14 nt, Human
acuggggcaggggc

SEQ ID NO: 1190198 - RNA, 16 nt, Human
acuggggcaggggccg

SEQ ID NO: 1190199 - RNA, 17 nt, Human
ugaggaagagggacugu

SEQ ID NO: 1190200 - RNA, 22 nt, Human
ugagggugacuauggagcugag

SEQ ID NO: 1190201 - RNA, 22 nt, Human
agagggacuguucuuuuguccc

SEQ ID NO: 1190202 - RNA, 14 nt, Human
agaagaaguguguc

SEQ ID NO: 1190203 - RNA, 11 nt, Human
ucuggcccuau

SEQ ID NO: 1190204 - RNA, 19 nt, Human
agccugacccucaucuuuc

SEQ ID NO: 1190205 - RNA, 19 nt, Human
ugccuugugaaggaauuau

SEQ ID NO: 1190206 - RNA, 15 nt, Human
agcuggggaugucuc

SEQ ID NO: 1190207 - RNA, 22 nt, Human
uggcacagccuggcuguggccu

SEQ ID NO: 1190208 - RNA, 15 nt, Human
aggccauucuuuccc

SEQ ID NO: 1190209 - RNA, 14 nt, Human
aggccauucuuucc

SEQ ID NO: 1190210 - RNA, 22 nt, Human
uggcauccagagucccugccug

SEQ ID NO: 1190211 - RNA, 21 nt, Human
uggcauccagagucccugccu

SEQ ID NO: 1190212 - RNA, 20 nt, Human
uggcauccagagucccugcc

SEQ ID NO: 1190213 - RNA, 16 nt, Human
aggccugacucucagc

SEQ ID NO: 1190214 - RNA, 18 nt, Human
aggcgaagcguuguccuc

SEQ ID NO: 1190215 - RNA, 20 nt, Human
aggcucagaggguguccugc

SEQ ID NO: 1190216 - RNA, 19 nt, Human
aggcucagaggguguccug

SEQ ID NO: 1190217 - RNA, 18 nt, Human
aggcucagaggguguccu

SEQ ID NO: 1190218 - RNA, 20 nt, Human
uggaagugugggucugugug

SEQ ID NO: 1190219 - RNA, 13 nt, Human
uggaagugugggu

SEQ ID NO: 1190220 - RNA, 14 nt, Human
uggaaguguggguc

SEQ ID NO: 1190221 - RNA, 20 nt, Human
uggcuguggccuaaccugcc

SEQ ID NO: 1190222 - RNA, 17 nt, Human
uggcuguggcauccaga

SEQ ID NO: 1190223 - RNA, 21 nt, Human
uguagugauuuuuaugccacc

SEQ ID NO: 1190224 - RNA, 20 nt, Human
uguagugauuuuuaugccac

SEQ ID NO: 1190225 - RNA, 14 nt, Human
aguauuugugggga

SEQ ID NO: 1190226 - RNA, 20 nt, Human
agugauuuuuaugccaccug

SEQ ID NO: 1190227 - RNA, 16 nt, Human
agugauuuuuaugcca

SEQ ID NO: 1190228 - RNA, 21 nt, Human
agugauuuuuaugccaccuga

SEQ ID NO: 1190229 - RNA, 14 nt, Human
agugaggaugucug

SEQ ID NO: 1190230 - RNA, 18 nt, Human
agugccaggauggaauga

SEQ ID NO: 1190231 - RNA, 9 nt, Human
aguguguaa

SEQ ID NO: 1190232 - RNA, 16 nt, Human
agugggguagguuggg

SEQ ID NO: 1190233 - RNA, 18 nt, Human
uguguguuguguguggga

SEQ ID NO: 1190234 - RNA, 10 nt, Human
uuaugugugu

SEQ ID NO: 1190235 - RNA, 12 nt, Human
uuaugugugugu

SEQ ID NO: 1190236 - RNA, 14 nt, Human
uuaugugugugugu

SEQ ID NO: 1190237 - RNA, 19 nt, Human
auagaaggcuauggggaua

SEQ ID NO: 1190238 - RNA, 11 nt, Human
auagaugugug

SEQ ID NO: 1190239 - RNA, 12 nt, Human
auagaugugugg

SEQ ID NO: 1190240 - RNA, 13 nt, Human
auagaugugugga

SEQ ID NO: 1190241 - RNA, 14 nt, Human
auagauguguggac

SEQ ID NO: 1190242 - RNA, 18 nt, Human
auaaucacaacccuucag

SEQ ID NO: 1190243 - RNA, 13 nt, Human
uucugccaggaga

SEQ ID NO: 1190244 - RNA, 19 nt, Human
auccauagcaccuccacau

SEQ ID NO: 1190245 - RNA, 16 nt, Human
auccuacccccugugc

SEQ ID NO: 1190246 - RNA, 14 nt, Human
auccuacccccugu

SEQ ID NO: 1190247 - RNA, 16 nt, Human
aucaggccauuguccc

SEQ ID NO: 1190248 - RNA, 16 nt, Human
augugacucuuuccaa

SEQ ID NO: 1190249 - RNA, 12 nt, Human
augugacucuuu

SEQ ID NO: 1190250 - RNA, 21 nt, Human
augugacucuuuccaaccggc

SEQ ID NO: 1190251 - RNA, 16 nt, Human
augguucucaggccug

SEQ ID NO: 1190252 - RNA, 20 nt, Human
auggggauagauguguggac

SEQ ID NO: 1190253 - RNA, 20 nt, Human
auuucccuuccuuccucucc

SEQ ID NO: 1190254 - RNA, 16 nt, Human
auuucccuuccuuccu

SEQ ID NO: 1190255 - RNA, 18 nt, Human
auuuguaaauuuauguga

SEQ ID NO: 1190256 - RNA, 19 nt, Human
auuuguaaauuuaugugau

SEQ ID NO: 1190257 - RNA, 12 nt, Human
auuuuucucaug

SEQ ID NO: 1190258 - RNA, 12 nt, Human
auuccagaggaa

SEQ ID NO: 1190259 - RNA, 13 nt, Human
aagggagggggag

SEQ ID NO: 1190260 - RNA, 13 nt, Human
aaugucaguaugu

SEQ ID NO: 1190261 - RNA, 15 nt, Human
aaugucaguaugugg

SEQ ID NO: 1190262 - RNA, 12 nt, Human
acugccagcauu

SEQ ID NO: 1190263 - RNA, 23 nt, Human
accugccgagaguccaucagccu

SEQ ID NO: 1190264 - RNA, 16 nt, Human
accugccgagagucca

SEQ ID NO: 1190265 - RNA, 11 nt, Human
acacugccagc

SEQ ID NO: 1190266 - RNA, 13 nt, Human
acccccugugccu

SEQ ID NO: 1190267 - RNA, 22 nt, Human
agcuccuuaaggcucuuuugua

SEQ ID NO: 1190268 - RNA, 14 nt, Human
agcugagcaggugu

SEQ ID NO: 1190269 - RNA, 17 nt, Human
agcugcuccccacguca

SEQ ID NO: 1190270 - RNA, 14 nt, Human
agcugcuccccacg

SEQ ID NO: 1190271 - RNA, 21 nt, Human
aggagucccugccaucauguu

SEQ ID NO: 1190272 - RNA, 14 nt, Human
agccgggagccuga

SEQ ID NO: 1190273 - RNA, 20 nt, Human
agaggacaguauuugugggg

SEQ ID NO: 1190274 - RNA, 19 nt, Human
augagcuccuuaaggcucu

SEQ ID NO: 1190275 - RNA, 14 nt, Human
aucagccugugcca

SEQ ID NO: 1190276 - RNA, 18 nt, Human
aguucauaaauuuauggu

SEQ ID NO: 1190277 - RNA, 16 nt, Human
aguggcuggaucugug

SEQ ID NO: 1190278 - RNA, 16 nt, Human
caccccgacuuuuguu

SEQ ID NO: 1190279 - RNA, 16 nt, Human
cccaacacugccagca

SEQ ID NO: 1190280 - RNA, 15 nt, Human
cccaacacugccagc

SEQ ID NO: 1190281 - RNA, 14 nt, Human
cccaacacugccag

SEQ ID NO: 1190282 - RNA, 15 nt, Human
cccacgucagcuggg

SEQ ID NO: 1190283 - RNA, 15 nt, Human
cccacggcuccucga

SEQ ID NO: 1190284 - RNA, 22 nt, Human
cccaugagcuccuuaaggcucu

SEQ ID NO: 1190285 - RNA, 15 nt, Human
cccaugagcuccuua

SEQ ID NO: 1190286 - RNA, 14 nt, Human
cccaugagcuccuu

SEQ ID NO: 1190287 - RNA, 13 nt, Human
cccaugagcuccu

SEQ ID NO: 1190288 - RNA, 18 nt, Human
cccagaaugccuccugca

SEQ ID NO: 1190289 - RNA, 22 nt, Human
cccccugugccuugucacgcca

SEQ ID NO: 1190290 - RNA, 14 nt, Human
ccccugugccuugu

SEQ ID NO: 1190291 - RNA, 20 nt, Human
ccgagaguccaucagccucc

SEQ ID NO: 1190292 - RNA, 21 nt, Human
ccgagaguccaucagccucca

SEQ ID NO: 1190293 - RNA, 21 nt, Human
ccgggggcagucugagagagg

SEQ ID NO: 1190294 - RNA, 20 nt, Human
ccggggccugggcaggaggg

SEQ ID NO: 1190295 - RNA, 23 nt, Human
ccguggcuguggcauccagaguc

SEQ ID NO: 1190296 - RNA, 22 nt, Human
ccgggucaucuguaccucugcc

SEQ ID NO: 1190297 - RNA, 13 nt, Human
ccuaaccugccga

SEQ ID NO: 1190298 - RNA, 12 nt, Human
ccuaaccugccg

SEQ ID NO: 1190299 - RNA, 16 nt, Human
ccuaggcuaggguggg

SEQ ID NO: 1190300 - RNA, 17 nt, Human
ccugcaccggggccugg

SEQ ID NO: 1190301 - RNA, 15 nt, Human
ccugcaccggggccu

SEQ ID NO: 1190302 - RNA, 19 nt, Human
ccugaagagaagggcaggg

SEQ ID NO: 1190303 - RNA, 23 nt, Human
ccugccgagaguccaucagccuc

SEQ ID NO: 1190304 - RNA, 22 nt, Human
ccugccgagaguccaucagccu

SEQ ID NO: 1190305 - RNA, 14 nt, Human
ccugccgagagucc

SEQ ID NO: 1190306 - RNA, 21 nt, Human
cgaagcguuguccucagcccc

SEQ ID NO: 1190307 - RNA, 17 nt, Human
cgaagcguuguccucag

SEQ ID NO: 1190308 - RNA, 16 nt, Human
cgaagcguuguccuca

SEQ ID NO: 1190309 - RNA, 15 nt, Human
cgaagcguuguccuc

SEQ ID NO: 1190310 - RNA, 14 nt, Human
ccuuugucccagaa

SEQ ID NO: 1190311 - RNA, 17 nt, Human
ccugugccuuuugccau

SEQ ID NO: 1190312 - RNA, 12 nt, Human
cgcggcugggag

SEQ ID NO: 1190313 - RNA, 11 nt, Human
cgcggcuggga

SEQ ID NO: 1190314 - RNA, 16 nt, Human
cgcggcugggaggagg

SEQ ID NO: 1190315 - RNA, 19 nt, Human
cgggacaccuaggcuaggg

SEQ ID NO: 1190316 - RNA, 18 nt, Human
cgggacaccuaggcuagg

SEQ ID NO: 1190317 - RNA, 12 nt, Human
cuaaccugccga

SEQ ID NO: 1190318 - RNA, 13 nt, Human
cuacccccugugc

SEQ ID NO: 1190319 - RNA, 16 nt, Human
cucagaggguguccug

SEQ ID NO: 1190320 - RNA, 17 nt, Human
cucagccccgcguggaa

SEQ ID NO: 1190321 - RNA, 19 nt, Human
cucaggaaccgaggcaggg

SEQ ID NO: 1190322 - RNA, 18 nt, Human
cucaggaaccgaggcagg

SEQ ID NO: 1190323 - RNA, 17 nt, Human
cucaggaaccgaggcag

SEQ ID NO: 1190324 - RNA, 22 nt, Human
cuccacucaugugacucuuucc

SEQ ID NO: 1190325 - RNA, 16 nt, Human
cuccacucaugugacu

SEQ ID NO: 1190326 - RNA, 20 nt, Human
cuccccacgucagcugggac

SEQ ID NO: 1190327 - RNA, 21 nt, Human
cuauggggauagaugugugga

SEQ ID NO: 1190328 - RNA, 19 nt, Human
cuauggggauagaugugug

SEQ ID NO: 1190329 - RNA, 20 nt, Human
cuauggggauagaugugugg

SEQ ID NO: 1190330 - RNA, 22 nt, Human
cuacucuggagguuuguuuaga

SEQ ID NO: 1190331 - RNA, 23 nt, Human
cugccgagaguccaucagccucc

SEQ ID NO: 1190332 - RNA, 22 nt, Human
cugccgagaguccaucagccuc

SEQ ID NO: 1190333 - RNA, 11 nt, Human
cugcugggcuu

SEQ ID NO: 1190334 - RNA, 18 nt, Human
cuggaccagccucuccac

SEQ ID NO: 1190335 - RNA, 14 nt, Human
cuggaccagccucu

SEQ ID NO: 1190336 - RNA, 12 nt, Human
cuggagguuugu

SEQ ID NO: 1190337 - RNA, 17 nt, Human
cuggagguuuguuuaga

SEQ ID NO: 1190338 - RNA, 21 nt, Human
cuggccaguggcuggaucugu

SEQ ID NO: 1190339 - RNA, 21 nt, Human
cugucucccuccucugcccgg

SEQ ID NO: 1190340 - RNA, 19 nt, Human
cugugaggggcucucucau

SEQ ID NO: 1190341 - RNA, 16 nt, Human
cuguguguuuaugugu

SEQ ID NO: 1190342 - RNA, 17 nt, Human
cuguguguuuaugugug

SEQ ID NO: 1190343 - RNA, 18 nt, Human
cuguguguuuaugugugu

SEQ ID NO: 1190344 - RNA, 13 nt, Human
cuuucccaacacc

SEQ ID NO: 1190345 - RNA, 18 nt, Human
cuugucacgccagacuuc

SEQ ID NO: 1190346 - RNA, 16 nt, Human
cuugucacgccagacu

SEQ ID NO: 1190347 - RNA, 13 nt, Human
cuugucacgccag

SEQ ID NO: 1190348 - RNA, 14 nt, Human
cuuuguggcacugg

SEQ ID NO: 1190349 - RNA, 14 nt, Human
gaccagccucucca

SEQ ID NO: 1190350 - RNA, 19 nt, Human
gaaugucaguauguggaag

SEQ ID NO: 1190351 - RNA, 13 nt, Human
gaaugucaguaug

SEQ ID NO: 1190352 - RNA, 16 nt, Human
gaaugucaguaugugg

SEQ ID NO: 1190353 - RNA, 18 nt, Human
gaaugucaguauguggaa

SEQ ID NO: 1190354 - RNA, 13 nt, Human
gagagacgggccc

SEQ ID NO: 1190355 - RNA, 17 nt, Human
gagaaugucaguaugug

SEQ ID NO: 1190356 - RNA, 20 nt, Human
gagaucccaacacugccagc

SEQ ID NO: 1190357 - RNA, 19 nt, Human
gagaucccaacacugccag

SEQ ID NO: 1190358 - RNA, 18 nt, Human
gagaucccaacacugcca

SEQ ID NO: 1190359 - RNA, 14 nt, Human
gaggcagggaagga

SEQ ID NO: 1190360 - RNA, 21 nt, Human
gaggcgaagcguuguccucag

SEQ ID NO: 1190361 - RNA, 20 nt, Human
gaggcgaagcguuguccuca

SEQ ID NO: 1190362 - RNA, 22 nt, Human
gaggccucucauuccagaggaa

SEQ ID NO: 1190363 - RNA, 14 nt, Human
gagggggagagggc

SEQ ID NO: 1190364 - RNA, 13 nt, Human
gaggguguccugc

SEQ ID NO: 1190365 - RNA, 23 nt, Human
gagucccugccuggaccagccuc

SEQ ID NO: 1190366 - RNA, 21 nt, Human
gagucccugccuggaccagcc

SEQ ID NO: 1190367 - RNA, 14 nt, Human
gauagaugugugga

SEQ ID NO: 1190368 - RNA, 22 nt, Human
gauagauguguggacacauugg

SEQ ID NO: 1190369 - RNA, 13 nt, Human
gaguguguaauuu

SEQ ID NO: 1190370 - RNA, 18 nt, Human
gcacuggggcaggggccg

SEQ ID NO: 1190371 - RNA, 15 nt, Human
gcacuggggcagggg

SEQ ID NO: 1190372 - RNA, 23 nt, Human
gcacuggggcaggggccgggggc

SEQ ID NO: 1190373 - RNA, 15 nt, Human
gaugggucaguugua

SEQ ID NO: 1190374 - RNA, 21 nt, Human
gaugggucaguuguaucagca

SEQ ID NO: 1190375 - RNA, 23 nt, Human
gcccuggugguggcucgggaggc

SEQ ID NO: 1190376 - RNA, 17 nt, Human
gccugacccucaucuuu

SEQ ID NO: 1190377 - RNA, 17 nt, Human
gcuaugagcuggggaug

SEQ ID NO: 1190378 - RNA, 22 nt, Human
gcuuuguggcacuggggcaggg

SEQ ID NO: 1190379 - RNA, 14 nt, Human
gcuuuguggcacug

SEQ ID NO: 1190380 - RNA, 22 nt, Human
ggaaggaucccaugagcuccuu

SEQ ID NO: 1190381 - RNA, 23 nt, Human
ggaagggacaccaagccuuggcu

SEQ ID NO: 1190382 - RNA, 22 nt, Human
ggagaaugucaguauguggaag

SEQ ID NO: 1190383 - RNA, 20 nt, Human
ggccauucuuucccaacacc

SEQ ID NO: 1190384 - RNA, 17 nt, Human
ggauggaaugauggguc

SEQ ID NO: 1190385 - RNA, 22 nt, Human
ggccuaaccugccgagagucca

SEQ ID NO: 1190386 - RNA, 12 nt, Human
ggcccugugccu

SEQ ID NO: 1190387 - RNA, 16 nt, Human
ggcuaggguggggaga

SEQ ID NO: 1190388 - RNA, 21 nt, Human
ggcuauggggauagaugugug

SEQ ID NO: 1190389 - RNA, 13 nt, Human
ggccugggcagga

SEQ ID NO: 1190390 - RNA, 14 nt, Human
ggccugggcaggag

SEQ ID NO: 1190391 - RNA, 16 nt, Human
ggcgcggcugggagga

SEQ ID NO: 1190392 - RNA, 14 nt, Human
gggcgcggcuggga

SEQ ID NO: 1190393 - RNA, 15 nt, Human
ggggcagucugagag

SEQ ID NO: 1190394 - RNA, 18 nt, Human
ggggaguuuagggugggg

SEQ ID NO: 1190395 - RNA, 13 nt, Human
ggggauagaugug

SEQ ID NO: 1190396 - RNA, 14 nt, Human
gucacgccagacuu

SEQ ID NO: 1190397 - RNA, 20 nt, Human
gucccagaaugccuccugca

SEQ ID NO: 1190398 - RNA, 12 nt, Human
guccucagcccc

SEQ ID NO: 1190399 - RNA, 23 nt, Human
gucccugccuggaccagccucuc

SEQ ID NO: 1190400 - RNA, 22 nt, Human
gucccugccuggaccagccucu

SEQ ID NO: 1190401 - RNA, 21 nt, Human
gucccugccuggaccagccuc

SEQ ID NO: 1190402 - RNA, 20 nt, Human
gucccugccuggaccagccu

SEQ ID NO: 1190403 - RNA, 12 nt, Human
gugacucuuucc

SEQ ID NO: 1190404 - RNA, 21 nt, Human
gugauuuuuaugccaccugaa

SEQ ID NO: 1190405 - RNA, 20 nt, Human
gugauuuuuaugccaccuga

SEQ ID NO: 1190406 - RNA, 19 nt, Human
gugauuuuuaugccaccug

SEQ ID NO: 1190407 - RNA, 17 nt, Human
gugauuuuuaugccacc

SEQ ID NO: 1190408 - RNA, 16 nt, Human
gugauuuuuaugccac

SEQ ID NO: 1190409 - RNA, 19 nt, Human
gugccuugucacgccagac

SEQ ID NO: 1190410 - RNA, 22 nt, Human
gugcuucuaguucugccaggag

SEQ ID NO: 1190411 - RNA, 21 nt, Human
gugcuucuaguucugccagga

SEQ ID NO: 1190412 - RNA, 20 nt, Human
gugcuucuaguucugccagg

SEQ ID NO: 1190413 - RNA, 18 nt, Human
guggcucgggaggcgaag

SEQ ID NO: 1190414 - RNA, 14 nt, Human
guggcauccagagu

SEQ ID NO: 1190415 - RNA, 16 nt, Human
uaggcuagggugggga

SEQ ID NO: 1190416 - RNA, 23 nt, Human
uaugagcuggggaugucucucau

SEQ ID NO: 1190417 - RNA, 14 nt, Human
uccaaacaggcuca

SEQ ID NO: 1190418 - RNA, 12 nt, Human
ucaucuuucuuc

SEQ ID NO: 1190419 - RNA, 21 nt, Human
uccagagucccugccuggacc

SEQ ID NO: 1190420 - RNA, 20 nt, Human
uccagagucccugccuggac

SEQ ID NO: 1190421 - RNA, 19 nt, Human
uccagagucccugccugga

SEQ ID NO: 1190422 - RNA, 18 nt, Human
uccagagucccugccugg

SEQ ID NO: 1190423 - RNA, 17 nt, Human
uccuacccccugugccu

SEQ ID NO: 1190424 - RNA, 16 nt, Human
uccuacccccugugcc

SEQ ID NO: 1190425 - RNA, 15 nt, Human
uccuacccccugugc

SEQ ID NO: 1190426 - RNA, 13 nt, Human
uccuacccccugu

SEQ ID NO: 1190427 - RNA, 23 nt, Human
uccugucucccuccucugcccgg

SEQ ID NO: 1190428 - RNA, 15 nt, Human
uccugucucccuccu

SEQ ID NO: 1190429 - RNA, 18 nt, Human
ucucccuccucugcccgg

SEQ ID NO: 1190430 - RNA, 21 nt, Human
ugagcuccuuaaggcucuuuu

SEQ ID NO: 1190431 - RNA, 19 nt, Human
ugagcuccuuaaggcucuu

SEQ ID NO: 1190432 - RNA, 20 nt, Human
ugagcuggggaugucucuca

SEQ ID NO: 1190433 - RNA, 17 nt, Human
ugacauacauccaacau

SEQ ID NO: 1190434 - RNA, 17 nt, Human
ugcccgggagcucagga

SEQ ID NO: 1190435 - RNA, 15 nt, Human
uggaccagccucucc

SEQ ID NO: 1190436 - RNA, 19 nt, Human
uggaucugugaggggcucu

SEQ ID NO: 1190437 - RNA, 15 nt, Human
uggaucugugagggg

SEQ ID NO: 1190438 - RNA, 18 nt, Human
ugggcaggagggaggugc

SEQ ID NO: 1190439 - RNA, 16 nt, Human
ugggcaggagggaggu

SEQ ID NO: 1190440 - RNA, 15 nt, Human
ugggcaggagggagg

SEQ ID NO: 1190441 - RNA, 13 nt, Human
ugggcaggaggga

SEQ ID NO: 1190442 - RNA, 11 nt, Human
ugggagugugu

SEQ ID NO: 1190443 - RNA, 13 nt, Human
ugggaguguguaa

SEQ ID NO: 1190444 - RNA, 20 nt, Human
uggggaguuuaggguggggg

SEQ ID NO: 1190445 - RNA, 16 nt, Human
uggggauagaugugug

SEQ ID NO: 1190446 - RNA, 17 nt, Human
uggggauagaugugugg

SEQ ID NO: 1190447 - RNA, 18 nt, Human
uggggauagaugugugga

SEQ ID NO: 1190448 - RNA, 20 nt, Human
uggggauagauguguggaca

SEQ ID NO: 1190449 - RNA, 14 nt, Human
ugggggucugugug

SEQ ID NO: 1190450 - RNA, 15 nt, Human
ugggggucugugugu

SEQ ID NO: 1190451 - RNA, 13 nt, Human
uuaugccaccuga

SEQ ID NO: 1190452 - RNA, 16 nt, Human
uuaugccaccugaaua

SEQ ID NO: 1190453 - RNA, 12 nt, Human
uuaacucagucu

SEQ ID NO: 1190454 - RNA, 19 nt, Human
uguuuagaagaaguguguc

SEQ ID NO: 1190455 - RNA, 14 nt, Human
uuuaugccaccuga

SEQ ID NO: 1190456 - RNA, 20 nt, Human
uuuacagaggacaguauuug

SEQ ID NO: 1190457 - RNA, 16 nt, Human
uuuaaaauugugaugu

SEQ ID NO: 1190458 - RNA, 15 nt, Human
uuguuuagaagaagu

SEQ ID NO: 1190459 - RNA, 18 nt, Human
uuguuuagaagaagugug

SEQ ID NO: 1190460 - RNA, 16 nt, Human
uuggcagcucuacucu

SEQ ID NO: 1190461 - RNA, 11 nt, Human
uuuguggggag

SEQ ID NO: 1190462 - RNA, 23 nt, Human
agucugagagaggccauucuuuc

SEQ ID NO: 1190463 - RNA, 16 nt, Human
agucugagagaggcca

SEQ ID NO: 1190464 - RNA, 21 nt, Human
auccagagucccugccuggac

SEQ ID NO: 1190465 - RNA, 20 nt, Human
auccagagucccugccugga

SEQ ID NO: 1190466 - RNA, 19 nt, Human
auccagagucccugccugg

SEQ ID NO: 1190467 - RNA, 16 nt, Human
augaugggucaguugu

SEQ ID NO: 1190468 - RNA, 18 nt, Human
agcuccuuaaggcucuuu

SEQ ID NO: 1190469 - RNA, 17 nt, Human
agcuccuuaaggcucuu

SEQ ID NO: 1190470 - RNA, 16 nt, Human
agcuccuuaaggcucu

SEQ ID NO: 1190471 - RNA, 19 nt, Human
agcuaauucuuugaccugu

SEQ ID NO: 1190472 - RNA, 16 nt, Human
aggaaccgaggcaggg

SEQ ID NO: 1190473 - RNA, 22 nt, Human
aggaacugcugggcuuggcagc

SEQ ID NO: 1190474 - RNA, 10 nt, Human
agagggcugc

SEQ ID NO: 1190475 - RNA, 18 nt, Human
aagagaagggcagggcug

SEQ ID NO: 1190476 - RNA, 23 nt, Human
acagaggacaguauuugugggga

SEQ ID NO: 1190477 - RNA, 11 nt, Human
aauugugaugu

SEQ ID NO: 1190478 - RNA, 14 nt, Human
aauugugauguguc

SEQ ID NO: 1190479 - RNA, 15 nt, Human
aauugugaugugucc

SEQ ID NO: 1190480 - RNA, 14 nt, Human
accaucucuuuacc

SEQ ID NO: 1190481 - RNA, 14 nt, Human
gccaggauggaaug

SEQ ID NO: 1190482 - RNA, 14 nt, Human
gccaguggcuggau

SEQ ID NO: 1190483 - RNA, 23 nt, Human
gccaguggcuggaucugugaggg

SEQ ID NO: 1190484 - RNA, 22 nt, Human
gcggcugggaggagggcaggca

SEQ ID NO: 1190485 - RNA, 19 nt, Human
gcggcugggaggagggcag

SEQ ID NO: 1190486 - RNA, 18 nt, Human
gcggcugggaggagggca

SEQ ID NO: 1190487 - RNA, 17 nt, Human
gcggcugggaggagggc

SEQ ID NO: 1190488 - RNA, 14 nt, Human
gcggcugggaggag

SEQ ID NO: 1190489 - RNA, 14 nt, Human
ggaacugcugggcu

SEQ ID NO: 1190490 - RNA, 15 nt, Human
ggaacugcugggcuu

SEQ ID NO: 1190491 - RNA, 20 nt, Human
gcuguagacauuugcuauga

SEQ ID NO: 1190492 - RNA, 13 nt, Human
gcuggaucuguga

SEQ ID NO: 1190493 - RNA, 19 nt, Human
gcuuuccucaucaggccau

SEQ ID NO: 1190494 - RNA, 14 nt, Human
gcugaggccucuca

SEQ ID NO: 1190495 - RNA, 18 nt, Human
gcuccucgagaucccaac

SEQ ID NO: 1190496 - RNA, 22 nt, Human
gcugcuccccacgucagcuggg

SEQ ID NO: 1190497 - RNA, 13 nt, Human
gcugcuccccacg

SEQ ID NO: 1190498 - RNA, 13 nt, Human
ggaugucugggcc

SEQ ID NO: 1190499 - RNA, 13 nt, Human
ggcacagccuggc

SEQ ID NO: 1190500 - RNA, 12 nt, Human
ggcacagccugg

SEQ ID NO: 1190501 - RNA, 17 nt, Human
ggcccugugccuuggug

SEQ ID NO: 1190502 - RNA, 15 nt, Human
ggcacuggggcaggg

SEQ ID NO: 1190503 - RNA, 22 nt, Human
ggcauccagagucccugccugg

SEQ ID NO: 1190504 - RNA, 19 nt, Human
ggccaguggcuggaucugu

SEQ ID NO: 1190505 - RNA, 22 nt, Human
ggcgaagcguuguccucagccc

SEQ ID NO: 1190506 - RNA, 14 nt, Human
aaaagggaggggga

SEQ ID NO: 1190507 - RNA, 14 nt, Human
gggaugucucucau

SEQ ID NO: 1190508 - RNA, 19 nt, Human
gggagaaugucaguaugug

SEQ ID NO: 1190509 - RNA, 22 nt, Human
gggagaaugucaguauguggaa

SEQ ID NO: 1190510 - RNA, 22 nt, Human
gggcccuggugguggcucggga

SEQ ID NO: 1190511 - RNA, 18 nt, Human
gggcucagagugggguag

SEQ ID NO: 1190512 - RNA, 13 nt, Human
ggguggggagaga

SEQ ID NO: 1190513 - RNA, 23 nt, Human
ggguguccugcaccggggccugg

SEQ ID NO: 1190514 - RNA, 16 nt, Human
gguaggaacugcuggg

SEQ ID NO: 1190515 - RNA, 21 nt, Human
ggugcuucuaguucugccagg

SEQ ID NO: 1190516 - RNA, 20 nt, Human
ggucuguguguguguaugug

SEQ ID NO: 1190517 - RNA, 21 nt, Human
ggucuguguguguguaugugg

SEQ ID NO: 1190518 - RNA, 11 nt, Human
ggucugugugu

SEQ ID NO: 1190519 - RNA, 17 nt, Human
ggucuguguguguguau

SEQ ID NO: 1190520 - RNA, 16 nt, Human
guaaauuuaugugaug

SEQ ID NO: 1190521 - RNA, 17 nt, Human
guaaauuuaugugaugg

SEQ ID NO: 1190522 - RNA, 17 nt, Human
cugccaucauguuuaca

SEQ ID NO: 1190523 - RNA, 22 nt, Human
cugccaucauguuuacagagga

SEQ ID NO: 1190524 - RNA, 23 nt, Human
cugccaucauguuuacagaggac

SEQ ID NO: 1190525 - RNA, 22 nt, Human
cuggggaugucucucaugacca

SEQ ID NO: 1190526 - RNA, 18 nt, Human
cuuauuggcagcucuacu

SEQ ID NO: 1190527 - RNA, 19 nt, Human
gagcuggggaugucucuca

SEQ ID NO: 1190528 - RNA, 19 nt, Human
gaagugugggucugugugu

SEQ ID NO: 1190529 - RNA, 17 nt, Human
gaagugugggucugugu

SEQ ID NO: 1190530 - RNA, 18 nt, Human
gaagugugggucugugug

SEQ ID NO: 1190531 - RNA, 15 nt, Human
gaaggcuauggggau

SEQ ID NO: 1190532 - RNA, 19 nt, Human
gaagggcagggcugaggcc

SEQ ID NO: 1190533 - RNA, 16 nt, Human
gacagguuagcugcuc

SEQ ID NO: 1190534 - RNA, 15 nt, Human
gacaguauuuguggg

SEQ ID NO: 1190535 - RNA, 16 nt, Human
gaguccaucagccucc

SEQ ID NO: 1190536 - RNA, 15 nt, Human
gaguccaucagccuc

SEQ ID NO: 1190537 - RNA, 14 nt, Human
gaguccaucagccu

SEQ ID NO: 1190538 - RNA, 13 nt, Human
gaguccaucagcc

SEQ ID NO: 1190539 - RNA, 18 nt, Human
gagugaggaugucugggc

SEQ ID NO: 1190540 - RNA, 15 nt, Human
gaguuuagggugggg

SEQ ID NO: 1190541 - RNA, 14 nt, Human
gaguuuaggguggg

SEQ ID NO: 1190542 - RNA, 16 nt, Human
gaucccaacacugcca

SEQ ID NO: 1190543 - RNA, 12 nt, Human
gaucccaacacu

SEQ ID NO: 1190544 - RNA, 20 nt, Human
gcaccggggccugggcagga

SEQ ID NO: 1190545 - RNA, 24 nt, Human
cagccccgcguggaacucgugucu

SEQ ID NO: 1190546 - RNA, 24 nt, Human
cagccucuccacucaugugacucu

SEQ ID NO: 1190547 - RNA, 15 nt, Human
caguauuugugggga

SEQ ID NO: 1190548 - RNA, 22 nt, Human
cacugccagcauuucccuuccu

SEQ ID NO: 1190549 - RNA, 18 nt, Human
cacugccagcauuucccu

SEQ ID NO: 1190550 - RNA, 15 nt, Human
caaacaggcucagag

SEQ ID NO: 1190551 - RNA, 14 nt, Human
caaacaggcucaga

SEQ ID NO: 1190552 - RNA, 22 nt, Human
auuuguggggagggauuugggg

SEQ ID NO: 1190553 - RNA, 16 nt, Human
auuugcuaugagcugg

SEQ ID NO: 1190554 - RNA, 20 nt, Human
auuugcuaugagcuggggau

SEQ ID NO: 1190555 - RNA, 19 nt, Human
auucuuucccaacaccucu

SEQ ID NO: 1190556 - RNA, 16 nt, Human
auucuuucccaacacc

SEQ ID NO: 1190557 - RNA, 22 nt, Human
cccugugccuugucacgccaga

SEQ ID NO: 1190558 - RNA, 20 nt, Human
cccugugccuugucacgcca

SEQ ID NO: 1190559 - RNA, 15 nt, Human
cccugugccuuguca

SEQ ID NO: 1190560 - RNA, 24 nt, Human
cccugugccuuggugugcuguauc

SEQ ID NO: 1190561 - RNA, 14 nt, Human
ccugacucucagca

SEQ ID NO: 1190562 - RNA, 14 nt, Human
cccgggagcucagg

SEQ ID NO: 1190563 - RNA, 14 nt, Human
ccccgacuuuuguu

SEQ ID NO: 1190564 - RNA, 12 nt, Human
ccaugagcuccu

SEQ ID NO: 1190565 - RNA, 22 nt, Human
ccagagucccugccuggaccag

SEQ ID NO: 1190566 - RNA, 19 nt, Human
ccagagucccugccuggac

SEQ ID NO: 1190567 - RNA, 18 nt, Human
ccagagucccugccugga

SEQ ID NO: 1190568 - RNA, 17 nt, Human
ccagagucccugccugg

SEQ ID NO: 1190569 - RNA, 16 nt, Human
ccagagucccugccug

SEQ ID NO: 1190570 - RNA, 23 nt, Human
cggcuccucgagaucccaacacu

SEQ ID NO: 1190571 - RNA, 21 nt, Human
cgugucuggcacagccuggcu

SEQ ID NO: 1190572 - RNA, 14 nt, Human
cgugucuggcacag

SEQ ID NO: 1190573 - RNA, 21 nt, Human
cuaaccugccgagaguccauc

SEQ ID NO: 1190574 - RNA, 19 nt, Human
cuaaccugccgagagucca

SEQ ID NO: 1190575 - RNA, 14 nt, Human
cucccuccucugcc

SEQ ID NO: 1190576 - RNA, 13 nt, Human
cucccuccucugc

SEQ ID NO: 1190577 - RNA, 16 nt, Human
cucaucuuucuuccaa

SEQ ID NO: 1190578 - RNA, 19 nt, Human
gucucccuccucugcccgg

SEQ ID NO: 1190579 - RNA, 19 nt, Human
aacucgugucuggcacagc

SEQ ID NO: 1190580 - RNA, 19 nt, Human
gucuggcacagccuggcug

SEQ ID NO: 1190581 - RNA, 17 nt, Human
gucuggcacagccuggc

SEQ ID NO: 1190582 - RNA, 17 nt, Human
gucaguauguggaagug

SEQ ID NO: 1190583 - RNA, 21 nt, Human
gucaguauguggaaguguggg

SEQ ID NO: 1190584 - RNA, 13 nt, Human
gucaguuguauca

SEQ ID NO: 1190585 - RNA, 12 nt, Human
aaauugugaugu

SEQ ID NO: 1190586 - RNA, 15 nt, Human
aaauugugauguguc

SEQ ID NO: 1190587 - RNA, 12 nt, Human
aaauuuauguga

SEQ ID NO: 1190588 - RNA, 15 nt, Human
aaauuuaugugaugg

SEQ ID NO: 1190589 - RNA, 22 nt, Human
guggccuaaccugccgagaguc

SEQ ID NO: 1190590 - RNA, 21 nt, Human
guggccuaaccugccgagagu

SEQ ID NO: 1190591 - RNA, 14 nt, Human
gugugggucugugu

SEQ ID NO: 1190592 - RNA, 20 nt, Human
gugugucacccuuaggccag

SEQ ID NO: 1190593 - RNA, 13 nt, Human
guguguauguggg

SEQ ID NO: 1190594 - RNA, 15 nt, Human
guguguauguggggg

SEQ ID NO: 1190595 - RNA, 19 nt, Human
gugggguagguugggagaa

SEQ ID NO: 1190596 - RNA, 16 nt, Human
gugugugggagugugu

SEQ ID NO: 1190597 - RNA, 14 nt, Human
aaggcucuuuugua

SEQ ID NO: 1190598 - RNA, 15 nt, Human
uacccccugugccuu

SEQ ID NO: 1190599 - RNA, 13 nt, Human
uaccucuuggcug

SEQ ID NO: 1190600 - RNA, 19 nt, Human
uaauuuaaaauugugaugu

SEQ ID NO: 1190601 - RNA, 20 nt, Human
uaauuuaaaauugugaugug

SEQ ID NO: 1190602 - RNA, 20 nt, Human
uaugccaccugaauaaagaa

SEQ ID NO: 1190603 - RNA, 21 nt, Human
uaugguaggaacugcugggcu

SEQ ID NO: 1190604 - RNA, 15 nt, Human
uaucagcacgugugg

SEQ ID NO: 1190605 - RNA, 14 nt, Human
uaucagcacgugug

SEQ ID NO: 1190606 - RNA, 21 nt, Human
uagacauuugcuaugagcugg

SEQ ID NO: 1190607 - RNA, 14 nt, Human
uagaagaagugugu

SEQ ID NO: 1190608 - RNA, 16 nt, Human
aauuccacacccucac

SEQ ID NO: 1190609 - RNA, 20 nt, Human
uccauccuacccccugugcc

SEQ ID NO: 1190610 - RNA, 16 nt, Human
uccauccuacccccug

SEQ ID NO: 1190611 - RNA, 23 nt, Human
acucgugucuggcacagccuggc

SEQ ID NO: 1190612 - RNA, 22 nt, Human
acucgugucuggcacagccugg

SEQ ID NO: 1190613 - RNA, 13 nt, Human
uccucuccugucu

SEQ ID NO: 1190614 - RNA, 22 nt, Human
uccucugcccgggagcucagga

SEQ ID NO: 1190615 - RNA, 16 nt, Human
uccucugcccgggagc

SEQ ID NO: 1190616 - RNA, 18 nt, Human
uaugugggggucugugug

SEQ ID NO: 1190617 - RNA, 19 nt, Human
uaugugggggucugugugu

SEQ ID NO: 1190618 - RNA, 20 nt, Human
uaugugggggucuguguguu

SEQ ID NO: 1190619 - RNA, 20 nt, Human
ucggggagccgggagccuga

SEQ ID NO: 1190620 - RNA, 14 nt, Human
ucuaguucugccag

SEQ ID NO: 1190621 - RNA, 15 nt, Human
ucuaccucuuggcug

SEQ ID NO: 1190622 - RNA, 22 nt, Human
ucuggcacagccuggcuguggc

SEQ ID NO: 1190623 - RNA, 23 nt, Human
ucuuggggaguuuaggguggggg

SEQ ID NO: 1190624 - RNA, 22 nt, Human
ucuuggggaguuuagggugggg

SEQ ID NO: 1190625 - RNA, 17 nt, Human
agagacgggcccuggug

SEQ ID NO: 1190626 - RNA, 21 nt, Human
ugacccucaucuuucuuccaa

SEQ ID NO: 1190627 - RNA, 17 nt, Human
agcauuucccuuccuuc

SEQ ID NO: 1190628 - RNA, 21 nt, Human
ugauagaaggcuauggggaua

SEQ ID NO: 1190629 - RNA, 24 nt, Human
ugauaagcagucauccucagauca

SEQ ID NO: 1190630 - RNA, 18 nt, Human
ugaguucauaaauuuaug

SEQ ID NO: 1190631 - RNA, 18 nt, Human
agccugacccucaucuuu

SEQ ID NO: 1190632 - RNA, 22 nt, Human
agcucaggaaccgaggcaggga

SEQ ID NO: 1190633 - RNA, 21 nt, Human
agcucaggaaccgaggcaggg

SEQ ID NO: 1190634 - RNA, 20 nt, Human
agcucaggaaccgaggcagg

SEQ ID NO: 1190635 - RNA, 21 nt, Human
agcugggacaccccgacuuuu

SEQ ID NO: 1190636 - RNA, 23 nt, Human
ugcuguauccauccauggggcug

SEQ ID NO: 1190637 - RNA, 18 nt, Human
ugcuauuguagagccaga

SEQ ID NO: 1190638 - RNA, 16 nt, Human
uggccuaaccugccga

SEQ ID NO: 1190639 - RNA, 21 nt, Human
uggccuguucuucuauggguu

SEQ ID NO: 1190640 - RNA, 12 nt, Human
aggacaguauuu

SEQ ID NO: 1190641 - RNA, 19 nt, Human
aggacaguauuugugggga

SEQ ID NO: 1190642 - RNA, 19 nt, Human
uggggaguuuagggugggg

SEQ ID NO: 1190643 - RNA, 18 nt, Human
uggggaguuuaggguggg

SEQ ID NO: 1190644 - RNA, 21 nt, Human
ugggguagguugggagaaugu

SEQ ID NO: 1190645 - RNA, 15 nt, Human
ugggguagguuggga

SEQ ID NO: 1190646 - RNA, 14 nt, Human
uggggcugauugua

SEQ ID NO: 1190647 - RNA, 16 nt, Human
agggggagagggcugc

SEQ ID NO: 1190648 - RNA, 15 nt, Human
agggggagagggcug

SEQ ID NO: 1190649 - RNA, 13 nt, Human
ugggucugugugu

SEQ ID NO: 1190650 - RNA, 12 nt, Human
ugggucugugug

SEQ ID NO: 1190651 - RNA, 13 nt, Human
ugguaggaacugc

SEQ ID NO: 1190652 - RNA, 20 nt, Human
ugguaggaacugcugggcuu

SEQ ID NO: 1190653 - RNA, 23 nt, Human
agucccugccuggaccagccucu

SEQ ID NO: 1190654 - RNA, 22 nt, Human
agucccugccuggaccagccuc

SEQ ID NO: 1190655 - RNA, 21 nt, Human
agucccugccuggaccagccu

SEQ ID NO: 1190656 - RNA, 15 nt, Human
agucccugccuggac

SEQ ID NO: 1190657 - RNA, 14 nt, Human
agucccugccugga

SEQ ID NO: 1190658 - RNA, 19 nt, Human
aguauguggaagugugggu

SEQ ID NO: 1190659 - RNA, 15 nt, Human
aguauguggaagugu

SEQ ID NO: 1190660 - RNA, 17 nt, Human
aguauguggaagugugg

SEQ ID NO: 1190661 - RNA, 18 nt, Human
ugucaguauguggaagug

SEQ ID NO: 1190662 - RNA, 19 nt, Human
ugucaguauguggaagugu

SEQ ID NO: 1190663 - RNA, 20 nt, Human
ugucaguauguggaagugug

SEQ ID NO: 1190664 - RNA, 22 nt, Human
ugucaguauguggaaguguggg

SEQ ID NO: 1190665 - RNA, 21 nt, Human
uguaauuuaaaauugugaugu

SEQ ID NO: 1190666 - RNA, 22 nt, Human
uguaauuuaaaauugugaugug

SEQ ID NO: 1190667 - RNA, 17 nt, Human
uguaauuuaaaauugug

SEQ ID NO: 1190668 - RNA, 18 nt, Human
uguaauuuaaaauuguga

SEQ ID NO: 1190669 - RNA, 20 nt, Human
uguaauuuaaaauugugaug

SEQ ID NO: 1190670 - RNA, 23 nt, Human
agguugggagaaugucaguaugu

SEQ ID NO: 1190671 - RNA, 19 nt, Human
uguggcacuggggcagggg

SEQ ID NO: 1190672 - RNA, 13 nt, Human
uguguguguguau

SEQ ID NO: 1190673 - RNA, 16 nt, Human
uguguguguguaugug

SEQ ID NO: 1190674 - RNA, 16 nt, Human
uguugugugugggagu

SEQ ID NO: 1190675 - RNA, 14 nt, Human
uguuguguguggga

SEQ ID NO: 1190676 - RNA, 15 nt, Human
uguugugugugggag

SEQ ID NO: 1190677 - RNA, 19 nt, Human
agugugggucugugugugu

SEQ ID NO: 1190678 - RNA, 23 nt, Human
agugugggucuguguguguguau

SEQ ID NO: 1190679 - RNA, 15 nt, Human
agugugggucugugu

SEQ ID NO: 1190680 - RNA, 16 nt, Human
agugugggucugugug

SEQ ID NO: 1190681 - RNA, 17 nt, Human
agugugggucugugugu

SEQ ID NO: 1190682 - RNA, 16 nt, Human
uuagccuuugucccag

SEQ ID NO: 1190683 - RNA, 16 nt, Human
uucuaguucugccagg

SEQ ID NO: 1190684 - RNA, 15 nt, Human
uucuaguucugccag

SEQ ID NO: 1190685 - RNA, 13 nt, Human
aucaggccauugu

SEQ ID NO: 1190686 - RNA, 16 nt, Human
auggccugggggaugu

SEQ ID NO: 1190687 - RNA, 21 nt, Human
auggaaugaugggucaguugu

SEQ ID NO: 1190688 - RNA, 12 nt, Human
uuuaugugaugg

SEQ ID NO: 1190689 - RNA, 11 nt, Human
uuuaugugugu

SEQ ID NO: 1190690 - RNA, 13 nt, Human
uuuaugugugugu

SEQ ID NO: 1190691 - RNA, 16 nt, Human
aucuguaccucugccu

SEQ ID NO: 1190692 - RNA, 20 nt, Human
auuuaaaauugugauguguc

SEQ ID NO: 1190693 - RNA, 23 nt, Human
auugcaggagucccugccaucau

SEQ ID NO: 1190694 - RNA, 15 nt, Human
auguuuacagaggac

SEQ ID NO: 1190695 - RNA, 17 nt, Human
auguuuacagaggacag

SEQ ID NO: 1190696 - RNA, 19 nt, Human
auguuuacagaggacagua

SEQ ID NO: 1190697 - RNA, 17 nt, Human
uuuguaaauuuauguga

SEQ ID NO: 1190698 - RNA, 19 nt, Human
uuugcuaugagcuggggau

SEQ ID NO: 1190699 - RNA, 13 nt, Human
augucaguaugug

SEQ ID NO: 1190700 - RNA, 14 nt, Human
augucaguaugugg

SEQ ID NO: 1190701 - RNA, 16 nt, Human
augucaguauguggaa

SEQ ID NO: 1190702 - RNA, 17 nt, Human
caagccuuggcucuacc

SEQ ID NO: 1190703 - RNA, 14 nt, Human
cccucaucuuucuu

SEQ ID NO: 1190704 - RNA, 18 nt, Human
cccugccuggaccagccu

SEQ ID NO: 1190705 - RNA, 13 nt, Human
cccugccuggacc

SEQ ID NO: 1190706 - RNA, 12 nt, Human
cccugccuggac

SEQ ID NO: 1190707 - RNA, 20 nt, Human
cccugccaucauguuuacag

SEQ ID NO: 1190708 - RNA, 19 nt, Human
ccggcuuuguggcacuggg

SEQ ID NO: 1190709 - RNA, 17 nt, Human
ccggcuuuguggcacug

SEQ ID NO: 1190710 - RNA, 19 nt, Human
ccggggccugggcaggagg

SEQ ID NO: 1190711 - RNA, 15 nt, Human
ccggggccugggcag

SEQ ID NO: 1190712 - RNA, 15 nt, Human
ccgggagcucaggaa

SEQ ID NO: 1190713 - RNA, 13 nt, Human
ccgggagcucagg

SEQ ID NO: 1190714 - RNA, 18 nt, Human
ccucagccccgcguggaa

SEQ ID NO: 1190715 - RNA, 23 nt, Human
ccuccauccuacccccugugccu

SEQ ID NO: 1190716 - RNA, 22 nt, Human
ccuccauccuacccccugugcc

SEQ ID NO: 1190717 - RNA, 17 nt, Human
ccuccauccuacccccu

SEQ ID NO: 1190718 - RNA, 21 nt, Human
cccagcuaugguucucucgca

SEQ ID NO: 1190719 - RNA, 20 nt, Human
ccaucauguuuacagaggac

SEQ ID NO: 1190720 - RNA, 22 nt, Human
ccaucauguuuacagaggacag

SEQ ID NO: 1190721 - RNA, 19 nt, Human
cauggggcugauuguauuu

SEQ ID NO: 1190722 - RNA, 21 nt, Human
cauuaccucagugagaagcca

SEQ ID NO: 1190723 - RNA, 22 nt, Human
cauuaccucagugagaagccag

SEQ ID NO: 1190724 - RNA, 15 nt, Human
cauaccuggcccugu

SEQ ID NO: 1190725 - RNA, 18 nt, Human
cauaaucacaacccuuca

SEQ ID NO: 1190726 - RNA, 16 nt, Human
caguggcuggaucugu

SEQ ID NO: 1190727 - RNA, 18 nt, Human
caguggcuggaucuguga

SEQ ID NO: 1190728 - RNA, 20 nt, Human
caguggcuggaucugugagg

SEQ ID NO: 1190729 - RNA, 18 nt, Human
cggcugggaggagggcag

SEQ ID NO: 1190730 - RNA, 17 nt, Human
cgggagccugacccuca

SEQ ID NO: 1190731 - RNA, 12 nt, Human
cggcugggagga

SEQ ID NO: 1190732 - RNA, 19 nt, Human
cggggccugggcaggaggg

SEQ ID NO: 1190733 - RNA, 17 nt, Human
cggggccugggcaggag

SEQ ID NO: 1190734 - RNA, 21 nt, Human
cgggggcagucugagagaggc

SEQ ID NO: 1190735 - RNA, 18 nt, Human
cgggggcagucugagaga

SEQ ID NO: 1190736 - RNA, 17 nt, Human
cgggggcagucugagag

SEQ ID NO: 1190737 - RNA, 15 nt, Human
cgggucaucuguacc

SEQ ID NO: 1190738 - RNA, 22 nt, Human
cgggucaucuguaccucugccu

SEQ ID NO: 1190739 - RNA, 23 nt, Human
cguggcuguggcauccagagucc

SEQ ID NO: 1190740 - RNA, 16 nt, Human
cguuguccucagcccc

SEQ ID NO: 1190741 - RNA, 14 nt, Human
cuacccccugugcc

SEQ ID NO: 1190742 - RNA, 18 nt, Human
cuccauccuacccccugu

SEQ ID NO: 1190743 - RNA, 22 nt, Human
cuccauccuacccccugugccu

SEQ ID NO: 1190744 - RNA, 20 nt, Human
cuccauccuacccccugugc

SEQ ID NO: 1190745 - RNA, 23 nt, Human
cuccauccuacccccugugccuu

SEQ ID NO: 1190746 - RNA, 24 nt, Human
cuccucgagaucccaacacugcca

SEQ ID NO: 1190747 - RNA, 21 nt, Human
cuccucgagaucccaacacug

SEQ ID NO: 1190748 - RNA, 17 nt, Human
cuccucgagaucccaac

SEQ ID NO: 1190749 - RNA, 21 nt, Human
cucuccacucaugugacucuu

SEQ ID NO: 1190750 - RNA, 22 nt, Human
cucuccacucaugugacucuuu

SEQ ID NO: 1190751 - RNA, 18 nt, Human
cucuccugucucccuccu

SEQ ID NO: 1190752 - RNA, 17 nt, Human
cucuccugucucccucc

SEQ ID NO: 1190753 - RNA, 15 nt, Human
cucuccugucucccu

SEQ ID NO: 1190754 - RNA, 23 nt, Human
cucuuggggaguuuagggugggg

SEQ ID NO: 1190755 - RNA, 19 nt, Human
cugcccgggagcucaggaa

SEQ ID NO: 1190756 - RNA, 11 nt, Human
cugccaggaga

SEQ ID NO: 1190757 - RNA, 21 nt, Human
cuggcacagccuggcuguggc

SEQ ID NO: 1190758 - RNA, 16 nt, Human
cuggcacagccuggcu

SEQ ID NO: 1190759 - RNA, 23 nt, Human
cuggcacagccuggcuguggccu

SEQ ID NO: 1190760 - RNA, 18 nt, Human
cuggcuguggccuaaccu

SEQ ID NO: 1190761 - RNA, 19 nt, Human
cugggaggagggcaggcau

SEQ ID NO: 1190762 - RNA, 14 nt, Human
cuguaccucugccu

SEQ ID NO: 1190763 - RNA, 21 nt, Human
cuuggggaguuuagggugggg

SEQ ID NO: 1190764 - RNA, 20 nt, Human
cuuggggaguuuaggguggg

SEQ ID NO: 1190765 - RNA, 23 nt, Human
cuugucacgccagacuucccacg

SEQ ID NO: 1190766 - RNA, 22 nt, Human
cuuucuuccaaacaggcucaga

SEQ ID NO: 1190767 - RNA, 19 nt, Human
cuuucuuccaaacaggcuc

SEQ ID NO: 1190768 - RNA, 13 nt, Human
cuuucuuccaaac

SEQ ID NO: 1190769 - RNA, 12 nt, Human
cuuuggacuugu

SEQ ID NO: 1190770 - RNA, 21 nt, Human
gaaggaucccaugagcuccuu

SEQ ID NO: 1190771 - RNA, 13 nt, Human
gaagaaguguguc

SEQ ID NO: 1190772 - RNA, 20 nt, Human
gacaccuaggcuaggguggg

SEQ ID NO: 1190773 - RNA, 16 nt, Human
gacaccuaggcuaggg

SEQ ID NO: 1190774 - RNA, 15 nt, Human
gacaccuaggcuagg

SEQ ID NO: 1190775 - RNA, 17 nt, Human
gaccuuuccugaggaag

SEQ ID NO: 1190776 - RNA, 21 nt, Human
gagagaggccauucuuuccca

SEQ ID NO: 1190777 - RNA, 13 nt, Human
gagagaggccauu

SEQ ID NO: 1190778 - RNA, 18 nt, Human
gacuugucccgggacacc

SEQ ID NO: 1190779 - RNA, 22 nt, Human
gagaagccagcuuuccucauca

SEQ ID NO: 1190780 - RNA, 21 nt, Human
gagccugacccucaucuuucu

SEQ ID NO: 1190781 - RNA, 22 nt, Human
gagcucaggaaccgaggcaggg

SEQ ID NO: 1190782 - RNA, 21 nt, Human
gagcucaggaaccgaggcagg

SEQ ID NO: 1190783 - RNA, 20 nt, Human
gagcucaggaaccgaggcag

SEQ ID NO: 1190784 - RNA, 17 nt, Human
gaucccaugagcuccuu

SEQ ID NO: 1190785 - RNA, 14 nt, Human
gaucauuaucagcc

SEQ ID NO: 1190786 - RNA, 13 nt, Human
gauagaugugugg

SEQ ID NO: 1190787 - RNA, 20 nt, Human
gauggcaaagaaggagagca

SEQ ID NO: 1190788 - RNA, 21 nt, Human
gaucugugaggggcucucuca

SEQ ID NO: 1190789 - RNA, 20 nt, Human
gauuuggggcucagaguggg

SEQ ID NO: 1190790 - RNA, 23 nt, Human
gauugcaggagucccugccauca

SEQ ID NO: 1190791 - RNA, 20 nt, Human
gcaggggccgggggcagucu

SEQ ID NO: 1190792 - RNA, 19 nt, Human
gcaggggccgggggcaguc

SEQ ID NO: 1190793 - RNA, 18 nt, Human
gcauuauauuuguaaauu

SEQ ID NO: 1190794 - RNA, 19 nt, Human
gcccgggagcucaggaacc

SEQ ID NO: 1190795 - RNA, 17 nt, Human
gcccgggagcucaggaa

SEQ ID NO: 1190796 - RNA, 15 nt, Human
gcccgggagcucagg

SEQ ID NO: 1190797 - RNA, 17 nt, Human
gccaucauguuuacaga

SEQ ID NO: 1190798 - RNA, 21 nt, Human
gccaucauguuuacagaggac

SEQ ID NO: 1190799 - RNA, 17 nt, Human
gccuaaccugccgagag

SEQ ID NO: 1190800 - RNA, 24 nt, Human
gccucuccacucaugugacucuuu

SEQ ID NO: 1190801 - RNA, 21 nt, Human
gccucuccacucaugugacuc

SEQ ID NO: 1190802 - RNA, 20 nt, Human
gccucucauuccagaggaag

SEQ ID NO: 1190803 - RNA, 19 nt, Human
gccucucauuccagaggaa

SEQ ID NO: 1190804 - RNA, 18 nt, Human
gccuuuggacuugucccg

SEQ ID NO: 1190805 - RNA, 18 nt, Human
gcgcggcugggaggaggg

SEQ ID NO: 1190806 - RNA, 12 nt, Human
gcgcggcuggga

SEQ ID NO: 1190807 - RNA, 19 nt, Human
guagugauuuuuaugccac

SEQ ID NO: 1190808 - RNA, 14 nt, Human
guagguugggagaa

SEQ ID NO: 1190809 - RNA, 22 nt, Human
gucagcugggacaccccgacuu

SEQ ID NO: 1190810 - RNA, 16 nt, Human
gucccugaagagaagg

SEQ ID NO: 1190811 - RNA, 13 nt, Human
gucccugccugga

SEQ ID NO: 1190812 - RNA, 14 nt, Human
gucccugccuggac

SEQ ID NO: 1190813 - RNA, 18 nt, Human
gucugagagaggccauuc

SEQ ID NO: 1190814 - RNA, 15 nt, Human
gucugagagaggcca

SEQ ID NO: 1190815 - RNA, 14 nt, Human
gucugagagaggcc

SEQ ID NO: 1190816 - RNA, 13 nt, Human
gucugagagaggc

SEQ ID NO: 1190817 - RNA, 11 nt, Human
gucugugugug

SEQ ID NO: 1190818 - RNA, 12 nt, Human
gucugugugugu

SEQ ID NO: 1190819 - RNA, 16 nt, Human
gucuguguguguguau

SEQ ID NO: 1190820 - RNA, 20 nt, Human
gucuguguguguguaugugg

SEQ ID NO: 1190821 - RNA, 11 nt, Human
gucuguguguu

SEQ ID NO: 1190822 - RNA, 21 nt, Human
gucuguguguuuaugugugug

SEQ ID NO: 1190823 - RNA, 22 nt, Human
gucuguguguuuaugugugugu

SEQ ID NO: 1190824 - RNA, 21 nt, Human
gugacuauggagcugagcagg

SEQ ID NO: 1190825 - RNA, 15 nt, Human
gugaggaugucuggg

SEQ ID NO: 1190826 - RNA, 14 nt, Human
gugccuuuugccau

SEQ ID NO: 1190827 - RNA, 21 nt, Human
gugccaggauggaaugauggg

SEQ ID NO: 1190828 - RNA, 16 nt, Human
guggcucgggaggcga

SEQ ID NO: 1190829 - RNA, 17 nt, Human
guggcuggaucugugag

SEQ ID NO: 1190830 - RNA, 21 nt, Human
guggggagagacgggcccugg

SEQ ID NO: 1190831 - RNA, 20 nt, Human
guguaauuuaaaauugugau

SEQ ID NO: 1190832 - RNA, 22 nt, Human
guguaauuuaaaauugugaugu

SEQ ID NO: 1190833 - RNA, 23 nt, Human
guguaauuuaaaauugugaugug

SEQ ID NO: 1190834 - RNA, 21 nt, Human
guguccugcaccggggccugg

SEQ ID NO: 1190835 - RNA, 17 nt, Human
gugucuggcacagccug

SEQ ID NO: 1190836 - RNA, 17 nt, Human
gugugggaguguguaau

SEQ ID NO: 1190837 - RNA, 14 nt, Human
guguguuuaugugu

SEQ ID NO: 1190838 - RNA, 15 nt, Human
guguguuuaugugug

SEQ ID NO: 1190839 - RNA, 16 nt, Human
guguguuuaugugugu

SEQ ID NO: 1190840 - RNA, 12 nt, Human
guguguugugug

SEQ ID NO: 1190841 - RNA, 14 nt, Human
guguguugugugug

SEQ ID NO: 1190842 - RNA, 17 nt, Human
guguguuguguguggga

SEQ ID NO: 1190843 - RNA, 14 nt, Human
guucugccaggaga

SEQ ID NO: 1190844 - RNA, 13 nt, Human
guucugccaggag

SEQ ID NO: 1190845 - RNA, 12 nt, Human
guucugccagga

SEQ ID NO: 1190846 - RNA, 23 nt, Human
guuguccucagccccgcguggaa

SEQ ID NO: 1190847 - RNA, 17 nt, Human
guuguccucagccccgc

SEQ ID NO: 1190848 - RNA, 12 nt, Human
guuguguguggg

SEQ ID NO: 1190849 - RNA, 13 nt, Human
guuguguguggga

SEQ ID NO: 1190850 - RNA, 14 nt, Human
guugugugugggag

SEQ ID NO: 1190851 - RNA, 16 nt, Human
guugugugugggagug

SEQ ID NO: 1190852 - RNA, 22 nt, Human
guugugugugggaguguguaau

SEQ ID NO: 1190853 - RNA, 16 nt, Human
guuuagaagaagugug

SEQ ID NO: 1190854 - RNA, 13 nt, Human
uaaauuuauguga

SEQ ID NO: 1190855 - RNA, 22 nt, Human
uaagugccaggauggaaugaug

SEQ ID NO: 1190856 - RNA, 22 nt, Human
uauaaacaugcuugcauuauau

SEQ ID NO: 1190857 - RNA, 20 nt, Human
uauauuuguaaauuuaugug

SEQ ID NO: 1190858 - RNA, 17 nt, Human
ucaucuuucuuccaaac

SEQ ID NO: 1190859 - RNA, 14 nt, Human
ucaucuuucuucca

SEQ ID NO: 1190860 - RNA, 23 nt, Human
ucagccuccauccuacccccugu

SEQ ID NO: 1190861 - RNA, 20 nt, Human
ucagaucauuaucagccugu

SEQ ID NO: 1190862 - RNA, 15 nt, Human
uccagagucccugcc

SEQ ID NO: 1190863 - RNA, 15 nt, Human
ucccaacacugccag

SEQ ID NO: 1190864 - RNA, 14 nt, Human
ucccaacacugcca

SEQ ID NO: 1190865 - RNA, 16 nt, Human
ucccaacacugccagc

SEQ ID NO: 1190866 - RNA, 23 nt, Human
ucccaugagcuccuuaaggcucu

SEQ ID NO: 1190867 - RNA, 23 nt, Human
uccucgagaucccaacacugcca

SEQ ID NO: 1190868 - RNA, 16 nt, Human
uccucgagaucccaac

SEQ ID NO: 1190869 - RNA, 19 nt, Human
uccugucccucauccauag

SEQ ID NO: 1190870 - RNA, 19 nt, Human
ucuuuccaaccggcuuugu

SEQ ID NO: 1190871 - RNA, 11 nt, Human
ucugugugugu

SEQ ID NO: 1190872 - RNA, 13 nt, Human
ucugugugugugu

SEQ ID NO: 1190873 - RNA, 22 nt, Human
ucuucauuaccucagugagaag

SEQ ID NO: 1190874 - RNA, 19 nt, Human
ugacucuuuccaaccggcu

SEQ ID NO: 1190875 - RNA, 13 nt, Human
ugacucuuuccaa

SEQ ID NO: 1190876 - RNA, 16 nt, Human
ugacucuuuccaaccg

SEQ ID NO: 1190877 - RNA, 14 nt, Human
ugacucuuuccaac

SEQ ID NO: 1190878 - RNA, 20 nt, Human
ugaagagaagggcagggcug

SEQ ID NO: 1190879 - RNA, 22 nt, Human
ugaagagaagggcagggcugag

SEQ ID NO: 1190880 - RNA, 22 nt, Human
ugcaccggggccugggcaggag

SEQ ID NO: 1190881 - RNA, 16 nt, Human
ugcaccggggccuggg

SEQ ID NO: 1190882 - RNA, 12 nt, Human
ugcaccggggcc

SEQ ID NO: 1190883 - RNA, 18 nt, Human
ugccaggauggaaugaug

SEQ ID NO: 1190884 - RNA, 18 nt, Human
uggaacucgugucuggca

SEQ ID NO: 1190885 - RNA, 20 nt, Human
uggaaugaugggucaguugu

SEQ ID NO: 1190886 - RNA, 21 nt, Human
ugggacaccccgacuuuuguu

SEQ ID NO: 1190887 - RNA, 21 nt, Human
ugggagugaggaugucugggc

SEQ ID NO: 1190888 - RNA, 22 nt, Human
ugggagugaggaugucugggcc

SEQ ID NO: 1190889 - RNA, 18 nt, Human
ugggggucuguguguuua

SEQ ID NO: 1190890 - RNA, 11 nt, Human
ugggggaugua

SEQ ID NO: 1190891 - RNA, 14 nt, Human
ugucacgccagacu

SEQ ID NO: 1190892 - RNA, 22 nt, Human
ugucacccuuaggccagcacca

SEQ ID NO: 1190893 - RNA, 14 nt, Human
uguaccucugccuc

SEQ ID NO: 1190894 - RNA, 17 nt, Human
ugucuggcacagccugg

SEQ ID NO: 1190895 - RNA, 20 nt, Human
ugugccuugucacgccagac

SEQ ID NO: 1190896 - RNA, 19 nt, Human
ugugccuugucacgccaga

SEQ ID NO: 1190897 - RNA, 17 nt, Human
ugugccuugucacgcca

SEQ ID NO: 1190898 - RNA, 17 nt, Human
ugugccuuggugugcug

SEQ ID NO: 1190899 - RNA, 16 nt, Human
ugugccuuuugccauc

SEQ ID NO: 1190900 - RNA, 15 nt, Human
uguggccuaaccugc

SEQ ID NO: 1190901 - RNA, 15 nt, Human
uguggaagugugggu

SEQ ID NO: 1190902 - RNA, 14 nt, Human
ugugggagugugua

SEQ ID NO: 1190903 - RNA, 15 nt, Human
ugugggaguguguaa

SEQ ID NO: 1190904 - RNA, 19 nt, Human
uguguaauuuaaaauugug

SEQ ID NO: 1190905 - RNA, 22 nt, Human
uguguaauuuaaaauugugaug

SEQ ID NO: 1190906 - RNA, 23 nt, Human
uguguaauuuaaaauugugaugu

SEQ ID NO: 1190907 - RNA, 11 nt, Human
uguguaauuua

SEQ ID NO: 1190908 - RNA, 18 nt, Human
uguguaauuuaaaauugu

SEQ ID NO: 1190909 - RNA, 16 nt, Human
uguuuagaagaagugu

SEQ ID NO: 1190910 - RNA, 16 nt, Human
uguucuuuugucccag

SEQ ID NO: 1190911 - RNA, 16 nt, Human
ugugugggagugugua

SEQ ID NO: 1190912 - RNA, 14 nt, Human
ugugugggagugug

SEQ ID NO: 1190913 - RNA, 15 nt, Human
ugugugggagugugu

SEQ ID NO: 1190914 - RNA, 11 nt, Human
uguguaugugg

SEQ ID NO: 1190915 - RNA, 12 nt, Human
uguguauguggg

SEQ ID NO: 1190916 - RNA, 13 nt, Human
uguguaugugggg

SEQ ID NO: 1190917 - RNA, 19 nt, Human
cugcaccggggccugggca

SEQ ID NO: 1190918 - RNA, 18 nt, Human
cugcaccggggccugggc

SEQ ID NO: 1190919 - RNA, 16 nt, Human
cugcaccggggccugg

SEQ ID NO: 1190920 - RNA, 14 nt, Human
cugcaccggggccu

SEQ ID NO: 1190921 - RNA, 14 nt, Human
cuggaucugugagg

SEQ ID NO: 1190922 - RNA, 13 nt, Human
cugggcaggaggg

SEQ ID NO: 1190923 - RNA, 13 nt, Human
cuggcccugugcc

SEQ ID NO: 1190924 - RNA, 21 nt, Human
gaagugugggucugugugugu

SEQ ID NO: 1190925 - RNA, 24 nt, Human
gaagugugggucugugugugugua

SEQ ID NO: 1190926 - RNA, 15 nt, Human
gaaccgaggcaggga

SEQ ID NO: 1190927 - RNA, 12 nt, Human
gaaccgaggcag

SEQ ID NO: 1190928 - RNA, 17 nt, Human
gaacugcugggcuuggc

SEQ ID NO: 1190929 - RNA, 20 nt, Human
gaacugcugggcuuggcagc

SEQ ID NO: 1190930 - RNA, 13 nt, Human
gaguuggcuggga

SEQ ID NO: 1190931 - RNA, 23 nt, Human
gaggugcuucuaguucugccagg

SEQ ID NO: 1190932 - RNA, 22 nt, Human
gaggugcuucuaguucugccag

SEQ ID NO: 1190933 - RNA, 17 nt, Human
gaguccaucagccucca

SEQ ID NO: 1190934 - RNA, 18 nt, Human
gagucagggagagcugaa

SEQ ID NO: 1190935 - RNA, 16 nt, Human
gagggcugccuuugga

SEQ ID NO: 1190936 - RNA, 9 nt, Human
gagggcugc

SEQ ID NO: 1190937 - RNA, 19 nt, Human
gcaccggggccugggcagg

SEQ ID NO: 1190938 - RNA, 16 nt, Human
gcaccggggccugggc

SEQ ID NO: 1190939 - RNA, 14 nt, Human
gcaccggggccugg

SEQ ID NO: 1190940 - RNA, 19 nt, Human
gcuauggggauagaugugu

SEQ ID NO: 1190941 - RNA, 21 nt, Human
gcuauggggauagaugugugg

SEQ ID NO: 1190942 - RNA, 12 nt, Human
gccauucuuucc

SEQ ID NO: 1190943 - RNA, 17 nt, Human
ggagagacgggcccugg

SEQ ID NO: 1190944 - RNA, 15 nt, Human
ggagagacgggcccu

SEQ ID NO: 1190945 - RNA, 18 nt, Human
ggccagcaccaucucuuu

SEQ ID NO: 1190946 - RNA, 23 nt, Human
ggcaggcaucggggagccgggag

SEQ ID NO: 1190947 - RNA, 15 nt, Human
aaaaagggaggggga

SEQ ID NO: 1190948 - RNA, 20 nt, Human
ggcuccucgagaucccaaca

SEQ ID NO: 1190949 - RNA, 17 nt, Human
ggcuggaucugugaggg

SEQ ID NO: 1190950 - RNA, 14 nt, Human
gggagggggagagg

SEQ ID NO: 1190951 - RNA, 15 nt, Human
ggggccugggcagga

SEQ ID NO: 1190952 - RNA, 12 nt, Human
ggggccugggca

SEQ ID NO: 1190953 - RNA, 23 nt, Human
ggggucuguguguuuaugugugu

SEQ ID NO: 1190954 - RNA, 16 nt, Human
aaaauugugauguguc

SEQ ID NO: 1190955 - RNA, 14 nt, Human
cucaugugacucuu

SEQ ID NO: 1190956 - RNA, 24 nt, Human
cuccucugcccgggagcucaggaa

SEQ ID NO: 1190957 - RNA, 22 nt, Human
cuccucugcccgggagcucagg

SEQ ID NO: 1190958 - RNA, 16 nt, Human
cuccugucucccuccu

SEQ ID NO: 1190959 - RNA, 20 nt, Human
cucaggccugacucucagca

SEQ ID NO: 1190960 - RNA, 23 nt, Human
cucaggccgaaggaggagucagg

SEQ ID NO: 1190961 - RNA, 23 nt, Human
cucaugauagaaggcuaugggga

SEQ ID NO: 1190962 - RNA, 22 nt, Human
ccucugcccgggagcucaggaa

SEQ ID NO: 1190963 - RNA, 21 nt, Human
ccucugcccgggagcucagga

SEQ ID NO: 1190964 - RNA, 22 nt, Human
ccucuuggggaguuuagggugg

SEQ ID NO: 1190965 - RNA, 15 nt, Human
ccucuuggcugccuu

SEQ ID NO: 1190966 - RNA, 23 nt, Human
ccucuuggggaguuuaggguggg

SEQ ID NO: 1190967 - RNA, 19 nt, Human
ccugccuggaccagccucu

SEQ ID NO: 1190968 - RNA, 12 nt, Human
ccugccuggacc

SEQ ID NO: 1190969 - RNA, 21 nt, Human
ccaugagcuccuuaaggcucu

SEQ ID NO: 1190970 - RNA, 13 nt, Human
ccauugguguuga

SEQ ID NO: 1190971 - RNA, 21 nt, Human
ccccgcguggaacucgugucu

SEQ ID NO: 1190972 - RNA, 18 nt, Human
ccagagaaaaagggaggg

SEQ ID NO: 1190973 - RNA, 23 nt, Human
ccagacuucccacggcuccucga

SEQ ID NO: 1190974 - RNA, 13 nt, Human
auucuuucccaac

SEQ ID NO: 1190975 - RNA, 17 nt, Human
auuuuuaugccaccuga

SEQ ID NO: 1190976 - RNA, 19 nt, Human
caccuaggcuagggugggg

SEQ ID NO: 1190977 - RNA, 18 nt, Human
caccuaggcuaggguggg

SEQ ID NO: 1190978 - RNA, 17 nt, Human
cagcacguguggccugu

SEQ ID NO: 1190979 - RNA, 17 nt, Human
caucuguaccucugccu

SEQ ID NO: 1190980 - RNA, 22 nt, Human
aacacugccagcauuucccuuc

SEQ ID NO: 1190981 - RNA, 12 nt, Human
aacacugccagc

SEQ ID NO: 1190982 - RNA, 16 nt, Human
gucucccuccucugcc

SEQ ID NO: 1190983 - RNA, 12 nt, Human
gucucccuccuc

SEQ ID NO: 1190984 - RNA, 15 nt, Human
guauguggaagugug

SEQ ID NO: 1190985 - RNA, 16 nt, Human
guauguggaagugugg

SEQ ID NO: 1190986 - RNA, 17 nt, Human
guauguggaaguguggg

SEQ ID NO: 1190987 - RNA, 18 nt, Human
guauguggaagugugggu

SEQ ID NO: 1190988 - RNA, 21 nt, Human
guauguggaagugugggucug

SEQ ID NO: 1190989 - RNA, 19 nt, Human
guaugugggggucugugug

SEQ ID NO: 1190990 - RNA, 20 nt, Human
guaugugggggucugugugu

SEQ ID NO: 1190991 - RNA, 16 nt, Human
guaggaacugcugggc

SEQ ID NO: 1190992 - RNA, 14 nt, Human
guggcacuggggca

SEQ ID NO: 1190993 - RNA, 21 nt, Human
guggaagugugggucugugug

SEQ ID NO: 1190994 - RNA, 22 nt, Human
guggaagugugggucugugugu

SEQ ID NO: 1190995 - RNA, 23 nt, Human
gugcuauuguagagccagagguc

SEQ ID NO: 1190996 - RNA, 14 nt, Human
guggaagugugggu

SEQ ID NO: 1190997 - RNA, 15 nt, Human
guggaaguguggguc

SEQ ID NO: 1190998 - RNA, 19 nt, Human
guggaagugugggucugug

SEQ ID NO: 1190999 - RNA, 20 nt, Human
guggaagugugggucugugu

SEQ ID NO: 1191000 - RNA, 19 nt, Human
aagaagugugucacccuua

SEQ ID NO: 1191001 - RNA, 23 nt, Human
guggggggggggcgcggcuggga

SEQ ID NO: 1191002 - RNA, 13 nt, Human
gugggucugugug

SEQ ID NO: 1191003 - RNA, 16 nt, Human
gugggucugugugugu

SEQ ID NO: 1191004 - RNA, 13 nt, Human
gugggagugugua

SEQ ID NO: 1191005 - RNA, 14 nt, Human
gugggaguguguaa

SEQ ID NO: 1191006 - RNA, 15 nt, Human
guguuguguguggga

SEQ ID NO: 1191007 - RNA, 12 nt, Human
guguguaugugg

SEQ ID NO: 1191008 - RNA, 14 nt, Human
guguguaauuuaaa

SEQ ID NO: 1191009 - RNA, 16 nt, Human
guuuucuuaacuuaaa

SEQ ID NO: 1191010 - RNA, 18 nt, Human
guuguaucagcacgugug

SEQ ID NO: 1191011 - RNA, 13 nt, Human
guuuaugugugug

SEQ ID NO: 1191012 - RNA, 16 nt, Human
guuuaugugugugugu

SEQ ID NO: 1191013 - RNA, 23 nt, Human
aaggcuauggggauagaugugug

SEQ ID NO: 1191014 - RNA, 17 nt, Human
acaccccgacuuuuguu

SEQ ID NO: 1191015 - RNA, 18 nt, Human
uacagaggacaguauuug

SEQ ID NO: 1191016 - RNA, 14 nt, Human
uacagaggacagua

SEQ ID NO: 1191017 - RNA, 15 nt, Human
uaauuuaaaauugug

SEQ ID NO: 1191018 - RNA, 16 nt, Human
uaauuuaaaauuguga

SEQ ID NO: 1191019 - RNA, 18 nt, Human
accagagaaaaagggagg

SEQ ID NO: 1191020 - RNA, 16 nt, Human
uauuuguaaauuuaug

SEQ ID NO: 1191021 - RNA, 17 nt, Human
uauuuguaaauuuaugu

SEQ ID NO: 1191022 - RNA, 22 nt, Human
uauuuguaaauuuaugugaugg

SEQ ID NO: 1191023 - RNA, 17 nt, Human
ucaggaaccgaggcagg

SEQ ID NO: 1191024 - RNA, 21 nt, Human
uccaaccggcuuuguggcacu

SEQ ID NO: 1191025 - RNA, 21 nt, Human
uccacucaugugacucuuucc

SEQ ID NO: 1191026 - RNA, 14 nt, Human
uccacucaugugac

SEQ ID NO: 1191027 - RNA, 21 nt, Human
ucccgggacaccuaggcuagg

SEQ ID NO: 1191028 - RNA, 19 nt, Human
acucaugugacucuuucca

SEQ ID NO: 1191029 - RNA, 21 nt, Human
ucgagaucccaacacugccag

SEQ ID NO: 1191030 - RNA, 18 nt, Human
ucgagaucccaacacugc

SEQ ID NO: 1191031 - RNA, 22 nt, Human
ucgagaucccaacacugccagc

SEQ ID NO: 1191032 - RNA, 17 nt, Human
ucgagaucccaacacug

SEQ ID NO: 1191033 - RNA, 23 nt, Human
acuggccaguggcuggaucugug

SEQ ID NO: 1191034 - RNA, 23 nt, Human
acuugucccgggacaccuaggcu

SEQ ID NO: 1191035 - RNA, 16 nt, Human
ucucauuccagaggaa

SEQ ID NO: 1191036 - RNA, 20 nt, Human
ucugagagaggccauucuuu

SEQ ID NO: 1191037 - RNA, 14 nt, Human
ucugagagaggcca

SEQ ID NO: 1191038 - RNA, 13 nt, Human
ucuuucuuccaaa

SEQ ID NO: 1191039 - RNA, 19 nt, Human
agacuucccacggcuccuc

SEQ ID NO: 1191040 - RNA, 14 nt, Human
agacuuaucaacau

SEQ ID NO: 1191041 - RNA, 21 nt, Human
agacauuugcuaugagcuggg

SEQ ID NO: 1191042 - RNA, 17 nt, Human
agaaugucaguaugugg

SEQ ID NO: 1191043 - RNA, 19 nt, Human
agaaugucaguauguggaa

SEQ ID NO: 1191044 - RNA, 15 nt, Human
agaaugucaguaugu

SEQ ID NO: 1191045 - RNA, 16 nt, Human
agaaugucaguaugug

SEQ ID NO: 1191046 - RNA, 21 nt, Human
agaggccauucuuucccaaca

SEQ ID NO: 1191047 - RNA, 17 nt, Human
agagucccugccuggac

SEQ ID NO: 1191048 - RNA, 14 nt, Human
agagucccugccug

SEQ ID NO: 1191049 - RNA, 23 nt, Human
agaguccaucagccuccauccua

SEQ ID NO: 1191050 - RNA, 20 nt, Human
agaucccaacacugccagca

SEQ ID NO: 1191051 - RNA, 19 nt, Human
agaucccaacacugccagc

SEQ ID NO: 1191052 - RNA, 18 nt, Human
agaucccaacacugccag

SEQ ID NO: 1191053 - RNA, 23 nt, Human
agccccgcguggaacucgugucu

SEQ ID NO: 1191054 - RNA, 16 nt, Human
agccucuccacucaug

SEQ ID NO: 1191055 - RNA, 15 nt, Human
ugaugggucaguugu

SEQ ID NO: 1191056 - RNA, 22 nt, Human
ugccgagaguccaucagccucc

SEQ ID NO: 1191057 - RNA, 16 nt, Human
ugccaucauguuuaca

SEQ ID NO: 1191058 - RNA, 17 nt, Human
ugccuugucacgccaga

SEQ ID NO: 1191059 - RNA, 16 nt, Human
ugccuuggugugcugu

SEQ ID NO: 1191060 - RNA, 15 nt, Human
ugccuugucacgcca

SEQ ID NO: 1191061 - RNA, 16 nt, Human
ugcuaugagcugggga

SEQ ID NO: 1191062 - RNA, 19 nt, Human
ugcuaugagcuggggaugu

SEQ ID NO: 1191063 - RNA, 20 nt, Human
ugcuaugagcuggggauguc

SEQ ID NO: 1191064 - RNA, 22 nt, Human
ugcuaugagcuggggaugucuc

SEQ ID NO: 1191065 - RNA, 19 nt, Human
aggaucccaugagcuccuu

SEQ ID NO: 1191066 - RNA, 23 nt, Human
agggaaggaucccaugagcuccu

SEQ ID NO: 1191067 - RNA, 22 nt, Human
agggaaggaucccaugagcucc

SEQ ID NO: 1191068 - RNA, 15 nt, Human
agggaaggaucccau

SEQ ID NO: 1191069 - RNA, 19 nt, Human
ugggagaaugucaguaugu

SEQ ID NO: 1191070 - RNA, 20 nt, Human
ugggagaaugucaguaugug

SEQ ID NO: 1191071 - RNA, 22 nt, Human
ugggagaaugucaguaugugga

SEQ ID NO: 1191072 - RNA, 13 nt, Human
uggggagagacgg

SEQ ID NO: 1191073 - RNA, 14 nt, Human
uggggagggauuug

SEQ ID NO: 1191074 - RNA, 15 nt, Human
uggggcucagagugg

SEQ ID NO: 1191075 - RNA, 22 nt, Human
uggggagggauuuggggcucag

SEQ ID NO: 1191076 - RNA, 21 nt, Human
aggguggggggggggcgcggc

SEQ ID NO: 1191077 - RNA, 19 nt, Human
agguuuuuguagugauuuu

SEQ ID NO: 1191078 - RNA, 23 nt, Human
agguuuguuuagaagaagugugu

SEQ ID NO: 1191079 - RNA, 12 nt, Human
uguauguggggg

SEQ ID NO: 1191080 - RNA, 20 nt, Human
uguaugugggggucugugug

SEQ ID NO: 1191081 - RNA, 17 nt, Human
ugugacucuuuccaacc

SEQ ID NO: 1191082 - RNA, 15 nt, Human
ugugacucuuuccaa

SEQ ID NO: 1191083 - RNA, 14 nt, Human
ugugacucuuucca

SEQ ID NO: 1191084 - RNA, 12 nt, Human
ugugacucuuuc

SEQ ID NO: 1191085 - RNA, 21 nt, Human
uguggcauccagagucccugc

SEQ ID NO: 1191086 - RNA, 19 nt, Human
uguggcauccagagucccu

SEQ ID NO: 1191087 - RNA, 16 nt, Human
uguggcauccagaguc

SEQ ID NO: 1191088 - RNA, 12 nt, Human
ugugugugggag

SEQ ID NO: 1191089 - RNA, 20 nt, Human
ugugugugggaguguguaau

SEQ ID NO: 1191090 - RNA, 14 nt, Human
uguguguguaugug

SEQ ID NO: 1191091 - RNA, 12 nt, Human
aguucugccagg

SEQ ID NO: 1191092 - RNA, 20 nt, Human
aguucugccaggagacaggu

SEQ ID NO: 1191093 - RNA, 14 nt, Human
aguucugccaggag

SEQ ID NO: 1191094 - RNA, 13 nt, Human
aguucugccagga

SEQ ID NO: 1191095 - RNA, 13 nt, Human
uguuuaugugugu

SEQ ID NO: 1191096 - RNA, 16 nt, Human
uguuuaugugugugug

SEQ ID NO: 1191097 - RNA, 14 nt, Human
aguuuagggugggg

SEQ ID NO: 1191098 - RNA, 13 nt, Human
aguuuaggguggg

SEQ ID NO: 1191099 - RNA, 12 nt, Human
aguuuagggugg

SEQ ID NO: 1191100 - RNA, 13 nt, Human
uuaaaauugugau

SEQ ID NO: 1191101 - RNA, 18 nt, Human
uuaaaauugugauguguc

SEQ ID NO: 1191102 - RNA, 14 nt, Human
uuagaagaagugug

SEQ ID NO: 1191103 - RNA, 15 nt, Human
uuagaagaagugugu

SEQ ID NO: 1191104 - RNA, 16 nt, Human
uuagaagaaguguguc

SEQ ID NO: 1191105 - RNA, 17 nt, Human
aucccaacacugccagc

SEQ ID NO: 1191106 - RNA, 16 nt, Human
aucccaacacugccag

SEQ ID NO: 1191107 - RNA, 15 nt, Human
aucccaacacugcca

SEQ ID NO: 1191108 - RNA, 11 nt, Human
aucccaacacu

SEQ ID NO: 1191109 - RNA, 12 nt, Human
uucugccaggag

SEQ ID NO: 1191110 - RNA, 17 nt, Human
uucuaguucugccagga

SEQ ID NO: 1191111 - RNA, 18 nt, Human
aucauguuuacagaggac

SEQ ID NO: 1191112 - RNA, 23 nt, Human
aucauguuuacagaggacaguau

SEQ ID NO: 1191113 - RNA, 20 nt, Human
auauuuguaaauuuauguga

SEQ ID NO: 1191114 - RNA, 16 nt, Human
uuggacuugucccggg

SEQ ID NO: 1191115 - RNA, 21 nt, Human
aucugugaggggcucucucau

SEQ ID NO: 1191116 - RNA, 22 nt, Human
aucugugaggggcucucucaug

SEQ ID NO: 1191117 - RNA, 19 nt, Human
uuguaaauuuaugugaugg

SEQ ID NO: 1191118 - RNA, 20 nt, Human
aucugagaggccacagugca

SEQ ID NO: 1191119 - RNA, 12 nt, Human
uugugauguguc

SEQ ID NO: 1191120 - RNA, 18 nt, Human
augaguuggcugggaaua

SEQ ID NO: 1191121 - RNA, 19 nt, Human
uuucccuuccuuccucucc

SEQ ID NO: 1191122 - RNA, 23 nt, Human
uuugaccuguugggagugaggau

SEQ ID NO: 1191123 - RNA, 17 nt, Human
auguauauaaacaugcu

SEQ ID NO: 1191124 - RNA, 18 nt, Human
uuuguaagguuuuuguag

SEQ ID NO: 1191125 - RNA, 15 nt, Human
uuuguagugauuuuu

SEQ ID NO: 1191126 - RNA, 22 nt, Human
uuuguagugauuuuuaugccac

SEQ ID NO: 1191127 - RNA, 22 nt, Human
auguguguguguuguguguggg

SEQ ID NO: 1191128 - RNA, 23 nt, Human
auguguguguguuguguguggga

SEQ ID NO: 1191129 - RNA, 15 nt, Human
auuuaaaauugugau

SEQ ID NO: 1191130 - RNA, 17 nt, Human
auuguagagccagaggu

SEQ ID NO: 1191131 - RNA, 18 nt, Human
auuguagagccagagguc

SEQ ID NO: 1191132 - RNA, 19 nt, Human
auuuaaaauugugaugugu

SEQ ID NO: 1191133 - RNA, 14 nt, Human
aacaggcucagagg

SEQ ID NO: 1191134 - RNA, 13 nt, Human
accggggccuggg

SEQ ID NO: 1191135 - RNA, 19 nt, Human
accggggccugggcaggag

SEQ ID NO: 1191136 - RNA, 19 nt, Human
acccucaucuuucuuccaa

SEQ ID NO: 1191137 - RNA, 16 nt, Human
acccucaucuuucuuc

SEQ ID NO: 1191138 - RNA, 14 nt, Human
acccucaucuuucu

SEQ ID NO: 1191139 - RNA, 13 nt, Human
acccucaucuuuc

SEQ ID NO: 1191140 - RNA, 12 nt, Human
agagaggccauu

SEQ ID NO: 1191141 - RNA, 23 nt, Human
agagaggccauucuuucccaaca

SEQ ID NO: 1191142 - RNA, 22 nt, Human
agagaggccauucuuucccaac

SEQ ID NO: 1191143 - RNA, 13 nt, Human
agcaucucccagu

SEQ ID NO: 1191144 - RNA, 19 nt, Human
agagugggguagguuggga

SEQ ID NO: 1191145 - RNA, 19 nt, Human
aggcuaggguggggagaga

SEQ ID NO: 1191146 - RNA, 16 nt, Human
aggcuaggguggggag

SEQ ID NO: 1191147 - RNA, 15 nt, Human
aggcuagggugggga

SEQ ID NO: 1191148 - RNA, 14 nt, Human
aggcuagggugggg

SEQ ID NO: 1191149 - RNA, 22 nt, Human
agggauuuggggcucagagugg

SEQ ID NO: 1191150 - RNA, 19 nt, Human
aggcaucggggagccggga

SEQ ID NO: 1191151 - RNA, 20 nt, Human
aggagacagguuagcugcuc

SEQ ID NO: 1191152 - RNA, 13 nt, Human
aggagggcaggca

SEQ ID NO: 1191153 - RNA, 15 nt, Human
aggagggaggugcuu

SEQ ID NO: 1191154 - RNA, 15 nt, Human
aggagggcaggcauc

SEQ ID NO: 1191155 - RNA, 13 nt, Human
aggaugucugggc

SEQ ID NO: 1191156 - RNA, 16 nt, Human
ccaaacaggcucagag

SEQ ID NO: 1191157 - RNA, 19 nt, Human
cauugucccugaagagaag

SEQ ID NO: 1191158 - RNA, 16 nt, Human
ccaacacugccagcau

SEQ ID NO: 1191159 - RNA, 15 nt, Human
ccaacacugccagca

SEQ ID NO: 1191160 - RNA, 14 nt, Human
ccaacacugccagc

SEQ ID NO: 1191161 - RNA, 13 nt, Human
ccaacacugccag

SEQ ID NO: 1191162 - RNA, 19 nt, Human
ccaagccuuggcucuaccc

SEQ ID NO: 1191163 - RNA, 21 nt, Human
ccacgucagcugggacacccc

SEQ ID NO: 1191164 - RNA, 16 nt, Human
ccacacccucacugcu

SEQ ID NO: 1191165 - RNA, 20 nt, Human
ccacacagacuugggcaggg

SEQ ID NO: 1191166 - RNA, 13 nt, Human
ccaucagccucca

SEQ ID NO: 1191167 - RNA, 13 nt, Human
cccaacaccucuu

SEQ ID NO: 1191168 - RNA, 22 nt, Human
ccgacuuuuguuuaccagagaa

SEQ ID NO: 1191169 - RNA, 15 nt, Human
ccuccucugcccggg

SEQ ID NO: 1191170 - RNA, 14 nt, Human
ccuccucugcccgg

SEQ ID NO: 1191171 - RNA, 23 nt, Human
ccucuccacucaugugacucuuu

SEQ ID NO: 1191172 - RNA, 16 nt, Human
ccuggaccagccucuc

SEQ ID NO: 1191173 - RNA, 15 nt, Human
ccuggaccagccucu

SEQ ID NO: 1191174 - RNA, 14 nt, Human
ccuggaccagccuc

SEQ ID NO: 1191175 - RNA, 23 nt, Human
cggcugggaggagggcaggcauc

SEQ ID NO: 1191176 - RNA, 22 nt, Human
cggcugggaggagggcaggcau

SEQ ID NO: 1191177 - RNA, 16 nt, Human
cgggagcucaggaacc

SEQ ID NO: 1191178 - RNA, 23 nt, Human
cgauugcaggagucccugccauc

SEQ ID NO: 1191179 - RNA, 21 nt, Human
cgauugcaggagucccugcca

SEQ ID NO: 1191180 - RNA, 19 nt, Human
cgucagcugggacaccccg

SEQ ID NO: 1191181 - RNA, 22 nt, Human
cuccuuaaggcucuuuuguaag

SEQ ID NO: 1191182 - RNA, 13 nt, Human
cuccuuaaggcuc

SEQ ID NO: 1191183 - RNA, 17 nt, Human
cuccauugguguugaca

SEQ ID NO: 1191184 - RNA, 15 nt, Human
cucauuccagaggaa

SEQ ID NO: 1191185 - RNA, 17 nt, Human
cucauuccagaggaagg

SEQ ID NO: 1191186 - RNA, 19 nt, Human
cucuccacucaugugacuc

SEQ ID NO: 1191187 - RNA, 21 nt, Human
cucuuggggaguuuagggugg

SEQ ID NO: 1191188 - RNA, 21 nt, Human
cugaagagaagggcagggcug

SEQ ID NO: 1191189 - RNA, 20 nt, Human
cugccagcauuucccuuccu

SEQ ID NO: 1191190 - RNA, 16 nt, Human
cugccaggagacaggu

SEQ ID NO: 1191191 - RNA, 18 nt, Human
cugcccgggagcucagga

SEQ ID NO: 1191192 - RNA, 12 nt, Human
cuggaccagccu

SEQ ID NO: 1191193 - RNA, 15 nt, Human
cuggcacagccuggc

SEQ ID NO: 1191194 - RNA, 14 nt, Human
cuggcacagccugg

SEQ ID NO: 1191195 - RNA, 14 nt, Human
cuuccuuccucucc

SEQ ID NO: 1191196 - RNA, 20 nt, Human
gaagcguuguccucagcccc

SEQ ID NO: 1191197 - RNA, 19 nt, Human
gaagcguuguccucagccc

SEQ ID NO: 1191198 - RNA, 13 nt, Human
gaagcguuguccu

SEQ ID NO: 1191199 - RNA, 17 nt, Human
gaagagaagggcagggc

SEQ ID NO: 1191200 - RNA, 18 nt, Human
gacuucccacggcuccuc

SEQ ID NO: 1191201 - RNA, 21 nt, Human
gaguguguaauuuaaaauugu

SEQ ID NO: 1191202 - RNA, 22 nt, Human
gaguguguaauuuaaaauugug

SEQ ID NO: 1191203 - RNA, 19 nt, Human
gcacagccuggcuguggcc

SEQ ID NO: 1191204 - RNA, 12 nt, Human
gcacagccuggc

SEQ ID NO: 1191205 - RNA, 15 nt, Human
gcaggagggaggugc

SEQ ID NO: 1191206 - RNA, 13 nt, Human
gccccgcguggaa

SEQ ID NO: 1191207 - RNA, 21 nt, Human
gccgagaguccaucagccucc

SEQ ID NO: 1191208 - RNA, 19 nt, Human
gccgggagccugacccuca

SEQ ID NO: 1191209 - RNA, 14 nt, Human
gccgggagccugac

SEQ ID NO: 1191210 - RNA, 13 nt, Human
gccgggagccuga

SEQ ID NO: 1191211 - RNA, 20 nt, Human
gcugccuuuggacuuguccc

SEQ ID NO: 1191212 - RNA, 15 nt, Human
gcugccuuuggacuu

SEQ ID NO: 1191213 - RNA, 19 nt, Human
gcugggaggagggcaggca

SEQ ID NO: 1191214 - RNA, 17 nt, Human
gcugggaggagggcagg

SEQ ID NO: 1191215 - RNA, 18 nt, Human
gcuucuaguucugccagg

SEQ ID NO: 1191216 - RNA, 20 nt, Human
gcuucuaguucugccaggag

SEQ ID NO: 1191217 - RNA, 19 nt, Human
gcuucuaguucugccagga

SEQ ID NO: 1191218 - RNA, 21 nt, Human
gcuucuaguucugccaggaga

SEQ ID NO: 1191219 - RNA, 20 nt, Human
ggaaccgaggcagggaagga

SEQ ID NO: 1191220 - RNA, 16 nt, Human
ggaaccgaggcaggga

SEQ ID NO: 1191221 - RNA, 15 nt, Human
ggaaccgaggcaggg

SEQ ID NO: 1191222 - RNA, 17 nt, Human
ggaacucgugucuggca

SEQ ID NO: 1191223 - RNA, 17 nt, Human
ggaaggaucccaugagc

SEQ ID NO: 1191224 - RNA, 20 nt, Human
ggaggagggcaggcaucggg

SEQ ID NO: 1191225 - RNA, 15 nt, Human
ggaggagggcaggca

SEQ ID NO: 1191226 - RNA, 14 nt, Human
ggaggagggcaggc

SEQ ID NO: 1191227 - RNA, 16 nt, Human
ggagccgggagccuga

SEQ ID NO: 1191228 - RNA, 14 nt, Human
ggagggcaggcauc

SEQ ID NO: 1191229 - RNA, 13 nt, Human
ggagggcaggcau

SEQ ID NO: 1191230 - RNA, 12 nt, Human
ggagggauuugg

SEQ ID NO: 1191231 - RNA, 13 nt, Human
ggauagaugugug

SEQ ID NO: 1191232 - RNA, 14 nt, Human
ggauagaugugugg

SEQ ID NO: 1191233 - RNA, 15 nt, Human
ggauagaugugugga

SEQ ID NO: 1191234 - RNA, 20 nt, Human
ggaucccaugagcuccuuaa

SEQ ID NO: 1191235 - RNA, 17 nt, Human
ggaucccaugagcuccu

SEQ ID NO: 1191236 - RNA, 20 nt, Human
ggcagucugagagaggccau

SEQ ID NO: 1191237 - RNA, 15 nt, Human
gggaaggaucccaug

SEQ ID NO: 1191238 - RNA, 19 nt, Human
gggcagucugagagaggcc

SEQ ID NO: 1191239 - RNA, 18 nt, Human
gggcagucugagagaggc

SEQ ID NO: 1191240 - RNA, 17 nt, Human
gggcagucugagagagg

SEQ ID NO: 1191241 - RNA, 23 nt, Human
gggaggugcuucuaguucugcca

SEQ ID NO: 1191242 - RNA, 16 nt, Human
gggaguuuaggguggg

SEQ ID NO: 1191243 - RNA, 11 nt, Human
gggagugugua

SEQ ID NO: 1191244 - RNA, 14 nt, Human
gggauagaugugug

SEQ ID NO: 1191245 - RNA, 13 nt, Human
gggauagaugugu

SEQ ID NO: 1191246 - RNA, 21 nt, Human
gggcagucugagagaggccau

SEQ ID NO: 1191247 - RNA, 20 nt, Human
gggcagucugagagaggcca

SEQ ID NO: 1191248 - RNA, 15 nt, Human
gggccugggcaggag

SEQ ID NO: 1191249 - RNA, 13 nt, Human
gggccugggcagg

SEQ ID NO: 1191250 - RNA, 12 nt, Human
gggccugggcag

SEQ ID NO: 1191251 - RNA, 17 nt, Human
gggccugggcaggaggg

SEQ ID NO: 1191252 - RNA, 16 nt, Human
gggccugggcaggagg

SEQ ID NO: 1191253 - RNA, 16 nt, Human
ggggcgcggcugggag

SEQ ID NO: 1191254 - RNA, 15 nt, Human
ggggcgcggcuggga

SEQ ID NO: 1191255 - RNA, 19 nt, Human
ggggcagucugagagaggc

SEQ ID NO: 1191256 - RNA, 18 nt, Human
ggggcagucugagagagg

SEQ ID NO: 1191257 - RNA, 15 nt, Human
gggggagagggcugc

SEQ ID NO: 1191258 - RNA, 21 nt, Human
gguguccugcaccggggccug

SEQ ID NO: 1191259 - RNA, 15 nt, Human
ggugguggcucggga

SEQ ID NO: 1191260 - RNA, 22 nt, Human
uagugauuuuuaugccaccuga

SEQ ID NO: 1191261 - RNA, 21 nt, Human
uagugauuuuuaugccaccug

SEQ ID NO: 1191262 - RNA, 20 nt, Human
uagugauuuuuaugccaccu

SEQ ID NO: 1191263 - RNA, 13 nt, Human
uaggcuagggugg

SEQ ID NO: 1191264 - RNA, 15 nt, Human
uaggcuagggugggg

SEQ ID NO: 1191265 - RNA, 15 nt, Human
uaggaacugcugggc

SEQ ID NO: 1191266 - RNA, 18 nt, Human
uaggaacugcugggcuug

SEQ ID NO: 1191267 - RNA, 11 nt, Human
uagaugugugg

SEQ ID NO: 1191268 - RNA, 19 nt, Human
uaauucuuugaccuguugg

SEQ ID NO: 1191269 - RNA, 19 nt, Human
gguugggagaaugucagua

SEQ ID NO: 1191270 - RNA, 18 nt, Human
ucacgccagacuucccac

SEQ ID NO: 1191271 - RNA, 22 nt, Human
ucagucuuuaaucugagaggcc

SEQ ID NO: 1191272 - RNA, 19 nt, Human
uccuuaaggcucuuuugua

SEQ ID NO: 1191273 - RNA, 16 nt, Human
uccuuaaggcucuuuu

SEQ ID NO: 1191274 - RNA, 19 nt, Human
ucuuuuguaagguuuuugu

SEQ ID NO: 1191275 - RNA, 22 nt, Human
ucuguguguguguauguggggg

SEQ ID NO: 1191276 - RNA, 15 nt, Human
ucuguguguuuaugu

SEQ ID NO: 1191277 - RNA, 16 nt, Human
ucuguguguuuaugug

SEQ ID NO: 1191278 - RNA, 19 nt, Human
ucuguguguuuaugugugu

SEQ ID NO: 1191279 - RNA, 20 nt, Human
ucuguguguuuaugugugug

SEQ ID NO: 1191280 - RNA, 15 nt, Human
ucuguguguguguau

SEQ ID NO: 1191281 - RNA, 18 nt, Human
ucuguguguguguaugug

SEQ ID NO: 1191282 - RNA, 19 nt, Human
ucuguguguguguaugugg

SEQ ID NO: 1191283 - RNA, 21 nt, Human
ucuguguguguguaugugggg

SEQ ID NO: 1191284 - RNA, 19 nt, Human
ugcuucuaguucugccagg

SEQ ID NO: 1191285 - RNA, 18 nt, Human
ugcuucuaguucugccag

SEQ ID NO: 1191286 - RNA, 20 nt, Human
ugcuucuaguucugccagga

SEQ ID NO: 1191287 - RNA, 21 nt, Human
uggaagugugggucugugugu

SEQ ID NO: 1191288 - RNA, 23 nt, Human
uggaagugugggucugugugugu

SEQ ID NO: 1191289 - RNA, 18 nt, Human
uggggcaggggccggggg

SEQ ID NO: 1191290 - RNA, 16 nt, Human
uggggcaggggccggg

SEQ ID NO: 1191291 - RNA, 15 nt, Human
uuacagaggacagua

SEQ ID NO: 1191292 - RNA, 14 nt, Human
uguguauguggggg

SEQ ID NO: 1191293 - RNA, 23 nt, Human
uguguaugugggggucugugugu

SEQ ID NO: 1191294 - RNA, 15 nt, Human
uguguuuaugugugu

SEQ ID NO: 1191295 - RNA, 13 nt, Human
uguguuuaugugu

SEQ ID NO: 1191296 - RNA, 14 nt, Human
uguguugugugugg

SEQ ID NO: 1191297 - RNA, 23 nt, Human
uguguugugugugggagugugua

SEQ ID NO: 1191298 - RNA, 11 nt, Human
uguguguaugu

SEQ ID NO: 1191299 - RNA, 21 nt, Human
uguuuacagaggacaguauuu

SEQ ID NO: 1191300 - RNA, 14 nt, Human
uguuuacagaggac

SEQ ID NO: 1191301 - RNA, 16 nt, Human
ugugggggucugugug

SEQ ID NO: 1191302 - RNA, 14 nt, Human
ugugggucugugug

SEQ ID NO: 1191303 - RNA, 16 nt, Human
ugugggucugugugug

SEQ ID NO: 1191304 - RNA, 20 nt, Human
ugugggucugugugugugua

SEQ ID NO: 1191305 - RNA, 18 nt, Human
ugugaggggcucucucau

SEQ ID NO: 1191306 - RNA, 15 nt, Human
uguaaauuuauguga

SEQ ID NO: 1191307 - RNA, 16 nt, Human
uguaaauuuaugugau

SEQ ID NO: 1191308 - RNA, 17 nt, Human
uuuagaagaaguguguc

SEQ ID NO: 1191309 - RNA, 19 nt, Human
uuuagaagaagugugucac

SEQ ID NO: 1191310 - RNA, 13 nt, Human
aggaugucugggc

SEQ ID NO: 1191311 - RNA, 15 nt, Human
aggagggcaggcauc

SEQ ID NO: 1191312 - RNA, 15 nt, Human
aggagggaggugcuu

SEQ ID NO: 1191313 - RNA, 13 nt, Human
aggagggcaggca

SEQ ID NO: 1191314 - RNA, 20 nt, Human
aggagacagguuagcugcuc

SEQ ID NO: 1191315 - RNA, 19 nt, Human
aggcaucggggagccggga

SEQ ID NO: 1191316 - RNA, 19 nt, Human
aggccagggggccaguccc

SEQ ID NO: 1191317 - RNA, 23 nt, Human
aggccagggggccagucccugag

SEQ ID NO: 1191318 - RNA, 22 nt, Human
agggauuuggggcucagagugg

SEQ ID NO: 1191319 - RNA, 15 nt, Human
agggaugcauggaga

SEQ ID NO: 1191320 - RNA, 14 nt, Human
agggaugguguuca

SEQ ID NO: 1191321 - RNA, 14 nt, Human
aggcuagggugggg

SEQ ID NO: 1191322 - RNA, 15 nt, Human
aggcuagggugggga

SEQ ID NO: 1191323 - RNA, 16 nt, Human
aggcuaggguggggag

SEQ ID NO: 1191324 - RNA, 19 nt, Human
aggcuaggguggggagaga

SEQ ID NO: 1191325 - RNA, 13 nt, Human
agcgaauuuuaaa

SEQ ID NO: 1191326 - RNA, 15 nt, Human
agcgaauuuuaaaag

SEQ ID NO: 1191327 - RNA, 16 nt, Human
agcgaauuuuaaaaga

SEQ ID NO: 1191328 - RNA, 15 nt, Human
agcugcgggcugggu

SEQ ID NO: 1191329 - RNA, 19 nt, Human
agcuuuuuucucugauaca

SEQ ID NO: 1191330 - RNA, 20 nt, Human
agcuuuuuucucugauacag

SEQ ID NO: 1191331 - RNA, 22 nt, Human
agcuuuuuucucugauacagaa

SEQ ID NO: 1191332 - RNA, 23 nt, Human
agcuuuuuucucugauacagaaa

SEQ ID NO: 1191333 - RNA, 19 nt, Human
agagugggguagguuggga

SEQ ID NO: 1191334 - RNA, 19 nt, Human
agauagccccacaggaggu

SEQ ID NO: 1191335 - RNA, 14 nt, Human
agauaugauucaaa

SEQ ID NO: 1191336 - RNA, 15 nt, Human
agauaugauucaaau

SEQ ID NO: 1191337 - RNA, 16 nt, Human
agauaugauucaaaug

SEQ ID NO: 1191338 - RNA, 13 nt, Human
agcaucucccagu

SEQ ID NO: 1191339 - RNA, 14 nt, Human
agccaagaggcugc

SEQ ID NO: 1191340 - RNA, 15 nt, Human
agccaagaggcugca

SEQ ID NO: 1191341 - RNA, 17 nt, Human
agcccaaaccaccagaa

SEQ ID NO: 1191342 - RNA, 19 nt, Human
agcccaaaccaccagaagc

SEQ ID NO: 1191343 - RNA, 20 nt, Human
agcccaaaccaccagaagcc

SEQ ID NO: 1191344 - RNA, 22 nt, Human
agcccaaaccaccagaagccca

SEQ ID NO: 1191345 - RNA, 14 nt, Human
agcagugggccugg

SEQ ID NO: 1191346 - RNA, 22 nt, Human
agagaggccauucuuucccaac

SEQ ID NO: 1191347 - RNA, 23 nt, Human
agagaggccauucuuucccaaca

SEQ ID NO: 1191348 - RNA, 12 nt, Human
agagaggccauu

SEQ ID NO: 1191349 - RNA, 12 nt, Human
agaaugaggcug

SEQ ID NO: 1191350 - RNA, 13 nt, Human
agaaugaggcugc

SEQ ID NO: 1191351 - RNA, 14 nt, Human
agaaugaggcugcu

SEQ ID NO: 1191352 - RNA, 20 nt, Human
agaaugaggcugcuuuccaa

SEQ ID NO: 1191353 - RNA, 18 nt, Human
agaagucacauuccugaa

SEQ ID NO: 1191354 - RNA, 23 nt, Human
auggagauagccccacaggaggu

SEQ ID NO: 1191355 - RNA, 22 nt, Human
augaggcugcuuuccaaagcca

SEQ ID NO: 1191356 - RNA, 16 nt, Human
augaaacuuuuggaag

SEQ ID NO: 1191357 - RNA, 13 nt, Human
augaaacuuggau

SEQ ID NO: 1191358 - RNA, 16 nt, Human
auauuuuuuucugaaa

SEQ ID NO: 1191359 - RNA, 18 nt, Human
auauuuuuuucugaaauu

SEQ ID NO: 1191360 - RNA, 14 nt, Human
auauuuuuuucuga

SEQ ID NO: 1191361 - RNA, 19 nt, Human
auauuuuuuucugaaauuu

SEQ ID NO: 1191362 - RNA, 21 nt, Human
auccagcccugaguuccuagc

SEQ ID NO: 1191363 - RNA, 13 nt, Human
acccucaucuuuc

SEQ ID NO: 1191364 - RNA, 14 nt, Human
acccucaucuuucu

SEQ ID NO: 1191365 - RNA, 16 nt, Human
acccucaucuuucuuc

SEQ ID NO: 1191366 - RNA, 19 nt, Human
acccucaucuuucuuccaa

SEQ ID NO: 1191367 - RNA, 19 nt, Human
accggggccugggcaggag

SEQ ID NO: 1191368 - RNA, 13 nt, Human
accggggccuggg

SEQ ID NO: 1191369 - RNA, 20 nt, Human
acuaauguguaagacaaaaa

SEQ ID NO: 1191370 - RNA, 13 nt, Human
acgucuuaaauau

SEQ ID NO: 1191371 - RNA, 14 nt, Human
acgucuuaaauauu

SEQ ID NO: 1191372 - RNA, 16 nt, Human
acugauccagcccuga

SEQ ID NO: 1191373 - RNA, 17 nt, Human
acugauccagcccugag

SEQ ID NO: 1191374 - RNA, 20 nt, Human
acugaauuaugaaacuuuug

SEQ ID NO: 1191375 - RNA, 13 nt, Human
acugaauuaugaa

SEQ ID NO: 1191376 - RNA, 14 nt, Human
acugaauuaugaaa

SEQ ID NO: 1191377 - RNA, 15 nt, Human
acugaauuaugaaac

SEQ ID NO: 1191378 - RNA, 17 nt, Human
aauuuccugggagcuuu

SEQ ID NO: 1191379 - RNA, 12 nt, Human
aauuuccuggga

SEQ ID NO: 1191380 - RNA, 15 nt, Human
aauuuccugggagcu

SEQ ID NO: 1191381 - RNA, 18 nt, Human
aauuaugaaacuuuugga

SEQ ID NO: 1191382 - RNA, 12 nt, Human
aauuaugaaacu

SEQ ID NO: 1191383 - RNA, 13 nt, Human
aauuaugaaacuu

SEQ ID NO: 1191384 - RNA, 15 nt, Human
aauuaugaaacuuuu

SEQ ID NO: 1191385 - RNA, 18 nt, Human
accaagccuggucagccc

SEQ ID NO: 1191386 - RNA, 15 nt, Human
accaccagaagccca

SEQ ID NO: 1191387 - RNA, 16 nt, Human
accaccagaagcccag

SEQ ID NO: 1191388 - RNA, 17 nt, Human
accaccagaagcccaga

SEQ ID NO: 1191389 - RNA, 23 nt, Human
acagugaucaaguuauuuuuaau

SEQ ID NO: 1191390 - RNA, 14 nt, Human
aacaggcucagagg

SEQ ID NO: 1191391 - RNA, 22 nt, Human
aaaccgaacugauguaaguaaa

SEQ ID NO: 1191392 - RNA, 18 nt, Human
aaaaguugaauuuuacau

SEQ ID NO: 1191393 - RNA, 17 nt, Human
aaaagauaaauauuaua

SEQ ID NO: 1191394 - RNA, 16 nt, Human
aaaagagaugaugaaa

SEQ ID NO: 1191395 - RNA, 19 nt, Human
aaaagagaugaugaaaaua

SEQ ID NO: 1191396 - RNA, 14 nt, Human
aaaagauaaauauu

SEQ ID NO: 1191397 - RNA, 12 nt, Human
aaguugaauuuu

SEQ ID NO: 1191398 - RNA, 13 nt, Human
aagcuacuuauug

SEQ ID NO: 1191399 - RNA, 19 nt, Human
auuuaaaauugugaugugu

SEQ ID NO: 1191400 - RNA, 14 nt, Human
auuggaaacaaguc

SEQ ID NO: 1191401 - RNA, 18 nt, Human
auuguagagccagagguc

SEQ ID NO: 1191402 - RNA, 17 nt, Human
auuguagcauccuggaa

SEQ ID NO: 1191403 - RNA, 17 nt, Human
auuguagagccagaggu

SEQ ID NO: 1191404 - RNA, 20 nt, Human
auuguagcauccuggaauau

SEQ ID NO: 1191405 - RNA, 15 nt, Human
auuuaaaauugugau

SEQ ID NO: 1191406 - RNA, 16 nt, Human
auuuaaauagcuuuuu

SEQ ID NO: 1191407 - RNA, 22 nt, Human
auuuccugggagcuuuuguaga

SEQ ID NO: 1191408 - RNA, 23 nt, Human
auuugaauguaugcuucauacag

SEQ ID NO: 1191409 - RNA, 18 nt, Human
auuugauaugugaacagu

SEQ ID NO: 1191410 - RNA, 19 nt, Human
auuugauaugugaacaguu

SEQ ID NO: 1191411 - RNA, 12 nt, Human
auuugguuuuca

SEQ ID NO: 1191412 - RNA, 14 nt, Human
auuugguuuucaca

SEQ ID NO: 1191413 - RNA, 15 nt, Human
auuugguuuucacau

SEQ ID NO: 1191414 - RNA, 23 nt, Human
auguguguguguuguguguggga

SEQ ID NO: 1191415 - RNA, 22 nt, Human
auguguguguguuguguguggg

SEQ ID NO: 1191416 - RNA, 23 nt, Human
auguggaaaagccaagaggcugc

SEQ ID NO: 1191417 - RNA, 17 nt, Human
uuuucucugauacagaa

SEQ ID NO: 1191418 - RNA, 22 nt, Human
uuuguagugauuuuuaugccac

SEQ ID NO: 1191419 - RNA, 15 nt, Human
uuuguagugauuuuu

SEQ ID NO: 1191420 - RNA, 18 nt, Human
uuuguaagguuuuuguag

SEQ ID NO: 1191421 - RNA, 17 nt, Human
auguauauaaacaugcu

SEQ ID NO: 1191422 - RNA, 18 nt, Human
uuuggcaaacucuccacc

SEQ ID NO: 1191423 - RNA, 23 nt, Human
uuuggcaaacucuccaccacacg

SEQ ID NO: 1191424 - RNA, 23 nt, Human
uuugaccuguugggagugaggau

SEQ ID NO: 1191425 - RNA, 19 nt, Human
uuucccuuccuuccucucc

SEQ ID NO: 1191426 - RNA, 18 nt, Human
augaguuggcugggaaua

SEQ ID NO: 1191427 - RNA, 18 nt, Human
uuguagcauccuggaaua

SEQ ID NO: 1191428 - RNA, 12 nt, Human
uugugauguguc

SEQ ID NO: 1191429 - RNA, 21 nt, Human
uuucaugcuguucaugaaaga

SEQ ID NO: 1191430 - RNA, 13 nt, Human
uuucacauuggaa

SEQ ID NO: 1191431 - RNA, 14 nt, Human
uuucacauuggaaa

SEQ ID NO: 1191432 - RNA, 19 nt, Human
uuucacauuggaaacaagu

SEQ ID NO: 1191433 - RNA, 17 nt, Human
uuuagggguagcauuug

SEQ ID NO: 1191434 - RNA, 15 nt, Human
augccccugaauuua

SEQ ID NO: 1191435 - RNA, 20 nt, Human
augccccugaauuuaaauag

SEQ ID NO: 1191436 - RNA, 19 nt, Human
uuguaaauuuaugugaugg

SEQ ID NO: 1191437 - RNA, 20 nt, Human
uugguuuucacauuggaaac

SEQ ID NO: 1191438 - RNA, 18 nt, Human
uuggagccugcagagcug

SEQ ID NO: 1191439 - RNA, 22 nt, Human
aucugugaggggcucucucaug

SEQ ID NO: 1191440 - RNA, 21 nt, Human
aucugugaggggcucucucau

SEQ ID NO: 1191441 - RNA, 16 nt, Human
uuggacuugucccggg

SEQ ID NO: 1191442 - RNA, 11 nt, Human
uuggagccugc

SEQ ID NO: 1191443 - RNA, 15 nt, Human
uuggagccugcagag

SEQ ID NO: 1191444 - RNA, 20 nt, Human
auauuuguaaauuuauguga

SEQ ID NO: 1191445 - RNA, 22 nt, Human
auauuuaaaggcccuaucuguu

SEQ ID NO: 1191446 - RNA, 22 nt, Human
auauucucacagcuccaagaau

SEQ ID NO: 1191447 - RNA, 23 nt, Human
auauucucacagcuccaagaauu

SEQ ID NO: 1191448 - RNA, 15 nt, Human
uuccugggagcuuuu

SEQ ID NO: 1191449 - RNA, 16 nt, Human
uuccugggagcuuuug

SEQ ID NO: 1191450 - RNA, 18 nt, Human
auauuuucaugcuguuca

SEQ ID NO: 1191451 - RNA, 21 nt, Human
auauuuucaugcuguucauga

SEQ ID NO: 1191452 - RNA, 23 nt, Human
aucauguuuacagaggacaguau

SEQ ID NO: 1191453 - RNA, 18 nt, Human
aucauguuuacagaggac

SEQ ID NO: 1191454 - RNA, 16 nt, Human
aucagugucuuuccac

SEQ ID NO: 1191455 - RNA, 17 nt, Human
uucuaguucugccagga

SEQ ID NO: 1191456 - RNA, 20 nt, Human
uucucacagcuccaagaauu

SEQ ID NO: 1191457 - RNA, 12 nt, Human
uucugccaggag

SEQ ID NO: 1191458 - RNA, 13 nt, Human
uucucuucacuca

SEQ ID NO: 1191459 - RNA, 21 nt, Human
uucugaaauuuccugggagcu

SEQ ID NO: 1191460 - RNA, 11 nt, Human
aucccaacacu

SEQ ID NO: 1191461 - RNA, 15 nt, Human
aucccaacacugcca

SEQ ID NO: 1191462 - RNA, 16 nt, Human
aucccaacacugccag

SEQ ID NO: 1191463 - RNA, 17 nt, Human
aucccaacacugccagc

SEQ ID NO: 1191464 - RNA, 13 nt, Human
auaugugaacagu

SEQ ID NO: 1191465 - RNA, 13 nt, Human
auaugauucaaau

SEQ ID NO: 1191466 - RNA, 22 nt, Human
auaugauucaaaugucuauaaa

SEQ ID NO: 1191467 - RNA, 17 nt, Human
auaucuauauuuuacau

SEQ ID NO: 1191468 - RNA, 20 nt, Human
auaucuauauuuuacauaaa

SEQ ID NO: 1191469 - RNA, 22 nt, Human
auaucuauauuuuacauaaauu

SEQ ID NO: 1191470 - RNA, 14 nt, Human
uucacauuggaaac

SEQ ID NO: 1191471 - RNA, 16 nt, Human
uucaaaaaacuuguaa

SEQ ID NO: 1191472 - RNA, 16 nt, Human
uuagaagaaguguguc

SEQ ID NO: 1191473 - RNA, 15 nt, Human
uuagaagaagugugu

SEQ ID NO: 1191474 - RNA, 14 nt, Human
uuagaagaagugug

SEQ ID NO: 1191475 - RNA, 12 nt, Human
auaaauauuaua

SEQ ID NO: 1191476 - RNA, 22 nt, Human
auaaauauuauauuauauauau

SEQ ID NO: 1191477 - RNA, 18 nt, Human
uuaaaauugugauguguc

SEQ ID NO: 1191478 - RNA, 13 nt, Human
uuaaaauugugau

SEQ ID NO: 1191479 - RNA, 12 nt, Human
aguuuagggugg

SEQ ID NO: 1191480 - RNA, 13 nt, Human
aguuuaggguggg

SEQ ID NO: 1191481 - RNA, 14 nt, Human
aguuuagggugggg

SEQ ID NO: 1191482 - RNA, 16 nt, Human
uguuuaugugugugug

SEQ ID NO: 1191483 - RNA, 13 nt, Human
uguuuaugugugu

SEQ ID NO: 1191484 - RNA, 13 nt, Human
aguucugccagga

SEQ ID NO: 1191485 - RNA, 14 nt, Human
aguucugccaggag

SEQ ID NO: 1191486 - RNA, 20 nt, Human
aguucugccaggagacaggu

SEQ ID NO: 1191487 - RNA, 12 nt, Human
aguucugccagg

SEQ ID NO: 1191488 - RNA, 21 nt, Human
uguuuuauuuaaccucuaaau

SEQ ID NO: 1191489 - RNA, 14 nt, Human
uguguguguaugug

SEQ ID NO: 1191490 - RNA, 20 nt, Human
ugugugugggaguguguaau

SEQ ID NO: 1191491 - RNA, 12 nt, Human
ugugugugggag

SEQ ID NO: 1191492 - RNA, 13 nt, Human
uguguugaagagg

SEQ ID NO: 1191493 - RNA, 18 nt, Human
uguguaagacaaaaagcu

SEQ ID NO: 1191494 - RNA, 21 nt, Human
uguuccgugguuaaacucgcu

SEQ ID NO: 1191495 - RNA, 16 nt, Human
uguggcauccagaguc

SEQ ID NO: 1191496 - RNA, 23 nt, Human
uguggcaguuuggcaaacucucc

SEQ ID NO: 1191497 - RNA, 19 nt, Human
uguggcauccagagucccu

SEQ ID NO: 1191498 - RNA, 21 nt, Human
uguggcauccagagucccugc

SEQ ID NO: 1191499 - RNA, 14 nt, Human
ugugcccacccucc

SEQ ID NO: 1191500 - RNA, 23 nt, Human
ugugcccacccuccacucuccuc

SEQ ID NO: 1191501 - RNA, 12 nt, Human
ugugacucuuuc

SEQ ID NO: 1191502 - RNA, 14 nt, Human
ugugacucuuucca

SEQ ID NO: 1191503 - RNA, 15 nt, Human
ugugaacagcggcug

SEQ ID NO: 1191504 - RNA, 20 nt, Human
ugugaacaguuguguuugaa

SEQ ID NO: 1191505 - RNA, 22 nt, Human
ugugaacaguuguguuugaagc

SEQ ID NO: 1191506 - RNA, 15 nt, Human
ugugacucuuuccaa

SEQ ID NO: 1191507 - RNA, 17 nt, Human
ugugacucuuuccaacc

SEQ ID NO: 1191508 - RNA, 20 nt, Human
uguaugugggggucugugug

SEQ ID NO: 1191509 - RNA, 12 nt, Human
uguauguggggg

SEQ ID NO: 1191510 - RNA, 23 nt, Human
agguuuguuuagaagaagugugu

SEQ ID NO: 1191511 - RNA, 19 nt, Human
agguuuuuguagugauuuu

SEQ ID NO: 1191512 - RNA, 18 nt, Human
aggugcccagaaugaggc

SEQ ID NO: 1191513 - RNA, 22 nt, Human
aggugcccagaaugaggcugcu

SEQ ID NO: 1191514 - RNA, 17 nt, Human
uguaaauaaaggaacca

SEQ ID NO: 1191515 - RNA, 21 nt, Human
aggguggggggggggcgcggc

SEQ ID NO: 1191516 - RNA, 21 nt, Human
agggucuugguuccagccugc

SEQ ID NO: 1191517 - RNA, 22 nt, Human
uggggagggauuuggggcucag

SEQ ID NO: 1191518 - RNA, 15 nt, Human
uggggcucagagugg

SEQ ID NO: 1191519 - RNA, 14 nt, Human
uggggagggauuug

SEQ ID NO: 1191520 - RNA, 13 nt, Human
uggggagagacgg

SEQ ID NO: 1191521 - RNA, 22 nt, Human
ugggagaaugucaguaugugga

SEQ ID NO: 1191522 - RNA, 20 nt, Human
ugggagaaugucaguaugug

SEQ ID NO: 1191523 - RNA, 19 nt, Human
ugggagaaugucaguaugu

SEQ ID NO: 1191524 - RNA, 15 nt, Human
agggaaggaucccau

SEQ ID NO: 1191525 - RNA, 22 nt, Human
agggaaggaucccaugagcucc

SEQ ID NO: 1191526 - RNA, 23 nt, Human
agggaaggaucccaugagcuccu

SEQ ID NO: 1191527 - RNA, 22 nt, Human
aggcccuaucuguuuacagugu

SEQ ID NO: 1191528 - RNA, 15 nt, Human
ugggccccugccaga

SEQ ID NO: 1191529 - RNA, 15 nt, Human
uggaagagggcugca

SEQ ID NO: 1191530 - RNA, 16 nt, Human
uggauucugagagcug

SEQ ID NO: 1191531 - RNA, 17 nt, Human
uggauucugagagcugu

SEQ ID NO: 1191532 - RNA, 16 nt, Human
uggacuguucccugag

SEQ ID NO: 1191533 - RNA, 17 nt, Human
uggacuguucccugagg

SEQ ID NO: 1191534 - RNA, 22 nt, Human
ugcuaugagcuggggaugucuc

SEQ ID NO: 1191535 - RNA, 20 nt, Human
ugcuaugagcuggggauguc

SEQ ID NO: 1191536 - RNA, 19 nt, Human
ugcuaugagcuggggaugu

SEQ ID NO: 1191537 - RNA, 16 nt, Human
ugcuaugagcugggga

SEQ ID NO: 1191538 - RNA, 15 nt, Human
ugccuugucacgcca

SEQ ID NO: 1191539 - RNA, 16 nt, Human
ugccuuggugugcugu

SEQ ID NO: 1191540 - RNA, 17 nt, Human
ugccuugucacgccaga

SEQ ID NO: 1191541 - RNA, 21 nt, Human
agcuuuggcuaugagggccuu

SEQ ID NO: 1191542 - RNA, 20 nt, Human
agcuuuggcuaugagggccu

SEQ ID NO: 1191543 - RNA, 22 nt, Human
agcuuugagguggaagagggcu

SEQ ID NO: 1191544 - RNA, 16 nt, Human
ugccaucauguuuaca

SEQ ID NO: 1191545 - RNA, 22 nt, Human
ugccgagaguccaucagccucc

SEQ ID NO: 1191546 - RNA, 18 nt, Human
agcugugugcucuccaag

SEQ ID NO: 1191547 - RNA, 15 nt, Human
ugaugggucaguugu

SEQ ID NO: 1191548 - RNA, 18 nt, Human
ugaugaaaauauuuaaag

SEQ ID NO: 1191549 - RNA, 17 nt, Human
agcauuuguguugaaga

SEQ ID NO: 1191550 - RNA, 18 nt, Human
agcauuuguguugaagag

SEQ ID NO: 1191551 - RNA, 14 nt, Human
agcauccuggaaua

SEQ ID NO: 1191552 - RNA, 15 nt, Human
agcauccuggaauau

SEQ ID NO: 1191553 - RNA, 13 nt, Human
agcauccuggaau

SEQ ID NO: 1191554 - RNA, 24 nt, Human
ugaguuacuugcugcccugugcuc

SEQ ID NO: 1191555 - RNA, 14 nt, Human
ugaguuccuagcca

SEQ ID NO: 1191556 - RNA, 18 nt, Human
ugaguuccuagccaccgc

SEQ ID NO: 1191557 - RNA, 20 nt, Human
agcagguccccagcuuuggc

SEQ ID NO: 1191558 - RNA, 21 nt, Human
agcagguccccagcuuuggcu

SEQ ID NO: 1191559 - RNA, 16 nt, Human
agccucuccacucaug

SEQ ID NO: 1191560 - RNA, 17 nt, Human
agccucgacacagagug

SEQ ID NO: 1191561 - RNA, 18 nt, Human
agccucgacacagagugg

SEQ ID NO: 1191562 - RNA, 23 nt, Human
agccccgcguggaacucgugucu

SEQ ID NO: 1191563 - RNA, 20 nt, Human
agcccugaguuccuagccac

SEQ ID NO: 1191564 - RNA, 23 nt, Human
agcccugaguuccuagccaccgc

SEQ ID NO: 1191565 - RNA, 18 nt, Human
agcccugaguuccuagcc

SEQ ID NO: 1191566 - RNA, 18 nt, Human
agaucccaacacugccag

SEQ ID NO: 1191567 - RNA, 19 nt, Human
agaucccaacacugccagc

SEQ ID NO: 1191568 - RNA, 20 nt, Human
agaucccaacacugccagca

SEQ ID NO: 1191569 - RNA, 17 nt, Human
agauguggaaaagccaa

SEQ ID NO: 1191570 - RNA, 22 nt, Human
agauguggaaaagccaagaggc

SEQ ID NO: 1191571 - RNA, 23 nt, Human
agaguccaucagccuccauccua

SEQ ID NO: 1191572 - RNA, 14 nt, Human
agagucccugccug

SEQ ID NO: 1191573 - RNA, 17 nt, Human
agagucccugccuggac

SEQ ID NO: 1191574 - RNA, 16 nt, Human
ugaauuuuacauggcu

SEQ ID NO: 1191575 - RNA, 14 nt, Human
agauaaauauuaua

SEQ ID NO: 1191576 - RNA, 12 nt, Human
agauaaauauua

SEQ ID NO: 1191577 - RNA, 12 nt, Human
agauacugaaau

SEQ ID NO: 1191578 - RNA, 13 nt, Human
agauacugaaaua

SEQ ID NO: 1191579 - RNA, 15 nt, Human
agauacugaaauaaa

SEQ ID NO: 1191580 - RNA, 21 nt, Human
agaggccauucuuucccaaca

SEQ ID NO: 1191581 - RNA, 12 nt, Human
agagguuuuaaa

SEQ ID NO: 1191582 - RNA, 22 nt, Human
ugaagcacagugaucaaguuau

SEQ ID NO: 1191583 - RNA, 14 nt, Human
agagcugcgggcug

SEQ ID NO: 1191584 - RNA, 16 nt, Human
agagcagugggccugg

SEQ ID NO: 1191585 - RNA, 16 nt, Human
agaaugucaguaugug

SEQ ID NO: 1191586 - RNA, 15 nt, Human
agaaugucaguaugu

SEQ ID NO: 1191587 - RNA, 22 nt, Human
agaaccccuggcuccaggccag

SEQ ID NO: 1191588 - RNA, 19 nt, Human
agaaugucaguauguggaa

SEQ ID NO: 1191589 - RNA, 17 nt, Human
agaaugucaguaugugg

SEQ ID NO: 1191590 - RNA, 21 nt, Human
agacauuugcuaugagcuggg

SEQ ID NO: 1191591 - RNA, 14 nt, Human
agacuuaucaacau

SEQ ID NO: 1191592 - RNA, 19 nt, Human
agacuucccacggcuccuc

SEQ ID NO: 1191593 - RNA, 13 nt, Human
ucuuucuuccaaa

SEQ ID NO: 1191594 - RNA, 17 nt, Human
ucuugguuccagccugc

SEQ ID NO: 1191595 - RNA, 18 nt, Human
ucuugguuccagccugcc

SEQ ID NO: 1191596 - RNA, 19 nt, Human
ucuugguuccagccugcca

SEQ ID NO: 1191597 - RNA, 13 nt, Human
ucuugguuccagc

SEQ ID NO: 1191598 - RNA, 14 nt, Human
ucugagagaggcca

SEQ ID NO: 1191599 - RNA, 20 nt, Human
ucugagagaggccauucuuu

SEQ ID NO: 1191600 - RNA, 12 nt, Human
ucugagagcugu

SEQ ID NO: 1191601 - RNA, 13 nt, Human
ucugauacagaaa

SEQ ID NO: 1191602 - RNA, 17 nt, Human
ucucucacuuguuuuau

SEQ ID NO: 1191603 - RNA, 21 nt, Human
ucucucacuuguuuuauuuaa

SEQ ID NO: 1191604 - RNA, 16 nt, Human
ucucauuccagaggaa

SEQ ID NO: 1191605 - RNA, 23 nt, Human
acuugucccgggacaccuaggcu

SEQ ID NO: 1191606 - RNA, 21 nt, Human
ucucacagcuccaagaauuuc

SEQ ID NO: 1191607 - RNA, 23 nt, Human
acuggccaguggcuggaucugug

SEQ ID NO: 1191608 - RNA, 17 nt, Human
ucgagaucccaacacug

SEQ ID NO: 1191609 - RNA, 22 nt, Human
ucgagaucccaacacugccagc

SEQ ID NO: 1191610 - RNA, 18 nt, Human
ucgagaucccaacacugc

SEQ ID NO: 1191611 - RNA, 21 nt, Human
ucgagaucccaacacugccag

SEQ ID NO: 1191612 - RNA, 16 nt, Human
acugcuaagaauauuu

SEQ ID NO: 1191613 - RNA, 18 nt, Human
acugcuaagaauauuuga

SEQ ID NO: 1191614 - RNA, 16 nt, Human
acuguucccugaggug

SEQ ID NO: 1191615 - RNA, 19 nt, Human
acuguucccugagguggga

SEQ ID NO: 1191616 - RNA, 19 nt, Human
acucaugugacucuuucca

SEQ ID NO: 1191617 - RNA, 14 nt, Human
acuccuccuagcca

SEQ ID NO: 1191618 - RNA, 15 nt, Human
acuccuccuagccac

SEQ ID NO: 1191619 - RNA, 16 nt, Human
acuccuccuagccacc

SEQ ID NO: 1191620 - RNA, 18 nt, Human
acuccuccuagccaccca

SEQ ID NO: 1191621 - RNA, 21 nt, Human
ucccgggacaccuaggcuagg

SEQ ID NO: 1191622 - RNA, 20 nt, Human
ucccugaaggaaccaaagcg

SEQ ID NO: 1191623 - RNA, 11 nt, Human
ucccugaggca

SEQ ID NO: 1191624 - RNA, 20 nt, Human
ucccugaggcagguccccag

SEQ ID NO: 1191625 - RNA, 21 nt, Human
ucccugaggcagguccccaga

SEQ ID NO: 1191626 - RNA, 22 nt, Human
ucccugaggcagguccccagac

SEQ ID NO: 1191627 - RNA, 17 nt, Human
acgugggcauucaaaug

SEQ ID NO: 1191628 - RNA, 20 nt, Human
acgugggcauucaaauguau

SEQ ID NO: 1191629 - RNA, 14 nt, Human
uccacucaugugac

SEQ ID NO: 1191630 - RNA, 21 nt, Human
uccacucaugugacucuuucc

SEQ ID NO: 1191631 - RNA, 15 nt, Human
uccacuccuccuagc

SEQ ID NO: 1191632 - RNA, 18 nt, Human
uccacuccuccuagccac

SEQ ID NO: 1191633 - RNA, 18 nt, Human
uccacuggggauugggcc

SEQ ID NO: 1191634 - RNA, 21 nt, Human
uccacuccuccuagccaccca

SEQ ID NO: 1191635 - RNA, 16 nt, Human
uccaggccagggggcc

SEQ ID NO: 1191636 - RNA, 18 nt, Human
uccaggccagggggccag

SEQ ID NO: 1191637 - RNA, 21 nt, Human
uccaaccggcuuuguggcacu

SEQ ID NO: 1191638 - RNA, 17 nt, Human
ucaggaaccgaggcagg

SEQ ID NO: 1191639 - RNA, 14 nt, Human
accucuaaauucuu

SEQ ID NO: 1191640 - RNA, 22 nt, Human
uauuuguaaauuuaugugaugg

SEQ ID NO: 1191641 - RNA, 17 nt, Human
uauuuguaaauuuaugu

SEQ ID NO: 1191642 - RNA, 16 nt, Human
uauuuguaaauuuaug

SEQ ID NO: 1191643 - RNA, 20 nt, Human
ucaaauacgugggcauucaa

SEQ ID NO: 1191644 - RNA, 22 nt, Human
uauuucccugaaggaaccaaag

SEQ ID NO: 1191645 - RNA, 18 nt, Human
accagagaaaaagggagg

SEQ ID NO: 1191646 - RNA, 13 nt, Human
accagaagcccag

SEQ ID NO: 1191647 - RNA, 14 nt, Human
accagaagcccaga

SEQ ID NO: 1191648 - RNA, 16 nt, Human
accagaagcccagaau

SEQ ID NO: 1191649 - RNA, 22 nt, Human
accacacguaaugaaacuugga

SEQ ID NO: 1191650 - RNA, 21 nt, Human
ucagcccaaaccaccagaagc

SEQ ID NO: 1191651 - RNA, 22 nt, Human
ucagcccaaaccaccagaagcc

SEQ ID NO: 1191652 - RNA, 13 nt, Human
ucacucuuggagc

SEQ ID NO: 1191653 - RNA, 16 nt, Human
uaauuuaaaauuguga

SEQ ID NO: 1191654 - RNA, 15 nt, Human
uaauuuaaaauugug

SEQ ID NO: 1191655 - RNA, 21 nt, Human
aaugccccugaauuuaaauag

SEQ ID NO: 1191656 - RNA, 14 nt, Human
uacagaggacagua

SEQ ID NO: 1191657 - RNA, 18 nt, Human
uacagaggacaguauuug

SEQ ID NO: 1191658 - RNA, 18 nt, Human
aauguaugcuucauacag

SEQ ID NO: 1191659 - RNA, 21 nt, Human
aauguaugcuucauacaggga

SEQ ID NO: 1191660 - RNA, 22 nt, Human
aaugacagguuugggaccccug

SEQ ID NO: 1191661 - RNA, 19 nt, Human
uaauagguuuggacaaaau

SEQ ID NO: 1191662 - RNA, 14 nt, Human
uaauagguuuggac

SEQ ID NO: 1191663 - RNA, 15 nt, Human
uaaugaaacuuggau

SEQ ID NO: 1191664 - RNA, 14 nt, Human
uaaugaaacuugga

SEQ ID NO: 1191665 - RNA, 16 nt, Human
aauaucuccgucaacu

SEQ ID NO: 1191666 - RNA, 21 nt, Human
aauaucuccgucaacucauau

SEQ ID NO: 1191667 - RNA, 18 nt, Human
uaagaauauuugaaugua

SEQ ID NO: 1191668 - RNA, 16 nt, Human
uaaccucuaaauucuu

SEQ ID NO: 1191669 - RNA, 24 nt, Human
aauagcuuuuuucucugauacaga

SEQ ID NO: 1191670 - RNA, 17 nt, Human
acaccccgacuuuuguu

SEQ ID NO: 1191671 - RNA, 22 nt, Human
uagguuuggacaaaauggaaua

SEQ ID NO: 1191672 - RNA, 16 nt, Human
acacucacccaacaau

SEQ ID NO: 1191673 - RNA, 15 nt, Human
aauuugguuuucaca

SEQ ID NO: 1191674 - RNA, 21 nt, Human
aauuugguuuucacauuggaa

SEQ ID NO: 1191675 - RNA, 13 nt, Human
aauuugguuuuca

SEQ ID NO: 1191676 - RNA, 13 nt, Human
aauuuaguauuuu

SEQ ID NO: 1191677 - RNA, 17 nt, Human
aauuucuaggacugaau

SEQ ID NO: 1191678 - RNA, 18 nt, Human
aauuucuaggacugaauu

SEQ ID NO: 1191679 - RNA, 22 nt, Human
aauuucuaggacugaauuauga

SEQ ID NO: 1191680 - RNA, 23 nt, Human
aauuucuaggacugaauuaugaa

SEQ ID NO: 1191681 - RNA, 16 nt, Human
uacugggagccuaccc

SEQ ID NO: 1191682 - RNA, 19 nt, Human
uacugaaauaaacgucuua

SEQ ID NO: 1191683 - RNA, 22 nt, Human
uacugaaauaaacgucuuaaau

SEQ ID NO: 1191684 - RNA, 23 nt, Human
aaggcuauggggauagaugugug

SEQ ID NO: 1191685 - RNA, 16 nt, Human
guuuaugugugugugu

SEQ ID NO: 1191686 - RNA, 13 nt, Human
guuuaugugugug

SEQ ID NO: 1191687 - RNA, 18 nt, Human
guuguaucagcacgugug

SEQ ID NO: 1191688 - RNA, 16 nt, Human
guuuucuuaacuuaaa

SEQ ID NO: 1191689 - RNA, 16 nt, Human
guuugggaccccuggu

SEQ ID NO: 1191690 - RNA, 22 nt, Human
guuugggaccccuggugguuca

SEQ ID NO: 1191691 - RNA, 17 nt, Human
aagccuggucagcccaa

SEQ ID NO: 1191692 - RNA, 15 nt, Human
aagccuggucagccc

SEQ ID NO: 1191693 - RNA, 15 nt, Human
aagccucgacacaga

SEQ ID NO: 1191694 - RNA, 14 nt, Human
guguguaauuuaaa

SEQ ID NO: 1191695 - RNA, 17 nt, Human
gugucuuuccacuccuc

SEQ ID NO: 1191696 - RNA, 12 nt, Human
guguguaugugg

SEQ ID NO: 1191697 - RNA, 15 nt, Human
guguuguguguggga

SEQ ID NO: 1191698 - RNA, 14 nt, Human
aagagguuuuaaag

SEQ ID NO: 1191699 - RNA, 18 nt, Human
aagagguuuuaaagcuuc

SEQ ID NO: 1191700 - RNA, 14 nt, Human
gugggaguguguaa

SEQ ID NO: 1191701 - RNA, 13 nt, Human
gugggagugugua

SEQ ID NO: 1191702 - RNA, 16 nt, Human
gugggucugugugugu

SEQ ID NO: 1191703 - RNA, 13 nt, Human
gugggucugugug

SEQ ID NO: 1191704 - RNA, 23 nt, Human
guggggggggggcgcggcuggga

SEQ ID NO: 1191705 - RNA, 16 nt, Human
guggggggcuucauac

SEQ ID NO: 1191706 - RNA, 15 nt, Human
guggggggcuucaua

SEQ ID NO: 1191707 - RNA, 19 nt, Human
aagaagugugucacccuua

SEQ ID NO: 1191708 - RNA, 20 nt, Human
guggaagugugggucugugu

SEQ ID NO: 1191709 - RNA, 19 nt, Human
guggaagugugggucugug

SEQ ID NO: 1191710 - RNA, 15 nt, Human
guggaaguguggguc

SEQ ID NO: 1191711 - RNA, 14 nt, Human
guggaagugugggu

SEQ ID NO: 1191712 - RNA, 23 nt, Human
gugcuauuguagagccagagguc

SEQ ID NO: 1191713 - RNA, 22 nt, Human
guggaagugugggucugugugu

SEQ ID NO: 1191714 - RNA, 21 nt, Human
guggaagugugggucugugug

SEQ ID NO: 1191715 - RNA, 15 nt, Human
guggaauuauuuuaa

SEQ ID NO: 1191716 - RNA, 16 nt, Human
guggaauuauuuuaaa

SEQ ID NO: 1191717 - RNA, 18 nt, Human
guggaauuauuuuaaaag

SEQ ID NO: 1191718 - RNA, 19 nt, Human
guggaauuauuuuaaaaga

SEQ ID NO: 1191719 - RNA, 14 nt, Human
guggcacuggggca

SEQ ID NO: 1191720 - RNA, 24 nt, Human
aagaauuucuaggacugaauuaug

SEQ ID NO: 1191721 - RNA, 20 nt, Human
aagaauugucuuucugucuc

SEQ ID NO: 1191722 - RNA, 20 nt, Human
aagacaaaaagcuacuuauu

SEQ ID NO: 1191723 - RNA, 23 nt, Human
aagacaaaaagcuacuuauugua

SEQ ID NO: 1191724 - RNA, 16 nt, Human
guaggaacugcugggc

SEQ ID NO: 1191725 - RNA, 13 nt, Human
guaggauuacuag

SEQ ID NO: 1191726 - RNA, 14 nt, Human
aaaucuaugauucc

SEQ ID NO: 1191727 - RNA, 16 nt, Human
aaaucuaugauuccag

SEQ ID NO: 1191728 - RNA, 9 nt, Human
aaaugaggg

SEQ ID NO: 1191729 - RNA, 20 nt, Human
guaugugggggucugugugu

SEQ ID NO: 1191730 - RNA, 19 nt, Human
guaugugggggucugugug

SEQ ID NO: 1191731 - RNA, 21 nt, Human
guauguggaagugugggucug

SEQ ID NO: 1191732 - RNA, 18 nt, Human
guauguggaagugugggu

SEQ ID NO: 1191733 - RNA, 17 nt, Human
guauguggaaguguggg

SEQ ID NO: 1191734 - RNA, 16 nt, Human
guauguggaagugugg

SEQ ID NO: 1191735 - RNA, 15 nt, Human
guauguggaagugug

SEQ ID NO: 1191736 - RNA, 19 nt, Human
gucaacucauauuuucaug

SEQ ID NO: 1191737 - RNA, 22 nt, Human
aaauuuccugggagcuuuugua

SEQ ID NO: 1191738 - RNA, 20 nt, Human
aaauuuaguauuuuguuuca

SEQ ID NO: 1191739 - RNA, 20 nt, Human
guauuuaauagguuuggaca

SEQ ID NO: 1191740 - RNA, 12 nt, Human
gucucccuccuc

SEQ ID NO: 1191741 - RNA, 16 nt, Human
gucucccuccucugcc

SEQ ID NO: 1191742 - RNA, 19 nt, Human
aaccaaagcgaauuuuaaa

SEQ ID NO: 1191743 - RNA, 19 nt, Human
aacucgugucuggcacagc

SEQ ID NO: 1191744 - RNA, 12 nt, Human
gucuggcugcag

SEQ ID NO: 1191745 - RNA, 13 nt, Human
gucuggcugcaga

SEQ ID NO: 1191746 - RNA, 14 nt, Human
gucuggcugcagag

SEQ ID NO: 1191747 - RNA, 12 nt, Human
aacacugccagc

SEQ ID NO: 1191748 - RNA, 22 nt, Human
aacacugccagcauuucccuuc

SEQ ID NO: 1191749 - RNA, 15 nt, Human
aacaagucagucauu

SEQ ID NO: 1191750 - RNA, 18 nt, Human
aacaagucagucauucag

SEQ ID NO: 1191751 - RNA, 19 nt, Human
aacaguuguguuugaagca

SEQ ID NO: 1191752 - RNA, 17 nt, Human
caucuguaccucugccu

SEQ ID NO: 1191753 - RNA, 16 nt, Human
cauacagggauggugu

SEQ ID NO: 1191754 - RNA, 19 nt, Human
cauacagggaugguguuca

SEQ ID NO: 1191755 - RNA, 14 nt, Human
caguucagcuuggg

SEQ ID NO: 1191756 - RNA, 15 nt, Human
caguucagcuugggg

SEQ ID NO: 1191757 - RNA, 15 nt, Human
cauuggauucugaga

SEQ ID NO: 1191758 - RNA, 20 nt, Human
cauuggauucugagagcugu

SEQ ID NO: 1191759 - RNA, 19 nt, Human
ccaauucgaacuuuuucca

SEQ ID NO: 1191760 - RNA, 17 nt, Human
cagcacguguggccugu

SEQ ID NO: 1191761 - RNA, 18 nt, Human
cagccaggccacuggccc

SEQ ID NO: 1191762 - RNA, 14 nt, Human
cagauaugauucaa

SEQ ID NO: 1191763 - RNA, 15 nt, Human
cagauaugauucaaa

SEQ ID NO: 1191764 - RNA, 18 nt, Human
caccuaggcuaggguggg

SEQ ID NO: 1191765 - RNA, 19 nt, Human
caccuaggcuagggugggg

SEQ ID NO: 1191766 - RNA, 20 nt, Human
caaguuauuuuuaauuuggu

SEQ ID NO: 1191767 - RNA, 17 nt, Human
auuuuuaugccaccuga

SEQ ID NO: 1191768 - RNA, 16 nt, Human
auuuuuuucugaaauu

SEQ ID NO: 1191769 - RNA, 17 nt, Human
auuuuuuucugaaauuu

SEQ ID NO: 1191770 - RNA, 18 nt, Human
auuuguguugaagagguu

SEQ ID NO: 1191771 - RNA, 22 nt, Human
auuuguguugaagagguuuuaa

SEQ ID NO: 1191772 - RNA, 14 nt, Human
auuuguguugaaga

SEQ ID NO: 1191773 - RNA, 15 nt, Human
auuuguguugaagag

SEQ ID NO: 1191774 - RNA, 22 nt, Human
auuuaauagguuuggacaaaau

SEQ ID NO: 1191775 - RNA, 13 nt, Human
auucuuucccaac

SEQ ID NO: 1191776 - RNA, 17 nt, Human
auucauggccuggggga

SEQ ID NO: 1191777 - RNA, 23 nt, Human
ccagacuucccacggcuccucga

SEQ ID NO: 1191778 - RNA, 18 nt, Human
ccagagaaaaagggaggg

SEQ ID NO: 1191779 - RNA, 14 nt, Human
ccagacuccaccaa

SEQ ID NO: 1191780 - RNA, 18 nt, Human
ccagacuccaccaagccu

SEQ ID NO: 1191781 - RNA, 21 nt, Human
ccccgcguggaacucgugucu

SEQ ID NO: 1191782 - RNA, 13 nt, Human
ccauugguguuga

SEQ ID NO: 1191783 - RNA, 21 nt, Human
ccaugagcuccuuaaggcucu

SEQ ID NO: 1191784 - RNA, 12 nt, Human
ccugccuggacc

SEQ ID NO: 1191785 - RNA, 19 nt, Human
ccugccuggaccagccucu

SEQ ID NO: 1191786 - RNA, 23 nt, Human
ccucuuggggaguuuaggguggg

SEQ ID NO: 1191787 - RNA, 15 nt, Human
ccucuuggcugccuu

SEQ ID NO: 1191788 - RNA, 22 nt, Human
ccucuuggggaguuuagggugg

SEQ ID NO: 1191789 - RNA, 14 nt, Human
ccugaguuccuagc

SEQ ID NO: 1191790 - RNA, 18 nt, Human
ccugaguuccuagccacc

SEQ ID NO: 1191791 - RNA, 12 nt, Human
ccugcagagcug

SEQ ID NO: 1191792 - RNA, 13 nt, Human
ccugcagagcugc

SEQ ID NO: 1191793 - RNA, 14 nt, Human
ccugcagagcugcg

SEQ ID NO: 1191794 - RNA, 17 nt, Human
ccugcagagcugcgggc

SEQ ID NO: 1191795 - RNA, 21 nt, Human
ccucugcccgggagcucagga

SEQ ID NO: 1191796 - RNA, 22 nt, Human
ccucugcccgggagcucaggaa

SEQ ID NO: 1191797 - RNA, 20 nt, Human
cccugaauuuaaauagcuuu

SEQ ID NO: 1191798 - RNA, 14 nt, Human
cccugaaggaacca

SEQ ID NO: 1191799 - RNA, 18 nt, Human
cccugagaucucugcagg

SEQ ID NO: 1191800 - RNA, 23 nt, Human
cucaugauagaaggcuaugggga

SEQ ID NO: 1191801 - RNA, 23 nt, Human
cucaggccgaaggaggagucagg

SEQ ID NO: 1191802 - RNA, 20 nt, Human
cucaggccugacucucagca

SEQ ID NO: 1191803 - RNA, 16 nt, Human
cuccugucucccuccu

SEQ ID NO: 1191804 - RNA, 22 nt, Human
cuccucugcccgggagcucagg

SEQ ID NO: 1191805 - RNA, 24 nt, Human
cuccucugcccgggagcucaggaa

SEQ ID NO: 1191806 - RNA, 14 nt, Human
cucaugugacucuu

SEQ ID NO: 1191807 - RNA, 13 nt, Human
cucccucuacugg

SEQ ID NO: 1191808 - RNA, 19 nt, Human
cucccucuacugggagccu

SEQ ID NO: 1191809 - RNA, 20 nt, Human
cucccucuacugggagccua

SEQ ID NO: 1191810 - RNA, 20 nt, Human
cucugcaggaaauggcugug

SEQ ID NO: 1191811 - RNA, 16 nt, Human
aaaauugugauguguc

SEQ ID NO: 1191812 - RNA, 12 nt, Human
aaaauggaauac

SEQ ID NO: 1191813 - RNA, 19 nt, Human
aaacaagucagucauucag

SEQ ID NO: 1191814 - RNA, 23 nt, Human
ggggucuguguguuuaugugugu

SEQ ID NO: 1191815 - RNA, 12 nt, Human
ggggccugggca

SEQ ID NO: 1191816 - RNA, 15 nt, Human
ggggccugggcagga

SEQ ID NO: 1191817 - RNA, 14 nt, Human
aaaccaccagaagc

SEQ ID NO: 1191818 - RNA, 16 nt, Human
aaagcuacuuauugua

SEQ ID NO: 1191819 - RNA, 17 nt, Human
aaagcuacuuauuguag

SEQ ID NO: 1191820 - RNA, 20 nt, Human
ggugcccagaaugaggcugc

SEQ ID NO: 1191821 - RNA, 20 nt, Human
ggucuugguuccagccugcc

SEQ ID NO: 1191822 - RNA, 21 nt, Human
ggucuugguuccagccugcca

SEQ ID NO: 1191823 - RNA, 14 nt, Human
aaagaugcaaugua

SEQ ID NO: 1191824 - RNA, 14 nt, Human
gggagggggagagg

SEQ ID NO: 1191825 - RNA, 17 nt, Human
ggcuggaucugugaggg

SEQ ID NO: 1191826 - RNA, 20 nt, Human
ggcuccucgagaucccaaca

SEQ ID NO: 1191827 - RNA, 15 nt, Human
aaaaagggaggggga

SEQ ID NO: 1191828 - RNA, 23 nt, Human
ggcaggcaucggggagccgggag

SEQ ID NO: 1191829 - RNA, 18 nt, Human
ggccagcaccaucucuuu

SEQ ID NO: 1191830 - RNA, 15 nt, Human
ggagagacgggcccu

SEQ ID NO: 1191831 - RNA, 17 nt, Human
ggagagacgggcccugg

SEQ ID NO: 1191832 - RNA, 16 nt, Human
ggacuuggagguagcu

SEQ ID NO: 1191833 - RNA, 18 nt, Human
ggaccccuggugguucac

SEQ ID NO: 1191834 - RNA, 12 nt, Human
gccauucuuucc

SEQ ID NO: 1191835 - RNA, 19 nt, Human
gccaggccacuggccccug

SEQ ID NO: 1191836 - RNA, 17 nt, Human
gccagacccccuggaga

SEQ ID NO: 1191837 - RNA, 19 nt, Human
gccaccgccuccuacagcc

SEQ ID NO: 1191838 - RNA, 16 nt, Human
gccaccgccuccuaca

SEQ ID NO: 1191839 - RNA, 16 nt, Human
gccuacccacccccag

SEQ ID NO: 1191840 - RNA, 17 nt, Human
gccuacccacccccagg

SEQ ID NO: 1191841 - RNA, 21 nt, Human
gcuauggggauagaugugugg

SEQ ID NO: 1191842 - RNA, 19 nt, Human
gcuauggggauagaugugu

SEQ ID NO: 1191843 - RNA, 14 nt, Human
gcaccggggccugg

SEQ ID NO: 1191844 - RNA, 16 nt, Human
gcaccggggccugggc

SEQ ID NO: 1191845 - RNA, 19 nt, Human
gcaccggggccugggcagg

SEQ ID NO: 1191846 - RNA, 9 nt, Human
gagggcugc

SEQ ID NO: 1191847 - RNA, 16 nt, Human
gagggcugccuuugga

SEQ ID NO: 1191848 - RNA, 18 nt, Human
gaggcugcagccaggcca

SEQ ID NO: 1191849 - RNA, 19 nt, Human
gaggcugcagccaggccac

SEQ ID NO: 1191850 - RNA, 12 nt, Human
gaggcagguccc

SEQ ID NO: 1191851 - RNA, 13 nt, Human
gaggcaggucccc

SEQ ID NO: 1191852 - RNA, 16 nt, Human
gaggcagguccccaga

SEQ ID NO: 1191853 - RNA, 18 nt, Human
gagucagggagagcugaa

SEQ ID NO: 1191854 - RNA, 17 nt, Human
gaguccaucagccucca

SEQ ID NO: 1191855 - RNA, 22 nt, Human
gaggugcuucuaguucugccag

SEQ ID NO: 1191856 - RNA, 23 nt, Human
gaggugcuucuaguucugccagg

SEQ ID NO: 1191857 - RNA, 17 nt, Human
gagguggaagagggcug

SEQ ID NO: 1191858 - RNA, 20 nt, Human
gagguggaagagggcugcaa

SEQ ID NO: 1191859 - RNA, 18 nt, Human
gagguggaauuauuuuaa

SEQ ID NO: 1191860 - RNA, 13 nt, Human
gaguuggcuggga

SEQ ID NO: 1191861 - RNA, 20 nt, Human
gaacugcugggcuuggcagc

SEQ ID NO: 1191862 - RNA, 17 nt, Human
gaacugcugggcuuggc

SEQ ID NO: 1191863 - RNA, 12 nt, Human
gaaccgaggcag

SEQ ID NO: 1191864 - RNA, 15 nt, Human
gaaccgaggcaggga

SEQ ID NO: 1191865 - RNA, 24 nt, Human
gaagugugggucugugugugugua

SEQ ID NO: 1191866 - RNA, 21 nt, Human
gaagugugggucugugugugu

SEQ ID NO: 1191867 - RNA, 14 nt, Human
gacugaauuaugaa

SEQ ID NO: 1191868 - RNA, 20 nt, Human
gacugaauuaugaaacuuuu

SEQ ID NO: 1191869 - RNA, 13 nt, Human
cuggcccugugcc

SEQ ID NO: 1191870 - RNA, 13 nt, Human
cugggcaggaggg

SEQ ID NO: 1191871 - RNA, 14 nt, Human
cuggaucugugagg

SEQ ID NO: 1191872 - RNA, 14 nt, Human
cugcaccggggccu

SEQ ID NO: 1191873 - RNA, 16 nt, Human
cugcaccggggccugg

SEQ ID NO: 1191874 - RNA, 18 nt, Human
cugcaccggggccugggc

SEQ ID NO: 1191875 - RNA, 19 nt, Human
cugcaccggggccugggca

SEQ ID NO: 1191876 - RNA, 16 nt, Human
cugcaaauccuugugg

SEQ ID NO: 1191877 - RNA, 19 nt, Human
cugcaaauccuugugggaa

SEQ ID NO: 1191878 - RNA, 15 nt, Human
cucuuauaucuauau

SEQ ID NO: 1191879 - RNA, 18 nt, Human
cucuuauaucuauauuuu

SEQ ID NO: 1191880 - RNA, 17 nt, Human
cugcaggaaauggcugu

SEQ ID NO: 1191881 - RNA, 14 nt, Human
cuuugagguggaag

SEQ ID NO: 1191882 - RNA, 16 nt, Human
cuuugagguggaagag

SEQ ID NO: 1191883 - RNA, 17 nt, Human
cuuugagguggaagagg

SEQ ID NO: 1191884 - RNA, 22 nt, Human
cuuugagguggaagagggcugc

SEQ ID NO: 1191885 - RNA, 14 nt, Human
caccacacucagcc

SEQ ID NO: 1191886 - RNA, 15 nt, Human
caccacacucagccc

SEQ ID NO: 1191887 - RNA, 19 nt, Human
caccacacugauccagccc

SEQ ID NO: 1191888 - RNA, 16 nt, Human
cacaugagauaauaug

SEQ ID NO: 1191889 - RNA, 15 nt, Human
cacaugagauaauau

SEQ ID NO: 1191890 - RNA, 19 nt, Human
cacacguaaugaaacuugg

SEQ ID NO: 1191891 - RNA, 20 nt, Human
cacacguaaugaaacuugga

SEQ ID NO: 1191892 - RNA, 20 nt, Human
caagcccaguucagcuuggg

SEQ ID NO: 1191893 - RNA, 23 nt, Human
caagagccugagagugaggugga

SEQ ID NO: 1191894 - RNA, 11 nt, Human
caagagccuga

SEQ ID NO: 1191895 - RNA, 13 nt, Human
caagagccugaga

SEQ ID NO: 1191896 - RNA, 19 nt, Human
uuuagaagaagugugucac

SEQ ID NO: 1191897 - RNA, 17 nt, Human
uuuagaagaaguguguc

SEQ ID NO: 1191898 - RNA, 22 nt, Human
uuuacauggcuggagcuagaau

SEQ ID NO: 1191899 - RNA, 17 nt, Human
uuuacauggcuggagcu

SEQ ID NO: 1191900 - RNA, 16 nt, Human
uuucuaggacugaauu

SEQ ID NO: 1191901 - RNA, 17 nt, Human
uuucuaggacugaauua

SEQ ID NO: 1191902 - RNA, 22 nt, Human
uuuuacauaaauuuaguauuuu

SEQ ID NO: 1191903 - RNA, 17 nt, Human
uuuuaauuugguuuuca

SEQ ID NO: 1191904 - RNA, 21 nt, Human
uuuuaauuugguuuucacauu

SEQ ID NO: 1191905 - RNA, 16 nt, Human
uuugagguggaagagg

SEQ ID NO: 1191906 - RNA, 12 nt, Human
uuuuuucugaaa

SEQ ID NO: 1191907 - RNA, 18 nt, Human
uuguaaauaaaggaacca

SEQ ID NO: 1191908 - RNA, 17 nt, Human
uuggguggggggcuuca

SEQ ID NO: 1191909 - RNA, 19 nt, Human
uuggguggggggcuucaua

SEQ ID NO: 1191910 - RNA, 20 nt, Human
uuggguggggggcuucauac

SEQ ID NO: 1191911 - RNA, 21 nt, Human
uuggguggggggcuucauaca

SEQ ID NO: 1191912 - RNA, 22 nt, Human
uuggguggggggcuucauacac

SEQ ID NO: 1191913 - RNA, 23 nt, Human
uuggcaaacucuccaccacacgu

SEQ ID NO: 1191914 - RNA, 16 nt, Human
uuggcaaacucuccac

SEQ ID NO: 1191915 - RNA, 20 nt, Human
uuggcaaacucuccaccaca

SEQ ID NO: 1191916 - RNA, 15 nt, Human
uuggauucugagagc

SEQ ID NO: 1191917 - RNA, 17 nt, Human
uuggauucugagagcug

SEQ ID NO: 1191918 - RNA, 18 nt, Human
uugaauguaugcuucaua

SEQ ID NO: 1191919 - RNA, 15 nt, Human
uugaacugagcuugg

SEQ ID NO: 1191920 - RNA, 16 nt, Human
uugaacugagcuugga

SEQ ID NO: 1191921 - RNA, 14 nt, Human
uucucugauacaga

SEQ ID NO: 1191922 - RNA, 15 nt, Human
uucucugauacagaa

SEQ ID NO: 1191923 - RNA, 16 nt, Human
uucucugauacagaaa

SEQ ID NO: 1191924 - RNA, 17 nt, Human
uucucugauacagaaaa

SEQ ID NO: 1191925 - RNA, 22 nt, Human
uuccuagccaccgccuccuaca

SEQ ID NO: 1191926 - RNA, 14 nt, Human
uuccuagccaccgc

SEQ ID NO: 1191927 - RNA, 15 nt, Human
uuccuagccaccgcc

SEQ ID NO: 1191928 - RNA, 21 nt, Human
uuccuagccaccgccuccuac

SEQ ID NO: 1191929 - RNA, 12 nt, Human
uuccagccugcc

SEQ ID NO: 1191930 - RNA, 14 nt, Human
uuccagccugccac

SEQ ID NO: 1191931 - RNA, 16 nt, Human
uuccagccugccacuc

SEQ ID NO: 1191932 - RNA, 14 nt, Human
uucacucuuggagc

SEQ ID NO: 1191933 - RNA, 18 nt, Human
uucacucuuggagccugc

SEQ ID NO: 1191934 - RNA, 19 nt, Human
uucacucuuggagccugca

SEQ ID NO: 1191935 - RNA, 19 nt, Human
uucaaugccccugaauuua

SEQ ID NO: 1191936 - RNA, 16 nt, Human
uguaaauuuaugugau

SEQ ID NO: 1191937 - RNA, 15 nt, Human
uguaaauuuauguga

SEQ ID NO: 1191938 - RNA, 18 nt, Human
ugugaggggcucucucau

SEQ ID NO: 1191939 - RNA, 14 nt, Human
ugucuggcugcaga

SEQ ID NO: 1191940 - RNA, 16 nt, Human
ugucuggcugcagagc

SEQ ID NO: 1191941 - RNA, 17 nt, Human
ugucuggcugcagagca

SEQ ID NO: 1191942 - RNA, 20 nt, Human
ugugggucugugugugugua

SEQ ID NO: 1191943 - RNA, 16 nt, Human
ugugggucugugugug

SEQ ID NO: 1191944 - RNA, 14 nt, Human
ugugggucugugug

SEQ ID NO: 1191945 - RNA, 16 nt, Human
ugugggggucugugug

SEQ ID NO: 1191946 - RNA, 21 nt, Human
uguggaaaagccaagaggcug

SEQ ID NO: 1191947 - RNA, 23 nt, Human
uguggaaaagccaagaggcugca

SEQ ID NO: 1191948 - RNA, 19 nt, Human
uguggaaaagccaagaggc

SEQ ID NO: 1191949 - RNA, 14 nt, Human
uguuuacagaggac

SEQ ID NO: 1191950 - RNA, 21 nt, Human
uguuuacagaggacaguauuu

SEQ ID NO: 1191951 - RNA, 19 nt, Human
uguugaagagguuuuaaag

SEQ ID NO: 1191952 - RNA, 11 nt, Human
uguguguaugu

SEQ ID NO: 1191953 - RNA, 23 nt, Human
uguguugugugugggagugugua

SEQ ID NO: 1191954 - RNA, 14 nt, Human
uguguugugugugg

SEQ ID NO: 1191955 - RNA, 13 nt, Human
uguguuuaugugu

SEQ ID NO: 1191956 - RNA, 15 nt, Human
uguguuuaugugugu

SEQ ID NO: 1191957 - RNA, 23 nt, Human
uguguaugugggggucugugugu

SEQ ID NO: 1191958 - RNA, 14 nt, Human
uguguauguggggg

SEQ ID NO: 1191959 - RNA, 15 nt, Human
uuacagaggacagua

SEQ ID NO: 1191960 - RNA, 22 nt, Human
uuacauggcuggagcuagaauu

SEQ ID NO: 1191961 - RNA, 23 nt, Human
uuacauggcuggagcuagaauuu

SEQ ID NO: 1191962 - RNA, 16 nt, Human
uuacggaacucaaaua

SEQ ID NO: 1191963 - RNA, 16 nt, Human
uuaauagguuuggaca

SEQ ID NO: 1191964 - RNA, 21 nt, Human
uuaauagguuuggacaaaaug

SEQ ID NO: 1191965 - RNA, 18 nt, Human
uuaaaagauaaauauuau

SEQ ID NO: 1191966 - RNA, 15 nt, Human
uuaaagcuuccauug

SEQ ID NO: 1191967 - RNA, 20 nt, Human
uuaaagcuuccauuguuguc

SEQ ID NO: 1191968 - RNA, 19 nt, Human
uuaaauagcuuuuuucucu

SEQ ID NO: 1191969 - RNA, 16 nt, Human
uggggcaggggccggg

SEQ ID NO: 1191970 - RNA, 18 nt, Human
uggggcaggggccggggg

SEQ ID NO: 1191971 - RNA, 16 nt, Human
ugggagcuuuuguaga

SEQ ID NO: 1191972 - RNA, 13 nt, Human
ugggcauucaaau

SEQ ID NO: 1191973 - RNA, 23 nt, Human
uggaagugugggucugugugugu

SEQ ID NO: 1191974 - RNA, 21 nt, Human
uggaagugugggucugugugu

SEQ ID NO: 1191975 - RNA, 16 nt, Human
uggaauacucuuauau

SEQ ID NO: 1191976 - RNA, 15 nt, Human
uggaauuauuuuaaa

SEQ ID NO: 1191977 - RNA, 20 nt, Human
ugcuucuaguucugccagga

SEQ ID NO: 1191978 - RNA, 18 nt, Human
ugcuucuaguucugccag

SEQ ID NO: 1191979 - RNA, 19 nt, Human
ugcuucuaguucugccagg

SEQ ID NO: 1191980 - RNA, 14 nt, Human
ugcuuuccaaagcc

SEQ ID NO: 1191981 - RNA, 17 nt, Human
uggaauuauuuuaaaag

SEQ ID NO: 1191982 - RNA, 19 nt, Human
uggaauuauuuuaaaagau

SEQ ID NO: 1191983 - RNA, 17 nt, Human
ugcaggaaauggcugug

SEQ ID NO: 1191984 - RNA, 21 nt, Human
ucuguguguguguaugugggg

SEQ ID NO: 1191985 - RNA, 19 nt, Human
ucuguguguguguaugugg

SEQ ID NO: 1191986 - RNA, 18 nt, Human
ucuguguguguguaugug

SEQ ID NO: 1191987 - RNA, 15 nt, Human
ucuguguguguguau

SEQ ID NO: 1191988 - RNA, 20 nt, Human
ucuguguguuuaugugugug

SEQ ID NO: 1191989 - RNA, 19 nt, Human
ucuguguguuuaugugugu

SEQ ID NO: 1191990 - RNA, 16 nt, Human
ucuguguguuuaugug

SEQ ID NO: 1191991 - RNA, 15 nt, Human
ucuguguguuuaugu

SEQ ID NO: 1191992 - RNA, 22 nt, Human
ucuguguguguguauguggggg

SEQ ID NO: 1191993 - RNA, 15 nt, Human
ucuugaacugagcuu

SEQ ID NO: 1191994 - RNA, 19 nt, Human
ucuuuuguaagguuuuugu

SEQ ID NO: 1191995 - RNA, 13 nt, Human
ugaaagauucaau

SEQ ID NO: 1191996 - RNA, 13 nt, Human
ugaaaagaggugu

SEQ ID NO: 1191997 - RNA, 22 nt, Human
ugaaaagaggugugcaagagag

SEQ ID NO: 1191998 - RNA, 19 nt, Human
ugaagagguuuuaaagcuu

SEQ ID NO: 1191999 - RNA, 16 nt, Human
ugaacugagcuuggaa

SEQ ID NO: 1192000 - RNA, 12 nt, Human
ugaacugagcuu

SEQ ID NO: 1192001 - RNA, 15 nt, Human
ugaacugagcuugga

SEQ ID NO: 1192002 - RNA, 16 nt, Human
uccuuaaggcucuuuu

SEQ ID NO: 1192003 - RNA, 19 nt, Human
uccuuaaggcucuuuugua

SEQ ID NO: 1192004 - RNA, 16 nt, Human
ucuaaauucuuucauu

SEQ ID NO: 1192005 - RNA, 14 nt, Human
ucugaaauuuccug

SEQ ID NO: 1192006 - RNA, 17 nt, Human
ucugaaauuuccuggga

SEQ ID NO: 1192007 - RNA, 22 nt, Human
ucucagugguuaagauuccuaa

SEQ ID NO: 1192008 - RNA, 22 nt, Human
ucagucuuuaaucugagaggcc

SEQ ID NO: 1192009 - RNA, 14 nt, Human
uccaagaauuucua

SEQ ID NO: 1192010 - RNA, 17 nt, Human
uccaaagccaaugugaa

SEQ ID NO: 1192011 - RNA, 22 nt, Human
ucauucagauaugauucaaaug

SEQ ID NO: 1192012 - RNA, 16 nt, Human
ucccccuccaccugcu

SEQ ID NO: 1192013 - RNA, 22 nt, Human
uccccagacuccaccaagccug

SEQ ID NO: 1192014 - RNA, 18 nt, Human
ucacgccagacuucccac

SEQ ID NO: 1192015 - RNA, 16 nt, Human
uauuuuuuucugaaau

SEQ ID NO: 1192016 - RNA, 17 nt, Human
uauuuuuuucugaaauu

SEQ ID NO: 1192017 - RNA, 19 nt, Human
gguugggagaaugucagua

SEQ ID NO: 1192018 - RNA, 15 nt, Human
uaaaaaagcugugug

SEQ ID NO: 1192019 - RNA, 16 nt, Human
uaaaagaugcaaugua

SEQ ID NO: 1192020 - RNA, 19 nt, Human
uaauucuuugaccuguugg

SEQ ID NO: 1192021 - RNA, 18 nt, Human
uaauuugguuuucacauu

SEQ ID NO: 1192022 - RNA, 15 nt, Human
uaauuugguuuucac

SEQ ID NO: 1192023 - RNA, 17 nt, Human
uaauuugguuuucacau

SEQ ID NO: 1192024 - RNA, 17 nt, Human
uaagagagucuauuuac

SEQ ID NO: 1192025 - RNA, 13 nt, Human
uaagaucucagug

SEQ ID NO: 1192026 - RNA, 19 nt, Human
uaagaucucagugguuaag

SEQ ID NO: 1192027 - RNA, 14 nt, Human
uaaauuuaguauuu

SEQ ID NO: 1192028 - RNA, 22 nt, Human
uaaauuuaguauuuuguuucag

SEQ ID NO: 1192029 - RNA, 11 nt, Human
uagaugugugg

SEQ ID NO: 1192030 - RNA, 18 nt, Human
uaggaacugcugggcuug

SEQ ID NO: 1192031 - RNA, 15 nt, Human
uaggaacugcugggc

SEQ ID NO: 1192032 - RNA, 16 nt, Human
uagccccacaggaggu

SEQ ID NO: 1192033 - RNA, 15 nt, Human
uaggcuagggugggg

SEQ ID NO: 1192034 - RNA, 13 nt, Human
uaggcuagggugg

SEQ ID NO: 1192035 - RNA, 20 nt, Human
uagugauuuuuaugccaccu

SEQ ID NO: 1192036 - RNA, 21 nt, Human
uagugauuuuuaugccaccug

SEQ ID NO: 1192037 - RNA, 22 nt, Human
uagugauuuuuaugccaccuga

SEQ ID NO: 1192038 - RNA, 21 nt, Human
uauauuucccugaaggaacca

SEQ ID NO: 1192039 - RNA, 15 nt, Human
uacccaaauuaagag

SEQ ID NO: 1192040 - RNA, 18 nt, Human
uacagaaaaguugaauuu

SEQ ID NO: 1192041 - RNA, 22 nt, Human
uacagaaaaguugaauuuuaca

SEQ ID NO: 1192042 - RNA, 17 nt, Human
uacagcccaccuggcuu

SEQ ID NO: 1192043 - RNA, 15 nt, Human
ggugguggcucggga

SEQ ID NO: 1192044 - RNA, 22 nt, Human
ggugguucacucuuggagccug

SEQ ID NO: 1192045 - RNA, 23 nt, Human
ggugguucacucuuggagccugc

SEQ ID NO: 1192046 - RNA, 21 nt, Human
gguguccugcaccggggccug

SEQ ID NO: 1192047 - RNA, 19 nt, Human
gguucacucuuggagccug

SEQ ID NO: 1192048 - RNA, 20 nt, Human
gguucacucuuggagccugc

SEQ ID NO: 1192049 - RNA, 21 nt, Human
gguucacucuuggagccugca

SEQ ID NO: 1192050 - RNA, 23 nt, Human
gguucacucuuggagccugcaga

SEQ ID NO: 1192051 - RNA, 19 nt, Human
ggugaccuuccaagagccu

SEQ ID NO: 1192052 - RNA, 20 nt, Human
ggugaccuuccaagagccug

SEQ ID NO: 1192053 - RNA, 21 nt, Human
ggugaccuuccaagagccuga

SEQ ID NO: 1192054 - RNA, 15 nt, Human
gggggagagggcugc

SEQ ID NO: 1192055 - RNA, 18 nt, Human
ggggcagucugagagagg

SEQ ID NO: 1192056 - RNA, 15 nt, Human
ggggcagucugagag

SEQ ID NO: 1192057 - RNA, 19 nt, Human
ggggcagucugagagaggc

SEQ ID NO: 1192058 - RNA, 15 nt, Human
ggggcgcggcuggga

SEQ ID NO: 1192059 - RNA, 16 nt, Human
ggggcgcggcugggag

SEQ ID NO: 1192060 - RNA, 16 nt, Human
gggccugggcaggagg

SEQ ID NO: 1192061 - RNA, 17 nt, Human
gggccugggcaggaggg

SEQ ID NO: 1192062 - RNA, 15 nt, Human
ggggaaaagagauga

SEQ ID NO: 1192063 - RNA, 18 nt, Human
gguagcauuuguguugaa

SEQ ID NO: 1192064 - RNA, 20 nt, Human
gggucuugguuccagccugc

SEQ ID NO: 1192065 - RNA, 12 nt, Human
gggccugggcag

SEQ ID NO: 1192066 - RNA, 13 nt, Human
gggccugggcagg

SEQ ID NO: 1192067 - RNA, 15 nt, Human
gggccugggcaggag

SEQ ID NO: 1192068 - RNA, 13 nt, Human
gggccccugccag

SEQ ID NO: 1192069 - RNA, 20 nt, Human
gggcagucugagagaggcca

SEQ ID NO: 1192070 - RNA, 21 nt, Human
gggcagucugagagaggccau

SEQ ID NO: 1192071 - RNA, 13 nt, Human
gggauagaugugu

SEQ ID NO: 1192072 - RNA, 14 nt, Human
gggauagaugugug

SEQ ID NO: 1192073 - RNA, 11 nt, Human
gggagugugua

SEQ ID NO: 1192074 - RNA, 16 nt, Human
gggaguuuaggguggg

SEQ ID NO: 1192075 - RNA, 23 nt, Human
gggaggugcuucuaguucugcca

SEQ ID NO: 1192076 - RNA, 17 nt, Human
gggcagucugagagagg

SEQ ID NO: 1192077 - RNA, 18 nt, Human
gggcagucugagagaggc

SEQ ID NO: 1192078 - RNA, 19 nt, Human
gggcagucugagagaggcc

SEQ ID NO: 1192079 - RNA, 15 nt, Human
gggaaggaucccaug

SEQ ID NO: 1192080 - RNA, 13 nt, Human
gggaaugaagaua

SEQ ID NO: 1192081 - RNA, 20 nt, Human
gggaccccuggugguucacu

SEQ ID NO: 1192082 - RNA, 16 nt, Human
ggcugcagccaggcca

SEQ ID NO: 1192083 - RNA, 22 nt, Human
ggcugcagccaggccacuggcc

SEQ ID NO: 1192084 - RNA, 20 nt, Human
ggccccugccagacccccug

SEQ ID NO: 1192085 - RNA, 15 nt, Human
ggcugcuuuccaaag

SEQ ID NO: 1192086 - RNA, 20 nt, Human
ggcagucugagagaggccau

SEQ ID NO: 1192087 - RNA, 17 nt, Human
ggccccugccagacccc

SEQ ID NO: 1192088 - RNA, 19 nt, Human
ggccccugccagacccccu

SEQ ID NO: 1192089 - RNA, 17 nt, Human
ggccccugagaucucug

SEQ ID NO: 1192090 - RNA, 21 nt, Human
ggccccugagaucucugcagg

SEQ ID NO: 1192091 - RNA, 17 nt, Human
ggaucccaugagcuccu

SEQ ID NO: 1192092 - RNA, 20 nt, Human
ggaucccaugagcuccuuaa

SEQ ID NO: 1192093 - RNA, 14 nt, Human
ggcagguccccaga

SEQ ID NO: 1192094 - RNA, 19 nt, Human
ggcagguccccagacucca

SEQ ID NO: 1192095 - RNA, 15 nt, Human
ggauagaugugugga

SEQ ID NO: 1192096 - RNA, 14 nt, Human
ggauagaugugugg

SEQ ID NO: 1192097 - RNA, 13 nt, Human
ggauagaugugug

SEQ ID NO: 1192098 - RNA, 12 nt, Human
ggagggauuugg

SEQ ID NO: 1192099 - RNA, 13 nt, Human
ggagggcaggcau

SEQ ID NO: 1192100 - RNA, 14 nt, Human
ggagggcaggcauc

SEQ ID NO: 1192101 - RNA, 16 nt, Human
ggagccgggagccuga

SEQ ID NO: 1192102 - RNA, 14 nt, Human
ggaggagggcaggc

SEQ ID NO: 1192103 - RNA, 15 nt, Human
ggaggagggcaggca

SEQ ID NO: 1192104 - RNA, 20 nt, Human
ggaggagggcaggcaucggg

SEQ ID NO: 1192105 - RNA, 17 nt, Human
ggaaggaucccaugagc

SEQ ID NO: 1192106 - RNA, 17 nt, Human
ggaacucgugucuggca

SEQ ID NO: 1192107 - RNA, 15 nt, Human
ggaaccgaggcaggg

SEQ ID NO: 1192108 - RNA, 16 nt, Human
ggaaccgaggcaggga

SEQ ID NO: 1192109 - RNA, 20 nt, Human
ggaaccgaggcagggaagga

SEQ ID NO: 1192110 - RNA, 21 nt, Human
gcuucuaguucugccaggaga

SEQ ID NO: 1192111 - RNA, 19 nt, Human
gcuucuaguucugccagga

SEQ ID NO: 1192112 - RNA, 20 nt, Human
gcuucuaguucugccaggag

SEQ ID NO: 1192113 - RNA, 18 nt, Human
gcuucuaguucugccagg

SEQ ID NO: 1192114 - RNA, 19 nt, Human
gcuucuggugaccuuccaa

SEQ ID NO: 1192115 - RNA, 17 nt, Human
gcugggaggagggcagg

SEQ ID NO: 1192116 - RNA, 19 nt, Human
gcugggaggagggcaggca

SEQ ID NO: 1192117 - RNA, 15 nt, Human
gcugccuuuggacuu

SEQ ID NO: 1192118 - RNA, 20 nt, Human
gcugccuuuggacuuguccc

SEQ ID NO: 1192119 - RNA, 13 nt, Human
gccgggagccuga

SEQ ID NO: 1192120 - RNA, 14 nt, Human
gccgggagccugac

SEQ ID NO: 1192121 - RNA, 19 nt, Human
gccgggagccugacccuca

SEQ ID NO: 1192122 - RNA, 21 nt, Human
gccgagaguccaucagccucc

SEQ ID NO: 1192123 - RNA, 20 nt, Human
gccugcagagcugcgggcug

SEQ ID NO: 1192124 - RNA, 14 nt, Human
gcuaagaauauuug

SEQ ID NO: 1192125 - RNA, 16 nt, Human
gcuaagaauauuugaa

SEQ ID NO: 1192126 - RNA, 13 nt, Human
gccccgcguggaa

SEQ ID NO: 1192127 - RNA, 14 nt, Human
gccacucaggccca

SEQ ID NO: 1192128 - RNA, 22 nt, Human
gccacucaggcccaaagccucg

SEQ ID NO: 1192129 - RNA, 15 nt, Human
gcaggagggaggugc

SEQ ID NO: 1192130 - RNA, 11 nt, Human
gcaggaggaag

SEQ ID NO: 1192131 - RNA, 19 nt, Human
gcagauuuugcccuugaca

SEQ ID NO: 1192132 - RNA, 12 nt, Human
gcacagccuggc

SEQ ID NO: 1192133 - RNA, 19 nt, Human
gcacagccuggcuguggcc

SEQ ID NO: 1192134 - RNA, 18 nt, Human
gcauggagauagccccac

SEQ ID NO: 1192135 - RNA, 15 nt, Human
gcagugggccuggcc

SEQ ID NO: 1192136 - RNA, 23 nt, Human
gcagguccccagacuccaccaag

SEQ ID NO: 1192137 - RNA, 22 nt, Human
gaguguguaauuuaaaauugug

SEQ ID NO: 1192138 - RNA, 21 nt, Human
gaguguguaauuuaaaauugu

SEQ ID NO: 1192139 - RNA, 18 nt, Human
gacuucccacggcuccuc

SEQ ID NO: 1192140 - RNA, 15 nt, Human
gauugggccccugcc

SEQ ID NO: 1192141 - RNA, 17 nt, Human
gaagagaagggcagggc

SEQ ID NO: 1192142 - RNA, 15 nt, Human
gaagauacugaaaua

SEQ ID NO: 1192143 - RNA, 20 nt, Human
gaagagguuuuaaagcuucc

SEQ ID NO: 1192144 - RNA, 12 nt, Human
gaagagggcugc

SEQ ID NO: 1192145 - RNA, 11 nt, Human
gaaccaaagcg

SEQ ID NO: 1192146 - RNA, 21 nt, Human
gaacagcggcuggacuuggag

SEQ ID NO: 1192147 - RNA, 13 nt, Human
gaagcguuguccu

SEQ ID NO: 1192148 - RNA, 19 nt, Human
gaagcguuguccucagccc

SEQ ID NO: 1192149 - RNA, 20 nt, Human
gaagcguuguccucagcccc

SEQ ID NO: 1192150 - RNA, 22 nt, Human
gaagggguaggauuacuaggug

SEQ ID NO: 1192151 - RNA, 20 nt, Human
gaauacucuuauaucuauau

SEQ ID NO: 1192152 - RNA, 17 nt, Human
gaauauuugaauguaug

SEQ ID NO: 1192153 - RNA, 22 nt, Human
gaauuuaaauagcuuuuuucuc

SEQ ID NO: 1192154 - RNA, 21 nt, Human
gaauguaugcuucauacaggg

SEQ ID NO: 1192155 - RNA, 16 nt, Human
gaauguaugcuucaua

SEQ ID NO: 1192156 - RNA, 18 nt, Human
gaauguaugcuucauaca

SEQ ID NO: 1192157 - RNA, 17 nt, Human
gaaugaagauacugaaa

SEQ ID NO: 1192158 - RNA, 18 nt, Human
gaaugaagauacugaaau

SEQ ID NO: 1192159 - RNA, 21 nt, Human
gaaugaagauacugaaauaaa

SEQ ID NO: 1192160 - RNA, 19 nt, Human
gaaugaagauacugaaaua

SEQ ID NO: 1192161 - RNA, 16 nt, Human
gaccuuccaagagccu

SEQ ID NO: 1192162 - RNA, 17 nt, Human
gaccuuccaagagccug

SEQ ID NO: 1192163 - RNA, 18 nt, Human
gaccuuccaagagccuga

SEQ ID NO: 1192164 - RNA, 18 nt, Human
gacuaaccccaccacacc

SEQ ID NO: 1192165 - RNA, 12 nt, Human
gacccccuggag

SEQ ID NO: 1192166 - RNA, 14 nt, Human
cuuccuuccucucc

SEQ ID NO: 1192167 - RNA, 15 nt, Human
cuuccaagagccuga

SEQ ID NO: 1192168 - RNA, 14 nt, Human
cuuccaagagccug

SEQ ID NO: 1192169 - RNA, 13 nt, Human
cuguuuacagugu

SEQ ID NO: 1192170 - RNA, 15 nt, Human
cuguuuacaguguuc

SEQ ID NO: 1192171 - RNA, 14 nt, Human
cuuucugucucucu

SEQ ID NO: 1192172 - RNA, 15 nt, Human
cuuggaagcuucugg

SEQ ID NO: 1192173 - RNA, 20 nt, Human
cuugcugcccugugcuccuc

SEQ ID NO: 1192174 - RNA, 14 nt, Human
cuggcacagccugg

SEQ ID NO: 1192175 - RNA, 15 nt, Human
cuggcacagccuggc

SEQ ID NO: 1192176 - RNA, 12 nt, Human
cuggaccagccu

SEQ ID NO: 1192177 - RNA, 16 nt, Human
cuggagcuagaauuug

SEQ ID NO: 1192178 - RNA, 17 nt, Human
cuggagcuagaauuuga

SEQ ID NO: 1192179 - RNA, 22 nt, Human
cuggagcuagaauuugauaugu

SEQ ID NO: 1192180 - RNA, 15 nt, Human
cugcuuuccaaagcc

SEQ ID NO: 1192181 - RNA, 17 nt, Human
cugcuuuccaaagccaa

SEQ ID NO: 1192182 - RNA, 16 nt, Human
cugggagcuuuuguag

SEQ ID NO: 1192183 - RNA, 18 nt, Human
cugcccgggagcucagga

SEQ ID NO: 1192184 - RNA, 16 nt, Human
cugccaggagacaggu

SEQ ID NO: 1192185 - RNA, 20 nt, Human
cugccagcauuucccuuccu

SEQ ID NO: 1192186 - RNA, 16 nt, Human
cugcagccaggccacu

SEQ ID NO: 1192187 - RNA, 17 nt, Human
cugcagccaggccacug

SEQ ID NO: 1192188 - RNA, 22 nt, Human
cugcagccaggccacuggcccc

SEQ ID NO: 1192189 - RNA, 23 nt, Human
cugcagccaggccacuggccccu

SEQ ID NO: 1192190 - RNA, 15 nt, Human
cugcagccaggccac

SEQ ID NO: 1192191 - RNA, 18 nt, Human
cugcagagcagugggccu

SEQ ID NO: 1192192 - RNA, 21 nt, Human
cugcagagcagugggccuggc

SEQ ID NO: 1192193 - RNA, 23 nt, Human
cugcagagcagugggccuggcca

SEQ ID NO: 1192194 - RNA, 12 nt, Human
cugcagagcugc

SEQ ID NO: 1192195 - RNA, 21 nt, Human
cugcagagcugcgggcugggu

SEQ ID NO: 1192196 - RNA, 23 nt, Human
cugcagagcugcgggcugggugu

SEQ ID NO: 1192197 - RNA, 20 nt, Human
cugauccagcccugaguucc

SEQ ID NO: 1192198 - RNA, 21 nt, Human
cugaagagaagggcagggcug

SEQ ID NO: 1192199 - RNA, 14 nt, Human
cugaauuuaaauag

SEQ ID NO: 1192200 - RNA, 18 nt, Human
cugaauuuaaauagcuuu

SEQ ID NO: 1192201 - RNA, 23 nt, Human
cugaauuuaaauagcuuuuuucu

SEQ ID NO: 1192202 - RNA, 21 nt, Human
cucuuggggaguuuagggugg

SEQ ID NO: 1192203 - RNA, 22 nt, Human
cucuuggagccugcagagcugc

SEQ ID NO: 1192204 - RNA, 16 nt, Human
cucuugaacugagcuu

SEQ ID NO: 1192205 - RNA, 17 nt, Human
cucuugaacugagcuug

SEQ ID NO: 1192206 - RNA, 19 nt, Human
cucuugaacugagcuugga

SEQ ID NO: 1192207 - RNA, 19 nt, Human
cucuccacucaugugacuc

SEQ ID NO: 1192208 - RNA, 17 nt, Human
cucauuccagaggaagg

SEQ ID NO: 1192209 - RNA, 15 nt, Human
cucauuccagaggaa

SEQ ID NO: 1192210 - RNA, 14 nt, Human
cucauauuuucaug

SEQ ID NO: 1192211 - RNA, 21 nt, Human
cucagugucuggcugcagagc

SEQ ID NO: 1192212 - RNA, 22 nt, Human
cucagugucuggcugcagagca

SEQ ID NO: 1192213 - RNA, 17 nt, Human
cuccauugguguugaca

SEQ ID NO: 1192214 - RNA, 13 nt, Human
cuccuuaaggcuc

SEQ ID NO: 1192215 - RNA, 22 nt, Human
cuccuuaaggcucuuuuguaag

SEQ ID NO: 1192216 - RNA, 13 nt, Human
cucuaaauucuuu

SEQ ID NO: 1192217 - RNA, 17 nt, Human
cucuaaauucuuucauu

SEQ ID NO: 1192218 - RNA, 19 nt, Human
cgucagcugggacaccccg

SEQ ID NO: 1192219 - RNA, 16 nt, Human
cgucaacucauauuuu

SEQ ID NO: 1192220 - RNA, 20 nt, Human
cgucaacucauauuuucaug

SEQ ID NO: 1192221 - RNA, 21 nt, Human
cgauugcaggagucccugcca

SEQ ID NO: 1192222 - RNA, 23 nt, Human
cgauugcaggagucccugccauc

SEQ ID NO: 1192223 - RNA, 16 nt, Human
cgggagcucaggaacc

SEQ ID NO: 1192224 - RNA, 22 nt, Human
cggcugggaggagggcaggcau

SEQ ID NO: 1192225 - RNA, 23 nt, Human
cggcugggaggagggcaggcauc

SEQ ID NO: 1192226 - RNA, 14 nt, Human
ccuggaccagccuc

SEQ ID NO: 1192227 - RNA, 15 nt, Human
ccuggaccagccucu

SEQ ID NO: 1192228 - RNA, 16 nt, Human
ccuggaccagccucuc

SEQ ID NO: 1192229 - RNA, 21 nt, Human
ccuugacaaagucaagccaca

SEQ ID NO: 1192230 - RNA, 23 nt, Human
ccuugacaaagucaagccacaug

SEQ ID NO: 1192231 - RNA, 23 nt, Human
ccucuccacucaugugacucuuu

SEQ ID NO: 1192232 - RNA, 14 nt, Human
ccuccucugcccgg

SEQ ID NO: 1192233 - RNA, 15 nt, Human
ccuccucugcccggg

SEQ ID NO: 1192234 - RNA, 19 nt, Human
ccugaggcagguccccaga

SEQ ID NO: 1192235 - RNA, 18 nt, Human
ccugaggcagguccccag

SEQ ID NO: 1192236 - RNA, 20 nt, Human
ccugaacaggauauucucac

SEQ ID NO: 1192237 - RNA, 22 nt, Human
ccgacuuuuguuuaccagagaa

SEQ ID NO: 1192238 - RNA, 13 nt, Human
cccaacaccucuu

SEQ ID NO: 1192239 - RNA, 13 nt, Human
ccaucagccucca

SEQ ID NO: 1192240 - RNA, 17 nt, Human
cccaaaccaccagaagc

SEQ ID NO: 1192241 - RNA, 18 nt, Human
cccaaaccaccagaagcc

SEQ ID NO: 1192242 - RNA, 22 nt, Human
cccaaaccaccagaagcccaga

SEQ ID NO: 1192243 - RNA, 20 nt, Human
ccacacagacuugggcaggg

SEQ ID NO: 1192244 - RNA, 16 nt, Human
ccacacccucacugcu

SEQ ID NO: 1192245 - RNA, 22 nt, Human
ccacacguaaugaaacuuggau

SEQ ID NO: 1192246 - RNA, 21 nt, Human
ccaccaagccuggucagccca

SEQ ID NO: 1192247 - RNA, 21 nt, Human
ccacgucagcugggacacccc

SEQ ID NO: 1192248 - RNA, 22 nt, Human
ccagaauaaacuggcagcucag

SEQ ID NO: 1192249 - RNA, 14 nt, Human
ccagaagcccagaa

SEQ ID NO: 1192250 - RNA, 15 nt, Human
ccagaagcccagaau

SEQ ID NO: 1192251 - RNA, 12 nt, Human
ccagaagcccag

SEQ ID NO: 1192252 - RNA, 13 nt, Human
ccagaagcccaga

SEQ ID NO: 1192253 - RNA, 19 nt, Human
ccaagccuuggcucuaccc

SEQ ID NO: 1192254 - RNA, 19 nt, Human
ccaagccuggucagcccaa

SEQ ID NO: 1192255 - RNA, 20 nt, Human
ccaagccuggucagcccaaa

SEQ ID NO: 1192256 - RNA, 13 nt, Human
ccaacacugccag

SEQ ID NO: 1192257 - RNA, 14 nt, Human
ccaacacugccagc

SEQ ID NO: 1192258 - RNA, 15 nt, Human
ccaacacugccagca

SEQ ID NO: 1192259 - RNA, 16 nt, Human
ccaacacugccagcau

SEQ ID NO: 1192260 - RNA, 17 nt, Human
ccaaagcgaauuuuaaa

SEQ ID NO: 1192261 - RNA, 14 nt, Human
ccaaagccaaugug

SEQ ID NO: 1192262 - RNA, 15 nt, Human
ccaagaggcugcagc

SEQ ID NO: 1192263 - RNA, 16 nt, Human
ccaagaggcugcagcc

SEQ ID NO: 1192264 - RNA, 19 nt, Human
cauugucccugaagagaag

SEQ ID NO: 1192265 - RNA, 16 nt, Human
ccaaacaggcucagag

SEQ ID NO: 1192266 - RNA, 19 nt, Human
cauuuuagggguagcauuu

SEQ ID NO: 1192267 - RNA, 17 nt, Human
caagccuuggcucuacc

SEQ ID NO: 1192268 - RNA, 15 nt, Human
caagccuggucagcc

SEQ ID NO: 1192269 - RNA, 16 nt, Human
caagccuggucagccc

SEQ ID NO: 1192270 - RNA, 17 nt, Human
caagccuggucagccca

SEQ ID NO: 1192271 - RNA, 18 nt, Human
caagccuggucagcccaa

SEQ ID NO: 1192272 - RNA, 14 nt, Human
caagaggcugcagc

SEQ ID NO: 1192273 - RNA, 16 nt, Human
augucaguauguggaa

SEQ ID NO: 1192274 - RNA, 14 nt, Human
augucaguaugugg

SEQ ID NO: 1192275 - RNA, 22 nt, Human
augucuauaaaccgaacugaug

SEQ ID NO: 1192276 - RNA, 13 nt, Human
augucaguaugug

SEQ ID NO: 1192277 - RNA, 17 nt, Human
auguaugcuucauacag

SEQ ID NO: 1192278 - RNA, 20 nt, Human
auguaugcuucauacaggga

SEQ ID NO: 1192279 - RNA, 19 nt, Human
uuugcuaugagcuggggau

SEQ ID NO: 1192280 - RNA, 23 nt, Human
uuugcucagugucuggcugcaga

SEQ ID NO: 1192281 - RNA, 17 nt, Human
uuuguaaauuuauguga

SEQ ID NO: 1192282 - RNA, 17 nt, Human
uuuguagaagucacauu

SEQ ID NO: 1192283 - RNA, 19 nt, Human
auguuuacagaggacagua

SEQ ID NO: 1192284 - RNA, 17 nt, Human
auguuuacagaggacag

SEQ ID NO: 1192285 - RNA, 15 nt, Human
auguuuacagaggac

SEQ ID NO: 1192286 - RNA, 16 nt, Human
auuaagaucucagugg

SEQ ID NO: 1192287 - RNA, 20 nt, Human
auuaagagagucuauuuacg

SEQ ID NO: 1192288 - RNA, 13 nt, Human
auuauuuuaaaag

SEQ ID NO: 1192289 - RNA, 14 nt, Human
auuauuuuaaaaga

SEQ ID NO: 1192290 - RNA, 23 nt, Human
auugcaggagucccugccaucau

SEQ ID NO: 1192291 - RNA, 19 nt, Human
auucucacagcuccaagaa

SEQ ID NO: 1192292 - RNA, 21 nt, Human
auucucacagcuccaagaauu

SEQ ID NO: 1192293 - RNA, 22 nt, Human
auucucacagcuccaagaauuu

SEQ ID NO: 1192294 - RNA, 20 nt, Human
auuuaaaauugugauguguc

SEQ ID NO: 1192295 - RNA, 18 nt, Human
auuuaaaggcccuaucug

SEQ ID NO: 1192296 - RNA, 20 nt, Human
auuuaaaggcccuaucuguu

SEQ ID NO: 1192297 - RNA, 21 nt, Human
auuuaaaggcccuaucuguuu

SEQ ID NO: 1192298 - RNA, 16 nt, Human
auuuaaccucuaaauu

SEQ ID NO: 1192299 - RNA, 18 nt, Human
auuuaaccucuaaauucu

SEQ ID NO: 1192300 - RNA, 21 nt, Human
auuggcucuugaacugagcuu

SEQ ID NO: 1192301 - RNA, 13 nt, Human
auuuuacauaaau

SEQ ID NO: 1192302 - RNA, 17 nt, Human
auuugguuuucacauug

SEQ ID NO: 1192303 - RNA, 21 nt, Human
auuugguuuucacauuggaaa

SEQ ID NO: 1192304 - RNA, 22 nt, Human
auuugguuuucacauuggaaac

SEQ ID NO: 1192305 - RNA, 17 nt, Human
auuugaauguaugcuuc

SEQ ID NO: 1192306 - RNA, 18 nt, Human
auuugaauguaugcuuca

SEQ ID NO: 1192307 - RNA, 20 nt, Human
auuugaauguaugcuucaua

SEQ ID NO: 1192308 - RNA, 21 nt, Human
auuugaauguaugcuucauac

SEQ ID NO: 1192309 - RNA, 22 nt, Human
auuugaauguaugcuucauaca

SEQ ID NO: 1192310 - RNA, 23 nt, Human
auuuccugggagcuuuuguagaa

SEQ ID NO: 1192311 - RNA, 16 nt, Human
aucuguaccucugccu

SEQ ID NO: 1192312 - RNA, 12 nt, Human
aucuguuuacag

SEQ ID NO: 1192313 - RNA, 20 nt, Human
aucugagaggccacagugca

SEQ ID NO: 1192314 - RNA, 23 nt, Human
aucucagugguuaagauuccuaa

SEQ ID NO: 1192315 - RNA, 16 nt, Human
augaagauacugaaau

SEQ ID NO: 1192316 - RNA, 17 nt, Human
augaagauacugaaaua

SEQ ID NO: 1192317 - RNA, 13 nt, Human
uuuaugugugugu

SEQ ID NO: 1192318 - RNA, 11 nt, Human
uuuaugugugu

SEQ ID NO: 1192319 - RNA, 12 nt, Human
uuuaugugaugg

SEQ ID NO: 1192320 - RNA, 23 nt, Human
augcuucauacagggaugguguu

SEQ ID NO: 1192321 - RNA, 10 nt, Human
augcuucaua

SEQ ID NO: 1192322 - RNA, 11 nt, Human
augcuucauac

SEQ ID NO: 1192323 - RNA, 12 nt, Human
augcuucauaca

SEQ ID NO: 1192324 - RNA, 13 nt, Human
augcuucauacag

SEQ ID NO: 1192325 - RNA, 15 nt, Human
augcuucauacaggg

SEQ ID NO: 1192326 - RNA, 16 nt, Human
augcuucauacaggga

SEQ ID NO: 1192327 - RNA, 19 nt, Human
augcuucauacagggaugg

SEQ ID NO: 1192328 - RNA, 21 nt, Human
auggaaugaugggucaguugu

SEQ ID NO: 1192329 - RNA, 17 nt, Human
auggaauacucuuauau

SEQ ID NO: 1192330 - RNA, 16 nt, Human
auggaauacucuuaua

SEQ ID NO: 1192331 - RNA, 19 nt, Human
uuucaugcuguucaugaaa

SEQ ID NO: 1192332 - RNA, 16 nt, Human
auggccugggggaugu

SEQ ID NO: 1192333 - RNA, 15 nt, Human
uuguugucugcaacu

SEQ ID NO: 1192334 - RNA, 21 nt, Human
augauucaaaugucuauaaac

SEQ ID NO: 1192335 - RNA, 15 nt, Human
augauuccagguggc

SEQ ID NO: 1192336 - RNA, 16 nt, Human
augauuccagguggca

SEQ ID NO: 1192337 - RNA, 21 nt, Human
aucauuggauucugagagcug

SEQ ID NO: 1192338 - RNA, 22 nt, Human
aucauuggauucugagagcugu

SEQ ID NO: 1192339 - RNA, 15 nt, Human
uucuaguucugccag

SEQ ID NO: 1192340 - RNA, 16 nt, Human
uucuaguucugccagg

SEQ ID NO: 1192341 - RNA, 14 nt, Human
aucaaguuauuuuu

SEQ ID NO: 1192342 - RNA, 15 nt, Human
auauuuuacauaaau

SEQ ID NO: 1192343 - RNA, 16 nt, Human
auauuuuacauaaauu

SEQ ID NO: 1192344 - RNA, 20 nt, Human
auauuuuacauaaauuuagu

SEQ ID NO: 1192345 - RNA, 21 nt, Human
uucauacagggaugguguuca

SEQ ID NO: 1192346 - RNA, 12 nt, Human
auaugauucaaa

SEQ ID NO: 1192347 - RNA, 16 nt, Human
auaucuauauuuuaca

SEQ ID NO: 1192348 - RNA, 19 nt, Human
auaucuccgucaacucaua

SEQ ID NO: 1192349 - RNA, 20 nt, Human
auaucuccgucaacucauau

SEQ ID NO: 1192350 - RNA, 21 nt, Human
auaucuccgucaacucauauu

SEQ ID NO: 1192351 - RNA, 14 nt, Human
uuccaagagccuga

SEQ ID NO: 1192352 - RNA, 22 nt, Human
uuccaagagccugagagugagg

SEQ ID NO: 1192353 - RNA, 13 nt, Human
uuccaagagccug

SEQ ID NO: 1192354 - RNA, 15 nt, Human
auauauauauauauu

SEQ ID NO: 1192355 - RNA, 21 nt, Human
auauauauuuuuuucugaaau

SEQ ID NO: 1192356 - RNA, 13 nt, Human
uucacauuggaaa

SEQ ID NO: 1192357 - RNA, 15 nt, Human
auagcuuuuuucucu

SEQ ID NO: 1192358 - RNA, 16 nt, Human
uuagccuuugucccag

SEQ ID NO: 1192359 - RNA, 17 nt, Human
agugugggucugugugu

SEQ ID NO: 1192360 - RNA, 16 nt, Human
agugugggucugugug

SEQ ID NO: 1192361 - RNA, 15 nt, Human
agugugggucugugu

SEQ ID NO: 1192362 - RNA, 23 nt, Human
agugugggucuguguguguguau

SEQ ID NO: 1192363 - RNA, 19 nt, Human
agugugggucugugugugu

SEQ ID NO: 1192364 - RNA, 15 nt, Human
uguugugugugggag

SEQ ID NO: 1192365 - RNA, 14 nt, Human
uguuguguguggga

SEQ ID NO: 1192366 - RNA, 16 nt, Human
uguugugugugggagu

SEQ ID NO: 1192367 - RNA, 13 nt, Human
uguugucugcaac

SEQ ID NO: 1192368 - RNA, 16 nt, Human
uguugucugcaacucu

SEQ ID NO: 1192369 - RNA, 16 nt, Human
uguguguguguaugug

SEQ ID NO: 1192370 - RNA, 13 nt, Human
uguguguguguau

SEQ ID NO: 1192371 - RNA, 13 nt, Human
uguggucuccacu

SEQ ID NO: 1192372 - RNA, 19 nt, Human
uguggcacuggggcagggg

SEQ ID NO: 1192373 - RNA, 14 nt, Human
agugcacuaaugug

SEQ ID NO: 1192374 - RNA, 23 nt, Human
agguugggagaaugucaguaugu

SEQ ID NO: 1192375 - RNA, 20 nt, Human
uguaauuuaaaauugugaug

SEQ ID NO: 1192376 - RNA, 18 nt, Human
uguaauuuaaaauuguga

SEQ ID NO: 1192377 - RNA, 17 nt, Human
uguaauuuaaaauugug

SEQ ID NO: 1192378 - RNA, 15 nt, Human
uguaaguaaacgguc

SEQ ID NO: 1192379 - RNA, 18 nt, Human
agguccccagcuuuggcu

SEQ ID NO: 1192380 - RNA, 11 nt, Human
agguccccaga

SEQ ID NO: 1192381 - RNA, 17 nt, Human
agguccccagcuuuggc

SEQ ID NO: 1192382 - RNA, 22 nt, Human
uguaauuuaaaauugugaugug

SEQ ID NO: 1192383 - RNA, 21 nt, Human
uguaauuuaaaauugugaugu

SEQ ID NO: 1192384 - RNA, 22 nt, Human
ugucaguauguggaaguguggg

SEQ ID NO: 1192385 - RNA, 20 nt, Human
ugucaguauguggaagugug

SEQ ID NO: 1192386 - RNA, 19 nt, Human
ugucaguauguggaagugu

SEQ ID NO: 1192387 - RNA, 18 nt, Human
ugucaguauguggaagug

SEQ ID NO: 1192388 - RNA, 17 nt, Human
aguauguggaagugugg

SEQ ID NO: 1192389 - RNA, 15 nt, Human
aguauguggaagugu

SEQ ID NO: 1192390 - RNA, 19 nt, Human
aguauguggaagugugggu

SEQ ID NO: 1192391 - RNA, 19 nt, Human
agucacauuccugaacagg

SEQ ID NO: 1192392 - RNA, 20 nt, Human
agucacauuccugaacagga

SEQ ID NO: 1192393 - RNA, 14 nt, Human
agucccugccugga

SEQ ID NO: 1192394 - RNA, 15 nt, Human
agucccugccuggac

SEQ ID NO: 1192395 - RNA, 21 nt, Human
agucccugccuggaccagccu

SEQ ID NO: 1192396 - RNA, 22 nt, Human
agucccugaggcagguccccag

SEQ ID NO: 1192397 - RNA, 23 nt, Human
agucccugaggcagguccccaga

SEQ ID NO: 1192398 - RNA, 22 nt, Human
agucccugccuggaccagccuc

SEQ ID NO: 1192399 - RNA, 23 nt, Human
agucccugccuggaccagccucu

SEQ ID NO: 1192400 - RNA, 19 nt, Human
agucccugaggcagguccc

SEQ ID NO: 1192401 - RNA, 20 nt, Human
agucccugaggcaggucccc

SEQ ID NO: 1192402 - RNA, 20 nt, Human
ugguaggaacugcugggcuu

SEQ ID NO: 1192403 - RNA, 13 nt, Human
ugguaggaacugc

SEQ ID NO: 1192404 - RNA, 16 nt, Human
uggguggggggcuuca

SEQ ID NO: 1192405 - RNA, 18 nt, Human
uggguggggggcuucaua

SEQ ID NO: 1192406 - RNA, 12 nt, Human
ugggucugugug

SEQ ID NO: 1192407 - RNA, 15 nt, Human
agggggagagggcug

SEQ ID NO: 1192408 - RNA, 16 nt, Human
agggggagagggcugc

SEQ ID NO: 1192409 - RNA, 10 nt, Human
uggucagccc

SEQ ID NO: 1192410 - RNA, 11 nt, Human
uggucagccca

SEQ ID NO: 1192411 - RNA, 12 nt, Human
uggucagcccaa

SEQ ID NO: 1192412 - RNA, 14 nt, Human
uggucuccacuggg

SEQ ID NO: 1192413 - RNA, 14 nt, Human
uggggcugauugua

SEQ ID NO: 1192414 - RNA, 15 nt, Human
ugggguagguuggga

SEQ ID NO: 1192415 - RNA, 21 nt, Human
ugggguagguugggagaaugu

SEQ ID NO: 1192416 - RNA, 18 nt, Human
uggggaguuuaggguggg

SEQ ID NO: 1192417 - RNA, 19 nt, Human
uggggaguuuagggugggg

SEQ ID NO: 1192418 - RNA, 14 nt, Human
uggggaaugaagau

SEQ ID NO: 1192419 - RNA, 15 nt, Human
uggggaaugaagaua

SEQ ID NO: 1192420 - RNA, 20 nt, Human
uggggacaggggcaggagga

SEQ ID NO: 1192421 - RNA, 22 nt, Human
uggggacaggggcaggaggaag

SEQ ID NO: 1192422 - RNA, 19 nt, Human
aggacaguauuugugggga

SEQ ID NO: 1192423 - RNA, 12 nt, Human
aggacaguauuu

SEQ ID NO: 1192424 - RNA, 19 nt, Human
aggaucccaugagcuccuu

SEQ ID NO: 1192425 - RNA, 13 nt, Human
uggaagguauuua

SEQ ID NO: 1192426 - RNA, 17 nt, Human
uggaagguauuuaauag

SEQ ID NO: 1192427 - RNA, 20 nt, Human
uggaagcuucuggugaccuu

SEQ ID NO: 1192428 - RNA, 20 nt, Human
uggaauuauuuuaaaagaua

SEQ ID NO: 1192429 - RNA, 21 nt, Human
uggccuguucuucuauggguu

SEQ ID NO: 1192430 - RNA, 16 nt, Human
uggccuaaccugccga

SEQ ID NO: 1192431 - RNA, 18 nt, Human
ugcuauuguagagccaga

SEQ ID NO: 1192432 - RNA, 23 nt, Human
ugcuguauccauccauggggcug

SEQ ID NO: 1192433 - RNA, 21 nt, Human
agcugggacaccccgacuuuu

SEQ ID NO: 1192434 - RNA, 20 nt, Human
agcugugugcucuccaagcc

SEQ ID NO: 1192435 - RNA, 23 nt, Human
agcuuggggacaggggcaggagg

SEQ ID NO: 1192436 - RNA, 20 nt, Human
agcucaggaaccgaggcagg

SEQ ID NO: 1192437 - RNA, 21 nt, Human
agcucaggaaccgaggcaggg

SEQ ID NO: 1192438 - RNA, 22 nt, Human
agcucaggaaccgaggcaggga

SEQ ID NO: 1192439 - RNA, 13 nt, Human
agcuagaauuuga

SEQ ID NO: 1192440 - RNA, 16 nt, Human
agcuagaauuugauau

SEQ ID NO: 1192441 - RNA, 17 nt, Human
ugccagacccccuggag

SEQ ID NO: 1192442 - RNA, 20 nt, Human
agccuggucagcccaaacca

SEQ ID NO: 1192443 - RNA, 15 nt, Human
agccuggucagccca

SEQ ID NO: 1192444 - RNA, 16 nt, Human
agccuggucagcccaa

SEQ ID NO: 1192445 - RNA, 18 nt, Human
agccugacccucaucuuu

SEQ ID NO: 1192446 - RNA, 18 nt, Human
agcccaguucagcuuggg

SEQ ID NO: 1192447 - RNA, 18 nt, Human
ugaguucauaaauuuaug

SEQ ID NO: 1192448 - RNA, 24 nt, Human
ugauaagcagucauccucagauca

SEQ ID NO: 1192449 - RNA, 12 nt, Human
ugauacagaaaa

SEQ ID NO: 1192450 - RNA, 21 nt, Human
ugauacagaaaaguugaauuu

SEQ ID NO: 1192451 - RNA, 21 nt, Human
ugauagaaggcuauggggaua

SEQ ID NO: 1192452 - RNA, 15 nt, Human
ugauaugugaacagu

SEQ ID NO: 1192453 - RNA, 16 nt, Human
ugauaugugaacaguu

SEQ ID NO: 1192454 - RNA, 17 nt, Human
agcauuucccuuccuuc

SEQ ID NO: 1192455 - RNA, 15 nt, Human
agccaggccacuggc

SEQ ID NO: 1192456 - RNA, 15 nt, Human
ugauccagcccugag

SEQ ID NO: 1192457 - RNA, 17 nt, Human
ugauccagcccugaguu

SEQ ID NO: 1192458 - RNA, 18 nt, Human
ugauccagcccugaguuc

SEQ ID NO: 1192459 - RNA, 21 nt, Human
ugacccucaucuuucuuccaa

SEQ ID NO: 1192460 - RNA, 18 nt, Human
ugaccuuccaagagccug

SEQ ID NO: 1192461 - RNA, 19 nt, Human
ugaccuuccaagagccuga

SEQ ID NO: 1192462 - RNA, 20 nt, Human
ugaccuuccaagagccugag

SEQ ID NO: 1192463 - RNA, 22 nt, Human
ugaaggguaauuauauaguuac

SEQ ID NO: 1192464 - RNA, 14 nt, Human
ugaauguaugcuuc

SEQ ID NO: 1192465 - RNA, 19 nt, Human
ugaauguaugcuucauaca

SEQ ID NO: 1192466 - RNA, 20 nt, Human
ugaauguaugcuucauacag

SEQ ID NO: 1192467 - RNA, 23 nt, Human
ugaauguaugcuucauacaggga

SEQ ID NO: 1192468 - RNA, 22 nt, Human
agaggugugcaagagagggaug

SEQ ID NO: 1192469 - RNA, 23 nt, Human
agaggugugcaagagagggaugc

SEQ ID NO: 1192470 - RNA, 17 nt, Human
agagacgggcccuggug

SEQ ID NO: 1192471 - RNA, 12 nt, Human
ugaaacuuuugg

SEQ ID NO: 1192472 - RNA, 11 nt, Human
ugaaaauauuu

SEQ ID NO: 1192473 - RNA, 12 nt, Human
ugaaaauauuua

SEQ ID NO: 1192474 - RNA, 13 nt, Human
ugaaaauauuuaa

SEQ ID NO: 1192475 - RNA, 14 nt, Human
ugaaaauauuuaaa

SEQ ID NO: 1192476 - RNA, 12 nt, Human
ugaaacuuggau

SEQ ID NO: 1192477 - RNA, 22 nt, Human
ucuuggggaguuuagggugggg

SEQ ID NO: 1192478 - RNA, 23 nt, Human
ucuuggggaguuuaggguggggg

SEQ ID NO: 1192479 - RNA, 13 nt, Human
agacccccuggag

SEQ ID NO: 1192480 - RNA, 14 nt, Human
agacccccuggaga

SEQ ID NO: 1192481 - RNA, 15 nt, Human
agacccccuggagac

SEQ ID NO: 1192482 - RNA, 19 nt, Human
agacccccuggagacuaac

SEQ ID NO: 1192483 - RNA, 22 nt, Human
ucuggcacagccuggcuguggc

SEQ ID NO: 1192484 - RNA, 13 nt, Human
agaauaaacuggc

SEQ ID NO: 1192485 - RNA, 20 nt, Human
ucugaaggguaauuauauag

SEQ ID NO: 1192486 - RNA, 22 nt, Human
ucucucacuuguuuuauuuaac

SEQ ID NO: 1192487 - RNA, 15 nt, Human
ucuaccucuuggcug

SEQ ID NO: 1192488 - RNA, 14 nt, Human
ucuaguucugccag

SEQ ID NO: 1192489 - RNA, 13 nt, Human
ucuauaaaccgaa

SEQ ID NO: 1192490 - RNA, 20 nt, Human
ucggggagccgggagccuga

SEQ ID NO: 1192491 - RNA, 20 nt, Human
uaugugggggucuguguguu

SEQ ID NO: 1192492 - RNA, 19 nt, Human
uaugugggggucugugugu

SEQ ID NO: 1192493 - RNA, 18 nt, Human
uaugugggggucugugug

SEQ ID NO: 1192494 - RNA, 21 nt, Human
uauuuuaaaagauaaauauua

SEQ ID NO: 1192495 - RNA, 13 nt, Human
uauuuuacauaaa

SEQ ID NO: 1192496 - RNA, 22 nt, Human
acauggcuggagcuagaauuug

SEQ ID NO: 1192497 - RNA, 21 nt, Human
ucaaauacgugggcauucaaa

SEQ ID NO: 1192498 - RNA, 22 nt, Human
ucaaauacgugggcauucaaau

SEQ ID NO: 1192499 - RNA, 23 nt, Human
ucaaauacgugggcauucaaaug

SEQ ID NO: 1192500 - RNA, 20 nt, Human
ucacauuccugaacaggaua

SEQ ID NO: 1192501 - RNA, 13 nt, Human
ucacauuccugaa

SEQ ID NO: 1192502 - RNA, 17 nt, Human
ucacauuccugaacagg

SEQ ID NO: 1192503 - RNA, 19 nt, Human
ucacagcuccaagaauuuc

SEQ ID NO: 1192504 - RNA, 16 nt, Human
acauuggaaacaaguc

SEQ ID NO: 1192505 - RNA, 21 nt, Human
accgaacugauguaaguaaac

SEQ ID NO: 1192506 - RNA, 23 nt, Human
acccucccucuacugggagccua

SEQ ID NO: 1192507 - RNA, 19 nt, Human
ucacauuccugaacaggau

SEQ ID NO: 1192508 - RNA, 14 nt, Human
ucacucuuggagcc

SEQ ID NO: 1192509 - RNA, 16 nt, Human
ucacucuuggagccug

SEQ ID NO: 1192510 - RNA, 17 nt, Human
ucacucuuggagccugc

SEQ ID NO: 1192511 - RNA, 18 nt, Human
ucacucuuggagccugca

SEQ ID NO: 1192512 - RNA, 16 nt, Human
uccucugcccgggagc

SEQ ID NO: 1192513 - RNA, 22 nt, Human
uccucugcccgggagcucagga

SEQ ID NO: 1192514 - RNA, 13 nt, Human
uccucuccugucu

SEQ ID NO: 1192515 - RNA, 22 nt, Human
acucgugucuggcacagccugg

SEQ ID NO: 1192516 - RNA, 23 nt, Human
acucgugucuggcacagccuggc

SEQ ID NO: 1192517 - RNA, 21 nt, Human
uccuagccaccgccuccuaca

SEQ ID NO: 1192518 - RNA, 20 nt, Human
uccuagccacccaccacacu

SEQ ID NO: 1192519 - RNA, 14 nt, Human
acuccaccaagccu

SEQ ID NO: 1192520 - RNA, 16 nt, Human
uccauccuacccccug

SEQ ID NO: 1192521 - RNA, 20 nt, Human
uccauccuacccccugugcc

SEQ ID NO: 1192522 - RNA, 15 nt, Human
accuuccaagagccu

SEQ ID NO: 1192523 - RNA, 16 nt, Human
accuuccaagagccug

SEQ ID NO: 1192524 - RNA, 20 nt, Human
accuggcuuuucuuucuacc

SEQ ID NO: 1192525 - RNA, 16 nt, Human
aauuccacacccucac

SEQ ID NO: 1192526 - RNA, 14 nt, Human
uagaagaagugugu

SEQ ID NO: 1192527 - RNA, 21 nt, Human
uagacauuugcuaugagcugg

SEQ ID NO: 1192528 - RNA, 20 nt, Human
uagaauuugauaugugaaca

SEQ ID NO: 1192529 - RNA, 22 nt, Human
uagaauuugauaugugaacagu

SEQ ID NO: 1192530 - RNA, 18 nt, Human
uagccacccaccacacug

SEQ ID NO: 1192531 - RNA, 18 nt, Human
uagccaccgccuccuaca

SEQ ID NO: 1192532 - RNA, 19 nt, Human
uagccaccgccuccuacag

SEQ ID NO: 1192533 - RNA, 24 nt, Human
uagaggggaaaagagaugaugaaa

SEQ ID NO: 1192534 - RNA, 20 nt, Human
aauuuuacauggcuggagcu

SEQ ID NO: 1192535 - RNA, 16 nt, Human
acaaaaagcuacuuau

SEQ ID NO: 1192536 - RNA, 19 nt, Human
acaaaaauucucaguucuc

SEQ ID NO: 1192537 - RNA, 13 nt, Human
uagcuuuuuucuc

SEQ ID NO: 1192538 - RNA, 23 nt, Human
uagcuuuuuucucugauacagaa

SEQ ID NO: 1192539 - RNA, 14 nt, Human
uaucagcacgugug

SEQ ID NO: 1192540 - RNA, 15 nt, Human
uaucagcacgugugg

SEQ ID NO: 1192541 - RNA, 21 nt, Human
uauaucuauauuuuacauaaa

SEQ ID NO: 1192542 - RNA, 11 nt, Human
uauauauuucc

SEQ ID NO: 1192543 - RNA, 19 nt, Human
uauauauuuuuuucugaaa

SEQ ID NO: 1192544 - RNA, 20 nt, Human
uauauauuuuuuucugaaau

SEQ ID NO: 1192545 - RNA, 21 nt, Human
uaugguaggaacugcugggcu

SEQ ID NO: 1192546 - RNA, 18 nt, Human
acagcggcuggacuugga

SEQ ID NO: 1192547 - RNA, 19 nt, Human
acagcggcuggacuuggag

SEQ ID NO: 1192548 - RNA, 20 nt, Human
uaugccaccugaauaaagaa

SEQ ID NO: 1192549 - RNA, 15 nt, Human
uaucuauauuuuaca

SEQ ID NO: 1192550 - RNA, 20 nt, Human
uaauuuaaaauugugaugug

SEQ ID NO: 1192551 - RNA, 19 nt, Human
uaauuuaaaauugugaugu

SEQ ID NO: 1192552 - RNA, 13 nt, Human
uaccucuuggcug

SEQ ID NO: 1192553 - RNA, 15 nt, Human
uacccccugugccuu

SEQ ID NO: 1192554 - RNA, 12 nt, Human
aauuauuuuaaa

SEQ ID NO: 1192555 - RNA, 15 nt, Human
aauuauuuuaaaaga

SEQ ID NO: 1192556 - RNA, 17 nt, Human
uacagggaugguguuca

SEQ ID NO: 1192557 - RNA, 15 nt, Human
aaucuaugauuccag

SEQ ID NO: 1192558 - RNA, 18 nt, Human
aaucuaugauuccaggug

SEQ ID NO: 1192559 - RNA, 23 nt, Human
uaagacaaaaagcuacuuauugu

SEQ ID NO: 1192560 - RNA, 14 nt, Human
aaggcucuuuugua

SEQ ID NO: 1192561 - RNA, 18 nt, Human
aagguauuuaauagguuu

SEQ ID NO: 1192562 - RNA, 13 nt, Human
guuuacaguguuc

SEQ ID NO: 1192563 - RNA, 15 nt, Human
guuuacaguguuccg

SEQ ID NO: 1192564 - RNA, 22 nt, Human
aaggcccuaucuguuuacagug

SEQ ID NO: 1192565 - RNA, 22 nt, Human
aaggaaccaaagcgaauuuuaa

SEQ ID NO: 1192566 - RNA, 23 nt, Human
aaggaaccaaagcgaauuuuaaa

SEQ ID NO: 1192567 - RNA, 12 nt, Human
uaaaagaauugu

SEQ ID NO: 1192568 - RNA, 16 nt, Human
gugugugggagugugu

SEQ ID NO: 1192569 - RNA, 18 nt, Human
aagcccaguucagcuugg

SEQ ID NO: 1192570 - RNA, 19 nt, Human
aagcccaguucagcuuggg

SEQ ID NO: 1192571 - RNA, 18 nt, Human
aagccaagaggcugcagc

SEQ ID NO: 1192572 - RNA, 22 nt, Human
aagccaagaggcugcagccagg

SEQ ID NO: 1192573 - RNA, 14 nt, Human
guuaagauuccuaa

SEQ ID NO: 1192574 - RNA, 19 nt, Human
gugggguagguugggagaa

SEQ ID NO: 1192575 - RNA, 14 nt, Human
aagaggcugcagcc

SEQ ID NO: 1192576 - RNA, 18 nt, Human
aagaucucagugguuaag

SEQ ID NO: 1192577 - RNA, 15 nt, Human
guguguauguggggg

SEQ ID NO: 1192578 - RNA, 13 nt, Human
guguguauguggg

SEQ ID NO: 1192579 - RNA, 20 nt, Human
gugugucacccuuaggccag

SEQ ID NO: 1192580 - RNA, 14 nt, Human
gugugggucugugu

SEQ ID NO: 1192581 - RNA, 21 nt, Human
guggccuaaccugccgagagu

SEQ ID NO: 1192582 - RNA, 22 nt, Human
guggccuaaccugccgagaguc

SEQ ID NO: 1192583 - RNA, 15 nt, Human
aaauuuaugugaugg

SEQ ID NO: 1192584 - RNA, 12 nt, Human
aaauuuauguga

SEQ ID NO: 1192585 - RNA, 15 nt, Human
aaauugugauguguc

SEQ ID NO: 1192586 - RNA, 12 nt, Human
aaauugugaugu

SEQ ID NO: 1192587 - RNA, 15 nt, Human
aaauguauuacagug

SEQ ID NO: 1192588 - RNA, 21 nt, Human
guaugcuucauacagggaugg

SEQ ID NO: 1192589 - RNA, 12 nt, Human
guaugcuucaua

SEQ ID NO: 1192590 - RNA, 13 nt, Human
guaugcuucauac

SEQ ID NO: 1192591 - RNA, 14 nt, Human
guaugcuucauaca

SEQ ID NO: 1192592 - RNA, 15 nt, Human
guaugcuucauacag

SEQ ID NO: 1192593 - RNA, 13 nt, Human
gucaguuguauca

SEQ ID NO: 1192594 - RNA, 21 nt, Human
gucaguauguggaaguguggg

SEQ ID NO: 1192595 - RNA, 17 nt, Human
gucaguauguggaagug

SEQ ID NO: 1192596 - RNA, 17 nt, Human
gucuggcacagccuggc

SEQ ID NO: 1192597 - RNA, 19 nt, Human
gucuggcacagccuggcug

SEQ ID NO: 1192598 - RNA, 19 nt, Human
gucucccuccucugcccgg

SEQ ID NO: 1192599 - RNA, 14 nt, Human
aaccaccagaagcc

SEQ ID NO: 1192600 - RNA, 17 nt, Human
aaccaccagaagcccag

SEQ ID NO: 1192601 - RNA, 17 nt, Human
aaccccccauuucuucc

SEQ ID NO: 1192602 - RNA, 20 nt, Human
aaccccuggcuccaggccag

SEQ ID NO: 1192603 - RNA, 12 nt, Human
aaccucuaaauu

SEQ ID NO: 1192604 - RNA, 24 nt, Human
aaccucuaaauucuuucauuuuag

SEQ ID NO: 1192605 - RNA, 12 nt, Human
gugcaagagagg

SEQ ID NO: 1192606 - RNA, 21 nt, Human
gugagguggaauuauuuuaaa

SEQ ID NO: 1192607 - RNA, 16 nt, Human
cucaucuuucuuccaa

SEQ ID NO: 1192608 - RNA, 20 nt, Human
cucagugucuggcugcagag

SEQ ID NO: 1192609 - RNA, 16 nt, Human
cucaggcccaaagccu

SEQ ID NO: 1192610 - RNA, 13 nt, Human
cucccuccucugc

SEQ ID NO: 1192611 - RNA, 14 nt, Human
cucccuccucugcc

SEQ ID NO: 1192612 - RNA, 14 nt, Human
cucuuggagccugc

SEQ ID NO: 1192613 - RNA, 15 nt, Human
cucuuggagccugca

SEQ ID NO: 1192614 - RNA, 21 nt, Human
cucucacuuguuuuauuuaac

SEQ ID NO: 1192615 - RNA, 19 nt, Human
cuaaccugccgagagucca

SEQ ID NO: 1192616 - RNA, 21 nt, Human
cuaaccugccgagaguccauc

SEQ ID NO: 1192617 - RNA, 14 nt, Human
cgugucuggcacag

SEQ ID NO: 1192618 - RNA, 21 nt, Human
cgugucuggcacagccuggcu

SEQ ID NO: 1192619 - RNA, 18 nt, Human
cuagccaccgccuccuac

SEQ ID NO: 1192620 - RNA, 19 nt, Human
cuagccaccgccuccuaca

SEQ ID NO: 1192621 - RNA, 23 nt, Human
cggcuccucgagaucccaacacu

SEQ ID NO: 1192622 - RNA, 16 nt, Human
ccagagucccugccug

SEQ ID NO: 1192623 - RNA, 17 nt, Human
ccagagucccugccugg

SEQ ID NO: 1192624 - RNA, 18 nt, Human
ccagagucccugccugga

SEQ ID NO: 1192625 - RNA, 19 nt, Human
ccagagucccugccuggac

SEQ ID NO: 1192626 - RNA, 22 nt, Human
ccagagucccugccuggaccag

SEQ ID NO: 1192627 - RNA, 12 nt, Human
ccaugagcuccu

SEQ ID NO: 1192628 - RNA, 15 nt, Human
ccaguucagcuuggg

SEQ ID NO: 1192629 - RNA, 14 nt, Human
ccccgacuuuuguu

SEQ ID NO: 1192630 - RNA, 21 nt, Human
ccccagacuccaccaagccug

SEQ ID NO: 1192631 - RNA, 14 nt, Human
cccgggagcucagg

SEQ ID NO: 1192632 - RNA, 14 nt, Human
ccugacucucagca

SEQ ID NO: 1192633 - RNA, 17 nt, Human
ccugagaucucugcagg

SEQ ID NO: 1192634 - RNA, 22 nt, Human
ccugaguaaaaaagcugugugc

SEQ ID NO: 1192635 - RNA, 24 nt, Human
cccugugccuuggugugcuguauc

SEQ ID NO: 1192636 - RNA, 15 nt, Human
cccugugccuuguca

SEQ ID NO: 1192637 - RNA, 20 nt, Human
cccugugccuugucacgcca

SEQ ID NO: 1192638 - RNA, 22 nt, Human
cccugugccuugucacgccaga

SEQ ID NO: 1192639 - RNA, 13 nt, Human
cccuggcuccagg

SEQ ID NO: 1192640 - RNA, 16 nt, Human
cccuggcuccaggcca

SEQ ID NO: 1192641 - RNA, 16 nt, Human
auucuuucccaacacc

SEQ ID NO: 1192642 - RNA, 19 nt, Human
auucuuucccaacaccucu

SEQ ID NO: 1192643 - RNA, 16 nt, Human
auuguugucugcaacu

SEQ ID NO: 1192644 - RNA, 18 nt, Human
auuaugaaacuuuuggaa

SEQ ID NO: 1192645 - RNA, 16 nt, Human
auucaaauguauuaca

SEQ ID NO: 1192646 - RNA, 18 nt, Human
auucaaauguauuacagu

SEQ ID NO: 1192647 - RNA, 18 nt, Human
auucaaugccccugaauu

SEQ ID NO: 1192648 - RNA, 20 nt, Human
auucaaugccccugaauuua

SEQ ID NO: 1192649 - RNA, 19 nt, Human
auuacaguggggaaugaag

SEQ ID NO: 1192650 - RNA, 20 nt, Human
auuugcuaugagcuggggau

SEQ ID NO: 1192651 - RNA, 16 nt, Human
auuugcuaugagcugg

SEQ ID NO: 1192652 - RNA, 22 nt, Human
auuuguggggagggauuugggg

SEQ ID NO: 1192653 - RNA, 14 nt, Human
caaacaggcucaga

SEQ ID NO: 1192654 - RNA, 15 nt, Human
caaacaggcucagag

SEQ ID NO: 1192655 - RNA, 17 nt, Human
caacaaucccaaggccc

SEQ ID NO: 1192656 - RNA, 18 nt, Human
cacugccagcauuucccu

SEQ ID NO: 1192657 - RNA, 22 nt, Human
cacugccagcauuucccuuccu

SEQ ID NO: 1192658 - RNA, 22 nt, Human
cacucuuggagccugcagagcu

SEQ ID NO: 1192659 - RNA, 23 nt, Human
cacucuuggagccugcagagcug

SEQ ID NO: 1192660 - RNA, 15 nt, Human
caguauuugugggga

SEQ ID NO: 1192661 - RNA, 24 nt, Human
cagccucuccacucaugugacucu

SEQ ID NO: 1192662 - RNA, 17 nt, Human
cagcggcuggaauuggg

SEQ ID NO: 1192663 - RNA, 16 nt, Human
cagcggcuggacuugg

SEQ ID NO: 1192664 - RNA, 18 nt, Human
cagcggcuggacuuggag

SEQ ID NO: 1192665 - RNA, 11 nt, Human
cagccugccac

SEQ ID NO: 1192666 - RNA, 12 nt, Human
cagccugccacu

SEQ ID NO: 1192667 - RNA, 16 nt, Human
cagccugccacucagg

SEQ ID NO: 1192668 - RNA, 17 nt, Human
cagccugccacucaggc

SEQ ID NO: 1192669 - RNA, 24 nt, Human
cagccccgcguggaacucgugucu

SEQ ID NO: 1192670 - RNA, 16 nt, Human
cagagcugcgggcugg

SEQ ID NO: 1192671 - RNA, 14 nt, Human
ccaccagaagccca

SEQ ID NO: 1192672 - RNA, 15 nt, Human
ccaccagaagcccag

SEQ ID NO: 1192673 - RNA, 16 nt, Human
ccaccagaagcccaga

SEQ ID NO: 1192674 - RNA, 18 nt, Human
ccaccagaagcccagaau

SEQ ID NO: 1192675 - RNA, 11 nt, Human
ccaccagaagc

SEQ ID NO: 1192676 - RNA, 12 nt, Human
ccaccagaagcc

SEQ ID NO: 1192677 - RNA, 13 nt, Human
ccaccagaagccc

SEQ ID NO: 1192678 - RNA, 22 nt, Human
ccaaaugagggucuugguucca

SEQ ID NO: 1192679 - RNA, 12 nt, Human
ccaaauuaagag

SEQ ID NO: 1192680 - RNA, 22 nt, Human
cauggcuggagcuagaauuuga

SEQ ID NO: 1192681 - RNA, 22 nt, Human
cauuggcucuugaacugagcuu

SEQ ID NO: 1192682 - RNA, 17 nt, Human
caguuuggcaaacucuc

SEQ ID NO: 1192683 - RNA, 20 nt, Human
gcaccggggccugggcagga

SEQ ID NO: 1192684 - RNA, 13 nt, Human
gauucugagagcu

SEQ ID NO: 1192685 - RNA, 14 nt, Human
gauucugagagcug

SEQ ID NO: 1192686 - RNA, 21 nt, Human
gcagagcagugggccuggcca

SEQ ID NO: 1192687 - RNA, 12 nt, Human
gaucccaacacu

SEQ ID NO: 1192688 - RNA, 16 nt, Human
gaucccaacacugcca

SEQ ID NO: 1192689 - RNA, 14 nt, Human
gaguuuaggguggg

SEQ ID NO: 1192690 - RNA, 15 nt, Human
gaguuuagggugggg

SEQ ID NO: 1192691 - RNA, 19 nt, Human
gaguggacuguucccugag

SEQ ID NO: 1192692 - RNA, 18 nt, Human
gagugaggaugucugggc

SEQ ID NO: 1192693 - RNA, 13 nt, Human
gaguccaucagcc

SEQ ID NO: 1192694 - RNA, 14 nt, Human
gaguccaucagccu

SEQ ID NO: 1192695 - RNA, 15 nt, Human
gaguccaucagccuc

SEQ ID NO: 1192696 - RNA, 16 nt, Human
gaguccaucagccucc

SEQ ID NO: 1192697 - RNA, 13 nt, Human
gauaugugaacag

SEQ ID NO: 1192698 - RNA, 14 nt, Human
gauaugugaacagu

SEQ ID NO: 1192699 - RNA, 15 nt, Human
gacaguauuuguggg

SEQ ID NO: 1192700 - RNA, 19 nt, Human
gacagguuugggaccccug

SEQ ID NO: 1192701 - RNA, 16 nt, Human
gacagguuagcugcuc

SEQ ID NO: 1192702 - RNA, 15 nt, Human
gacaaaauggaauac

SEQ ID NO: 1192703 - RNA, 12 nt, Human
gaauuaugaaac

SEQ ID NO: 1192704 - RNA, 14 nt, Human
gaauuaugaaacuu

SEQ ID NO: 1192705 - RNA, 12 nt, Human
gaauuuuaaaag

SEQ ID NO: 1192706 - RNA, 15 nt, Human
gaauuuuaaaagaug

SEQ ID NO: 1192707 - RNA, 21 nt, Human
gaauuuuaaaagaugcaaugu

SEQ ID NO: 1192708 - RNA, 23 nt, Human
gaauuuuaaaagaugcaauguag

SEQ ID NO: 1192709 - RNA, 19 nt, Human
gaagggcagggcugaggcc

SEQ ID NO: 1192710 - RNA, 15 nt, Human
gaaggcuauggggau

SEQ ID NO: 1192711 - RNA, 18 nt, Human
gaagugugggucugugug

SEQ ID NO: 1192712 - RNA, 17 nt, Human
gaagugugggucugugu

SEQ ID NO: 1192713 - RNA, 19 nt, Human
gaagugugggucugugugu

SEQ ID NO: 1192714 - RNA, 19 nt, Human
gagcuggggaugucucuca

SEQ ID NO: 1192715 - RNA, 20 nt, Human
gagaugaugaaaauauuuaa

SEQ ID NO: 1192716 - RNA, 18 nt, Human
gacuuuugaaaagaggug

SEQ ID NO: 1192717 - RNA, 23 nt, Human
gagacuaaccccaccacacccuc

SEQ ID NO: 1192718 - RNA, 18 nt, Human
cuuauuggcagcucuacu

SEQ ID NO: 1192719 - RNA, 23 nt, Human
cuuauuguagcauccuggaauau

SEQ ID NO: 1192720 - RNA, 20 nt, Human
cuuauuguagcauccuggaa

SEQ ID NO: 1192721 - RNA, 12 nt, Human
cuucauacaggg

SEQ ID NO: 1192722 - RNA, 13 nt, Human
cuucauacaggga

SEQ ID NO: 1192723 - RNA, 22 nt, Human
cuucauacagggaugguguuca

SEQ ID NO: 1192724 - RNA, 9 nt, Human
cuucauaca

SEQ ID NO: 1192725 - RNA, 10 nt, Human
cuucauacac

SEQ ID NO: 1192726 - RNA, 22 nt, Human
cuugacaaagucaagccacaug

SEQ ID NO: 1192727 - RNA, 16 nt, Human
cuugacaaagucaagc

SEQ ID NO: 1192728 - RNA, 19 nt, Human
cuugacaaagucaagccac

SEQ ID NO: 1192729 - RNA, 13 nt, Human
gaaacuuuuggaa

SEQ ID NO: 1192730 - RNA, 15 nt, Human
gaaacuuuuggaagg

SEQ ID NO: 1192731 - RNA, 19 nt, Human
cuuuuguagaagucacauu

SEQ ID NO: 1192732 - RNA, 22 nt, Human
cuggggaugucucucaugacca

SEQ ID NO: 1192733 - RNA, 16 nt, Human
cuggggauugggcccc

SEQ ID NO: 1192734 - RNA, 18 nt, Human
cuggggauugggccccug

SEQ ID NO: 1192735 - RNA, 22 nt, Human
cuggggauugggccccugccag

SEQ ID NO: 1192736 - RNA, 17 nt, Human
cuggagacuaaccccac

SEQ ID NO: 1192737 - RNA, 16 nt, Human
cuggcuccaggccagg

SEQ ID NO: 1192738 - RNA, 23 nt, Human
cugccaucauguuuacagaggac

SEQ ID NO: 1192739 - RNA, 22 nt, Human
cugccaucauguuuacagagga

SEQ ID NO: 1192740 - RNA, 17 nt, Human
cugccaucauguuuaca

SEQ ID NO: 1192741 - RNA, 16 nt, Human
cugccugguccucaca

SEQ ID NO: 1192742 - RNA, 17 nt, Human
guaaauuuaugugaugg

SEQ ID NO: 1192743 - RNA, 16 nt, Human
guaaauuuaugugaug

SEQ ID NO: 1192744 - RNA, 16 nt, Human
aaaguugaauuuuaca

SEQ ID NO: 1192745 - RNA, 20 nt, Human
gguuuggacaaaauggaaua

SEQ ID NO: 1192746 - RNA, 14 nt, Human
gguuugggaccccu

SEQ ID NO: 1192747 - RNA, 14 nt, Human
aaagcgaauuuuaa

SEQ ID NO: 1192748 - RNA, 14 nt, Human
gguuccagccugcc

SEQ ID NO: 1192749 - RNA, 17 nt, Human
ggucuguguguguguau

SEQ ID NO: 1192750 - RNA, 11 nt, Human
ggucugugugu

SEQ ID NO: 1192751 - RNA, 21 nt, Human
ggucuguguguguguaugugg

SEQ ID NO: 1192752 - RNA, 20 nt, Human
ggucuguguguguguaugug

SEQ ID NO: 1192753 - RNA, 21 nt, Human
ggugcuucuaguucugccagg

SEQ ID NO: 1192754 - RNA, 16 nt, Human
gguaggaacugcuggg

SEQ ID NO: 1192755 - RNA, 17 nt, Human
gguagcuuugaggugga

SEQ ID NO: 1192756 - RNA, 23 nt, Human
ggguguccugcaccggggccugg

SEQ ID NO: 1192757 - RNA, 13 nt, Human
ggguggggagaga

SEQ ID NO: 1192758 - RNA, 18 nt, Human
gggcucagagugggguag

SEQ ID NO: 1192759 - RNA, 17 nt, Human
aaacaccggguuccagc

SEQ ID NO: 1192760 - RNA, 22 nt, Human
gggcccuggugguggcucggga

SEQ ID NO: 1192761 - RNA, 18 nt, Human
gggccagucccugaggca

SEQ ID NO: 1192762 - RNA, 21 nt, Human
gggccagucccugaggcaggu

SEQ ID NO: 1192763 - RNA, 22 nt, Human
gggagaaugucaguauguggaa

SEQ ID NO: 1192764 - RNA, 19 nt, Human
gggagaaugucaguaugug

SEQ ID NO: 1192765 - RNA, 15 nt, Human
aaaagaugcaaugua

SEQ ID NO: 1192766 - RNA, 14 nt, Human
gggaugucucucau

SEQ ID NO: 1192767 - RNA, 16 nt, Human
gggaugguguucaaaa

SEQ ID NO: 1192768 - RNA, 14 nt, Human
aaaagggaggggga

SEQ ID NO: 1192769 - RNA, 15 nt, Human
gggauugggccccug

SEQ ID NO: 1192770 - RNA, 22 nt, Human
ggcgaagcguuguccucagccc

SEQ ID NO: 1192771 - RNA, 16 nt, Human
ggccuugaguccccca

SEQ ID NO: 1192772 - RNA, 19 nt, Human
ggccaguggcuggaucugu

SEQ ID NO: 1192773 - RNA, 22 nt, Human
ggcauccagagucccugccugg

SEQ ID NO: 1192774 - RNA, 15 nt, Human
ggcacuggggcaggg

SEQ ID NO: 1192775 - RNA, 17 nt, Human
ggcccugugccuuggug

SEQ ID NO: 1192776 - RNA, 12 nt, Human
ggcacagccugg

SEQ ID NO: 1192777 - RNA, 13 nt, Human
ggcacagccuggc

SEQ ID NO: 1192778 - RNA, 13 nt, Human
ggaugucugggcc

SEQ ID NO: 1192779 - RNA, 21 nt, Human
ggagguagcuuugagguggaa

SEQ ID NO: 1192780 - RNA, 13 nt, Human
gcugcuccccacg

SEQ ID NO: 1192781 - RNA, 22 nt, Human
gcugcuccccacgucagcuggg

SEQ ID NO: 1192782 - RNA, 20 nt, Human
gcugcagagcagugggccug

SEQ ID NO: 1192783 - RNA, 21 nt, Human
gcugcagagcagugggccugg

SEQ ID NO: 1192784 - RNA, 18 nt, Human
gcuccucgagaucccaac

SEQ ID NO: 1192785 - RNA, 14 nt, Human
gcugaggccucuca

SEQ ID NO: 1192786 - RNA, 17 nt, Human
gcucugugcccacccuc

SEQ ID NO: 1192787 - RNA, 19 nt, Human
gcuuuccucaucaggccau

SEQ ID NO: 1192788 - RNA, 19 nt, Human
gcuuugagguggaagaggg

SEQ ID NO: 1192789 - RNA, 22 nt, Human
gcuuugagguggaagagggcug

SEQ ID NO: 1192790 - RNA, 13 nt, Human
gcuggaucuguga

SEQ ID NO: 1192791 - RNA, 20 nt, Human
gcuguagacauuugcuauga

SEQ ID NO: 1192792 - RNA, 15 nt, Human
ggaacugcugggcuu

SEQ ID NO: 1192793 - RNA, 14 nt, Human
ggaacugcugggcu

SEQ ID NO: 1192794 - RNA, 22 nt, Human
gcuuuuuucucugauacagaaa

SEQ ID NO: 1192795 - RNA, 14 nt, Human
gcggcugggaggag

SEQ ID NO: 1192796 - RNA, 17 nt, Human
gcggcugggaggagggc

SEQ ID NO: 1192797 - RNA, 18 nt, Human
gcggcugggaggagggca

SEQ ID NO: 1192798 - RNA, 19 nt, Human
gcggcugggaggagggcag

SEQ ID NO: 1192799 - RNA, 22 nt, Human
gcggcugggaggagggcaggca

SEQ ID NO: 1192800 - RNA, 23 nt, Human
gccaguggcuggaucugugaggg

SEQ ID NO: 1192801 - RNA, 14 nt, Human
gccaguggcuggau

SEQ ID NO: 1192802 - RNA, 14 nt, Human
gccaggauggaaug

SEQ ID NO: 1192803 - RNA, 11 nt, Human
gcccuaucugu

SEQ ID NO: 1192804 - RNA, 14 nt, Human
accaucucuuuacc

SEQ ID NO: 1192805 - RNA, 15 nt, Human
acaguggggaaugaa

SEQ ID NO: 1192806 - RNA, 19 nt, Human
acaguggggaaugaagaua

SEQ ID NO: 1192807 - RNA, 15 nt, Human
aauugugaugugucc

SEQ ID NO: 1192808 - RNA, 14 nt, Human
aauugugauguguc

SEQ ID NO: 1192809 - RNA, 11 nt, Human
aauugugaugu

SEQ ID NO: 1192810 - RNA, 21 nt, Human
aauuggguggggggcuucaua

SEQ ID NO: 1192811 - RNA, 22 nt, Human
aauuggguggggggcuucauac

SEQ ID NO: 1192812 - RNA, 23 nt, Human
aauuggguggggggcuucauaca

SEQ ID NO: 1192813 - RNA, 18 nt, Human
aauuuccugggagcuuuu

SEQ ID NO: 1192814 - RNA, 21 nt, Human
aauuuccugggagcuuuugua

SEQ ID NO: 1192815 - RNA, 13 nt, Human
acaaaauggaaua

SEQ ID NO: 1192816 - RNA, 14 nt, Human
acaaaauggaauac

SEQ ID NO: 1192817 - RNA, 15 nt, Human
acaaaauggaauacu

SEQ ID NO: 1192818 - RNA, 23 nt, Human
acagaggacaguauuugugggga

SEQ ID NO: 1192819 - RNA, 20 nt, Human
acacguaaugaaacuuggau

SEQ ID NO: 1192820 - RNA, 22 nt, Human
acuaggugcccagaaugaggcu

SEQ ID NO: 1192821 - RNA, 18 nt, Human
aagagaagggcagggcug

SEQ ID NO: 1192822 - RNA, 20 nt, Human
aagauucaaugccccugaau

SEQ ID NO: 1192823 - RNA, 21 nt, Human
aagauucaaugccccugaauu

SEQ ID NO: 1192824 - RNA, 16 nt, Human
aagauacugaaauaaa

SEQ ID NO: 1192825 - RNA, 20 nt, Human
aagauacugaaauaaacguc

SEQ ID NO: 1192826 - RNA, 19 nt, Human
aauacgugggcauucaaau

SEQ ID NO: 1192827 - RNA, 20 nt, Human
aauacgugggcauucaaaug

SEQ ID NO: 1192828 - RNA, 15 nt, Human
aauaaacgucuuaaa

SEQ ID NO: 1192829 - RNA, 16 nt, Human
aauaaacgucuuaaau

SEQ ID NO: 1192830 - RNA, 15 nt, Human
aacucauauuuucau

SEQ ID NO: 1192831 - RNA, 16 nt, Human
aacucauauuuucaug

SEQ ID NO: 1192832 - RNA, 18 nt, Human
aacucauauuuucaugcu

SEQ ID NO: 1192833 - RNA, 13 nt, Human
aacugagcuugga

SEQ ID NO: 1192834 - RNA, 17 nt, Human
aacugagcuuggaagcu

SEQ ID NO: 1192835 - RNA, 21 nt, Human
aacugagcuuggaagcuucug

SEQ ID NO: 1192836 - RNA, 20 nt, Human
aacagcggcuggacuuggag

SEQ ID NO: 1192837 - RNA, 14 nt, Human
aaagauaaauauua

SEQ ID NO: 1192838 - RNA, 15 nt, Human
aaagauaaauauuau

SEQ ID NO: 1192839 - RNA, 13 nt, Human
aaagaggugugca

SEQ ID NO: 1192840 - RNA, 16 nt, Human
aaagauaaauauuaua

SEQ ID NO: 1192841 - RNA, 15 nt, Human
aaagccaagaggcug

SEQ ID NO: 1192842 - RNA, 17 nt, Human
aaauaaacgucuuaaau

SEQ ID NO: 1192843 - RNA, 15 nt, Human
aaauaaacgucuuaa

SEQ ID NO: 1192844 - RNA, 16 nt, Human
aaauaaacgucuuaaa

SEQ ID NO: 1192845 - RNA, 10 nt, Human
agagggcugc

SEQ ID NO: 1192846 - RNA, 15 nt, Human
agagccugagaguga

SEQ ID NO: 1192847 - RNA, 22 nt, Human
agaagucacauuccugaacagg

SEQ ID NO: 1192848 - RNA, 20 nt, Human
agaagucacauuccugaaca

SEQ ID NO: 1192849 - RNA, 21 nt, Human
agaagucacauuccugaacag

SEQ ID NO: 1192850 - RNA, 18 nt, Human
agaugaugaaaauauuua

SEQ ID NO: 1192851 - RNA, 23 nt, Human
agaugaugaaaauauuuaaaggc

SEQ ID NO: 1192852 - RNA, 22 nt, Human
aggaacugcugggcuuggcagc

SEQ ID NO: 1192853 - RNA, 16 nt, Human
aggaaccgaggcaggg

SEQ ID NO: 1192854 - RNA, 13 nt, Human
aggaaccaaagcg

SEQ ID NO: 1192855 - RNA, 15 nt, Human
aggaaccaaagcgaa

SEQ ID NO: 1192856 - RNA, 16 nt, Human
aggaaccauaaucaau

SEQ ID NO: 1192857 - RNA, 19 nt, Human
agcuaauucuuugaccugu

SEQ ID NO: 1192858 - RNA, 16 nt, Human
agcuccuuaaggcucu

SEQ ID NO: 1192859 - RNA, 17 nt, Human
agcuccuuaaggcucuu

SEQ ID NO: 1192860 - RNA, 18 nt, Human
agcuccuuaaggcucuuu

SEQ ID NO: 1192861 - RNA, 16 nt, Human
agggaugguguucaaa

SEQ ID NO: 1192862 - RNA, 12 nt, Human
aggggcaggagg

SEQ ID NO: 1192863 - RNA, 13 nt, Human
aggggcaggagga

SEQ ID NO: 1192864 - RNA, 18 nt, Human
aggggcaggaggaagggg

SEQ ID NO: 1192865 - RNA, 16 nt, Human
augaugggucaguugu

SEQ ID NO: 1192866 - RNA, 19 nt, Human
augaugaaaauauuuaaag

SEQ ID NO: 1192867 - RNA, 13 nt, Human
augaugaaaauau

SEQ ID NO: 1192868 - RNA, 15 nt, Human
augaugaaaauauuu

SEQ ID NO: 1192869 - RNA, 16 nt, Human
augugaacagcggcug

SEQ ID NO: 1192870 - RNA, 11 nt, Human
augugaacagu

SEQ ID NO: 1192871 - RNA, 17 nt, Human
auguguaagacaaaaag

SEQ ID NO: 1192872 - RNA, 19 nt, Human
auguguaagacaaaaagcu

SEQ ID NO: 1192873 - RNA, 19 nt, Human
auccagagucccugccugg

SEQ ID NO: 1192874 - RNA, 20 nt, Human
auccagagucccugccugga

SEQ ID NO: 1192875 - RNA, 21 nt, Human
auccagagucccugccuggac

SEQ ID NO: 1192876 - RNA, 21 nt, Human
auauuucccugaaggaaccaa

SEQ ID NO: 1192877 - RNA, 13 nt, Human
augaaaauauuua

SEQ ID NO: 1192878 - RNA, 14 nt, Human
augaaaauauuuaa

SEQ ID NO: 1192879 - RNA, 16 nt, Human
augaaaauauuuaaag

SEQ ID NO: 1192880 - RNA, 20 nt, Human
augagggucuugguuccagc

SEQ ID NO: 1192881 - RNA, 13 nt, Human
augagggucuugg

SEQ ID NO: 1192882 - RNA, 22 nt, Human
aucucugcaggaaauggcugug

SEQ ID NO: 1192883 - RNA, 14 nt, Human
aucuauauuuuaca

SEQ ID NO: 1192884 - RNA, 20 nt, Human
aucuccgucaacucauauuu

SEQ ID NO: 1192885 - RNA, 16 nt, Human
agucugagagaggcca

SEQ ID NO: 1192886 - RNA, 23 nt, Human
agucugagagaggccauucuuuc

SEQ ID NO: 1192887 - RNA, 14 nt, Human
aguauuuuguuuca

SEQ ID NO: 1192888 - RNA, 17 nt, Human
aguauuuuguuucagug

SEQ ID NO: 1192889 - RNA, 13 nt, Human
aguucagcuuggg

SEQ ID NO: 1192890 - RNA, 14 nt, Human
aguucagcuugggg

SEQ ID NO: 1192891 - RNA, 12 nt, Human
agugucuggcug

SEQ ID NO: 1192892 - RNA, 13 nt, Human
agugucuggcugc

SEQ ID NO: 1192893 - RNA, 14 nt, Human
agugucuggcugca

SEQ ID NO: 1192894 - RNA, 16 nt, Human
aguuuggcaaacucuc

SEQ ID NO: 1192895 - RNA, 18 nt, Human
aguuuggcaaacucucca

SEQ ID NO: 1192896 - RNA, 13 nt, Human
auacagaaaaguu

SEQ ID NO: 1192897 - RNA, 17 nt, Human
auaugcagauuuugccc

SEQ ID NO: 1192898 - RNA, 19 nt, Human
auauuucccugaaggaacc

SEQ ID NO: 1192899 - RNA, 18 nt, Human
auauauuuuuuucugaaa

SEQ ID NO: 1192900 - RNA, 19 nt, Human
auauauuuuuuucugaaau

SEQ ID NO: 1192901 - RNA, 24 nt, Human
auagguuuggacaaaauggaauac

SEQ ID NO: 1192902 - RNA, 13 nt, Human
uguguaugugggg

SEQ ID NO: 1192903 - RNA, 12 nt, Human
uguguauguggg

SEQ ID NO: 1192904 - RNA, 11 nt, Human
uguguaugugg

SEQ ID NO: 1192905 - RNA, 15 nt, Human
ugugugggagugugu

SEQ ID NO: 1192906 - RNA, 14 nt, Human
ugugugggagugug

SEQ ID NO: 1192907 - RNA, 13 nt, Human
ugugugcucucca

SEQ ID NO: 1192908 - RNA, 16 nt, Human
ugugugggagugugua

SEQ ID NO: 1192909 - RNA, 13 nt, Human
uguguuugaagca

SEQ ID NO: 1192910 - RNA, 16 nt, Human
uguucuuuugucccag

SEQ ID NO: 1192911 - RNA, 20 nt, Human
uguucaugaaagauucaaug

SEQ ID NO: 1192912 - RNA, 13 nt, Human
uguucaugaaaga

SEQ ID NO: 1192913 - RNA, 14 nt, Human
uguucaugaaagau

SEQ ID NO: 1192914 - RNA, 12 nt, Human
uguuuacagugu

SEQ ID NO: 1192915 - RNA, 16 nt, Human
uguuuagaagaagugu

SEQ ID NO: 1192916 - RNA, 18 nt, Human
uguguaauuuaaaauugu

SEQ ID NO: 1192917 - RNA, 11 nt, Human
uguguaauuua

SEQ ID NO: 1192918 - RNA, 23 nt, Human
uguguaauuuaaaauugugaugu

SEQ ID NO: 1192919 - RNA, 22 nt, Human
uguguaauuuaaaauugugaug

SEQ ID NO: 1192920 - RNA, 19 nt, Human
uguguaauuuaaaauugug

SEQ ID NO: 1192921 - RNA, 15 nt, Human
ugugggaguguguaa

SEQ ID NO: 1192922 - RNA, 14 nt, Human
ugugggagugugua

SEQ ID NO: 1192923 - RNA, 15 nt, Human
uguggaagugugggu

SEQ ID NO: 1192924 - RNA, 15 nt, Human
uguggccuaaccugc

SEQ ID NO: 1192925 - RNA, 16 nt, Human
ugugccuuuugccauc

SEQ ID NO: 1192926 - RNA, 17 nt, Human
ugugccuuggugugcug

SEQ ID NO: 1192927 - RNA, 17 nt, Human
ugugccuugucacgcca

SEQ ID NO: 1192928 - RNA, 19 nt, Human
ugugccuugucacgccaga

SEQ ID NO: 1192929 - RNA, 20 nt, Human
ugugccuugucacgccagac

SEQ ID NO: 1192930 - RNA, 17 nt, Human
ugucuggcacagccugg

SEQ ID NO: 1192931 - RNA, 14 nt, Human
uguaccucugccuc

SEQ ID NO: 1192932 - RNA, 14 nt, Human
uguagcauccugga

SEQ ID NO: 1192933 - RNA, 16 nt, Human
uguagcauccuggaau

SEQ ID NO: 1192934 - RNA, 17 nt, Human
uguagcauccuggaaua

SEQ ID NO: 1192935 - RNA, 18 nt, Human
uguagcauccuggaauau

SEQ ID NO: 1192936 - RNA, 22 nt, Human
ugucacccuuaggccagcacca

SEQ ID NO: 1192937 - RNA, 14 nt, Human
ugucacgccagacu

SEQ ID NO: 1192938 - RNA, 21 nt, Human
uguccucagccccgcguggaa

SEQ ID NO: 1192939 - RNA, 11 nt, Human
ugggggaugua

SEQ ID NO: 1192940 - RNA, 18 nt, Human
ugggggucuguguguuua

SEQ ID NO: 1192941 - RNA, 20 nt, Human
uggggauugggccccugcca

SEQ ID NO: 1192942 - RNA, 20 nt, Human
uggguggggggcuucauaca

SEQ ID NO: 1192943 - RNA, 21 nt, Human
uggguggggggcuucauacac

SEQ ID NO: 1192944 - RNA, 21 nt, Human
ugggagugaggaugucugggc

SEQ ID NO: 1192945 - RNA, 21 nt, Human
ugggacaccccgacuuuuguu

SEQ ID NO: 1192946 - RNA, 14 nt, Human
ugggagauguggaa

SEQ ID NO: 1192947 - RNA, 20 nt, Human
uggaaugaugggucaguugu

SEQ ID NO: 1192948 - RNA, 18 nt, Human
uggaacucgugucuggca

SEQ ID NO: 1192949 - RNA, 16 nt, Human
uggaauaucuccguca

SEQ ID NO: 1192950 - RNA, 17 nt, Human
uggaaacaagucaguca

SEQ ID NO: 1192951 - RNA, 18 nt, Human
ugccaggauggaaugaug

SEQ ID NO: 1192952 - RNA, 17 nt, Human
ugcccacccuccacucu

SEQ ID NO: 1192953 - RNA, 12 nt, Human
ugcaccggggcc

SEQ ID NO: 1192954 - RNA, 16 nt, Human
ugcaccggggccuggg

SEQ ID NO: 1192955 - RNA, 22 nt, Human
ugcaccggggccugggcaggag

SEQ ID NO: 1192956 - RNA, 22 nt, Human
ugcagagcagugggccuggcca

SEQ ID NO: 1192957 - RNA, 11 nt, Human
ugcagagcugc

SEQ ID NO: 1192958 - RNA, 19 nt, Human
ugcucagugucuggcugca

SEQ ID NO: 1192959 - RNA, 17 nt, Human
ugcucuccaagcccagu

SEQ ID NO: 1192960 - RNA, 22 nt, Human
ugaagagaagggcagggcugag

SEQ ID NO: 1192961 - RNA, 20 nt, Human
ugaagagaagggcagggcug

SEQ ID NO: 1192962 - RNA, 20 nt, Human
ugaagagguuuuaaagcuuc

SEQ ID NO: 1192963 - RNA, 21 nt, Human
ugaagagguuuuaaagcuucc

SEQ ID NO: 1192964 - RNA, 16 nt, Human
ugaaggaaccaaagcg

SEQ ID NO: 1192965 - RNA, 16 nt, Human
ugaauuuaaauagcuu

SEQ ID NO: 1192966 - RNA, 14 nt, Human
ugacucuuuccaac

SEQ ID NO: 1192967 - RNA, 16 nt, Human
ugacucuuuccaaccg

SEQ ID NO: 1192968 - RNA, 13 nt, Human
ugacucuuuccaa

SEQ ID NO: 1192969 - RNA, 19 nt, Human
ugacucuuuccaaccggcu

SEQ ID NO: 1192970 - RNA, 13 nt, Human
ugaggcagguccc

SEQ ID NO: 1192971 - RNA, 22 nt, Human
ucuucauuaccucagugagaag

SEQ ID NO: 1192972 - RNA, 13 nt, Human
ucugugugugugu

SEQ ID NO: 1192973 - RNA, 11 nt, Human
ucugugugugu

SEQ ID NO: 1192974 - RNA, 18 nt, Human
ucuugaacugagcuugga

SEQ ID NO: 1192975 - RNA, 17 nt, Human
ucuugaacugagcuugg

SEQ ID NO: 1192976 - RNA, 19 nt, Human
ucuuuccaaccggcuuugu

SEQ ID NO: 1192977 - RNA, 18 nt, Human
ucuggugaccuuccaaga

SEQ ID NO: 1192978 - RNA, 23 nt, Human
ucuggugaccuuccaagagccug

SEQ ID NO: 1192979 - RNA, 16 nt, Human
ucuggugaccuuccaa

SEQ ID NO: 1192980 - RNA, 15 nt, Human
ucuggcugcagagca

SEQ ID NO: 1192981 - RNA, 19 nt, Human
uccugucccucauccauag

SEQ ID NO: 1192982 - RNA, 13 nt, Human
ucuauauuuuaca

SEQ ID NO: 1192983 - RNA, 16 nt, Human
uccucgagaucccaac

SEQ ID NO: 1192984 - RNA, 23 nt, Human
uccucgagaucccaacacugcca

SEQ ID NO: 1192985 - RNA, 23 nt, Human
ucccaugagcuccuuaaggcucu

SEQ ID NO: 1192986 - RNA, 18 nt, Human
ucccucuacugggagccu

SEQ ID NO: 1192987 - RNA, 22 nt, Human
ucccucuacugggagccuaccc

SEQ ID NO: 1192988 - RNA, 23 nt, Human
ucccucuacugggagccuaccca

SEQ ID NO: 1192989 - RNA, 16 nt, Human
ucccaacacugccagc

SEQ ID NO: 1192990 - RNA, 14 nt, Human
ucccaacacugcca

SEQ ID NO: 1192991 - RNA, 15 nt, Human
ucccaacacugccag

SEQ ID NO: 1192992 - RNA, 15 nt, Human
uccagagucccugcc

SEQ ID NO: 1192993 - RNA, 22 nt, Human
uccaagcccaguucagcuuggg

SEQ ID NO: 1192994 - RNA, 13 nt, Human
uccaagagccuga

SEQ ID NO: 1192995 - RNA, 14 nt, Human
uccaagagccugag

SEQ ID NO: 1192996 - RNA, 20 nt, Human
ucagaucauuaucagccugu

SEQ ID NO: 1192997 - RNA, 17 nt, Human
ucagauaugauucaaau

SEQ ID NO: 1192998 - RNA, 18 nt, Human
ucagauaugauucaaaug

SEQ ID NO: 1192999 - RNA, 23 nt, Human
ucagccuccauccuacccccugu

SEQ ID NO: 1193000 - RNA, 14 nt, Human
ucaucuuucuucca

SEQ ID NO: 1193001 - RNA, 17 nt, Human
ucaucuuucuuccaaac

SEQ ID NO: 1193002 - RNA, 15 nt, Human
ucaugaaagauucaa

SEQ ID NO: 1193003 - RNA, 13 nt, Human
ucaugaaagauuc

SEQ ID NO: 1193004 - RNA, 14 nt, Human
ucaguucucuucac

SEQ ID NO: 1193005 - RNA, 17 nt, Human
ucaguucucuucacuca

SEQ ID NO: 1193006 - RNA, 20 nt, Human
uauauuuguaaauuuaugug

SEQ ID NO: 1193007 - RNA, 16 nt, Human
uauauuuuuuucugaa

SEQ ID NO: 1193008 - RNA, 19 nt, Human
uauauuuuuuucugaaauu

SEQ ID NO: 1193009 - RNA, 20 nt, Human
uauauuuuuuucugaaauuu

SEQ ID NO: 1193010 - RNA, 22 nt, Human
uauaaacaugcuugcauuauau

SEQ ID NO: 1193011 - RNA, 18 nt, Human
uauaaaccgaacugaugu

SEQ ID NO: 1193012 - RNA, 13 nt, Human
uagcauccuggaa

SEQ ID NO: 1193013 - RNA, 15 nt, Human
uagcauccuggaaua

SEQ ID NO: 1193014 - RNA, 16 nt, Human
uagcauccuggaauau

SEQ ID NO: 1193015 - RNA, 18 nt, Human
uagcauccuggaauaucu

SEQ ID NO: 1193016 - RNA, 23 nt, Human
uacauggcuggagcuagaauuug

SEQ ID NO: 1193017 - RNA, 21 nt, Human
uacauggcuggagcuagaauu

SEQ ID NO: 1193018 - RNA, 22 nt, Human
uaagugccaggauggaaugaug

SEQ ID NO: 1193019 - RNA, 23 nt, Human
uaauaaucauuggauucugagag

SEQ ID NO: 1193020 - RNA, 13 nt, Human
uaaauuuauguga

SEQ ID NO: 1193021 - RNA, 13 nt, Human
uaaauucuuucau

SEQ ID NO: 1193022 - RNA, 16 nt, Human
guuuagaagaagugug

SEQ ID NO: 1193023 - RNA, 22 nt, Human
guugugugugggaguguguaau

SEQ ID NO: 1193024 - RNA, 16 nt, Human
guugugugugggagug

SEQ ID NO: 1193025 - RNA, 14 nt, Human
guugugugugggag

SEQ ID NO: 1193026 - RNA, 13 nt, Human
guuguguguggga

SEQ ID NO: 1193027 - RNA, 12 nt, Human
guuguguguggg

SEQ ID NO: 1193028 - RNA, 19 nt, Human
guugucugcaacucugaag

SEQ ID NO: 1193029 - RNA, 17 nt, Human
guuguccucagccccgc

SEQ ID NO: 1193030 - RNA, 23 nt, Human
guuguccucagccccgcguggaa

SEQ ID NO: 1193031 - RNA, 21 nt, Human
uaaaggcccuaucuguuuaca

SEQ ID NO: 1193032 - RNA, 17 nt, Human
uaaaagauaaauauuau

SEQ ID NO: 1193033 - RNA, 12 nt, Human
guucugccagga

SEQ ID NO: 1193034 - RNA, 13 nt, Human
guucugccaggag

SEQ ID NO: 1193035 - RNA, 14 nt, Human
guucugccaggaga

SEQ ID NO: 1193036 - RNA, 18 nt, Human
guugaagagguuuuaaag

SEQ ID NO: 1193037 - RNA, 16 nt, Human
guuccuagccaccgcc

SEQ ID NO: 1193038 - RNA, 15 nt, Human
guuccagccugccac

SEQ ID NO: 1193039 - RNA, 14 nt, Human
guuccagcaccaca

SEQ ID NO: 1193040 - RNA, 13 nt, Human
guuccagccugcc

SEQ ID NO: 1193041 - RNA, 14 nt, Human
guuccagccugcca

SEQ ID NO: 1193042 - RNA, 12 nt, Human
guucaugaaaga

SEQ ID NO: 1193043 - RNA, 20 nt, Human
guucacucuuggagccugca

SEQ ID NO: 1193044 - RNA, 24 nt, Human
guucacucuuggagccugcagagc

SEQ ID NO: 1193045 - RNA, 17 nt, Human
guucacucuuggagccu

SEQ ID NO: 1193046 - RNA, 18 nt, Human
guucacucuuggagccug

SEQ ID NO: 1193047 - RNA, 19 nt, Human
guucacucuuggagccugc

SEQ ID NO: 1193048 - RNA, 16 nt, Human
guuacccaaauuaaga

SEQ ID NO: 1193049 - RNA, 17 nt, Human
guguguuguguguggga

SEQ ID NO: 1193050 - RNA, 14 nt, Human
guguguugugugug

SEQ ID NO: 1193051 - RNA, 12 nt, Human
guguguugugug

SEQ ID NO: 1193052 - RNA, 16 nt, Human
guguguuuaugugugu

SEQ ID NO: 1193053 - RNA, 15 nt, Human
guguguuuaugugug

SEQ ID NO: 1193054 - RNA, 14 nt, Human
guguguuuaugugu

SEQ ID NO: 1193055 - RNA, 17 nt, Human
gugugggaguguguaau

SEQ ID NO: 1193056 - RNA, 17 nt, Human
gugucuggcacagccug

SEQ ID NO: 1193057 - RNA, 14 nt, Human
gugucuggcugcag

SEQ ID NO: 1193058 - RNA, 21 nt, Human
guguccugcaccggggccugg

SEQ ID NO: 1193059 - RNA, 17 nt, Human
guuaaacucgcucacug

SEQ ID NO: 1193060 - RNA, 23 nt, Human
guguaauuuaaaauugugaugug

SEQ ID NO: 1193061 - RNA, 22 nt, Human
guguaauuuaaaauugugaugu

SEQ ID NO: 1193062 - RNA, 20 nt, Human
guguaauuuaaaauugugau

SEQ ID NO: 1193063 - RNA, 18 nt, Human
guggucuccacuggggau

SEQ ID NO: 1193064 - RNA, 17 nt, Human
guguaagacaaaaagcu

SEQ ID NO: 1193065 - RNA, 21 nt, Human
guggggagagacgggcccugg

SEQ ID NO: 1193066 - RNA, 15 nt, Human
gugggcauucaaaug

SEQ ID NO: 1193067 - RNA, 13 nt, Human
gugggccuggcca

SEQ ID NO: 1193068 - RNA, 17 nt, Human
guggcuggaucugugag

SEQ ID NO: 1193069 - RNA, 16 nt, Human
guggcucgggaggcga

SEQ ID NO: 1193070 - RNA, 21 nt, Human
gugccaggauggaaugauggg

SEQ ID NO: 1193071 - RNA, 14 nt, Human
gugccuuuugccau

SEQ ID NO: 1193072 - RNA, 15 nt, Human
gugaggaugucuggg

SEQ ID NO: 1193073 - RNA, 21 nt, Human
gugacuauggagcugagcagg

SEQ ID NO: 1193074 - RNA, 21 nt, Human
gugaccuuccaagagccugag

SEQ ID NO: 1193075 - RNA, 22 nt, Human
gugaccuuccaagagccugaga

SEQ ID NO: 1193076 - RNA, 22 nt, Human
gucuguguguuuaugugugugu

SEQ ID NO: 1193077 - RNA, 21 nt, Human
gucuguguguuuaugugugug

SEQ ID NO: 1193078 - RNA, 11 nt, Human
gucuguguguu

SEQ ID NO: 1193079 - RNA, 20 nt, Human
gucuguguguguguaugugg

SEQ ID NO: 1193080 - RNA, 16 nt, Human
gucuguguguguguau

SEQ ID NO: 1193081 - RNA, 12 nt, Human
gucugugugugu

SEQ ID NO: 1193082 - RNA, 11 nt, Human
gucugugugug

SEQ ID NO: 1193083 - RNA, 13 nt, Human
gucugagagaggc

SEQ ID NO: 1193084 - RNA, 14 nt, Human
gucugagagaggcc

SEQ ID NO: 1193085 - RNA, 15 nt, Human
gucugagagaggcca

SEQ ID NO: 1193086 - RNA, 18 nt, Human
gucugagagaggccauuc

SEQ ID NO: 1193087 - RNA, 16 nt, Human
gucuugguuccagccu

SEQ ID NO: 1193088 - RNA, 17 nt, Human
gucuugguuccagccug

SEQ ID NO: 1193089 - RNA, 19 nt, Human
gucuugguuccagccugcc

SEQ ID NO: 1193090 - RNA, 14 nt, Human
gucccugccuggac

SEQ ID NO: 1193091 - RNA, 13 nt, Human
gucccugccugga

SEQ ID NO: 1193092 - RNA, 16 nt, Human
gucccugaagagaagg

SEQ ID NO: 1193093 - RNA, 18 nt, Human
gucccugaggcagguccc

SEQ ID NO: 1193094 - RNA, 22 nt, Human
gucccugaggcagguccccaga

SEQ ID NO: 1193095 - RNA, 22 nt, Human
gucagcugggacaccccgacuu

SEQ ID NO: 1193096 - RNA, 21 nt, Human
gucauucagauaugauucaaa

SEQ ID NO: 1193097 - RNA, 14 nt, Human
guagguugggagaa

SEQ ID NO: 1193098 - RNA, 19 nt, Human
guagugauuuuuaugccac

SEQ ID NO: 1193099 - RNA, 21 nt, Human
guagcauuuguguugaagagg

SEQ ID NO: 1193100 - RNA, 16 nt, Human
guagcauccuggaaua

SEQ ID NO: 1193101 - RNA, 23 nt, Human
uuuuucucugauacagaaaaguu

SEQ ID NO: 1193102 - RNA, 20 nt, Human
uuuuaaaagaugcaauguag

SEQ ID NO: 1193103 - RNA, 17 nt, Human
uuugaauguaugcuuca

SEQ ID NO: 1193104 - RNA, 22 nt, Human
uuugaauguaugcuucauacag

SEQ ID NO: 1193105 - RNA, 19 nt, Human
uuugguuuucacauuggaa

SEQ ID NO: 1193106 - RNA, 19 nt, Human
uuuggacaaaauggaauac

SEQ ID NO: 1193107 - RNA, 18 nt, Human
uuugaagcacagugauca

SEQ ID NO: 1193108 - RNA, 15 nt, Human
uuucucugauacaga

SEQ ID NO: 1193109 - RNA, 16 nt, Human
uuucucugauacagaa

SEQ ID NO: 1193110 - RNA, 17 nt, Human
uuucucugauacagaaa

SEQ ID NO: 1193111 - RNA, 18 nt, Human
uuucucugauacagaaaa

SEQ ID NO: 1193112 - RNA, 21 nt, Human
uuucugaaauuuccugggagc

SEQ ID NO: 1193113 - RNA, 12 nt, Human
gcgcggcuggga

SEQ ID NO: 1193114 - RNA, 18 nt, Human
gcgcggcugggaggaggg

SEQ ID NO: 1193115 - RNA, 17 nt, Human
gcuaagaauauuugaau

SEQ ID NO: 1193116 - RNA, 18 nt, Human
gccuuuggacuugucccg

SEQ ID NO: 1193117 - RNA, 15 nt, Human
gccugccacucaggc

SEQ ID NO: 1193118 - RNA, 23 nt, Human
gccugccacucaggcccaaagcc

SEQ ID NO: 1193119 - RNA, 19 nt, Human
gccucucauuccagaggaa

SEQ ID NO: 1193120 - RNA, 20 nt, Human
gccuccuacagcccaccugg

SEQ ID NO: 1193121 - RNA, 20 nt, Human
gccucucauuccagaggaag

SEQ ID NO: 1193122 - RNA, 21 nt, Human
gccucuccacucaugugacuc

SEQ ID NO: 1193123 - RNA, 24 nt, Human
gccucuccacucaugugacucuuu

SEQ ID NO: 1193124 - RNA, 17 nt, Human
gccuaaccugccgagag

SEQ ID NO: 1193125 - RNA, 21 nt, Human
gccaucauguuuacagaggac

SEQ ID NO: 1193126 - RNA, 17 nt, Human
gccaucauguuuacaga

SEQ ID NO: 1193127 - RNA, 16 nt, Human
gccagucccugaggca

SEQ ID NO: 1193128 - RNA, 22 nt, Human
gccagucccugaggcagguccc

SEQ ID NO: 1193129 - RNA, 16 nt, Human
gcccagaaugaggcug

SEQ ID NO: 1193130 - RNA, 17 nt, Human
gcccagaaugaggcugc

SEQ ID NO: 1193131 - RNA, 15 nt, Human
gcccgggagcucagg

SEQ ID NO: 1193132 - RNA, 17 nt, Human
gcccgggagcucaggaa

SEQ ID NO: 1193133 - RNA, 19 nt, Human
gcccgggagcucaggaacc

SEQ ID NO: 1193134 - RNA, 16 nt, Human
gccccugagaucucug

SEQ ID NO: 1193135 - RNA, 20 nt, Human
gccccugagaucucugcagg

SEQ ID NO: 1193136 - RNA, 18 nt, Human
gcauuauauuuguaaauu

SEQ ID NO: 1193137 - RNA, 19 nt, Human
gcauucaaauguauuacag

SEQ ID NO: 1193138 - RNA, 16 nt, Human
gcauuuguguugaaga

SEQ ID NO: 1193139 - RNA, 19 nt, Human
gcaggggccgggggcaguc

SEQ ID NO: 1193140 - RNA, 20 nt, Human
gcaggggccgggggcagucu

SEQ ID NO: 1193141 - RNA, 13 nt, Human
gcagguccccaga

SEQ ID NO: 1193142 - RNA, 14 nt, Human
gcagguccccagac

SEQ ID NO: 1193143 - RNA, 23 nt, Human
gauugcaggagucccugccauca

SEQ ID NO: 1193144 - RNA, 20 nt, Human
gauuuggggcucagaguggg

SEQ ID NO: 1193145 - RNA, 23 nt, Human
gauuugcucagugucuggcugca

SEQ ID NO: 1193146 - RNA, 17 nt, Human
gauuccagguggcauca

SEQ ID NO: 1193147 - RNA, 22 nt, Human
gcaaauccuugugggaaaagaa

SEQ ID NO: 1193148 - RNA, 20 nt, Human
gcaaauccuugugggaaaag

SEQ ID NO: 1193149 - RNA, 21 nt, Human
gaucugugaggggcucucuca

SEQ ID NO: 1193150 - RNA, 23 nt, Human
gaucucagugguuaagauuccua

SEQ ID NO: 1193151 - RNA, 14 nt, Human
gaugaaaauauuua

SEQ ID NO: 1193152 - RNA, 15 nt, Human
gaugaaaauauuuaa

SEQ ID NO: 1193153 - RNA, 16 nt, Human
gaugaaaauauuuaaa

SEQ ID NO: 1193154 - RNA, 17 nt, Human
gaugaaaauauuuaaag

SEQ ID NO: 1193155 - RNA, 20 nt, Human
gauggcaaagaaggagagca

SEQ ID NO: 1193156 - RNA, 13 nt, Human
gauagaugugugg

SEQ ID NO: 1193157 - RNA, 11 nt, Human
gauacagaaaa

SEQ ID NO: 1193158 - RNA, 15 nt, Human
gauaaauauuauauu

SEQ ID NO: 1193159 - RNA, 22 nt, Human
gauaaauauuauauuauauaua

SEQ ID NO: 1193160 - RNA, 14 nt, Human
gaucauuaucagcc

SEQ ID NO: 1193161 - RNA, 17 nt, Human
gaucccaugagcuccuu

SEQ ID NO: 1193162 - RNA, 21 nt, Human
gaucaaguuauuuuuaauuug

SEQ ID NO: 1193163 - RNA, 20 nt, Human
gagcucaggaaccgaggcag

SEQ ID NO: 1193164 - RNA, 21 nt, Human
gagcucaggaaccgaggcagg

SEQ ID NO: 1193165 - RNA, 22 nt, Human
gagcucaggaaccgaggcaggg

SEQ ID NO: 1193166 - RNA, 14 nt, Human
gagcuuuuguagaa

SEQ ID NO: 1193167 - RNA, 21 nt, Human
gagccugacccucaucuuucu

SEQ ID NO: 1193168 - RNA, 15 nt, Human
gagccuacccacccc

SEQ ID NO: 1193169 - RNA, 17 nt, Human
gagccuacccaccccca

SEQ ID NO: 1193170 - RNA, 22 nt, Human
gagaagccagcuuuccucauca

SEQ ID NO: 1193171 - RNA, 18 nt, Human
gacuugucccgggacacc

SEQ ID NO: 1193172 - RNA, 13 nt, Human
gagagaggccauu

SEQ ID NO: 1193173 - RNA, 21 nt, Human
gagagaggccauucuuuccca

SEQ ID NO: 1193174 - RNA, 15 nt, Human
gagagugagguggaa

SEQ ID NO: 1193175 - RNA, 17 nt, Human
gaccuuuccugaggaag

SEQ ID NO: 1193176 - RNA, 15 nt, Human
gacaccuaggcuagg

SEQ ID NO: 1193177 - RNA, 16 nt, Human
gacaccuaggcuaggg

SEQ ID NO: 1193178 - RNA, 20 nt, Human
gacaccuaggcuaggguggg

SEQ ID NO: 1193179 - RNA, 13 nt, Human
gaagaaguguguc

SEQ ID NO: 1193180 - RNA, 21 nt, Human
gaaggaucccaugagcuccuu

SEQ ID NO: 1193181 - RNA, 21 nt, Human
gaagucacauuccugaacagg

SEQ ID NO: 1193182 - RNA, 16 nt, Human
gaagucacauuccuga

SEQ ID NO: 1193183 - RNA, 20 nt, Human
gaagucacauuccugaacag

SEQ ID NO: 1193184 - RNA, 23 nt, Human
gaaggaaccaaagcgaauuuuaa

SEQ ID NO: 1193185 - RNA, 22 nt, Human
gaagcuucuggugaccuuccaa

SEQ ID NO: 1193186 - RNA, 20 nt, Human
gaacaguuguguuugaagca

SEQ ID NO: 1193187 - RNA, 17 nt, Human
gaacaggauauucucac

SEQ ID NO: 1193188 - RNA, 22 nt, Human
gaacaguuguguuugaagcaca

SEQ ID NO: 1193189 - RNA, 20 nt, Human
gaaccaaagcgaauuuuaaa

SEQ ID NO: 1193190 - RNA, 23 nt, Human
gaaccaaagcgaauuuuaaaaga

SEQ ID NO: 1193191 - RNA, 21 nt, Human
gaaauuuccugggagcuuuug

SEQ ID NO: 1193192 - RNA, 14 nt, Human
gaaauaaacgucuu

SEQ ID NO: 1193193 - RNA, 16 nt, Human
gaaauaaacgucuuaa

SEQ ID NO: 1193194 - RNA, 17 nt, Human
gaaauaaacgucuuaaa

SEQ ID NO: 1193195 - RNA, 18 nt, Human
gaaauaaacgucuuaaau

SEQ ID NO: 1193196 - RNA, 21 nt, Human
gaaauaaacgucuuaaauauu

SEQ ID NO: 1193197 - RNA, 12 nt, Human
cuuuggacuugu

SEQ ID NO: 1193198 - RNA, 16 nt, Human
cuuuucuuucuaccaa

SEQ ID NO: 1193199 - RNA, 13 nt, Human
cuuucuuccaaac

SEQ ID NO: 1193200 - RNA, 19 nt, Human
cuuucuuccaaacaggcuc

SEQ ID NO: 1193201 - RNA, 22 nt, Human
cuuucuuccaaacaggcucaga

SEQ ID NO: 1193202 - RNA, 21 nt, Human
cuuuccacuccuccuagccac

SEQ ID NO: 1193203 - RNA, 23 nt, Human
cuuuccaaagccaaugugaacag

SEQ ID NO: 1193204 - RNA, 18 nt, Human
cuuuccacuccuccuagc

SEQ ID NO: 1193205 - RNA, 23 nt, Human
cuugucacgccagacuucccacg

SEQ ID NO: 1193206 - RNA, 20 nt, Human
cuuggggaguuuaggguggg

SEQ ID NO: 1193207 - RNA, 21 nt, Human
cuuggggaguuuagggugggg

SEQ ID NO: 1193208 - RNA, 13 nt, Human
cuuggagccugca

SEQ ID NO: 1193209 - RNA, 15 nt, Human
cuuggagccugcaga

SEQ ID NO: 1193210 - RNA, 16 nt, Human
cuuggagccugcagag

SEQ ID NO: 1193211 - RNA, 17 nt, Human
cuuggagccugcagagc

SEQ ID NO: 1193212 - RNA, 18 nt, Human
cuuggagccugcagagcu

SEQ ID NO: 1193213 - RNA, 19 nt, Human
cuuggagccugcagagcug

SEQ ID NO: 1193214 - RNA, 20 nt, Human
cuuggagccugcagagcugc

SEQ ID NO: 1193215 - RNA, 17 nt, Human
cuugaacugagcuugga

SEQ ID NO: 1193216 - RNA, 19 nt, Human
cuugaacugagcuuggaag

SEQ ID NO: 1193217 - RNA, 14 nt, Human
cuguaccucugccu

SEQ ID NO: 1193218 - RNA, 12 nt, Human
cuggucagccca

SEQ ID NO: 1193219 - RNA, 13 nt, Human
cuggucagcccaa

SEQ ID NO: 1193220 - RNA, 19 nt, Human
cugggaggagggcaggcau

SEQ ID NO: 1193221 - RNA, 16 nt, Human
cugggagccuacccac

SEQ ID NO: 1193222 - RNA, 19 nt, Human
cugggagccuacccacccc

SEQ ID NO: 1193223 - RNA, 22 nt, Human
cugggagccuacccacccccag

SEQ ID NO: 1193224 - RNA, 18 nt, Human
cuggcuguggccuaaccu

SEQ ID NO: 1193225 - RNA, 23 nt, Human
cuggcacagccuggcuguggccu

SEQ ID NO: 1193226 - RNA, 16 nt, Human
cuggcacagccuggcu

SEQ ID NO: 1193227 - RNA, 21 nt, Human
cuggcacagccuggcuguggc

SEQ ID NO: 1193228 - RNA, 11 nt, Human
cugccaggaga

SEQ ID NO: 1193229 - RNA, 17 nt, Human
cugccagacccccugga

SEQ ID NO: 1193230 - RNA, 19 nt, Human
cugccagacccccuggaga

SEQ ID NO: 1193231 - RNA, 19 nt, Human
cugcccgggagcucaggaa

SEQ ID NO: 1193232 - RNA, 15 nt, Human
cugcucugugcccac

SEQ ID NO: 1193233 - RNA, 23 nt, Human
cucuuggggaguuuagggugggg

SEQ ID NO: 1193234 - RNA, 13 nt, Human
cugaaauuuccug

SEQ ID NO: 1193235 - RNA, 23 nt, Human
cugaaauuuccugggagcuuuug

SEQ ID NO: 1193236 - RNA, 16 nt, Human
cugaaauuuccuggga

SEQ ID NO: 1193237 - RNA, 21 nt, Human
cugaaauaaacgucuuaaaua

SEQ ID NO: 1193238 - RNA, 22 nt, Human
cucugugcccacccuccacucu

SEQ ID NO: 1193239 - RNA, 14 nt, Human
cugaggcagguccc

SEQ ID NO: 1193240 - RNA, 17 nt, Human
cugaggcagguccccag

SEQ ID NO: 1193241 - RNA, 18 nt, Human
cugaggcagguccccaga

SEQ ID NO: 1193242 - RNA, 19 nt, Human
cugaggcagguccccagac

SEQ ID NO: 1193243 - RNA, 15 nt, Human
cucuccugucucccu

SEQ ID NO: 1193244 - RNA, 17 nt, Human
cucuccugucucccucc

SEQ ID NO: 1193245 - RNA, 18 nt, Human
cucuccugucucccuccu

SEQ ID NO: 1193246 - RNA, 22 nt, Human
cucuccacucaugugacucuuu

SEQ ID NO: 1193247 - RNA, 21 nt, Human
cucuccacucaugugacucuu

SEQ ID NO: 1193248 - RNA, 18 nt, Human
cucuacugggagccuacc

SEQ ID NO: 1193249 - RNA, 21 nt, Human
cucuacugggagccuacccac

SEQ ID NO: 1193250 - RNA, 17 nt, Human
cuccucgagaucccaac

SEQ ID NO: 1193251 - RNA, 21 nt, Human
cuccucgagaucccaacacug

SEQ ID NO: 1193252 - RNA, 24 nt, Human
cuccucgagaucccaacacugcca

SEQ ID NO: 1193253 - RNA, 23 nt, Human
cuccauccuacccccugugccuu

SEQ ID NO: 1193254 - RNA, 20 nt, Human
cuccauccuacccccugugc

SEQ ID NO: 1193255 - RNA, 22 nt, Human
cuccauccuacccccugugccu

SEQ ID NO: 1193256 - RNA, 18 nt, Human
cuccauccuacccccugu

SEQ ID NO: 1193257 - RNA, 14 nt, Human
cuacccccugugcc

SEQ ID NO: 1193258 - RNA, 22 nt, Human
cuacuuauuguagcauccugga

SEQ ID NO: 1193259 - RNA, 20 nt, Human
cuaucuguuuacaguguucc

SEQ ID NO: 1193260 - RNA, 21 nt, Human
cuaucuguuuacaguguuccg

SEQ ID NO: 1193261 - RNA, 22 nt, Human
cuaggacugaauuaugaaacuu

SEQ ID NO: 1193262 - RNA, 16 nt, Human
cguuguccucagcccc

SEQ ID NO: 1193263 - RNA, 23 nt, Human
cguggcuguggcauccagagucc

SEQ ID NO: 1193264 - RNA, 22 nt, Human
cgggucaucuguaccucugccu

SEQ ID NO: 1193265 - RNA, 15 nt, Human
cgggucaucuguacc

SEQ ID NO: 1193266 - RNA, 17 nt, Human
cgggggcagucugagag

SEQ ID NO: 1193267 - RNA, 18 nt, Human
cgggggcagucugagaga

SEQ ID NO: 1193268 - RNA, 21 nt, Human
cgggggcagucugagagaggc

SEQ ID NO: 1193269 - RNA, 17 nt, Human
cggggccugggcaggag

SEQ ID NO: 1193270 - RNA, 19 nt, Human
cggggccugggcaggaggg

SEQ ID NO: 1193271 - RNA, 12 nt, Human
cggcugggagga

SEQ ID NO: 1193272 - RNA, 17 nt, Human
cgggagccugacccuca

SEQ ID NO: 1193273 - RNA, 18 nt, Human
cggcugggaggagggcag

SEQ ID NO: 1193274 - RNA, 15 nt, Human
cggcuggacuuggag

SEQ ID NO: 1193275 - RNA, 20 nt, Human
caguggcuggaucugugagg

SEQ ID NO: 1193276 - RNA, 18 nt, Human
caguggcuggaucuguga

SEQ ID NO: 1193277 - RNA, 16 nt, Human
caguggcuggaucugu

SEQ ID NO: 1193278 - RNA, 11 nt, Human
cagugguuaag

SEQ ID NO: 1193279 - RNA, 17 nt, Human
cagugucuggcugcaga

SEQ ID NO: 1193280 - RNA, 19 nt, Human
cagugucuggcugcagagc

SEQ ID NO: 1193281 - RNA, 16 nt, Human
caguucucuucacuca

SEQ ID NO: 1193282 - RNA, 18 nt, Human
caguguuccgugguuaaa

SEQ ID NO: 1193283 - RNA, 18 nt, Human
cauaaucacaacccuuca

SEQ ID NO: 1193284 - RNA, 19 nt, Human
cauaaauuuaguauuuugu

SEQ ID NO: 1193285 - RNA, 20 nt, Human
cauaaauuuaguauuuuguu

SEQ ID NO: 1193286 - RNA, 15 nt, Human
cauaccuggcccugu

SEQ ID NO: 1193287 - RNA, 12 nt, Human
cauauuuucaug

SEQ ID NO: 1193288 - RNA, 22 nt, Human
cauuaccucagugagaagccag

SEQ ID NO: 1193289 - RNA, 21 nt, Human
cauuaccucagugagaagcca

SEQ ID NO: 1193290 - RNA, 20 nt, Human
cauggugacuuuugaaaaga

SEQ ID NO: 1193291 - RNA, 19 nt, Human
cauggggcugauuguauuu

SEQ ID NO: 1193292 - RNA, 21 nt, Human
cauggagauagccccacagga

SEQ ID NO: 1193293 - RNA, 16 nt, Human
ccaagagccugagagu

SEQ ID NO: 1193294 - RNA, 12 nt, Human
ccaagaggcugc

SEQ ID NO: 1193295 - RNA, 13 nt, Human
ccaagaggcugca

SEQ ID NO: 1193296 - RNA, 14 nt, Human
ccaagaggcugcag

SEQ ID NO: 1193297 - RNA, 12 nt, Human
ccaagagccuga

SEQ ID NO: 1193298 - RNA, 22 nt, Human
ccaucauguuuacagaggacag

SEQ ID NO: 1193299 - RNA, 20 nt, Human
ccaucauguuuacagaggac

SEQ ID NO: 1193300 - RNA, 21 nt, Human
cccagcuaugguucucucgca

SEQ ID NO: 1193301 - RNA, 16 nt, Human
cccaggaccccugagu

SEQ ID NO: 1193302 - RNA, 17 nt, Human
ccuccauccuacccccu

SEQ ID NO: 1193303 - RNA, 22 nt, Human
ccuccauccuacccccugugcc

SEQ ID NO: 1193304 - RNA, 23 nt, Human
ccuccauccuacccccugugccu

SEQ ID NO: 1193305 - RNA, 13 nt, Human
ccuccacucuccu

SEQ ID NO: 1193306 - RNA, 14 nt, Human
ccucuacugggagc

SEQ ID NO: 1193307 - RNA, 18 nt, Human
ccucagccccgcguggaa

SEQ ID NO: 1193308 - RNA, 14 nt, Human
ccucacacucaccc

SEQ ID NO: 1193309 - RNA, 22 nt, Human
ccuaucuguuuacaguguuccg

SEQ ID NO: 1193310 - RNA, 13 nt, Human
ccgggagcucagg

SEQ ID NO: 1193311 - RNA, 15 nt, Human
ccgggagcucaggaa

SEQ ID NO: 1193312 - RNA, 15 nt, Human
ccggggccugggcag

SEQ ID NO: 1193313 - RNA, 19 nt, Human
ccggggccugggcaggagg

SEQ ID NO: 1193314 - RNA, 17 nt, Human
ccggcuuuguggcacug

SEQ ID NO: 1193315 - RNA, 19 nt, Human
ccggcuuuguggcacuggg

SEQ ID NO: 1193316 - RNA, 13 nt, Human
cccuggugguuca

SEQ ID NO: 1193317 - RNA, 15 nt, Human
ccuacagcccaccug

SEQ ID NO: 1193318 - RNA, 20 nt, Human
cccugccaucauguuuacag

SEQ ID NO: 1193319 - RNA, 17 nt, Human
cccucuacugggagccu

SEQ ID NO: 1193320 - RNA, 20 nt, Human
cccucuacugggagccuacc

SEQ ID NO: 1193321 - RNA, 12 nt, Human
cccugccuggac

SEQ ID NO: 1193322 - RNA, 13 nt, Human
cccugccuggacc

SEQ ID NO: 1193323 - RNA, 18 nt, Human
cccugccuggaccagccu

SEQ ID NO: 1193324 - RNA, 14 nt, Human
cccucaucuuucuu

SEQ ID NO: 1193325 - RNA, 19 nt, Human
cccucauuggcucuugaac

SEQ ID NO: 1193326 - RNA, 23 nt, Human
cccucccucuacugggagccuac

SEQ ID NO: 1193327 - RNA, 23 nt, Human
ccccacaggagguggucugggac

SEQ ID NO: 1193328 - RNA, 16 nt, Human
caccccgacuuuuguu

SEQ ID NO: 1193329 - RNA, 16 nt, Human
caccagaagcccagaa

SEQ ID NO: 1193330 - RNA, 17 nt, Human
caccagaagcccagaau

SEQ ID NO: 1193331 - RNA, 13 nt, Human
caccagaagccca

SEQ ID NO: 1193332 - RNA, 14 nt, Human
caccagaagcccag

SEQ ID NO: 1193333 - RNA, 15 nt, Human
caccagaagcccaga

SEQ ID NO: 1193334 - RNA, 22 nt, Human
caccaagccuggucagcccaaa

SEQ ID NO: 1193335 - RNA, 17 nt, Human
cacauuggaaacaaguc

SEQ ID NO: 1193336 - RNA, 19 nt, Human
caccaagccuggucagccc

SEQ ID NO: 1193337 - RNA, 20 nt, Human
caccaagccuggucagccca

SEQ ID NO: 1193338 - RNA, 21 nt, Human
caccaagccuggucagcccaa

SEQ ID NO: 1193339 - RNA, 22 nt, Human
cacauggugacuuuugaaaaga

SEQ ID NO: 1193340 - RNA, 16 nt, Human
cacauuccugaacagg

SEQ ID NO: 1193341 - RNA, 21 nt, Human
caacucugaaggguaauuaua

SEQ ID NO: 1193342 - RNA, 20 nt, Human
caaauacgugggcauucaaa

SEQ ID NO: 1193343 - RNA, 16 nt, Human
aguggcuggaucugug

SEQ ID NO: 1193344 - RNA, 18 nt, Human
aguucauaaauuuauggu

SEQ ID NO: 1193345 - RNA, 16 nt, Human
aguuguguuugaagca

SEQ ID NO: 1193346 - RNA, 14 nt, Human
auagguuuggacaa

SEQ ID NO: 1193347 - RNA, 18 nt, Human
auagguuuggacaaaaug

SEQ ID NO: 1193348 - RNA, 14 nt, Human
aucagccugugcca

SEQ ID NO: 1193349 - RNA, 19 nt, Human
augagcuccuuaaggcucu

SEQ ID NO: 1193350 - RNA, 17 nt, Human
aucuauauuuuacauaa

SEQ ID NO: 1193351 - RNA, 21 nt, Human
aucuauauuuuacauaaauuu

SEQ ID NO: 1193352 - RNA, 16 nt, Human
auggcuguggagugug

SEQ ID NO: 1193353 - RNA, 21 nt, Human
augugaacaguuguguuugaa

SEQ ID NO: 1193354 - RNA, 23 nt, Human
augugaacaguuguguuugaagc

SEQ ID NO: 1193355 - RNA, 20 nt, Human
agaggacaguauuugugggg

SEQ ID NO: 1193356 - RNA, 17 nt, Human
agagggaugcauggaga

SEQ ID NO: 1193357 - RNA, 14 nt, Human
agccgggagccuga

SEQ ID NO: 1193358 - RNA, 18 nt, Human
agcagugggccuggccag

SEQ ID NO: 1193359 - RNA, 21 nt, Human
aggagucccugccaucauguu

SEQ ID NO: 1193360 - RNA, 14 nt, Human
agcugcuccccacg

SEQ ID NO: 1193361 - RNA, 17 nt, Human
agcugcuccccacguca

SEQ ID NO: 1193362 - RNA, 21 nt, Human
agcuucuggugaccuuccaag

SEQ ID NO: 1193363 - RNA, 22 nt, Human
agcuucuggugaccuuccaaga

SEQ ID NO: 1193364 - RNA, 14 nt, Human
agcugagcaggugu

SEQ ID NO: 1193365 - RNA, 22 nt, Human
agcuccuuaaggcucuuuugua

SEQ ID NO: 1193366 - RNA, 17 nt, Human
agguggaauuauuuuaa

SEQ ID NO: 1193367 - RNA, 21 nt, Human
agguggaauuauuuuaaaaga

SEQ ID NO: 1193368 - RNA, 13 nt, Human
acccccugugccu

SEQ ID NO: 1193369 - RNA, 11 nt, Human
acacugccagc

SEQ ID NO: 1193370 - RNA, 16 nt, Human
accugccgagagucca

SEQ ID NO: 1193371 - RNA, 23 nt, Human
accugccgagaguccaucagccu

SEQ ID NO: 1193372 - RNA, 14 nt, Human
acggaacucaaaua

SEQ ID NO: 1193373 - RNA, 15 nt, Human
acucauauuuucaug

SEQ ID NO: 1193374 - RNA, 16 nt, Human
acucaggcccaaagcc

SEQ ID NO: 1193375 - RNA, 17 nt, Human
acucagcccucauuggc

SEQ ID NO: 1193376 - RNA, 21 nt, Human
acucagcccucauuggcucuu

SEQ ID NO: 1193377 - RNA, 12 nt, Human
acugccagcauu

SEQ ID NO: 1193378 - RNA, 14 nt, Human
acuuuuggaaggua

SEQ ID NO: 1193379 - RNA, 15 nt, Human
aaugucaguaugugg

SEQ ID NO: 1193380 - RNA, 13 nt, Human
aaugucaguaugu

SEQ ID NO: 1193381 - RNA, 13 nt, Human
aauacucuuauau

SEQ ID NO: 1193382 - RNA, 13 nt, Human
aagggagggggag

SEQ ID NO: 1193383 - RNA, 13 nt, Human
aagauacugaaau

SEQ ID NO: 1193384 - RNA, 14 nt, Human
aagauacugaaaua

SEQ ID NO: 1193385 - RNA, 21 nt, Human
aagcugugugcucuccaagcc

SEQ ID NO: 1193386 - RNA, 13 nt, Human
aaauucuuucauu

SEQ ID NO: 1193387 - RNA, 18 nt, Human
aaccaccagaagcccaga

SEQ ID NO: 1193388 - RNA, 19 nt, Human
aaccaccagaagcccagaa

SEQ ID NO: 1193389 - RNA, 21 nt, Human
aaccgaacugauguaaguaaa

SEQ ID NO: 1193390 - RNA, 13 nt, Human
aaagauaaauauu

SEQ ID NO: 1193391 - RNA, 13 nt, Human
aaaaguugaauuu

SEQ ID NO: 1193392 - RNA, 15 nt, Human
aaagccaaugugaac

SEQ ID NO: 1193393 - RNA, 17 nt, Human
aaagccaaugugaacag

SEQ ID NO: 1193394 - RNA, 17 nt, Human
aaauagcuuuuuucucu

SEQ ID NO: 1193395 - RNA, 20 nt, Human
aaauagcuuuuuucucugau

SEQ ID NO: 1193396 - RNA, 12 nt, Human
auuccagaggaa

SEQ ID NO: 1193397 - RNA, 12 nt, Human
auuuuucucaug

SEQ ID NO: 1193398 - RNA, 16 nt, Human
auuuuguuucagugca

SEQ ID NO: 1193399 - RNA, 15 nt, Human
auuuugcccuugaca

SEQ ID NO: 1193400 - RNA, 23 nt, Human
auuuugcccuugacaaagucaag

SEQ ID NO: 1193401 - RNA, 19 nt, Human
auuuguaaauuuaugugau

SEQ ID NO: 1193402 - RNA, 18 nt, Human
auuuguaaauuuauguga

SEQ ID NO: 1193403 - RNA, 20 nt, Human
auuuuaaaagauaaauauua

SEQ ID NO: 1193404 - RNA, 20 nt, Human
auuuuaaaagaugcaaugua

SEQ ID NO: 1193405 - RNA, 16 nt, Human
auuucccuuccuuccu

SEQ ID NO: 1193406 - RNA, 20 nt, Human
auuucccuuccuuccucucc

SEQ ID NO: 1193407 - RNA, 18 nt, Human
auuucuaggacugaauua

SEQ ID NO: 1193408 - RNA, 17 nt, Human
auuucccugaaggaacc

SEQ ID NO: 1193409 - RNA, 23 nt, Human
auuucccugaaggaaccaaagcg

SEQ ID NO: 1193410 - RNA, 20 nt, Human
auuucuaggacugaauuaug

SEQ ID NO: 1193411 - RNA, 23 nt, Human
auuucuaggacugaauuaugaaa

SEQ ID NO: 1193412 - RNA, 13 nt, Human
auuggaaacaagu

SEQ ID NO: 1193413 - RNA, 23 nt, Human
auuggguggggggcuucauacac

SEQ ID NO: 1193414 - RNA, 19 nt, Human
auuggauucugagagcugu

SEQ ID NO: 1193415 - RNA, 22 nt, Human
auuggauucugagagcugugca

SEQ ID NO: 1193416 - RNA, 20 nt, Human
auggggauagauguguggac

SEQ ID NO: 1193417 - RNA, 16 nt, Human
augguucucaggccug

SEQ ID NO: 1193418 - RNA, 19 nt, Human
augguguucaaaaaacuug

SEQ ID NO: 1193419 - RNA, 21 nt, Human
augugacucuuuccaaccggc

SEQ ID NO: 1193420 - RNA, 12 nt, Human
augugacucuuu

SEQ ID NO: 1193421 - RNA, 16 nt, Human
augugacucuuuccaa

SEQ ID NO: 1193422 - RNA, 22 nt, Human
auguauuacaguggggaaugaa

SEQ ID NO: 1193423 - RNA, 14 nt, Human
auguaugcuucaua

SEQ ID NO: 1193424 - RNA, 15 nt, Human
auguaugcuucauac

SEQ ID NO: 1193425 - RNA, 16 nt, Human
auguaugcuucauaca

SEQ ID NO: 1193426 - RNA, 19 nt, Human
auguagaggggaaaagaga

SEQ ID NO: 1193427 - RNA, 23 nt, Human
augcuguucaugaaagauucaau

SEQ ID NO: 1193428 - RNA, 19 nt, Human
augcuguucaugaaagauu

SEQ ID NO: 1193429 - RNA, 17 nt, Human
augcuguucaugaaaga

SEQ ID NO: 1193430 - RNA, 22 nt, Human
augcagauuuugcccuugacaa

SEQ ID NO: 1193431 - RNA, 16 nt, Human
aucaggccauuguccc

SEQ ID NO: 1193432 - RNA, 13 nt, Human
aucaggccauugu

SEQ ID NO: 1193433 - RNA, 13 nt, Human
uucuaggacugaa

SEQ ID NO: 1193434 - RNA, 14 nt, Human
uucuaggacugaau

SEQ ID NO: 1193435 - RNA, 16 nt, Human
uucuaggacugaauua

SEQ ID NO: 1193436 - RNA, 23 nt, Human
uucuaggacugaauuaugaaacu

SEQ ID NO: 1193437 - RNA, 15 nt, Human
uuccugaacaggaua

SEQ ID NO: 1193438 - RNA, 14 nt, Human
auccuacccccugu

SEQ ID NO: 1193439 - RNA, 16 nt, Human
auccuacccccugugc

SEQ ID NO: 1193440 - RNA, 19 nt, Human
auccauagcaccuccacau

SEQ ID NO: 1193441 - RNA, 13 nt, Human
uucugccaggaga

SEQ ID NO: 1193442 - RNA, 23 nt, Human
uuggggacaggggcaggaggaag

SEQ ID NO: 1193443 - RNA, 15 nt, Human
augaagauacugaaa

SEQ ID NO: 1193444 - RNA, 15 nt, Human
aucuguuuacagugu

SEQ ID NO: 1193445 - RNA, 17 nt, Human
aucuguuuacaguguuc

SEQ ID NO: 1193446 - RNA, 22 nt, Human
uugauuaagaucucagugguua

SEQ ID NO: 1193447 - RNA, 18 nt, Human
auaaucacaacccuucag

SEQ ID NO: 1193448 - RNA, 17 nt, Human
uuacaguggggaaugaa

SEQ ID NO: 1193449 - RNA, 13 nt, Human
uuacaguguuccg

SEQ ID NO: 1193450 - RNA, 22 nt, Human
uuaagagagucuauuuacggaa

SEQ ID NO: 1193451 - RNA, 16 nt, Human
uuaauuugguuuucac

SEQ ID NO: 1193452 - RNA, 14 nt, Human
auagauguguggac

SEQ ID NO: 1193453 - RNA, 13 nt, Human
auagaugugugga

SEQ ID NO: 1193454 - RNA, 12 nt, Human
auagaugugugg

SEQ ID NO: 1193455 - RNA, 11 nt, Human
auagaugugug

SEQ ID NO: 1193456 - RNA, 19 nt, Human
auagaaggcuauggggaua

SEQ ID NO: 1193457 - RNA, 14 nt, Human
auacucuuauaucu

SEQ ID NO: 1193458 - RNA, 18 nt, Human
auacucuuauaucuauau

SEQ ID NO: 1193459 - RNA, 14 nt, Human
uuaugugugugugu

SEQ ID NO: 1193460 - RNA, 12 nt, Human
uuaugugugugu

SEQ ID NO: 1193461 - RNA, 10 nt, Human
uuaugugugu

SEQ ID NO: 1193462 - RNA, 14 nt, Human
uuaugaaacuuuug

SEQ ID NO: 1193463 - RNA, 17 nt, Human
uuaugaaacuuuuggaa

SEQ ID NO: 1193464 - RNA, 18 nt, Human
uuaugaaacuuuuggaag

SEQ ID NO: 1193465 - RNA, 19 nt, Human
uuaugaaacuuuuggaagg

SEQ ID NO: 1193466 - RNA, 18 nt, Human
auacgugggcauucaaau

SEQ ID NO: 1193467 - RNA, 19 nt, Human
auacgugggcauucaaaug

SEQ ID NO: 1193468 - RNA, 16 nt, Human
auacagggaugguguu

SEQ ID NO: 1193469 - RNA, 18 nt, Human
uguguguuguguguggga

SEQ ID NO: 1193470 - RNA, 16 nt, Human
agugggguagguuggg

SEQ ID NO: 1193471 - RNA, 16 nt, Human
aguggggaaugaagau

SEQ ID NO: 1193472 - RNA, 21 nt, Human
aguggacuguucccugaggug

SEQ ID NO: 1193473 - RNA, 9 nt, Human
aguguguaa

SEQ ID NO: 1193474 - RNA, 16 nt, Human
aguguggcaguuuggc

SEQ ID NO: 1193475 - RNA, 17 nt, Human
aguguggcaguuuggca

SEQ ID NO: 1193476 - RNA, 21 nt, Human
aguguuccgugguuaaacucg

SEQ ID NO: 1193477 - RNA, 18 nt, Human
agugccaggauggaauga

SEQ ID NO: 1193478 - RNA, 17 nt, Human
agugcacuaauguguaa

SEQ ID NO: 1193479 - RNA, 21 nt, Human
agugcacuaauguguaagaca

SEQ ID NO: 1193480 - RNA, 14 nt, Human
agugaggaugucug

SEQ ID NO: 1193481 - RNA, 21 nt, Human
agugauuuuuaugccaccuga

SEQ ID NO: 1193482 - RNA, 16 nt, Human
agugauuuuuaugcca

SEQ ID NO: 1193483 - RNA, 20 nt, Human
agugauuuuuaugccaccug

SEQ ID NO: 1193484 - RNA, 19 nt, Human
ugugcucuccaagcccagu

SEQ ID NO: 1193485 - RNA, 14 nt, Human
ugugcucuccaagc

SEQ ID NO: 1193486 - RNA, 14 nt, Human
aguauuugugggga

SEQ ID NO: 1193487 - RNA, 15 nt, Human
agucuauuuacggaa

SEQ ID NO: 1193488 - RNA, 20 nt, Human
agucuauuuacggaacucaa

SEQ ID NO: 1193489 - RNA, 20 nt, Human
uguagugauuuuuaugccac

SEQ ID NO: 1193490 - RNA, 21 nt, Human
uguagugauuuuuaugccacc

SEQ ID NO: 1193491 - RNA, 14 nt, Human
aggugugcaagaga

SEQ ID NO: 1193492 - RNA, 17 nt, Human
uggcuguggcauccaga

SEQ ID NO: 1193493 - RNA, 20 nt, Human
uggcuguggccuaaccugcc

SEQ ID NO: 1193494 - RNA, 16 nt, Human
uggcuguggagugugg

SEQ ID NO: 1193495 - RNA, 15 nt, Human
uggcugcagagcagu

SEQ ID NO: 1193496 - RNA, 18 nt, Human
uggcugcagagcaguggg

SEQ ID NO: 1193497 - RNA, 22 nt, Human
uggcugcagagcagugggccug

SEQ ID NO: 1193498 - RNA, 16 nt, Human
uggcuaugagggccuu

SEQ ID NO: 1193499 - RNA, 14 nt, Human
ugggcauucaaaug

SEQ ID NO: 1193500 - RNA, 14 nt, Human
uggaaguguggguc

SEQ ID NO: 1193501 - RNA, 13 nt, Human
uggaagugugggu

SEQ ID NO: 1193502 - RNA, 20 nt, Human
uggaagugugggucugugug

SEQ ID NO: 1193503 - RNA, 17 nt, Human
uggacaaaauggaauac

SEQ ID NO: 1193504 - RNA, 14 nt, Human
uggacaaaauggaa

SEQ ID NO: 1193505 - RNA, 16 nt, Human
aggcagguccccagac

SEQ ID NO: 1193506 - RNA, 12 nt, Human
aggcaggucccc

SEQ ID NO: 1193507 - RNA, 13 nt, Human
aggcaggucccca

SEQ ID NO: 1193508 - RNA, 14 nt, Human
aggcagguccccag

SEQ ID NO: 1193509 - RNA, 15 nt, Human
aggcagguccccaga

SEQ ID NO: 1193510 - RNA, 11 nt, Human
aggcagguccc

SEQ ID NO: 1193511 - RNA, 11 nt, Human
uggagccugca

SEQ ID NO: 1193512 - RNA, 16 nt, Human
uggagccugcagagcu

SEQ ID NO: 1193513 - RNA, 18 nt, Human
aggcucagaggguguccu

SEQ ID NO: 1193514 - RNA, 19 nt, Human
aggcucagaggguguccug

SEQ ID NO: 1193515 - RNA, 20 nt, Human
aggcucagaggguguccugc

SEQ ID NO: 1193516 - RNA, 18 nt, Human
aggcgaagcguuguccuc

SEQ ID NO: 1193517 - RNA, 16 nt, Human
aggccugacucucagc

SEQ ID NO: 1193518 - RNA, 20 nt, Human
uggcauccagagucccugcc

SEQ ID NO: 1193519 - RNA, 21 nt, Human
uggcauccagagucccugccu

SEQ ID NO: 1193520 - RNA, 22 nt, Human
uggcauccagagucccugccug

SEQ ID NO: 1193521 - RNA, 14 nt, Human
aggccauucuuucc

SEQ ID NO: 1193522 - RNA, 15 nt, Human
aggccauucuuuccc

SEQ ID NO: 1193523 - RNA, 22 nt, Human
uggcacagccuggcuguggccu

SEQ ID NO: 1193524 - RNA, 15 nt, Human
agcuggggaugucuc

SEQ ID NO: 1193525 - RNA, 19 nt, Human
ugccuugugaaggaauuau

SEQ ID NO: 1193526 - RNA, 19 nt, Human
ugcucugugcccacccucc

SEQ ID NO: 1193527 - RNA, 19 nt, Human
agccugacccucaucuuuc

SEQ ID NO: 1193528 - RNA, 18 nt, Human
agccugccacucaggccc

SEQ ID NO: 1193529 - RNA, 12 nt, Human
agccugcagagc

SEQ ID NO: 1193530 - RNA, 13 nt, Human
agccugcagagcu

SEQ ID NO: 1193531 - RNA, 14 nt, Human
agccugcagagcug

SEQ ID NO: 1193532 - RNA, 15 nt, Human
agccugcagagcugc

SEQ ID NO: 1193533 - RNA, 20 nt, Human
agcggcuggaauuggguggg

SEQ ID NO: 1193534 - RNA, 17 nt, Human
agcggcuggacuuggag

SEQ ID NO: 1193535 - RNA, 11 nt, Human
ucuggcccuau

SEQ ID NO: 1193536 - RNA, 16 nt, Human
ucugauacagaaaagu

SEQ ID NO: 1193537 - RNA, 17 nt, Human
ucugauacagaaaaguu

SEQ ID NO: 1193538 - RNA, 22 nt, Human
acuuguuuuauuuaaccucuaa

SEQ ID NO: 1193539 - RNA, 15 nt, Human
ucuuggagccugcag

SEQ ID NO: 1193540 - RNA, 18 nt, Human
ucuuggagccugcagagc

SEQ ID NO: 1193541 - RNA, 19 nt, Human
ucuuggagccugcagagcu

SEQ ID NO: 1193542 - RNA, 12 nt, Human
ucuuggagccug

SEQ ID NO: 1193543 - RNA, 13 nt, Human
ucuuggagccugc

SEQ ID NO: 1193544 - RNA, 14 nt, Human
ucuuggagccugca

SEQ ID NO: 1193545 - RNA, 17 nt, Human
agaauuugauaugugaa

SEQ ID NO: 1193546 - RNA, 18 nt, Human
agaauuugauaugugaac

SEQ ID NO: 1193547 - RNA, 19 nt, Human
agaauuugauaugugaaca

SEQ ID NO: 1193548 - RNA, 20 nt, Human
agaauuugauaugugaacag

SEQ ID NO: 1193549 - RNA, 21 nt, Human
agaauuugauaugugaacagu

SEQ ID NO: 1193550 - RNA, 13 nt, Human
agaauuucuagga

SEQ ID NO: 1193551 - RNA, 21 nt, Human
agaauuucuaggacugaauua

SEQ ID NO: 1193552 - RNA, 20 nt, Human
agaauugucuuucugucucu

SEQ ID NO: 1193553 - RNA, 22 nt, Human
agagggacuguucuuuuguccc

SEQ ID NO: 1193554 - RNA, 18 nt, Human
agagucuauuuacggaac

SEQ ID NO: 1193555 - RNA, 23 nt, Human
agauuauauauauuuuuuucuga

SEQ ID NO: 1193556 - RNA, 21 nt, Human
agauucaaugccccugaauuu

SEQ ID NO: 1193557 - RNA, 22 nt, Human
agauucaaugccccugaauuua

SEQ ID NO: 1193558 - RNA, 17 nt, Human
ugacagguuugggaccc

SEQ ID NO: 1193559 - RNA, 22 nt, Human
ugagggugacuauggagcugag

SEQ ID NO: 1193560 - RNA, 17 nt, Human
ugaggaagagggacugu

SEQ ID NO: 1193561 - RNA, 15 nt, Human
agcacagugaucaag

SEQ ID NO: 1193562 - RNA, 16 nt, Human
acuggggcaggggccg

SEQ ID NO: 1193563 - RNA, 14 nt, Human
acuggggcaggggc

SEQ ID NO: 1193564 - RNA, 12 nt, Human
acugggagccua

SEQ ID NO: 1193565 - RNA, 23 nt, Human
acugggagccuacccacccccag

SEQ ID NO: 1193566 - RNA, 23 nt, Human
ucgagaucccaacacugccagca

SEQ ID NO: 1193567 - RNA, 12 nt, Human
ucgacacagagu

SEQ ID NO: 1193568 - RNA, 20 nt, Human
uccugcaccggggccugggc

SEQ ID NO: 1193569 - RNA, 21 nt, Human
uccugcaccggggccugggca

SEQ ID NO: 1193570 - RNA, 12 nt, Human
acugagcuugga

SEQ ID NO: 1193571 - RNA, 13 nt, Human
acugagcuuggaa

SEQ ID NO: 1193572 - RNA, 16 nt, Human
acugagcuuggaagcu

SEQ ID NO: 1193573 - RNA, 17 nt, Human
acugagcuuggaagcuu

SEQ ID NO: 1193574 - RNA, 21 nt, Human
acucuggagguuuguuuagaa

SEQ ID NO: 1193575 - RNA, 23 nt, Human
acucuuauaucuauauuuuacau

SEQ ID NO: 1193576 - RNA, 11 nt, Human
uccucagcccc

SEQ ID NO: 1193577 - RNA, 15 nt, Human
acucaugugacucuu

SEQ ID NO: 1193578 - RNA, 16 nt, Human
acucaugugacucuuu

SEQ ID NO: 1193579 - RNA, 17 nt, Human
acucaugugacucuuuc

SEQ ID NO: 1193580 - RNA, 18 nt, Human
acucaugugacucuuucc

SEQ ID NO: 1193581 - RNA, 22 nt, Human
ucaugauagaaggcuaugggga

SEQ ID NO: 1193582 - RNA, 18 nt, Human
accucuaaauucuuucau

SEQ ID NO: 1193583 - RNA, 21 nt, Human
ucauuggauucugagagcugu

SEQ ID NO: 1193584 - RNA, 21 nt, Human
accucuaaauucuuucauuuu

SEQ ID NO: 1193585 - RNA, 16 nt, Human
accgccuccuacagcc

SEQ ID NO: 1193586 - RNA, 18 nt, Human
accugaauaaagaaugaa

SEQ ID NO: 1193587 - RNA, 20 nt, Human
ucauuuuagggguagcauuu

SEQ ID NO: 1193588 - RNA, 18 nt, Human
uccaccaagccuggucag

SEQ ID NO: 1193589 - RNA, 22 nt, Human
uccaccaagccuggucagccca

SEQ ID NO: 1193590 - RNA, 23 nt, Human
uccaccaagccuggucagcccaa

SEQ ID NO: 1193591 - RNA, 11 nt, Human
uccagccugcc

SEQ ID NO: 1193592 - RNA, 17 nt, Human
accuuccaagagccuga

SEQ ID NO: 1193593 - RNA, 15 nt, Human
ucaggccgaaggagg

SEQ ID NO: 1193594 - RNA, 14 nt, Human
ucaggcccaaagcc

SEQ ID NO: 1193595 - RNA, 18 nt, Human
ucaggaaccgaggcaggg

SEQ ID NO: 1193596 - RNA, 15 nt, Human
acccuccacucuccu

SEQ ID NO: 1193597 - RNA, 22 nt, Human
acccagcuaugguucucucgca

SEQ ID NO: 1193598 - RNA, 16 nt, Human
ucagccccgcguggaa

SEQ ID NO: 1193599 - RNA, 16 nt, Human
acccccaggaccccug

SEQ ID NO: 1193600 - RNA, 22 nt, Human
accccuggcuccaggccagggg

SEQ ID NO: 1193601 - RNA, 19 nt, Human
accccuggcuccaggccag

SEQ ID NO: 1193602 - RNA, 20 nt, Human
accccuggcuccaggccagg

SEQ ID NO: 1193603 - RNA, 20 nt, Human
accagagaaaaagggagggg

SEQ ID NO: 1193604 - RNA, 22 nt, Human
uauguguguguguugugugugg

SEQ ID NO: 1193605 - RNA, 14 nt, Human
uauguguguguguu

SEQ ID NO: 1193606 - RNA, 11 nt, Human
uaugugugugu

SEQ ID NO: 1193607 - RNA, 23 nt, Human
uauguguguguguuguguguggg

SEQ ID NO: 1193608 - RNA, 23 nt, Human
uauuacaguggggaaugaagaua

SEQ ID NO: 1193609 - RNA, 11 nt, Human
acaguguuccg

SEQ ID NO: 1193610 - RNA, 14 nt, Human
uauuuaauagguuu

SEQ ID NO: 1193611 - RNA, 17 nt, Human
uauuuaaccucuaaauu

SEQ ID NO: 1193612 - RNA, 18 nt, Human
uauuuaaccucuaaauuc

SEQ ID NO: 1193613 - RNA, 17 nt, Human
uauuguagcauccugga

SEQ ID NO: 1193614 - RNA, 18 nt, Human
uauuguagcauccuggaa

SEQ ID NO: 1193615 - RNA, 20 nt, Human
uauuguagcauccuggaaua

SEQ ID NO: 1193616 - RNA, 21 nt, Human
uauuguagcauccuggaauau

SEQ ID NO: 1193617 - RNA, 21 nt, Human
acagacacucccacuuggcau

SEQ ID NO: 1193618 - RNA, 22 nt, Human
acagaguggacuguucccugag

SEQ ID NO: 1193619 - RNA, 18 nt, Human
uauggggauagaugugug

SEQ ID NO: 1193620 - RNA, 17 nt, Human
uauggggauagaugugu

SEQ ID NO: 1193621 - RNA, 19 nt, Human
uauggggauagaugugugg

SEQ ID NO: 1193622 - RNA, 12 nt, Human
acagccuggcug

SEQ ID NO: 1193623 - RNA, 15 nt, Human
acagcuccaagaauu

SEQ ID NO: 1193624 - RNA, 13 nt, Human
acagcccaccugg

SEQ ID NO: 1193625 - RNA, 20 nt, Human
acaccuaggcuagggugggg

SEQ ID NO: 1193626 - RNA, 23 nt, Human
acaccuaggcuaggguggggaga

SEQ ID NO: 1193627 - RNA, 21 nt, Human
uauauauuuuuuucugaaauu

SEQ ID NO: 1193628 - RNA, 22 nt, Human
uauauauuuuuuucugaaauuu

SEQ ID NO: 1193629 - RNA, 23 nt, Human
uauauauuuuuuucugaaauuuc

SEQ ID NO: 1193630 - RNA, 13 nt, Human
uaguucugccagg

SEQ ID NO: 1193631 - RNA, 14 nt, Human
uaguucugccagga

SEQ ID NO: 1193632 - RNA, 22 nt, Human
aauucuuugaccuguugggagu

SEQ ID NO: 1193633 - RNA, 18 nt, Human
aauucuuugaccuguugg

SEQ ID NO: 1193634 - RNA, 14 nt, Human
aauucuuucauuuu

SEQ ID NO: 1193635 - RNA, 20 nt, Human
uacucuuauaucuauauuuu

SEQ ID NO: 1193636 - RNA, 22 nt, Human
uacucuuauaucuauauuuuac

SEQ ID NO: 1193637 - RNA, 14 nt, Human
aauuuaugugaugg

SEQ ID NO: 1193638 - RNA, 19 nt, Human
aauuugauaugugaacagu

SEQ ID NO: 1193639 - RNA, 15 nt, Human
aauuugauaugugaa

SEQ ID NO: 1193640 - RNA, 16 nt, Human
aauuugauaugugaac

SEQ ID NO: 1193641 - RNA, 18 nt, Human
aauuugauaugugaacag

SEQ ID NO: 1193642 - RNA, 15 nt, Human
aauuuaaauagcuuu

SEQ ID NO: 1193643 - RNA, 16 nt, Human
aauuuaaauagcuuuu

SEQ ID NO: 1193644 - RNA, 19 nt, Human
uagcauuuguguugaagag

SEQ ID NO: 1193645 - RNA, 19 nt, Human
uagaauuugauaugugaac

SEQ ID NO: 1193646 - RNA, 23 nt, Human
uagaagucacauuccugaacagg

SEQ ID NO: 1193647 - RNA, 19 nt, Human
uaccagagaaaaagggagg

SEQ ID NO: 1193648 - RNA, 19 nt, Human
aaugugaacagcggcugga

SEQ ID NO: 1193649 - RNA, 15 nt, Human
aauguaugcuucaua

SEQ ID NO: 1193650 - RNA, 16 nt, Human
aauguaugcuucauac

SEQ ID NO: 1193651 - RNA, 17 nt, Human
aauguaugcuucauaca

SEQ ID NO: 1193652 - RNA, 12 nt, Human
aauguagagggg

SEQ ID NO: 1193653 - RNA, 20 nt, Human
uacaguggggaaugaagaua

SEQ ID NO: 1193654 - RNA, 16 nt, Human
guguuuaugugugugu

SEQ ID NO: 1193655 - RNA, 12 nt, Human
guguuuaugugu

SEQ ID NO: 1193656 - RNA, 13 nt, Human
guugaauuuuaca

SEQ ID NO: 1193657 - RNA, 21 nt, Human
guugggagaaugucaguaugu

SEQ ID NO: 1193658 - RNA, 14 nt, Human
guugggagaauguc

SEQ ID NO: 1193659 - RNA, 20 nt, Human
aagucacauuccugaacagg

SEQ ID NO: 1193660 - RNA, 17 nt, Human
aauaagugccaggaugg

SEQ ID NO: 1193661 - RNA, 12 nt, Human
uaaauagcuuuu

SEQ ID NO: 1193662 - RNA, 13 nt, Human
uaaacgucuuaaa

SEQ ID NO: 1193663 - RNA, 17 nt, Human
uaaacgucuuaaauauu

SEQ ID NO: 1193664 - RNA, 17 nt, Human
guguguguugugugugg

SEQ ID NO: 1193665 - RNA, 14 nt, Human
guguguguaugugg

SEQ ID NO: 1193666 - RNA, 13 nt, Human
guguguguaugug

SEQ ID NO: 1193667 - RNA, 20 nt, Human
gugguucacucuuggagccu

SEQ ID NO: 1193668 - RNA, 21 nt, Human
gugguucacucuuggagccug

SEQ ID NO: 1193669 - RNA, 15 nt, Human
aagaugcaauguaga

SEQ ID NO: 1193670 - RNA, 16 nt, Human
gugggggucugugugu

SEQ ID NO: 1193671 - RNA, 15 nt, Human
gugggggucugugug

SEQ ID NO: 1193672 - RNA, 14 nt, Human
gugggggucugugu

SEQ ID NO: 1193673 - RNA, 14 nt, Human
gugguggcucggga

SEQ ID NO: 1193674 - RNA, 20 nt, Human
aagagaugaugaaaauauuu

SEQ ID NO: 1193675 - RNA, 17 nt, Human
guggcacuggggcaggg

SEQ ID NO: 1193676 - RNA, 18 nt, Human
guggcacuggggcagggg

SEQ ID NO: 1193677 - RNA, 11 nt, Human
aagaauauuug

SEQ ID NO: 1193678 - RNA, 15 nt, Human
aagaauauuugaaug

SEQ ID NO: 1193679 - RNA, 16 nt, Human
aagacaaaaagcuacu

SEQ ID NO: 1193680 - RNA, 14 nt, Human
guggaagagggcug

SEQ ID NO: 1193681 - RNA, 17 nt, Human
guggaagagggcugcaa

SEQ ID NO: 1193682 - RNA, 20 nt, Human
guggaauuauuuuaaaagau

SEQ ID NO: 1193683 - RNA, 20 nt, Human
gugcacuaauguguaagaca

SEQ ID NO: 1193684 - RNA, 22 nt, Human
gugcacuaauguguaagacaaa

SEQ ID NO: 1193685 - RNA, 15 nt, Human
guccugcaccggggc

SEQ ID NO: 1193686 - RNA, 19 nt, Human
guccugcaccggggccugg

SEQ ID NO: 1193687 - RNA, 20 nt, Human
guccugcaccggggccuggg

SEQ ID NO: 1193688 - RNA, 15 nt, Human
guagagccagagguc

SEQ ID NO: 1193689 - RNA, 20 nt, Human
guaauuuaaaauugugaugu

SEQ ID NO: 1193690 - RNA, 19 nt, Human
guaauuuaaaauugugaug

SEQ ID NO: 1193691 - RNA, 23 nt, Human
guaauuuaaaauugugauguguc

SEQ ID NO: 1193692 - RNA, 22 nt, Human
ggugcuucuaguucugccagga

SEQ ID NO: 1193693 - RNA, 15 nt, Human
gguggaauuauuuua

SEQ ID NO: 1193694 - RNA, 14 nt, Human
ggguggggagagac

SEQ ID NO: 1193695 - RNA, 18 nt, Human
ggguggggagagacgggc

SEQ ID NO: 1193696 - RNA, 17 nt, Human
ggguggggggcuucaua

SEQ ID NO: 1193697 - RNA, 19 nt, Human
ggguggggggcuucauaca

SEQ ID NO: 1193698 - RNA, 19 nt, Human
aaacuuguaaauaaaggaa

SEQ ID NO: 1193699 - RNA, 19 nt, Human
aaagagaugaugaaaauau

SEQ ID NO: 1193700 - RNA, 20 nt, Human
aaagagaugaugaaaauauu

SEQ ID NO: 1193701 - RNA, 22 nt, Human
aaagagaugaugaaaauauuua

SEQ ID NO: 1193702 - RNA, 18 nt, Human
gggggcgcggcugggagg

SEQ ID NO: 1193703 - RNA, 13 nt, Human
aaacgucuuaaau

SEQ ID NO: 1193704 - RNA, 14 nt, Human
aaacgucuuaaaua

SEQ ID NO: 1193705 - RNA, 15 nt, Human
aaacgucuuaaauau

SEQ ID NO: 1193706 - RNA, 17 nt, Human
ggggccgggggcagucu

SEQ ID NO: 1193707 - RNA, 22 nt, Human
gggacaccuaggcuaggguggg

SEQ ID NO: 1193708 - RNA, 17 nt, Human
gggacaggggcaggagg

SEQ ID NO: 1193709 - RNA, 18 nt, Human
gggacaggggcaggagga

SEQ ID NO: 1193710 - RNA, 9 nt, Human
ggcuucaua

SEQ ID NO: 1193711 - RNA, 11 nt, Human
ggcuucauaca

SEQ ID NO: 1193712 - RNA, 12 nt, Human
ggcuucauacac

SEQ ID NO: 1193713 - RNA, 18 nt, Human
aaaagccaagaggcugca

SEQ ID NO: 1193714 - RNA, 14 nt, Human
ggcucagagugggg

SEQ ID NO: 1193715 - RNA, 20 nt, Human
ggcucagaggguguccugca

SEQ ID NO: 1193716 - RNA, 15 nt, Human
ggcagggcugaggcc

SEQ ID NO: 1193717 - RNA, 17 nt, Human
ggccagucccugaggca

SEQ ID NO: 1193718 - RNA, 23 nt, Human
ggccagucccugaggcagguccc

SEQ ID NO: 1193719 - RNA, 16 nt, Human
gcuucuaguucugcca

SEQ ID NO: 1193720 - RNA, 17 nt, Human
gcuucuaguucugccag

SEQ ID NO: 1193721 - RNA, 22 nt, Human
ggaagugugggucugugugugu

SEQ ID NO: 1193722 - RNA, 21 nt, Human
ggaagugugggucugugugug

SEQ ID NO: 1193723 - RNA, 12 nt, Human
ggaagugugggu

SEQ ID NO: 1193724 - RNA, 19 nt, Human
ggaaugaagauacugaaau

SEQ ID NO: 1193725 - RNA, 20 nt, Human
ggaacugcugggcuuggcag

SEQ ID NO: 1193726 - RNA, 16 nt, Human
gcucaggaaccgaggc

SEQ ID NO: 1193727 - RNA, 19 nt, Human
gcucaggaaccgaggcagg

SEQ ID NO: 1193728 - RNA, 20 nt, Human
gcucaggaaccgaggcaggg

SEQ ID NO: 1193729 - RNA, 21 nt, Human
gcucaggaaccgaggcaggga

SEQ ID NO: 1193730 - RNA, 14 nt, Human
gcuaugagggccuu

SEQ ID NO: 1193731 - RNA, 22 nt, Human
gcuaauucuuugaccuguuggg

SEQ ID NO: 1193732 - RNA, 17 nt, Human
gcucccccuccaccugc

SEQ ID NO: 1193733 - RNA, 18 nt, Human
gcucccccuccaccugcu

SEQ ID NO: 1193734 - RNA, 23 nt, Human
gccuccauccuacccccugugcc

SEQ ID NO: 1193735 - RNA, 17 nt, Human
gccucgacacagagugg

SEQ ID NO: 1193736 - RNA, 11 nt, Human
gccccugccag

SEQ ID NO: 1193737 - RNA, 16 nt, Human
gccccugccagacccc

SEQ ID NO: 1193738 - RNA, 18 nt, Human
gcauuucccuuccuuccu

SEQ ID NO: 1193739 - RNA, 12 nt, Human
gccaagaggcug

SEQ ID NO: 1193740 - RNA, 13 nt, Human
gccaagaggcugc

SEQ ID NO: 1193741 - RNA, 14 nt, Human
gccaagaggcugca

SEQ ID NO: 1193742 - RNA, 17 nt, Human
gccaagaggcugcagcc

SEQ ID NO: 1193743 - RNA, 15 nt, Human
gacccucaucuuucu

SEQ ID NO: 1193744 - RNA, 19 nt, Human
gacccucaucuuucuucca

SEQ ID NO: 1193745 - RNA, 20 nt, Human
gacccucaucuuucuuccaa

SEQ ID NO: 1193746 - RNA, 15 nt, Human
gacuauggagcugag

SEQ ID NO: 1193747 - RNA, 22 nt, Human
gacagguuugggaccccuggug

SEQ ID NO: 1193748 - RNA, 18 nt, Human
gacaggggcaggaggaag

SEQ ID NO: 1193749 - RNA, 20 nt, Human
gacaggggcaggaggaaggg

SEQ ID NO: 1193750 - RNA, 15 nt, Human
gagcagugggccugg

SEQ ID NO: 1193751 - RNA, 17 nt, Human
gagcagugggccuggcc

SEQ ID NO: 1193752 - RNA, 18 nt, Human
gagcagugggccuggcca

SEQ ID NO: 1193753 - RNA, 20 nt, Human
gagcugugcaucagcuagaa

SEQ ID NO: 1193754 - RNA, 19 nt, Human
cuucuaguucugccaggag

SEQ ID NO: 1193755 - RNA, 16 nt, Human
cuucuaguucugccag

SEQ ID NO: 1193756 - RNA, 17 nt, Human
cuucuaguucugccagg

SEQ ID NO: 1193757 - RNA, 18 nt, Human
cuucuaguucugccagga

SEQ ID NO: 1193758 - RNA, 20 nt, Human
cuugauuaagaucucagugg

SEQ ID NO: 1193759 - RNA, 14 nt, Human
cuuugaccuguugg

SEQ ID NO: 1193760 - RNA, 14 nt, Human
gaacugagcuugga

SEQ ID NO: 1193761 - RNA, 15 nt, Human
gaacugagcuuggaa

SEQ ID NO: 1193762 - RNA, 16 nt, Human
gaacugagcuuggaag

SEQ ID NO: 1193763 - RNA, 21 nt, Human
gaacugagcuuggaagcuucu

SEQ ID NO: 1193764 - RNA, 22 nt, Human
gaacugagcuuggaagcuucug

SEQ ID NO: 1193765 - RNA, 17 nt, Human
gaacugauguaaguaaa

SEQ ID NO: 1193766 - RNA, 18 nt, Human
gaaccccuggcuccaggc

SEQ ID NO: 1193767 - RNA, 22 nt, Human
gaaccccuggcuccaggccagg

SEQ ID NO: 1193768 - RNA, 17 nt, Human
gaagcacagugaucaag

SEQ ID NO: 1193769 - RNA, 18 nt, Human
gaaaucuaugauuccagg

SEQ ID NO: 1193770 - RNA, 20 nt, Human
gaaaucuaugauuccaggug

SEQ ID NO: 1193771 - RNA, 21 nt, Human
gaaacaagucagucauucaga

SEQ ID NO: 1193772 - RNA, 22 nt, Human
gaaaagaaaucuaugauuccag

SEQ ID NO: 1193773 - RNA, 16 nt, Human
cugugccuuuugccau

SEQ ID NO: 1193774 - RNA, 20 nt, Human
cugugccuugucacgccaga

SEQ ID NO: 1193775 - RNA, 15 nt, Human
cuuaggccagcacca

SEQ ID NO: 1193776 - RNA, 18 nt, Human
cugggaauaagugccagg

SEQ ID NO: 1193777 - RNA, 18 nt, Human
cuggccccugagaucucu

SEQ ID NO: 1193778 - RNA, 22 nt, Human
cuggccccugagaucucugcag

SEQ ID NO: 1193779 - RNA, 23 nt, Human
cuggccccugagaucucugcagg

SEQ ID NO: 1193780 - RNA, 17 nt, Human
cuggggaugucucucau

SEQ ID NO: 1193781 - RNA, 16 nt, Human
cuggggaugucucuca

SEQ ID NO: 1193782 - RNA, 17 nt, Human
cugccugguccucacac

SEQ ID NO: 1193783 - RNA, 19 nt, Human
cugccugguccucacacuc

SEQ ID NO: 1193784 - RNA, 23 nt, Human
cugccugguccucacacucaccc

SEQ ID NO: 1193785 - RNA, 13 nt, Human
cuggacuuggagg

SEQ ID NO: 1193786 - RNA, 17 nt, Human
caccuaggcuagggugg

SEQ ID NO: 1193787 - RNA, 21 nt, Human
caagucagucauucagauaug

SEQ ID NO: 1193788 - RNA, 19 nt, Human
auuuuagggguagcauuug

SEQ ID NO: 1193789 - RNA, 20 nt, Human
caagaauuucuaggacugaa

SEQ ID NO: 1193790 - RNA, 17 nt, Human
caacucauauuuucaug

SEQ ID NO: 1193791 - RNA, 16 nt, Human
auucaaaugucuauaa

SEQ ID NO: 1193792 - RNA, 19 nt, Human
cauccauggggcugauugu

SEQ ID NO: 1193793 - RNA, 15 nt, Human
caggccugacucuca

SEQ ID NO: 1193794 - RNA, 13 nt, Human
caggaggaagggg

SEQ ID NO: 1193795 - RNA, 12 nt, Human
caggaccccuga

SEQ ID NO: 1193796 - RNA, 14 nt, Human
caggaccccugagu

SEQ ID NO: 1193797 - RNA, 15 nt, Human
caggagguggucugg

SEQ ID NO: 1193798 - RNA, 18 nt, Human
cagucugagagaggccau

SEQ ID NO: 1193799 - RNA, 22 nt, Human
cagugcacuaauguguaagaca

SEQ ID NO: 1193800 - RNA, 15 nt, Human
cagguuugggacccc

SEQ ID NO: 1193801 - RNA, 18 nt, Human
cagguuugggaccccugg

SEQ ID NO: 1193802 - RNA, 23 nt, Human
cagguuugggaccccuggugguu

SEQ ID NO: 1193803 - RNA, 16 nt, Human
cagauaugauucaaau

SEQ ID NO: 1193804 - RNA, 17 nt, Human
cagauaugauucaaaug

SEQ ID NO: 1193805 - RNA, 19 nt, Human
cagauaugauucaaauguc

SEQ ID NO: 1193806 - RNA, 21 nt, Human
cagcagguccccagcuuuggc

SEQ ID NO: 1193807 - RNA, 19 nt, Human
cagcuccaagaauuucuag

SEQ ID NO: 1193808 - RNA, 16 nt, Human
cagcuccaagaauuuc

SEQ ID NO: 1193809 - RNA, 21 nt, Human
ccugucucccuccucugcccg

SEQ ID NO: 1193810 - RNA, 18 nt, Human
ccuggugguggcucggga

SEQ ID NO: 1193811 - RNA, 21 nt, Human
ccuggugguggcucgggaggc

SEQ ID NO: 1193812 - RNA, 12 nt, Human
ccuggugguuca

SEQ ID NO: 1193813 - RNA, 13 nt, Human
ccuggugguucac

SEQ ID NO: 1193814 - RNA, 22 nt, Human
ccuggugguucacucuuggagc

SEQ ID NO: 1193815 - RNA, 20 nt, Human
ccugccaucauguuuacaga

SEQ ID NO: 1193816 - RNA, 18 nt, Human
ccugccaucauguuuaca

SEQ ID NO: 1193817 - RNA, 18 nt, Human
ccugacccucaucuuucu

SEQ ID NO: 1193818 - RNA, 19 nt, Human
ccugacccucaucuuucuu

SEQ ID NO: 1193819 - RNA, 22 nt, Human
ccugacccucaucuuucuucca

SEQ ID NO: 1193820 - RNA, 18 nt, Human
ccugagaucucugcagga

SEQ ID NO: 1193821 - RNA, 19 nt, Human
ccugaguuccuagccaccg

SEQ ID NO: 1193822 - RNA, 20 nt, Human
ccugaguuccuagccaccgc

SEQ ID NO: 1193823 - RNA, 21 nt, Human
ccugaguuccuagccaccgcc

SEQ ID NO: 1193824 - RNA, 12 nt, Human
ccuagccaccca

SEQ ID NO: 1193825 - RNA, 16 nt, Human
ccuagccacccaccac

SEQ ID NO: 1193826 - RNA, 15 nt, Human
ccuccuagccaccca

SEQ ID NO: 1193827 - RNA, 12 nt, Human
ccauucuuuccc

SEQ ID NO: 1193828 - RNA, 14 nt, Human
ccauucuuucccaa

SEQ ID NO: 1193829 - RNA, 20 nt, Human
ccauucuuucccaacaccuc

SEQ ID NO: 1193830 - RNA, 15 nt, Human
ccagucccugaggca

SEQ ID NO: 1193831 - RNA, 23 nt, Human
ccagggggccagucccugaggca

SEQ ID NO: 1193832 - RNA, 10 nt, Human
ccccugccag

SEQ ID NO: 1193833 - RNA, 17 nt, Human
ccccugaauuuaaauag

SEQ ID NO: 1193834 - RNA, 13 nt, Human
ccccugaauuuaa

SEQ ID NO: 1193835 - RNA, 13 nt, Human
cgugucuggcaca

SEQ ID NO: 1193836 - RNA, 15 nt, Human
cuaggcuaggguggg

SEQ ID NO: 1193837 - RNA, 14 nt, Human
cuaguucugccagg

SEQ ID NO: 1193838 - RNA, 15 nt, Human
cuaguucugccagga

SEQ ID NO: 1193839 - RNA, 16 nt, Human
cuaguucugccaggag

SEQ ID NO: 1193840 - RNA, 15 nt, Human
cuaggguggggagag

SEQ ID NO: 1193841 - RNA, 13 nt, Human
cuaguucugccag

SEQ ID NO: 1193842 - RNA, 23 nt, Human
cucaaauacgugggcauucaaau

SEQ ID NO: 1193843 - RNA, 18 nt, Human
cucacuuguuuuauuuaa

SEQ ID NO: 1193844 - RNA, 23 nt, Human
cugaggaagagggacuguucuuu

SEQ ID NO: 1193845 - RNA, 18 nt, Human
cugaggaagagggacugu

SEQ ID NO: 1193846 - RNA, 12 nt, Human
cugagcuuggaa

SEQ ID NO: 1193847 - RNA, 14 nt, Human
cugagcuuggaagc

SEQ ID NO: 1193848 - RNA, 20 nt, Human
cugagcuuggaagcuucugg

SEQ ID NO: 1193849 - RNA, 21 nt, Human
cugagcuuggaagcuucuggu

SEQ ID NO: 1193850 - RNA, 18 nt, Human
cugacccucaucuuucuu

SEQ ID NO: 1193851 - RNA, 21 nt, Human
cugaggugggagauguggaaa

SEQ ID NO: 1193852 - RNA, 21 nt, Human
cugaguaaaaaagcugugugc

SEQ ID NO: 1193853 - RNA, 14 nt, Human
cuccgucaacucau

SEQ ID NO: 1193854 - RNA, 20 nt, Human
cucucuugauuaagaucuca

SEQ ID NO: 1193855 - RNA, 16 nt, Human
cuccuagccacccacc

SEQ ID NO: 1193856 - RNA, 11 nt, Human
uuuguggggag

SEQ ID NO: 1193857 - RNA, 16 nt, Human
uuggcagcucuacucu

SEQ ID NO: 1193858 - RNA, 18 nt, Human
uuggacaaaauggaauac

SEQ ID NO: 1193859 - RNA, 14 nt, Human
uugggaccccuggu

SEQ ID NO: 1193860 - RNA, 15 nt, Human
uugggaccccuggug

SEQ ID NO: 1193861 - RNA, 16 nt, Human
uugggaccccuggugg

SEQ ID NO: 1193862 - RNA, 20 nt, Human
uugggaccccuggugguuca

SEQ ID NO: 1193863 - RNA, 17 nt, Human
uuguagaagucacauuc

SEQ ID NO: 1193864 - RNA, 22 nt, Human
uuguagaagucacauuccugaa

SEQ ID NO: 1193865 - RNA, 15 nt, Human
uuguagcauccugga

SEQ ID NO: 1193866 - RNA, 16 nt, Human
uuguagcauccuggaa

SEQ ID NO: 1193867 - RNA, 16 nt, Human
uugauaugugaacagu

SEQ ID NO: 1193868 - RNA, 16 nt, Human
uugaagagguuuuaaa

SEQ ID NO: 1193869 - RNA, 21 nt, Human
uugaagagguuuuaaagcuuc

SEQ ID NO: 1193870 - RNA, 20 nt, Human
uugaagcacagugaucaagu

SEQ ID NO: 1193871 - RNA, 18 nt, Human
uuguuuagaagaagugug

SEQ ID NO: 1193872 - RNA, 15 nt, Human
uuguuuagaagaagu

SEQ ID NO: 1193873 - RNA, 16 nt, Human
uuuaaaauugugaugu

SEQ ID NO: 1193874 - RNA, 20 nt, Human
uuuaaaagauaaauauuaua

SEQ ID NO: 1193875 - RNA, 18 nt, Human
uuuaaaagaugcaaugua

SEQ ID NO: 1193876 - RNA, 20 nt, Human
uuuacagaggacaguauuug

SEQ ID NO: 1193877 - RNA, 16 nt, Human
uuuacauggcuggagc

SEQ ID NO: 1193878 - RNA, 14 nt, Human
uuuaaccucuaaau

SEQ ID NO: 1193879 - RNA, 14 nt, Human
uuuaugccaccuga

SEQ ID NO: 1193880 - RNA, 19 nt, Human
uuuccacuccuccuagcca

SEQ ID NO: 1193881 - RNA, 18 nt, Human
uuuccacuccuccuagcc

SEQ ID NO: 1193882 - RNA, 12 nt, Human
uuucugaaauuu

SEQ ID NO: 1193883 - RNA, 19 nt, Human
uuucugaaauuuccuggga

SEQ ID NO: 1193884 - RNA, 15 nt, Human
uuugauaugugaaca

SEQ ID NO: 1193885 - RNA, 17 nt, Human
uuugauaugugaacagu

SEQ ID NO: 1193886 - RNA, 14 nt, Human
uuugauaugugaac

SEQ ID NO: 1193887 - RNA, 19 nt, Human
uguuuagaagaaguguguc

SEQ ID NO: 1193888 - RNA, 21 nt, Human
uuaaaagaugcaauguagagg

SEQ ID NO: 1193889 - RNA, 12 nt, Human
uuaacucagucu

SEQ ID NO: 1193890 - RNA, 21 nt, Human
uuacuaggugcccagaaugag

SEQ ID NO: 1193891 - RNA, 16 nt, Human
uuaugccaccugaaua

SEQ ID NO: 1193892 - RNA, 13 nt, Human
uuaugccaccuga

SEQ ID NO: 1193893 - RNA, 16 nt, Human
uucccugaaggaacca

SEQ ID NO: 1193894 - RNA, 12 nt, Human
uucccugaggug

SEQ ID NO: 1193895 - RNA, 15 nt, Human
uucaugaaagauuca

SEQ ID NO: 1193896 - RNA, 17 nt, Human
uucaugaaagauucaau

SEQ ID NO: 1193897 - RNA, 18 nt, Human
uucaugaaagauucaaug

SEQ ID NO: 1193898 - RNA, 16 nt, Human
uuccacuccuccuagc

SEQ ID NO: 1193899 - RNA, 18 nt, Human
uuccacuccuccuagcca

SEQ ID NO: 1193900 - RNA, 21 nt, Human
uuccacuccuccuagccaccc

SEQ ID NO: 1193901 - RNA, 15 nt, Human
ugggggucugugugu

SEQ ID NO: 1193902 - RNA, 14 nt, Human
ugggggucugugug

SEQ ID NO: 1193903 - RNA, 20 nt, Human
uggggauagauguguggaca

SEQ ID NO: 1193904 - RNA, 18 nt, Human
uggggauagaugugugga

SEQ ID NO: 1193905 - RNA, 17 nt, Human
uggggauagaugugugg

SEQ ID NO: 1193906 - RNA, 16 nt, Human
uggggauagaugugug

SEQ ID NO: 1193907 - RNA, 20 nt, Human
uggggaguuuaggguggggg

SEQ ID NO: 1193908 - RNA, 13 nt, Human
ugggaguguguaa

SEQ ID NO: 1193909 - RNA, 11 nt, Human
ugggagugugu

SEQ ID NO: 1193910 - RNA, 22 nt, Human
ugggagugaggaugucugggcc

SEQ ID NO: 1193911 - RNA, 13 nt, Human
ugggcaggaggga

SEQ ID NO: 1193912 - RNA, 15 nt, Human
ugggcaggagggagg

SEQ ID NO: 1193913 - RNA, 16 nt, Human
ugggcaggagggaggu

SEQ ID NO: 1193914 - RNA, 18 nt, Human
ugggcaggagggaggugc

SEQ ID NO: 1193915 - RNA, 21 nt, Human
uggugaccuuccaagagccug

SEQ ID NO: 1193916 - RNA, 22 nt, Human
uggugaccuuccaagagccuga

SEQ ID NO: 1193917 - RNA, 14 nt, Human
ugguccucacacuc

SEQ ID NO: 1193918 - RNA, 15 nt, Human
uggaucugugagggg

SEQ ID NO: 1193919 - RNA, 19 nt, Human
uggaucugugaggggcucu

SEQ ID NO: 1193920 - RNA, 19 nt, Human
uggcaaacucuccaccaca

SEQ ID NO: 1193921 - RNA, 15 nt, Human
uggaccagccucucc

SEQ ID NO: 1193922 - RNA, 17 nt, Human
ugcccgggagcucagga

SEQ ID NO: 1193923 - RNA, 16 nt, Human
ugcuguuaucccugcc

SEQ ID NO: 1193924 - RNA, 16 nt, Human
ugcuguucaugaaaga

SEQ ID NO: 1193925 - RNA, 17 nt, Human
ugcuguucaugaaagau

SEQ ID NO: 1193926 - RNA, 22 nt, Human
ugcuaagaauauuugaauguau

SEQ ID NO: 1193927 - RNA, 17 nt, Human
ugcuaagaauauuugaa

SEQ ID NO: 1193928 - RNA, 21 nt, Human
ugcuaagaauauuugaaugua

SEQ ID NO: 1193929 - RNA, 17 nt, Human
ugacauacauccaacau

SEQ ID NO: 1193930 - RNA, 13 nt, Human
ugaauuaugaaac

SEQ ID NO: 1193931 - RNA, 15 nt, Human
ugaauuaugaaacuu

SEQ ID NO: 1193932 - RNA, 17 nt, Human
ugaauuaugaaacuuuu

SEQ ID NO: 1193933 - RNA, 14 nt, Human
ugaagauacugaaa

SEQ ID NO: 1193934 - RNA, 15 nt, Human
ugaagauacugaaau

SEQ ID NO: 1193935 - RNA, 16 nt, Human
ugaagauacugaaaua

SEQ ID NO: 1193936 - RNA, 18 nt, Human
ugaagauacugaaauaaa

SEQ ID NO: 1193937 - RNA, 15 nt, Human
ugaacagcggcugga

SEQ ID NO: 1193938 - RNA, 21 nt, Human
ugaacagcggcuggacuugga

SEQ ID NO: 1193939 - RNA, 22 nt, Human
ugaacagcggcuggacuuggag

SEQ ID NO: 1193940 - RNA, 19 nt, Human
ugaacaguuguguuugaag

SEQ ID NO: 1193941 - RNA, 21 nt, Human
ucuuuccacuccuccuagcca

SEQ ID NO: 1193942 - RNA, 22 nt, Human
ucuuuccacuccuccuagccac

SEQ ID NO: 1193943 - RNA, 20 nt, Human
ugagcuggggaugucucuca

SEQ ID NO: 1193944 - RNA, 14 nt, Human
ugaggcaggucccc

SEQ ID NO: 1193945 - RNA, 16 nt, Human
ugaggcagguccccag

SEQ ID NO: 1193946 - RNA, 17 nt, Human
ugaggcagguccccaga

SEQ ID NO: 1193947 - RNA, 14 nt, Human
ugaggugggagaug

SEQ ID NO: 1193948 - RNA, 19 nt, Human
ugagcuccuuaaggcucuu

SEQ ID NO: 1193949 - RNA, 21 nt, Human
ugagcuccuuaaggcucuuuu

SEQ ID NO: 1193950 - RNA, 18 nt, Human
ucucccuccucugcccgg

SEQ ID NO: 1193951 - RNA, 16 nt, Human
ucuacugggagccuac

SEQ ID NO: 1193952 - RNA, 19 nt, Human
ucuacugggagccuaccca

SEQ ID NO: 1193953 - RNA, 15 nt, Human
uccugucucccuccu

SEQ ID NO: 1193954 - RNA, 23 nt, Human
uccugucucccuccucugcccgg

SEQ ID NO: 1193955 - RNA, 13 nt, Human
uccuacccccugu

SEQ ID NO: 1193956 - RNA, 15 nt, Human
uccuacccccugugc

SEQ ID NO: 1193957 - RNA, 16 nt, Human
uccuacccccugugcc

SEQ ID NO: 1193958 - RNA, 17 nt, Human
uccuacccccugugccu

SEQ ID NO: 1193959 - RNA, 18 nt, Human
uccagagucccugccugg

SEQ ID NO: 1193960 - RNA, 19 nt, Human
uccagagucccugccugga

SEQ ID NO: 1193961 - RNA, 20 nt, Human
uccagagucccugccuggac

SEQ ID NO: 1193962 - RNA, 21 nt, Human
uccagagucccugccuggacc

SEQ ID NO: 1193963 - RNA, 14 nt, Human
uccagcaccacacu

SEQ ID NO: 1193964 - RNA, 12 nt, Human
ucaucuuucuuc

SEQ ID NO: 1193965 - RNA, 17 nt, Human
ucaugcuguucaugaaa

SEQ ID NO: 1193966 - RNA, 14 nt, Human
uccaaacaggcuca

SEQ ID NO: 1193967 - RNA, 23 nt, Human
uaugagcuggggaugucucucau

SEQ ID NO: 1193968 - RNA, 16 nt, Human
uaugauucaaaugucu

SEQ ID NO: 1193969 - RNA, 21 nt, Human
uaugauucaaaugucuauaaa

SEQ ID NO: 1193970 - RNA, 17 nt, Human
uaugcuucauacaggga

SEQ ID NO: 1193971 - RNA, 12 nt, Human
uaugcuucauac

SEQ ID NO: 1193972 - RNA, 13 nt, Human
uaugcuucauaca

SEQ ID NO: 1193973 - RNA, 14 nt, Human
uaugcuucauacag

SEQ ID NO: 1193974 - RNA, 16 nt, Human
uaugcuucauacaggg

SEQ ID NO: 1193975 - RNA, 16 nt, Human
uaucuguuuacagugu

SEQ ID NO: 1193976 - RNA, 17 nt, Human
uaucuguuuacaguguu

SEQ ID NO: 1193977 - RNA, 16 nt, Human
uaggcuagggugggga

SEQ ID NO: 1193978 - RNA, 17 nt, Human
ucacauuggaaacaagu

SEQ ID NO: 1193979 - RNA, 14 nt, Human
ucacauuggaaaca

SEQ ID NO: 1193980 - RNA, 22 nt, Human
uauuugaauguaugcuucauac

SEQ ID NO: 1193981 - RNA, 23 nt, Human
uauuugaauguaugcuucauaca

SEQ ID NO: 1193982 - RNA, 21 nt, Human
uauuugaauguaugcuucaua

SEQ ID NO: 1193983 - RNA, 14 nt, Human
guggcauccagagu

SEQ ID NO: 1193984 - RNA, 15 nt, Human
guggcaguuuggcaa

SEQ ID NO: 1193985 - RNA, 18 nt, Human
guggcucgggaggcgaag

SEQ ID NO: 1193986 - RNA, 20 nt, Human
gugcuucuaguucugccagg

SEQ ID NO: 1193987 - RNA, 21 nt, Human
gugcuucuaguucugccagga

SEQ ID NO: 1193988 - RNA, 22 nt, Human
gugcuucuaguucugccaggag

SEQ ID NO: 1193989 - RNA, 23 nt, Human
guggaaaagccaagaggcugcag

SEQ ID NO: 1193990 - RNA, 19 nt, Human
gugccuugucacgccagac

SEQ ID NO: 1193991 - RNA, 16 nt, Human
gugauuuuuaugccac

SEQ ID NO: 1193992 - RNA, 17 nt, Human
gugauuuuuaugccacc

SEQ ID NO: 1193993 - RNA, 19 nt, Human
gugauuuuuaugccaccug

SEQ ID NO: 1193994 - RNA, 20 nt, Human
gugauuuuuaugccaccuga

SEQ ID NO: 1193995 - RNA, 21 nt, Human
gugauuuuuaugccaccugaa

SEQ ID NO: 1193996 - RNA, 12 nt, Human
gugacucuuucc

SEQ ID NO: 1193997 - RNA, 19 nt, Human
gugaccuuccaagagccug

SEQ ID NO: 1193998 - RNA, 20 nt, Human
gugaccuuccaagagccuga

SEQ ID NO: 1193999 - RNA, 20 nt, Human
gucccugccuggaccagccu

SEQ ID NO: 1194000 - RNA, 21 nt, Human
gucccugccuggaccagccuc

SEQ ID NO: 1194001 - RNA, 22 nt, Human
gucccugccuggaccagccucu

SEQ ID NO: 1194002 - RNA, 23 nt, Human
gucccugccuggaccagccucuc

SEQ ID NO: 1194003 - RNA, 12 nt, Human
guccucagcccc

SEQ ID NO: 1194004 - RNA, 13 nt, Human
guccucacacuca

SEQ ID NO: 1194005 - RNA, 20 nt, Human
gucccagaaugccuccugca

SEQ ID NO: 1194006 - RNA, 14 nt, Human
gucacgccagacuu

SEQ ID NO: 1194007 - RNA, 22 nt, Human
gucagcccaaaccaccagaagc

SEQ ID NO: 1194008 - RNA, 23 nt, Human
gucagcccaaaccaccagaagcc

SEQ ID NO: 1194009 - RNA, 22 nt, Human
guauuacaguggggaaugaaga

SEQ ID NO: 1194010 - RNA, 20 nt, Human
guauuacaguggggaaugaa

SEQ ID NO: 1194011 - RNA, 13 nt, Human
ggggauagaugug

SEQ ID NO: 1194012 - RNA, 18 nt, Human
ggggaguuuagggugggg

SEQ ID NO: 1194013 - RNA, 19 nt, Human
gggcuucauacacaugaga

SEQ ID NO: 1194014 - RNA, 13 nt, Human
gggcuucauacac

SEQ ID NO: 1194015 - RNA, 14 nt, Human
gggcgcggcuggga

SEQ ID NO: 1194016 - RNA, 23 nt, Human
ggucagcccaaaccaccagaagc

SEQ ID NO: 1194017 - RNA, 19 nt, Human
ggguuccagcaccacacuc

SEQ ID NO: 1194018 - RNA, 15 nt, Human
guaaugaaacuugga

SEQ ID NO: 1194019 - RNA, 16 nt, Human
guaaugaaacuuggau

SEQ ID NO: 1194020 - RNA, 16 nt, Human
guaaauaaaggaacca

SEQ ID NO: 1194021 - RNA, 16 nt, Human
ggcgcggcugggagga

SEQ ID NO: 1194022 - RNA, 14 nt, Human
ggccugggcaggag

SEQ ID NO: 1194023 - RNA, 13 nt, Human
ggccugggcagga

SEQ ID NO: 1194024 - RNA, 21 nt, Human
ggcuauggggauagaugugug

SEQ ID NO: 1194025 - RNA, 16 nt, Human
ggcuaggguggggaga

SEQ ID NO: 1194026 - RNA, 18 nt, Human
ggcuccaggccagggggc

SEQ ID NO: 1194027 - RNA, 14 nt, Human
ggcuccaggccagg

SEQ ID NO: 1194028 - RNA, 16 nt, Human
ggcuccaggccagggg

SEQ ID NO: 1194029 - RNA, 12 nt, Human
ggcccugugccu

SEQ ID NO: 1194030 - RNA, 22 nt, Human
ggccuaaccugccgagagucca

SEQ ID NO: 1194031 - RNA, 17 nt, Human
ggauggaaugauggguc

SEQ ID NO: 1194032 - RNA, 16 nt, Human
ggaugcauggagauag

SEQ ID NO: 1194033 - RNA, 17 nt, Human
ggauugggccccugcca

SEQ ID NO: 1194034 - RNA, 18 nt, Human
ggauugggccccugccag

SEQ ID NO: 1194035 - RNA, 20 nt, Human
ggccauucuuucccaacacc

SEQ ID NO: 1194036 - RNA, 12 nt, Human
ggcagcucagcu

SEQ ID NO: 1194037 - RNA, 22 nt, Human
ggagaaugucaguauguggaag

SEQ ID NO: 1194038 - RNA, 20 nt, Human
ggagauagccccacaggagg

SEQ ID NO: 1194039 - RNA, 21 nt, Human
ggagauagccccacaggaggu

SEQ ID NO: 1194040 - RNA, 23 nt, Human
ggaagggacaccaagccuuggcu

SEQ ID NO: 1194041 - RNA, 22 nt, Human
ggaaggaucccaugagcuccuu

SEQ ID NO: 1194042 - RNA, 14 nt, Human
ggaauuauuuuaaa

SEQ ID NO: 1194043 - RNA, 15 nt, Human
ggaauuauuuuaaaa

SEQ ID NO: 1194044 - RNA, 16 nt, Human
ggaauuauuuuaaaag

SEQ ID NO: 1194045 - RNA, 17 nt, Human
ggaauuauuuuaaaaga

SEQ ID NO: 1194046 - RNA, 23 nt, Human
ggaauuggguggggggcuucaua

SEQ ID NO: 1194047 - RNA, 16 nt, Human
ggacaaaauggaauac

SEQ ID NO: 1194048 - RNA, 17 nt, Human
ggacaaaauggaauacu

SEQ ID NO: 1194049 - RNA, 14 nt, Human
gcuuuguggcacug

SEQ ID NO: 1194050 - RNA, 22 nt, Human
gcuuuguggcacuggggcaggg

SEQ ID NO: 1194051 - RNA, 20 nt, Human
ggaaaagccaagaggcugca

SEQ ID NO: 1194052 - RNA, 21 nt, Human
ggaaccaaagcgaauuuuaaa

SEQ ID NO: 1194053 - RNA, 22 nt, Human
ggaaccaaagcgaauuuuaaaa

SEQ ID NO: 1194054 - RNA, 11 nt, Human
gcuucauacag

SEQ ID NO: 1194055 - RNA, 22 nt, Human
gcuucauacagggaugguguuc

SEQ ID NO: 1194056 - RNA, 12 nt, Human
gcuguucaugaa

SEQ ID NO: 1194057 - RNA, 21 nt, Human
gcuguucaugaaagauucaau

SEQ ID NO: 1194058 - RNA, 17 nt, Human
gcuaugagcuggggaug

SEQ ID NO: 1194059 - RNA, 22 nt, Human
gcucagugucuggcugcagagc

SEQ ID NO: 1194060 - RNA, 14 nt, Human
gcuccaagaauuuc

SEQ ID NO: 1194061 - RNA, 17 nt, Human
gccugacccucaucuuu

SEQ ID NO: 1194062 - RNA, 12 nt, Human
gccugcagagcu

SEQ ID NO: 1194063 - RNA, 15 nt, Human
gccugcagagcugcg

SEQ ID NO: 1194064 - RNA, 23 nt, Human
gccuggccagcagguccccagcu

SEQ ID NO: 1194065 - RNA, 23 nt, Human
gcccuggugguggcucgggaggc

SEQ ID NO: 1194066 - RNA, 16 nt, Human
gcccugaguuccuagc

SEQ ID NO: 1194067 - RNA, 18 nt, Human
gcccugaguuccuagcca

SEQ ID NO: 1194068 - RNA, 21 nt, Human
gaugggucaguuguaucagca

SEQ ID NO: 1194069 - RNA, 15 nt, Human
gaugggucaguugua

SEQ ID NO: 1194070 - RNA, 24 nt, Human
gaugguguucaaaaaacuuguaaa

SEQ ID NO: 1194071 - RNA, 17 nt, Human
gauugggccccugccag

SEQ ID NO: 1194072 - RNA, 19 nt, Human
gauucaaugccccugaauu

SEQ ID NO: 1194073 - RNA, 20 nt, Human
gauucaaugccccugaauuu

SEQ ID NO: 1194074 - RNA, 21 nt, Human
gauucaaugccccugaauuua

SEQ ID NO: 1194075 - RNA, 23 nt, Human
gcacuggggcaggggccgggggc

SEQ ID NO: 1194076 - RNA, 15 nt, Human
gcacuggggcagggg

SEQ ID NO: 1194077 - RNA, 18 nt, Human
gcacuggggcaggggccg

SEQ ID NO: 1194078 - RNA, 22 nt, Human
gcaauguagaggggaaaagaga

SEQ ID NO: 1194079 - RNA, 13 nt, Human
gcaacucugaagg

SEQ ID NO: 1194080 - RNA, 13 nt, Human
gaguguguaauuu

SEQ ID NO: 1194081 - RNA, 22 nt, Human
gauagauguguggacacauugg

SEQ ID NO: 1194082 - RNA, 14 nt, Human
gauagaugugugga

SEQ ID NO: 1194083 - RNA, 14 nt, Human
gauaugauucaaau

SEQ ID NO: 1194084 - RNA, 22 nt, Human
gauaugauucaaaugucuauaa

SEQ ID NO: 1194085 - RNA, 24 nt, Human
gauaugauucaaaugucuauaaac

SEQ ID NO: 1194086 - RNA, 21 nt, Human
gagucccugccuggaccagcc

SEQ ID NO: 1194087 - RNA, 23 nt, Human
gagucccugccuggaccagccuc

SEQ ID NO: 1194088 - RNA, 21 nt, Human
gagucuauuuacggaacucaa

SEQ ID NO: 1194089 - RNA, 13 nt, Human
gaggguguccugc

SEQ ID NO: 1194090 - RNA, 21 nt, Human
gagguagcuuugagguggaag

SEQ ID NO: 1194091 - RNA, 23 nt, Human
gagggucuugguuccagccugcc

SEQ ID NO: 1194092 - RNA, 14 nt, Human
gagggggagagggc

SEQ ID NO: 1194093 - RNA, 22 nt, Human
gaggccucucauuccagaggaa

SEQ ID NO: 1194094 - RNA, 20 nt, Human
gaggcgaagcguuguccuca

SEQ ID NO: 1194095 - RNA, 21 nt, Human
gaggcgaagcguuguccucag

SEQ ID NO: 1194096 - RNA, 14 nt, Human
gaggcagggaagga

SEQ ID NO: 1194097 - RNA, 18 nt, Human
gagaucccaacacugcca

SEQ ID NO: 1194098 - RNA, 19 nt, Human
gagaucccaacacugccag

SEQ ID NO: 1194099 - RNA, 20 nt, Human
gagaucccaacacugccagc

SEQ ID NO: 1194100 - RNA, 18 nt, Human
gagaugaugaaaauauuu

SEQ ID NO: 1194101 - RNA, 19 nt, Human
gagaugaugaaaauauuua

SEQ ID NO: 1194102 - RNA, 17 nt, Human
gagaaugucaguaugug

SEQ ID NO: 1194103 - RNA, 13 nt, Human
gagagacgggccc

SEQ ID NO: 1194104 - RNA, 18 nt, Human
gaaugucaguauguggaa

SEQ ID NO: 1194105 - RNA, 16 nt, Human
gaaugucaguaugugg

SEQ ID NO: 1194106 - RNA, 13 nt, Human
gaaugucaguaug

SEQ ID NO: 1194107 - RNA, 19 nt, Human
gaaugucaguauguggaag

SEQ ID NO: 1194108 - RNA, 22 nt, Human
gaauuggguggggggcuucaua

SEQ ID NO: 1194109 - RNA, 23 nt, Human
gaauuggguggggggcuucauac

SEQ ID NO: 1194110 - RNA, 20 nt, Human
gaauuggguggggggcuuca

SEQ ID NO: 1194111 - RNA, 19 nt, Human
gaauuucuaggacugaauu

SEQ ID NO: 1194112 - RNA, 20 nt, Human
gaauuucuaggacugaauua

SEQ ID NO: 1194113 - RNA, 20 nt, Human
gaauuugauaugugaacagu

SEQ ID NO: 1194114 - RNA, 14 nt, Human
gaccagccucucca

SEQ ID NO: 1194115 - RNA, 14 nt, Human
cuuuguggcacugg

SEQ ID NO: 1194116 - RNA, 14 nt, Human
gaaaaguugaauuu

SEQ ID NO: 1194117 - RNA, 15 nt, Human
gaaaaguugaauuuu

SEQ ID NO: 1194118 - RNA, 13 nt, Human
gaaaauauuuaaa

SEQ ID NO: 1194119 - RNA, 13 nt, Human
cuugucacgccag

SEQ ID NO: 1194120 - RNA, 16 nt, Human
cuugucacgccagacu

SEQ ID NO: 1194121 - RNA, 18 nt, Human
cuugucacgccagacuuc

SEQ ID NO: 1194122 - RNA, 13 nt, Human
cuuucccaacacc

SEQ ID NO: 1194123 - RNA, 19 nt, Human
cuuuggcuaugagggccuu

SEQ ID NO: 1194124 - RNA, 21 nt, Human
cuucuggugaccuuccaagag

SEQ ID NO: 1194125 - RNA, 18 nt, Human
cuucuggugaccuuccaa

SEQ ID NO: 1194126 - RNA, 20 nt, Human
cuucuggugaccuuccaaga

SEQ ID NO: 1194127 - RNA, 19 nt, Human
cuuauaucuauauuuuaca

SEQ ID NO: 1194128 - RNA, 17 nt, Human
cuguguguuuaugugug

SEQ ID NO: 1194129 - RNA, 16 nt, Human
cuguguguuuaugugu

SEQ ID NO: 1194130 - RNA, 17 nt, Human
cuguucaugaaagauuc

SEQ ID NO: 1194131 - RNA, 18 nt, Human
cuguucaugaaagauuca

SEQ ID NO: 1194132 - RNA, 23 nt, Human
cuguucaugaaagauucaaugcc

SEQ ID NO: 1194133 - RNA, 19 nt, Human
cugugaggggcucucucau

SEQ ID NO: 1194134 - RNA, 21 nt, Human
cugucucccuccucugcccgg

SEQ ID NO: 1194135 - RNA, 21 nt, Human
cuggccaguggcuggaucugu

SEQ ID NO: 1194136 - RNA, 23 nt, Human
cuggcugcagagcagugggccug

SEQ ID NO: 1194137 - RNA, 17 nt, Human
cuggagguuuguuuaga

SEQ ID NO: 1194138 - RNA, 12 nt, Human
cuggagguuugu

SEQ ID NO: 1194139 - RNA, 14 nt, Human
cuggaccagccucu

SEQ ID NO: 1194140 - RNA, 18 nt, Human
cuggaccagccucuccac

SEQ ID NO: 1194141 - RNA, 11 nt, Human
cugcugggcuu

SEQ ID NO: 1194142 - RNA, 22 nt, Human
cugccgagaguccaucagccuc

SEQ ID NO: 1194143 - RNA, 23 nt, Human
cugccgagaguccaucagccucc

SEQ ID NO: 1194144 - RNA, 22 nt, Human
cuacucuggagguuuguuuaga

SEQ ID NO: 1194145 - RNA, 18 nt, Human
cuacugggagccuaccca

SEQ ID NO: 1194146 - RNA, 14 nt, Human
cuacugggagccua

SEQ ID NO: 1194147 - RNA, 15 nt, Human
cuacugggagccuac

SEQ ID NO: 1194148 - RNA, 20 nt, Human
cuauggggauagaugugugg

SEQ ID NO: 1194149 - RNA, 19 nt, Human
cuauggggauagaugugug

SEQ ID NO: 1194150 - RNA, 21 nt, Human
cuauggggauagaugugugga

SEQ ID NO: 1194151 - RNA, 13 nt, Human
cucacacucaccc

SEQ ID NO: 1194152 - RNA, 20 nt, Human
cuccccacgucagcugggac

SEQ ID NO: 1194153 - RNA, 16 nt, Human
cuccacucaugugacu

SEQ ID NO: 1194154 - RNA, 22 nt, Human
cuccacucaugugacucuuucc

SEQ ID NO: 1194155 - RNA, 14 nt, Human
cuccacucuccucu

SEQ ID NO: 1194156 - RNA, 21 nt, Human
cuccacucuccucuuccaggc

SEQ ID NO: 1194157 - RNA, 16 nt, Human
cucaguucucuucacu

SEQ ID NO: 1194158 - RNA, 17 nt, Human
cucaguucucuucacuc

SEQ ID NO: 1194159 - RNA, 17 nt, Human
cucaggaaccgaggcag

SEQ ID NO: 1194160 - RNA, 18 nt, Human
cucaggaaccgaggcagg

SEQ ID NO: 1194161 - RNA, 19 nt, Human
cucaggaaccgaggcaggg

SEQ ID NO: 1194162 - RNA, 17 nt, Human
cucagccccgcguggaa

SEQ ID NO: 1194163 - RNA, 16 nt, Human
cucagaggguguccug

SEQ ID NO: 1194164 - RNA, 20 nt, Human
cucacugcuaagaauauuug

SEQ ID NO: 1194165 - RNA, 21 nt, Human
cucacugcuaagaauauuuga

SEQ ID NO: 1194166 - RNA, 22 nt, Human
cucacugcuaagaauauuugaa

SEQ ID NO: 1194167 - RNA, 23 nt, Human
cucacugcuaagaauauuugaau

SEQ ID NO: 1194168 - RNA, 13 nt, Human
cuacccccugugc

SEQ ID NO: 1194169 - RNA, 12 nt, Human
cuaaccugccga

SEQ ID NO: 1194170 - RNA, 19 nt, Human
cuaaauucuuucauuuuag

SEQ ID NO: 1194171 - RNA, 18 nt, Human
cuaauaaucauuggauuc

SEQ ID NO: 1194172 - RNA, 18 nt, Human
cgggacaccuaggcuagg

SEQ ID NO: 1194173 - RNA, 19 nt, Human
cgggacaccuaggcuaggg

SEQ ID NO: 1194174 - RNA, 16 nt, Human
cgcggcugggaggagg

SEQ ID NO: 1194175 - RNA, 11 nt, Human
cgcggcuggga

SEQ ID NO: 1194176 - RNA, 12 nt, Human
cgcggcugggag

SEQ ID NO: 1194177 - RNA, 17 nt, Human
ccugugccuuuugccau

SEQ ID NO: 1194178 - RNA, 14 nt, Human
ccuuugucccagaa

SEQ ID NO: 1194179 - RNA, 15 nt, Human
cgaagcguuguccuc

SEQ ID NO: 1194180 - RNA, 16 nt, Human
cgaagcguuguccuca

SEQ ID NO: 1194181 - RNA, 17 nt, Human
cgaagcguuguccucag

SEQ ID NO: 1194182 - RNA, 21 nt, Human
cgaagcguuguccucagcccc

SEQ ID NO: 1194183 - RNA, 14 nt, Human
ccugccgagagucc

SEQ ID NO: 1194184 - RNA, 22 nt, Human
ccugccgagaguccaucagccu

SEQ ID NO: 1194185 - RNA, 23 nt, Human
ccugccgagaguccaucagccuc

SEQ ID NO: 1194186 - RNA, 19 nt, Human
ccugaagagaagggcaggg

SEQ ID NO: 1194187 - RNA, 15 nt, Human
ccucuuccaggcccc

SEQ ID NO: 1194188 - RNA, 15 nt, Human
ccugcaccggggccu

SEQ ID NO: 1194189 - RNA, 17 nt, Human
ccugcaccggggccugg

SEQ ID NO: 1194190 - RNA, 20 nt, Human
ccugguccucacacucaccc

SEQ ID NO: 1194191 - RNA, 19 nt, Human
ccuggagacuaaccccacc

SEQ ID NO: 1194192 - RNA, 16 nt, Human
ccuaggcuaggguggg

SEQ ID NO: 1194193 - RNA, 12 nt, Human
ccuaaccugccg

SEQ ID NO: 1194194 - RNA, 13 nt, Human
ccuaaccugccga

SEQ ID NO: 1194195 - RNA, 22 nt, Human
ccgggucaucuguaccucugcc

SEQ ID NO: 1194196 - RNA, 23 nt, Human
ccguggcuguggcauccagaguc

SEQ ID NO: 1194197 - RNA, 20 nt, Human
ccggggccugggcaggaggg

SEQ ID NO: 1194198 - RNA, 21 nt, Human
ccgggggcagucugagagagg

SEQ ID NO: 1194199 - RNA, 17 nt, Human
ccgccuccuacagccca

SEQ ID NO: 1194200 - RNA, 21 nt, Human
ccgagaguccaucagccucca

SEQ ID NO: 1194201 - RNA, 20 nt, Human
ccgagaguccaucagccucc

SEQ ID NO: 1194202 - RNA, 18 nt, Human
cccugaggcaggucccca

SEQ ID NO: 1194203 - RNA, 20 nt, Human
cccugaggcagguccccaga

SEQ ID NO: 1194204 - RNA, 17 nt, Human
cccugaggcaggucccc

SEQ ID NO: 1194205 - RNA, 21 nt, Human
cccugaggcagguccccagac

SEQ ID NO: 1194206 - RNA, 14 nt, Human
ccccugugccuugu

SEQ ID NO: 1194207 - RNA, 20 nt, Human
ccccuggcuccaggccaggg

SEQ ID NO: 1194208 - RNA, 12 nt, Human
ccccuggugguu

SEQ ID NO: 1194209 - RNA, 23 nt, Human
ccccuggugguucacucuuggag

SEQ ID NO: 1194210 - RNA, 22 nt, Human
cccccugugccuugucacgcca

SEQ ID NO: 1194211 - RNA, 13 nt, Human
ccccuccaccugc

SEQ ID NO: 1194212 - RNA, 20 nt, Human
ccccagacuccaccaagccu

SEQ ID NO: 1194213 - RNA, 18 nt, Human
cccagaaugccuccugca

SEQ ID NO: 1194214 - RNA, 17 nt, Human
cccagaaugaggcugcu

SEQ ID NO: 1194215 - RNA, 13 nt, Human
cccaugagcuccu

SEQ ID NO: 1194216 - RNA, 14 nt, Human
cccaugagcuccuu

SEQ ID NO: 1194217 - RNA, 15 nt, Human
cccaugagcuccuua

SEQ ID NO: 1194218 - RNA, 22 nt, Human
cccaugagcuccuuaaggcucu

SEQ ID NO: 1194219 - RNA, 15 nt, Human
cccacggcuccucga

SEQ ID NO: 1194220 - RNA, 15 nt, Human
cccacgucagcuggg

SEQ ID NO: 1194221 - RNA, 22 nt, Human
cccagaauaaacuggcagcuca

SEQ ID NO: 1194222 - RNA, 24 nt, Human
cccagaauaaacuggcagcucagc

SEQ ID NO: 1194223 - RNA, 16 nt, Human
cccagaaugaggcugc

SEQ ID NO: 1194224 - RNA, 14 nt, Human
cccaacacugccag

SEQ ID NO: 1194225 - RNA, 19 nt, Human
cccaaaacaccggguucca

SEQ ID NO: 1194226 - RNA, 15 nt, Human
cccaacacugccagc

SEQ ID NO: 1194227 - RNA, 16 nt, Human
cccaacacugccagca

SEQ ID NO: 1194228 - RNA, 23 nt, Human
ccaggccacuggccccugagauc

SEQ ID NO: 1194229 - RNA, 16 nt, Human
ccaggccacuggcccc

SEQ ID NO: 1194230 - RNA, 10 nt, Human
ccagccugcc

SEQ ID NO: 1194231 - RNA, 14 nt, Human
ccagcccugaguuc

SEQ ID NO: 1194232 - RNA, 18 nt, Human
ccagcccugaguuccuag

SEQ ID NO: 1194233 - RNA, 16 nt, Human
ccacccccaggacccc

SEQ ID NO: 1194234 - RNA, 18 nt, Human
ccacccccaggaccccug

SEQ ID NO: 1194235 - RNA, 19 nt, Human
ccacccccaggaccccuga

SEQ ID NO: 1194236 - RNA, 15 nt, Human
ccagaaugaggcugc

SEQ ID NO: 1194237 - RNA, 13 nt, Human
caaccggcuuugu

SEQ ID NO: 1194238 - RNA, 22 nt, Human
caaccggcuuuguggcacuggg

SEQ ID NO: 1194239 - RNA, 12 nt, Human
caacacugccag

SEQ ID NO: 1194240 - RNA, 13 nt, Human
caacacugccagc

SEQ ID NO: 1194241 - RNA, 14 nt, Human
caacacugccagca

SEQ ID NO: 1194242 - RNA, 16 nt, Human
caagaggcugcagcca

SEQ ID NO: 1194243 - RNA, 12 nt, Human
caagccugguca

SEQ ID NO: 1194244 - RNA, 19 nt, Human
caauguagaggggaaaaga

SEQ ID NO: 1194245 - RNA, 16 nt, Human
caaaaauucucaguuc

SEQ ID NO: 1194246 - RNA, 20 nt, Human
caaagcgaauuuuaaaagau

SEQ ID NO: 1194247 - RNA, 14 nt, Human
caaagcgaauuuua

SEQ ID NO: 1194248 - RNA, 19 nt, Human
caaagcgaauuuuaaaaga

SEQ ID NO: 1194249 - RNA, 15 nt, Human
caaaugucuauaaac

SEQ ID NO: 1194250 - RNA, 14 nt, Human
caaaugucuauaaa

SEQ ID NO: 1194251 - RNA, 21 nt, Human
caaauacgugggcauucaaau

SEQ ID NO: 1194252 - RNA, 22 nt, Human
caaauacgugggcauucaaaug

SEQ ID NO: 1194253 - RNA, 19 nt, Human
cacagugaucaaguuauuu

SEQ ID NO: 1194254 - RNA, 23 nt, Human
aguuguaucagcacguguggccu

SEQ ID NO: 1194255 - RNA, 20 nt, Human
aguuguaucagcacgugugg

SEQ ID NO: 1194256 - RNA, 15 nt, Human
aguugaauuuuacau

SEQ ID NO: 1194257 - RNA, 16 nt, Human
agugucuuuccacucc

SEQ ID NO: 1194258 - RNA, 15 nt, Human
agucauucagauaug

SEQ ID NO: 1194259 - RNA, 20 nt, Human
agucauucagauaugauuca

SEQ ID NO: 1194260 - RNA, 23 nt, Human
agucauucagauaugauucaaau

SEQ ID NO: 1194261 - RNA, 16 nt, Human
augugggggucugugu

SEQ ID NO: 1194262 - RNA, 18 nt, Human
augugggggucugugugu

SEQ ID NO: 1194263 - RNA, 17 nt, Human
augugggggucugugug

SEQ ID NO: 1194264 - RNA, 16 nt, Human
auguaaguaaacgguc

SEQ ID NO: 1194265 - RNA, 23 nt, Human
auggugacuuuugaaaagaggug

SEQ ID NO: 1194266 - RNA, 18 nt, Human
auggcuggagcuagaauu

SEQ ID NO: 1194267 - RNA, 12 nt, Human
augaaaauauuu

SEQ ID NO: 1194268 - RNA, 16 nt, Human
aggaacugcugggcuu

SEQ ID NO: 1194269 - RNA, 20 nt, Human
aggaaauggcuguggagugu

SEQ ID NO: 1194270 - RNA, 22 nt, Human
aggcuauggggauagaugugug

SEQ ID NO: 1194271 - RNA, 21 nt, Human
aggcuauggggauagaugugu

SEQ ID NO: 1194272 - RNA, 19 nt, Human
aggcuauggggauagaugu

SEQ ID NO: 1194273 - RNA, 18 nt, Human
aggcugcagccaggccac

SEQ ID NO: 1194274 - RNA, 21 nt, Human
aggugcuucuaguucugccag

SEQ ID NO: 1194275 - RNA, 22 nt, Human
aggugcuucuaguucugccagg

SEQ ID NO: 1194276 - RNA, 23 nt, Human
aggugcuucuaguucugccagga

SEQ ID NO: 1194277 - RNA, 16 nt, Human
agguggaagagggcug

SEQ ID NO: 1194278 - RNA, 22 nt, Human
agguggcaucagugucuuucca

SEQ ID NO: 1194279 - RNA, 23 nt, Human
agguggcaucagugucuuuccac

SEQ ID NO: 1194280 - RNA, 17 nt, Human
aggggccgggggcaguc

SEQ ID NO: 1194281 - RNA, 13 nt, Human
agccagaggucug

SEQ ID NO: 1194282 - RNA, 14 nt, Human
agcccugaguuccu

SEQ ID NO: 1194283 - RNA, 14 nt, Human
agacgggcccuggu

SEQ ID NO: 1194284 - RNA, 16 nt, Human
agaggguguccugcac

SEQ ID NO: 1194285 - RNA, 18 nt, Human
agaggggaaaagagauga

SEQ ID NO: 1194286 - RNA, 16 nt, Human
agaggggaaaagagau

SEQ ID NO: 1194287 - RNA, 22 nt, Human
aaugucaguauguggaagugug

SEQ ID NO: 1194288 - RNA, 16 nt, Human
aaugucaguaugugga

SEQ ID NO: 1194289 - RNA, 17 nt, Human
aaugaagauacugaaau

SEQ ID NO: 1194290 - RNA, 12 nt, Human
aaugaagauacu

SEQ ID NO: 1194291 - RNA, 20 nt, Human
aaugaagauacugaaauaaa

SEQ ID NO: 1194292 - RNA, 13 nt, Human
aauaaucauugga

SEQ ID NO: 1194293 - RNA, 17 nt, Human
aauaaacgucuuaaaua

SEQ ID NO: 1194294 - RNA, 18 nt, Human
aauaaacuggcagcucag

SEQ ID NO: 1194295 - RNA, 17 nt, Human
aaauggaauacucuuau

SEQ ID NO: 1194296 - RNA, 13 nt, Human
aaauaaaggaacc

SEQ ID NO: 1194297 - RNA, 13 nt, Human
acucagucuuuaa

SEQ ID NO: 1194298 - RNA, 17 nt, Human
acucaggcccaaagccu

SEQ ID NO: 1194299 - RNA, 16 nt, Human
acgccagacuucccac

SEQ ID NO: 1194300 - RNA, 22 nt, Human
acgccagacuucccacggcucc

SEQ ID NO: 1194301 - RNA, 18 nt, Human
agaaaaguugaauuuuac

SEQ ID NO: 1194302 - RNA, 21 nt, Human
agaaaaguugaauuuuacaug

SEQ ID NO: 1194303 - RNA, 20 nt, Human
acuuauuguagcauccugga

SEQ ID NO: 1194304 - RNA, 23 nt, Human
acuuauuguagcauccuggaaua

SEQ ID NO: 1194305 - RNA, 12 nt, Human
accccgacuuuu

SEQ ID NO: 1194306 - RNA, 15 nt, Human
accccgacuuuuguu

SEQ ID NO: 1194307 - RNA, 15 nt, Human
acagguuagcugcuc

SEQ ID NO: 1194308 - RNA, 15 nt, Human
acagguuugggaccc

SEQ ID NO: 1194309 - RNA, 18 nt, Human
acagguuugggaccccug

SEQ ID NO: 1194310 - RNA, 20 nt, Human
acauaaauuuaguauuuugu

SEQ ID NO: 1194311 - RNA, 19 nt, Human
accaagccuggucagccca

SEQ ID NO: 1194312 - RNA, 20 nt, Human
accaagccuggucagcccaa

SEQ ID NO: 1194313 - RNA, 15 nt, Human
acaggggcaggagga

SEQ ID NO: 1194314 - RNA, 15 nt, Human
acacugauccagccc

SEQ ID NO: 1194315 - RNA, 20 nt, Human
acaaaauggaauacucuuau

SEQ ID NO: 1194316 - RNA, 19 nt, Human
acaaaauggaauacucuua

SEQ ID NO: 1194317 - RNA, 20 nt, Human
acaagucagucauucagaua

SEQ ID NO: 1194318 - RNA, 12 nt, Human
auugguguugac

SEQ ID NO: 1194319 - RNA, 15 nt, Human
auugugauguguccu

SEQ ID NO: 1194320 - RNA, 14 nt, Human
auugugaugugucc

SEQ ID NO: 1194321 - RNA, 13 nt, Human
auugugauguguc

SEQ ID NO: 1194322 - RNA, 15 nt, Human
auugggccccugcca

SEQ ID NO: 1194323 - RNA, 16 nt, Human
auugggccccugccag

SEQ ID NO: 1194324 - RNA, 20 nt, Human
auuggguggggggcuucaua

SEQ ID NO: 1194325 - RNA, 21 nt, Human
auuggguggggggcuucauac

SEQ ID NO: 1194326 - RNA, 22 nt, Human
auuggguggggggcuucauaca

SEQ ID NO: 1194327 - RNA, 18 nt, Human
auuuaguauuuuguuuca

SEQ ID NO: 1194328 - RNA, 17 nt, Human
auuucuaggacugaauu

SEQ ID NO: 1194329 - RNA, 16 nt, Human
auuuuacauaaauuua

SEQ ID NO: 1194330 - RNA, 17 nt, Human
auuuuacauaaauuuag

SEQ ID NO: 1194331 - RNA, 18 nt, Human
auguguguguguugugug

SEQ ID NO: 1194332 - RNA, 10 nt, Human
augugugugu

SEQ ID NO: 1194333 - RNA, 23 nt, Human
auguggaagugugggucugugug

SEQ ID NO: 1194334 - RNA, 22 nt, Human
auguggaagugugggucugugu

SEQ ID NO: 1194335 - RNA, 16 nt, Human
auguggaagugugggu

SEQ ID NO: 1194336 - RNA, 15 nt, Human
auguggaaguguggg

SEQ ID NO: 1194337 - RNA, 13 nt, Human
auguggaagugug

SEQ ID NO: 1194338 - RNA, 16 nt, Human
uuuuguuuaccagaga

SEQ ID NO: 1194339 - RNA, 21 nt, Human
auuacaguggggaaugaagau

SEQ ID NO: 1194340 - RNA, 18 nt, Human
auucagauaugauucaaa

SEQ ID NO: 1194341 - RNA, 20 nt, Human
auucagauaugauucaaaug

SEQ ID NO: 1194342 - RNA, 20 nt, Human
uugcuaugagcuggggaugu

SEQ ID NO: 1194343 - RNA, 12 nt, Human
augaaagauuca

SEQ ID NO: 1194344 - RNA, 16 nt, Human
uugugugugggagugu

SEQ ID NO: 1194345 - RNA, 13 nt, Human
uugugugugggag

SEQ ID NO: 1194346 - RNA, 10 nt, Human
uugugugugg

SEQ ID NO: 1194347 - RNA, 13 nt, Human
uugucacgccaga

SEQ ID NO: 1194348 - RNA, 20 nt, Human
uugucacgccagacuuccca

SEQ ID NO: 1194349 - RNA, 18 nt, Human
uugucccugaagagaagg

SEQ ID NO: 1194350 - RNA, 22 nt, Human
uuguccucagccccgcguggaa

SEQ ID NO: 1194351 - RNA, 22 nt, Human
uuucuaggacugaauuaugaaa

SEQ ID NO: 1194352 - RNA, 21 nt, Human
uuucuaggacugaauuaugaa

SEQ ID NO: 1194353 - RNA, 16 nt, Human
uuuaaagcuuccauug

SEQ ID NO: 1194354 - RNA, 17 nt, Human
uuuaaaggcccuaucug

SEQ ID NO: 1194355 - RNA, 16 nt, Human
uucagauuugccuuau

SEQ ID NO: 1194356 - RNA, 19 nt, Human
uucagauaugauucaaaug

SEQ ID NO: 1194357 - RNA, 16 nt, Human
uucagauaugauucaa

SEQ ID NO: 1194358 - RNA, 17 nt, Human
uucagauaugauucaaa

SEQ ID NO: 1194359 - RNA, 18 nt, Human
uucagauaugauucaaau

SEQ ID NO: 1194360 - RNA, 9 nt, Human
auauauuuc

SEQ ID NO: 1194361 - RNA, 22 nt, Human
uucaugcuguucaugaaagauu

SEQ ID NO: 1194362 - RNA, 12 nt, Human
uuccugaacagg

SEQ ID NO: 1194363 - RNA, 14 nt, Human
uuccugaacaggau

SEQ ID NO: 1194364 - RNA, 21 nt, Human
auauuugaauguaugcuucau

SEQ ID NO: 1194365 - RNA, 21 nt, Human
auauucucacagcuccaagaa

SEQ ID NO: 1194366 - RNA, 18 nt, Human
auauucucacagcuccaa

SEQ ID NO: 1194367 - RNA, 20 nt, Human
aucauuaucagccugugcca

SEQ ID NO: 1194368 - RNA, 20 nt, Human
auccauggggcugauuguau

SEQ ID NO: 1194369 - RNA, 16 nt, Human
aucggggagccgggag

SEQ ID NO: 1194370 - RNA, 18 nt, Human
aucggggagccgggagcc

SEQ ID NO: 1194371 - RNA, 18 nt, Human
uguugggagugaggaugu

SEQ ID NO: 1194372 - RNA, 17 nt, Human
aguuccuagccaccgcc

SEQ ID NO: 1194373 - RNA, 17 nt, Human
aguuacccaaauuaaga

SEQ ID NO: 1194374 - RNA, 18 nt, Human
aguuacccaaauuaagag

SEQ ID NO: 1194375 - RNA, 14 nt, Human
ugugcaagagaggg

SEQ ID NO: 1194376 - RNA, 20 nt, Human
aguucucuucacucaaggau

SEQ ID NO: 1194377 - RNA, 14 nt, Human
uuaucaacauuugu

SEQ ID NO: 1194378 - RNA, 19 nt, Human
uuauauauauauauauuuc

SEQ ID NO: 1194379 - RNA, 22 nt, Human
uuauauauauuuuuuucugaaa

SEQ ID NO: 1194380 - RNA, 15 nt, Human
auaaacgucuuaaau

SEQ ID NO: 1194381 - RNA, 16 nt, Human
auaaacgucuuaaaua

SEQ ID NO: 1194382 - RNA, 18 nt, Human
auaaacgucuuaaauauu

SEQ ID NO: 1194383 - RNA, 18 nt, Human
auaaacuggcagcucagc

SEQ ID NO: 1194384 - RNA, 16 nt, Human
auaaaccgaacugaug

SEQ ID NO: 1194385 - RNA, 23 nt, Human
ugggaauaagugccaggauggaa

SEQ ID NO: 1194386 - RNA, 22 nt, Human
agggucuugguuccagccugcc

SEQ ID NO: 1194387 - RNA, 15 nt, Human
ugggucugugugugu

SEQ ID NO: 1194388 - RNA, 13 nt, Human
ugggucugugugu

SEQ ID NO: 1194389 - RNA, 23 nt, Human
agguagcuuugagguggaagagg

SEQ ID NO: 1194390 - RNA, 16 nt, Human
uggucugggacucucu

SEQ ID NO: 1194391 - RNA, 21 nt, Human
uguagaagucacauuccugaa

SEQ ID NO: 1194392 - RNA, 20 nt, Human
ugguucacucuuggagccug

SEQ ID NO: 1194393 - RNA, 21 nt, Human
ugguucacucuuggagccugc

SEQ ID NO: 1194394 - RNA, 22 nt, Human
ugguucacucuuggagccugca

SEQ ID NO: 1194395 - RNA, 17 nt, Human
ugguucacucuuggagc

SEQ ID NO: 1194396 - RNA, 21 nt, Human
ugguguucaaaaaacuuguaa

SEQ ID NO: 1194397 - RNA, 22 nt, Human
ugguguucaaaaaacuuguaaa

SEQ ID NO: 1194398 - RNA, 11 nt, Human
ugugauguguc

SEQ ID NO: 1194399 - RNA, 13 nt, Human
agucccugccugg

SEQ ID NO: 1194400 - RNA, 21 nt, Human
ugucuuuccacuccuccuagc

SEQ ID NO: 1194401 - RNA, 22 nt, Human
uguauccauccauggggcugau

SEQ ID NO: 1194402 - RNA, 16 nt, Human
agguuugggaccccug

SEQ ID NO: 1194403 - RNA, 21 nt, Human
agguuugggaccccugguggu

SEQ ID NO: 1194404 - RNA, 23 nt, Human
agguuuggacaaaauggaauacu

SEQ ID NO: 1194405 - RNA, 22 nt, Human
uguaugugggggucuguguguu

SEQ ID NO: 1194406 - RNA, 21 nt, Human
uguaugugggggucugugugu

SEQ ID NO: 1194407 - RNA, 18 nt, Human
agucacauuccugaacag

SEQ ID NO: 1194408 - RNA, 16 nt, Human
aguccaucagccucca

SEQ ID NO: 1194409 - RNA, 13 nt, Human
aguccaucagccu

SEQ ID NO: 1194410 - RNA, 14 nt, Human
aguccaucagccuc

SEQ ID NO: 1194411 - RNA, 15 nt, Human
agucagucauucaga

SEQ ID NO: 1194412 - RNA, 21 nt, Human
agucagucauucagauaugau

SEQ ID NO: 1194413 - RNA, 14 nt, Human
agcugccugugccu

SEQ ID NO: 1194414 - RNA, 18 nt, Human
agcuccaagaauuucuag

SEQ ID NO: 1194415 - RNA, 15 nt, Human
agcuccaagaauuuc

SEQ ID NO: 1194416 - RNA, 21 nt, Human
agcggcuggacuuggagguag

SEQ ID NO: 1194417 - RNA, 22 nt, Human
uggcugccuugugaaggaauua

SEQ ID NO: 1194418 - RNA, 16 nt, Human
uggcucuugaacugag

SEQ ID NO: 1194419 - RNA, 22 nt, Human
uggcucuugaacugagcuugga

SEQ ID NO: 1194420 - RNA, 13 nt, Human
aggcugcuuucca

SEQ ID NO: 1194421 - RNA, 14 nt, Human
aggcugcuuuccaa

SEQ ID NO: 1194422 - RNA, 15 nt, Human
aggcugcuuuccaaa

SEQ ID NO: 1194423 - RNA, 17 nt, Human
aggcugcuuuccaaagc

SEQ ID NO: 1194424 - RNA, 18 nt, Human
aggcugcuuuccaaagcc

SEQ ID NO: 1194425 - RNA, 19 nt, Human
aggcugcuuuccaaagcca

SEQ ID NO: 1194426 - RNA, 21 nt, Human
aggcugcuuuccaaagccaau

SEQ ID NO: 1194427 - RNA, 22 nt, Human
uggaccuuuccugaggaagagg

SEQ ID NO: 1194428 - RNA, 23 nt, Human
uggccaguggcuggaucugugag

SEQ ID NO: 1194429 - RNA, 16 nt, Human
uggccaguggcuggau

SEQ ID NO: 1194430 - RNA, 15 nt, Human
uggccaguggcugga

SEQ ID NO: 1194431 - RNA, 14 nt, Human
uggccaguggcugg

SEQ ID NO: 1194432 - RNA, 21 nt, Human
aggccucucauuccagaggaa

SEQ ID NO: 1194433 - RNA, 17 nt, Human
aggccauucuuucccaa

SEQ ID NO: 1194434 - RNA, 18 nt, Human
aggccauucuuucccaac

SEQ ID NO: 1194435 - RNA, 19 nt, Human
aggccauucuuucccaaca

SEQ ID NO: 1194436 - RNA, 12 nt, Human
aggcccaaagcc

SEQ ID NO: 1194437 - RNA, 13 nt, Human
aggcccaaagccu

SEQ ID NO: 1194438 - RNA, 15 nt, Human
aggcccaaagccucg

SEQ ID NO: 1194439 - RNA, 16 nt, Human
uggaccagccucucca

SEQ ID NO: 1194440 - RNA, 22 nt, Human
uggaccagccucuccacucaug

SEQ ID NO: 1194441 - RNA, 22 nt, Human
uggaauuggguggggggcuuca

SEQ ID NO: 1194442 - RNA, 19 nt, Human
aggacugaauuaugaaacu

SEQ ID NO: 1194443 - RNA, 20 nt, Human
aggacugaauuaugaaacuu

SEQ ID NO: 1194444 - RNA, 15 nt, Human
ugcuguagacauuug

SEQ ID NO: 1194445 - RNA, 11 nt, Human
ugcuucauaca

SEQ ID NO: 1194446 - RNA, 14 nt, Human
ugcuucauacaggg

SEQ ID NO: 1194447 - RNA, 15 nt, Human
ugcuucauacaggga

SEQ ID NO: 1194448 - RNA, 16 nt, Human
ugcuucauacagggau

SEQ ID NO: 1194449 - RNA, 22 nt, Human
ugcuauuguagagccagagguc

SEQ ID NO: 1194450 - RNA, 13 nt, Human
ugcuccccacguc

SEQ ID NO: 1194451 - RNA, 13 nt, Human
ugagagaggccau

SEQ ID NO: 1194452 - RNA, 17 nt, Human
ugagagcugugcaucag

SEQ ID NO: 1194453 - RNA, 15 nt, Human
ugacagguuugggac

SEQ ID NO: 1194454 - RNA, 16 nt, Human
agaggcugcagccagg

SEQ ID NO: 1194455 - RNA, 13 nt, Human
ugaaauaaacguc

SEQ ID NO: 1194456 - RNA, 18 nt, Human
ugaaauaaacgucuuaaa

SEQ ID NO: 1194457 - RNA, 22 nt, Human
ugaaauaaacgucuuaaauauu

SEQ ID NO: 1194458 - RNA, 23 nt, Human
ugaaauaaacgucuuaaauauuc

SEQ ID NO: 1194459 - RNA, 21 nt, Human
ugaaauuuccugggagcuuuu

SEQ ID NO: 1194460 - RNA, 23 nt, Human
ugaaauuuccugggagcuuuugu

SEQ ID NO: 1194461 - RNA, 15 nt, Human
ugaaauuuccuggga

SEQ ID NO: 1194462 - RNA, 12 nt, Human
agacuccaccaa

SEQ ID NO: 1194463 - RNA, 16 nt, Human
agacuccaccaagccu

SEQ ID NO: 1194464 - RNA, 13 nt, Human
agaaugucaguau

SEQ ID NO: 1194465 - RNA, 22 nt, Human
agaauuugauaugugaacaguu

SEQ ID NO: 1194466 - RNA, 14 nt, Human
ucuguuuacagugu

SEQ ID NO: 1194467 - RNA, 11 nt, Human
agaagcccaga

SEQ ID NO: 1194468 - RNA, 12 nt, Human
agaagcccagaa

SEQ ID NO: 1194469 - RNA, 13 nt, Human
agaagcccagaau

SEQ ID NO: 1194470 - RNA, 14 nt, Human
agaagaaguguguc

SEQ ID NO: 1194471 - RNA, 17 nt, Human
ucuaguucugccaggag

SEQ ID NO: 1194472 - RNA, 15 nt, Human
ucuaguucugccagg

SEQ ID NO: 1194473 - RNA, 16 nt, Human
ucuaguucugccagga

SEQ ID NO: 1194474 - RNA, 18 nt, Human
uccugcaccggggccugg

SEQ ID NO: 1194475 - RNA, 19 nt, Human
uccugcaccggggccuggg

SEQ ID NO: 1194476 - RNA, 15 nt, Human
uccugggagcuuuug

SEQ ID NO: 1194477 - RNA, 22 nt, Human
uccuggaauaucuccgucaacu

SEQ ID NO: 1194478 - RNA, 19 nt, Human
acucuuauaucuauauuuu

SEQ ID NO: 1194479 - RNA, 14 nt, Human
acucuuggagccug

SEQ ID NO: 1194480 - RNA, 15 nt, Human
acucuuggagccugc

SEQ ID NO: 1194481 - RNA, 16 nt, Human
acucuuggagccugca

SEQ ID NO: 1194482 - RNA, 22 nt, Human
acucuuggagccugcagagcug

SEQ ID NO: 1194483 - RNA, 23 nt, Human
acucuuggagccugcagagcugc

SEQ ID NO: 1194484 - RNA, 22 nt, Human
acucuuauaucuauauuuuaca

SEQ ID NO: 1194485 - RNA, 16 nt, Human
acucuuauaucuauau

SEQ ID NO: 1194486 - RNA, 17 nt, Human
acucuuauaucuauauu

SEQ ID NO: 1194487 - RNA, 18 nt, Human
acucuuauaucuauauuu

SEQ ID NO: 1194488 - RNA, 13 nt, Human
acuccuccuagcc

SEQ ID NO: 1194489 - RNA, 18 nt, Human
acguaaugaaacuuggau

SEQ ID NO: 1194490 - RNA, 13 nt, Human
uccagccugccac

SEQ ID NO: 1194491 - RNA, 20 nt, Human
uccagcccugaguuccuagc

SEQ ID NO: 1194492 - RNA, 22 nt, Human
uccagcccugaguuccuagcca

SEQ ID NO: 1194493 - RNA, 23 nt, Human
ucacagcaagucacuggccagug

SEQ ID NO: 1194494 - RNA, 16 nt, Human
accaaagcgaauuuua

SEQ ID NO: 1194495 - RNA, 13 nt, Human
accaccagaagcc

SEQ ID NO: 1194496 - RNA, 14 nt, Human
acauuccugaacag

SEQ ID NO: 1194497 - RNA, 15 nt, Human
acauuccugaacagg

SEQ ID NO: 1194498 - RNA, 22 nt, Human
ucagauuugccuuauuggcagc

SEQ ID NO: 1194499 - RNA, 17 nt, Human
ucagauuugccuuauug

SEQ ID NO: 1194500 - RNA, 16 nt, Human
accccuggugguucac

SEQ ID NO: 1194501 - RNA, 12 nt, Human
accuaggcuagg

SEQ ID NO: 1194502 - RNA, 17 nt, Human
accuaggcuaggguggg

SEQ ID NO: 1194503 - RNA, 14 nt, Human
ucaugugacucuuu

SEQ ID NO: 1194504 - RNA, 17 nt, Human
ucaugugacucuuucca

SEQ ID NO: 1194505 - RNA, 17 nt, Human
ucauguuuacagaggac

SEQ ID NO: 1194506 - RNA, 18 nt, Human
ucaugugacucuuuccaa

SEQ ID NO: 1194507 - RNA, 19 nt, Human
ucaugugacucuuuccaac

SEQ ID NO: 1194508 - RNA, 16 nt, Human
ucaugaaagauucaau

SEQ ID NO: 1194509 - RNA, 17 nt, Human
ucaugaaagauucaaug

SEQ ID NO: 1194510 - RNA, 16 nt, Human
ucaguauguggaagug

SEQ ID NO: 1194511 - RNA, 14 nt, Human
ucaguauguggaag

SEQ ID NO: 1194512 - RNA, 12 nt, Human
ucaguaugugga

SEQ ID NO: 1194513 - RNA, 16 nt, Human
ucauaaauuuaugguu

SEQ ID NO: 1194514 - RNA, 13 nt, Human
accgaggcaggga

SEQ ID NO: 1194515 - RNA, 15 nt, Human
ucauauuuucaugcu

SEQ ID NO: 1194516 - RNA, 22 nt, Human
uaacuuaaaagaacauguauau

SEQ ID NO: 1194517 - RNA, 13 nt, Human
uaagaauauuuga

SEQ ID NO: 1194518 - RNA, 14 nt, Human
uaagaauauuugaa

SEQ ID NO: 1194519 - RNA, 15 nt, Human
uaagaauauuugaau

SEQ ID NO: 1194520 - RNA, 14 nt, Human
aauauuugaaugua

SEQ ID NO: 1194521 - RNA, 21 nt, Human
aauauuugaauguaugcuuca

SEQ ID NO: 1194522 - RNA, 23 nt, Human
aauauuugaauguaugcuucaua

SEQ ID NO: 1194523 - RNA, 14 nt, Human
aaugaaacuuggau

SEQ ID NO: 1194524 - RNA, 15 nt, Human
aauuaagagagucua

SEQ ID NO: 1194525 - RNA, 22 nt, Human
aauguauuacaguggggaauga

SEQ ID NO: 1194526 - RNA, 20 nt, Human
uauggggauagaugugugga

SEQ ID NO: 1194527 - RNA, 23 nt, Human
uaucuauauuuuacauaaauuua

SEQ ID NO: 1194528 - RNA, 16 nt, Human
uauguggaaguguggg

SEQ ID NO: 1194529 - RNA, 12 nt, Human
uauguggaagug

SEQ ID NO: 1194530 - RNA, 12 nt, Human
uaugugaacagu

SEQ ID NO: 1194531 - RNA, 22 nt, Human
uaugugaacaguuguguuugaa

SEQ ID NO: 1194532 - RNA, 21 nt, Human
acagcggcuggacuuggaggu

SEQ ID NO: 1194533 - RNA, 22 nt, Human
acagcggcuggacuuggaggua

SEQ ID NO: 1194534 - RNA, 16 nt, Human
acaccucuuggggagu

SEQ ID NO: 1194535 - RNA, 21 nt, Human
guguaugugggggucugugug

SEQ ID NO: 1194536 - RNA, 13 nt, Human
guguauguggggg

SEQ ID NO: 1194537 - RNA, 16 nt, Human
aagaggugugcaagag

SEQ ID NO: 1194538 - RNA, 18 nt, Human
aagaggugugcaagagag

SEQ ID NO: 1194539 - RNA, 22 nt, Human
gugguucacucuuggagccugc

SEQ ID NO: 1194540 - RNA, 23 nt, Human
gugguucacucuuggagccugca

SEQ ID NO: 1194541 - RNA, 12 nt, Human
guguuugaagca

SEQ ID NO: 1194542 - RNA, 18 nt, Human
aagccuggucagcccaaa

SEQ ID NO: 1194543 - RNA, 12 nt, Human
guucagcuuggg

SEQ ID NO: 1194544 - RNA, 21 nt, Human
aagucacuggccaguggcugg

SEQ ID NO: 1194545 - RNA, 19 nt, Human
guuuggacaaaauggaaua

SEQ ID NO: 1194546 - RNA, 15 nt, Human
guuuuaaagcuucca

SEQ ID NO: 1194547 - RNA, 21 nt, Human
aagggguaggauuacuaggug

SEQ ID NO: 1194548 - RNA, 18 nt, Human
aagugugggucugugugu

SEQ ID NO: 1194549 - RNA, 17 nt, Human
aagugugggucugugug

SEQ ID NO: 1194550 - RNA, 10 nt, Human
aagugugggu

SEQ ID NO: 1194551 - RNA, 20 nt, Human
aagugugggucugugugugu

SEQ ID NO: 1194552 - RNA, 16 nt, Human
uaaaauugugaugugu

SEQ ID NO: 1194553 - RNA, 15 nt, Human
uaaaauugugaugug

SEQ ID NO: 1194554 - RNA, 19 nt, Human
aaguuauuuuuaauuuggu

SEQ ID NO: 1194555 - RNA, 10 nt, Human
gugauguguc

SEQ ID NO: 1194556 - RNA, 15 nt, Human
gugcucuccaagccc

SEQ ID NO: 1194557 - RNA, 12 nt, Human
aacgucuuaaau

SEQ ID NO: 1194558 - RNA, 14 nt, Human
aacgucuuaaauau

SEQ ID NO: 1194559 - RNA, 15 nt, Human
aacgucuuaaauauu

SEQ ID NO: 1194560 - RNA, 22 nt, Human
gucuuuccacuccuccuagcca

SEQ ID NO: 1194561 - RNA, 15 nt, Human
guccaucagccucca

SEQ ID NO: 1194562 - RNA, 22 nt, Human
guccccagacuccaccaagccu

SEQ ID NO: 1194563 - RNA, 22 nt, Human
gucccgggacaccuaggcuagg

SEQ ID NO: 1194564 - RNA, 20 nt, Human
gucuauuuacggaacucaaa

SEQ ID NO: 1194565 - RNA, 18 nt, Human
gucacauuccugaacagg

SEQ ID NO: 1194566 - RNA, 22 nt, Human
gguuuguuuagaagaagugugu

SEQ ID NO: 1194567 - RNA, 17 nt, Human
gguuuucacauuggaaa

SEQ ID NO: 1194568 - RNA, 20 nt, Human
gguuuucacauuggaaacaa

SEQ ID NO: 1194569 - RNA, 22 nt, Human
gguggggggggggcgcggcugg

SEQ ID NO: 1194570 - RNA, 21 nt, Human
gguggggagagacgggcccug

SEQ ID NO: 1194571 - RNA, 16 nt, Human
gguggggggcuucaua

SEQ ID NO: 1194572 - RNA, 18 nt, Human
gguggggggcuucauaca

SEQ ID NO: 1194573 - RNA, 15 nt, Human
gguuccagccugcca

SEQ ID NO: 1194574 - RNA, 16 nt, Human
gguuccagccugccac

SEQ ID NO: 1194575 - RNA, 20 nt, Human
aaauacgugggcauucaaau

SEQ ID NO: 1194576 - RNA, 21 nt, Human
aaauacgugggcauucaaaug

SEQ ID NO: 1194577 - RNA, 22 nt, Human
aaauacgugggcauucaaaugu

SEQ ID NO: 1194578 - RNA, 18 nt, Human
gguaggaacugcugggcu

SEQ ID NO: 1194579 - RNA, 17 nt, Human
ggguguccugcaccggg

SEQ ID NO: 1194580 - RNA, 21 nt, Human
ggguguccugcaccggggccu

SEQ ID NO: 1194581 - RNA, 18 nt, Human
gggucauucauggccugg

SEQ ID NO: 1194582 - RNA, 21 nt, Human
gggucaucuguaccucugccu

SEQ ID NO: 1194583 - RNA, 15 nt, Human
aaaccaccagaagcc

SEQ ID NO: 1194584 - RNA, 18 nt, Human
aaaccaccagaagcccag

SEQ ID NO: 1194585 - RNA, 19 nt, Human
aaaccaccagaagcccaga

SEQ ID NO: 1194586 - RNA, 22 nt, Human
gggggcagucugagagaggcca

SEQ ID NO: 1194587 - RNA, 22 nt, Human
gggggcuucauacacaugagau

SEQ ID NO: 1194588 - RNA, 14 nt, Human
aaaauauuuaaagg

SEQ ID NO: 1194589 - RNA, 23 nt, Human
ggcaucggggagccgggagccug

SEQ ID NO: 1194590 - RNA, 22 nt, Human
ggcaucggggagccgggagccu

SEQ ID NO: 1194591 - RNA, 16 nt, Human
ggcauccagagucccu

SEQ ID NO: 1194592 - RNA, 18 nt, Human
ggcauccagagucccugc

SEQ ID NO: 1194593 - RNA, 14 nt, Human
ggcaggagggaggu

SEQ ID NO: 1194594 - RNA, 12 nt, Human
ggcaggggccgg

SEQ ID NO: 1194595 - RNA, 14 nt, Human
ggagggggagaggg

SEQ ID NO: 1194596 - RNA, 22 nt, Human
ggaguguguaauuuaaaauugu

SEQ ID NO: 1194597 - RNA, 11 nt, Human
ggaguguguaa

SEQ ID NO: 1194598 - RNA, 15 nt, Human
ggaugguguucaaaa

SEQ ID NO: 1194599 - RNA, 18 nt, Human
ggcucuugaacugagcuu

SEQ ID NO: 1194600 - RNA, 19 nt, Human
ggcucuugaacugagcuug

SEQ ID NO: 1194601 - RNA, 20 nt, Human
ggcucuugaacugagcuugg

SEQ ID NO: 1194602 - RNA, 16 nt, Human
ggacaccccgacuuuu

SEQ ID NO: 1194603 - RNA, 19 nt, Human
ggaauacucuuauaucuau

SEQ ID NO: 1194604 - RNA, 18 nt, Human
ggacaguauuugugggga

SEQ ID NO: 1194605 - RNA, 17 nt, Human
ggacaggggcaggagga

SEQ ID NO: 1194606 - RNA, 19 nt, Human
ggacaguauuuguggggag

SEQ ID NO: 1194607 - RNA, 16 nt, Human
ggacaccuaggcuagg

SEQ ID NO: 1194608 - RNA, 22 nt, Human
gcuuuuccucaaagggagagag

SEQ ID NO: 1194609 - RNA, 17 nt, Human
gcuuuucuuucuaccaa

SEQ ID NO: 1194610 - RNA, 20 nt, Human
gcugggaauaagugccagga

SEQ ID NO: 1194611 - RNA, 23 nt, Human
gcugggacaccccgacuuuuguu

SEQ ID NO: 1194612 - RNA, 13 nt, Human
gcuggacuuggag

SEQ ID NO: 1194613 - RNA, 15 nt, Human
gcugcagccaggcca

SEQ ID NO: 1194614 - RNA, 23 nt, Human
gcugcagccaggccacuggcccc

SEQ ID NO: 1194615 - RNA, 21 nt, Human
gcguggaacucgugucuggca

SEQ ID NO: 1194616 - RNA, 13 nt, Human
gcggcugggagga

SEQ ID NO: 1194617 - RNA, 16 nt, Human
gcggcuggacuuggag

SEQ ID NO: 1194618 - RNA, 15 nt, Human
gcggcuggacuugga

SEQ ID NO: 1194619 - RNA, 17 nt, Human
gcuaggguggggagaga

SEQ ID NO: 1194620 - RNA, 18 nt, Human
gcuaggguggggagagac

SEQ ID NO: 1194621 - RNA, 18 nt, Human
gcucagaggguguccugc

SEQ ID NO: 1194622 - RNA, 19 nt, Human
gcucagaggguguccugca

SEQ ID NO: 1194623 - RNA, 21 nt, Human
gcucagaggguguccugcacc

SEQ ID NO: 1194624 - RNA, 21 nt, Human
gcucacugcuaagaauauuug

SEQ ID NO: 1194625 - RNA, 19 nt, Human
gccauucuuucccaacacc

SEQ ID NO: 1194626 - RNA, 17 nt, Human
gcaucggggagccggga

SEQ ID NO: 1194627 - RNA, 22 nt, Human
gcauccagagucccugccugga

SEQ ID NO: 1194628 - RNA, 23 nt, Human
gcauccagagucccugccuggac

SEQ ID NO: 1194629 - RNA, 21 nt, Human
gcauccagagucccugccugg

SEQ ID NO: 1194630 - RNA, 20 nt, Human
gcagccaggccacuggcccc

SEQ ID NO: 1194631 - RNA, 17 nt, Human
gcagagcugcgggcugg

SEQ ID NO: 1194632 - RNA, 19 nt, Human
gcagagcugcgggcugggu

SEQ ID NO: 1194633 - RNA, 17 nt, Human
gaucccaacacugccag

SEQ ID NO: 1194634 - RNA, 23 nt, Human
gauccagcccugaguuccuagcc

SEQ ID NO: 1194635 - RNA, 18 nt, Human
gaucccaacacugccagc

SEQ ID NO: 1194636 - RNA, 19 nt, Human
gaucccaacacugccagca

SEQ ID NO: 1194637 - RNA, 15 nt, Human
gaucccaugagcucc

SEQ ID NO: 1194638 - RNA, 12 nt, Human
gaucucugcagg

SEQ ID NO: 1194639 - RNA, 23 nt, Human
gaucucugcaggaaauggcugug

SEQ ID NO: 1194640 - RNA, 12 nt, Human
gauacugaaaua

SEQ ID NO: 1194641 - RNA, 13 nt, Human
gauggaaugaugg

SEQ ID NO: 1194642 - RNA, 16 nt, Human
gagacgggcccuggug

SEQ ID NO: 1194643 - RNA, 22 nt, Human
gaggacaguauuuguggggagg

SEQ ID NO: 1194644 - RNA, 22 nt, Human
gaauaucuccgucaacucauau

SEQ ID NO: 1194645 - RNA, 15 nt, Human
gacaaagucaagcca

SEQ ID NO: 1194646 - RNA, 13 nt, Human
gaauuauuuuaaa

SEQ ID NO: 1194647 - RNA, 16 nt, Human
gaauuauuuuaaaaga

SEQ ID NO: 1194648 - RNA, 18 nt, Human
gaauuauuuuaaaagaua

SEQ ID NO: 1194649 - RNA, 14 nt, Human
gacaaaaagcuacu

SEQ ID NO: 1194650 - RNA, 17 nt, Human
cuucuaccucuuggcug

SEQ ID NO: 1194651 - RNA, 15 nt, Human
cuuccucuccugucu

SEQ ID NO: 1194652 - RNA, 19 nt, Human
cuuccucuccugucucccu

SEQ ID NO: 1194653 - RNA, 20 nt, Human
cuugguuccagccugccacu

SEQ ID NO: 1194654 - RNA, 17 nt, Human
cuugguuccagccugcc

SEQ ID NO: 1194655 - RNA, 19 nt, Human
cuugguuccagccugccac

SEQ ID NO: 1194656 - RNA, 14 nt, Human
cuuuugucccagaa

SEQ ID NO: 1194657 - RNA, 18 nt, Human
cuuuuggaagguauuuaa

SEQ ID NO: 1194658 - RNA, 11 nt, Human
gaaacuuggau

SEQ ID NO: 1194659 - RNA, 23 nt, Human
cuggcccuaugcuuccggccucc

SEQ ID NO: 1194660 - RNA, 19 nt, Human
cuguuaucccugccugguc

SEQ ID NO: 1194661 - RNA, 22 nt, Human
cuggugaccuuccaagagccug

SEQ ID NO: 1194662 - RNA, 23 nt, Human
cuggugaccuuccaagagccuga

SEQ ID NO: 1194663 - RNA, 18 nt, Human
cagggcugaggccucuca

SEQ ID NO: 1194664 - RNA, 16 nt, Human
cagggcugaggccucu

SEQ ID NO: 1194665 - RNA, 16 nt, Human
cagggaugguguucaa

SEQ ID NO: 1194666 - RNA, 17 nt, Human
cagucugagagaggcca

SEQ ID NO: 1194667 - RNA, 14 nt, Human
cagugggccuggcc

SEQ ID NO: 1194668 - RNA, 15 nt, Human
cagugggccuggcca

SEQ ID NO: 1194669 - RNA, 21 nt, Human
cagugggccuggccagcaggu

SEQ ID NO: 1194670 - RNA, 14 nt, Human
caguggggaaugaa

SEQ ID NO: 1194671 - RNA, 23 nt, Human
cagaucauuaucagccugugcca

SEQ ID NO: 1194672 - RNA, 17 nt, Human
cagaggguguccugcac

SEQ ID NO: 1194673 - RNA, 19 nt, Human
ccaaugugaacagcggcug

SEQ ID NO: 1194674 - RNA, 16 nt, Human
cauuuguguugaagag

SEQ ID NO: 1194675 - RNA, 20 nt, Human
cauuuguguugaagagguuu

SEQ ID NO: 1194676 - RNA, 21 nt, Human
ccaccacacugauccagcccu

SEQ ID NO: 1194677 - RNA, 17 nt, Human
ccaccgccuccuacagc

SEQ ID NO: 1194678 - RNA, 13 nt, Human
ccaccgccuccua

SEQ ID NO: 1194679 - RNA, 14 nt, Human
ccacuccuccuagc

SEQ ID NO: 1194680 - RNA, 12 nt, Human
cauccuggaaua

SEQ ID NO: 1194681 - RNA, 17 nt, Human
cauggcucccccuccac

SEQ ID NO: 1194682 - RNA, 19 nt, Human
auucuuugaccuguuggga

SEQ ID NO: 1194683 - RNA, 13 nt, Human
auuccugaacagg

SEQ ID NO: 1194684 - RNA, 13 nt, Human
auucugagagcug

SEQ ID NO: 1194685 - RNA, 14 nt, Human
auucugagagcugu

SEQ ID NO: 1194686 - RNA, 18 nt, Human
caacaccucuuggggagu

SEQ ID NO: 1194687 - RNA, 16 nt, Human
caaagucaagccacau

SEQ ID NO: 1194688 - RNA, 20 nt, Human
caaauccuugugggaaaaga

SEQ ID NO: 1194689 - RNA, 22 nt, Human
caaaugagggucuugguuccag

SEQ ID NO: 1194690 - RNA, 23 nt, Human
caagaauuucuaggacugaauua

SEQ ID NO: 1194691 - RNA, 15 nt, Human
caaaccaccagaagc

SEQ ID NO: 1194692 - RNA, 16 nt, Human
caaaccaccagaagcc

SEQ ID NO: 1194693 - RNA, 20 nt, Human
caaaccaccagaagcccaga

SEQ ID NO: 1194694 - RNA, 22 nt, Human
caaaccaccagaagcccagaau

SEQ ID NO: 1194695 - RNA, 13 nt, Human
cacuggggcaggg

SEQ ID NO: 1194696 - RNA, 23 nt, Human
cacuggggauugggccccugcca

SEQ ID NO: 1194697 - RNA, 15 nt, Human
cacuggggcaggggc

SEQ ID NO: 1194698 - RNA, 19 nt, Human
cacuggggcaggggccggg

SEQ ID NO: 1194699 - RNA, 15 nt, Human
cacuggggauugggc

SEQ ID NO: 1194700 - RNA, 16 nt, Human
cacuggggauugggcc

SEQ ID NO: 1194701 - RNA, 17 nt, Human
cacuggggauugggccc

SEQ ID NO: 1194702 - RNA, 18 nt, Human
cacuggggauugggcccc

SEQ ID NO: 1194703 - RNA, 21 nt, Human
cagaauaaacuggcagcucag

SEQ ID NO: 1194704 - RNA, 17 nt, Human
cacucuuggagccugca

SEQ ID NO: 1194705 - RNA, 19 nt, Human
cacucuuggagccugcaga

SEQ ID NO: 1194706 - RNA, 21 nt, Human
cacucuuggagccugcagagc

SEQ ID NO: 1194707 - RNA, 14 nt, Human
cacucuuggagccu

SEQ ID NO: 1194708 - RNA, 15 nt, Human
cacucuuggagccug

SEQ ID NO: 1194709 - RNA, 16 nt, Human
cacucuuggagccugc

SEQ ID NO: 1194710 - RNA, 17 nt, Human
ccauccuacccccugug

SEQ ID NO: 1194711 - RNA, 22 nt, Human
ccagggggccagucccugaggc

SEQ ID NO: 1194712 - RNA, 22 nt, Human
cuaauucuuugaccuguuggga

SEQ ID NO: 1194713 - RNA, 21 nt, Human
cuaauucuuugaccuguuggg

SEQ ID NO: 1194714 - RNA, 23 nt, Human
cuagaauuugauaugugaacagu

SEQ ID NO: 1194715 - RNA, 16 nt, Human
cgaauuuuaaaagaug

SEQ ID NO: 1194716 - RNA, 15 nt, Human
cucgugucuggcaca

SEQ ID NO: 1194717 - RNA, 14 nt, Human
cuccucuuccaggc

SEQ ID NO: 1194718 - RNA, 12 nt, Human
cuccuacagccc

SEQ ID NO: 1194719 - RNA, 18 nt, Human
cucaugugacucuuucca

SEQ ID NO: 1194720 - RNA, 13 nt, Human
cuccaagaauuuc

SEQ ID NO: 1194721 - RNA, 14 nt, Human
cuccaagaauuucu

SEQ ID NO: 1194722 - RNA, 23 nt, Human
cuccaagcccaguucagcuuggg

SEQ ID NO: 1194723 - RNA, 12 nt, Human
cugagaggccac

SEQ ID NO: 1194724 - RNA, 13 nt, Human
cugagagaggcca

SEQ ID NO: 1194725 - RNA, 14 nt, Human
cugagagaggccau

SEQ ID NO: 1194726 - RNA, 21 nt, Human
cugagagaggccauucuuucc

SEQ ID NO: 1194727 - RNA, 22 nt, Human
cugagagaggccauucuuuccc

SEQ ID NO: 1194728 - RNA, 16 nt, Human
cugagaucucugcagg

SEQ ID NO: 1194729 - RNA, 17 nt, Human
cugagaucucugcagga

SEQ ID NO: 1194730 - RNA, 18 nt, Human
cugagaucucugcaggaa

SEQ ID NO: 1194731 - RNA, 21 nt, Human
uuuuauuuuucucaugaugag

SEQ ID NO: 1194732 - RNA, 16 nt, Human
uuuucacauuggaaac

SEQ ID NO: 1194733 - RNA, 21 nt, Human
uuccugaggaagagggacugu

SEQ ID NO: 1194734 - RNA, 13 nt, Human
uucugagagcugu

SEQ ID NO: 1194735 - RNA, 19 nt, Human
uucugagagcugugcauca

SEQ ID NO: 1194736 - RNA, 19 nt, Human
uugacaaagucaagccaca

SEQ ID NO: 1194737 - RNA, 20 nt, Human
uugacaaagucaagccacau

SEQ ID NO: 1194738 - RNA, 12 nt, Human
uugaauuuuaca

SEQ ID NO: 1194739 - RNA, 13 nt, Human
uugaaaagaggug

SEQ ID NO: 1194740 - RNA, 14 nt, Human
uugaaaagaggugu

SEQ ID NO: 1194741 - RNA, 21 nt, Human
uugaaaagaggugugcaagag

SEQ ID NO: 1194742 - RNA, 13 nt, Human
uucagcuugggga

SEQ ID NO: 1194743 - RNA, 20 nt, Human
uucaugcuguucaugaaaga

SEQ ID NO: 1194744 - RNA, 13 nt, Human
uuauuuuaaaaga

SEQ ID NO: 1194745 - RNA, 18 nt, Human
uucaaauguauuacagug

SEQ ID NO: 1194746 - RNA, 19 nt, Human
uuauaucuauauuuuacau

SEQ ID NO: 1194747 - RNA, 23 nt, Human
uuauaucuauauuuuacauaaau

SEQ ID NO: 1194748 - RNA, 19 nt, Human
uuuccaaccggcuuugugg

SEQ ID NO: 1194749 - RNA, 21 nt, Human
uuuaauagguuuggacaaaau

SEQ ID NO: 1194750 - RNA, 20 nt, Human
uuguguugaagagguuuuaa

SEQ ID NO: 1194751 - RNA, 17 nt, Human
uguaaauuuaugugaug

SEQ ID NO: 1194752 - RNA, 15 nt, Human
ugguuccagccugcc

SEQ ID NO: 1194753 - RNA, 16 nt, Human
ugguuccagccugcca

SEQ ID NO: 1194754 - RNA, 18 nt, Human
uguccugcaccggggccu

SEQ ID NO: 1194755 - RNA, 13 nt, Human
uguccucagcccc

SEQ ID NO: 1194756 - RNA, 13 nt, Human
uguaugcuucaua

SEQ ID NO: 1194757 - RNA, 14 nt, Human
uguaugcuucauac

SEQ ID NO: 1194758 - RNA, 16 nt, Human
uguaugcuucauacag

SEQ ID NO: 1194759 - RNA, 19 nt, Human
uguaugcuucauacaggga

SEQ ID NO: 1194760 - RNA, 14 nt, Human
ugggaggagggcag

SEQ ID NO: 1194761 - RNA, 17 nt, Human
ugggaggagggcaggca

SEQ ID NO: 1194762 - RNA, 18 nt, Human
ugggaggagggcaggcau

SEQ ID NO: 1194763 - RNA, 17 nt, Human
uggggggcuucauacac

SEQ ID NO: 1194764 - RNA, 20 nt, Human
uggcuccauugguguugaca

SEQ ID NO: 1194765 - RNA, 15 nt, Human
uggcuccaggccagg

SEQ ID NO: 1194766 - RNA, 23 nt, Human
uggccuaaccugccgagagucca

SEQ ID NO: 1194767 - RNA, 14 nt, Human
uggccccugagauc

SEQ ID NO: 1194768 - RNA, 16 nt, Human
uggaaaagccaagagg

SEQ ID NO: 1194769 - RNA, 19 nt, Human
uggaaaagccaagaggcug

SEQ ID NO: 1194770 - RNA, 17 nt, Human
ugaguuggcugggaaua

SEQ ID NO: 1194771 - RNA, 16 nt, Human
ugaguuggcugggaau

SEQ ID NO: 1194772 - RNA, 14 nt, Human
ugaguuggcuggga

SEQ ID NO: 1194773 - RNA, 19 nt, Human
ugagguggaagagggcugc

SEQ ID NO: 1194774 - RNA, 16 nt, Human
ugaggcugcuuuccaa

SEQ ID NO: 1194775 - RNA, 20 nt, Human
ugaggcugcuuuccaaagcc

SEQ ID NO: 1194776 - RNA, 23 nt, Human
ugaggcugcuuuccaaagccaau

SEQ ID NO: 1194777 - RNA, 15 nt, Human
ugaugaaaauauuua

SEQ ID NO: 1194778 - RNA, 14 nt, Human
ugaugaaaauauuu

SEQ ID NO: 1194779 - RNA, 21 nt, Human
ugcauuauauuuguaaauuua

SEQ ID NO: 1194780 - RNA, 22 nt, Human
ugccaucauguuuacagaggac

SEQ ID NO: 1194781 - RNA, 18 nt, Human
ugcccgggagcucaggaa

SEQ ID NO: 1194782 - RNA, 19 nt, Human
ugcccagaaugaggcugcu

SEQ ID NO: 1194783 - RNA, 17 nt, Human
ugcccagaaugaggcug

SEQ ID NO: 1194784 - RNA, 18 nt, Human
ugcccagaaugaggcugc

SEQ ID NO: 1194785 - RNA, 17 nt, Human
ugccugguccucacacu

SEQ ID NO: 1194786 - RNA, 18 nt, Human
ugauuuuuaugccaccug

SEQ ID NO: 1194787 - RNA, 22 nt, Human
ugcaacucugaaggguaauuau

SEQ ID NO: 1194788 - RNA, 22 nt, Human
ugcaauguagaggggaaaagag

SEQ ID NO: 1194789 - RNA, 15 nt, Human
ucugccaggagacag

SEQ ID NO: 1194790 - RNA, 14 nt, Human
ucuggcugcagagc

SEQ ID NO: 1194791 - RNA, 18 nt, Human
ucugaaauuuccugggag

SEQ ID NO: 1194792 - RNA, 20 nt, Human
ucugaaauuuccugggagcu

SEQ ID NO: 1194793 - RNA, 14 nt, Human
ucugcaacucugaa

SEQ ID NO: 1194794 - RNA, 15 nt, Human
ucugcaacucugaag

SEQ ID NO: 1194795 - RNA, 15 nt, Human
ucucugauacagaaa

SEQ ID NO: 1194796 - RNA, 14 nt, Human
ucgugucuggcaca

SEQ ID NO: 1194797 - RNA, 21 nt, Human
ucgugucuggcacagccuggc

SEQ ID NO: 1194798 - RNA, 22 nt, Human
ucuaugauuccagguggcauca

SEQ ID NO: 1194799 - RNA, 23 nt, Human
ucuaggacugaauuaugaaacuu

SEQ ID NO: 1194800 - RNA, 16 nt, Human
ucuaggacugaauuau

SEQ ID NO: 1194801 - RNA, 16 nt, Human
ucccuccucugcccgg

SEQ ID NO: 1194802 - RNA, 15 nt, Human
ucccucuacugggag

SEQ ID NO: 1194803 - RNA, 17 nt, Human
ucccucuacugggagcc

SEQ ID NO: 1194804 - RNA, 16 nt, Human
ucccuuccuuccucuc

SEQ ID NO: 1194805 - RNA, 19 nt, Human
ucccuuccuuccucuccug

SEQ ID NO: 1194806 - RNA, 13 nt, Human
ucccugccuggac

SEQ ID NO: 1194807 - RNA, 23 nt, Human
ucccugccugguccucacacuca

SEQ ID NO: 1194808 - RNA, 20 nt, Human
uccuaauaaucauuggauuc

SEQ ID NO: 1194809 - RNA, 12 nt, Human
uauucccaugag

SEQ ID NO: 1194810 - RNA, 17 nt, Human
ucaaugccccugaauuu

SEQ ID NO: 1194811 - RNA, 18 nt, Human
ucaaugccccugaauuua

SEQ ID NO: 1194812 - RNA, 20 nt, Human
ucaaugccccugaauuuaaa

SEQ ID NO: 1194813 - RNA, 22 nt, Human
ucaaugccccugaauuuaaaua

SEQ ID NO: 1194814 - RNA, 14 nt, Human
ucaaaaaacuugua

SEQ ID NO: 1194815 - RNA, 15 nt, Human
ucaaaaaacuuguaa

SEQ ID NO: 1194816 - RNA, 14 nt, Human
ucauuccagaggaa

SEQ ID NO: 1194817 - RNA, 14 nt, Human
uccagguggcauca

SEQ ID NO: 1194818 - RNA, 19 nt, Human
ucagaggguguccugcacc

SEQ ID NO: 1194819 - RNA, 20 nt, Human
ucacuuguuuuauuuaaccu

SEQ ID NO: 1194820 - RNA, 19 nt, Human
ucacugcuaagaauauuug

SEQ ID NO: 1194821 - RNA, 15 nt, Human
ucagauaugauucaa

SEQ ID NO: 1194822 - RNA, 16 nt, Human
ucagauaugauucaaa

SEQ ID NO: 1194823 - RNA, 16 nt, Human
gggaggagggcaggca

SEQ ID NO: 1194824 - RNA, 12 nt, Human
gggaggagggca

SEQ ID NO: 1194825 - RNA, 13 nt, Human
gggagccgggagc

SEQ ID NO: 1194826 - RNA, 23 nt, Human
gggagcucaggaaccgaggcagg

SEQ ID NO: 1194827 - RNA, 12 nt, Human
gggagcucagga

SEQ ID NO: 1194828 - RNA, 22 nt, Human
gggagcucaggaaccgaggcag

SEQ ID NO: 1194829 - RNA, 20 nt, Human
gggacaccaagccuuggcuc

SEQ ID NO: 1194830 - RNA, 14 nt, Human
gggacaccuaggcu

SEQ ID NO: 1194831 - RNA, 21 nt, Human
ggcuguggcauccagaguccc

SEQ ID NO: 1194832 - RNA, 23 nt, Human
ggcuguggcauccagagucccug

SEQ ID NO: 1194833 - RNA, 13 nt, Human
ggcugggaggagg

SEQ ID NO: 1194834 - RNA, 20 nt, Human
ggcugggaggagggcaggca

SEQ ID NO: 1194835 - RNA, 21 nt, Human
ggcugggaggagggcaggcau

SEQ ID NO: 1194836 - RNA, 13 nt, Human
ggcuggacuugga

SEQ ID NO: 1194837 - RNA, 18 nt, Human
ggcuggacuuggagguag

SEQ ID NO: 1194838 - RNA, 18 nt, Human
ggcuggagcuagaauuug

SEQ ID NO: 1194839 - RNA, 16 nt, Human
ggccugacucucagca

SEQ ID NO: 1194840 - RNA, 15 nt, Human
ggccugggcaggagg

SEQ ID NO: 1194841 - RNA, 17 nt, Human
ggccugggcaggaggga

SEQ ID NO: 1194842 - RNA, 19 nt, Human
ggccugggcaggagggagg

SEQ ID NO: 1194843 - RNA, 20 nt, Human
ggccucucauuccagaggaa

SEQ ID NO: 1194844 - RNA, 15 nt, Human
ggccuaaccugccga

SEQ ID NO: 1194845 - RNA, 16 nt, Human
ggccuaaccugccgag

SEQ ID NO: 1194846 - RNA, 21 nt, Human
ggccuaaccugccgagagucc

SEQ ID NO: 1194847 - RNA, 21 nt, Human
ggagcucaggaaccgaggcag

SEQ ID NO: 1194848 - RNA, 14 nt, Human
ggagcuagaauuug

SEQ ID NO: 1194849 - RNA, 17 nt, Human
ggagccugcagagcugc

SEQ ID NO: 1194850 - RNA, 16 nt, Human
ggagccuacccacccc

SEQ ID NO: 1194851 - RNA, 19 nt, Human
ggagacagguuagcugcuc

SEQ ID NO: 1194852 - RNA, 17 nt, Human
ggacugaauuaugaaac

SEQ ID NO: 1194853 - RNA, 19 nt, Human
ggacugaauuaugaaacuu

SEQ ID NO: 1194854 - RNA, 12 nt, Human
ggaccagccucu

SEQ ID NO: 1194855 - RNA, 16 nt, Human
ggauucugagagcugu

SEQ ID NO: 1194856 - RNA, 14 nt, Human
gcugauuguauuua

SEQ ID NO: 1194857 - RNA, 15 nt, Human
gcucuccaagcccag

SEQ ID NO: 1194858 - RNA, 19 nt, Human
gcuguggccuaaccugccg

SEQ ID NO: 1194859 - RNA, 20 nt, Human
gcuguggccuaaccugccga

SEQ ID NO: 1194860 - RNA, 16 nt, Human
gcugugugcucuccaa

SEQ ID NO: 1194861 - RNA, 14 nt, Human
gcuggggaugucuc

SEQ ID NO: 1194862 - RNA, 22 nt, Human
gcugggcuuggcagcccggguc

SEQ ID NO: 1194863 - RNA, 21 nt, Human
gcugggaggagggcaggcauc

SEQ ID NO: 1194864 - RNA, 10 nt, Human
gcuucauaca

SEQ ID NO: 1194865 - RNA, 11 nt, Human
gcuucauacac

SEQ ID NO: 1194866 - RNA, 14 nt, Human
gcuuuccaaagcca

SEQ ID NO: 1194867 - RNA, 15 nt, Human
gcuccuuaaggcucu

SEQ ID NO: 1194868 - RNA, 17 nt, Human
gcuccuuaaggcucuuu

SEQ ID NO: 1194869 - RNA, 21 nt, Human
gcuccuuaaggcucuuuugua

SEQ ID NO: 1194870 - RNA, 17 nt, Human
gcuccaggccagggggc

SEQ ID NO: 1194871 - RNA, 18 nt, Human
gcuccaggccagggggcc

SEQ ID NO: 1194872 - RNA, 15 nt, Human
gccuugucacgccag

SEQ ID NO: 1194873 - RNA, 16 nt, Human
gccuugucacgccaga

SEQ ID NO: 1194874 - RNA, 17 nt, Human
gccuugucacgccagac

SEQ ID NO: 1194875 - RNA, 17 nt, Human
gcgaagcguuguccuca

SEQ ID NO: 1194876 - RNA, 14 nt, Human
gcgaauuuuaaaag

SEQ ID NO: 1194877 - RNA, 15 nt, Human
gcgaauuuuaaaaga

SEQ ID NO: 1194878 - RNA, 16 nt, Human
gcgaauuuuaaaagau

SEQ ID NO: 1194879 - RNA, 16 nt, Human
gccugggcaggaggga

SEQ ID NO: 1194880 - RNA, 17 nt, Human
gccugguccucacacuc

SEQ ID NO: 1194881 - RNA, 13 nt, Human
gccuggucagccc

SEQ ID NO: 1194882 - RNA, 14 nt, Human
gccuggucagccca

SEQ ID NO: 1194883 - RNA, 15 nt, Human
gccuggucagcccaa

SEQ ID NO: 1194884 - RNA, 16 nt, Human
gccuggaccagccucu

SEQ ID NO: 1194885 - RNA, 17 nt, Human
gccuggaccagccucuc

SEQ ID NO: 1194886 - RNA, 21 nt, Human
gccagacuucccacggcuccu

SEQ ID NO: 1194887 - RNA, 15 nt, Human
gccacgauugcagga

SEQ ID NO: 1194888 - RNA, 16 nt, Human
gccaccugaauaaaga

SEQ ID NO: 1194889 - RNA, 20 nt, Human
gccaaugugaacagcggcug

SEQ ID NO: 1194890 - RNA, 23 nt, Human
gcccaaaccaccagaagcccaga

SEQ ID NO: 1194891 - RNA, 21 nt, Human
gcccaaaccaccagaagccca

SEQ ID NO: 1194892 - RNA, 22 nt, Human
gcccaaaccaccagaagcccag

SEQ ID NO: 1194893 - RNA, 21 nt, Human
gcaggcaucggggagccggga

SEQ ID NO: 1194894 - RNA, 22 nt, Human
gcaggcaucggggagccgggag

SEQ ID NO: 1194895 - RNA, 23 nt, Human
gcaggcaucggggagccgggagc

SEQ ID NO: 1194896 - RNA, 17 nt, Human
gcagugggccuggccag

SEQ ID NO: 1194897 - RNA, 16 nt, Human
gcagugggccuggcca

SEQ ID NO: 1194898 - RNA, 18 nt, Human
gcaggaaauggcugugga

SEQ ID NO: 1194899 - RNA, 15 nt, Human
gcaccacacucagcc

SEQ ID NO: 1194900 - RNA, 17 nt, Human
gcaccacacucagcccu

SEQ ID NO: 1194901 - RNA, 21 nt, Human
gauguguccugauaagcugag

SEQ ID NO: 1194902 - RNA, 21 nt, Human
gauguggaaaagccaagaggc

SEQ ID NO: 1194903 - RNA, 23 nt, Human
gauguggaaaagccaagaggcug

SEQ ID NO: 1194904 - RNA, 22 nt, Human
gauuaagaucucagugguuaag

SEQ ID NO: 1194905 - RNA, 13 nt, Human
gaugcauggagau

SEQ ID NO: 1194906 - RNA, 20 nt, Human
gaugcauggagauagcccca

SEQ ID NO: 1194907 - RNA, 17 nt, Human
gaugcaauguagagggg

SEQ ID NO: 1194908 - RNA, 22 nt, Human
gagguuuguuuagaagaagugu

SEQ ID NO: 1194909 - RNA, 16 nt, Human
gagucccugccuggac

SEQ ID NO: 1194910 - RNA, 19 nt, Human
gagucccugccuggaccag

SEQ ID NO: 1194911 - RNA, 14 nt, Human
gagucccugccauc

SEQ ID NO: 1194912 - RNA, 14 nt, Human
gagucccugccugg

SEQ ID NO: 1194913 - RNA, 15 nt, Human
gagucccugccugga

SEQ ID NO: 1194914 - RNA, 13 nt, Human
gaguuccuagcca

SEQ ID NO: 1194915 - RNA, 15 nt, Human
gaggaugucugggcc

SEQ ID NO: 1194916 - RNA, 13 nt, Human
gaggagggcaggc

SEQ ID NO: 1194917 - RNA, 14 nt, Human
gaggagggcaggca

SEQ ID NO: 1194918 - RNA, 15 nt, Human
gaggagggcaggcau

SEQ ID NO: 1194919 - RNA, 23 nt, Human
gagcucaggaaccgaggcaggga

SEQ ID NO: 1194920 - RNA, 20 nt, Human
gagcuccuuaaggcucuuuu

SEQ ID NO: 1194921 - RNA, 12 nt, Human
gagccugcagag

SEQ ID NO: 1194922 - RNA, 15 nt, Human
gagccugcagagcug

SEQ ID NO: 1194923 - RNA, 13 nt, Human
gaacuauuagagc

SEQ ID NO: 1194924 - RNA, 14 nt, Human
gaaugccuccugca

SEQ ID NO: 1194925 - RNA, 20 nt, Human
gaauaagugccaggauggaa

SEQ ID NO: 1194926 - RNA, 17 nt, Human
gaauaaagaaugaaugg

SEQ ID NO: 1194927 - RNA, 19 nt, Human
gaaggaucccaugagcucc

SEQ ID NO: 1194928 - RNA, 10 nt, Human
gaagcccaga

SEQ ID NO: 1194929 - RNA, 12 nt, Human
gaagcccagaau

SEQ ID NO: 1194930 - RNA, 17 nt, Human
cuuucccaacaccucuu

SEQ ID NO: 1194931 - RNA, 20 nt, Human
cuuuccaaagccaaugugaa

SEQ ID NO: 1194932 - RNA, 17 nt, Human
cuuggagguagcuuuga

SEQ ID NO: 1194933 - RNA, 20 nt, Human
cuuggggacaggggcaggag

SEQ ID NO: 1194934 - RNA, 22 nt, Human
cuuuuuucucugauacagaaaa

SEQ ID NO: 1194935 - RNA, 20 nt, Human
cuuuuuucucugauacagaa

SEQ ID NO: 1194936 - RNA, 19 nt, Human
cuuccaaacaggcucagag

SEQ ID NO: 1194937 - RNA, 15 nt, Human
cuuaaggcucuuuug

SEQ ID NO: 1194938 - RNA, 21 nt, Human
cuguguguguguauguggggg

SEQ ID NO: 1194939 - RNA, 20 nt, Human
cuguguguuuaugugugugu

SEQ ID NO: 1194940 - RNA, 18 nt, Human
cuguguguuuaugugugu

SEQ ID NO: 1194941 - RNA, 20 nt, Human
cuguguguguguaugugggg

SEQ ID NO: 1194942 - RNA, 18 nt, Human
cuguguguguguaugugg

SEQ ID NO: 1194943 - RNA, 16 nt, Human
cuguguguguguaugu

SEQ ID NO: 1194944 - RNA, 15 nt, Human
cuguguguguguaug

SEQ ID NO: 1194945 - RNA, 14 nt, Human
cuguguguguguau

SEQ ID NO: 1194946 - RNA, 18 nt, Human
cuguggccuaaccugccg

SEQ ID NO: 1194947 - RNA, 17 nt, Human
cugugcccacccuccac

SEQ ID NO: 1194948 - RNA, 23 nt, Human
cugugcccacccuccacucuccu

SEQ ID NO: 1194949 - RNA, 14 nt, Human
cuggugguggcucg

SEQ ID NO: 1194950 - RNA, 22 nt, Human
cuggugguggcucgggaggcga

SEQ ID NO: 1194951 - RNA, 12 nt, Human
cuggugguucac

SEQ ID NO: 1194952 - RNA, 20 nt, Human
cuggugguucacucuuggag

SEQ ID NO: 1194953 - RNA, 21 nt, Human
cuggugguucacucuuggagc

SEQ ID NO: 1194954 - RNA, 23 nt, Human
cuggugguucacucuuggagccu

SEQ ID NO: 1194955 - RNA, 13 nt, Human
cugauuguauuua

SEQ ID NO: 1194956 - RNA, 22 nt, Human
cugauacagaaaaguugaauuu

SEQ ID NO: 1194957 - RNA, 15 nt, Human
cugaguuccuagcca

SEQ ID NO: 1194958 - RNA, 16 nt, Human
cugaguuccuagccac

SEQ ID NO: 1194959 - RNA, 17 nt, Human
cugaguuccuagccacc

SEQ ID NO: 1194960 - RNA, 18 nt, Human
cugaguuccuagccaccg

SEQ ID NO: 1194961 - RNA, 17 nt, Human
cugccuggaccagccuc

SEQ ID NO: 1194962 - RNA, 22 nt, Human
cugcgggcuggguguggucucc

SEQ ID NO: 1194963 - RNA, 16 nt, Human
cugccacucaggccca

SEQ ID NO: 1194964 - RNA, 23 nt, Human
cugccacucaggcccaaagccuc

SEQ ID NO: 1194965 - RNA, 12 nt, Human
cugagcaggugu

SEQ ID NO: 1194966 - RNA, 16 nt, Human
cugaauuaugaaacuu

SEQ ID NO: 1194967 - RNA, 20 nt, Human
cugaaauaaacgucuuaaau

SEQ ID NO: 1194968 - RNA, 13 nt, Human
cugaauuaugaaa

SEQ ID NO: 1194969 - RNA, 14 nt, Human
cugaauuaugaaac

SEQ ID NO: 1194970 - RNA, 15 nt, Human
cugaauuaugaaacu

SEQ ID NO: 1194971 - RNA, 14 nt, Human
cucugcccgggagc

SEQ ID NO: 1194972 - RNA, 20 nt, Human
cucugcccgggagcucagga

SEQ ID NO: 1194973 - RNA, 15 nt, Human
cucugauacagaaaa

SEQ ID NO: 1194974 - RNA, 19 nt, Human
cucugaaggguaauuauau

SEQ ID NO: 1194975 - RNA, 14 nt, Human
cuauuguagagcca

SEQ ID NO: 1194976 - RNA, 17 nt, Human
cuauauuuuacauaaau

SEQ ID NO: 1194977 - RNA, 16 nt, Human
cuaucuguuuacagug

SEQ ID NO: 1194978 - RNA, 17 nt, Human
cuaucuguuuacagugu

SEQ ID NO: 1194979 - RNA, 13 nt, Human
cuaugagggccuu

SEQ ID NO: 1194980 - RNA, 15 nt, Human
cuaugagggccuuga

SEQ ID NO: 1194981 - RNA, 17 nt, Human
cuaugagggccuugagu

SEQ ID NO: 1194982 - RNA, 13 nt, Human
cucgagaucccaa

SEQ ID NO: 1194983 - RNA, 21 nt, Human
cucgagaucccaacacugcca

SEQ ID NO: 1194984 - RNA, 22 nt, Human
cucgagaucccaacacugccag

SEQ ID NO: 1194985 - RNA, 23 nt, Human
cucgagaucccaacacugccagc

SEQ ID NO: 1194986 - RNA, 12 nt, Human
cuccuccuagcc

SEQ ID NO: 1194987 - RNA, 13 nt, Human
cuccaccugcucu

SEQ ID NO: 1194988 - RNA, 23 nt, Human
cuccaccaagccuggucagccca

SEQ ID NO: 1194989 - RNA, 21 nt, Human
cuccaaugcuguuaucccugc

SEQ ID NO: 1194990 - RNA, 22 nt, Human
cgagaucccaacacugccagca

SEQ ID NO: 1194991 - RNA, 13 nt, Human
cgagaucccaaca

SEQ ID NO: 1194992 - RNA, 15 nt, Human
cgagaucccaacacu

SEQ ID NO: 1194993 - RNA, 21 nt, Human
cgagaucccaacacugccagc

SEQ ID NO: 1194994 - RNA, 15 nt, Human
ccuugucacgccaga

SEQ ID NO: 1194995 - RNA, 18 nt, Human
ccuugucacgccagacuu

SEQ ID NO: 1194996 - RNA, 15 nt, Human
ccuuccaagagccug

SEQ ID NO: 1194997 - RNA, 16 nt, Human
ccuuccaagagccuga

SEQ ID NO: 1194998 - RNA, 17 nt, Human
ccuuccaagagccugag

SEQ ID NO: 1194999 - RNA, 13 nt, Human
ccuuaaggcucuu

SEQ ID NO: 1195000 - RNA, 16 nt, Human
ccuuaaggcucuuuug

SEQ ID NO: 1195001 - RNA, 18 nt, Human
ccuuaaggcucuuuugua

SEQ ID NO: 1195002 - RNA, 19 nt, Human
ccugaggaagagggacugu

SEQ ID NO: 1195003 - RNA, 15 nt, Human
ccugaggcagguccc

SEQ ID NO: 1195004 - RNA, 14 nt, Human
ccugccacucaggc

SEQ ID NO: 1195005 - RNA, 22 nt, Human
ccugccacucaggcccaaagcc

SEQ ID NO: 1195006 - RNA, 23 nt, Human
ccugccacucaggcccaaagccu

SEQ ID NO: 1195007 - RNA, 14 nt, Human
ccugccagaccccc

SEQ ID NO: 1195008 - RNA, 12 nt, Human
ccugggcaggag

SEQ ID NO: 1195009 - RNA, 14 nt, Human
ccugggcaggaggg

SEQ ID NO: 1195010 - RNA, 12 nt, Human
ccuggucagccc

SEQ ID NO: 1195011 - RNA, 14 nt, Human
ccuggucagcccaa

SEQ ID NO: 1195012 - RNA, 15 nt, Human
ccuggcuccaggcca

SEQ ID NO: 1195013 - RNA, 16 nt, Human
ccuggcuccaggccag

SEQ ID NO: 1195014 - RNA, 17 nt, Human
ccuggcuccaggccagg

SEQ ID NO: 1195015 - RNA, 18 nt, Human
ccugccugguccucacac

SEQ ID NO: 1195016 - RNA, 18 nt, Human
ccucucauuccagaggaa

SEQ ID NO: 1195017 - RNA, 18 nt, Human
ccucuccacucaugugac

SEQ ID NO: 1195018 - RNA, 20 nt, Human
ccgggacaccuaggcuaggg

SEQ ID NO: 1195019 - RNA, 19 nt, Human
ccgggacaccuaggcuagg

SEQ ID NO: 1195020 - RNA, 16 nt, Human
ccggcuuuguggcacu

SEQ ID NO: 1195021 - RNA, 12 nt, Human
ccggguuccagc

SEQ ID NO: 1195022 - RNA, 15 nt, Human
ccggguuccagcacc

SEQ ID NO: 1195023 - RNA, 15 nt, Human
ccgaggcagggaagg

SEQ ID NO: 1195024 - RNA, 13 nt, Human
cccugccagaccc

SEQ ID NO: 1195025 - RNA, 21 nt, Human
cccugccagacccccuggaga

SEQ ID NO: 1195026 - RNA, 13 nt, Human
cccuccaccugcu

SEQ ID NO: 1195027 - RNA, 23 nt, Human
cccuccacucuccucuuccaggc

SEQ ID NO: 1195028 - RNA, 17 nt, Human
cccaccacacccucccu

SEQ ID NO: 1195029 - RNA, 21 nt, Human
cccacaggagguggucuggga

SEQ ID NO: 1195030 - RNA, 16 nt, Human
cccacaggaggugguc

SEQ ID NO: 1195031 - RNA, 18 nt, Human
ccauccuacccccugugc

SEQ ID NO: 1195032 - RNA, 21 nt, Human
cccaaaacaccggguuccagc

SEQ ID NO: 1195033 - RNA, 13 nt, Human
ccaggagacaggu

SEQ ID NO: 1195034 - RNA, 19 nt, Human
ccaggccagggggccaguc

SEQ ID NO: 1195035 - RNA, 16 nt, Human
ccagcauuucccuucc

SEQ ID NO: 1195036 - RNA, 21 nt, Human
ccagcauuucccuuccuuccu

SEQ ID NO: 1195037 - RNA, 18 nt, Human
ccagacccccuggagacu

SEQ ID NO: 1195038 - RNA, 12 nt, Human
ccagacccccug

SEQ ID NO: 1195039 - RNA, 16 nt, Human
ccagacccccuggaga

SEQ ID NO: 1195040 - RNA, 19 nt, Human
ccacucaugugacucuuuc

SEQ ID NO: 1195041 - RNA, 22 nt, Human
ccacucaugugacucuuuccaa

SEQ ID NO: 1195042 - RNA, 20 nt, Human
ccaccugaauaaagaaugaa

SEQ ID NO: 1195043 - RNA, 15 nt, Human
ccacccuccacucuc

SEQ ID NO: 1195044 - RNA, 22 nt, Human
ccaccaagccuggucagcccaa

SEQ ID NO: 1195045 - RNA, 19 nt, Human
ccacacugauccagcccug

SEQ ID NO: 1195046 - RNA, 22 nt, Human
ccacacugauccagcccugagu

SEQ ID NO: 1195047 - RNA, 20 nt, Human
ccaaaccaccagaagcccag

SEQ ID NO: 1195048 - RNA, 13 nt, Human
cauuccagaggaa

SEQ ID NO: 1195049 - RNA, 21 nt, Human
cauucagauaugauucaaaug

SEQ ID NO: 1195050 - RNA, 14 nt, Human
cauuccagaggaag

SEQ ID NO: 1195051 - RNA, 20 nt, Human
cauucaaauguauuacagug

SEQ ID NO: 1195052 - RNA, 12 nt, Human
cauucuuuccca

SEQ ID NO: 1195053 - RNA, 14 nt, Human
cauucuuucccaac

SEQ ID NO: 1195054 - RNA, 14 nt, Human
cauuccugaacagg

SEQ ID NO: 1195055 - RNA, 17 nt, Human
ccaaaccaccagaagcc

SEQ ID NO: 1195056 - RNA, 14 nt, Human
caugugacucuuuc

SEQ ID NO: 1195057 - RNA, 16 nt, Human
caugugacucuuucca

SEQ ID NO: 1195058 - RNA, 17 nt, Human
caugugacucuuuccaa

SEQ ID NO: 1195059 - RNA, 16 nt, Human
caugcuguucaugaaa

SEQ ID NO: 1195060 - RNA, 18 nt, Human
caugcuguucaugaaaga

SEQ ID NO: 1195061 - RNA, 20 nt, Human
caugcuguucaugaaagauu

SEQ ID NO: 1195062 - RNA, 15 nt, Human
caugcuguucaugaa

SEQ ID NO: 1195063 - RNA, 19 nt, Human
caugaguuggcugggaaua

SEQ ID NO: 1195064 - RNA, 23 nt, Human
caugagcuccuuaaggcucuuuu

SEQ ID NO: 1195065 - RNA, 18 nt, Human
caugagauaauaugcaga

SEQ ID NO: 1195066 - RNA, 14 nt, Human
caugaaagauucaa

SEQ ID NO: 1195067 - RNA, 18 nt, Human
cauccuacccccugugcc

SEQ ID NO: 1195068 - RNA, 19 nt, Human
cauccuacccccugugccu

SEQ ID NO: 1195069 - RNA, 15 nt, Human
cauccuacccccugu

SEQ ID NO: 1195070 - RNA, 21 nt, Human
caucauguuuacagaggacag

SEQ ID NO: 1195071 - RNA, 19 nt, Human
caucauguuuacagaggac

SEQ ID NO: 1195072 - RNA, 13 nt, Human
caucauguuuaca

SEQ ID NO: 1195073 - RNA, 21 nt, Human
cauccagagucccugccugga

SEQ ID NO: 1195074 - RNA, 13 nt, Human
cauccagaguccc

SEQ ID NO: 1195075 - RNA, 17 nt, Human
cauccagagucccugcc

SEQ ID NO: 1195076 - RNA, 18 nt, Human
cauccagagucccugccu

SEQ ID NO: 1195077 - RNA, 20 nt, Human
cauccagagucccugccugg

SEQ ID NO: 1195078 - RNA, 12 nt, Human
cagguguucuuc

SEQ ID NO: 1195079 - RNA, 12 nt, Human
cagguccccaga

SEQ ID NO: 1195080 - RNA, 13 nt, Human
cagguccccagac

SEQ ID NO: 1195081 - RNA, 18 nt, Human
cagguccccagcuuuggc

SEQ ID NO: 1195082 - RNA, 12 nt, Human
caguauguggaa

SEQ ID NO: 1195083 - RNA, 17 nt, Human
cagucauucagauauga

SEQ ID NO: 1195084 - RNA, 20 nt, Human
cagucauucagauaugauuc

SEQ ID NO: 1195085 - RNA, 20 nt, Human
cagucccugaggcagguccc

SEQ ID NO: 1195086 - RNA, 23 nt, Human
cagucccugaggcagguccccag

SEQ ID NO: 1195087 - RNA, 14 nt, Human
cagucccugaggca

SEQ ID NO: 1195088 - RNA, 22 nt, Human
cagucuuuaaucugagaggcca

SEQ ID NO: 1195089 - RNA, 13 nt, Human
cagggaaggaucc

SEQ ID NO: 1195090 - RNA, 18 nt, Human
cagggaaggaucccauga

SEQ ID NO: 1195091 - RNA, 14 nt, Human
caggggcaggagga

SEQ ID NO: 1195092 - RNA, 22 nt, Human
cagggggccagucccugaggca

SEQ ID NO: 1195093 - RNA, 11 nt, Human
caggcucagag

SEQ ID NO: 1195094 - RNA, 15 nt, Human
caggcucagagggug

SEQ ID NO: 1195095 - RNA, 20 nt, Human
caggcaucggggagccggga

SEQ ID NO: 1195096 - RNA, 21 nt, Human
caggcaucggggagccgggag

SEQ ID NO: 1195097 - RNA, 21 nt, Human
caggauauucucacagcucca

SEQ ID NO: 1195098 - RNA, 21 nt, Human
caggcccccagaaccccuggc

SEQ ID NO: 1195099 - RNA, 21 nt, Human
caggccagggggccagucccu

SEQ ID NO: 1195100 - RNA, 21 nt, Human
caggagucccugccaucaugu

SEQ ID NO: 1195101 - RNA, 15 nt, Human
caggagucccugcca

SEQ ID NO: 1195102 - RNA, 14 nt, Human
caggagucccugcc

SEQ ID NO: 1195103 - RNA, 23 nt, Human
caggagacagguuagcugcuccc

SEQ ID NO: 1195104 - RNA, 15 nt, Human
caggaaccgaggcag

SEQ ID NO: 1195105 - RNA, 17 nt, Human
caggaaccgaggcaggg

SEQ ID NO: 1195106 - RNA, 18 nt, Human
caggaaccgaggcaggga

SEQ ID NO: 1195107 - RNA, 23 nt, Human
cagccucuccacucaugugacuc

SEQ ID NO: 1195108 - RNA, 23 nt, Human
cagccuggcuguggccuaaccug

SEQ ID NO: 1195109 - RNA, 21 nt, Human
cagccuccauccuacccccug

SEQ ID NO: 1195110 - RNA, 18 nt, Human
cagccuccauccuacccc

SEQ ID NO: 1195111 - RNA, 18 nt, Human
cagcccugaguuccuagc

SEQ ID NO: 1195112 - RNA, 19 nt, Human
cagcccugaguuccuagcc

SEQ ID NO: 1195113 - RNA, 21 nt, Human
cagcccugaguuccuagccac

SEQ ID NO: 1195114 - RNA, 18 nt, Human
cagcccucauuggcucuu

SEQ ID NO: 1195115 - RNA, 15 nt, Human
cagcauuucccuucc

SEQ ID NO: 1195116 - RNA, 16 nt, Human
cagcccaccuggcuuu

SEQ ID NO: 1195117 - RNA, 16 nt, Human
cagcccaaaccaccag

SEQ ID NO: 1195118 - RNA, 19 nt, Human
cagcccaaaccaccagaag

SEQ ID NO: 1195119 - RNA, 20 nt, Human
cagcccaaaccaccagaagc

SEQ ID NO: 1195120 - RNA, 21 nt, Human
cagcccaaaccaccagaagcc

SEQ ID NO: 1195121 - RNA, 23 nt, Human
cagcccaaaccaccagaagccca

SEQ ID NO: 1195122 - RNA, 22 nt, Human
cagaggacaguauuugugggga

SEQ ID NO: 1195123 - RNA, 22 nt, Human
cagagcagugggccuggccagc

SEQ ID NO: 1195124 - RNA, 15 nt, Human
cagagcagugggccu

SEQ ID NO: 1195125 - RNA, 17 nt, Human
cagagcagugggccugg

SEQ ID NO: 1195126 - RNA, 20 nt, Human
cagagcagugggccuggcca

SEQ ID NO: 1195127 - RNA, 21 nt, Human
cagagcagugggccuggccag

SEQ ID NO: 1195128 - RNA, 18 nt, Human
cagagucccugccuggac

SEQ ID NO: 1195129 - RNA, 14 nt, Human
cagagucccugccu

SEQ ID NO: 1195130 - RNA, 12 nt, Human
cagagaaaaagg

SEQ ID NO: 1195131 - RNA, 17 nt, Human
cagagaaaaagggaggg

SEQ ID NO: 1195132 - RNA, 18 nt, Human
cagagaaaaagggagggg

SEQ ID NO: 1195133 - RNA, 12 nt, Human
cagacuucccac

SEQ ID NO: 1195134 - RNA, 22 nt, Human
cagacuucccacggcuccucga

SEQ ID NO: 1195135 - RNA, 15 nt, Human
cagacccccuggaga

SEQ ID NO: 1195136 - RNA, 14 nt, Human
cagaaugaggcugc

SEQ ID NO: 1195137 - RNA, 15 nt, Human
cagaaugaggcugcu

SEQ ID NO: 1195138 - RNA, 11 nt, Human
cagaagcccag

SEQ ID NO: 1195139 - RNA, 12 nt, Human
cagaagcccaga

SEQ ID NO: 1195140 - RNA, 14 nt, Human
cagaagcccagaau

SEQ ID NO: 1195141 - RNA, 23 nt, Human
cagaaccccuggcuccaggccag

SEQ ID NO: 1195142 - RNA, 17 nt, Human
cagaaaaguugaauuuu

SEQ ID NO: 1195143 - RNA, 20 nt, Human
cagaaaaguugaauuuuaca

SEQ ID NO: 1195144 - RNA, 22 nt, Human
cagaaaaguugaauuuuacaug

SEQ ID NO: 1195145 - RNA, 22 nt, Human
cacucaugugacucuuuccaac

SEQ ID NO: 1195146 - RNA, 16 nt, Human
cacucaugugacucuu

SEQ ID NO: 1195147 - RNA, 13 nt, Human
cacuccuccuagc

SEQ ID NO: 1195148 - RNA, 18 nt, Human
cacuccuccuagccaccc

SEQ ID NO: 1195149 - RNA, 19 nt, Human
cacguguggccuguucuuc

SEQ ID NO: 1195150 - RNA, 16 nt, Human
cacguaaugaaacuug

SEQ ID NO: 1195151 - RNA, 19 nt, Human
cacguaaugaaacuuggau

SEQ ID NO: 1195152 - RNA, 20 nt, Human
cacggcuccucgagauccca

SEQ ID NO: 1195153 - RNA, 22 nt, Human
cacggcuccucgagaucccaac

SEQ ID NO: 1195154 - RNA, 17 nt, Human
cacuggccccugagauc

SEQ ID NO: 1195155 - RNA, 18 nt, Human
cacugcuaagaauauuug

SEQ ID NO: 1195156 - RNA, 14 nt, Human
cacugauccagccc

SEQ ID NO: 1195157 - RNA, 15 nt, Human
cacugauccagcccu

SEQ ID NO: 1195158 - RNA, 16 nt, Human
cacugauccagcccug

SEQ ID NO: 1195159 - RNA, 14 nt, Human
caccggggccuggg

SEQ ID NO: 1195160 - RNA, 21 nt, Human
caccggggccugggcaggagg

SEQ ID NO: 1195161 - RNA, 22 nt, Human
caccggggccugggcaggaggg

SEQ ID NO: 1195162 - RNA, 17 nt, Human
caccgccuccuacagcc

SEQ ID NO: 1195163 - RNA, 18 nt, Human
gaccuuuccugaggaaga

SEQ ID NO: 1195164 - RNA, 12 nt, Human
gcaggaggaagg

SEQ ID NO: 1195165 - RNA, 21 nt, Human
gccucucauuccagaggaagg

SEQ ID NO: 1195166 - RNA, 21 nt, Human
gcggcuggacuuggagguagc

SEQ ID NO: 1195167 - RNA, 17 nt, Dobrava virus
cauugauuugcuuccug

SEQ ID NO: 1195168 - RNA, 14 nt, Dobrava virus
uuuauguaauccca

SEQ ID NO: 1195169 - RNA, 14 nt, Dobrava virus
caacuaccuaccuc

SEQ ID NO: 1195170 - RNA, 15 nt, Dobrava virus
auauaucaguuuaaa

SEQ ID NO: 1195171 - RNA, 15 nt, Dobrava virus
uuuccuuucuuuacu

SEQ ID NO: 1195172 - RNA, 20 nt, Dobrava virus
auaucaguuuaaacuucugu

SEQ ID NO: 1195173 - RNA, 18 nt, Dobrava virus
gaauuauuauacuacuga

SEQ ID NO: 1195174 - RNA, 16 nt, Dobrava virus
uuuucauuuuccggag

SEQ ID NO: 1195175 - RNA, 22 nt, Dobrava virus
cuuaagugacuuuuuucuguau

SEQ ID NO: 1195176 - RNA, 12 nt, Dobrava virus
accuaccucaaa

SEQ ID NO: 1195177 - RNA, 23 nt, Dobrava virus
guuuauauuuauuuucauuuucc

SEQ ID NO: 1195178 - RNA, 17 nt, Dobrava virus
cuaacaucuuauuuccu

SEQ ID NO: 1195179 - RNA, 21 nt, Dobrava virus
uacugauuggugaauguauuu

SEQ ID NO: 1195180 - RNA, 19 nt, Dobrava virus
uuaaacuucuguacuuauu

SEQ ID NO: 1195181 - RNA, 15 nt, Dobrava virus
cuuucuuuacuaaca

SEQ ID NO: 1195182 - RNA, 21 nt, Dobrava virus
aucuaaaaaaaauaacuccuu

SEQ ID NO: 1195183 - RNA, 21 nt, Dobrava virus
cuuucuuuacuaacaacaacu

SEQ ID NO: 1195184 - RNA, 15 nt, Dobrava virus
uauuucuauaucuug

SEQ ID NO: 1195185 - RNA, 18 nt, Dobrava virus
uuucauuugaucuguacu

SEQ ID NO: 1195186 - RNA, 12 nt, Dobrava virus
cuuucaacaaug

SEQ ID NO: 1195187 - RNA, 14 nt, Dobrava virus
guacuuauuaacuu

SEQ ID NO: 1195188 - RNA, 21 nt, Dobrava virus
ucauuugaucuguacuaacau

SEQ ID NO: 1195189 - RNA, 21 nt, Dobrava virus
ugauuugcuuccugaaugucu

SEQ ID NO: 1195190 - RNA, 14 nt, Dobrava virus
guauauagcuuuca

SEQ ID NO: 1195191 - RNA, 23 nt, Dobrava virus
uauagcuuucaacaaugcaauuu

SEQ ID NO: 1195192 - RNA, 19 nt, Dobrava virus
auuuucauuuuccggagca

SEQ ID NO: 1195193 - RNA, 16 nt, Dobrava virus
acaacuaccuaccuca

SEQ ID NO: 1195194 - RNA, 19 nt, Dobrava virus
cauuaucccaugcuuuaug

SEQ ID NO: 1195195 - RNA, 17 nt, Dobrava virus
auauuuauuuucauuuu

SEQ ID NO: 1195196 - RNA, 20 nt, Dobrava virus
aacuacuaccucauugauuu

SEQ ID NO: 1195197 - RNA, 23 nt, Dobrava virus
uuuacauuuaucaaccuaguuau

SEQ ID NO: 1195198 - RNA, 22 nt, Dobrava virus
ggaauuauuauacuacugauug

SEQ ID NO: 1195199 - RNA, 22 nt, Dobrava virus
cuaccucaacaacuacuaccuc

SEQ ID NO: 1195200 - RNA, 18 nt, Dobrava virus
cuuaagugacuuuuuucu

SEQ ID NO: 1195201 - RNA, 14 nt, Dobrava virus
cauugauuugcuuc

SEQ ID NO: 1195202 - RNA, 17 nt, Dobrava virus
uuuguugcauuauccca

SEQ ID NO: 1195203 - RNA, 14 nt, Dobrava virus
acuaccuaccucaa

SEQ ID NO: 1195204 - RNA, 22 nt, Dobrava virus
uacuacugauuggugaauguau

SEQ ID NO: 1195205 - RNA, 23 nt, Dobrava virus
agcuuguccuuguauauagcuuu

SEQ ID NO: 1195206 - RNA, 22 nt, Dobrava virus
gcugcauuaacugcuuggacug

SEQ ID NO: 1195207 - RNA, 16 nt, Dobrava virus
ugacuuuuuucuguau

SEQ ID NO: 1195208 - RNA, 12 nt, Dobrava virus
cuacuaccucau

SEQ ID NO: 1195209 - RNA, 22 nt, Dobrava virus
ucauuuuccggagcauacuacu

SEQ ID NO: 1195210 - RNA, 21 nt, Dobrava virus
aucuguacuaacaucuuauuu

SEQ ID NO: 1195211 - RNA, 18 nt, Dobrava virus
auuaacuuuuuacauuua

SEQ ID NO: 1195212 - RNA, 18 nt, Dobrava virus
aucccaugcuuuauguaa

SEQ ID NO: 1195213 - RNA, 13 nt, Dobrava virus
acuacuaccucau

SEQ ID NO: 1195214 - RNA, 19 nt, Dobrava virus
acaacuaccuaccucaaaa

SEQ ID NO: 1195215 - RNA, 21 nt, Dobrava virus
uuucuguauauauggauguag

SEQ ID NO: 1195216 - RNA, 16 nt, Dobrava virus
auauuuauuuucauuu

SEQ ID NO: 1195217 - RNA, 17 nt, Dobrava virus
aaauaacuccuucauua

SEQ ID NO: 1195218 - RNA, 20 nt, Dobrava virus
guuaucuaaaaaaaauaacu

SEQ ID NO: 1195219 - RNA, 14 nt, Dobrava virus
cuaccucaacaacu

SEQ ID NO: 1195220 - RNA, 11 nt, Dobrava virus
cggagcauacu

SEQ ID NO: 1195221 - RNA, 17 nt, Dobrava virus
cugauuggugaauguau

SEQ ID NO: 1195222 - RNA, 11 nt, Dobrava virus
acuaccucaac

SEQ ID NO: 1195223 - RNA, 19 nt, Dobrava virus
cauuugaucuguacuaaca

SEQ ID NO: 1195224 - RNA, 12 nt, Dobrava virus
uccggagcauac

SEQ ID NO: 1195225 - RNA, 16 nt, Dobrava virus
uauagcuuucaacaau

SEQ ID NO: 1195226 - RNA, 21 nt, Dobrava virus
uagcuuucaacaaugcaauuu

SEQ ID NO: 1195227 - RNA, 17 nt, Dobrava virus
auuacuauaaaccuuag

SEQ ID NO: 1195228 - RNA, 23 nt, Dobrava virus
ucauugauuugcuuccugaaugu

SEQ ID NO: 1195229 - RNA, 12 nt, Dobrava virus
acuauaaaccuu

SEQ ID NO: 1195230 - RNA, 21 nt, Dobrava virus
uucauuuuccggagcauacua

SEQ ID NO: 1195231 - RNA, 13 nt, Dobrava virus
acuaccucaacaa

SEQ ID NO: 1195232 - RNA, 14 nt, Dobrava virus
auuuucauuuuccg

SEQ ID NO: 1195233 - RNA, 15 nt, Dobrava virus
caucuuauuuccuuc

SEQ ID NO: 1195234 - RNA, 12 nt, Dobrava virus
cauuuuccggag

SEQ ID NO: 1195235 - RNA, 16 nt, Dobrava virus
caguuuaaacuucugu

SEQ ID NO: 1195236 - RNA, 13 nt, Dobrava virus
cuaccuaccucaa

SEQ ID NO: 1195237 - RNA, 18 nt, Dobrava virus
cauuuaucaaccuaguua

SEQ ID NO: 1195238 - RNA, 18 nt, Dobrava virus
cuacugauuggugaaugu

SEQ ID NO: 1195239 - RNA, 13 nt, Dobrava virus
cuaacaucuuauu

SEQ ID NO: 1195240 - RNA, 15 nt, Dobrava virus
acaacuacuaccuca

SEQ ID NO: 1195241 - RNA, 18 nt, Dobrava virus
guuuauauuuauuuucau

SEQ ID NO: 1195242 - RNA, 18 nt, Dobrava virus
cuuauuuccuucuuuucc

SEQ ID NO: 1195243 - RNA, 22 nt, Dobrava virus
cugauuggugaauguauuugca

SEQ ID NO: 1195244 - RNA, 16 nt, Dobrava virus
gaauguauuugcacua

SEQ ID NO: 1195245 - RNA, 20 nt, Dobrava virus
ucuuuagggagucuacuacu

SEQ ID NO: 1195246 - RNA, 23 nt, Dobrava virus
auauauggauguagauuucauuu

SEQ ID NO: 1195247 - RNA, 20 nt, Dobrava virus
ucuugcggagcauacuacua

SEQ ID NO: 1195248 - RNA, 21 nt, Dobrava virus
ucuuuagggagucuacuacua

SEQ ID NO: 1195249 - RNA, 20 nt, Dobrava virus
cuggaauuauuauacuacug

SEQ ID NO: 1195250 - RNA, 16 nt, Dobrava virus
aacaucuuauuuccuu

SEQ ID NO: 1195251 - RNA, 19 nt, Dobrava virus
uuuccggagcauacuacua

SEQ ID NO: 1195252 - RNA, 23 nt, Human
agucugagagaggccauucuuuc

SEQ ID NO: 1195253 - RNA, 16 nt, Human
agucugagagaggcca

SEQ ID NO: 1195254 - RNA, 21 nt, Human
auccagagucccugccuggac

SEQ ID NO: 1195255 - RNA, 20 nt, Human
auccagagucccugccugga

SEQ ID NO: 1195256 - RNA, 19 nt, Human
auccagagucccugccugg

SEQ ID NO: 1195257 - RNA, 16 nt, Human
augaugggucaguugu

SEQ ID NO: 1195258 - RNA, 18 nt, Human
agcuccuuaaggcucuuu

SEQ ID NO: 1195259 - RNA, 17 nt, Human
agcuccuuaaggcucuu

SEQ ID NO: 1195260 - RNA, 16 nt, Human
agcuccuuaaggcucu

SEQ ID NO: 1195261 - RNA, 19 nt, Human
agcuaauucuuugaccugu

SEQ ID NO: 1195262 - RNA, 16 nt, Human
aggaaccgaggcaggg

SEQ ID NO: 1195263 - RNA, 22 nt, Human
aggaacugcugggcuuggcagc

SEQ ID NO: 1195264 - RNA, 10 nt, Human
agagggcugc

SEQ ID NO: 1195265 - RNA, 18 nt, Human
aagagaagggcagggcug

SEQ ID NO: 1195266 - RNA, 23 nt, Human
acagaggacaguauuugugggga

SEQ ID NO: 1195267 - RNA, 11 nt, Human
aauugugaugu

SEQ ID NO: 1195268 - RNA, 14 nt, Human
aauugugauguguc

SEQ ID NO: 1195269 - RNA, 15 nt, Human
aauugugaugugucc

SEQ ID NO: 1195270 - RNA, 14 nt, Human
accaucucuuuacc

SEQ ID NO: 1195271 - RNA, 22 nt, Human
ggcgaagcguuguccucagccc

SEQ ID NO: 1195272 - RNA, 17 nt, Human
ggcccugugccuuggug

SEQ ID NO: 1195273 - RNA, 15 nt, Human
ggcacuggggcaggg

SEQ ID NO: 1195274 - RNA, 22 nt, Human
ggcauccagagucccugccugg

SEQ ID NO: 1195275 - RNA, 19 nt, Human
ggccaguggcuggaucugu

SEQ ID NO: 1195276 - RNA, 13 nt, Human
ggaugucugggcc

SEQ ID NO: 1195277 - RNA, 13 nt, Human
ggcacagccuggc

SEQ ID NO: 1195278 - RNA, 12 nt, Human
ggcacagccugg

SEQ ID NO: 1195279 - RNA, 14 nt, Human
aaaagggaggggga

SEQ ID NO: 1195280 - RNA, 14 nt, Human
gggaugucucucau

SEQ ID NO: 1195281 - RNA, 19 nt, Human
gggagaaugucaguaugug

SEQ ID NO: 1195282 - RNA, 22 nt, Human
gggagaaugucaguauguggaa

SEQ ID NO: 1195283 - RNA, 22 nt, Human
gggcccuggugguggcucggga

SEQ ID NO: 1195284 - RNA, 18 nt, Human
gggcucagagugggguag

SEQ ID NO: 1195285 - RNA, 13 nt, Human
ggguggggagaga

SEQ ID NO: 1195286 - RNA, 23 nt, Human
ggguguccugcaccggggccugg

SEQ ID NO: 1195287 - RNA, 16 nt, Human
gguaggaacugcuggg

SEQ ID NO: 1195288 - RNA, 21 nt, Human
ggugcuucuaguucugccagg

SEQ ID NO: 1195289 - RNA, 20 nt, Human
ggucuguguguguguaugug

SEQ ID NO: 1195290 - RNA, 21 nt, Human
ggucuguguguguguaugugg

SEQ ID NO: 1195291 - RNA, 11 nt, Human
ggucugugugu

SEQ ID NO: 1195292 - RNA, 17 nt, Human
ggucuguguguguguau

SEQ ID NO: 1195293 - RNA, 16 nt, Human
guaaauuuaugugaug

SEQ ID NO: 1195294 - RNA, 17 nt, Human
guaaauuuaugugaugg

SEQ ID NO: 1195295 - RNA, 22 nt, Human
gcugcuccccacgucagcuggg

SEQ ID NO: 1195296 - RNA, 13 nt, Human
gcugcuccccacg

SEQ ID NO: 1195297 - RNA, 14 nt, Human
gcugaggccucuca

SEQ ID NO: 1195298 - RNA, 18 nt, Human
gcuccucgagaucccaac

SEQ ID NO: 1195299 - RNA, 14 nt, Human
ggaacugcugggcu

SEQ ID NO: 1195300 - RNA, 15 nt, Human
ggaacugcugggcuu

SEQ ID NO: 1195301 - RNA, 20 nt, Human
gcuguagacauuugcuauga

SEQ ID NO: 1195302 - RNA, 13 nt, Human
gcuggaucuguga

SEQ ID NO: 1195303 - RNA, 19 nt, Human
gcuuuccucaucaggccau

SEQ ID NO: 1195304 - RNA, 22 nt, Human
gcggcugggaggagggcaggca

SEQ ID NO: 1195305 - RNA, 19 nt, Human
gcggcugggaggagggcag

SEQ ID NO: 1195306 - RNA, 18 nt, Human
gcggcugggaggagggca

SEQ ID NO: 1195307 - RNA, 17 nt, Human
gcggcugggaggagggc

SEQ ID NO: 1195308 - RNA, 14 nt, Human
gcggcugggaggag

SEQ ID NO: 1195309 - RNA, 14 nt, Human
gccaguggcuggau

SEQ ID NO: 1195310 - RNA, 23 nt, Human
gccaguggcuggaucugugaggg

SEQ ID NO: 1195311 - RNA, 14 nt, Human
gccaggauggaaug

SEQ ID NO: 1195312 - RNA, 20 nt, Human
gcaccggggccugggcagga

SEQ ID NO: 1195313 - RNA, 16 nt, Human
gaguccaucagccucc

SEQ ID NO: 1195314 - RNA, 15 nt, Human
gaguccaucagccuc

SEQ ID NO: 1195315 - RNA, 14 nt, Human
gaguccaucagccu

SEQ ID NO: 1195316 - RNA, 13 nt, Human
gaguccaucagcc

SEQ ID NO: 1195317 - RNA, 18 nt, Human
gagugaggaugucugggc

SEQ ID NO: 1195318 - RNA, 15 nt, Human
gaguuuagggugggg

SEQ ID NO: 1195319 - RNA, 14 nt, Human
gaguuuaggguggg

SEQ ID NO: 1195320 - RNA, 16 nt, Human
gaucccaacacugcca

SEQ ID NO: 1195321 - RNA, 12 nt, Human
gaucccaacacu

SEQ ID NO: 1195322 - RNA, 19 nt, Human
gagcuggggaugucucuca

SEQ ID NO: 1195323 - RNA, 19 nt, Human
gaagugugggucugugugu

SEQ ID NO: 1195324 - RNA, 17 nt, Human
gaagugugggucugugu

SEQ ID NO: 1195325 - RNA, 18 nt, Human
gaagugugggucugugug

SEQ ID NO: 1195326 - RNA, 15 nt, Human
gaaggcuauggggau

SEQ ID NO: 1195327 - RNA, 19 nt, Human
gaagggcagggcugaggcc

SEQ ID NO: 1195328 - RNA, 16 nt, Human
gacagguuagcugcuc

SEQ ID NO: 1195329 - RNA, 15 nt, Human
gacaguauuuguggg

SEQ ID NO: 1195330 - RNA, 18 nt, Human
cuuauuggcagcucuacu

SEQ ID NO: 1195331 - RNA, 17 nt, Human
cugccaucauguuuaca

SEQ ID NO: 1195332 - RNA, 22 nt, Human
cugccaucauguuuacagagga

SEQ ID NO: 1195333 - RNA, 23 nt, Human
cugccaucauguuuacagaggac

SEQ ID NO: 1195334 - RNA, 22 nt, Human
cuggggaugucucucaugacca

SEQ ID NO: 1195335 - RNA, 24 nt, Human
cagccccgcguggaacucgugucu

SEQ ID NO: 1195336 - RNA, 24 nt, Human
cagccucuccacucaugugacucu

SEQ ID NO: 1195337 - RNA, 15 nt, Human
caguauuugugggga

SEQ ID NO: 1195338 - RNA, 22 nt, Human
cacugccagcauuucccuuccu

SEQ ID NO: 1195339 - RNA, 18 nt, Human
cacugccagcauuucccu

SEQ ID NO: 1195340 - RNA, 15 nt, Human
caaacaggcucagag

SEQ ID NO: 1195341 - RNA, 14 nt, Human
caaacaggcucaga

SEQ ID NO: 1195342 - RNA, 22 nt, Human
auuuguggggagggauuugggg

SEQ ID NO: 1195343 - RNA, 16 nt, Human
auuugcuaugagcugg

SEQ ID NO: 1195344 - RNA, 20 nt, Human
auuugcuaugagcuggggau

SEQ ID NO: 1195345 - RNA, 19 nt, Human
auucuuucccaacaccucu

SEQ ID NO: 1195346 - RNA, 16 nt, Human
auucuuucccaacacc

SEQ ID NO: 1195347 - RNA, 22 nt, Human
cccugugccuugucacgccaga

SEQ ID NO: 1195348 - RNA, 20 nt, Human
cccugugccuugucacgcca

SEQ ID NO: 1195349 - RNA, 15 nt, Human
cccugugccuuguca

SEQ ID NO: 1195350 - RNA, 24 nt, Human
cccugugccuuggugugcuguauc

SEQ ID NO: 1195351 - RNA, 14 nt, Human
ccugacucucagca

SEQ ID NO: 1195352 - RNA, 14 nt, Human
cccgggagcucagg

SEQ ID NO: 1195353 - RNA, 14 nt, Human
ccccgacuuuuguu

SEQ ID NO: 1195354 - RNA, 12 nt, Human
ccaugagcuccu

SEQ ID NO: 1195355 - RNA, 22 nt, Human
ccagagucccugccuggaccag

SEQ ID NO: 1195356 - RNA, 19 nt, Human
ccagagucccugccuggac

SEQ ID NO: 1195357 - RNA, 18 nt, Human
ccagagucccugccugga

SEQ ID NO: 1195358 - RNA, 17 nt, Human
ccagagucccugccugg

SEQ ID NO: 1195359 - RNA, 16 nt, Human
ccagagucccugccug

SEQ ID NO: 1195360 - RNA, 23 nt, Human
cggcuccucgagaucccaacacu

SEQ ID NO: 1195361 - RNA, 21 nt, Human
cgugucuggcacagccuggcu

SEQ ID NO: 1195362 - RNA, 14 nt, Human
cgugucuggcacag

SEQ ID NO: 1195363 - RNA, 21 nt, Human
cuaaccugccgagaguccauc

SEQ ID NO: 1195364 - RNA, 19 nt, Human
cuaaccugccgagagucca

SEQ ID NO: 1195365 - RNA, 12 nt, Human
cuaaccugccga

SEQ ID NO: 1195366 - RNA, 14 nt, Human
cucccuccucugcc

SEQ ID NO: 1195367 - RNA, 13 nt, Human
cucccuccucugc

SEQ ID NO: 1195368 - RNA, 16 nt, Human
cucaucuuucuuccaa

SEQ ID NO: 1195369 - RNA, 19 nt, Human
gucucccuccucugcccgg

SEQ ID NO: 1195370 - RNA, 19 nt, Human
gucuggcacagccuggcug

SEQ ID NO: 1195371 - RNA, 17 nt, Human
gucuggcacagccuggc

SEQ ID NO: 1195372 - RNA, 17 nt, Human
gucaguauguggaagug

SEQ ID NO: 1195373 - RNA, 21 nt, Human
gucaguauguggaaguguggg

SEQ ID NO: 1195374 - RNA, 13 nt, Human
gucaguuguauca

SEQ ID NO: 1195375 - RNA, 12 nt, Human
aaauugugaugu

SEQ ID NO: 1195376 - RNA, 15 nt, Human
aaauugugauguguc

SEQ ID NO: 1195377 - RNA, 12 nt, Human
aaauuuauguga

SEQ ID NO: 1195378 - RNA, 15 nt, Human
aaauuuaugugaugg

SEQ ID NO: 1195379 - RNA, 22 nt, Human
guggccuaaccugccgagaguc

SEQ ID NO: 1195380 - RNA, 21 nt, Human
guggccuaaccugccgagagu

SEQ ID NO: 1195381 - RNA, 14 nt, Human
gugugggucugugu

SEQ ID NO: 1195382 - RNA, 20 nt, Human
gugugucacccuuaggccag

SEQ ID NO: 1195383 - RNA, 13 nt, Human
guguguauguggg

SEQ ID NO: 1195384 - RNA, 15 nt, Human
guguguauguggggg

SEQ ID NO: 1195385 - RNA, 19 nt, Human
gugggguagguugggagaa

SEQ ID NO: 1195386 - RNA, 16 nt, Human
gugugugggagugugu

SEQ ID NO: 1195387 - RNA, 14 nt, Human
aaggcucuuuugua

SEQ ID NO: 1195388 - RNA, 15 nt, Human
uacccccugugccuu

SEQ ID NO: 1195389 - RNA, 13 nt, Human
uaccucuuggcug

SEQ ID NO: 1195390 - RNA, 19 nt, Human
uaauuuaaaauugugaugu

SEQ ID NO: 1195391 - RNA, 20 nt, Human
uaauuuaaaauugugaugug

SEQ ID NO: 1195392 - RNA, 20 nt, Human
uaugccaccugaauaaagaa

SEQ ID NO: 1195393 - RNA, 21 nt, Human
uaugguaggaacugcugggcu

SEQ ID NO: 1195394 - RNA, 15 nt, Human
uaucagcacgugugg

SEQ ID NO: 1195395 - RNA, 14 nt, Human
uaucagcacgugug

SEQ ID NO: 1195396 - RNA, 21 nt, Human
uagacauuugcuaugagcugg

SEQ ID NO: 1195397 - RNA, 14 nt, Human
uagaagaagugugu

SEQ ID NO: 1195398 - RNA, 16 nt, Human
aauuccacacccucac

SEQ ID NO: 1195399 - RNA, 20 nt, Human
uccauccuacccccugugcc

SEQ ID NO: 1195400 - RNA, 16 nt, Human
uccauccuacccccug

SEQ ID NO: 1195401 - RNA, 23 nt, Human
acucgugucuggcacagccuggc

SEQ ID NO: 1195402 - RNA, 22 nt, Human
acucgugucuggcacagccugg

SEQ ID NO: 1195403 - RNA, 13 nt, Human
uccucuccugucu

SEQ ID NO: 1195404 - RNA, 22 nt, Human
uccucugcccgggagcucagga

SEQ ID NO: 1195405 - RNA, 16 nt, Human
uccucugcccgggagc

SEQ ID NO: 1195406 - RNA, 18 nt, Human
uaugugggggucugugug

SEQ ID NO: 1195407 - RNA, 19 nt, Human
uaugugggggucugugugu

SEQ ID NO: 1195408 - RNA, 20 nt, Human
uaugugggggucuguguguu

SEQ ID NO: 1195409 - RNA, 20 nt, Human
ucggggagccgggagccuga

SEQ ID NO: 1195410 - RNA, 16 nt, Human
acuggggcaggggccg

SEQ ID NO: 1195411 - RNA, 14 nt, Human
ucuaguucugccag

SEQ ID NO: 1195412 - RNA, 15 nt, Human
ucuaccucuuggcug

SEQ ID NO: 1195413 - RNA, 22 nt, Human
ucuggcacagccuggcuguggc

SEQ ID NO: 1195414 - RNA, 23 nt, Human
ucuuggggaguuuaggguggggg

SEQ ID NO: 1195415 - RNA, 22 nt, Human
ucuuggggaguuuagggugggg

SEQ ID NO: 1195416 - RNA, 17 nt, Human
agagacgggcccuggug

SEQ ID NO: 1195417 - RNA, 21 nt, Human
ugacccucaucuuucuuccaa

SEQ ID NO: 1195418 - RNA, 17 nt, Human
agcauuucccuuccuuc

SEQ ID NO: 1195419 - RNA, 21 nt, Human
ugauagaaggcuauggggaua

SEQ ID NO: 1195420 - RNA, 24 nt, Human
ugauaagcagucauccucagauca

SEQ ID NO: 1195421 - RNA, 18 nt, Human
ugaguucauaaauuuaug

SEQ ID NO: 1195422 - RNA, 18 nt, Human
agccugacccucaucuuu

SEQ ID NO: 1195423 - RNA, 22 nt, Human
agcucaggaaccgaggcaggga

SEQ ID NO: 1195424 - RNA, 21 nt, Human
agcucaggaaccgaggcaggg

SEQ ID NO: 1195425 - RNA, 20 nt, Human
agcucaggaaccgaggcagg

SEQ ID NO: 1195426 - RNA, 21 nt, Human
agcugggacaccccgacuuuu

SEQ ID NO: 1195427 - RNA, 23 nt, Human
ugcuguauccauccauggggcug

SEQ ID NO: 1195428 - RNA, 18 nt, Human
ugcuauuguagagccaga

SEQ ID NO: 1195429 - RNA, 16 nt, Human
uggccuaaccugccga

SEQ ID NO: 1195430 - RNA, 21 nt, Human
uggccuguucuucuauggguu

SEQ ID NO: 1195431 - RNA, 19 nt, Human
aggaucccaugagcuccuu

SEQ ID NO: 1195432 - RNA, 12 nt, Human
aggacaguauuu

SEQ ID NO: 1195433 - RNA, 19 nt, Human
aggacaguauuugugggga

SEQ ID NO: 1195434 - RNA, 19 nt, Human
uggggaguuuagggugggg

SEQ ID NO: 1195435 - RNA, 18 nt, Human
uggggaguuuaggguggg

SEQ ID NO: 1195436 - RNA, 21 nt, Human
ugggguagguugggagaaugu

SEQ ID NO: 1195437 - RNA, 15 nt, Human
ugggguagguuggga

SEQ ID NO: 1195438 - RNA, 14 nt, Human
uggggcugauugua

SEQ ID NO: 1195439 - RNA, 16 nt, Human
agggggagagggcugc

SEQ ID NO: 1195440 - RNA, 15 nt, Human
agggggagagggcug

SEQ ID NO: 1195441 - RNA, 12 nt, Human
ugggucugugug

SEQ ID NO: 1195442 - RNA, 13 nt, Human
ugguaggaacugc

SEQ ID NO: 1195443 - RNA, 20 nt, Human
ugguaggaacugcugggcuu

SEQ ID NO: 1195444 - RNA, 23 nt, Human
agucccugccuggaccagccucu

SEQ ID NO: 1195445 - RNA, 22 nt, Human
agucccugccuggaccagccuc

SEQ ID NO: 1195446 - RNA, 21 nt, Human
agucccugccuggaccagccu

SEQ ID NO: 1195447 - RNA, 15 nt, Human
agucccugccuggac

SEQ ID NO: 1195448 - RNA, 14 nt, Human
agucccugccugga

SEQ ID NO: 1195449 - RNA, 19 nt, Human
aguauguggaagugugggu

SEQ ID NO: 1195450 - RNA, 15 nt, Human
aguauguggaagugu

SEQ ID NO: 1195451 - RNA, 17 nt, Human
aguauguggaagugugg

SEQ ID NO: 1195452 - RNA, 18 nt, Human
ugucaguauguggaagug

SEQ ID NO: 1195453 - RNA, 19 nt, Human
ugucaguauguggaagugu

SEQ ID NO: 1195454 - RNA, 20 nt, Human
ugucaguauguggaagugug

SEQ ID NO: 1195455 - RNA, 22 nt, Human
ugucaguauguggaaguguggg

SEQ ID NO: 1195456 - RNA, 21 nt, Human
uguaauuuaaaauugugaugu

SEQ ID NO: 1195457 - RNA, 22 nt, Human
uguaauuuaaaauugugaugug

SEQ ID NO: 1195458 - RNA, 17 nt, Human
uguaauuuaaaauugug

SEQ ID NO: 1195459 - RNA, 18 nt, Human
uguaauuuaaaauuguga

SEQ ID NO: 1195460 - RNA, 20 nt, Human
uguaauuuaaaauugugaug

SEQ ID NO: 1195461 - RNA, 23 nt, Human
agguugggagaaugucaguaugu

SEQ ID NO: 1195462 - RNA, 19 nt, Human
uguggcacuggggcagggg

SEQ ID NO: 1195463 - RNA, 13 nt, Human
uguguguguguau

SEQ ID NO: 1195464 - RNA, 16 nt, Human
uguguguguguaugug

SEQ ID NO: 1195465 - RNA, 16 nt, Human
uguugugugugggagu

SEQ ID NO: 1195466 - RNA, 14 nt, Human
uguuguguguggga

SEQ ID NO: 1195467 - RNA, 15 nt, Human
uguugugugugggag

SEQ ID NO: 1195468 - RNA, 19 nt, Human
agugugggucugugugugu

SEQ ID NO: 1195469 - RNA, 23 nt, Human
agugugggucuguguguguguau

SEQ ID NO: 1195470 - RNA, 15 nt, Human
agugugggucugugu

SEQ ID NO: 1195471 - RNA, 16 nt, Human
agugugggucugugug

SEQ ID NO: 1195472 - RNA, 17 nt, Human
agugugggucugugugu

SEQ ID NO: 1195473 - RNA, 16 nt, Human
uuagccuuugucccag

SEQ ID NO: 1195474 - RNA, 16 nt, Human
uucuaguucugccagg

SEQ ID NO: 1195475 - RNA, 15 nt, Human
uucuaguucugccag

SEQ ID NO: 1195476 - RNA, 16 nt, Human
auggccugggggaugu

SEQ ID NO: 1195477 - RNA, 21 nt, Human
auggaaugaugggucaguugu

SEQ ID NO: 1195478 - RNA, 12 nt, Human
uuuaugugaugg

SEQ ID NO: 1195479 - RNA, 11 nt, Human
uuuaugugugu

SEQ ID NO: 1195480 - RNA, 13 nt, Human
uuuaugugugugu

SEQ ID NO: 1195481 - RNA, 20 nt, Human
aucugagaggccacagugca

SEQ ID NO: 1195482 - RNA, 16 nt, Human
aucuguaccucugccu

SEQ ID NO: 1195483 - RNA, 20 nt, Human
auuuaaaauugugauguguc

SEQ ID NO: 1195484 - RNA, 19 nt, Human
auuuaaaauugugaugugu

SEQ ID NO: 1195485 - RNA, 23 nt, Human
auugcaggagucccugccaucau

SEQ ID NO: 1195486 - RNA, 15 nt, Human
auguuuacagaggac

SEQ ID NO: 1195487 - RNA, 17 nt, Human
auguuuacagaggacag

SEQ ID NO: 1195488 - RNA, 19 nt, Human
auguuuacagaggacagua

SEQ ID NO: 1195489 - RNA, 17 nt, Human
uuuguaaauuuauguga

SEQ ID NO: 1195490 - RNA, 19 nt, Human
uuugcuaugagcuggggau

SEQ ID NO: 1195491 - RNA, 13 nt, Human
augucaguaugug

SEQ ID NO: 1195492 - RNA, 14 nt, Human
augucaguaugugg

SEQ ID NO: 1195493 - RNA, 16 nt, Human
augucaguauguggaa

SEQ ID NO: 1195494 - RNA, 17 nt, Human
caagccuuggcucuacc

SEQ ID NO: 1195495 - RNA, 14 nt, Human
cccucaucuuucuu

SEQ ID NO: 1195496 - RNA, 18 nt, Human
cccugccuggaccagccu

SEQ ID NO: 1195497 - RNA, 13 nt, Human
cccugccuggacc

SEQ ID NO: 1195498 - RNA, 12 nt, Human
cccugccuggac

SEQ ID NO: 1195499 - RNA, 20 nt, Human
cccugccaucauguuuacag

SEQ ID NO: 1195500 - RNA, 19 nt, Human
ccggcuuuguggcacuggg

SEQ ID NO: 1195501 - RNA, 17 nt, Human
ccggcuuuguggcacug

SEQ ID NO: 1195502 - RNA, 19 nt, Human
ccggggccugggcaggagg

SEQ ID NO: 1195503 - RNA, 15 nt, Human
ccggggccugggcag

SEQ ID NO: 1195504 - RNA, 15 nt, Human
ccgggagcucaggaa

SEQ ID NO: 1195505 - RNA, 13 nt, Human
ccgggagcucagg

SEQ ID NO: 1195506 - RNA, 18 nt, Human
ccucagccccgcguggaa

SEQ ID NO: 1195507 - RNA, 23 nt, Human
ccuccauccuacccccugugccu

SEQ ID NO: 1195508 - RNA, 22 nt, Human
ccuccauccuacccccugugcc

SEQ ID NO: 1195509 - RNA, 17 nt, Human
ccuccauccuacccccu

SEQ ID NO: 1195510 - RNA, 21 nt, Human
cccagcuaugguucucucgca

SEQ ID NO: 1195511 - RNA, 20 nt, Human
ccaucauguuuacagaggac

SEQ ID NO: 1195512 - RNA, 22 nt, Human
ccaucauguuuacagaggacag

SEQ ID NO: 1195513 - RNA, 19 nt, Human
cauggggcugauuguauuu

SEQ ID NO: 1195514 - RNA, 21 nt, Human
cauuaccucagugagaagcca

SEQ ID NO: 1195515 - RNA, 22 nt, Human
cauuaccucagugagaagccag

SEQ ID NO: 1195516 - RNA, 15 nt, Human
cauaccuggcccugu

SEQ ID NO: 1195517 - RNA, 18 nt, Human
cauaaucacaacccuuca

SEQ ID NO: 1195518 - RNA, 16 nt, Human
caguggcuggaucugu

SEQ ID NO: 1195519 - RNA, 18 nt, Human
caguggcuggaucuguga

SEQ ID NO: 1195520 - RNA, 20 nt, Human
caguggcuggaucugugagg

SEQ ID NO: 1195521 - RNA, 18 nt, Human
cggcugggaggagggcag

SEQ ID NO: 1195522 - RNA, 17 nt, Human
cgggagccugacccuca

SEQ ID NO: 1195523 - RNA, 12 nt, Human
cggcugggagga

SEQ ID NO: 1195524 - RNA, 19 nt, Human
cggggccugggcaggaggg

SEQ ID NO: 1195525 - RNA, 17 nt, Human
cggggccugggcaggag

SEQ ID NO: 1195526 - RNA, 21 nt, Human
cgggggcagucugagagaggc

SEQ ID NO: 1195527 - RNA, 18 nt, Human
cgggggcagucugagaga

SEQ ID NO: 1195528 - RNA, 17 nt, Human
cgggggcagucugagag

SEQ ID NO: 1195529 - RNA, 15 nt, Human
cgggucaucuguacc

SEQ ID NO: 1195530 - RNA, 22 nt, Human
cgggucaucuguaccucugccu

SEQ ID NO: 1195531 - RNA, 23 nt, Human
cguggcuguggcauccagagucc

SEQ ID NO: 1195532 - RNA, 16 nt, Human
cguuguccucagcccc

SEQ ID NO: 1195533 - RNA, 14 nt, Human
cuacccccugugcc

SEQ ID NO: 1195534 - RNA, 18 nt, Human
cuccauccuacccccugu

SEQ ID NO: 1195535 - RNA, 22 nt, Human
cuccauccuacccccugugccu

SEQ ID NO: 1195536 - RNA, 20 nt, Human
cuccauccuacccccugugc

SEQ ID NO: 1195537 - RNA, 23 nt, Human
cuccauccuacccccugugccuu

SEQ ID NO: 1195538 - RNA, 24 nt, Human
cuccucgagaucccaacacugcca

SEQ ID NO: 1195539 - RNA, 21 nt, Human
cuccucgagaucccaacacug

SEQ ID NO: 1195540 - RNA, 17 nt, Human
cuccucgagaucccaac

SEQ ID NO: 1195541 - RNA, 21 nt, Human
cucuccacucaugugacucuu

SEQ ID NO: 1195542 - RNA, 22 nt, Human
cucuccacucaugugacucuuu

SEQ ID NO: 1195543 - RNA, 18 nt, Human
cucuccugucucccuccu

SEQ ID NO: 1195544 - RNA, 17 nt, Human
cucuccugucucccucc

SEQ ID NO: 1195545 - RNA, 15 nt, Human
cucuccugucucccu

SEQ ID NO: 1195546 - RNA, 23 nt, Human
cucuuggggaguuuagggugggg

SEQ ID NO: 1195547 - RNA, 19 nt, Human
cugcccgggagcucaggaa

SEQ ID NO: 1195548 - RNA, 11 nt, Human
cugccaggaga

SEQ ID NO: 1195549 - RNA, 21 nt, Human
cuggcacagccuggcuguggc

SEQ ID NO: 1195550 - RNA, 16 nt, Human
cuggcacagccuggcu

SEQ ID NO: 1195551 - RNA, 23 nt, Human
cuggcacagccuggcuguggccu

SEQ ID NO: 1195552 - RNA, 18 nt, Human
cuggcuguggccuaaccu

SEQ ID NO: 1195553 - RNA, 19 nt, Human
cugggaggagggcaggcau

SEQ ID NO: 1195554 - RNA, 14 nt, Human
cuguaccucugccu

SEQ ID NO: 1195555 - RNA, 21 nt, Human
cuuggggaguuuagggugggg

SEQ ID NO: 1195556 - RNA, 20 nt, Human
cuuggggaguuuaggguggg

SEQ ID NO: 1195557 - RNA, 23 nt, Human
cuugucacgccagacuucccacg

SEQ ID NO: 1195558 - RNA, 22 nt, Human
cuuucuuccaaacaggcucaga

SEQ ID NO: 1195559 - RNA, 19 nt, Human
cuuucuuccaaacaggcuc

SEQ ID NO: 1195560 - RNA, 13 nt, Human
cuuucuuccaaac

SEQ ID NO: 1195561 - RNA, 12 nt, Human
cuuuggacuugu

SEQ ID NO: 1195562 - RNA, 21 nt, Human
gaaggaucccaugagcuccuu

SEQ ID NO: 1195563 - RNA, 13 nt, Human
gaagaaguguguc

SEQ ID NO: 1195564 - RNA, 20 nt, Human
gacaccuaggcuaggguggg

SEQ ID NO: 1195565 - RNA, 16 nt, Human
gacaccuaggcuaggg

SEQ ID NO: 1195566 - RNA, 15 nt, Human
gacaccuaggcuagg

SEQ ID NO: 1195567 - RNA, 17 nt, Human
gaccuuuccugaggaag

SEQ ID NO: 1195568 - RNA, 21 nt, Human
gagagaggccauucuuuccca

SEQ ID NO: 1195569 - RNA, 13 nt, Human
gagagaggccauu

SEQ ID NO: 1195570 - RNA, 18 nt, Human
gacuugucccgggacacc

SEQ ID NO: 1195571 - RNA, 22 nt, Human
gagaagccagcuuuccucauca

SEQ ID NO: 1195572 - RNA, 21 nt, Human
gagccugacccucaucuuucu

SEQ ID NO: 1195573 - RNA, 22 nt, Human
gagcucaggaaccgaggcaggg

SEQ ID NO: 1195574 - RNA, 21 nt, Human
gagcucaggaaccgaggcagg

SEQ ID NO: 1195575 - RNA, 20 nt, Human
gagcucaggaaccgaggcag

SEQ ID NO: 1195576 - RNA, 17 nt, Human
gaucccaugagcuccuu

SEQ ID NO: 1195577 - RNA, 14 nt, Human
gaucauuaucagcc

SEQ ID NO: 1195578 - RNA, 13 nt, Human
gauagaugugugg

SEQ ID NO: 1195579 - RNA, 20 nt, Human
gauggcaaagaaggagagca

SEQ ID NO: 1195580 - RNA, 21 nt, Human
gaucugugaggggcucucuca

SEQ ID NO: 1195581 - RNA, 20 nt, Human
gauuuggggcucagaguggg

SEQ ID NO: 1195582 - RNA, 23 nt, Human
gauugcaggagucccugccauca

SEQ ID NO: 1195583 - RNA, 20 nt, Human
gcaggggccgggggcagucu

SEQ ID NO: 1195584 - RNA, 19 nt, Human
gcaggggccgggggcaguc

SEQ ID NO: 1195585 - RNA, 18 nt, Human
gcauuauauuuguaaauu

SEQ ID NO: 1195586 - RNA, 19 nt, Human
gcccgggagcucaggaacc

SEQ ID NO: 1195587 - RNA, 17 nt, Human
gcccgggagcucaggaa

SEQ ID NO: 1195588 - RNA, 15 nt, Human
gcccgggagcucagg

SEQ ID NO: 1195589 - RNA, 17 nt, Human
gccaucauguuuacaga

SEQ ID NO: 1195590 - RNA, 21 nt, Human
gccaucauguuuacagaggac

SEQ ID NO: 1195591 - RNA, 17 nt, Human
gccuaaccugccgagag

SEQ ID NO: 1195592 - RNA, 24 nt, Human
gccucuccacucaugugacucuuu

SEQ ID NO: 1195593 - RNA, 21 nt, Human
gccucuccacucaugugacuc

SEQ ID NO: 1195594 - RNA, 20 nt, Human
gccucucauuccagaggaag

SEQ ID NO: 1195595 - RNA, 19 nt, Human
gccucucauuccagaggaa

SEQ ID NO: 1195596 - RNA, 18 nt, Human
gccuuuggacuugucccg

SEQ ID NO: 1195597 - RNA, 18 nt, Human
gcgcggcugggaggaggg

SEQ ID NO: 1195598 - RNA, 12 nt, Human
gcgcggcuggga

SEQ ID NO: 1195599 - RNA, 19 nt, Human
guagugauuuuuaugccac

SEQ ID NO: 1195600 - RNA, 14 nt, Human
guagguugggagaa

SEQ ID NO: 1195601 - RNA, 22 nt, Human
gucagcugggacaccccgacuu

SEQ ID NO: 1195602 - RNA, 16 nt, Human
gucccugaagagaagg

SEQ ID NO: 1195603 - RNA, 13 nt, Human
gucccugccugga

SEQ ID NO: 1195604 - RNA, 14 nt, Human
gucccugccuggac

SEQ ID NO: 1195605 - RNA, 18 nt, Human
gucugagagaggccauuc

SEQ ID NO: 1195606 - RNA, 15 nt, Human
gucugagagaggcca

SEQ ID NO: 1195607 - RNA, 14 nt, Human
gucugagagaggcc

SEQ ID NO: 1195608 - RNA, 13 nt, Human
gucugagagaggc

SEQ ID NO: 1195609 - RNA, 11 nt, Human
gucugugugug

SEQ ID NO: 1195610 - RNA, 12 nt, Human
gucugugugugu

SEQ ID NO: 1195611 - RNA, 16 nt, Human
gucuguguguguguau

SEQ ID NO: 1195612 - RNA, 20 nt, Human
gucuguguguguguaugugg

SEQ ID NO: 1195613 - RNA, 11 nt, Human
gucuguguguu

SEQ ID NO: 1195614 - RNA, 21 nt, Human
gucuguguguuuaugugugug

SEQ ID NO: 1195615 - RNA, 22 nt, Human
gucuguguguuuaugugugugu

SEQ ID NO: 1195616 - RNA, 21 nt, Human
gugacuauggagcugagcagg

SEQ ID NO: 1195617 - RNA, 15 nt, Human
gugaggaugucuggg

SEQ ID NO: 1195618 - RNA, 14 nt, Human
gugccuuuugccau

SEQ ID NO: 1195619 - RNA, 21 nt, Human
gugccaggauggaaugauggg

SEQ ID NO: 1195620 - RNA, 21 nt, Human
gugauuuuuaugccaccugaa

SEQ ID NO: 1195621 - RNA, 16 nt, Human
guggcucgggaggcga

SEQ ID NO: 1195622 - RNA, 17 nt, Human
guggcuggaucugugag

SEQ ID NO: 1195623 - RNA, 21 nt, Human
guggggagagacgggcccugg

SEQ ID NO: 1195624 - RNA, 20 nt, Human
guguaauuuaaaauugugau

SEQ ID NO: 1195625 - RNA, 22 nt, Human
guguaauuuaaaauugugaugu

SEQ ID NO: 1195626 - RNA, 23 nt, Human
guguaauuuaaaauugugaugug

SEQ ID NO: 1195627 - RNA, 21 nt, Human
guguccugcaccggggccugg

SEQ ID NO: 1195628 - RNA, 17 nt, Human
gugucuggcacagccug

SEQ ID NO: 1195629 - RNA, 17 nt, Human
gugugggaguguguaau

SEQ ID NO: 1195630 - RNA, 14 nt, Human
guguguuuaugugu

SEQ ID NO: 1195631 - RNA, 15 nt, Human
guguguuuaugugug

SEQ ID NO: 1195632 - RNA, 16 nt, Human
guguguuuaugugugu

SEQ ID NO: 1195633 - RNA, 12 nt, Human
guguguugugug

SEQ ID NO: 1195634 - RNA, 14 nt, Human
guguguugugugug

SEQ ID NO: 1195635 - RNA, 17 nt, Human
guguguuguguguggga

SEQ ID NO: 1195636 - RNA, 14 nt, Human
guucugccaggaga

SEQ ID NO: 1195637 - RNA, 13 nt, Human
guucugccaggag

SEQ ID NO: 1195638 - RNA, 12 nt, Human
guucugccagga

SEQ ID NO: 1195639 - RNA, 23 nt, Human
guuguccucagccccgcguggaa

SEQ ID NO: 1195640 - RNA, 17 nt, Human
guuguccucagccccgc

SEQ ID NO: 1195641 - RNA, 12 nt, Human
guuguguguggg

SEQ ID NO: 1195642 - RNA, 13 nt, Human
guuguguguggga

SEQ ID NO: 1195643 - RNA, 14 nt, Human
guugugugugggag

SEQ ID NO: 1195644 - RNA, 16 nt, Human
guugugugugggagug

SEQ ID NO: 1195645 - RNA, 22 nt, Human
guugugugugggaguguguaau

SEQ ID NO: 1195646 - RNA, 16 nt, Human
guuuagaagaagugug

SEQ ID NO: 1195647 - RNA, 13 nt, Human
uaaauuuauguga

SEQ ID NO: 1195648 - RNA, 22 nt, Human
uaagugccaggauggaaugaug

SEQ ID NO: 1195649 - RNA, 22 nt, Human
uauaaacaugcuugcauuauau

SEQ ID NO: 1195650 - RNA, 20 nt, Human
uauauuuguaaauuuaugug

SEQ ID NO: 1195651 - RNA, 17 nt, Human
ucaucuuucuuccaaac

SEQ ID NO: 1195652 - RNA, 14 nt, Human
ucaucuuucuucca

SEQ ID NO: 1195653 - RNA, 23 nt, Human
ucagccuccauccuacccccugu

SEQ ID NO: 1195654 - RNA, 20 nt, Human
ucagaucauuaucagccugu

SEQ ID NO: 1195655 - RNA, 15 nt, Human
uccagagucccugcc

SEQ ID NO: 1195656 - RNA, 15 nt, Human
ucccaacacugccag

SEQ ID NO: 1195657 - RNA, 14 nt, Human
ucccaacacugcca

SEQ ID NO: 1195658 - RNA, 16 nt, Human
ucccaacacugccagc

SEQ ID NO: 1195659 - RNA, 23 nt, Human
ucccaugagcuccuuaaggcucu

SEQ ID NO: 1195660 - RNA, 23 nt, Human
uccucgagaucccaacacugcca

SEQ ID NO: 1195661 - RNA, 16 nt, Human
uccucgagaucccaac

SEQ ID NO: 1195662 - RNA, 19 nt, Human
uccugucccucauccauag

SEQ ID NO: 1195663 - RNA, 19 nt, Human
ucuuuccaaccggcuuugu

SEQ ID NO: 1195664 - RNA, 11 nt, Human
ucugugugugu

SEQ ID NO: 1195665 - RNA, 13 nt, Human
ucugugugugugu

SEQ ID NO: 1195666 - RNA, 22 nt, Human
ucuucauuaccucagugagaag

SEQ ID NO: 1195667 - RNA, 19 nt, Human
ugacucuuuccaaccggcu

SEQ ID NO: 1195668 - RNA, 13 nt, Human
ugacucuuuccaa

SEQ ID NO: 1195669 - RNA, 16 nt, Human
ugacucuuuccaaccg

SEQ ID NO: 1195670 - RNA, 14 nt, Human
ugacucuuuccaac

SEQ ID NO: 1195671 - RNA, 20 nt, Human
ugaagagaagggcagggcug

SEQ ID NO: 1195672 - RNA, 22 nt, Human
ugaagagaagggcagggcugag

SEQ ID NO: 1195673 - RNA, 22 nt, Human
ugcaccggggccugggcaggag

SEQ ID NO: 1195674 - RNA, 16 nt, Human
ugcaccggggccuggg

SEQ ID NO: 1195675 - RNA, 12 nt, Human
ugcaccggggcc

SEQ ID NO: 1195676 - RNA, 18 nt, Human
ugccaggauggaaugaug

SEQ ID NO: 1195677 - RNA, 18 nt, Human
uggaacucgugucuggca

SEQ ID NO: 1195678 - RNA, 20 nt, Human
uggaaugaugggucaguugu

SEQ ID NO: 1195679 - RNA, 21 nt, Human
ugggacaccccgacuuuuguu

SEQ ID NO: 1195680 - RNA, 21 nt, Human
ugggagugaggaugucugggc

SEQ ID NO: 1195681 - RNA, 18 nt, Human
ugggggucuguguguuua

SEQ ID NO: 1195682 - RNA, 15 nt, Human
ugggggucugugugu

SEQ ID NO: 1195683 - RNA, 11 nt, Human
ugggggaugua

SEQ ID NO: 1195684 - RNA, 21 nt, Human
uguccucagccccgcguggaa

SEQ ID NO: 1195685 - RNA, 14 nt, Human
ugucacgccagacu

SEQ ID NO: 1195686 - RNA, 22 nt, Human
ugucacccuuaggccagcacca

SEQ ID NO: 1195687 - RNA, 14 nt, Human
uguaccucugccuc

SEQ ID NO: 1195688 - RNA, 17 nt, Human
ugucuggcacagccugg

SEQ ID NO: 1195689 - RNA, 20 nt, Human
ugugccuugucacgccagac

SEQ ID NO: 1195690 - RNA, 19 nt, Human
ugugccuugucacgccaga

SEQ ID NO: 1195691 - RNA, 17 nt, Human
ugugccuugucacgcca

SEQ ID NO: 1195692 - RNA, 17 nt, Human
ugugccuuggugugcug

SEQ ID NO: 1195693 - RNA, 16 nt, Human
ugugccuuuugccauc

SEQ ID NO: 1195694 - RNA, 15 nt, Human
uguggccuaaccugc

SEQ ID NO: 1195695 - RNA, 15 nt, Human
uguggaagugugggu

SEQ ID NO: 1195696 - RNA, 14 nt, Human
ugugggagugugua

SEQ ID NO: 1195697 - RNA, 15 nt, Human
ugugggaguguguaa

SEQ ID NO: 1195698 - RNA, 19 nt, Human
uguguaauuuaaaauugug

SEQ ID NO: 1195699 - RNA, 22 nt, Human
uguguaauuuaaaauugugaug

SEQ ID NO: 1195700 - RNA, 23 nt, Human
uguguaauuuaaaauugugaugu

SEQ ID NO: 1195701 - RNA, 11 nt, Human
uguguaauuua

SEQ ID NO: 1195702 - RNA, 18 nt, Human
uguguaauuuaaaauugu

SEQ ID NO: 1195703 - RNA, 16 nt, Human
uguuuagaagaagugu

SEQ ID NO: 1195704 - RNA, 16 nt, Human
uguucuuuugucccag

SEQ ID NO: 1195705 - RNA, 16 nt, Human
ugugugggagugugua

SEQ ID NO: 1195706 - RNA, 14 nt, Human
ugugugggagugug

SEQ ID NO: 1195707 - RNA, 15 nt, Human
ugugugggagugugu

SEQ ID NO: 1195708 - RNA, 11 nt, Human
uguguaugugg

SEQ ID NO: 1195709 - RNA, 12 nt, Human
uguguauguggg

SEQ ID NO: 1195710 - RNA, 13 nt, Human
uguguaugugggg

SEQ ID NO: 1195711 - RNA, 18 nt, Human
ggccagcaccaucucuuu

SEQ ID NO: 1195712 - RNA, 23 nt, Human
ggcaggcaucggggagccgggag

SEQ ID NO: 1195713 - RNA, 17 nt, Human
ggagagacgggcccugg

SEQ ID NO: 1195714 - RNA, 15 nt, Human
ggagagacgggcccu

SEQ ID NO: 1195715 - RNA, 15 nt, Human
aaaaagggaggggga

SEQ ID NO: 1195716 - RNA, 20 nt, Human
ggcuccucgagaucccaaca

SEQ ID NO: 1195717 - RNA, 17 nt, Human
ggcuggaucugugaggg

SEQ ID NO: 1195718 - RNA, 14 nt, Human
gggagggggagagg

SEQ ID NO: 1195719 - RNA, 15 nt, Human
ggggccugggcagga

SEQ ID NO: 1195720 - RNA, 12 nt, Human
ggggccugggca

SEQ ID NO: 1195721 - RNA, 23 nt, Human
ggggucuguguguuuaugugugu

SEQ ID NO: 1195722 - RNA, 16 nt, Human
aaaauugugauguguc

SEQ ID NO: 1195723 - RNA, 12 nt, Human
gccauucuuucc

SEQ ID NO: 1195724 - RNA, 19 nt, Human
gcuauggggauagaugugu

SEQ ID NO: 1195725 - RNA, 21 nt, Human
gcuauggggauagaugugugg

SEQ ID NO: 1195726 - RNA, 19 nt, Human
gcaccggggccugggcagg

SEQ ID NO: 1195727 - RNA, 16 nt, Human
gcaccggggccugggc

SEQ ID NO: 1195728 - RNA, 14 nt, Human
gcaccggggccugg

SEQ ID NO: 1195729 - RNA, 23 nt, Human
gaggugcuucuaguucugccagg

SEQ ID NO: 1195730 - RNA, 22 nt, Human
gaggugcuucuaguucugccag

SEQ ID NO: 1195731 - RNA, 17 nt, Human
gaguccaucagccucca

SEQ ID NO: 1195732 - RNA, 18 nt, Human
gagucagggagagcugaa

SEQ ID NO: 1195733 - RNA, 13 nt, Human
gaguuggcuggga

SEQ ID NO: 1195734 - RNA, 16 nt, Human
gagggcugccuuugga

SEQ ID NO: 1195735 - RNA, 9 nt, Human
gagggcugc

SEQ ID NO: 1195736 - RNA, 21 nt, Human
gaagugugggucugugugugu

SEQ ID NO: 1195737 - RNA, 24 nt, Human
gaagugugggucugugugugugua

SEQ ID NO: 1195738 - RNA, 15 nt, Human
gaaccgaggcaggga

SEQ ID NO: 1195739 - RNA, 12 nt, Human
gaaccgaggcag

SEQ ID NO: 1195740 - RNA, 17 nt, Human
gaacugcugggcuuggc

SEQ ID NO: 1195741 - RNA, 20 nt, Human
gaacugcugggcuuggcagc

SEQ ID NO: 1195742 - RNA, 19 nt, Human
cugcaccggggccugggca

SEQ ID NO: 1195743 - RNA, 18 nt, Human
cugcaccggggccugggc

SEQ ID NO: 1195744 - RNA, 16 nt, Human
cugcaccggggccugg

SEQ ID NO: 1195745 - RNA, 14 nt, Human
cugcaccggggccu

SEQ ID NO: 1195746 - RNA, 14 nt, Human
cuggaucugugagg

SEQ ID NO: 1195747 - RNA, 13 nt, Human
cugggcaggaggg

SEQ ID NO: 1195748 - RNA, 13 nt, Human
cuggcccugugcc

SEQ ID NO: 1195749 - RNA, 14 nt, Human
cucaugugacucuu

SEQ ID NO: 1195750 - RNA, 24 nt, Human
cuccucugcccgggagcucaggaa

SEQ ID NO: 1195751 - RNA, 22 nt, Human
cuccucugcccgggagcucagg

SEQ ID NO: 1195752 - RNA, 16 nt, Human
cuccugucucccuccu

SEQ ID NO: 1195753 - RNA, 20 nt, Human
cucaggccugacucucagca

SEQ ID NO: 1195754 - RNA, 23 nt, Human
cucaggccgaaggaggagucagg

SEQ ID NO: 1195755 - RNA, 23 nt, Human
cucaugauagaaggcuaugggga

SEQ ID NO: 1195756 - RNA, 22 nt, Human
ccucugcccgggagcucaggaa

SEQ ID NO: 1195757 - RNA, 21 nt, Human
ccucugcccgggagcucagga

SEQ ID NO: 1195758 - RNA, 22 nt, Human
ccucuuggggaguuuagggugg

SEQ ID NO: 1195759 - RNA, 15 nt, Human
ccucuuggcugccuu

SEQ ID NO: 1195760 - RNA, 23 nt, Human
ccucuuggggaguuuaggguggg

SEQ ID NO: 1195761 - RNA, 19 nt, Human
ccugccuggaccagccucu

SEQ ID NO: 1195762 - RNA, 12 nt, Human
ccugccuggacc

SEQ ID NO: 1195763 - RNA, 21 nt, Human
ccaugagcuccuuaaggcucu

SEQ ID NO: 1195764 - RNA, 13 nt, Human
ccauugguguuga

SEQ ID NO: 1195765 - RNA, 21 nt, Human
ccccgcguggaacucgugucu

SEQ ID NO: 1195766 - RNA, 18 nt, Human
ccagagaaaaagggaggg

SEQ ID NO: 1195767 - RNA, 23 nt, Human
ccagacuucccacggcuccucga

SEQ ID NO: 1195768 - RNA, 17 nt, Human
auucauggccuggggga

SEQ ID NO: 1195769 - RNA, 13 nt, Human
auucuuucccaac

SEQ ID NO: 1195770 - RNA, 17 nt, Human
auuuuuaugccaccuga

SEQ ID NO: 1195771 - RNA, 19 nt, Human
caccuaggcuagggugggg

SEQ ID NO: 1195772 - RNA, 18 nt, Human
caccuaggcuaggguggg

SEQ ID NO: 1195773 - RNA, 17 nt, Human
cagcacguguggccugu

SEQ ID NO: 1195774 - RNA, 17 nt, Human
caucuguaccucugccu

SEQ ID NO: 1195775 - RNA, 22 nt, Human
aacacugccagcauuucccuuc

SEQ ID NO: 1195776 - RNA, 12 nt, Human
aacacugccagc

SEQ ID NO: 1195777 - RNA, 19 nt, Human
aacucgugucuggcacagc

SEQ ID NO: 1195778 - RNA, 16 nt, Human
gucucccuccucugcc

SEQ ID NO: 1195779 - RNA, 12 nt, Human
gucucccuccuc

SEQ ID NO: 1195780 - RNA, 15 nt, Human
guauguggaagugug

SEQ ID NO: 1195781 - RNA, 16 nt, Human
guauguggaagugugg

SEQ ID NO: 1195782 - RNA, 17 nt, Human
guauguggaaguguggg

SEQ ID NO: 1195783 - RNA, 18 nt, Human
guauguggaagugugggu

SEQ ID NO: 1195784 - RNA, 21 nt, Human
guauguggaagugugggucug

SEQ ID NO: 1195785 - RNA, 19 nt, Human
guaugugggggucugugug

SEQ ID NO: 1195786 - RNA, 20 nt, Human
guaugugggggucugugugu

SEQ ID NO: 1195787 - RNA, 16 nt, Human
guaggaacugcugggc

SEQ ID NO: 1195788 - RNA, 14 nt, Human
guggcacuggggca

SEQ ID NO: 1195789 - RNA, 21 nt, Human
guggaagugugggucugugug

SEQ ID NO: 1195790 - RNA, 22 nt, Human
guggaagugugggucugugugu

SEQ ID NO: 1195791 - RNA, 23 nt, Human
gugcuauuguagagccagagguc

SEQ ID NO: 1195792 - RNA, 14 nt, Human
guggaagugugggu

SEQ ID NO: 1195793 - RNA, 15 nt, Human
guggaaguguggguc

SEQ ID NO: 1195794 - RNA, 19 nt, Human
guggaagugugggucugug

SEQ ID NO: 1195795 - RNA, 20 nt, Human
guggaagugugggucugugu

SEQ ID NO: 1195796 - RNA, 19 nt, Human
aagaagugugucacccuua

SEQ ID NO: 1195797 - RNA, 23 nt, Human
guggggggggggcgcggcuggga

SEQ ID NO: 1195798 - RNA, 13 nt, Human
gugggucugugug

SEQ ID NO: 1195799 - RNA, 16 nt, Human
gugggucugugugugu

SEQ ID NO: 1195800 - RNA, 14 nt, Human
gugguggcucggga

SEQ ID NO: 1195801 - RNA, 13 nt, Human
gugggagugugua

SEQ ID NO: 1195802 - RNA, 14 nt, Human
gugggaguguguaa

SEQ ID NO: 1195803 - RNA, 15 nt, Human
guguuguguguggga

SEQ ID NO: 1195804 - RNA, 12 nt, Human
guguguaugugg

SEQ ID NO: 1195805 - RNA, 14 nt, Human
guguguaauuuaaa

SEQ ID NO: 1195806 - RNA, 16 nt, Human
guuuucuuaacuuaaa

SEQ ID NO: 1195807 - RNA, 18 nt, Human
guuguaucagcacgugug

SEQ ID NO: 1195808 - RNA, 13 nt, Human
guuuaugugugug

SEQ ID NO: 1195809 - RNA, 16 nt, Human
guuuaugugugugugu

SEQ ID NO: 1195810 - RNA, 23 nt, Human
aaggcuauggggauagaugugug

SEQ ID NO: 1195811 - RNA, 17 nt, Human
acaccccgacuuuuguu

SEQ ID NO: 1195812 - RNA, 18 nt, Human
uacagaggacaguauuug

SEQ ID NO: 1195813 - RNA, 14 nt, Human
uacagaggacagua

SEQ ID NO: 1195814 - RNA, 15 nt, Human
uaauuuaaaauugug

SEQ ID NO: 1195815 - RNA, 16 nt, Human
uaauuuaaaauuguga

SEQ ID NO: 1195816 - RNA, 18 nt, Human
accagagaaaaagggagg

SEQ ID NO: 1195817 - RNA, 16 nt, Human
uauuuguaaauuuaug

SEQ ID NO: 1195818 - RNA, 17 nt, Human
uauuuguaaauuuaugu

SEQ ID NO: 1195819 - RNA, 22 nt, Human
uauuuguaaauuuaugugaugg

SEQ ID NO: 1195820 - RNA, 17 nt, Human
ucaggaaccgaggcagg

SEQ ID NO: 1195821 - RNA, 21 nt, Human
uccaaccggcuuuguggcacu

SEQ ID NO: 1195822 - RNA, 21 nt, Human
uccacucaugugacucuuucc

SEQ ID NO: 1195823 - RNA, 14 nt, Human
uccacucaugugac

SEQ ID NO: 1195824 - RNA, 21 nt, Human
ucccgggacaccuaggcuagg

SEQ ID NO: 1195825 - RNA, 19 nt, Human
acucaugugacucuuucca

SEQ ID NO: 1195826 - RNA, 18 nt, Human
acucaugugacucuuucc

SEQ ID NO: 1195827 - RNA, 21 nt, Human
ucgagaucccaacacugccag

SEQ ID NO: 1195828 - RNA, 18 nt, Human
ucgagaucccaacacugc

SEQ ID NO: 1195829 - RNA, 17 nt, Human
ucgagaucccaacacug

SEQ ID NO: 1195830 - RNA, 23 nt, Human
acuggccaguggcuggaucugug

SEQ ID NO: 1195831 - RNA, 23 nt, Human
acuugucccgggacaccuaggcu

SEQ ID NO: 1195832 - RNA, 16 nt, Human
ucucauuccagaggaa

SEQ ID NO: 1195833 - RNA, 20 nt, Human
ucugagagaggccauucuuu

SEQ ID NO: 1195834 - RNA, 14 nt, Human
ucugagagaggcca

SEQ ID NO: 1195835 - RNA, 13 nt, Human
ucuuucuuccaaa

SEQ ID NO: 1195836 - RNA, 19 nt, Human
agacuucccacggcuccuc

SEQ ID NO: 1195837 - RNA, 14 nt, Human
agacuuaucaacau

SEQ ID NO: 1195838 - RNA, 21 nt, Human
agacauuugcuaugagcuggg

SEQ ID NO: 1195839 - RNA, 17 nt, Human
agaaugucaguaugugg

SEQ ID NO: 1195840 - RNA, 19 nt, Human
agaaugucaguauguggaa

SEQ ID NO: 1195841 - RNA, 15 nt, Human
agaaugucaguaugu

SEQ ID NO: 1195842 - RNA, 16 nt, Human
agaaugucaguaugug

SEQ ID NO: 1195843 - RNA, 21 nt, Human
agaggccauucuuucccaaca

SEQ ID NO: 1195844 - RNA, 17 nt, Human
agagucccugccuggac

SEQ ID NO: 1195845 - RNA, 14 nt, Human
agagucccugccug

SEQ ID NO: 1195846 - RNA, 23 nt, Human
agaguccaucagccuccauccua

SEQ ID NO: 1195847 - RNA, 20 nt, Human
agaucccaacacugccagca

SEQ ID NO: 1195848 - RNA, 19 nt, Human
agaucccaacacugccagc

SEQ ID NO: 1195849 - RNA, 18 nt, Human
agaucccaacacugccag

SEQ ID NO: 1195850 - RNA, 23 nt, Human
agccccgcguggaacucgugucu

SEQ ID NO: 1195851 - RNA, 16 nt, Human
agccucuccacucaug

SEQ ID NO: 1195852 - RNA, 15 nt, Human
ugaugggucaguugu

SEQ ID NO: 1195853 - RNA, 22 nt, Human
ugccgagaguccaucagccucc

SEQ ID NO: 1195854 - RNA, 16 nt, Human
ugccaucauguuuaca

SEQ ID NO: 1195855 - RNA, 17 nt, Human
ugccuugucacgccaga

SEQ ID NO: 1195856 - RNA, 16 nt, Human
ugccuuggugugcugu

SEQ ID NO: 1195857 - RNA, 15 nt, Human
ugccuugucacgcca

SEQ ID NO: 1195858 - RNA, 16 nt, Human
ugcuaugagcugggga

SEQ ID NO: 1195859 - RNA, 19 nt, Human
ugcuaugagcuggggaugu

SEQ ID NO: 1195860 - RNA, 20 nt, Human
ugcuaugagcuggggauguc

SEQ ID NO: 1195861 - RNA, 22 nt, Human
ugcuaugagcuggggaugucuc

SEQ ID NO: 1195862 - RNA, 23 nt, Human
agggaaggaucccaugagcuccu

SEQ ID NO: 1195863 - RNA, 22 nt, Human
agggaaggaucccaugagcucc

SEQ ID NO: 1195864 - RNA, 15 nt, Human
agggaaggaucccau

SEQ ID NO: 1195865 - RNA, 19 nt, Human
ugggagaaugucaguaugu

SEQ ID NO: 1195866 - RNA, 20 nt, Human
ugggagaaugucaguaugug

SEQ ID NO: 1195867 - RNA, 22 nt, Human
ugggagaaugucaguaugugga

SEQ ID NO: 1195868 - RNA, 13 nt, Human
uggggagagacgg

SEQ ID NO: 1195869 - RNA, 14 nt, Human
uggggagggauuug

SEQ ID NO: 1195870 - RNA, 15 nt, Human
uggggcucagagugg

SEQ ID NO: 1195871 - RNA, 22 nt, Human
uggggagggauuuggggcucag

SEQ ID NO: 1195872 - RNA, 21 nt, Human
aggguggggggggggcgcggc

SEQ ID NO: 1195873 - RNA, 19 nt, Human
agguuuuuguagugauuuu

SEQ ID NO: 1195874 - RNA, 23 nt, Human
agguuuguuuagaagaagugugu

SEQ ID NO: 1195875 - RNA, 12 nt, Human
uguauguggggg

SEQ ID NO: 1195876 - RNA, 20 nt, Human
uguaugugggggucugugug

SEQ ID NO: 1195877 - RNA, 17 nt, Human
ugugacucuuuccaacc

SEQ ID NO: 1195878 - RNA, 15 nt, Human
ugugacucuuuccaa

SEQ ID NO: 1195879 - RNA, 14 nt, Human
ugugacucuuucca

SEQ ID NO: 1195880 - RNA, 12 nt, Human
ugugacucuuuc

SEQ ID NO: 1195881 - RNA, 21 nt, Human
uguggcauccagagucccugc

SEQ ID NO: 1195882 - RNA, 19 nt, Human
uguggcauccagagucccu

SEQ ID NO: 1195883 - RNA, 16 nt, Human
uguggcauccagaguc

SEQ ID NO: 1195884 - RNA, 12 nt, Human
ugugugugggag

SEQ ID NO: 1195885 - RNA, 20 nt, Human
ugugugugggaguguguaau

SEQ ID NO: 1195886 - RNA, 14 nt, Human
uguguguguaugug

SEQ ID NO: 1195887 - RNA, 12 nt, Human
aguucugccagg

SEQ ID NO: 1195888 - RNA, 20 nt, Human
aguucugccaggagacaggu

SEQ ID NO: 1195889 - RNA, 14 nt, Human
aguucugccaggag

SEQ ID NO: 1195890 - RNA, 13 nt, Human
aguucugccagga

SEQ ID NO: 1195891 - RNA, 13 nt, Human
uguuuaugugugu

SEQ ID NO: 1195892 - RNA, 16 nt, Human
uguuuaugugugugug

SEQ ID NO: 1195893 - RNA, 14 nt, Human
aguuuagggugggg

SEQ ID NO: 1195894 - RNA, 13 nt, Human
aguuuaggguggg

SEQ ID NO: 1195895 - RNA, 12 nt, Human
aguuuagggugg

SEQ ID NO: 1195896 - RNA, 13 nt, Human
uuaaaauugugau

SEQ ID NO: 1195897 - RNA, 18 nt, Human
uuaaaauugugauguguc

SEQ ID NO: 1195898 - RNA, 14 nt, Human
uuagaagaagugug

SEQ ID NO: 1195899 - RNA, 15 nt, Human
uuagaagaagugugu

SEQ ID NO: 1195900 - RNA, 16 nt, Human
uuagaagaaguguguc

SEQ ID NO: 1195901 - RNA, 17 nt, Human
aucccaacacugccagc

SEQ ID NO: 1195902 - RNA, 16 nt, Human
aucccaacacugccag

SEQ ID NO: 1195903 - RNA, 15 nt, Human
aucccaacacugcca

SEQ ID NO: 1195904 - RNA, 11 nt, Human
aucccaacacu

SEQ ID NO: 1195905 - RNA, 12 nt, Human
uucugccaggag

SEQ ID NO: 1195906 - RNA, 17 nt, Human
uucuaguucugccagga

SEQ ID NO: 1195907 - RNA, 18 nt, Human
aucauguuuacagaggac

SEQ ID NO: 1195908 - RNA, 23 nt, Human
aucauguuuacagaggacaguau

SEQ ID NO: 1195909 - RNA, 20 nt, Human
auauuuguaaauuuauguga

SEQ ID NO: 1195910 - RNA, 16 nt, Human
uuggacuugucccggg

SEQ ID NO: 1195911 - RNA, 21 nt, Human
aucugugaggggcucucucau

SEQ ID NO: 1195912 - RNA, 22 nt, Human
aucugugaggggcucucucaug

SEQ ID NO: 1195913 - RNA, 19 nt, Human
uuguaaauuuaugugaugg

SEQ ID NO: 1195914 - RNA, 12 nt, Human
uugugauguguc

SEQ ID NO: 1195915 - RNA, 18 nt, Human
augaguuggcugggaaua

SEQ ID NO: 1195916 - RNA, 19 nt, Human
uuucccuuccuuccucucc

SEQ ID NO: 1195917 - RNA, 23 nt, Human
uuugaccuguugggagugaggau

SEQ ID NO: 1195918 - RNA, 17 nt, Human
auguauauaaacaugcu

SEQ ID NO: 1195919 - RNA, 18 nt, Human
uuuguaagguuuuuguag

SEQ ID NO: 1195920 - RNA, 15 nt, Human
uuuguagugauuuuu

SEQ ID NO: 1195921 - RNA, 22 nt, Human
uuuguagugauuuuuaugccac

SEQ ID NO: 1195922 - RNA, 22 nt, Human
auguguguguguuguguguggg

SEQ ID NO: 1195923 - RNA, 23 nt, Human
auguguguguguuguguguggga

SEQ ID NO: 1195924 - RNA, 15 nt, Human
auuuaaaauugugau

SEQ ID NO: 1195925 - RNA, 17 nt, Human
auuguagagccagaggu

SEQ ID NO: 1195926 - RNA, 18 nt, Human
auuguagagccagagguc

SEQ ID NO: 1195927 - RNA, 14 nt, Human
aacaggcucagagg

SEQ ID NO: 1195928 - RNA, 13 nt, Human
accggggccuggg

SEQ ID NO: 1195929 - RNA, 19 nt, Human
accggggccugggcaggag

SEQ ID NO: 1195930 - RNA, 19 nt, Human
acccucaucuuucuuccaa

SEQ ID NO: 1195931 - RNA, 16 nt, Human
acccucaucuuucuuc

SEQ ID NO: 1195932 - RNA, 14 nt, Human
acccucaucuuucu

SEQ ID NO: 1195933 - RNA, 13 nt, Human
acccucaucuuuc

SEQ ID NO: 1195934 - RNA, 12 nt, Human
agagaggccauu

SEQ ID NO: 1195935 - RNA, 23 nt, Human
agagaggccauucuuucccaaca

SEQ ID NO: 1195936 - RNA, 22 nt, Human
agagaggccauucuuucccaac

SEQ ID NO: 1195937 - RNA, 13 nt, Human
agcaucucccagu

SEQ ID NO: 1195938 - RNA, 19 nt, Human
agagugggguagguuggga

SEQ ID NO: 1195939 - RNA, 19 nt, Human
aggcuaggguggggagaga

SEQ ID NO: 1195940 - RNA, 16 nt, Human
aggcuaggguggggag

SEQ ID NO: 1195941 - RNA, 15 nt, Human
aggcuagggugggga

SEQ ID NO: 1195942 - RNA, 14 nt, Human
aggcuagggugggg

SEQ ID NO: 1195943 - RNA, 22 nt, Human
agggauuuggggcucagagugg

SEQ ID NO: 1195944 - RNA, 19 nt, Human
aggcaucggggagccggga

SEQ ID NO: 1195945 - RNA, 20 nt, Human
aggagacagguuagcugcuc

SEQ ID NO: 1195946 - RNA, 13 nt, Human
aggagggcaggca

SEQ ID NO: 1195947 - RNA, 15 nt, Human
aggagggaggugcuu

SEQ ID NO: 1195948 - RNA, 15 nt, Human
aggagggcaggcauc

SEQ ID NO: 1195949 - RNA, 13 nt, Human
aggaugucugggc

SEQ ID NO: 1195950 - RNA, 16 nt, Human
ccaaacaggcucagag

SEQ ID NO: 1195951 - RNA, 19 nt, Human
cauugucccugaagagaag

SEQ ID NO: 1195952 - RNA, 16 nt, Human
ccaacacugccagcau

SEQ ID NO: 1195953 - RNA, 15 nt, Human
ccaacacugccagca

SEQ ID NO: 1195954 - RNA, 14 nt, Human
ccaacacugccagc

SEQ ID NO: 1195955 - RNA, 13 nt, Human
ccaacacugccag

SEQ ID NO: 1195956 - RNA, 19 nt, Human
ccaagccuuggcucuaccc

SEQ ID NO: 1195957 - RNA, 21 nt, Human
ccacgucagcugggacacccc

SEQ ID NO: 1195958 - RNA, 16 nt, Human
ccacacccucacugcu

SEQ ID NO: 1195959 - RNA, 20 nt, Human
ccacacagacuugggcaggg

SEQ ID NO: 1195960 - RNA, 13 nt, Human
ccaucagccucca

SEQ ID NO: 1195961 - RNA, 13 nt, Human
cccaacaccucuu

SEQ ID NO: 1195962 - RNA, 22 nt, Human
ccgacuuuuguuuaccagagaa

SEQ ID NO: 1195963 - RNA, 15 nt, Human
ccuccucugcccggg

SEQ ID NO: 1195964 - RNA, 14 nt, Human
ccuccucugcccgg

SEQ ID NO: 1195965 - RNA, 23 nt, Human
ccucuccacucaugugacucuuu

SEQ ID NO: 1195966 - RNA, 16 nt, Human
ccuggaccagccucuc

SEQ ID NO: 1195967 - RNA, 15 nt, Human
ccuggaccagccucu

SEQ ID NO: 1195968 - RNA, 14 nt, Human
ccuggaccagccuc

SEQ ID NO: 1195969 - RNA, 23 nt, Human
cggcugggaggagggcaggcauc

SEQ ID NO: 1195970 - RNA, 22 nt, Human
cggcugggaggagggcaggcau

SEQ ID NO: 1195971 - RNA, 16 nt, Human
cgggagcucaggaacc

SEQ ID NO: 1195972 - RNA, 23 nt, Human
cgauugcaggagucccugccauc

SEQ ID NO: 1195973 - RNA, 21 nt, Human
cgauugcaggagucccugcca

SEQ ID NO: 1195974 - RNA, 19 nt, Human
cgucagcugggacaccccg

SEQ ID NO: 1195975 - RNA, 22 nt, Human
cuccuuaaggcucuuuuguaag

SEQ ID NO: 1195976 - RNA, 13 nt, Human
cuccuuaaggcuc

SEQ ID NO: 1195977 - RNA, 17 nt, Human
cuccauugguguugaca

SEQ ID NO: 1195978 - RNA, 15 nt, Human
cucauuccagaggaa

SEQ ID NO: 1195979 - RNA, 17 nt, Human
cucauuccagaggaagg

SEQ ID NO: 1195980 - RNA, 19 nt, Human
cucuccacucaugugacuc

SEQ ID NO: 1195981 - RNA, 21 nt, Human
cucuuggggaguuuagggugg

SEQ ID NO: 1195982 - RNA, 21 nt, Human
cugaagagaagggcagggcug

SEQ ID NO: 1195983 - RNA, 20 nt, Human
cugccagcauuucccuuccu

SEQ ID NO: 1195984 - RNA, 16 nt, Human
cugccaggagacaggu

SEQ ID NO: 1195985 - RNA, 18 nt, Human
cugcccgggagcucagga

SEQ ID NO: 1195986 - RNA, 12 nt, Human
cuggaccagccu

SEQ ID NO: 1195987 - RNA, 15 nt, Human
cuggcacagccuggc

SEQ ID NO: 1195988 - RNA, 14 nt, Human
cuggcacagccugg

SEQ ID NO: 1195989 - RNA, 14 nt, Human
cuuccuuccucucc

SEQ ID NO: 1195990 - RNA, 20 nt, Human
gaagcguuguccucagcccc

SEQ ID NO: 1195991 - RNA, 19 nt, Human
gaagcguuguccucagccc

SEQ ID NO: 1195992 - RNA, 13 nt, Human
gaagcguuguccu

SEQ ID NO: 1195993 - RNA, 17 nt, Human
gaagagaagggcagggc

SEQ ID NO: 1195994 - RNA, 18 nt, Human
gacuucccacggcuccuc

SEQ ID NO: 1195995 - RNA, 21 nt, Human
gaguguguaauuuaaaauugu

SEQ ID NO: 1195996 - RNA, 22 nt, Human
gaguguguaauuuaaaauugug

SEQ ID NO: 1195997 - RNA, 19 nt, Human
gcacagccuggcuguggcc

SEQ ID NO: 1195998 - RNA, 12 nt, Human
gcacagccuggc

SEQ ID NO: 1195999 - RNA, 15 nt, Human
gcaggagggaggugc

SEQ ID NO: 1196000 - RNA, 13 nt, Human
gccccgcguggaa

SEQ ID NO: 1196001 - RNA, 21 nt, Human
gccgagaguccaucagccucc

SEQ ID NO: 1196002 - RNA, 19 nt, Human
gccgggagccugacccuca

SEQ ID NO: 1196003 - RNA, 14 nt, Human
gccgggagccugac

SEQ ID NO: 1196004 - RNA, 13 nt, Human
gccgggagccuga

SEQ ID NO: 1196005 - RNA, 20 nt, Human
gcugccuuuggacuuguccc

SEQ ID NO: 1196006 - RNA, 15 nt, Human
gcugccuuuggacuu

SEQ ID NO: 1196007 - RNA, 23 nt, Human
gcugggacaccccgacuuuuguu

SEQ ID NO: 1196008 - RNA, 19 nt, Human
gcugggaggagggcaggca

SEQ ID NO: 1196009 - RNA, 17 nt, Human
gcugggaggagggcagg

SEQ ID NO: 1196010 - RNA, 18 nt, Human
gcuucuaguucugccagg

SEQ ID NO: 1196011 - RNA, 20 nt, Human
gcuucuaguucugccaggag

SEQ ID NO: 1196012 - RNA, 19 nt, Human
gcuucuaguucugccagga

SEQ ID NO: 1196013 - RNA, 21 nt, Human
gcuucuaguucugccaggaga

SEQ ID NO: 1196014 - RNA, 20 nt, Human
ggaaccgaggcagggaagga

SEQ ID NO: 1196015 - RNA, 16 nt, Human
ggaaccgaggcaggga

SEQ ID NO: 1196016 - RNA, 15 nt, Human
ggaaccgaggcaggg

SEQ ID NO: 1196017 - RNA, 17 nt, Human
ggaacucgugucuggca

SEQ ID NO: 1196018 - RNA, 17 nt, Human
ggaaggaucccaugagc

SEQ ID NO: 1196019 - RNA, 20 nt, Human
ggaggagggcaggcaucggg

SEQ ID NO: 1196020 - RNA, 15 nt, Human
ggaggagggcaggca

SEQ ID NO: 1196021 - RNA, 14 nt, Human
ggaggagggcaggc

SEQ ID NO: 1196022 - RNA, 16 nt, Human
ggagccgggagccuga

SEQ ID NO: 1196023 - RNA, 14 nt, Human
ggagggcaggcauc

SEQ ID NO: 1196024 - RNA, 13 nt, Human
ggagggcaggcau

SEQ ID NO: 1196025 - RNA, 12 nt, Human
ggagggauuugg

SEQ ID NO: 1196026 - RNA, 13 nt, Human
ggauagaugugug

SEQ ID NO: 1196027 - RNA, 14 nt, Human
ggauagaugugugg

SEQ ID NO: 1196028 - RNA, 15 nt, Human
ggauagaugugugga

SEQ ID NO: 1196029 - RNA, 20 nt, Human
ggaucccaugagcuccuuaa

SEQ ID NO: 1196030 - RNA, 17 nt, Human
ggaucccaugagcuccu

SEQ ID NO: 1196031 - RNA, 20 nt, Human
ggcagucugagagaggccau

SEQ ID NO: 1196032 - RNA, 15 nt, Human
gggaaggaucccaug

SEQ ID NO: 1196033 - RNA, 19 nt, Human
gggcagucugagagaggcc

SEQ ID NO: 1196034 - RNA, 18 nt, Human
gggcagucugagagaggc

SEQ ID NO: 1196035 - RNA, 17 nt, Human
gggcagucugagagagg

SEQ ID NO: 1196036 - RNA, 23 nt, Human
gggaggugcuucuaguucugcca

SEQ ID NO: 1196037 - RNA, 16 nt, Human
gggaguuuaggguggg

SEQ ID NO: 1196038 - RNA, 11 nt, Human
gggagugugua

SEQ ID NO: 1196039 - RNA, 14 nt, Human
gggauagaugugug

SEQ ID NO: 1196040 - RNA, 13 nt, Human
gggauagaugugu

SEQ ID NO: 1196041 - RNA, 21 nt, Human
gggcagucugagagaggccau

SEQ ID NO: 1196042 - RNA, 20 nt, Human
gggcagucugagagaggcca

SEQ ID NO: 1196043 - RNA, 15 nt, Human
gggccugggcaggag

SEQ ID NO: 1196044 - RNA, 13 nt, Human
gggccugggcagg

SEQ ID NO: 1196045 - RNA, 12 nt, Human
gggccugggcag

SEQ ID NO: 1196046 - RNA, 17 nt, Human
gggccugggcaggaggg

SEQ ID NO: 1196047 - RNA, 16 nt, Human
gggccugggcaggagg

SEQ ID NO: 1196048 - RNA, 16 nt, Human
ggggcgcggcugggag

SEQ ID NO: 1196049 - RNA, 15 nt, Human
ggggcgcggcuggga

SEQ ID NO: 1196050 - RNA, 19 nt, Human
ggggcagucugagagaggc

SEQ ID NO: 1196051 - RNA, 15 nt, Human
ggggcagucugagag

SEQ ID NO: 1196052 - RNA, 18 nt, Human
ggggcagucugagagagg

SEQ ID NO: 1196053 - RNA, 15 nt, Human
gggggagagggcugc

SEQ ID NO: 1196054 - RNA, 21 nt, Human
gguguccugcaccggggccug

SEQ ID NO: 1196055 - RNA, 15 nt, Human
ggugguggcucggga

SEQ ID NO: 1196056 - RNA, 22 nt, Human
uagugauuuuuaugccaccuga

SEQ ID NO: 1196057 - RNA, 21 nt, Human
uagugauuuuuaugccaccug

SEQ ID NO: 1196058 - RNA, 20 nt, Human
uagugauuuuuaugccaccu

SEQ ID NO: 1196059 - RNA, 13 nt, Human
uaggcuagggugg

SEQ ID NO: 1196060 - RNA, 15 nt, Human
uaggcuagggugggg

SEQ ID NO: 1196061 - RNA, 15 nt, Human
uaggaacugcugggc

SEQ ID NO: 1196062 - RNA, 18 nt, Human
uaggaacugcugggcuug

SEQ ID NO: 1196063 - RNA, 11 nt, Human
uagaugugugg

SEQ ID NO: 1196064 - RNA, 19 nt, Human
uaauucuuugaccuguugg

SEQ ID NO: 1196065 - RNA, 19 nt, Human
gguugggagaaugucagua

SEQ ID NO: 1196066 - RNA, 18 nt, Human
ucacgccagacuucccac

SEQ ID NO: 1196067 - RNA, 22 nt, Human
ucagucuuuaaucugagaggcc

SEQ ID NO: 1196068 - RNA, 19 nt, Human
uccuuaaggcucuuuugua

SEQ ID NO: 1196069 - RNA, 16 nt, Human
uccuuaaggcucuuuu

SEQ ID NO: 1196070 - RNA, 19 nt, Human
ucuuuuguaagguuuuugu

SEQ ID NO: 1196071 - RNA, 22 nt, Human
ucuguguguguguauguggggg

SEQ ID NO: 1196072 - RNA, 15 nt, Human
ucuguguguuuaugu

SEQ ID NO: 1196073 - RNA, 16 nt, Human
ucuguguguuuaugug

SEQ ID NO: 1196074 - RNA, 19 nt, Human
ucuguguguuuaugugugu

SEQ ID NO: 1196075 - RNA, 20 nt, Human
ucuguguguuuaugugugug

SEQ ID NO: 1196076 - RNA, 15 nt, Human
ucuguguguguguau

SEQ ID NO: 1196077 - RNA, 18 nt, Human
ucuguguguguguaugug

SEQ ID NO: 1196078 - RNA, 19 nt, Human
ucuguguguguguaugugg

SEQ ID NO: 1196079 - RNA, 21 nt, Human
ucuguguguguguaugugggg

SEQ ID NO: 1196080 - RNA, 19 nt, Human
ugcuucuaguucugccagg

SEQ ID NO: 1196081 - RNA, 18 nt, Human
ugcuucuaguucugccag

SEQ ID NO: 1196082 - RNA, 20 nt, Human
ugcuucuaguucugccagga

SEQ ID NO: 1196083 - RNA, 21 nt, Human
uggaagugugggucugugugu

SEQ ID NO: 1196084 - RNA, 23 nt, Human
uggaagugugggucugugugugu

SEQ ID NO: 1196085 - RNA, 18 nt, Human
uggggcaggggccggggg

SEQ ID NO: 1196086 - RNA, 16 nt, Human
uggggcaggggccggg

SEQ ID NO: 1196087 - RNA, 15 nt, Human
uuacagaggacagua

SEQ ID NO: 1196088 - RNA, 14 nt, Human
uguguauguggggg

SEQ ID NO: 1196089 - RNA, 23 nt, Human
uguguaugugggggucugugugu

SEQ ID NO: 1196090 - RNA, 15 nt, Human
uguguuuaugugugu

SEQ ID NO: 1196091 - RNA, 13 nt, Human
uguguuuaugugu

SEQ ID NO: 1196092 - RNA, 14 nt, Human
uguguugugugugg

SEQ ID NO: 1196093 - RNA, 23 nt, Human
uguguugugugugggagugugua

SEQ ID NO: 1196094 - RNA, 11 nt, Human
uguguguaugu

SEQ ID NO: 1196095 - RNA, 21 nt, Human
uguuuacagaggacaguauuu

SEQ ID NO: 1196096 - RNA, 14 nt, Human
uguuuacagaggac

SEQ ID NO: 1196097 - RNA, 16 nt, Human
ugugggggucugugug

SEQ ID NO: 1196098 - RNA, 14 nt, Human
ugugggucugugug

SEQ ID NO: 1196099 - RNA, 16 nt, Human
ugugggucugugugug

SEQ ID NO: 1196100 - RNA, 20 nt, Human
ugugggucugugugugugua

SEQ ID NO: 1196101 - RNA, 18 nt, Human
ugugaggggcucucucau

SEQ ID NO: 1196102 - RNA, 15 nt, Human
uguaaauuuauguga

SEQ ID NO: 1196103 - RNA, 16 nt, Human
uguaaauuuaugugau

SEQ ID NO: 1196104 - RNA, 17 nt, Human
uuuagaagaaguguguc

SEQ ID NO: 1196105 - RNA, 19 nt, Human
uuuagaagaagugugucac

SEQ ID NO: 1196106 - RNA, 15 nt, Human
cucgugucuggcaca

SEQ ID NO: 1196107 - RNA, 18 nt, Human
cucaugugacucuuucca

SEQ ID NO: 1196108 - RNA, 22 nt, Human
cugagagaggccauucuuuccc

SEQ ID NO: 1196109 - RNA, 21 nt, Human
cugagagaggccauucuuucc

SEQ ID NO: 1196110 - RNA, 14 nt, Human
cugagagaggccau

SEQ ID NO: 1196111 - RNA, 13 nt, Human
cugagagaggcca

SEQ ID NO: 1196112 - RNA, 12 nt, Human
cugagaggccac

SEQ ID NO: 1196113 - RNA, 21 nt, Human
cuaauucuuugaccuguuggg

SEQ ID NO: 1196114 - RNA, 22 nt, Human
cuaauucuuugaccuguuggga

SEQ ID NO: 1196115 - RNA, 17 nt, Human
ccauccuacccccugug

SEQ ID NO: 1196116 - RNA, 19 nt, Human
cacuggggcaggggccggg

SEQ ID NO: 1196117 - RNA, 15 nt, Human
cacuggggcaggggc

SEQ ID NO: 1196118 - RNA, 13 nt, Human
cacuggggcaggg

SEQ ID NO: 1196119 - RNA, 18 nt, Human
caacaccucuuggggagu

SEQ ID NO: 1196120 - RNA, 19 nt, Human
auucuuugaccuguuggga

SEQ ID NO: 1196121 - RNA, 17 nt, Human
cagaggguguccugcac

SEQ ID NO: 1196122 - RNA, 23 nt, Human
cagaucauuaucagccugugcca

SEQ ID NO: 1196123 - RNA, 17 nt, Human
cagucugagagaggcca

SEQ ID NO: 1196124 - RNA, 16 nt, Human
cagggcugaggccucu

SEQ ID NO: 1196125 - RNA, 18 nt, Human
cagggcugaggccucuca

SEQ ID NO: 1196126 - RNA, 11 nt, Human
ggaguguguaa

SEQ ID NO: 1196127 - RNA, 22 nt, Human
ggaguguguaauuuaaaauugu

SEQ ID NO: 1196128 - RNA, 14 nt, Human
ggagggggagaggg

SEQ ID NO: 1196129 - RNA, 12 nt, Human
ggcaggggccgg

SEQ ID NO: 1196130 - RNA, 14 nt, Human
ggcaggagggaggu

SEQ ID NO: 1196131 - RNA, 18 nt, Human
ggcauccagagucccugc

SEQ ID NO: 1196132 - RNA, 16 nt, Human
ggcauccagagucccu

SEQ ID NO: 1196133 - RNA, 22 nt, Human
ggcaucggggagccgggagccu

SEQ ID NO: 1196134 - RNA, 23 nt, Human
ggcaucggggagccgggagccug

SEQ ID NO: 1196135 - RNA, 22 nt, Human
gggggcagucugagagaggcca

SEQ ID NO: 1196136 - RNA, 21 nt, Human
gggucaucuguaccucugccu

SEQ ID NO: 1196137 - RNA, 18 nt, Human
gggucauucauggccugg

SEQ ID NO: 1196138 - RNA, 21 nt, Human
ggguguccugcaccggggccu

SEQ ID NO: 1196139 - RNA, 17 nt, Human
ggguguccugcaccggg

SEQ ID NO: 1196140 - RNA, 18 nt, Human
gguaggaacugcugggcu

SEQ ID NO: 1196141 - RNA, 21 nt, Human
gguggggagagacgggcccug

SEQ ID NO: 1196142 - RNA, 22 nt, Human
gguggggggggggcgcggcugg

SEQ ID NO: 1196143 - RNA, 22 nt, Human
gguuuguuuagaagaagugugu

SEQ ID NO: 1196144 - RNA, 20 nt, Human
gcugggaauaagugccagga

SEQ ID NO: 1196145 - RNA, 22 nt, Human
gcuuuuccucaaagggagagag

SEQ ID NO: 1196146 - RNA, 16 nt, Human
ggacaccuaggcuagg

SEQ ID NO: 1196147 - RNA, 19 nt, Human
ggacaguauuuguggggag

SEQ ID NO: 1196148 - RNA, 18 nt, Human
ggacaguauuugugggga

SEQ ID NO: 1196149 - RNA, 16 nt, Human
ggacaccccgacuuuu

SEQ ID NO: 1196150 - RNA, 18 nt, Human
gcuaggguggggagagac

SEQ ID NO: 1196151 - RNA, 17 nt, Human
gcuaggguggggagaga

SEQ ID NO: 1196152 - RNA, 19 nt, Human
gcucagaggguguccugca

SEQ ID NO: 1196153 - RNA, 18 nt, Human
gcucagaggguguccugc

SEQ ID NO: 1196154 - RNA, 13 nt, Human
gcggcugggagga

SEQ ID NO: 1196155 - RNA, 21 nt, Human
gcguggaacucgugucuggca

SEQ ID NO: 1196156 - RNA, 19 nt, Human
gccauucuuucccaacacc

SEQ ID NO: 1196157 - RNA, 15 nt, Human
gaucccaugagcucc

SEQ ID NO: 1196158 - RNA, 19 nt, Human
gaucccaacacugccagca

SEQ ID NO: 1196159 - RNA, 18 nt, Human
gaucccaacacugccagc

SEQ ID NO: 1196160 - RNA, 17 nt, Human
gaucccaacacugccag

SEQ ID NO: 1196161 - RNA, 13 nt, Human
gauggaaugaugg

SEQ ID NO: 1196162 - RNA, 21 nt, Human
gcauccagagucccugccugg

SEQ ID NO: 1196163 - RNA, 23 nt, Human
gcauccagagucccugccuggac

SEQ ID NO: 1196164 - RNA, 22 nt, Human
gcauccagagucccugccugga

SEQ ID NO: 1196165 - RNA, 17 nt, Human
gcaucggggagccggga

SEQ ID NO: 1196166 - RNA, 22 nt, Human
gaggacaguauuuguggggagg

SEQ ID NO: 1196167 - RNA, 16 nt, Human
gagacgggcccuggug

SEQ ID NO: 1196168 - RNA, 19 nt, Human
cuuccucuccugucucccu

SEQ ID NO: 1196169 - RNA, 15 nt, Human
cuuccucuccugucu

SEQ ID NO: 1196170 - RNA, 17 nt, Human
cuucuaccucuuggcug

SEQ ID NO: 1196171 - RNA, 14 nt, Human
cuuuugucccagaa

SEQ ID NO: 1196172 - RNA, 23 nt, Human
cuggcccuaugcuuccggccucc

SEQ ID NO: 1196173 - RNA, 22 nt, Human
gucccgggacaccuaggcuagg

SEQ ID NO: 1196174 - RNA, 15 nt, Human
guccaucagccucca

SEQ ID NO: 1196175 - RNA, 10 nt, Human
gugauguguc

SEQ ID NO: 1196176 - RNA, 15 nt, Human
uaaaauugugaugug

SEQ ID NO: 1196177 - RNA, 16 nt, Human
uaaaauugugaugugu

SEQ ID NO: 1196178 - RNA, 20 nt, Human
aagugugggucugugugugu

SEQ ID NO: 1196179 - RNA, 10 nt, Human
aagugugggu

SEQ ID NO: 1196180 - RNA, 17 nt, Human
aagugugggucugugug

SEQ ID NO: 1196181 - RNA, 18 nt, Human
aagugugggucugugugu

SEQ ID NO: 1196182 - RNA, 21 nt, Human
aagucacuggccaguggcugg

SEQ ID NO: 1196183 - RNA, 13 nt, Human
guguauguggggg

SEQ ID NO: 1196184 - RNA, 21 nt, Human
guguaugugggggucugugug

SEQ ID NO: 1196185 - RNA, 16 nt, Human
acaccucuuggggagu

SEQ ID NO: 1196186 - RNA, 12 nt, Human
uauguggaagug

SEQ ID NO: 1196187 - RNA, 16 nt, Human
uauguggaaguguggg

SEQ ID NO: 1196188 - RNA, 20 nt, Human
uauggggauagaugugugga

SEQ ID NO: 1196189 - RNA, 22 nt, Human
uaacuuaaaagaacauguauau

SEQ ID NO: 1196190 - RNA, 13 nt, Human
accgaggcaggga

SEQ ID NO: 1196191 - RNA, 16 nt, Human
ucauaaauuuaugguu

SEQ ID NO: 1196192 - RNA, 12 nt, Human
ucaguaugugga

SEQ ID NO: 1196193 - RNA, 14 nt, Human
ucaguauguggaag

SEQ ID NO: 1196194 - RNA, 16 nt, Human
ucaguauguggaagug

SEQ ID NO: 1196195 - RNA, 19 nt, Human
ucaugugacucuuuccaac

SEQ ID NO: 1196196 - RNA, 18 nt, Human
ucaugugacucuuuccaa

SEQ ID NO: 1196197 - RNA, 17 nt, Human
ucauguuuacagaggac

SEQ ID NO: 1196198 - RNA, 17 nt, Human
ucaugugacucuuucca

SEQ ID NO: 1196199 - RNA, 14 nt, Human
ucaugugacucuuu

SEQ ID NO: 1196200 - RNA, 17 nt, Human
accuaggcuaggguggg

SEQ ID NO: 1196201 - RNA, 12 nt, Human
accuaggcuagg

SEQ ID NO: 1196202 - RNA, 17 nt, Human
ucagauuugccuuauug

SEQ ID NO: 1196203 - RNA, 22 nt, Human
ucagauuugccuuauuggcagc

SEQ ID NO: 1196204 - RNA, 23 nt, Human
ucacagcaagucacuggccagug

SEQ ID NO: 1196205 - RNA, 19 nt, Human
uccugcaccggggccuggg

SEQ ID NO: 1196206 - RNA, 18 nt, Human
uccugcaccggggccugg

SEQ ID NO: 1196207 - RNA, 16 nt, Human
ucuaguucugccagga

SEQ ID NO: 1196208 - RNA, 15 nt, Human
ucuaguucugccagg

SEQ ID NO: 1196209 - RNA, 17 nt, Human
ucuaguucugccaggag

SEQ ID NO: 1196210 - RNA, 14 nt, Human
agaagaaguguguc

SEQ ID NO: 1196211 - RNA, 13 nt, Human
agaaugucaguau

SEQ ID NO: 1196212 - RNA, 13 nt, Human
ugagagaggccau

SEQ ID NO: 1196213 - RNA, 13 nt, Human
ugcuccccacguc

SEQ ID NO: 1196214 - RNA, 22 nt, Human
ugcuauuguagagccagagguc

SEQ ID NO: 1196215 - RNA, 15 nt, Human
ugcuguagacauuug

SEQ ID NO: 1196216 - RNA, 22 nt, Human
uggaccagccucuccacucaug

SEQ ID NO: 1196217 - RNA, 16 nt, Human
uggaccagccucucca

SEQ ID NO: 1196218 - RNA, 19 nt, Human
aggccauucuuucccaaca

SEQ ID NO: 1196219 - RNA, 18 nt, Human
aggccauucuuucccaac

SEQ ID NO: 1196220 - RNA, 17 nt, Human
aggccauucuuucccaa

SEQ ID NO: 1196221 - RNA, 21 nt, Human
aggccucucauuccagaggaa

SEQ ID NO: 1196222 - RNA, 14 nt, Human
uggccaguggcugg

SEQ ID NO: 1196223 - RNA, 15 nt, Human
uggccaguggcugga

SEQ ID NO: 1196224 - RNA, 16 nt, Human
uggccaguggcuggau

SEQ ID NO: 1196225 - RNA, 23 nt, Human
uggccaguggcuggaucugugag

SEQ ID NO: 1196226 - RNA, 22 nt, Human
uggaccuuuccugaggaagagg

SEQ ID NO: 1196227 - RNA, 22 nt, Human
uggcugccuugugaaggaauua

SEQ ID NO: 1196228 - RNA, 14 nt, Human
agcugccugugccu

SEQ ID NO: 1196229 - RNA, 14 nt, Human
aguccaucagccuc

SEQ ID NO: 1196230 - RNA, 13 nt, Human
aguccaucagccu

SEQ ID NO: 1196231 - RNA, 16 nt, Human
aguccaucagccucca

SEQ ID NO: 1196232 - RNA, 21 nt, Human
uguaugugggggucugugugu

SEQ ID NO: 1196233 - RNA, 22 nt, Human
uguaugugggggucuguguguu

SEQ ID NO: 1196234 - RNA, 22 nt, Human
uguauccauccauggggcugau

SEQ ID NO: 1196235 - RNA, 13 nt, Human
agucccugccugg

SEQ ID NO: 1196236 - RNA, 11 nt, Human
ugugauguguc

SEQ ID NO: 1196237 - RNA, 13 nt, Human
ugggucugugugu

SEQ ID NO: 1196238 - RNA, 15 nt, Human
ugggucugugugugu

SEQ ID NO: 1196239 - RNA, 23 nt, Human
ugggaauaagugccaggauggaa

SEQ ID NO: 1196240 - RNA, 14 nt, Human
uuaucaacauuugu

SEQ ID NO: 1196241 - RNA, 18 nt, Human
uguugggagugaggaugu

SEQ ID NO: 1196242 - RNA, 18 nt, Human
aucggggagccgggagcc

SEQ ID NO: 1196243 - RNA, 16 nt, Human
aucggggagccgggag

SEQ ID NO: 1196244 - RNA, 20 nt, Human
auccauggggcugauuguau

SEQ ID NO: 1196245 - RNA, 20 nt, Human
aucauuaucagccugugcca

SEQ ID NO: 1196246 - RNA, 16 nt, Human
uucagauuugccuuau

SEQ ID NO: 1196247 - RNA, 22 nt, Human
uuguccucagccccgcguggaa

SEQ ID NO: 1196248 - RNA, 18 nt, Human
uugucccugaagagaagg

SEQ ID NO: 1196249 - RNA, 20 nt, Human
uugucacgccagacuuccca

SEQ ID NO: 1196250 - RNA, 13 nt, Human
uugucacgccaga

SEQ ID NO: 1196251 - RNA, 10 nt, Human
uugugugugg

SEQ ID NO: 1196252 - RNA, 13 nt, Human
uugugugugggag

SEQ ID NO: 1196253 - RNA, 16 nt, Human
uugugugugggagugu

SEQ ID NO: 1196254 - RNA, 20 nt, Human
uugcuaugagcuggggaugu

SEQ ID NO: 1196255 - RNA, 16 nt, Human
uuuuguuuaccagaga

SEQ ID NO: 1196256 - RNA, 13 nt, Human
auguggaagugug

SEQ ID NO: 1196257 - RNA, 15 nt, Human
auguggaaguguggg

SEQ ID NO: 1196258 - RNA, 16 nt, Human
auguggaagugugggu

SEQ ID NO: 1196259 - RNA, 22 nt, Human
auguggaagugugggucugugu

SEQ ID NO: 1196260 - RNA, 23 nt, Human
auguggaagugugggucugugug

SEQ ID NO: 1196261 - RNA, 10 nt, Human
augugugugu

SEQ ID NO: 1196262 - RNA, 18 nt, Human
auguguguguguugugug

SEQ ID NO: 1196263 - RNA, 13 nt, Human
auugugauguguc

SEQ ID NO: 1196264 - RNA, 14 nt, Human
auugugaugugucc

SEQ ID NO: 1196265 - RNA, 15 nt, Human
auugugauguguccu

SEQ ID NO: 1196266 - RNA, 12 nt, Human
auugguguugac

SEQ ID NO: 1196267 - RNA, 15 nt, Human
acagguuagcugcuc

SEQ ID NO: 1196268 - RNA, 15 nt, Human
accccgacuuuuguu

SEQ ID NO: 1196269 - RNA, 12 nt, Human
accccgacuuuu

SEQ ID NO: 1196270 - RNA, 22 nt, Human
acgccagacuucccacggcucc

SEQ ID NO: 1196271 - RNA, 16 nt, Human
acgccagacuucccac

SEQ ID NO: 1196272 - RNA, 13 nt, Human
acucagucuuuaa

SEQ ID NO: 1196273 - RNA, 16 nt, Human
aaugucaguaugugga

SEQ ID NO: 1196274 - RNA, 22 nt, Human
aaugucaguauguggaagugug

SEQ ID NO: 1196275 - RNA, 16 nt, Human
agaggguguccugcac

SEQ ID NO: 1196276 - RNA, 14 nt, Human
agacgggcccuggu

SEQ ID NO: 1196277 - RNA, 13 nt, Human
agccagaggucug

SEQ ID NO: 1196278 - RNA, 17 nt, Human
aggggccgggggcaguc

SEQ ID NO: 1196279 - RNA, 23 nt, Human
aggugcuucuaguucugccagga

SEQ ID NO: 1196280 - RNA, 22 nt, Human
aggugcuucuaguucugccagg

SEQ ID NO: 1196281 - RNA, 21 nt, Human
aggugcuucuaguucugccag

SEQ ID NO: 1196282 - RNA, 19 nt, Human
aggcuauggggauagaugu

SEQ ID NO: 1196283 - RNA, 21 nt, Human
aggcuauggggauagaugugu

SEQ ID NO: 1196284 - RNA, 22 nt, Human
aggcuauggggauagaugugug

SEQ ID NO: 1196285 - RNA, 16 nt, Human
aggaacugcugggcuu

SEQ ID NO: 1196286 - RNA, 17 nt, Human
augugggggucugugug

SEQ ID NO: 1196287 - RNA, 18 nt, Human
augugggggucugugugu

SEQ ID NO: 1196288 - RNA, 16 nt, Human
augugggggucugugu

SEQ ID NO: 1196289 - RNA, 20 nt, Human
aguuguaucagcacgugugg

SEQ ID NO: 1196290 - RNA, 23 nt, Human
aguuguaucagcacguguggccu

SEQ ID NO: 1196291 - RNA, 14 nt, Human
caacacugccagca

SEQ ID NO: 1196292 - RNA, 13 nt, Human
caacacugccagc

SEQ ID NO: 1196293 - RNA, 12 nt, Human
caacacugccag

SEQ ID NO: 1196294 - RNA, 22 nt, Human
caaccggcuuuguggcacuggg

SEQ ID NO: 1196295 - RNA, 13 nt, Human
caaccggcuuugu

SEQ ID NO: 1196296 - RNA, 22 nt, Human
caccggggccugggcaggaggg

SEQ ID NO: 1196297 - RNA, 21 nt, Human
caccggggccugggcaggagg

SEQ ID NO: 1196298 - RNA, 14 nt, Human
caccggggccuggg

SEQ ID NO: 1196299 - RNA, 22 nt, Human
cacggcuccucgagaucccaac

SEQ ID NO: 1196300 - RNA, 20 nt, Human
cacggcuccucgagauccca

SEQ ID NO: 1196301 - RNA, 19 nt, Human
cacguguggccuguucuuc

SEQ ID NO: 1196302 - RNA, 16 nt, Human
cacucaugugacucuu

SEQ ID NO: 1196303 - RNA, 22 nt, Human
cacucaugugacucuuuccaac

SEQ ID NO: 1196304 - RNA, 22 nt, Human
cagacuucccacggcuccucga

SEQ ID NO: 1196305 - RNA, 12 nt, Human
cagacuucccac

SEQ ID NO: 1196306 - RNA, 18 nt, Human
cagagaaaaagggagggg

SEQ ID NO: 1196307 - RNA, 17 nt, Human
cagagaaaaagggaggg

SEQ ID NO: 1196308 - RNA, 12 nt, Human
cagagaaaaagg

SEQ ID NO: 1196309 - RNA, 14 nt, Human
cagagucccugccu

SEQ ID NO: 1196310 - RNA, 18 nt, Human
cagagucccugccuggac

SEQ ID NO: 1196311 - RNA, 22 nt, Human
cagaggacaguauuugugggga

SEQ ID NO: 1196312 - RNA, 15 nt, Human
cagcauuucccuucc

SEQ ID NO: 1196313 - RNA, 18 nt, Human
cagccuccauccuacccc

SEQ ID NO: 1196314 - RNA, 21 nt, Human
cagccuccauccuacccccug

SEQ ID NO: 1196315 - RNA, 23 nt, Human
cagccuggcuguggccuaaccug

SEQ ID NO: 1196316 - RNA, 23 nt, Human
cagccucuccacucaugugacuc

SEQ ID NO: 1196317 - RNA, 18 nt, Human
caggaaccgaggcaggga

SEQ ID NO: 1196318 - RNA, 17 nt, Human
caggaaccgaggcaggg

SEQ ID NO: 1196319 - RNA, 15 nt, Human
caggaaccgaggcag

SEQ ID NO: 1196320 - RNA, 23 nt, Human
caggagacagguuagcugcuccc

SEQ ID NO: 1196321 - RNA, 14 nt, Human
caggagucccugcc

SEQ ID NO: 1196322 - RNA, 15 nt, Human
caggagucccugcca

SEQ ID NO: 1196323 - RNA, 21 nt, Human
caggagucccugccaucaugu

SEQ ID NO: 1196324 - RNA, 21 nt, Human
caggcaucggggagccgggag

SEQ ID NO: 1196325 - RNA, 20 nt, Human
caggcaucggggagccggga

SEQ ID NO: 1196326 - RNA, 15 nt, Human
caggcucagagggug

SEQ ID NO: 1196327 - RNA, 11 nt, Human
caggcucagag

SEQ ID NO: 1196328 - RNA, 18 nt, Human
cagggaaggaucccauga

SEQ ID NO: 1196329 - RNA, 13 nt, Human
cagggaaggaucc

SEQ ID NO: 1196330 - RNA, 22 nt, Human
cagucuuuaaucugagaggcca

SEQ ID NO: 1196331 - RNA, 12 nt, Human
caguauguggaa

SEQ ID NO: 1196332 - RNA, 12 nt, Human
cagguguucuuc

SEQ ID NO: 1196333 - RNA, 20 nt, Human
cauccagagucccugccugg

SEQ ID NO: 1196334 - RNA, 18 nt, Human
cauccagagucccugccu

SEQ ID NO: 1196335 - RNA, 17 nt, Human
cauccagagucccugcc

SEQ ID NO: 1196336 - RNA, 13 nt, Human
cauccagaguccc

SEQ ID NO: 1196337 - RNA, 21 nt, Human
cauccagagucccugccugga

SEQ ID NO: 1196338 - RNA, 13 nt, Human
caucauguuuaca

SEQ ID NO: 1196339 - RNA, 19 nt, Human
caucauguuuacagaggac

SEQ ID NO: 1196340 - RNA, 21 nt, Human
caucauguuuacagaggacag

SEQ ID NO: 1196341 - RNA, 15 nt, Human
cauccuacccccugu

SEQ ID NO: 1196342 - RNA, 19 nt, Human
cauccuacccccugugccu

SEQ ID NO: 1196343 - RNA, 18 nt, Human
cauccuacccccugugcc

SEQ ID NO: 1196344 - RNA, 23 nt, Human
caugagcuccuuaaggcucuuuu

SEQ ID NO: 1196345 - RNA, 19 nt, Human
caugaguuggcugggaaua

SEQ ID NO: 1196346 - RNA, 17 nt, Human
caugugacucuuuccaa

SEQ ID NO: 1196347 - RNA, 16 nt, Human
caugugacucuuucca

SEQ ID NO: 1196348 - RNA, 14 nt, Human
caugugacucuuuc

SEQ ID NO: 1196349 - RNA, 14 nt, Human
cauucuuucccaac

SEQ ID NO: 1196350 - RNA, 12 nt, Human
cauucuuuccca

SEQ ID NO: 1196351 - RNA, 14 nt, Human
cauuccagaggaag

SEQ ID NO: 1196352 - RNA, 13 nt, Human
cauuccagaggaa

SEQ ID NO: 1196353 - RNA, 20 nt, Human
ccaccugaauaaagaaugaa

SEQ ID NO: 1196354 - RNA, 22 nt, Human
ccacucaugugacucuuuccaa

SEQ ID NO: 1196355 - RNA, 19 nt, Human
ccacucaugugacucuuuc

SEQ ID NO: 1196356 - RNA, 21 nt, Human
ccagcauuucccuuccuuccu

SEQ ID NO: 1196357 - RNA, 16 nt, Human
ccagcauuucccuucc

SEQ ID NO: 1196358 - RNA, 13 nt, Human
ccaggagacaggu

SEQ ID NO: 1196359 - RNA, 18 nt, Human
ccauccuacccccugugc

SEQ ID NO: 1196360 - RNA, 15 nt, Human
ccgaggcagggaagg

SEQ ID NO: 1196361 - RNA, 16 nt, Human
ccggcuuuguggcacu

SEQ ID NO: 1196362 - RNA, 19 nt, Human
ccgggacaccuaggcuagg

SEQ ID NO: 1196363 - RNA, 20 nt, Human
ccgggacaccuaggcuaggg

SEQ ID NO: 1196364 - RNA, 18 nt, Human
ccucuccacucaugugac

SEQ ID NO: 1196365 - RNA, 18 nt, Human
ccucucauuccagaggaa

SEQ ID NO: 1196366 - RNA, 14 nt, Human
ccugggcaggaggg

SEQ ID NO: 1196367 - RNA, 12 nt, Human
ccugggcaggag

SEQ ID NO: 1196368 - RNA, 19 nt, Human
ccugaggaagagggacugu

SEQ ID NO: 1196369 - RNA, 18 nt, Human
ccuuaaggcucuuuugua

SEQ ID NO: 1196370 - RNA, 16 nt, Human
ccuuaaggcucuuuug

SEQ ID NO: 1196371 - RNA, 13 nt, Human
ccuuaaggcucuu

SEQ ID NO: 1196372 - RNA, 18 nt, Human
ccuugucacgccagacuu

SEQ ID NO: 1196373 - RNA, 15 nt, Human
ccuugucacgccaga

SEQ ID NO: 1196374 - RNA, 21 nt, Human
cgagaucccaacacugccagc

SEQ ID NO: 1196375 - RNA, 15 nt, Human
cgagaucccaacacu

SEQ ID NO: 1196376 - RNA, 13 nt, Human
cgagaucccaaca

SEQ ID NO: 1196377 - RNA, 22 nt, Human
cgagaucccaacacugccagca

SEQ ID NO: 1196378 - RNA, 23 nt, Human
cucgagaucccaacacugccagc

SEQ ID NO: 1196379 - RNA, 22 nt, Human
cucgagaucccaacacugccag

SEQ ID NO: 1196380 - RNA, 21 nt, Human
cucgagaucccaacacugcca

SEQ ID NO: 1196381 - RNA, 13 nt, Human
cucgagaucccaa

SEQ ID NO: 1196382 - RNA, 14 nt, Human
cuauuguagagcca

SEQ ID NO: 1196383 - RNA, 20 nt, Human
cucugcccgggagcucagga

SEQ ID NO: 1196384 - RNA, 14 nt, Human
cucugcccgggagc

SEQ ID NO: 1196385 - RNA, 12 nt, Human
cugagcaggugu

SEQ ID NO: 1196386 - RNA, 17 nt, Human
cugccuggaccagccuc

SEQ ID NO: 1196387 - RNA, 13 nt, Human
cugauuguauuua

SEQ ID NO: 1196388 - RNA, 22 nt, Human
cuggugguggcucgggaggcga

SEQ ID NO: 1196389 - RNA, 14 nt, Human
cuggugguggcucg

SEQ ID NO: 1196390 - RNA, 18 nt, Human
cuguggccuaaccugccg

SEQ ID NO: 1196391 - RNA, 14 nt, Human
cuguguguguguau

SEQ ID NO: 1196392 - RNA, 15 nt, Human
cuguguguguguaug

SEQ ID NO: 1196393 - RNA, 16 nt, Human
cuguguguguguaugu

SEQ ID NO: 1196394 - RNA, 18 nt, Human
cuguguguguguaugugg

SEQ ID NO: 1196395 - RNA, 20 nt, Human
cuguguguguguaugugggg

SEQ ID NO: 1196396 - RNA, 18 nt, Human
cuguguguuuaugugugu

SEQ ID NO: 1196397 - RNA, 20 nt, Human
cuguguguuuaugugugugu

SEQ ID NO: 1196398 - RNA, 21 nt, Human
cuguguguguguauguggggg

SEQ ID NO: 1196399 - RNA, 15 nt, Human
cuuaaggcucuuuug

SEQ ID NO: 1196400 - RNA, 19 nt, Human
cuuccaaacaggcucagag

SEQ ID NO: 1196401 - RNA, 17 nt, Human
cuuucccaacaccucuu

SEQ ID NO: 1196402 - RNA, 19 nt, Human
gaaggaucccaugagcucc

SEQ ID NO: 1196403 - RNA, 17 nt, Human
gaauaaagaaugaaugg

SEQ ID NO: 1196404 - RNA, 20 nt, Human
gaauaagugccaggauggaa

SEQ ID NO: 1196405 - RNA, 14 nt, Human
gaaugccuccugca

SEQ ID NO: 1196406 - RNA, 13 nt, Human
gaacuauuagagc

SEQ ID NO: 1196407 - RNA, 20 nt, Human
gagcuccuuaaggcucuuuu

SEQ ID NO: 1196408 - RNA, 23 nt, Human
gagcucaggaaccgaggcaggga

SEQ ID NO: 1196409 - RNA, 15 nt, Human
gaggagggcaggcau

SEQ ID NO: 1196410 - RNA, 14 nt, Human
gaggagggcaggca

SEQ ID NO: 1196411 - RNA, 13 nt, Human
gaggagggcaggc

SEQ ID NO: 1196412 - RNA, 15 nt, Human
gaggaugucugggcc

SEQ ID NO: 1196413 - RNA, 15 nt, Human
gagucccugccugga

SEQ ID NO: 1196414 - RNA, 14 nt, Human
gagucccugccugg

SEQ ID NO: 1196415 - RNA, 14 nt, Human
gagucccugccauc

SEQ ID NO: 1196416 - RNA, 19 nt, Human
gagucccugccuggaccag

SEQ ID NO: 1196417 - RNA, 16 nt, Human
gagucccugccuggac

SEQ ID NO: 1196418 - RNA, 22 nt, Human
gagguuuguuuagaagaagugu

SEQ ID NO: 1196419 - RNA, 21 nt, Human
gauguguccugauaagcugag

SEQ ID NO: 1196420 - RNA, 23 nt, Human
gcaggcaucggggagccgggagc

SEQ ID NO: 1196421 - RNA, 22 nt, Human
gcaggcaucggggagccgggag

SEQ ID NO: 1196422 - RNA, 21 nt, Human
gcaggcaucggggagccggga

SEQ ID NO: 1196423 - RNA, 16 nt, Human
gccaccugaauaaaga

SEQ ID NO: 1196424 - RNA, 15 nt, Human
gccacgauugcagga

SEQ ID NO: 1196425 - RNA, 21 nt, Human
gccagacuucccacggcuccu

SEQ ID NO: 1196426 - RNA, 17 nt, Human
gccuggaccagccucuc

SEQ ID NO: 1196427 - RNA, 16 nt, Human
gccuggaccagccucu

SEQ ID NO: 1196428 - RNA, 16 nt, Human
gccugggcaggaggga

SEQ ID NO: 1196429 - RNA, 17 nt, Human
gcgaagcguuguccuca

SEQ ID NO: 1196430 - RNA, 17 nt, Human
gccuugucacgccagac

SEQ ID NO: 1196431 - RNA, 16 nt, Human
gccuugucacgccaga

SEQ ID NO: 1196432 - RNA, 15 nt, Human
gccuugucacgccag

SEQ ID NO: 1196433 - RNA, 21 nt, Human
gcuccuuaaggcucuuuugua

SEQ ID NO: 1196434 - RNA, 17 nt, Human
gcuccuuaaggcucuuu

SEQ ID NO: 1196435 - RNA, 15 nt, Human
gcuccuuaaggcucu

SEQ ID NO: 1196436 - RNA, 21 nt, Human
gcugggaggagggcaggcauc

SEQ ID NO: 1196437 - RNA, 22 nt, Human
gcugggcuuggcagcccggguc

SEQ ID NO: 1196438 - RNA, 14 nt, Human
gcuggggaugucuc

SEQ ID NO: 1196439 - RNA, 20 nt, Human
gcuguggccuaaccugccga

SEQ ID NO: 1196440 - RNA, 19 nt, Human
gcuguggccuaaccugccg

SEQ ID NO: 1196441 - RNA, 14 nt, Human
gcugauuguauuua

SEQ ID NO: 1196442 - RNA, 12 nt, Human
ggaccagccucu

SEQ ID NO: 1196443 - RNA, 19 nt, Human
ggagacagguuagcugcuc

SEQ ID NO: 1196444 - RNA, 21 nt, Human
ggagcucaggaaccgaggcag

SEQ ID NO: 1196445 - RNA, 21 nt, Human
ggccuaaccugccgagagucc

SEQ ID NO: 1196446 - RNA, 16 nt, Human
ggccuaaccugccgag

SEQ ID NO: 1196447 - RNA, 15 nt, Human
ggccuaaccugccga

SEQ ID NO: 1196448 - RNA, 20 nt, Human
ggccucucauuccagaggaa

SEQ ID NO: 1196449 - RNA, 19 nt, Human
ggccugggcaggagggagg

SEQ ID NO: 1196450 - RNA, 17 nt, Human
ggccugggcaggaggga

SEQ ID NO: 1196451 - RNA, 15 nt, Human
ggccugggcaggagg

SEQ ID NO: 1196452 - RNA, 16 nt, Human
ggccugacucucagca

SEQ ID NO: 1196453 - RNA, 21 nt, Human
ggcugggaggagggcaggcau

SEQ ID NO: 1196454 - RNA, 20 nt, Human
ggcugggaggagggcaggca

SEQ ID NO: 1196455 - RNA, 13 nt, Human
ggcugggaggagg

SEQ ID NO: 1196456 - RNA, 23 nt, Human
ggcuguggcauccagagucccug

SEQ ID NO: 1196457 - RNA, 21 nt, Human
ggcuguggcauccagaguccc

SEQ ID NO: 1196458 - RNA, 14 nt, Human
gggacaccuaggcu

SEQ ID NO: 1196459 - RNA, 20 nt, Human
gggacaccaagccuuggcuc

SEQ ID NO: 1196460 - RNA, 22 nt, Human
gggagcucaggaaccgaggcag

SEQ ID NO: 1196461 - RNA, 12 nt, Human
gggagcucagga

SEQ ID NO: 1196462 - RNA, 23 nt, Human
gggagcucaggaaccgaggcagg

SEQ ID NO: 1196463 - RNA, 13 nt, Human
gggagccgggagc

SEQ ID NO: 1196464 - RNA, 12 nt, Human
gggaggagggca

SEQ ID NO: 1196465 - RNA, 16 nt, Human
gggaggagggcaggca

SEQ ID NO: 1196466 - RNA, 19 nt, Human
ucagaggguguccugcacc

SEQ ID NO: 1196467 - RNA, 14 nt, Human
ucauuccagaggaa

SEQ ID NO: 1196468 - RNA, 12 nt, Human
uauucccaugag

SEQ ID NO: 1196469 - RNA, 13 nt, Human
ucccugccuggac

SEQ ID NO: 1196470 - RNA, 19 nt, Human
ucccuuccuuccucuccug

SEQ ID NO: 1196471 - RNA, 16 nt, Human
ucccuuccuuccucuc

SEQ ID NO: 1196472 - RNA, 16 nt, Human
ucccuccucugcccgg

SEQ ID NO: 1196473 - RNA, 21 nt, Human
ucgugucuggcacagccuggc

SEQ ID NO: 1196474 - RNA, 14 nt, Human
ucgugucuggcaca

SEQ ID NO: 1196475 - RNA, 15 nt, Human
ucugccaggagacag

SEQ ID NO: 1196476 - RNA, 18 nt, Human
ugauuuuuaugccaccug

SEQ ID NO: 1196477 - RNA, 17 nt, Human
ugcccgggagcucagga

SEQ ID NO: 1196478 - RNA, 18 nt, Human
ugcccgggagcucaggaa

SEQ ID NO: 1196479 - RNA, 22 nt, Human
ugccaucauguuuacagaggac

SEQ ID NO: 1196480 - RNA, 21 nt, Human
ugcauuauauuuguaaauuua

SEQ ID NO: 1196481 - RNA, 14 nt, Human
ugaguuggcuggga

SEQ ID NO: 1196482 - RNA, 16 nt, Human
ugaguuggcugggaau

SEQ ID NO: 1196483 - RNA, 17 nt, Human
ugaguuggcugggaaua

SEQ ID NO: 1196484 - RNA, 23 nt, Human
uggccuaaccugccgagagucca

SEQ ID NO: 1196485 - RNA, 20 nt, Human
uggcuccauugguguugaca

SEQ ID NO: 1196486 - RNA, 18 nt, Human
ugggaggagggcaggcau

SEQ ID NO: 1196487 - RNA, 17 nt, Human
ugggaggagggcaggca

SEQ ID NO: 1196488 - RNA, 14 nt, Human
ugggaggagggcag

SEQ ID NO: 1196489 - RNA, 13 nt, Human
uguccucagcccc

SEQ ID NO: 1196490 - RNA, 18 nt, Human
uguccugcaccggggccu

SEQ ID NO: 1196491 - RNA, 17 nt, Human
uguaaauuuaugugaug

SEQ ID NO: 1196492 - RNA, 19 nt, Human
uuuccaaccggcuuugugg

SEQ ID NO: 1196493 - RNA, 21 nt, Human
uuccugaggaagagggacugu

SEQ ID NO: 1196494 - RNA, 21 nt, Human
uuuuauuuuucucaugaugag

SEQ ID NO: 1196495 - RNA, 18 nt, Human
cugacccucaucuuucuu

SEQ ID NO: 1196496 - RNA, 18 nt, Human
cugaggaagagggacugu

SEQ ID NO: 1196497 - RNA, 23 nt, Human
cugaggaagagggacuguucuuu

SEQ ID NO: 1196498 - RNA, 13 nt, Human
cuaguucugccag

SEQ ID NO: 1196499 - RNA, 15 nt, Human
cuaggguggggagag

SEQ ID NO: 1196500 - RNA, 16 nt, Human
cuaguucugccaggag

SEQ ID NO: 1196501 - RNA, 15 nt, Human
cuaguucugccagga

SEQ ID NO: 1196502 - RNA, 14 nt, Human
cuaguucugccagg

SEQ ID NO: 1196503 - RNA, 15 nt, Human
cuaggcuaggguggg

SEQ ID NO: 1196504 - RNA, 13 nt, Human
cgugucuggcaca

SEQ ID NO: 1196505 - RNA, 20 nt, Human
ccauucuuucccaacaccuc

SEQ ID NO: 1196506 - RNA, 14 nt, Human
ccauucuuucccaa

SEQ ID NO: 1196507 - RNA, 12 nt, Human
ccauucuuuccc

SEQ ID NO: 1196508 - RNA, 22 nt, Human
ccugacccucaucuuucuucca

SEQ ID NO: 1196509 - RNA, 19 nt, Human
ccugacccucaucuuucuu

SEQ ID NO: 1196510 - RNA, 18 nt, Human
ccugacccucaucuuucu

SEQ ID NO: 1196511 - RNA, 18 nt, Human
ccugccaucauguuuaca

SEQ ID NO: 1196512 - RNA, 20 nt, Human
ccugccaucauguuuacaga

SEQ ID NO: 1196513 - RNA, 21 nt, Human
ccuggugguggcucgggaggc

SEQ ID NO: 1196514 - RNA, 18 nt, Human
ccuggugguggcucggga

SEQ ID NO: 1196515 - RNA, 21 nt, Human
ccugucucccuccucugcccg

SEQ ID NO: 1196516 - RNA, 18 nt, Human
cagucugagagaggccau

SEQ ID NO: 1196517 - RNA, 15 nt, Human
caggccugacucuca

SEQ ID NO: 1196518 - RNA, 19 nt, Human
cauccauggggcugauugu

SEQ ID NO: 1196519 - RNA, 17 nt, Human
caccuaggcuagggugg

SEQ ID NO: 1196520 - RNA, 15 nt, Human
ggcagggcugaggcc

SEQ ID NO: 1196521 - RNA, 20 nt, Human
ggcucagaggguguccugca

SEQ ID NO: 1196522 - RNA, 14 nt, Human
ggcucagagugggg

SEQ ID NO: 1196523 - RNA, 22 nt, Human
gggacaccuaggcuaggguggg

SEQ ID NO: 1196524 - RNA, 17 nt, Human
ggggccgggggcagucu

SEQ ID NO: 1196525 - RNA, 18 nt, Human
gggggcgcggcugggagg

SEQ ID NO: 1196526 - RNA, 18 nt, Human
ggguggggagagacgggc

SEQ ID NO: 1196527 - RNA, 14 nt, Human
ggguggggagagac

SEQ ID NO: 1196528 - RNA, 22 nt, Human
ggugcuucuaguucugccagga

SEQ ID NO: 1196529 - RNA, 23 nt, Human
guaauuuaaaauugugauguguc

SEQ ID NO: 1196530 - RNA, 19 nt, Human
guaauuuaaaauugugaug

SEQ ID NO: 1196531 - RNA, 20 nt, Human
guaauuuaaaauugugaugu

SEQ ID NO: 1196532 - RNA, 15 nt, Human
guagagccagagguc

SEQ ID NO: 1196533 - RNA, 17 nt, Human
gcuucuaguucugccag

SEQ ID NO: 1196534 - RNA, 16 nt, Human
gcuucuaguucugcca

SEQ ID NO: 1196535 - RNA, 20 nt, Human
ggaacugcugggcuuggcag

SEQ ID NO: 1196536 - RNA, 12 nt, Human
ggaagugugggu

SEQ ID NO: 1196537 - RNA, 21 nt, Human
ggaagugugggucugugugug

SEQ ID NO: 1196538 - RNA, 22 nt, Human
ggaagugugggucugugugugu

SEQ ID NO: 1196539 - RNA, 22 nt, Human
gcuaauucuuugaccuguuggg

SEQ ID NO: 1196540 - RNA, 21 nt, Human
gcucaggaaccgaggcaggga

SEQ ID NO: 1196541 - RNA, 20 nt, Human
gcucaggaaccgaggcaggg

SEQ ID NO: 1196542 - RNA, 19 nt, Human
gcucaggaaccgaggcagg

SEQ ID NO: 1196543 - RNA, 16 nt, Human
gcucaggaaccgaggc

SEQ ID NO: 1196544 - RNA, 23 nt, Human
gccuccauccuacccccugugcc

SEQ ID NO: 1196545 - RNA, 18 nt, Human
gcauuucccuuccuuccu

SEQ ID NO: 1196546 - RNA, 15 nt, Human
gacuauggagcugag

SEQ ID NO: 1196547 - RNA, 20 nt, Human
gacccucaucuuucuuccaa

SEQ ID NO: 1196548 - RNA, 19 nt, Human
gacccucaucuuucuucca

SEQ ID NO: 1196549 - RNA, 15 nt, Human
gacccucaucuuucu

SEQ ID NO: 1196550 - RNA, 18 nt, Human
cuucuaguucugccagga

SEQ ID NO: 1196551 - RNA, 17 nt, Human
cuucuaguucugccagg

SEQ ID NO: 1196552 - RNA, 16 nt, Human
cuucuaguucugccag

SEQ ID NO: 1196553 - RNA, 19 nt, Human
cuucuaguucugccaggag

SEQ ID NO: 1196554 - RNA, 14 nt, Human
cuuugaccuguugg

SEQ ID NO: 1196555 - RNA, 18 nt, Human
cugggaauaagugccagg

SEQ ID NO: 1196556 - RNA, 16 nt, Human
cuggggaugucucuca

SEQ ID NO: 1196557 - RNA, 17 nt, Human
cuggggaugucucucau

SEQ ID NO: 1196558 - RNA, 15 nt, Human
cuuaggccagcacca

SEQ ID NO: 1196559 - RNA, 20 nt, Human
cugugccuugucacgccaga

SEQ ID NO: 1196560 - RNA, 16 nt, Human
cugugccuuuugccau

SEQ ID NO: 1196561 - RNA, 20 nt, Human
guccugcaccggggccuggg

SEQ ID NO: 1196562 - RNA, 19 nt, Human
guccugcaccggggccugg

SEQ ID NO: 1196563 - RNA, 15 nt, Human
guccugcaccggggc

SEQ ID NO: 1196564 - RNA, 18 nt, Human
guggcacuggggcagggg

SEQ ID NO: 1196565 - RNA, 17 nt, Human
guggcacuggggcaggg

SEQ ID NO: 1196566 - RNA, 14 nt, Human
gugggggucugugu

SEQ ID NO: 1196567 - RNA, 15 nt, Human
gugggggucugugug

SEQ ID NO: 1196568 - RNA, 16 nt, Human
gugggggucugugugu

SEQ ID NO: 1196569 - RNA, 13 nt, Human
guguguguaugug

SEQ ID NO: 1196570 - RNA, 14 nt, Human
guguguguaugugg

SEQ ID NO: 1196571 - RNA, 17 nt, Human
guguguguugugugugg

SEQ ID NO: 1196572 - RNA, 17 nt, Human
aauaagugccaggaugg

SEQ ID NO: 1196573 - RNA, 14 nt, Human
guugggagaauguc

SEQ ID NO: 1196574 - RNA, 21 nt, Human
guugggagaaugucaguaugu

SEQ ID NO: 1196575 - RNA, 12 nt, Human
guguuuaugugu

SEQ ID NO: 1196576 - RNA, 16 nt, Human
guguuuaugugugugu

SEQ ID NO: 1196577 - RNA, 19 nt, Human
uaccagagaaaaagggagg

SEQ ID NO: 1196578 - RNA, 14 nt, Human
aauuuaugugaugg

SEQ ID NO: 1196579 - RNA, 18 nt, Human
aauucuuugaccuguugg

SEQ ID NO: 1196580 - RNA, 22 nt, Human
aauucuuugaccuguugggagu

SEQ ID NO: 1196581 - RNA, 14 nt, Human
uaguucugccagga

SEQ ID NO: 1196582 - RNA, 13 nt, Human
uaguucugccagg

SEQ ID NO: 1196583 - RNA, 23 nt, Human
acaccuaggcuaggguggggaga

SEQ ID NO: 1196584 - RNA, 20 nt, Human
acaccuaggcuagggugggg

SEQ ID NO: 1196585 - RNA, 12 nt, Human
acagccuggcug

SEQ ID NO: 1196586 - RNA, 19 nt, Human
uauggggauagaugugugg

SEQ ID NO: 1196587 - RNA, 17 nt, Human
uauggggauagaugugu

SEQ ID NO: 1196588 - RNA, 18 nt, Human
uauggggauagaugugug

SEQ ID NO: 1196589 - RNA, 21 nt, Human
acagacacucccacuuggcau

SEQ ID NO: 1196590 - RNA, 23 nt, Human
uauguguguguguuguguguggg

SEQ ID NO: 1196591 - RNA, 11 nt, Human
uaugugugugu

SEQ ID NO: 1196592 - RNA, 14 nt, Human
uauguguguguguu

SEQ ID NO: 1196593 - RNA, 22 nt, Human
uauguguguguguugugugugg

SEQ ID NO: 1196594 - RNA, 20 nt, Human
accagagaaaaagggagggg

SEQ ID NO: 1196595 - RNA, 16 nt, Human
ucagccccgcguggaa

SEQ ID NO: 1196596 - RNA, 22 nt, Human
acccagcuaugguucucucgca

SEQ ID NO: 1196597 - RNA, 18 nt, Human
ucaggaaccgaggcaggg

SEQ ID NO: 1196598 - RNA, 15 nt, Human
ucaggccgaaggagg

SEQ ID NO: 1196599 - RNA, 18 nt, Human
accugaauaaagaaugaa

SEQ ID NO: 1196600 - RNA, 22 nt, Human
ucaugauagaaggcuaugggga

SEQ ID NO: 1196601 - RNA, 17 nt, Human
acucaugugacucuuuc

SEQ ID NO: 1196602 - RNA, 16 nt, Human
acucaugugacucuuu

SEQ ID NO: 1196603 - RNA, 15 nt, Human
acucaugugacucuu

SEQ ID NO: 1196604 - RNA, 11 nt, Human
uccucagcccc

SEQ ID NO: 1196605 - RNA, 21 nt, Human
acucuggagguuuguuuagaa

SEQ ID NO: 1196606 - RNA, 21 nt, Human
uccugcaccggggccugggca

SEQ ID NO: 1196607 - RNA, 20 nt, Human
uccugcaccggggccugggc

SEQ ID NO: 1196608 - RNA, 23 nt, Human
ucgagaucccaacacugccagca

SEQ ID NO: 1196609 - RNA, 22 nt, Human
ucgagaucccaacacugccagc

SEQ ID NO: 1196610 - RNA, 14 nt, Human
acuggggcaggggc

SEQ ID NO: 1196611 - RNA, 17 nt, Human
ugaggaagagggacugu

SEQ ID NO: 1196612 - RNA, 22 nt, Human
ugagggugacuauggagcugag

SEQ ID NO: 1196613 - RNA, 22 nt, Human
agagggacuguucuuuuguccc

SEQ ID NO: 1196614 - RNA, 11 nt, Human
ucuggcccuau

SEQ ID NO: 1196615 - RNA, 19 nt, Human
agccugacccucaucuuuc

SEQ ID NO: 1196616 - RNA, 19 nt, Human
ugccuugugaaggaauuau

SEQ ID NO: 1196617 - RNA, 15 nt, Human
agcuggggaugucuc

SEQ ID NO: 1196618 - RNA, 22 nt, Human
uggcacagccuggcuguggccu

SEQ ID NO: 1196619 - RNA, 15 nt, Human
aggccauucuuuccc

SEQ ID NO: 1196620 - RNA, 14 nt, Human
aggccauucuuucc

SEQ ID NO: 1196621 - RNA, 22 nt, Human
uggcauccagagucccugccug

SEQ ID NO: 1196622 - RNA, 21 nt, Human
uggcauccagagucccugccu

SEQ ID NO: 1196623 - RNA, 20 nt, Human
uggcauccagagucccugcc

SEQ ID NO: 1196624 - RNA, 16 nt, Human
aggccugacucucagc

SEQ ID NO: 1196625 - RNA, 18 nt, Human
aggcgaagcguuguccuc

SEQ ID NO: 1196626 - RNA, 20 nt, Human
aggcucagaggguguccugc

SEQ ID NO: 1196627 - RNA, 19 nt, Human
aggcucagaggguguccug

SEQ ID NO: 1196628 - RNA, 18 nt, Human
aggcucagaggguguccu

SEQ ID NO: 1196629 - RNA, 20 nt, Human
uggaagugugggucugugug

SEQ ID NO: 1196630 - RNA, 13 nt, Human
uggaagugugggu

SEQ ID NO: 1196631 - RNA, 14 nt, Human
uggaaguguggguc

SEQ ID NO: 1196632 - RNA, 20 nt, Human
uggcuguggccuaaccugcc

SEQ ID NO: 1196633 - RNA, 17 nt, Human
uggcuguggcauccaga

SEQ ID NO: 1196634 - RNA, 21 nt, Human
uguagugauuuuuaugccacc

SEQ ID NO: 1196635 - RNA, 20 nt, Human
uguagugauuuuuaugccac

SEQ ID NO: 1196636 - RNA, 14 nt, Human
aguauuugugggga

SEQ ID NO: 1196637 - RNA, 20 nt, Human
agugauuuuuaugccaccug

SEQ ID NO: 1196638 - RNA, 16 nt, Human
agugauuuuuaugcca

SEQ ID NO: 1196639 - RNA, 21 nt, Human
agugauuuuuaugccaccuga

SEQ ID NO: 1196640 - RNA, 14 nt, Human
agugaggaugucug

SEQ ID NO: 1196641 - RNA, 18 nt, Human
agugccaggauggaauga

SEQ ID NO: 1196642 - RNA, 9 nt, Human
aguguguaa

SEQ ID NO: 1196643 - RNA, 16 nt, Human
agugggguagguuggg

SEQ ID NO: 1196644 - RNA, 18 nt, Human
uguguguuguguguggga

SEQ ID NO: 1196645 - RNA, 10 nt, Human
uuaugugugu

SEQ ID NO: 1196646 - RNA, 12 nt, Human
uuaugugugugu

SEQ ID NO: 1196647 - RNA, 14 nt, Human
uuaugugugugugu

SEQ ID NO: 1196648 - RNA, 19 nt, Human
auagaaggcuauggggaua

SEQ ID NO: 1196649 - RNA, 11 nt, Human
auagaugugug

SEQ ID NO: 1196650 - RNA, 12 nt, Human
auagaugugugg

SEQ ID NO: 1196651 - RNA, 13 nt, Human
auagaugugugga

SEQ ID NO: 1196652 - RNA, 14 nt, Human
auagauguguggac

SEQ ID NO: 1196653 - RNA, 18 nt, Human
auaaucacaacccuucag

SEQ ID NO: 1196654 - RNA, 13 nt, Human
uucugccaggaga

SEQ ID NO: 1196655 - RNA, 19 nt, Human
auccauagcaccuccacau

SEQ ID NO: 1196656 - RNA, 16 nt, Human
auccuacccccugugc

SEQ ID NO: 1196657 - RNA, 14 nt, Human
auccuacccccugu

SEQ ID NO: 1196658 - RNA, 13 nt, Human
aucaggccauugu

SEQ ID NO: 1196659 - RNA, 16 nt, Human
aucaggccauuguccc

SEQ ID NO: 1196660 - RNA, 16 nt, Human
augugacucuuuccaa

SEQ ID NO: 1196661 - RNA, 12 nt, Human
augugacucuuu

SEQ ID NO: 1196662 - RNA, 21 nt, Human
augugacucuuuccaaccggc

SEQ ID NO: 1196663 - RNA, 16 nt, Human
augguucucaggccug

SEQ ID NO: 1196664 - RNA, 20 nt, Human
auggggauagauguguggac

SEQ ID NO: 1196665 - RNA, 20 nt, Human
auuucccuuccuuccucucc

SEQ ID NO: 1196666 - RNA, 16 nt, Human
auuucccuuccuuccu

SEQ ID NO: 1196667 - RNA, 18 nt, Human
auuuguaaauuuauguga

SEQ ID NO: 1196668 - RNA, 19 nt, Human
auuuguaaauuuaugugau

SEQ ID NO: 1196669 - RNA, 12 nt, Human
auuuuucucaug

SEQ ID NO: 1196670 - RNA, 12 nt, Human
auuccagaggaa

SEQ ID NO: 1196671 - RNA, 13 nt, Human
aagggagggggag

SEQ ID NO: 1196672 - RNA, 13 nt, Human
aaugucaguaugu

SEQ ID NO: 1196673 - RNA, 15 nt, Human
aaugucaguaugugg

SEQ ID NO: 1196674 - RNA, 12 nt, Human
acugccagcauu

SEQ ID NO: 1196675 - RNA, 23 nt, Human
accugccgagaguccaucagccu

SEQ ID NO: 1196676 - RNA, 16 nt, Human
accugccgagagucca

SEQ ID NO: 1196677 - RNA, 11 nt, Human
acacugccagc

SEQ ID NO: 1196678 - RNA, 13 nt, Human
acccccugugccu

SEQ ID NO: 1196679 - RNA, 22 nt, Human
agcuccuuaaggcucuuuugua

SEQ ID NO: 1196680 - RNA, 14 nt, Human
agcugagcaggugu

SEQ ID NO: 1196681 - RNA, 17 nt, Human
agcugcuccccacguca

SEQ ID NO: 1196682 - RNA, 14 nt, Human
agcugcuccccacg

SEQ ID NO: 1196683 - RNA, 21 nt, Human
aggagucccugccaucauguu

SEQ ID NO: 1196684 - RNA, 14 nt, Human
agccgggagccuga

SEQ ID NO: 1196685 - RNA, 20 nt, Human
agaggacaguauuugugggg

SEQ ID NO: 1196686 - RNA, 19 nt, Human
augagcuccuuaaggcucu

SEQ ID NO: 1196687 - RNA, 14 nt, Human
aucagccugugcca

SEQ ID NO: 1196688 - RNA, 18 nt, Human
aguucauaaauuuauggu

SEQ ID NO: 1196689 - RNA, 16 nt, Human
aguggcuggaucugug

SEQ ID NO: 1196690 - RNA, 16 nt, Human
caccccgacuuuuguu

SEQ ID NO: 1196691 - RNA, 16 nt, Human
cccaacacugccagca

SEQ ID NO: 1196692 - RNA, 15 nt, Human
cccaacacugccagc

SEQ ID NO: 1196693 - RNA, 14 nt, Human
cccaacacugccag

SEQ ID NO: 1196694 - RNA, 15 nt, Human
cccacgucagcuggg

SEQ ID NO: 1196695 - RNA, 15 nt, Human
cccacggcuccucga

SEQ ID NO: 1196696 - RNA, 22 nt, Human
cccaugagcuccuuaaggcucu

SEQ ID NO: 1196697 - RNA, 15 nt, Human
cccaugagcuccuua

SEQ ID NO: 1196698 - RNA, 14 nt, Human
cccaugagcuccuu

SEQ ID NO: 1196699 - RNA, 13 nt, Human
cccaugagcuccu

SEQ ID NO: 1196700 - RNA, 18 nt, Human
cccagaaugccuccugca

SEQ ID NO: 1196701 - RNA, 22 nt, Human
cccccugugccuugucacgcca

SEQ ID NO: 1196702 - RNA, 14 nt, Human
ccccugugccuugu

SEQ ID NO: 1196703 - RNA, 20 nt, Human
ccgagaguccaucagccucc

SEQ ID NO: 1196704 - RNA, 21 nt, Human
ccgagaguccaucagccucca

SEQ ID NO: 1196705 - RNA, 21 nt, Human
ccgggggcagucugagagagg

SEQ ID NO: 1196706 - RNA, 20 nt, Human
ccggggccugggcaggaggg

SEQ ID NO: 1196707 - RNA, 23 nt, Human
ccguggcuguggcauccagaguc

SEQ ID NO: 1196708 - RNA, 22 nt, Human
ccgggucaucuguaccucugcc

SEQ ID NO: 1196709 - RNA, 13 nt, Human
ccuaaccugccga

SEQ ID NO: 1196710 - RNA, 12 nt, Human
ccuaaccugccg

SEQ ID NO: 1196711 - RNA, 16 nt, Human
ccuaggcuaggguggg

SEQ ID NO: 1196712 - RNA, 17 nt, Human
ccugcaccggggccugg

SEQ ID NO: 1196713 - RNA, 15 nt, Human
ccugcaccggggccu

SEQ ID NO: 1196714 - RNA, 19 nt, Human
ccugaagagaagggcaggg

SEQ ID NO: 1196715 - RNA, 23 nt, Human
ccugccgagaguccaucagccuc

SEQ ID NO: 1196716 - RNA, 22 nt, Human
ccugccgagaguccaucagccu

SEQ ID NO: 1196717 - RNA, 14 nt, Human
ccugccgagagucc

SEQ ID NO: 1196718 - RNA, 21 nt, Human
cgaagcguuguccucagcccc

SEQ ID NO: 1196719 - RNA, 17 nt, Human
cgaagcguuguccucag

SEQ ID NO: 1196720 - RNA, 16 nt, Human
cgaagcguuguccuca

SEQ ID NO: 1196721 - RNA, 15 nt, Human
cgaagcguuguccuc

SEQ ID NO: 1196722 - RNA, 14 nt, Human
ccuuugucccagaa

SEQ ID NO: 1196723 - RNA, 17 nt, Human
ccugugccuuuugccau

SEQ ID NO: 1196724 - RNA, 12 nt, Human
cgcggcugggag

SEQ ID NO: 1196725 - RNA, 11 nt, Human
cgcggcuggga

SEQ ID NO: 1196726 - RNA, 16 nt, Human
cgcggcugggaggagg

SEQ ID NO: 1196727 - RNA, 19 nt, Human
cgggacaccuaggcuaggg

SEQ ID NO: 1196728 - RNA, 18 nt, Human
cgggacaccuaggcuagg

SEQ ID NO: 1196729 - RNA, 13 nt, Human
cuacccccugugc

SEQ ID NO: 1196730 - RNA, 16 nt, Human
cucagaggguguccug

SEQ ID NO: 1196731 - RNA, 17 nt, Human
cucagccccgcguggaa

SEQ ID NO: 1196732 - RNA, 19 nt, Human
cucaggaaccgaggcaggg

SEQ ID NO: 1196733 - RNA, 18 nt, Human
cucaggaaccgaggcagg

SEQ ID NO: 1196734 - RNA, 17 nt, Human
cucaggaaccgaggcag

SEQ ID NO: 1196735 - RNA, 22 nt, Human
cuccacucaugugacucuuucc

SEQ ID NO: 1196736 - RNA, 16 nt, Human
cuccacucaugugacu

SEQ ID NO: 1196737 - RNA, 20 nt, Human
cuccccacgucagcugggac

SEQ ID NO: 1196738 - RNA, 21 nt, Human
cuauggggauagaugugugga

SEQ ID NO: 1196739 - RNA, 19 nt, Human
cuauggggauagaugugug

SEQ ID NO: 1196740 - RNA, 20 nt, Human
cuauggggauagaugugugg

SEQ ID NO: 1196741 - RNA, 22 nt, Human
cuacucuggagguuuguuuaga

SEQ ID NO: 1196742 - RNA, 23 nt, Human
cugccgagaguccaucagccucc

SEQ ID NO: 1196743 - RNA, 22 nt, Human
cugccgagaguccaucagccuc

SEQ ID NO: 1196744 - RNA, 11 nt, Human
cugcugggcuu

SEQ ID NO: 1196745 - RNA, 18 nt, Human
cuggaccagccucuccac

SEQ ID NO: 1196746 - RNA, 14 nt, Human
cuggaccagccucu

SEQ ID NO: 1196747 - RNA, 12 nt, Human
cuggagguuugu

SEQ ID NO: 1196748 - RNA, 17 nt, Human
cuggagguuuguuuaga

SEQ ID NO: 1196749 - RNA, 21 nt, Human
cuggccaguggcuggaucugu

SEQ ID NO: 1196750 - RNA, 21 nt, Human
cugucucccuccucugcccgg

SEQ ID NO: 1196751 - RNA, 19 nt, Human
cugugaggggcucucucau

SEQ ID NO: 1196752 - RNA, 16 nt, Human
cuguguguuuaugugu

SEQ ID NO: 1196753 - RNA, 17 nt, Human
cuguguguuuaugugug

SEQ ID NO: 1196754 - RNA, 13 nt, Human
cuuucccaacacc

SEQ ID NO: 1196755 - RNA, 18 nt, Human
cuugucacgccagacuuc

SEQ ID NO: 1196756 - RNA, 16 nt, Human
cuugucacgccagacu

SEQ ID NO: 1196757 - RNA, 13 nt, Human
cuugucacgccag

SEQ ID NO: 1196758 - RNA, 14 nt, Human
cuuuguggcacugg

SEQ ID NO: 1196759 - RNA, 14 nt, Human
gaccagccucucca

SEQ ID NO: 1196760 - RNA, 19 nt, Human
gaaugucaguauguggaag

SEQ ID NO: 1196761 - RNA, 13 nt, Human
gaaugucaguaug

SEQ ID NO: 1196762 - RNA, 16 nt, Human
gaaugucaguaugugg

SEQ ID NO: 1196763 - RNA, 18 nt, Human
gaaugucaguauguggaa

SEQ ID NO: 1196764 - RNA, 13 nt, Human
gagagacgggccc

SEQ ID NO: 1196765 - RNA, 17 nt, Human
gagaaugucaguaugug

SEQ ID NO: 1196766 - RNA, 20 nt, Human
gagaucccaacacugccagc

SEQ ID NO: 1196767 - RNA, 19 nt, Human
gagaucccaacacugccag

SEQ ID NO: 1196768 - RNA, 18 nt, Human
gagaucccaacacugcca

SEQ ID NO: 1196769 - RNA, 14 nt, Human
gaggcagggaagga

SEQ ID NO: 1196770 - RNA, 21 nt, Human
gaggcgaagcguuguccucag

SEQ ID NO: 1196771 - RNA, 20 nt, Human
gaggcgaagcguuguccuca

SEQ ID NO: 1196772 - RNA, 22 nt, Human
gaggccucucauuccagaggaa

SEQ ID NO: 1196773 - RNA, 14 nt, Human
gagggggagagggc

SEQ ID NO: 1196774 - RNA, 13 nt, Human
gaggguguccugc

SEQ ID NO: 1196775 - RNA, 23 nt, Human
gagucccugccuggaccagccuc

SEQ ID NO: 1196776 - RNA, 21 nt, Human
gagucccugccuggaccagcc

SEQ ID NO: 1196777 - RNA, 14 nt, Human
gauagaugugugga

SEQ ID NO: 1196778 - RNA, 22 nt, Human
gauagauguguggacacauugg

SEQ ID NO: 1196779 - RNA, 13 nt, Human
gaguguguaauuu

SEQ ID NO: 1196780 - RNA, 18 nt, Human
gcacuggggcaggggccg

SEQ ID NO: 1196781 - RNA, 15 nt, Human
gcacuggggcagggg

SEQ ID NO: 1196782 - RNA, 23 nt, Human
gcacuggggcaggggccgggggc

SEQ ID NO: 1196783 - RNA, 15 nt, Human
gaugggucaguugua

SEQ ID NO: 1196784 - RNA, 21 nt, Human
gaugggucaguuguaucagca

SEQ ID NO: 1196785 - RNA, 23 nt, Human
gcccuggugguggcucgggaggc

SEQ ID NO: 1196786 - RNA, 17 nt, Human
gccugacccucaucuuu

SEQ ID NO: 1196787 - RNA, 17 nt, Human
gcuaugagcuggggaug

SEQ ID NO: 1196788 - RNA, 21 nt, Human
gcucagaggguguccugcacc

SEQ ID NO: 1196789 - RNA, 22 nt, Human
gcuuuguggcacuggggcaggg

SEQ ID NO: 1196790 - RNA, 14 nt, Human
gcuuuguggcacug

SEQ ID NO: 1196791 - RNA, 22 nt, Human
ggaaggaucccaugagcuccuu

SEQ ID NO: 1196792 - RNA, 23 nt, Human
ggaagggacaccaagccuuggcu

SEQ ID NO: 1196793 - RNA, 22 nt, Human
ggagaaugucaguauguggaag

SEQ ID NO: 1196794 - RNA, 20 nt, Human
ggccauucuuucccaacacc

SEQ ID NO: 1196795 - RNA, 17 nt, Human
ggauggaaugauggguc

SEQ ID NO: 1196796 - RNA, 22 nt, Human
ggccuaaccugccgagagucca

SEQ ID NO: 1196797 - RNA, 12 nt, Human
ggcccugugccu

SEQ ID NO: 1196798 - RNA, 16 nt, Human
ggcuaggguggggaga

SEQ ID NO: 1196799 - RNA, 21 nt, Human
ggcuauggggauagaugugug

SEQ ID NO: 1196800 - RNA, 13 nt, Human
ggccugggcagga

SEQ ID NO: 1196801 - RNA, 14 nt, Human
ggccugggcaggag

SEQ ID NO: 1196802 - RNA, 16 nt, Human
ggcgcggcugggagga

SEQ ID NO: 1196803 - RNA, 14 nt, Human
gggcgcggcuggga

SEQ ID NO: 1196804 - RNA, 18 nt, Human
ggggaguuuagggugggg

SEQ ID NO: 1196805 - RNA, 13 nt, Human
ggggauagaugug

SEQ ID NO: 1196806 - RNA, 14 nt, Human
gucacgccagacuu

SEQ ID NO: 1196807 - RNA, 20 nt, Human
gucccagaaugccuccugca

SEQ ID NO: 1196808 - RNA, 12 nt, Human
guccucagcccc

SEQ ID NO: 1196809 - RNA, 23 nt, Human
gucccugccuggaccagccucuc

SEQ ID NO: 1196810 - RNA, 22 nt, Human
gucccugccuggaccagccucu

SEQ ID NO: 1196811 - RNA, 21 nt, Human
gucccugccuggaccagccuc

SEQ ID NO: 1196812 - RNA, 20 nt, Human
gucccugccuggaccagccu

SEQ ID NO: 1196813 - RNA, 12 nt, Human
gugacucuuucc

SEQ ID NO: 1196814 - RNA, 20 nt, Human
gugauuuuuaugccaccuga

SEQ ID NO: 1196815 - RNA, 19 nt, Human
gugauuuuuaugccaccug

SEQ ID NO: 1196816 - RNA, 17 nt, Human
gugauuuuuaugccacc

SEQ ID NO: 1196817 - RNA, 16 nt, Human
gugauuuuuaugccac

SEQ ID NO: 1196818 - RNA, 19 nt, Human
gugccuugucacgccagac

SEQ ID NO: 1196819 - RNA, 22 nt, Human
gugcuucuaguucugccaggag

SEQ ID NO: 1196820 - RNA, 21 nt, Human
gugcuucuaguucugccagga

SEQ ID NO: 1196821 - RNA, 20 nt, Human
gugcuucuaguucugccagg

SEQ ID NO: 1196822 - RNA, 18 nt, Human
guggcucgggaggcgaag

SEQ ID NO: 1196823 - RNA, 14 nt, Human
guggcauccagagu

SEQ ID NO: 1196824 - RNA, 16 nt, Human
uaggcuagggugggga

SEQ ID NO: 1196825 - RNA, 23 nt, Human
uaugagcuggggaugucucucau

SEQ ID NO: 1196826 - RNA, 14 nt, Human
uccaaacaggcuca

SEQ ID NO: 1196827 - RNA, 12 nt, Human
ucaucuuucuuc

SEQ ID NO: 1196828 - RNA, 21 nt, Human
uccagagucccugccuggacc

SEQ ID NO: 1196829 - RNA, 20 nt, Human
uccagagucccugccuggac

SEQ ID NO: 1196830 - RNA, 19 nt, Human
uccagagucccugccugga

SEQ ID NO: 1196831 - RNA, 18 nt, Human
uccagagucccugccugg

SEQ ID NO: 1196832 - RNA, 17 nt, Human
uccuacccccugugccu

SEQ ID NO: 1196833 - RNA, 16 nt, Human
uccuacccccugugcc

SEQ ID NO: 1196834 - RNA, 15 nt, Human
uccuacccccugugc

SEQ ID NO: 1196835 - RNA, 13 nt, Human
uccuacccccugu

SEQ ID NO: 1196836 - RNA, 23 nt, Human
uccugucucccuccucugcccgg

SEQ ID NO: 1196837 - RNA, 15 nt, Human
uccugucucccuccu

SEQ ID NO: 1196838 - RNA, 18 nt, Human
ucucccuccucugcccgg

SEQ ID NO: 1196839 - RNA, 21 nt, Human
ugagcuccuuaaggcucuuuu

SEQ ID NO: 1196840 - RNA, 19 nt, Human
ugagcuccuuaaggcucuu

SEQ ID NO: 1196841 - RNA, 20 nt, Human
ugagcuggggaugucucuca

SEQ ID NO: 1196842 - RNA, 17 nt, Human
ugacauacauccaacau

SEQ ID NO: 1196843 - RNA, 15 nt, Human
uggaccagccucucc

SEQ ID NO: 1196844 - RNA, 19 nt, Human
uggaucugugaggggcucu

SEQ ID NO: 1196845 - RNA, 15 nt, Human
uggaucugugagggg

SEQ ID NO: 1196846 - RNA, 18 nt, Human
ugggcaggagggaggugc

SEQ ID NO: 1196847 - RNA, 16 nt, Human
ugggcaggagggaggu

SEQ ID NO: 1196848 - RNA, 15 nt, Human
ugggcaggagggagg

SEQ ID NO: 1196849 - RNA, 13 nt, Human
ugggcaggaggga

SEQ ID NO: 1196850 - RNA, 22 nt, Human
ugggagugaggaugucugggcc

SEQ ID NO: 1196851 - RNA, 11 nt, Human
ugggagugugu

SEQ ID NO: 1196852 - RNA, 13 nt, Human
ugggaguguguaa

SEQ ID NO: 1196853 - RNA, 20 nt, Human
uggggaguuuaggguggggg

SEQ ID NO: 1196854 - RNA, 16 nt, Human
uggggauagaugugug

SEQ ID NO: 1196855 - RNA, 17 nt, Human
uggggauagaugugugg

SEQ ID NO: 1196856 - RNA, 18 nt, Human
uggggauagaugugugga

SEQ ID NO: 1196857 - RNA, 20 nt, Human
uggggauagauguguggaca

SEQ ID NO: 1196858 - RNA, 14 nt, Human
ugggggucugugug

SEQ ID NO: 1196859 - RNA, 13 nt, Human
uuaugccaccuga

SEQ ID NO: 1196860 - RNA, 16 nt, Human
uuaugccaccugaaua

SEQ ID NO: 1196861 - RNA, 12 nt, Human
uuaacucagucu

SEQ ID NO: 1196862 - RNA, 19 nt, Human
uguuuagaagaaguguguc

SEQ ID NO: 1196863 - RNA, 14 nt, Human
uuuaugccaccuga

SEQ ID NO: 1196864 - RNA, 20 nt, Human
uuuacagaggacaguauuug

SEQ ID NO: 1196865 - RNA, 16 nt, Human
uuuaaaauugugaugu

SEQ ID NO: 1196866 - RNA, 15 nt, Human
uuguuuagaagaagu

SEQ ID NO: 1196867 - RNA, 18 nt, Human
uuguuuagaagaagugug

SEQ ID NO: 1196868 - RNA, 16 nt, Human
uuggcagcucuacucu

SEQ ID NO: 1196869 - RNA, 11 nt, Human
uuuguggggag

SEQ ID NO: 1196870 - RNA, 18 nt, Human
aaggaauuauucccauga

SEQ ID NO: 1196871 - RNA, 16 nt, Human
auagcaccuccacaua

SEQ ID NO: 1196872 - RNA, 19 nt, Eastern equine encephalitis virus
augcaaccguuacacccac

SEQ ID NO: 1196873 - RNA, 23 nt, Eastern equine encephalitis virus
accgauucaaaacacgcuccaag

SEQ ID NO: 1196874 - RNA, 13 nt, Eastern equine encephalitis virus
cgaccuugcugac

SEQ ID NO: 1196875 - RNA, 15 nt, Eastern equine encephalitis virus
ccaggucacuuggaa

SEQ ID NO: 1196876 - RNA, 21 nt, Eastern equine encephalitis virus
uuggacacucauuucacccag

SEQ ID NO: 1196877 - RNA, 16 nt, Eastern equine encephalitis virus
accuaguacugcaaga

SEQ ID NO: 1196878 - RNA, 14 nt, Eastern equine encephalitis virus
auagguccacuguc

SEQ ID NO: 1196879 - RNA, 16 nt, Eastern equine encephalitis virus
ugcaucgccacgcugg

SEQ ID NO: 1196880 - RNA, 20 nt, Eastern equine encephalitis virus
augucaaacaaugcagggcu

SEQ ID NO: 1196881 - RNA, 13 nt, Eastern equine encephalitis virus
aagagucaggaga

SEQ ID NO: 1196882 - RNA, 17 nt, Eastern equine encephalitis virus
gccuccgauuucggugg

SEQ ID NO: 1196883 - RNA, 22 nt, Eastern equine encephalitis virus
auggaccuuaaacgggauguca

SEQ ID NO: 1196884 - RNA, 12 nt, Eastern equine encephalitis virus
cacaaugcauga

SEQ ID NO: 1196885 - RNA, 13 nt, Eastern equine encephalitis virus
cgauaacaaggug

SEQ ID NO: 1196886 - RNA, 21 nt, Eastern equine encephalitis virus
acaccaacuugaagcuacaac

SEQ ID NO: 1196887 - RNA, 18 nt, Eastern equine encephalitis virus
agggacccaaagcagcug

SEQ ID NO: 1196888 - RNA, 19 nt, Eastern equine encephalitis virus
acgcaagaagccugcgcca

SEQ ID NO: 1196889 - RNA, 17 nt, Eastern equine encephalitis virus
accuggaguacaucacc

SEQ ID NO: 1196890 - RNA, 17 nt, Eastern equine encephalitis virus
auucgauaacaaggugg

SEQ ID NO: 1196891 - RNA, 23 nt, Eastern equine encephalitis virus
aucaaaacuuuuucuggaugcag

SEQ ID NO: 1196892 - RNA, 19 nt, Eastern equine encephalitis virus
cagaaguggccgucaaagu

SEQ ID NO: 1196893 - RNA, 20 nt, Eastern equine encephalitis virus
cucaucauagguccacuguc

SEQ ID NO: 1196894 - RNA, 15 nt, Eastern equine encephalitis virus
caggcaauggugaac

SEQ ID NO: 1196895 - RNA, 14 nt, Eastern equine encephalitis virus
agguguugcaguua

SEQ ID NO: 1196896 - RNA, 19 nt, Eastern equine encephalitis virus
acaagcgugcagaccaagg

SEQ ID NO: 1196897 - RNA, 20 nt, Eastern equine encephalitis virus
cgcagagcucugcaugauga

SEQ ID NO: 1196898 - RNA, 14 nt, Eastern equine encephalitis virus
agaaugacgucacu

SEQ ID NO: 1196899 - RNA, 18 nt, Eastern equine encephalitis virus
ugaaagcaguugaaucac

SEQ ID NO: 1196900 - RNA, 15 nt, Eastern equine encephalitis virus
ggcgcagagcucugc

SEQ ID NO: 1196901 - RNA, 19 nt, Eastern equine encephalitis virus
ggcggcccuuuaggccacc

SEQ ID NO: 1196902 - RNA, 18 nt, Eastern equine encephalitis virus
agggaacuaccagcagcg

SEQ ID NO: 1196903 - RNA, 19 nt, Eastern equine encephalitis virus
guguggcuccuuugcagga

SEQ ID NO: 1196904 - RNA, 20 nt, Eastern equine encephalitis virus
cuuacagccauugcaugaga

SEQ ID NO: 1196905 - RNA, 20 nt, Eastern equine encephalitis virus
agcgacuauacaaccaccug

SEQ ID NO: 1196906 - RNA, 19 nt, Eastern equine encephalitis virus
aguucggggcaaugaugaa

SEQ ID NO: 1196907 - RNA, 14 nt, Eastern equine encephalitis virus
gccugcgcaggaaa

SEQ ID NO: 1196908 - RNA, 19 nt, Eastern equine encephalitis virus
gccacgcuggcaccagagc

SEQ ID NO: 1196909 - RNA, 15 nt, Eastern equine encephalitis virus
caagagucaggagaa

SEQ ID NO: 1196910 - RNA, 21 nt, Eastern equine encephalitis virus
aaggagcuuuccaaagaagca

SEQ ID NO: 1196911 - RNA, 19 nt, Eastern equine encephalitis virus
agguagaauucaggccagu

SEQ ID NO: 1196912 - RNA, 16 nt, Eastern equine encephalitis virus
agaccuauucuugaca

SEQ ID NO: 1196913 - RNA, 16 nt, Eastern equine encephalitis virus
ugcuaggagaaccagg

SEQ ID NO: 1196914 - RNA, 16 nt, Eastern equine encephalitis virus
ucgacaaccugcaugu

SEQ ID NO: 1196915 - RNA, 15 nt, Eastern equine encephalitis virus
gucagauaaaacguu

SEQ ID NO: 1196916 - RNA, 15 nt, Eastern equine encephalitis virus
gccuacaaauccagu

SEQ ID NO: 1196917 - RNA, 16 nt, Eastern equine encephalitis virus
caaccuaguacugcaa

SEQ ID NO: 1196918 - RNA, 15 nt, Eastern equine encephalitis virus
cacagcagugaugcc

SEQ ID NO: 1196919 - RNA, 21 nt, Eastern equine encephalitis virus
uauuacauccuggcucaaugc

SEQ ID NO: 1196920 - RNA, 14 nt, Eastern equine encephalitis virus
ccaacaacugucaa

SEQ ID NO: 1196921 - RNA, 23 nt, Eastern equine encephalitis virus
ugagcaacuggccgccaucaagc

SEQ ID NO: 1196922 - RNA, 17 nt, Eastern equine encephalitis virus
cacucaauguaccucca

SEQ ID NO: 1196923 - RNA, 14 nt, Eastern equine encephalitis virus
cacaguugcccaua

SEQ ID NO: 1196924 - RNA, 12 nt, Eastern equine encephalitis virus
gugacaagccuc

SEQ ID NO: 1196925 - RNA, 23 nt, Eastern equine encephalitis virus
cggcucuaucaguggugacaugg

SEQ ID NO: 1196926 - RNA, 23 nt, Eastern equine encephalitis virus
cgcauauacaauuacacuacagg

SEQ ID NO: 1196927 - RNA, 14 nt, Eastern equine encephalitis virus
accaccaccaccug

SEQ ID NO: 1196928 - RNA, 13 nt, Eastern equine encephalitis virus
caguuaccugcaa

SEQ ID NO: 1196929 - RNA, 18 nt, Eastern equine encephalitis virus
caucagguguugcaguua

SEQ ID NO: 1196930 - RNA, 13 nt, Eastern equine encephalitis virus
cuacagcaguggu

SEQ ID NO: 1196931 - RNA, 18 nt, Eastern equine encephalitis virus
gacugccucgaggagagg

SEQ ID NO: 1196932 - RNA, 16 nt, Eastern equine encephalitis virus
gucgcaauuguccugg

SEQ ID NO: 1196933 - RNA, 17 nt, Eastern equine encephalitis virus
ccuauaaacacuacagg

SEQ ID NO: 1196934 - RNA, 20 nt, Eastern equine encephalitis virus
cccguauauugcugauugcc

SEQ ID NO: 1196935 - RNA, 14 nt, Eastern equine encephalitis virus
uccaguacaccagu

SEQ ID NO: 1196936 - RNA, 17 nt, Eastern equine encephalitis virus
gggaugucaaggucaca

SEQ ID NO: 1196937 - RNA, 21 nt, Eastern equine encephalitis virus
aggcugcuauauuaccacauu

SEQ ID NO: 1196938 - RNA, 16 nt, Eastern equine encephalitis virus
cgugcagaccaaggac

SEQ ID NO: 1196939 - RNA, 18 nt, Eastern equine encephalitis virus
aggccaagugcaucgcca

SEQ ID NO: 1196940 - RNA, 13 nt, Eastern equine encephalitis virus
cacgcaaaagcuu

SEQ ID NO: 1196941 - RNA, 18 nt, Eastern equine encephalitis virus
gcuuaucccacuugcagc

SEQ ID NO: 1196942 - RNA, 16 nt, Eastern equine encephalitis virus
gaauuacgacagccga

SEQ ID NO: 1196943 - RNA, 21 nt, Eastern equine encephalitis virus
caucugacgcacugauggcag

SEQ ID NO: 1196944 - RNA, 16 nt, Eastern equine encephalitis virus
cuauaaacacuacagg

SEQ ID NO: 1196945 - RNA, 23 nt, Eastern equine encephalitis virus
agagauuuggacacucauuucac

SEQ ID NO: 1196946 - RNA, 19 nt, Eastern equine encephalitis virus
acgccgccgaugcagugca

SEQ ID NO: 1196947 - RNA, 14 nt, Eastern equine encephalitis virus
cacuagugcaguua

SEQ ID NO: 1196948 - RNA, 16 nt, Eastern equine encephalitis virus
acagauacccauuaac

SEQ ID NO: 1196949 - RNA, 16 nt, Eastern equine encephalitis virus
aauacuacugcaagug

SEQ ID NO: 1196950 - RNA, 17 nt, Eastern equine encephalitis virus
ccuacagauacagcugg

SEQ ID NO: 1196951 - RNA, 17 nt, Eastern equine encephalitis virus
acgucacucuugcugag

SEQ ID NO: 1196952 - RNA, 14 nt, Eastern equine encephalitis virus
agcggcgcccaagu

SEQ ID NO: 1196953 - RNA, 23 nt, Eastern equine encephalitis virus
uuuaauacacacuuuauaaucag

SEQ ID NO: 1196954 - RNA, 14 nt, Eastern equine encephalitis virus
gugcaguuaccugc

SEQ ID NO: 1196955 - RNA, 20 nt, Eastern equine encephalitis virus
guugaccacuucccccugcg

SEQ ID NO: 1196956 - RNA, 15 nt, Eastern equine encephalitis virus
cgaucagcagugcca

SEQ ID NO: 1196957 - RNA, 14 nt, Eastern equine encephalitis virus
augccgaacaaggu

SEQ ID NO: 1196958 - RNA, 22 nt, Eastern equine encephalitis virus
uacuaaacacuaaauucacccu

SEQ ID NO: 1196959 - RNA, 14 nt, Eastern equine encephalitis virus
acgcuggcaccaga

SEQ ID NO: 1196960 - RNA, 19 nt, Eastern equine encephalitis virus
gccuucuccaguagugaaa

SEQ ID NO: 1196961 - RNA, 18 nt, Eastern equine encephalitis virus
auagacaaugagcaacug

SEQ ID NO: 1196962 - RNA, 21 nt, Eastern equine encephalitis virus
agucucguaaaguagagaaca

SEQ ID NO: 1196963 - RNA, 21 nt, Eastern equine encephalitis virus
acauuccacuucuccacugca

SEQ ID NO: 1196964 - RNA, 21 nt, Eastern equine encephalitis virus
ugaagcuacaacgaccccagg

SEQ ID NO: 1196965 - RNA, 23 nt, Eastern equine encephalitis virus
aagcaucccuauaucuauagaua

SEQ ID NO: 1196966 - RNA, 15 nt, Eastern equine encephalitis virus
cuagcagcagccacg

SEQ ID NO: 1196967 - RNA, 19 nt, Eastern equine encephalitis virus
uggcaucacugaagagcug

SEQ ID NO: 1196968 - RNA, 14 nt, Eastern equine encephalitis virus
cccauucauguggg

SEQ ID NO: 1196969 - RNA, 18 nt, Eastern equine encephalitis virus
gggaaaccauccaccaaa

SEQ ID NO: 1196970 - RNA, 13 nt, Eastern equine encephalitis virus
cuggguggaguca

SEQ ID NO: 1196971 - RNA, 23 nt, Eastern equine encephalitis virus
aguauaccuggggaaaccaucca

SEQ ID NO: 1196972 - RNA, 18 nt, Eastern equine encephalitis virus
caauucauucuccaucag

SEQ ID NO: 1196973 - RNA, 21 nt, Eastern equine encephalitis virus
gcguuacuuugcugcauuaag

SEQ ID NO: 1196974 - RNA, 19 nt, Eastern equine encephalitis virus
cgcuuauuguaugcaugcg

SEQ ID NO: 1196975 - RNA, 17 nt, Eastern equine encephalitis virus
ugcaguuaccugcaaag

SEQ ID NO: 1196976 - RNA, 18 nt, Eastern equine encephalitis virus
acuggacgaugaccaaga

SEQ ID NO: 1196977 - RNA, 17 nt, Eastern equine encephalitis virus
augggagcgucagcugg

SEQ ID NO: 1196978 - RNA, 23 nt, Eastern equine encephalitis virus
gccuucuccaguagugaaaugcu

SEQ ID NO: 1196979 - RNA, 18 nt, Eastern equine encephalitis virus
ugcauaaccccguauaaa

SEQ ID NO: 1196980 - RNA, 12 nt, Eastern equine encephalitis virus
uccgcauccaga

SEQ ID NO: 1196981 - RNA, 14 nt, Eastern equine encephalitis virus
uacaggcagcgcau

SEQ ID NO: 1196982 - RNA, 19 nt, Eastern equine encephalitis virus
ccacugucaucugcguggu

SEQ ID NO: 1196983 - RNA, 17 nt, Eastern equine encephalitis virus
agauacgaucagcagug

SEQ ID NO: 1196984 - RNA, 17 nt, Eastern equine encephalitis virus
gaagcuagagucagaua

SEQ ID NO: 1196985 - RNA, 17 nt, Eastern equine encephalitis virus
uaaauucacccuaguuc

SEQ ID NO: 1196986 - RNA, 14 nt, Eastern equine encephalitis virus
caagccuaagccug

SEQ ID NO: 1196987 - RNA, 17 nt, Eastern equine encephalitis virus
aguguauaaggcugucu

SEQ ID NO: 1196988 - RNA, 19 nt, Eastern equine encephalitis virus
aggcacuguucaggcaaug

SEQ ID NO: 1196989 - RNA, 22 nt, Eastern equine encephalitis virus
caggccaguggguagagagaaa

SEQ ID NO: 1196990 - RNA, 20 nt, Eastern equine encephalitis virus
acuguucaggcaauggugaa

SEQ ID NO: 1196991 - RNA, 21 nt, Eastern equine encephalitis virus
aucaacuaaccuggaguacau

SEQ ID NO: 1196992 - RNA, 14 nt, Eastern equine encephalitis virus
aacauaacaucugu

SEQ ID NO: 1196993 - RNA, 23 nt, Eastern equine encephalitis virus
gcaggucugcacuagugcaguua

SEQ ID NO: 1196994 - RNA, 14 nt, Eastern equine encephalitis virus
gcuggagaucugca

SEQ ID NO: 1196995 - RNA, 17 nt, Eastern equine encephalitis virus
ggacaagggcaccugca

SEQ ID NO: 1196996 - RNA, 22 nt, Eastern equine encephalitis virus
uuccaaucauguugaacggaca

SEQ ID NO: 1196997 - RNA, 17 nt, Eastern equine encephalitis virus
gaagaagucagagggga

SEQ ID NO: 1196998 - RNA, 13 nt, Eastern equine encephalitis virus
ugcgcaugcugcg

SEQ ID NO: 1196999 - RNA, 18 nt, Eastern equine encephalitis virus
uggaguacaucaccugca

SEQ ID NO: 1197000 - RNA, 20 nt, Eastern equine encephalitis virus
gacaaaacauacugaagaaa

SEQ ID NO: 1197001 - RNA, 16 nt, Eastern equine encephalitis virus
accacccugcaugcca

SEQ ID NO: 1197002 - RNA, 20 nt, Eastern equine encephalitis virus
cacaagcgugcagaccaagg

SEQ ID NO: 1197003 - RNA, 19 nt, Eastern equine encephalitis virus
cauaacgccgccgaugcag

SEQ ID NO: 1197004 - RNA, 15 nt, Eastern equine encephalitis virus
aacauacugaagaaa

SEQ ID NO: 1197005 - RNA, 12 nt, Eastern equine encephalitis virus
ucgcuugccacu

SEQ ID NO: 1197006 - RNA, 15 nt, Eastern equine encephalitis virus
gcgucuacugcaggg

SEQ ID NO: 1197007 - RNA, 12 nt, Eastern equine encephalitis virus
ugcagcucaaau

SEQ ID NO: 1197008 - RNA, 17 nt, Eastern equine encephalitis virus
uaccacauuauaacacu

SEQ ID NO: 1197009 - RNA, 14 nt, Eastern equine encephalitis virus
gaucagcagugcca

SEQ ID NO: 1197010 - RNA, 12 nt, Eastern equine encephalitis virus
caaccugcaugu

SEQ ID NO: 1197011 - RNA, 20 nt, Eastern equine encephalitis virus
aguugauuuggccuacauga

SEQ ID NO: 1197012 - RNA, 15 nt, Eastern equine encephalitis virus
gccaccacuugcagc

SEQ ID NO: 1197013 - RNA, 19 nt, Eastern equine encephalitis virus
gaaaagggacaaaggggca

SEQ ID NO: 1197014 - RNA, 14 nt, Eastern equine encephalitis virus
aaaccccauccuga

SEQ ID NO: 1197015 - RNA, 22 nt, Eastern equine encephalitis virus
aaacaccgacagucucagaccu

SEQ ID NO: 1197016 - RNA, 16 nt, Eastern equine encephalitis virus
cucuggaagacugccu

SEQ ID NO: 1197017 - RNA, 20 nt, Eastern equine encephalitis virus
ggacccaaagcagcugcccu

SEQ ID NO: 1197018 - RNA, 22 nt, Eastern equine encephalitis virus
agagugcucuauugaccacgca

SEQ ID NO: 1197019 - RNA, 16 nt, Eastern equine encephalitis virus
auacgaucagcagugc

SEQ ID NO: 1197020 - RNA, 19 nt, Eastern equine encephalitis virus
cagcugguuaauaccagga

SEQ ID NO: 1197021 - RNA, 18 nt, Eastern equine encephalitis virus
ucugcgacacugaaaaca

SEQ ID NO: 1197022 - RNA, 21 nt, Eastern equine encephalitis virus
gcugcuuauuuugcugugggc

SEQ ID NO: 1197023 - RNA, 17 nt, Eastern equine encephalitis virus
cggcucuaucaguggug

SEQ ID NO: 1197024 - RNA, 17 nt, Eastern equine encephalitis virus
acacuaagggcagugca

SEQ ID NO: 1197025 - RNA, 17 nt, Eastern equine encephalitis virus
ugcaaccguuacaccca

SEQ ID NO: 1197026 - RNA, 22 nt, Eastern equine encephalitis virus
agagucgccgacccccugaaga

SEQ ID NO: 1197027 - RNA, 17 nt, Eastern equine encephalitis virus
agcaacuggccgccauc

SEQ ID NO: 1197028 - RNA, 13 nt, Eastern equine encephalitis virus
cucagaccuggaa

SEQ ID NO: 1197029 - RNA, 23 nt, Eastern equine encephalitis virus
gcaugaaaucagauacccuccag

SEQ ID NO: 1197030 - RNA, 23 nt, Eastern equine encephalitis virus
auacagcugguuaauaccaggau

SEQ ID NO: 1197031 - RNA, 17 nt, Eastern equine encephalitis virus
uaccgucacccaccuga

SEQ ID NO: 1197032 - RNA, 15 nt, Eastern equine encephalitis virus
uacgcggcaaugcaa

SEQ ID NO: 1197033 - RNA, 20 nt, Eastern equine encephalitis virus
cagggcuuaccugauugaca

SEQ ID NO: 1197034 - RNA, 18 nt, Eastern equine encephalitis virus
gagcucugcaugaugaag

SEQ ID NO: 1197035 - RNA, 21 nt, Eastern equine encephalitis virus
uacagucaaagauacaccaga

SEQ ID NO: 1197036 - RNA, 20 nt, Eastern equine encephalitis virus
caggucugcacuagugcagu

SEQ ID NO: 1197037 - RNA, 16 nt, Eastern equine encephalitis virus
gaucgacaaccugcau

SEQ ID NO: 1197038 - RNA, 17 nt, Eastern equine encephalitis virus
guagagaacaugaaggc

SEQ ID NO: 1197039 - RNA, 18 nt, Eastern equine encephalitis virus
ugcaaccguuacacccac

SEQ ID NO: 1197040 - RNA, 16 nt, Eastern equine encephalitis virus
aaugcugucuuuuaua

SEQ ID NO: 1197041 - RNA, 20 nt, Eastern equine encephalitis virus
agagcuggugaaagcaguug

SEQ ID NO: 1197042 - RNA, 17 nt, Eastern equine encephalitis virus
cgauugcccuggagccg

SEQ ID NO: 1197043 - RNA, 14 nt, Eastern equine encephalitis virus
aguugaucaggcau

SEQ ID NO: 1197044 - RNA, 14 nt, Eastern equine encephalitis virus
cgcccaagugaaau

SEQ ID NO: 1197045 - RNA, 23 nt, Eastern equine encephalitis virus
uagagagaaauaccgucacccac

SEQ ID NO: 1197046 - RNA, 21 nt, Eastern equine encephalitis virus
cauaauugccgcauauacaau

SEQ ID NO: 1197047 - RNA, 20 nt, Eastern equine encephalitis virus
ucaaauugaggaccugagac

SEQ ID NO: 1197048 - RNA, 11 nt, Eastern equine encephalitis virus
ccgucacccac

SEQ ID NO: 1197049 - RNA, 18 nt, Eastern equine encephalitis virus
agugcaucgccacgcugg

SEQ ID NO: 1197050 - RNA, 16 nt, Eastern equine encephalitis virus
guugccuacaaaucca

SEQ ID NO: 1197051 - RNA, 18 nt, Eastern equine encephalitis virus
acagcgaauguguaugaa

SEQ ID NO: 1197052 - RNA, 18 nt, Eastern equine encephalitis virus
cagugcauaaugcugcuc

SEQ ID NO: 1197053 - RNA, 17 nt, Eastern equine encephalitis virus
guggcuccuuugcagga

SEQ ID NO: 1197054 - RNA, 14 nt, Eastern equine encephalitis virus
guacuagcagcagc

SEQ ID NO: 1197055 - RNA, 21 nt, Eastern equine encephalitis virus
gcaccauggagcuguacagua

SEQ ID NO: 1197056 - RNA, 22 nt, Eastern equine encephalitis virus
auccauccugcuuuuaagcugc

SEQ ID NO: 1197057 - RNA, 17 nt, Eastern equine encephalitis virus
accuugaguauggugau

SEQ ID NO: 1197058 - RNA, 15 nt, Eastern equine encephalitis virus
cacucuugcugagag

SEQ ID NO: 1197059 - RNA, 13 nt, Eastern equine encephalitis virus
gucaauggugaaa

SEQ ID NO: 1197060 - RNA, 14 nt, Eastern equine encephalitis virus
aggaccgcccgcca

SEQ ID NO: 1197061 - RNA, 21 nt, Eastern equine encephalitis virus
aucacgcacaucaaccagcaa

SEQ ID NO: 1197062 - RNA, 12 nt, Eastern equine encephalitis virus
accacccugcau

SEQ ID NO: 1197063 - RNA, 12 nt, Eastern equine encephalitis virus
augagcaacugg

SEQ ID NO: 1197064 - RNA, 14 nt, Eastern equine encephalitis virus
gggccuaaccgcca

SEQ ID NO: 1197065 - RNA, 13 nt, Eastern equine encephalitis virus
aagggcaccugca

SEQ ID NO: 1197066 - RNA, 14 nt, Eastern equine encephalitis virus
aagcugcaggucug

SEQ ID NO: 1197067 - RNA, 19 nt, Eastern equine encephalitis virus
guuggaguauaccugggga

SEQ ID NO: 1197068 - RNA, 18 nt, Eastern equine encephalitis virus
gucacauccguguggcuc

SEQ ID NO: 1197069 - RNA, 16 nt, Eastern equine encephalitis virus
guugucaauaucauga

SEQ ID NO: 1197070 - RNA, 14 nt, Eastern equine encephalitis virus
augcaugaaaucag

SEQ ID NO: 1197071 - RNA, 18 nt, Eastern equine encephalitis virus
caccggcaaagcaggcuc

SEQ ID NO: 1197072 - RNA, 17 nt, Eastern equine encephalitis virus
aaaagugccuucuccag

SEQ ID NO: 1197073 - RNA, 13 nt, Eastern equine encephalitis virus
uggaagacugccu

SEQ ID NO: 1197074 - RNA, 20 nt, Eastern equine encephalitis virus
aagaucgacaaccugcaugu

SEQ ID NO: 1197075 - RNA, 16 nt, Eastern equine encephalitis virus
uuuaauacacacuuua

SEQ ID NO: 1197076 - RNA, 22 nt, Eastern equine encephalitis virus
guauguagagcgcucggaagag

SEQ ID NO: 1197077 - RNA, 22 nt, Eastern equine encephalitis virus
gacaacaucgugaaagggguua

SEQ ID NO: 1197078 - RNA, 20 nt, Eastern equine encephalitis virus
gagucaacgaaggauccagg

SEQ ID NO: 1197079 - RNA, 14 nt, Eastern equine encephalitis virus
auuuacaaaaucau

SEQ ID NO: 1197080 - RNA, 16 nt, Eastern equine encephalitis virus
ggaugcgcacgcagga

SEQ ID NO: 1197081 - RNA, 15 nt, Eastern equine encephalitis virus
gaaagggguuacauc

SEQ ID NO: 1197082 - RNA, 20 nt, Eastern equine encephalitis virus
agcgaccaccaccaccugcc

SEQ ID NO: 1197083 - RNA, 17 nt, Eastern equine encephalitis virus
aggcguauguagagcgc

SEQ ID NO: 1197084 - RNA, 23 nt, Eastern equine encephalitis virus
uccaagauguacuagcagcagcc

SEQ ID NO: 1197085 - RNA, 19 nt, Eastern equine encephalitis virus
aaugcuaggagaaccagga

SEQ ID NO: 1197086 - RNA, 18 nt, Eastern equine encephalitis virus
cguguggcuccuuugcag

SEQ ID NO: 1197087 - RNA, 21 nt, Eastern equine encephalitis virus
ugcacacaccuuucacccagg

SEQ ID NO: 1197088 - RNA, 13 nt, Eastern equine encephalitis virus
augaucagcugcu

SEQ ID NO: 1197089 - RNA, 20 nt, Eastern equine encephalitis virus
cugaaaacacccagaugagc

SEQ ID NO: 1197090 - RNA, 14 nt, Eastern equine encephalitis virus
gaucgacaaccugc

SEQ ID NO: 1197091 - RNA, 14 nt, Eastern equine encephalitis virus
augaaggcaaucac

SEQ ID NO: 1197092 - RNA, 13 nt, Eastern equine encephalitis virus
gcccaagugaaau

SEQ ID NO: 1197093 - RNA, 14 nt, Eastern equine encephalitis virus
gacaaccugcaugu

SEQ ID NO: 1197094 - RNA, 13 nt, Eastern equine encephalitis virus
agaucaucgaugc

SEQ ID NO: 1197095 - RNA, 23 nt, Eastern equine encephalitis virus
auauaccgccuccuauaaacacu

SEQ ID NO: 1197096 - RNA, 23 nt, Eastern equine encephalitis virus
uuacuaaacacuaaauucacccu

SEQ ID NO: 1197097 - RNA, 13 nt, Eastern equine encephalitis virus
gaaagggugacag

SEQ ID NO: 1197098 - RNA, 13 nt, Eastern equine encephalitis virus
aacggacagguga

SEQ ID NO: 1197099 - RNA, 19 nt, Eastern equine encephalitis virus
gacagucucagaccuggaa

SEQ ID NO: 1197100 - RNA, 22 nt, Eastern equine encephalitis virus
aaaguuugcaaccuaguacugc

SEQ ID NO: 1197101 - RNA, 23 nt, Eastern equine encephalitis virus
cugagauacgaucagcagugcca

SEQ ID NO: 1197102 - RNA, 16 nt, Eastern equine encephalitis virus
gacaaugagcaacugg

SEQ ID NO: 1197103 - RNA, 14 nt, Eastern equine encephalitis virus
ccugcuguuuagau

SEQ ID NO: 1197104 - RNA, 23 nt, Eastern equine encephalitis virus
acuaaacacuaaauucacccuag

SEQ ID NO: 1197105 - RNA, 15 nt, Eastern equine encephalitis virus
gcauccacagugcca

SEQ ID NO: 1197106 - RNA, 23 nt, Eastern equine encephalitis virus
gacuauacaaccaccugcacgga

SEQ ID NO: 1197107 - RNA, 17 nt, Eastern equine encephalitis virus
gccgccgaugcagugca

SEQ ID NO: 1197108 - RNA, 16 nt, Eastern equine encephalitis virus
gaguacaucaccugca

SEQ ID NO: 1197109 - RNA, 15 nt, Eastern equine encephalitis virus
cucaccauguuggaa

SEQ ID NO: 1197110 - RNA, 21 nt, Eastern equine encephalitis virus
cuuuuggagaccugcaaucac

SEQ ID NO: 1197111 - RNA, 15 nt, Eastern equine encephalitis virus
aaccuaaaccaggca

SEQ ID NO: 1197112 - RNA, 22 nt, Eastern equine encephalitis virus
ccauaagguagaauucaggcca

SEQ ID NO: 1197113 - RNA, 12 nt, Eastern equine encephalitis virus
cuaacccuccag

SEQ ID NO: 1197114 - RNA, 23 nt, Eastern equine encephalitis virus
ccuaugaucagcugcucgaugcc

SEQ ID NO: 1197115 - RNA, 13 nt, Eastern equine encephalitis virus
gcuuuuaagcugc

SEQ ID NO: 1197116 - RNA, 15 nt, Eastern equine encephalitis virus
gcauccagacaucag

SEQ ID NO: 1197117 - RNA, 18 nt, Eastern equine encephalitis virus
cuguacaguaugagaaca

SEQ ID NO: 1197118 - RNA, 15 nt, Eastern equine encephalitis virus
caagccuccuggcuu

SEQ ID NO: 1197119 - RNA, 16 nt, Eastern equine encephalitis virus
agugacaagccuccug

SEQ ID NO: 1197120 - RNA, 21 nt, Eastern equine encephalitis virus
acagcugguuaauaccaggau

SEQ ID NO: 1197121 - RNA, 20 nt, Eastern equine encephalitis virus
ccauucgauaacaagguggu

SEQ ID NO: 1197122 - RNA, 20 nt, Eastern equine encephalitis virus
caagauguacuagcagcagc

SEQ ID NO: 1197123 - RNA, 19 nt, Eastern equine encephalitis virus
uauaagacaaaagugccuu

SEQ ID NO: 1197124 - RNA, 13 nt, Eastern equine encephalitis virus
uugacaacaaagg

SEQ ID NO: 1197125 - RNA, 18 nt, Eastern equine encephalitis virus
cacacaggcacuguucag

SEQ ID NO: 1197126 - RNA, 14 nt, Eastern equine encephalitis virus
gggcagugcauaau

SEQ ID NO: 1197127 - RNA, 18 nt, Eastern equine encephalitis virus
gauacaccagagggguca

SEQ ID NO: 1197128 - RNA, 18 nt, Eastern equine encephalitis virus
ccagaggggucagagcca

SEQ ID NO: 1197129 - RNA, 22 nt, Eastern equine encephalitis virus
agccugcgcaggaaaaagaagc

SEQ ID NO: 1197130 - RNA, 12 nt, Eastern equine encephalitis virus
agugcauaaggc

SEQ ID NO: 1197131 - RNA, 12 nt, Eastern equine encephalitis virus
cugcaaguauaa

SEQ ID NO: 1197132 - RNA, 20 nt, Eastern equine encephalitis virus
caggcucuuuuggagaccug

SEQ ID NO: 1197133 - RNA, 19 nt, Eastern equine encephalitis virus
ccaggucacuuggaaguga

SEQ ID NO: 1197134 - RNA, 15 nt, Eastern equine encephalitis virus
agguguuuacccauu

SEQ ID NO: 1197135 - RNA, 13 nt, Eastern equine encephalitis virus
aucucucugcaga

SEQ ID NO: 1197136 - RNA, 16 nt, Eastern equine encephalitis virus
acaccuuucacccagg

SEQ ID NO: 1197137 - RNA, 18 nt, Eastern equine encephalitis virus
caugugaucaaccacccu

SEQ ID NO: 1197138 - RNA, 20 nt, Eastern equine encephalitis virus
ugaacauggaagugaagauc

SEQ ID NO: 1197139 - RNA, 15 nt, Eastern equine encephalitis virus
cgugcagaccaagga

SEQ ID NO: 1197140 - RNA, 16 nt, Eastern equine encephalitis virus
gccaucaagcugaaga

SEQ ID NO: 1197141 - RNA, 23 nt, Eastern equine encephalitis virus
uacugcaagagaauuuucccacc

SEQ ID NO: 1197142 - RNA, 20 nt, Eastern equine encephalitis virus
ggcucaagagucaggagaag

SEQ ID NO: 1197143 - RNA, 16 nt, Eastern equine encephalitis virus
acgaucagcagugcca

SEQ ID NO: 1197144 - RNA, 20 nt, Eastern equine encephalitis virus
uaaaguagagaacaugaagg

SEQ ID NO: 1197145 - RNA, 15 nt, Eastern equine encephalitis virus
cgcaccucagccccu

SEQ ID NO: 1197146 - RNA, 22 nt, Eastern equine encephalitis virus
gacuauacaaccaccugcacgg

SEQ ID NO: 1197147 - RNA, 17 nt, Eastern equine encephalitis virus
guacaucaccugcaagu

SEQ ID NO: 1197148 - RNA, 16 nt, Eastern equine encephalitis virus
acccaaagcagcugcc

SEQ ID NO: 1197149 - RNA, 15 nt, Eastern equine encephalitis virus
agaagcgaccaccac

SEQ ID NO: 1197150 - RNA, 14 nt, Eastern equine encephalitis virus
guacaucaccugca

SEQ ID NO: 1197151 - RNA, 17 nt, Eastern equine encephalitis virus
agcgcauaaugcugucu

SEQ ID NO: 1197152 - RNA, 12 nt, Eastern equine encephalitis virus
aggcacccgauu

SEQ ID NO: 1197153 - RNA, 15 nt, Eastern equine encephalitis virus
cagauacccuccagu

SEQ ID NO: 1197154 - RNA, 14 nt, Eastern equine encephalitis virus
cgcacugauggcag

SEQ ID NO: 1197155 - RNA, 19 nt, Eastern equine encephalitis virus
gaaggcagaauagacaaug

SEQ ID NO: 1197156 - RNA, 22 nt, Eastern equine encephalitis virus
aguugauuuggccuacaugagu

SEQ ID NO: 1197157 - RNA, 13 nt, Eastern equine encephalitis virus
gucaccggagaag

SEQ ID NO: 1197158 - RNA, 17 nt, Eastern equine encephalitis virus
agcgcucggaagagugc

SEQ ID NO: 1197159 - RNA, 20 nt, Eastern equine encephalitis virus
uugcaauguuacucaaauga

SEQ ID NO: 1197160 - RNA, 21 nt, Eastern equine encephalitis virus
cuauaaacacuacaggcagcg

SEQ ID NO: 1197161 - RNA, 19 nt, Eastern equine encephalitis virus
aaugagggaacuuccagug

SEQ ID NO: 1197162 - RNA, 21 nt, Eastern equine encephalitis virus
aguaugggcucaagagucagg

SEQ ID NO: 1197163 - RNA, 13 nt, Eastern equine encephalitis virus
gaagucagagggg

SEQ ID NO: 1197164 - RNA, 19 nt, Eastern equine encephalitis virus
ugagaacaauagguucacc

SEQ ID NO: 1197165 - RNA, 14 nt, Eastern equine encephalitis virus
caucaacuaaccug

SEQ ID NO: 1197166 - RNA, 17 nt, Eastern equine encephalitis virus
uccaaaccccauccuga

SEQ ID NO: 1197167 - RNA, 21 nt, Eastern equine encephalitis virus
caauguaccuccaaaccccau

SEQ ID NO: 1197168 - RNA, 19 nt, Eastern equine encephalitis virus
uggagccgcuccgugcaga

SEQ ID NO: 1197169 - RNA, 13 nt, Eastern equine encephalitis virus
uagagagaaauac

SEQ ID NO: 1197170 - RNA, 15 nt, Eastern equine encephalitis virus
gacaggcgcagagcu

SEQ ID NO: 1197171 - RNA, 21 nt, Eastern equine encephalitis virus
uacaauuacacuacagguaau

SEQ ID NO: 1197172 - RNA, 14 nt, Eastern equine encephalitis virus
uacaaccaccugca

SEQ ID NO: 1197173 - RNA, 19 nt, Eastern equine encephalitis virus
uacaacucuggaagacugc

SEQ ID NO: 1197174 - RNA, 22 nt, Eastern equine encephalitis virus
cuaccagcagcgacuauacaac

SEQ ID NO: 1197175 - RNA, 16 nt, Eastern equine encephalitis virus
ccuggguggagucaac

SEQ ID NO: 1197176 - RNA, 16 nt, Eastern equine encephalitis virus
agggaacuuccagugu

SEQ ID NO: 1197177 - RNA, 13 nt, Eastern equine encephalitis virus
ccugcaacaaaaa

SEQ ID NO: 1197178 - RNA, 13 nt, Eastern equine encephalitis virus
auucaaguacugc

SEQ ID NO: 1197179 - RNA, 18 nt, Eastern equine encephalitis virus
cacuuggaagugaugcaa

SEQ ID NO: 1197180 - RNA, 15 nt, Eastern equine encephalitis virus
aggugauacaggcag

SEQ ID NO: 1197181 - RNA, 15 nt, Eastern equine encephalitis virus
acccugcaugccaug

SEQ ID NO: 1197182 - RNA, 14 nt, Eastern equine encephalitis virus
ugcaguuaccugca

SEQ ID NO: 1197183 - RNA, 15 nt, Eastern equine encephalitis virus
aaaagggguuacagu

SEQ ID NO: 1197184 - RNA, 19 nt, Eastern equine encephalitis virus
ugagaagcuguugcagaag

SEQ ID NO: 1197185 - RNA, 19 nt, Eastern equine encephalitis virus
cugcacuagugcaguuacc

SEQ ID NO: 1197186 - RNA, 15 nt, Eastern equine encephalitis virus
auucgauaacaaggu

SEQ ID NO: 1197187 - RNA, 14 nt, Eastern equine encephalitis virus
ccaccaccugccaa

SEQ ID NO: 1197188 - RNA, 21 nt, Eastern equine encephalitis virus
cgcuggcaccagagccucuag

SEQ ID NO: 1197189 - RNA, 17 nt, Eastern equine encephalitis virus
gaauucaggccaguggg

SEQ ID NO: 1197190 - RNA, 18 nt, Eastern equine encephalitis virus
aucaccgauucaaaacac

SEQ ID NO: 1197191 - RNA, 17 nt, Eastern equine encephalitis virus
agugcaguuaccugcaa

SEQ ID NO: 1197192 - RNA, 16 nt, Eastern equine encephalitis virus
gccuaucuugacaugg

SEQ ID NO: 1197193 - RNA, 23 nt, Eastern equine encephalitis virus
agcgcuuauuguaugcaugcgca

SEQ ID NO: 1197194 - RNA, 12 nt, Eastern equine encephalitis virus
agcuauggugac

SEQ ID NO: 1197195 - RNA, 20 nt, Eastern equine encephalitis virus
cugaagguaaucggagcagg

SEQ ID NO: 1197196 - RNA, 23 nt, Eastern equine encephalitis virus
gacacgguuacaguuggguuuca

SEQ ID NO: 1197197 - RNA, 16 nt, Eastern equine encephalitis virus
auguacuagcagcagc

SEQ ID NO: 1197198 - RNA, 21 nt, Eastern equine encephalitis virus
aaucagauacccuccaguaca

SEQ ID NO: 1197199 - RNA, 15 nt, Eastern equine encephalitis virus
agccauugcaugaga

SEQ ID NO: 1197200 - RNA, 19 nt, Eastern equine encephalitis virus
uucccaccguagccagcua

SEQ ID NO: 1197201 - RNA, 18 nt, Eastern equine encephalitis virus
aucugcgugguccccauu

SEQ ID NO: 1197202 - RNA, 18 nt, Eastern equine encephalitis virus
ccacaagcgugcagacca

SEQ ID NO: 1197203 - RNA, 18 nt, Eastern equine encephalitis virus
gaagacggauggaguuga

SEQ ID NO: 1197204 - RNA, 16 nt, Eastern equine encephalitis virus
gugcaguuaccugcaa

SEQ ID NO: 1197205 - RNA, 13 nt, Eastern equine encephalitis virus
agugaaaugcugc

SEQ ID NO: 1197206 - RNA, 17 nt, Eastern equine encephalitis virus
cuuaccugauugacaac

SEQ ID NO: 1197207 - RNA, 19 nt, Eastern equine encephalitis virus
gugcgcagguugaacgcug

SEQ ID NO: 1197208 - RNA, 14 nt, Eastern equine encephalitis virus
caugucugcagaag

SEQ ID NO: 1197209 - RNA, 20 nt, Eastern equine encephalitis virus
accacggcuauuacauccug

SEQ ID NO: 1197210 - RNA, 14 nt, Eastern equine encephalitis virus
ugaaaacacccaga

SEQ ID NO: 1197211 - RNA, 17 nt, Eastern equine encephalitis virus
gacaacaucgugaaagg

SEQ ID NO: 1197212 - RNA, 12 nt, Eastern equine encephalitis virus
caggcgcagagc

SEQ ID NO: 1197213 - RNA, 14 nt, Eastern equine encephalitis virus
uaguaucuaaccua

SEQ ID NO: 1197214 - RNA, 21 nt, Eastern equine encephalitis virus
cuugucaaccacauaacacua

SEQ ID NO: 1197215 - RNA, 19 nt, Eastern equine encephalitis virus
gucaaagauacaccagagg

SEQ ID NO: 1197216 - RNA, 18 nt, Eastern equine encephalitis virus
agcguuccguccaugaga

SEQ ID NO: 1197217 - RNA, 22 nt, Eastern equine encephalitis virus
ucagcuauguucggucugaaga

SEQ ID NO: 1197218 - RNA, 19 nt, Eastern equine encephalitis virus
aauaucacguuuccaugug

SEQ ID NO: 1197219 - RNA, 15 nt, Eastern equine encephalitis virus
cuaucauugcagaac

SEQ ID NO: 1197220 - RNA, 21 nt, Eastern equine encephalitis virus
cauagucggugcgacagcccu

SEQ ID NO: 1197221 - RNA, 21 nt, Eastern equine encephalitis virus
caaccaccugcacggauguca

SEQ ID NO: 1197222 - RNA, 14 nt, Eastern equine encephalitis virus
uucgauaacaaggu

SEQ ID NO: 1197223 - RNA, 18 nt, Eastern equine encephalitis virus
gaugucaaacaaugcagg

SEQ ID NO: 1197224 - RNA, 14 nt, Eastern equine encephalitis virus
auacaggcagcuga

SEQ ID NO: 1197225 - RNA, 20 nt, Eastern equine encephalitis virus
accuccaaaccccauccuga

SEQ ID NO: 1197226 - RNA, 19 nt, Eastern equine encephalitis virus
gacacuacguugagaugca

SEQ ID NO: 1197227 - RNA, 22 nt, Eastern equine encephalitis virus
ccaggacggcucuaucaguggu

SEQ ID NO: 1197228 - RNA, 23 nt, Eastern equine encephalitis virus
agcaggcucuuuuggagaccugc

SEQ ID NO: 1197229 - RNA, 14 nt, Eastern equine encephalitis virus
ccaaagaagcacag

SEQ ID NO: 1197230 - RNA, 21 nt, Eastern equine encephalitis virus
aacuguccaauucauucucca

SEQ ID NO: 1197231 - RNA, 17 nt, Eastern equine encephalitis virus
uacgacuuuccugagua

SEQ ID NO: 1197232 - RNA, 13 nt, Eastern equine encephalitis virus
gaugcagugcaua

SEQ ID NO: 1197233 - RNA, 23 nt, Eastern equine encephalitis virus
cuguucaggcaauggugaacaua

SEQ ID NO: 1197234 - RNA, 21 nt, Eastern equine encephalitis virus
gccauggucgcuugccacugu

SEQ ID NO: 1197235 - RNA, 16 nt, Eastern equine encephalitis virus
gcaccuaacccuccag

SEQ ID NO: 1197236 - RNA, 13 nt, Eastern equine encephalitis virus
cuacaagacaaac

SEQ ID NO: 1197237 - RNA, 16 nt, Eastern equine encephalitis virus
cucaaugcccaccagg

SEQ ID NO: 1197238 - RNA, 22 nt, Eastern equine encephalitis virus
gugccuguuaaggccaagugca

SEQ ID NO: 1197239 - RNA, 11 nt, Eastern equine encephalitis virus
gcucugcauga

SEQ ID NO: 1197240 - RNA, 20 nt, Eastern equine encephalitis virus
acaccagaggggucagagcc

SEQ ID NO: 1197241 - RNA, 14 nt, Eastern equine encephalitis virus
guaugaugccuauc

SEQ ID NO: 1197242 - RNA, 13 nt, Eastern equine encephalitis virus
aacuucaugugcc

SEQ ID NO: 1197243 - RNA, 22 nt, Eastern equine encephalitis virus
agauguuuacgucaauggugaa

SEQ ID NO: 1197244 - RNA, 15 nt, Eastern equine encephalitis virus
ugcaugugcgcaccu

SEQ ID NO: 1197245 - RNA, 20 nt, Eastern equine encephalitis virus
cgacuauacaaccaccugca

SEQ ID NO: 1197246 - RNA, 16 nt, Eastern equine encephalitis virus
auggaaccaaaaaggg

SEQ ID NO: 1197247 - RNA, 16 nt, Eastern equine encephalitis virus
acugaaaacacccaga

SEQ ID NO: 1197248 - RNA, 23 nt, Eastern equine encephalitis virus
cccaagugaaauacuacugcaag

SEQ ID NO: 1197249 - RNA, 12 nt, Eastern equine encephalitis virus
uuacuaaacacu

SEQ ID NO: 1197250 - RNA, 16 nt, Eastern equine encephalitis virus
augucaaacaaugcag

SEQ ID NO: 1197251 - RNA, 16 nt, Eastern equine encephalitis virus
aggagucauccgcauc

SEQ ID NO: 1197252 - RNA, 21 nt, Eastern equine encephalitis virus
accgauucaaaacacgcucca

SEQ ID NO: 1197253 - RNA, 19 nt, Eastern equine encephalitis virus
augaucagcugcucgaugc

SEQ ID NO: 1197254 - RNA, 14 nt, Eastern equine encephalitis virus
ucaagcugaagaag

SEQ ID NO: 1197255 - RNA, 17 nt, Eastern equine encephalitis virus
ucgagagcuugugcgca

SEQ ID NO: 1197256 - RNA, 20 nt, Eastern equine encephalitis virus
ccacggcuauuacauccugg

SEQ ID NO: 1197257 - RNA, 22 nt, Eastern equine encephalitis virus
gcgacuauacaaccaccugcac

SEQ ID NO: 1197258 - RNA, 17 nt, Eastern equine encephalitis virus
aucuugucaaccacaua

SEQ ID NO: 1197259 - RNA, 22 nt, Eastern equine encephalitis virus
aauuguccuggguggagucaac

SEQ ID NO: 1197260 - RNA, 16 nt, Eastern equine encephalitis virus
agcaccuaacccucca

SEQ ID NO: 1197261 - RNA, 22 nt, Eastern equine encephalitis virus
accagaggggucagagccaugg

SEQ ID NO: 1197262 - RNA, 15 nt, Eastern equine encephalitis virus
agcucugcaugauga

SEQ ID NO: 1197263 - RNA, 15 nt, Eastern equine encephalitis virus
gcccuaacugugggc

SEQ ID NO: 1197264 - RNA, 14 nt, Eastern equine encephalitis virus
acaucaaccagcaa

SEQ ID NO: 1197265 - RNA, 17 nt, Eastern equine encephalitis virus
cgcagagcucugcauga

SEQ ID NO: 1197266 - RNA, 22 nt, Eastern equine encephalitis virus
gauacagcugguuaauaccagg

SEQ ID NO: 1197267 - RNA, 19 nt, Eastern equine encephalitis virus
gcagaaaauugugcagugg

SEQ ID NO: 1197268 - RNA, 18 nt, Eastern equine encephalitis virus
uugaaacaacgagcaccu

SEQ ID NO: 1197269 - RNA, 17 nt, Eastern equine encephalitis virus
ccaguauaagcuggcac

SEQ ID NO: 1197270 - RNA, 20 nt, Eastern equine encephalitis virus
caccagaggggucagagcca

SEQ ID NO: 1197271 - RNA, 16 nt, Eastern equine encephalitis virus
acucgcaaucuuugca

SEQ ID NO: 1197272 - RNA, 16 nt, Eastern equine encephalitis virus
uuaucccacuugcagc

SEQ ID NO: 1197273 - RNA, 20 nt, Eastern equine encephalitis virus
gcacacaccuuucacccagg

SEQ ID NO: 1197274 - RNA, 15 nt, Eastern equine encephalitis virus
caccaccaccugcca

SEQ ID NO: 1197275 - RNA, 19 nt, Eastern equine encephalitis virus
ccuuagcauccacagugcc

SEQ ID NO: 1197276 - RNA, 24 nt, Eastern equine encephalitis virus
agggcagaugacaccuugcaagug

SEQ ID NO: 1197277 - RNA, 18 nt, Eastern equine encephalitis virus
cacacagcagugaugccg

SEQ ID NO: 1197278 - RNA, 15 nt, Eastern equine encephalitis virus
ccuuagcauccacag

SEQ ID NO: 1197279 - RNA, 20 nt, Eastern equine encephalitis virus
ugauugcccuaacugugggc

SEQ ID NO: 1197280 - RNA, 16 nt, Eastern equine encephalitis virus
cuacugcaagugccca

SEQ ID NO: 1197281 - RNA, 14 nt, Eastern equine encephalitis virus
gaguacaucaccug

SEQ ID NO: 1197282 - RNA, 23 nt, Eastern equine encephalitis virus
aacucaucauagguccacuguca

SEQ ID NO: 1197283 - RNA, 15 nt, Eastern equine encephalitis virus
ugcaagcaacagcuu

SEQ ID NO: 1197284 - RNA, 17 nt, Eastern equine encephalitis virus
cacagcguugaccacau

SEQ ID NO: 1197285 - RNA, 17 nt, Eastern equine encephalitis virus
cgugcagaccaaggaca

SEQ ID NO: 1197286 - RNA, 20 nt, Eastern equine encephalitis virus
cuggaguacaucaccugcaa

SEQ ID NO: 1197287 - RNA, 17 nt, Eastern equine encephalitis virus
ugaaacaccgacagucu

SEQ ID NO: 1197288 - RNA, 14 nt, Eastern equine encephalitis virus
gacaugucugcaga

SEQ ID NO: 1197289 - RNA, 17 nt, Eastern equine encephalitis virus
accaccaccaccugcca

SEQ ID NO: 1197290 - RNA, 14 nt, Eastern equine encephalitis virus
cugauugacaacaa

SEQ ID NO: 1197291 - RNA, 22 nt, Eastern equine encephalitis virus
ugccuguuaaggccaagugcau

SEQ ID NO: 1197292 - RNA, 12 nt, Eastern equine encephalitis virus
gggaauccacau

SEQ ID NO: 1197293 - RNA, 19 nt, Eastern equine encephalitis virus
acuuacagccauugcauga

SEQ ID NO: 1197294 - RNA, 14 nt, Eastern equine encephalitis virus
cuaaauaucagaga

SEQ ID NO: 1197295 - RNA, 22 nt, Eastern equine encephalitis virus
cccuggagccgcuccgugcaga

SEQ ID NO: 1197296 - RNA, 16 nt, Eastern equine encephalitis virus
cagaauuacgacagcc

SEQ ID NO: 1197297 - RNA, 12 nt, Eastern equine encephalitis virus
uacaauuacacu

SEQ ID NO: 1197298 - RNA, 15 nt, Eastern equine encephalitis virus
cauuauaacacuaag

SEQ ID NO: 1197299 - RNA, 16 nt, Eastern equine encephalitis virus
uuccaucaacuaaccu

SEQ ID NO: 1197300 - RNA, 11 nt, Eastern equine encephalitis virus
cauugcagaac

SEQ ID NO: 1197301 - RNA, 16 nt, Eastern equine encephalitis virus
caaacaccaacuugaa

SEQ ID NO: 1197302 - RNA, 20 nt, Eastern equine encephalitis virus
ggcugcuauauuaccacauu

SEQ ID NO: 1197303 - RNA, 16 nt, Eastern equine encephalitis virus
cuauucuugacaacaa

SEQ ID NO: 1197304 - RNA, 19 nt, Eastern equine encephalitis virus
ucaauaaagaucgacaacc

SEQ ID NO: 1197305 - RNA, 14 nt, Eastern equine encephalitis virus
ggagcgucagcugg

SEQ ID NO: 1197306 - RNA, 21 nt, Eastern equine encephalitis virus
uuuggacacucauuucaccca

SEQ ID NO: 1197307 - RNA, 19 nt, Eastern equine encephalitis virus
gacacugaaaacacccaga

SEQ ID NO: 1197308 - RNA, 21 nt, Eastern equine encephalitis virus
cgcugcuuauuuugcuguggg

SEQ ID NO: 1197309 - RNA, 17 nt, Eastern equine encephalitis virus
uugcaaccuaguacugc

SEQ ID NO: 1197310 - RNA, 20 nt, Eastern equine encephalitis virus
ccacgcuggcaccagagccu

SEQ ID NO: 1197311 - RNA, 14 nt, Eastern equine encephalitis virus
uaccgucacccacc

SEQ ID NO: 1197312 - RNA, 17 nt, Eastern equine encephalitis virus
acacuacguugagaugc

SEQ ID NO: 1197313 - RNA, 12 nt, Eastern equine encephalitis virus
auugugcagugg

SEQ ID NO: 1197314 - RNA, 19 nt, Eastern equine encephalitis virus
cagcuggagaucugcagau

SEQ ID NO: 1197315 - RNA, 23 nt, Eastern equine encephalitis virus
gccgcuccgugcagaaaauugug

SEQ ID NO: 1197316 - RNA, 18 nt, Eastern equine encephalitis virus
gaaggccagcauauauga

SEQ ID NO: 1197317 - RNA, 15 nt, Eastern equine encephalitis virus
uucacccaguauaag

SEQ ID NO: 1197318 - RNA, 14 nt, Eastern equine encephalitis virus
accacccugcaugc

SEQ ID NO: 1197319 - RNA, 18 nt, Eastern equine encephalitis virus
ugaugugccacaaugcau

SEQ ID NO: 1197320 - RNA, 18 nt, Eastern equine encephalitis virus
augcacccguucaccuac

SEQ ID NO: 1197321 - RNA, 15 nt, Eastern equine encephalitis virus
cauccagacaucagc

SEQ ID NO: 1197322 - RNA, 16 nt, Eastern equine encephalitis virus
acucauuucacccagu

SEQ ID NO: 1197323 - RNA, 14 nt, Eastern equine encephalitis virus
acuuugcugcauua

SEQ ID NO: 1197324 - RNA, 19 nt, Eastern equine encephalitis virus
gcucaagagucaggagaag

SEQ ID NO: 1197325 - RNA, 19 nt, Eastern equine encephalitis virus
gccaagaaacaaaaacgua

SEQ ID NO: 1197326 - RNA, 13 nt, Eastern equine encephalitis virus
aagaaacaaaaac

SEQ ID NO: 1197327 - RNA, 13 nt, Eastern equine encephalitis virus
aucagcauuuauc

SEQ ID NO: 1197328 - RNA, 16 nt, Eastern equine encephalitis virus
gcaaucuuugcauaac

SEQ ID NO: 1197329 - RNA, 12 nt, Eastern equine encephalitis virus
gggacaaaacau

SEQ ID NO: 1197330 - RNA, 16 nt, Eastern equine encephalitis virus
uauaaucaggcauaau

SEQ ID NO: 1197331 - RNA, 14 nt, Eastern equine encephalitis virus
ugccacucaaugua

SEQ ID NO: 1197332 - RNA, 15 nt, Eastern equine encephalitis virus
uccaaucauguugaa

SEQ ID NO: 1197333 - RNA, 17 nt, Eastern equine encephalitis virus
cagcgaauguguaugaa

SEQ ID NO: 1197334 - RNA, 19 nt, Eastern equine encephalitis virus
uugcauaaccccguauaaa

SEQ ID NO: 1197335 - RNA, 21 nt, Eastern equine encephalitis virus
cgacuauacaaccaccugcac

SEQ ID NO: 1197336 - RNA, 22 nt, Eastern equine encephalitis virus
ugaugugccacaaugcaugaaa

SEQ ID NO: 1197337 - RNA, 13 nt, Eastern equine encephalitis virus
agcaacgaucugu

SEQ ID NO: 1197338 - RNA, 15 nt, Eastern equine encephalitis virus
ccuaugaucagcugc

SEQ ID NO: 1197339 - RNA, 14 nt, Eastern equine encephalitis virus
ccaccaccaccugc

SEQ ID NO: 1197340 - RNA, 16 nt, Eastern equine encephalitis virus
auaacauaacggauga

SEQ ID NO: 1197341 - RNA, 18 nt, Eastern equine encephalitis virus
agaagcuguugcagaaga

SEQ ID NO: 1197342 - RNA, 17 nt, Eastern equine encephalitis virus
acuaucagugucaggug

SEQ ID NO: 1197343 - RNA, 22 nt, Eastern equine encephalitis virus
gucggcgauauccgccacugcg

SEQ ID NO: 1197344 - RNA, 14 nt, Eastern equine encephalitis virus
ugcacaguugccca

SEQ ID NO: 1197345 - RNA, 13 nt, Eastern equine encephalitis virus
cuggcaccagagc

SEQ ID NO: 1197346 - RNA, 19 nt, Eastern equine encephalitis virus
ugucugcggcgccuugggc

SEQ ID NO: 1197347 - RNA, 17 nt, Eastern equine encephalitis virus
ccauggagcuguacagu

SEQ ID NO: 1197348 - RNA, 22 nt, Eastern equine encephalitis virus
cgucacccaccugaacauggag

SEQ ID NO: 1197349 - RNA, 19 nt, Eastern equine encephalitis virus
gaccuugcugacgaccagg

SEQ ID NO: 1197350 - RNA, 18 nt, Eastern equine encephalitis virus
cauaagaggucaccccau

SEQ ID NO: 1197351 - RNA, 17 nt, Eastern equine encephalitis virus
gcaguguauaaggcugu

SEQ ID NO: 1197352 - RNA, 22 nt, Eastern equine encephalitis virus
augcuaucauugcagaacacuu

SEQ ID NO: 1197353 - RNA, 16 nt, Eastern equine encephalitis virus
augauucuugaagacc

SEQ ID NO: 1197354 - RNA, 14 nt, Eastern equine encephalitis virus
cacucaauguaccu

SEQ ID NO: 1197355 - RNA, 14 nt, Eastern equine encephalitis virus
ugcauaaugcugcu

SEQ ID NO: 1197356 - RNA, 20 nt, Eastern equine encephalitis virus
ucauuucacccaguauaagc

SEQ ID NO: 1197357 - RNA, 16 nt, Eastern equine encephalitis virus
cuaugaucagcugcuc

SEQ ID NO: 1197358 - RNA, 22 nt, Eastern equine encephalitis virus
aaggcugucuuacuaaacacua

SEQ ID NO: 1197359 - RNA, 20 nt, Eastern equine encephalitis virus
gcgacuauacaaccaccugc

SEQ ID NO: 1197360 - RNA, 15 nt, Eastern equine encephalitis virus
agugcauaaugcugc

SEQ ID NO: 1197361 - RNA, 15 nt, Eastern equine encephalitis virus
cacguuggaacagaa

SEQ ID NO: 1197362 - RNA, 20 nt, Eastern equine encephalitis virus
augcuaggagaaccaggaga

SEQ ID NO: 1197363 - RNA, 14 nt, Eastern equine encephalitis virus
cuggcaccauggag

SEQ ID NO: 1197364 - RNA, 19 nt, Eastern equine encephalitis virus
gaucgcuagccgcgugcuc

SEQ ID NO: 1197365 - RNA, 23 nt, Eastern equine encephalitis virus
acuaucagugucagguguuuaca

SEQ ID NO: 1197366 - RNA, 15 nt, Eastern equine encephalitis virus
cugacuaucaguguc

SEQ ID NO: 1197367 - RNA, 17 nt, Eastern equine encephalitis virus
caguguauaaggcuguc

SEQ ID NO: 1197368 - RNA, 15 nt, Eastern equine encephalitis virus
cuggcaccagagccu

SEQ ID NO: 1197369 - RNA, 20 nt, Eastern equine encephalitis virus
ccaugugaucaaccacccug

SEQ ID NO: 1197370 - RNA, 21 nt, Eastern equine encephalitis virus
cauaagguagaauucaggcca

SEQ ID NO: 1197371 - RNA, 23 nt, Eastern equine encephalitis virus
gacggcucuaucaguggugacau

SEQ ID NO: 1197372 - RNA, 14 nt, Eastern equine encephalitis virus
cuauucuugacaac

SEQ ID NO: 1197373 - RNA, 14 nt, Eastern equine encephalitis virus
agcgaccaccacca

SEQ ID NO: 1197374 - RNA, 17 nt, Eastern equine encephalitis virus
caacgaccccaggcugg

SEQ ID NO: 1197375 - RNA, 17 nt, Eastern equine encephalitis virus
ggugacgguggugcaua

SEQ ID NO: 1197376 - RNA, 15 nt, Eastern equine encephalitis virus
agaccuaggaguuga

SEQ ID NO: 1197377 - RNA, 18 nt, Eastern equine encephalitis virus
agagggaacuaccagcag

SEQ ID NO: 1197378 - RNA, 14 nt, Eastern equine encephalitis virus
ccaagaaacaaaaa

SEQ ID NO: 1197379 - RNA, 16 nt, Eastern equine encephalitis virus
caaauccaacucgaca

SEQ ID NO: 1197380 - RNA, 16 nt, Eastern equine encephalitis virus
accgaaagaccacauc

SEQ ID NO: 1197381 - RNA, 22 nt, Eastern equine encephalitis virus
cuggagcguuccguccaugaga

SEQ ID NO: 1197382 - RNA, 18 nt, Eastern equine encephalitis virus
gcagugcauaaggcugcu

SEQ ID NO: 1197383 - RNA, 20 nt, Eastern equine encephalitis virus
guaugcaugcgcaugcugcg

SEQ ID NO: 1197384 - RNA, 20 nt, Eastern equine encephalitis virus
acacucuuuaucaauacugu

SEQ ID NO: 1197385 - RNA, 16 nt, Eastern equine encephalitis virus
uucaugugcccuuugu

SEQ ID NO: 1197386 - RNA, 22 nt, Eastern equine encephalitis virus
gagucgccgacccccugaagag

SEQ ID NO: 1197387 - RNA, 16 nt, Eastern equine encephalitis virus
ugccacaaugcaugaa

SEQ ID NO: 1197388 - RNA, 16 nt, Eastern equine encephalitis virus
aguacaucaccugcaa

SEQ ID NO: 1197389 - RNA, 13 nt, Eastern equine encephalitis virus
accaccaccugcc

SEQ ID NO: 1197390 - RNA, 16 nt, Eastern equine encephalitis virus
gggaacauaacaucug

SEQ ID NO: 1197391 - RNA, 14 nt, Eastern equine encephalitis virus
ggagaaccaggaga

SEQ ID NO: 1197392 - RNA, 15 nt, Eastern equine encephalitis virus
caugucugcagaaga

SEQ ID NO: 1197393 - RNA, 19 nt, Eastern equine encephalitis virus
cuccaguacaccagugaca

SEQ ID NO: 1197394 - RNA, 13 nt, Eastern equine encephalitis virus
uauccgccacugc

SEQ ID NO: 1197395 - RNA, 12 nt, Eastern equine encephalitis virus
uuaauaccagga

SEQ ID NO: 1197396 - RNA, 14 nt, Eastern equine encephalitis virus
acacuacguugaga

SEQ ID NO: 1197397 - RNA, 16 nt, Eastern equine encephalitis virus
gaccaccaccaccugc

SEQ ID NO: 1197398 - RNA, 21 nt, Eastern equine encephalitis virus
agcaacuuuaaacacauaaga

SEQ ID NO: 1197399 - RNA, 13 nt, Eastern equine encephalitis virus
agaggggaugcgc

SEQ ID NO: 1197400 - RNA, 20 nt, Eastern equine encephalitis virus
uggcggcccuuuaggccacc

SEQ ID NO: 1197401 - RNA, 23 nt, Eastern equine encephalitis virus
agaagcgaccaccaccaccugcc

SEQ ID NO: 1197402 - RNA, 12 nt, Eastern equine encephalitis virus
aacccuccagca

SEQ ID NO: 1197403 - RNA, 19 nt, Eastern equine encephalitis virus
auaucacguuuccauguga

SEQ ID NO: 1197404 - RNA, 15 nt, Eastern equine encephalitis virus
auacccuccaguaca

SEQ ID NO: 1197405 - RNA, 15 nt, Eastern equine encephalitis virus
acuuuguuugacaug

SEQ ID NO: 1197406 - RNA, 22 nt, Eastern equine encephalitis virus
uugucaaccacauaacacuaua

SEQ ID NO: 1197407 - RNA, 19 nt, Eastern equine encephalitis virus
aaugauucuugaagaccua

SEQ ID NO: 1197408 - RNA, 17 nt, Eastern equine encephalitis virus
aaacacuacaggcagcg

SEQ ID NO: 1197409 - RNA, 20 nt, Eastern equine encephalitis virus
gccaaacgcaagaagccugc

SEQ ID NO: 1197410 - RNA, 13 nt, Eastern equine encephalitis virus
agguguugcaguu

SEQ ID NO: 1197411 - RNA, 15 nt, Eastern equine encephalitis virus
gcacguagaaggcag

SEQ ID NO: 1197412 - RNA, 15 nt, Eastern equine encephalitis virus
ccaccugccaagaaa

SEQ ID NO: 1197413 - RNA, 13 nt, Eastern equine encephalitis virus
uuacaggaacugc

SEQ ID NO: 1197414 - RNA, 15 nt, Eastern equine encephalitis virus
gcgaccaccaccacc

SEQ ID NO: 1197415 - RNA, 17 nt, Eastern equine encephalitis virus
uucaggugauacaggca

SEQ ID NO: 1197416 - RNA, 14 nt, Eastern equine encephalitis virus
ccuccagcaggacc

SEQ ID NO: 1197417 - RNA, 15 nt, Eastern equine encephalitis virus
uguuacucaaaugag

SEQ ID NO: 1197418 - RNA, 19 nt, Eastern equine encephalitis virus
caucauagguccacuguca

SEQ ID NO: 1197419 - RNA, 11 nt, Eastern equine encephalitis virus
caccaccugcc

SEQ ID NO: 1197420 - RNA, 12 nt, Eastern equine encephalitis virus
gacgcggugcua

SEQ ID NO: 1197421 - RNA, 15 nt, Eastern equine encephalitis virus
caucaagcugaagaa

SEQ ID NO: 1197422 - RNA, 12 nt, Eastern equine encephalitis virus
guacgagaggga

SEQ ID NO: 1197423 - RNA, 21 nt, Eastern equine encephalitis virus
gugcagaaaauugugcagugg

SEQ ID NO: 1197424 - RNA, 20 nt, Eastern equine encephalitis virus
ccuggaguacaucaccugca

SEQ ID NO: 1197425 - RNA, 21 nt, Eastern equine encephalitis virus
caggucugcacuagugcaguu

SEQ ID NO: 1197426 - RNA, 10 nt, Eastern equine encephalitis virus
cccugcaugc

SEQ ID NO: 1197427 - RNA, 15 nt, Eastern equine encephalitis virus
caggcacuguucagg

SEQ ID NO: 1197428 - RNA, 14 nt, Eastern equine encephalitis virus
cuccuauaaacacu

SEQ ID NO: 1197429 - RNA, 13 nt, Eastern equine encephalitis virus
aggcgcagagcuc

SEQ ID NO: 1197430 - RNA, 15 nt, Eastern equine encephalitis virus
cagccauugcaugag

SEQ ID NO: 1197431 - RNA, 18 nt, Eastern equine encephalitis virus
agccuaugaucagcugcu

SEQ ID NO: 1197432 - RNA, 17 nt, Eastern equine encephalitis virus
gagccuaugaucagcug

SEQ ID NO: 1197433 - RNA, 16 nt, Eastern equine encephalitis virus
accacauuauaacacu

SEQ ID NO: 1197434 - RNA, 16 nt, Eastern equine encephalitis virus
ucaaccacauaacacu

SEQ ID NO: 1197435 - RNA, 12 nt, Eastern equine encephalitis virus
gagcgugagaag

SEQ ID NO: 1197436 - RNA, 21 nt, Eastern equine encephalitis virus
caacgaucuguacgcaaacac

SEQ ID NO: 1197437 - RNA, 20 nt, Eastern equine encephalitis virus
gucgccgacccccugaagag

SEQ ID NO: 1197438 - RNA, 23 nt, Eastern equine encephalitis virus
ggaguugauuuggccuacaugag

SEQ ID NO: 1197439 - RNA, 15 nt, Eastern equine encephalitis virus
cuguguggcuaucau

SEQ ID NO: 1197440 - RNA, 20 nt, Eastern equine encephalitis virus
acugcaaacauccauccugc

SEQ ID NO: 1197441 - RNA, 14 nt, Eastern equine encephalitis virus
ccucgugucgcacc

SEQ ID NO: 1197442 - RNA, 18 nt, Eastern equine encephalitis virus
ccaccacuugcagcucaa

SEQ ID NO: 1197443 - RNA, 12 nt, Eastern equine encephalitis virus
auagacauuaac

SEQ ID NO: 1197444 - RNA, 21 nt, Eastern equine encephalitis virus
gaucaaccacccugcaugcca

SEQ ID NO: 1197445 - RNA, 13 nt, Eastern equine encephalitis virus
acauccauccugc

SEQ ID NO: 1197446 - RNA, 12 nt, Eastern equine encephalitis virus
cuaaccuggagu

SEQ ID NO: 1197447 - RNA, 21 nt, Eastern equine encephalitis virus
cauaaugcugcuccuaaguaa

SEQ ID NO: 1197448 - RNA, 13 nt, Eastern equine encephalitis virus
gcaucgccacgcu

SEQ ID NO: 1197449 - RNA, 16 nt, Eastern equine encephalitis virus
uauacaaccaccugca

SEQ ID NO: 1197450 - RNA, 12 nt, Eastern equine encephalitis virus
aagcugaagaag

SEQ ID NO: 1197451 - RNA, 23 nt, Eastern equine encephalitis virus
auggaaccaaaaagggguuacag

SEQ ID NO: 1197452 - RNA, 16 nt, Eastern equine encephalitis virus
ggugauacaggcagcu

SEQ ID NO: 1197453 - RNA, 12 nt, Eastern equine encephalitis virus
ucaagcugaaga

SEQ ID NO: 1197454 - RNA, 16 nt, Eastern equine encephalitis virus
accuccaaaccccauc

SEQ ID NO: 1197455 - RNA, 22 nt, Eastern equine encephalitis virus
cuggaguacaucaccugcaagu

SEQ ID NO: 1197456 - RNA, 19 nt, Eastern equine encephalitis virus
gcgaccaccaccaccugcc

SEQ ID NO: 1197457 - RNA, 22 nt, Eastern equine encephalitis virus
ucgaggagagggcgacacuuuu

SEQ ID NO: 1197458 - RNA, 21 nt, Eastern equine encephalitis virus
cacuacguugagaugcaucaa

SEQ ID NO: 1197459 - RNA, 22 nt, Eastern equine encephalitis virus
cauccugcuuuuaagcugcagg

SEQ ID NO: 1197460 - RNA, 21 nt, Eastern equine encephalitis virus
ccacaagcgugcagaccaagg

SEQ ID NO: 1197461 - RNA, 17 nt, Eastern equine encephalitis virus
caaaaagggguuacagu

SEQ ID NO: 1197462 - RNA, 11 nt, Eastern equine encephalitis virus
uaccugcaaag

SEQ ID NO: 1197463 - RNA, 19 nt, Eastern equine encephalitis virus
auuaccacauuauaacacu

SEQ ID NO: 1197464 - RNA, 15 nt, Eastern equine encephalitis virus
gcaucacugaagagc

SEQ ID NO: 1197465 - RNA, 18 nt, Eastern equine encephalitis virus
agggcagugcauaaugcu

SEQ ID NO: 1197466 - RNA, 19 nt, Eastern equine encephalitis virus
cacacuuuguuugacaugu

SEQ ID NO: 1197467 - RNA, 18 nt, Eastern equine encephalitis virus
aauccaguaaagcaggaa

SEQ ID NO: 1197468 - RNA, 17 nt, Eastern equine encephalitis virus
cuuuccaaagaagcaca

SEQ ID NO: 1197469 - RNA, 20 nt, Eastern equine encephalitis virus
ugaugcuaucauugcagaac

SEQ ID NO: 1197470 - RNA, 18 nt, Eastern equine encephalitis virus
caauuacacuacagguaa

SEQ ID NO: 1197471 - RNA, 17 nt, Eastern equine encephalitis virus
cgaucagcagugccauc

SEQ ID NO: 1197472 - RNA, 22 nt, Eastern equine encephalitis virus
uagcuauagaagaagucagagg

SEQ ID NO: 1197473 - RNA, 23 nt, Eastern equine encephalitis virus
auaacgccgccgaugcagugcau

SEQ ID NO: 1197474 - RNA, 18 nt, Eastern equine encephalitis virus
gccgacgagggcagauga

SEQ ID NO: 1197475 - RNA, 19 nt, Eastern equine encephalitis virus
ucccgcgaaaauaggagau

SEQ ID NO: 1197476 - RNA, 14 nt, Eastern equine encephalitis virus
uagagaacaugaag

SEQ ID NO: 1197477 - RNA, 20 nt, Eastern equine encephalitis virus
cauccugacuaucaguguca

SEQ ID NO: 1197478 - RNA, 13 nt, Eastern equine encephalitis virus
gugaaaugcugcg

SEQ ID NO: 1197479 - RNA, 16 nt, Eastern equine encephalitis virus
ggaggagccuacugcu

SEQ ID NO: 1197480 - RNA, 19 nt, Eastern equine encephalitis virus
gagccauggucgcuugcca

SEQ ID NO: 1197481 - RNA, 22 nt, Eastern equine encephalitis virus
gcggugcuagagacagacauag

SEQ ID NO: 1197482 - RNA, 15 nt, Eastern equine encephalitis virus
ucauucuccaucagg

SEQ ID NO: 1197483 - RNA, 14 nt, Eastern equine encephalitis virus
uccuauaaacacua

SEQ ID NO: 1197484 - RNA, 15 nt, Eastern equine encephalitis virus
auucuccaucaggug

SEQ ID NO: 1197485 - RNA, 12 nt, Eastern equine encephalitis virus
gucagcuggaga

SEQ ID NO: 1197486 - RNA, 21 nt, Eastern equine encephalitis virus
caugugaucaaccacccugca

SEQ ID NO: 1197487 - RNA, 20 nt, Eastern equine encephalitis virus
gcucuuuuggagaccugcaa

SEQ ID NO: 1197488 - RNA, 20 nt, Eastern equine encephalitis virus
cagaugacaccuugcaagug

SEQ ID NO: 1197489 - RNA, 11 nt, Eastern equine encephalitis virus
caucaccugca

SEQ ID NO: 1197490 - RNA, 17 nt, Eastern equine encephalitis virus
ucaaccacccugcaugc

SEQ ID NO: 1197491 - RNA, 16 nt, Eastern equine encephalitis virus
augaacggcaaaacgc

SEQ ID NO: 1197492 - RNA, 22 nt, Eastern equine encephalitis virus
uccaguguuggauucagcugcc

SEQ ID NO: 1197493 - RNA, 14 nt, Eastern equine encephalitis virus
uacaguaugagaac

SEQ ID NO: 1197494 - RNA, 18 nt, Eastern equine encephalitis virus
guuacacccacaagcgug

SEQ ID NO: 1197495 - RNA, 13 nt, Eastern equine encephalitis virus
gucacccaccuga

SEQ ID NO: 1197496 - RNA, 16 nt, Eastern equine encephalitis virus
aaugagggaacuucca

SEQ ID NO: 1197497 - RNA, 20 nt, Eastern equine encephalitis virus
ugugccuguuaaggccaagu

SEQ ID NO: 1197498 - RNA, 20 nt, Eastern equine encephalitis virus
ccgagccuaugaucagcugc

SEQ ID NO: 1197499 - RNA, 17 nt, Eastern equine encephalitis virus
uccugcucccauguauu

SEQ ID NO: 1197500 - RNA, 17 nt, Eastern equine encephalitis virus
uaaugauucuugaagac

SEQ ID NO: 1197501 - RNA, 15 nt, Eastern equine encephalitis virus
cuagagucagauaaa

SEQ ID NO: 1197502 - RNA, 21 nt, Eastern equine encephalitis virus
ggacaaaacauacugaagaaa

SEQ ID NO: 1197503 - RNA, 15 nt, Eastern equine encephalitis virus
cccugcaugccaugc

SEQ ID NO: 1197504 - RNA, 19 nt, Eastern equine encephalitis virus
gcauaaugcugucuuuuau

SEQ ID NO: 1197505 - RNA, 20 nt, Eastern equine encephalitis virus
caagcugaagaaggccagca

SEQ ID NO: 1197506 - RNA, 18 nt, Eastern equine encephalitis virus
agccauggucgcuugcca

SEQ ID NO: 1197507 - RNA, 23 nt, Eastern equine encephalitis virus
guggacgaguguucaaaccgcug

SEQ ID NO: 1197508 - RNA, 13 nt, Eastern equine encephalitis virus
accugcaugugcg

SEQ ID NO: 1197509 - RNA, 13 nt, Eastern equine encephalitis virus
ccacccugcaugc

SEQ ID NO: 1197510 - RNA, 23 nt, Eastern equine encephalitis virus
cgauuucggugguauagccaccg

SEQ ID NO: 1197511 - RNA, 13 nt, Eastern equine encephalitis virus
ugcaaguauaaga

SEQ ID NO: 1197512 - RNA, 19 nt, Eastern equine encephalitis virus
cgagccuaugaucagcugc

SEQ ID NO: 1197513 - RNA, 16 nt, Eastern equine encephalitis virus
acuauacaaccaccug

SEQ ID NO: 1197514 - RNA, 13 nt, Eastern equine encephalitis virus
cuucuccacugca

SEQ ID NO: 1197515 - RNA, 15 nt, Eastern equine encephalitis virus
ggcaccggcaaagca

SEQ ID NO: 1197516 - RNA, 14 nt, Eastern equine encephalitis virus
aggggucagagcca

SEQ ID NO: 1197517 - RNA, 20 nt, Eastern equine encephalitis virus
cuauguucggucugaagacg

SEQ ID NO: 1197518 - RNA, 17 nt, Eastern equine encephalitis virus
gcgaaaauaggagaugc

SEQ ID NO: 1197519 - RNA, 21 nt, Eastern equine encephalitis virus
cugacgcacugauggcagagc

SEQ ID NO: 1197520 - RNA, 17 nt, Eastern equine encephalitis virus
gcagaaccgcaaccagu

SEQ ID NO: 1197521 - RNA, 14 nt, Eastern equine encephalitis virus
ggaguugaucaggc

SEQ ID NO: 1197522 - RNA, 16 nt, Eastern equine encephalitis virus
caguagugaaaugcug

SEQ ID NO: 1197523 - RNA, 16 nt, Eastern equine encephalitis virus
ccauguuggaacagaa

SEQ ID NO: 1197524 - RNA, 17 nt, Eastern equine encephalitis virus
caaacgcaagaagccug

SEQ ID NO: 1197525 - RNA, 22 nt, Eastern equine encephalitis virus
uauggugaugugccacaaugca

SEQ ID NO: 1197526 - RNA, 18 nt, Eastern equine encephalitis virus
cgggacaagggcaccugc

SEQ ID NO: 1197527 - RNA, 21 nt, Eastern equine encephalitis virus
aguugagcacaaacaccgcac

SEQ ID NO: 1197528 - RNA, 18 nt, Eastern equine encephalitis virus
cugucaauuucacaguca

SEQ ID NO: 1197529 - RNA, 17 nt, Eastern equine encephalitis virus
uaucagagauguuccca

SEQ ID NO: 1197530 - RNA, 14 nt, Eastern equine encephalitis virus
ccauccaccaaaaa

SEQ ID NO: 1197531 - RNA, 13 nt, Eastern equine encephalitis virus
aucaucgaugcag

SEQ ID NO: 1197532 - RNA, 20 nt, Eastern equine encephalitis virus
gacaacaaagguagagucgu

SEQ ID NO: 1197533 - RNA, 13 nt, Eastern equine encephalitis virus
cuaagggcagugc

SEQ ID NO: 1197534 - RNA, 12 nt, Eastern equine encephalitis virus
ugaaaugcugcg

SEQ ID NO: 1197535 - RNA, 16 nt, Eastern equine encephalitis virus
ucaucagcagaagugg

SEQ ID NO: 1197536 - RNA, 14 nt, Eastern equine encephalitis virus
agagcucugcauga

SEQ ID NO: 1197537 - RNA, 22 nt, Eastern equine encephalitis virus
cgccuccuauaaacacuacagg

SEQ ID NO: 1197538 - RNA, 23 nt, Eastern equine encephalitis virus
agccgcuuccacuggacgaugac

SEQ ID NO: 1197539 - RNA, 21 nt, Eastern equine encephalitis virus
gcagaaccgcaaccaguugaa

SEQ ID NO: 1197540 - RNA, 23 nt, Eastern equine encephalitis virus
gugcacacaccuuucacccaggc

SEQ ID NO: 1197541 - RNA, 21 nt, Eastern equine encephalitis virus
gaagcuguugcagaagaaacu

SEQ ID NO: 1197542 - RNA, 19 nt, Eastern equine encephalitis virus
auuccacuucuccacugca

SEQ ID NO: 1197543 - RNA, 18 nt, Eastern equine encephalitis virus
aaacacuaaauucacccu

SEQ ID NO: 1197544 - RNA, 19 nt, Eastern equine encephalitis virus
uggcucaaugcccaccagg

SEQ ID NO: 1197545 - RNA, 20 nt, Eastern equine encephalitis virus
aggcagaauagacaaugagc

SEQ ID NO: 1197546 - RNA, 14 nt, Eastern equine encephalitis virus
aaugcuaggagaac

SEQ ID NO: 1197547 - RNA, 15 nt, Eastern equine encephalitis virus
aaaguacacacaggc

SEQ ID NO: 1197548 - RNA, 15 nt, Eastern equine encephalitis virus
gugcgcagguugaac

SEQ ID NO: 1197549 - RNA, 18 nt, Eastern equine encephalitis virus
gccaccuuuugcccagcu

SEQ ID NO: 1197550 - RNA, 14 nt, Eastern equine encephalitis virus
cccgaacgcucaag

SEQ ID NO: 1197551 - RNA, 16 nt, Eastern equine encephalitis virus
aagcugaagaaggcca

SEQ ID NO: 1197552 - RNA, 18 nt, Eastern equine encephalitis virus
caacaaaaaaugggugua

SEQ ID NO: 1197553 - RNA, 16 nt, Eastern equine encephalitis virus
caccugcaacaaaaau

SEQ ID NO: 1197554 - RNA, 21 nt, Eastern equine encephalitis virus
ucgacaaccugcaugugcgca

SEQ ID NO: 1197555 - RNA, 19 nt, Eastern equine encephalitis virus
cgggacaagggcaccugca

SEQ ID NO: 1197556 - RNA, 17 nt, Eastern equine encephalitis virus
gacccaaagcagcugcc

SEQ ID NO: 1197557 - RNA, 19 nt, Eastern equine encephalitis virus
cucaaugcccaccagggga

SEQ ID NO: 1197558 - RNA, 23 nt, Eastern equine encephalitis virus
ggagucauccgcauccagacauc

SEQ ID NO: 1197559 - RNA, 15 nt, Eastern equine encephalitis virus
ugguugcccuaguuc

SEQ ID NO: 1197560 - RNA, 15 nt, Eastern equine encephalitis virus
ccugcacggauguca

SEQ ID NO: 1197561 - RNA, 13 nt, Eastern equine encephalitis virus
caaccaccugcac

SEQ ID NO: 1197562 - RNA, 14 nt, Eastern equine encephalitis virus
aggaaaaagaagcg

SEQ ID NO: 1197563 - RNA, 19 nt, Eastern equine encephalitis virus
ucugaaacaccgacagucu

SEQ ID NO: 1197564 - RNA, 22 nt, Eastern equine encephalitis virus
uaccagaauaucugaaacaccg

SEQ ID NO: 1197565 - RNA, 13 nt, Eastern equine encephalitis virus
accuaacccucca

SEQ ID NO: 1197566 - RNA, 18 nt, Eastern equine encephalitis virus
gccugagauacgaucagc

SEQ ID NO: 1197567 - RNA, 14 nt, Eastern equine encephalitis virus
agacaaacccgaua

SEQ ID NO: 1197568 - RNA, 16 nt, Eastern equine encephalitis virus
aaaacgcagaaaucaa

SEQ ID NO: 1197569 - RNA, 19 nt, Eastern equine encephalitis virus
agugcauaaugcugcuccu

SEQ ID NO: 1197570 - RNA, 15 nt, Eastern equine encephalitis virus
gucacuaaucaucac

SEQ ID NO: 1197571 - RNA, 14 nt, Eastern equine encephalitis virus
agcuggagaucugc

SEQ ID NO: 1197572 - RNA, 18 nt, Eastern equine encephalitis virus
caccuuucacccaggcgc

SEQ ID NO: 1197573 - RNA, 22 nt, Eastern equine encephalitis virus
uacacacuuuauaaucaggcau

SEQ ID NO: 1197574 - RNA, 18 nt, Eastern equine encephalitis virus
cuccaguacaccagugac

SEQ ID NO: 1197575 - RNA, 15 nt, Eastern equine encephalitis virus
gugcauaaugcugcu

SEQ ID NO: 1197576 - RNA, 19 nt, Eastern equine encephalitis virus
gaugugccacaaugcauga

SEQ ID NO: 1197577 - RNA, 20 nt, Eastern equine encephalitis virus
ccaggggacacgguuacagu

SEQ ID NO: 1197578 - RNA, 14 nt, Eastern equine encephalitis virus
cauccacagugcca

SEQ ID NO: 1197579 - RNA, 19 nt, Eastern equine encephalitis virus
uguaaugcuaggagaacca

SEQ ID NO: 1197580 - RNA, 20 nt, Eastern equine encephalitis virus
aaaaagggguuacagucaaa

SEQ ID NO: 1197581 - RNA, 15 nt, Eastern equine encephalitis virus
caguaaagcaggaaa

SEQ ID NO: 1197582 - RNA, 15 nt, Eastern equine encephalitis virus
caccgcacccugauu

SEQ ID NO: 1197583 - RNA, 13 nt, Eastern equine encephalitis virus
agcgaccaacaac

SEQ ID NO: 1197584 - RNA, 12 nt, Eastern equine encephalitis virus
gauacagcuggu

SEQ ID NO: 1197585 - RNA, 15 nt, Eastern equine encephalitis virus
gcuauuacauccugg

SEQ ID NO: 1197586 - RNA, 17 nt, Eastern equine encephalitis virus
gaaccaaaaagggguua

SEQ ID NO: 1197587 - RNA, 16 nt, Eastern equine encephalitis virus
acaauuacacuacagg

SEQ ID NO: 1197588 - RNA, 13 nt, Eastern equine encephalitis virus
cacccugcaugcc

SEQ ID NO: 1197589 - RNA, 13 nt, Eastern equine encephalitis virus
cacaaugcaugaa

SEQ ID NO: 1197590 - RNA, 23 nt, Eastern equine encephalitis virus
agacgcuuaucccacuugcagcg

SEQ ID NO: 1197591 - RNA, 14 nt, Eastern equine encephalitis virus
uaugaucagcugcu

SEQ ID NO: 1197592 - RNA, 21 nt, Eastern equine encephalitis virus
cagcuucucaucagcagaagu

SEQ ID NO: 1197593 - RNA, 19 nt, Eastern equine encephalitis virus
cauaacacuauaggcagug

SEQ ID NO: 1197594 - RNA, 11 nt, Eastern equine encephalitis virus
cucugcaugau

SEQ ID NO: 1197595 - RNA, 19 nt, Eastern equine encephalitis virus
gccuauggcgccgauuaac

SEQ ID NO: 1197596 - RNA, 17 nt, Eastern equine encephalitis virus
gucaauaucaugaucgc

SEQ ID NO: 1197597 - RNA, 18 nt, Eastern equine encephalitis virus
gcugaagaaggccagcau

SEQ ID NO: 1197598 - RNA, 22 nt, Eastern equine encephalitis virus
ugcaggucugcacuagugcagu

SEQ ID NO: 1197599 - RNA, 12 nt, Eastern equine encephalitis virus
ccuuucacccag

SEQ ID NO: 1197600 - RNA, 12 nt, Eastern equine encephalitis virus
caccucagcccc

SEQ ID NO: 1197601 - RNA, 18 nt, Eastern equine encephalitis virus
cagugcauaaggcugcua

SEQ ID NO: 1197602 - RNA, 15 nt, Eastern equine encephalitis virus
acuaagggcagugca

SEQ ID NO: 1197603 - RNA, 16 nt, Eastern equine encephalitis virus
ucaaagauacaccaga

SEQ ID NO: 1197604 - RNA, 12 nt, Eastern equine encephalitis virus
uuacgacagccg

SEQ ID NO: 1197605 - RNA, 14 nt, Eastern equine encephalitis virus
aaccacauaacacu

SEQ ID NO: 1197606 - RNA, 12 nt, Eastern equine encephalitis virus
caaucuuugcau

SEQ ID NO: 1197607 - RNA, 19 nt, Eastern equine encephalitis virus
gacgaguguucaaaccgcu

SEQ ID NO: 1197608 - RNA, 21 nt, Eastern equine encephalitis virus
ggcaguguauaaggcugucuu

SEQ ID NO: 1197609 - RNA, 20 nt, Eastern equine encephalitis virus
aggaaaacuucaugugcccu

SEQ ID NO: 1197610 - RNA, 23 nt, Eastern equine encephalitis virus
cagucaaagauacaccagagggg

SEQ ID NO: 1197611 - RNA, 16 nt, Eastern equine encephalitis virus
uaccgucacccaccug

SEQ ID NO: 1197612 - RNA, 14 nt, Eastern equine encephalitis virus
auaagguagaauuc

SEQ ID NO: 1197613 - RNA, 14 nt, Eastern equine encephalitis virus
caccagagggguca

SEQ ID NO: 1197614 - RNA, 22 nt, Eastern equine encephalitis virus
acaggcagcgcauaaugcuguc

SEQ ID NO: 1197615 - RNA, 15 nt, Eastern equine encephalitis virus
ccguauauugcugau

SEQ ID NO: 1197616 - RNA, 21 nt, Eastern equine encephalitis virus
gcucaaauugaggaccugaga

SEQ ID NO: 1197617 - RNA, 22 nt, Eastern equine encephalitis virus
ucuugucaaccacauaacacua

SEQ ID NO: 1197618 - RNA, 14 nt, Eastern equine encephalitis virus
ugcaggggauaggc

SEQ ID NO: 1197619 - RNA, 14 nt, Eastern equine encephalitis virus
cuaucaucaugguc

SEQ ID NO: 1197620 - RNA, 14 nt, Eastern equine encephalitis virus
acccugauuuuaca

SEQ ID NO: 1197621 - RNA, 21 nt, Eastern equine encephalitis virus
cuauagaagaagucagagggg

SEQ ID NO: 1197622 - RNA, 19 nt, Eastern equine encephalitis virus
cuuacagccauugcaugag

SEQ ID NO: 1197623 - RNA, 18 nt, Eastern equine encephalitis virus
gcacgaagugguagucua

SEQ ID NO: 1197624 - RNA, 21 nt, Eastern equine encephalitis virus
gaauuggcaucacugaagagc

SEQ ID NO: 1197625 - RNA, 18 nt, Eastern equine encephalitis virus
cacagugccaaggugaaa

SEQ ID NO: 1197626 - RNA, 17 nt, Eastern equine encephalitis virus
cacuaagggcagugcau

SEQ ID NO: 1197627 - RNA, 21 nt, Eastern equine encephalitis virus
uauaccuggggaaaccaucca

SEQ ID NO: 1197628 - RNA, 16 nt, Eastern equine encephalitis virus
gccacugucaugugcg

SEQ ID NO: 1197629 - RNA, 15 nt, Eastern equine encephalitis virus
ccaaagaagcacagu

SEQ ID NO: 1197630 - RNA, 20 nt, Eastern equine encephalitis virus
cagcugguuaauaccaggau

SEQ ID NO: 1197631 - RNA, 19 nt, Eastern equine encephalitis virus
gacuauacaaccaccugca

SEQ ID NO: 1197632 - RNA, 20 nt, Eastern equine encephalitis virus
uaaugcuaggagaaccagga

SEQ ID NO: 1197633 - RNA, 14 nt, Eastern equine encephalitis virus
cagguguugcaguu

SEQ ID NO: 1197634 - RNA, 16 nt, Eastern equine encephalitis virus
acugcaagcaacagcu

SEQ ID NO: 1197635 - RNA, 14 nt, Eastern equine encephalitis virus
gaacggacagguga

SEQ ID NO: 1197636 - RNA, 14 nt, Eastern equine encephalitis virus
ggacacgguuacag

SEQ ID NO: 1197637 - RNA, 22 nt, Eastern equine encephalitis virus
cgccaagccuaagccugcgcag

SEQ ID NO: 1197638 - RNA, 21 nt, Eastern equine encephalitis virus
ugcacggaugucaaacaaugc

SEQ ID NO: 1197639 - RNA, 14 nt, Eastern equine encephalitis virus
agcggaucauuuac

SEQ ID NO: 1197640 - RNA, 18 nt, Eastern equine encephalitis virus
cagucucagaccuggaau

SEQ ID NO: 1197641 - RNA, 20 nt, Eastern equine encephalitis virus
agaauuggcaucacugaaga

SEQ ID NO: 1197642 - RNA, 20 nt, Eastern equine encephalitis virus
aaguaauuuaauacacacuu

SEQ ID NO: 1197643 - RNA, 14 nt, Eastern equine encephalitis virus
accagagccucuag

SEQ ID NO: 1197644 - RNA, 24 nt, Eastern equine encephalitis virus
uuaucaauacuguugucaauauca

SEQ ID NO: 1197645 - RNA, 15 nt, Eastern equine encephalitis virus
aagcuguugcagaag

SEQ ID NO: 1197646 - RNA, 16 nt, Eastern equine encephalitis virus
cuaucauugcagaaca

SEQ ID NO: 1197647 - RNA, 15 nt, Eastern equine encephalitis virus
ccaccguagccagcu

SEQ ID NO: 1197648 - RNA, 11 nt, Eastern equine encephalitis virus
cuugccacugu

SEQ ID NO: 1197649 - RNA, 17 nt, Eastern equine encephalitis virus
cuauacaaccaccugca

SEQ ID NO: 1197650 - RNA, 18 nt, Eastern equine encephalitis virus
gagggaacuaccagcagc

SEQ ID NO: 1197651 - RNA, 14 nt, Eastern equine encephalitis virus
gaggggucagagcc

SEQ ID NO: 1197652 - RNA, 22 nt, Eastern equine encephalitis virus
uugcagcucaaauugaggaccu

SEQ ID NO: 1197653 - RNA, 24 nt, Eastern equine encephalitis virus
cuccaguacaccagugacaagccu

SEQ ID NO: 1197654 - RNA, 19 nt, Eastern equine encephalitis virus
agucauccgcauccagaca

SEQ ID NO: 1197655 - RNA, 17 nt, Eastern equine encephalitis virus
agcuguacaguaugaga

SEQ ID NO: 1197656 - RNA, 20 nt, Eastern equine encephalitis virus
gucucguaaaguagagaaca

SEQ ID NO: 1197657 - RNA, 17 nt, Eastern equine encephalitis virus
acccacaagcgugcaga

SEQ ID NO: 1197658 - RNA, 16 nt, Eastern equine encephalitis virus
ugaugccgaacaaggu

SEQ ID NO: 1197659 - RNA, 21 nt, Eastern equine encephalitis virus
ugccaucaccgauucaaaaca

SEQ ID NO: 1197660 - RNA, 13 nt, Eastern equine encephalitis virus
caccaccugccaa

SEQ ID NO: 1197661 - RNA, 17 nt, Eastern equine encephalitis virus
gcuacaacgaccccagg

SEQ ID NO: 1197662 - RNA, 23 nt, Eastern equine encephalitis virus
cagcagcgacuauacaaccaccu

SEQ ID NO: 1197663 - RNA, 12 nt, Eastern equine encephalitis virus
ucauuucaccca

SEQ ID NO: 1197664 - RNA, 17 nt, Eastern equine encephalitis virus
gugcuagagacagacau

SEQ ID NO: 1197665 - RNA, 13 nt, Eastern equine encephalitis virus
gcauaaggcugcu

SEQ ID NO: 1197666 - RNA, 18 nt, Eastern equine encephalitis virus
auaacacuauaggcagug

SEQ ID NO: 1197667 - RNA, 17 nt, Eastern equine encephalitis virus
aguagagaacaugaagg

SEQ ID NO: 1197668 - RNA, 23 nt, Eastern equine encephalitis virus
uagauacugccaccuuuugccca

SEQ ID NO: 1197669 - RNA, 21 nt, Eastern equine encephalitis virus
cgaucucgagcgugagaagcu

SEQ ID NO: 1197670 - RNA, 13 nt, Eastern equine encephalitis virus
aagcgaccaccac

SEQ ID NO: 1197671 - RNA, 18 nt, Eastern equine encephalitis virus
uacauuccacuucuccac

SEQ ID NO: 1197672 - RNA, 20 nt, Eastern equine encephalitis virus
cgcggugcuagagacagaca

SEQ ID NO: 1197673 - RNA, 12 nt, Eastern equine encephalitis virus
gcaugccaugcu

SEQ ID NO: 1197674 - RNA, 24 nt, Eastern equine encephalitis virus
cauaaugcugucuuuuauaucaau

SEQ ID NO: 1197675 - RNA, 17 nt, Eastern equine encephalitis virus
gccuugggcgccgcagc

SEQ ID NO: 1197676 - RNA, 14 nt, Eastern equine encephalitis virus
ugcaugccaugcug

SEQ ID NO: 1197677 - RNA, 15 nt, Eastern equine encephalitis virus
uauacaaccaccugc

SEQ ID NO: 1197678 - RNA, 14 nt, Eastern equine encephalitis virus
acauacugaagaaa

SEQ ID NO: 1197679 - RNA, 20 nt, Eastern equine encephalitis virus
ggaguugaauuaccaugcaa

SEQ ID NO: 1197680 - RNA, 23 nt, Eastern equine encephalitis virus
ccaagauguacuagcagcagcca

SEQ ID NO: 1197681 - RNA, 12 nt, Eastern equine encephalitis virus
agcauauaugac

SEQ ID NO: 1197682 - RNA, 23 nt, Eastern equine encephalitis virus
caggcucuuuuggagaccugcaa

SEQ ID NO: 1197683 - RNA, 18 nt, Eastern equine encephalitis virus
ucacgacgggccuaaccg

SEQ ID NO: 1197684 - RNA, 22 nt, Eastern equine encephalitis virus
gacggcucuaucaguggugaca

SEQ ID NO: 1197685 - RNA, 13 nt, Eastern equine encephalitis virus
cacagugccaagg

SEQ ID NO: 1197686 - RNA, 18 nt, Eastern equine encephalitis virus
ggaguacaucaccugcaa

SEQ ID NO: 1197687 - RNA, 12 nt, Eastern equine encephalitis virus
auuacauccugg

SEQ ID NO: 1197688 - RNA, 13 nt, Eastern equine encephalitis virus
caccaccaccugc

SEQ ID NO: 1197689 - RNA, 17 nt, Eastern equine encephalitis virus
aggcagcgcauaaugcu

SEQ ID NO: 1197690 - RNA, 18 nt, Eastern equine encephalitis virus
caacgaccccaggcuggu

SEQ ID NO: 1197691 - RNA, 21 nt, Eastern equine encephalitis virus
ccaguguuggauucagcugcc

SEQ ID NO: 1197692 - RNA, 20 nt, Eastern equine encephalitis virus
uaaacacauaagaggucacc

SEQ ID NO: 1197693 - RNA, 17 nt, Eastern equine encephalitis virus
agugcauaaugcugcuc

SEQ ID NO: 1197694 - RNA, 15 nt, Eastern equine encephalitis virus
guucggucugaagac

SEQ ID NO: 1197695 - RNA, 14 nt, Eastern equine encephalitis virus
ggccaccacuugca

SEQ ID NO: 1197696 - RNA, 23 nt, Eastern equine encephalitis virus
cgccacgugguugaacauggaag

SEQ ID NO: 1197697 - RNA, 14 nt, Eastern equine encephalitis virus
cuuaccaacaggca

SEQ ID NO: 1197698 - RNA, 21 nt, Eastern equine encephalitis virus
auuucacccaguauaagcugg

SEQ ID NO: 1197699 - RNA, 17 nt, Eastern equine encephalitis virus
aacauggaguugaauua

SEQ ID NO: 1197700 - RNA, 14 nt, Eastern equine encephalitis virus
aggagaaccaggag

SEQ ID NO: 1197701 - RNA, 22 nt, Eastern equine encephalitis virus
ccaaaaagggguuacagucaaa

SEQ ID NO: 1197702 - RNA, 14 nt, Eastern equine encephalitis virus
cggugcgacagccc

SEQ ID NO: 1197703 - RNA, 21 nt, Eastern equine encephalitis virus
cuucaacguagaguguuucaa

SEQ ID NO: 1197704 - RNA, 13 nt, Eastern equine encephalitis virus
gaagagcugguga

SEQ ID NO: 1197705 - RNA, 16 nt, Eastern equine encephalitis virus
gacaagggcaccugca

SEQ ID NO: 1197706 - RNA, 20 nt, Eastern equine encephalitis virus
aucgucgauuauccagcaca

SEQ ID NO: 1197707 - RNA, 20 nt, Eastern equine encephalitis virus
ggacaaaacauacugaagaa

SEQ ID NO: 1197708 - RNA, 14 nt, Eastern equine encephalitis virus
ucagcuauguucgg

SEQ ID NO: 1197709 - RNA, 22 nt, Eastern equine encephalitis virus
aggcucuuuuggagaccugcaa

SEQ ID NO: 1197710 - RNA, 15 nt, Eastern equine encephalitis virus
uuccaucgcuaaccu

SEQ ID NO: 1197711 - RNA, 22 nt, Eastern equine encephalitis virus
caauaaagaucgacaaccugca

SEQ ID NO: 1197712 - RNA, 16 nt, Eastern equine encephalitis virus
cuacaacgaccccagg

SEQ ID NO: 1197713 - RNA, 15 nt, Eastern equine encephalitis virus
gccacgugguugaac

SEQ ID NO: 1197714 - RNA, 23 nt, Eastern equine encephalitis virus
guuacaucugacgcacugauggc

SEQ ID NO: 1197715 - RNA, 22 nt, Eastern equine encephalitis virus
cuccuaaguaauuuaauacaca

SEQ ID NO: 1197716 - RNA, 16 nt, Eastern equine encephalitis virus
ccaagccuaagccugc

SEQ ID NO: 1197717 - RNA, 19 nt, Eastern equine encephalitis virus
caaagauacaccagagggg

SEQ ID NO: 1197718 - RNA, 13 nt, Eastern equine encephalitis virus
cggaagagugcuc

SEQ ID NO: 1197719 - RNA, 12 nt, Eastern equine encephalitis virus
ccggcaaagcag

SEQ ID NO: 1197720 - RNA, 22 nt, Eastern equine encephalitis virus
gcaggagucauccgcauccaga

SEQ ID NO: 1197721 - RNA, 22 nt, Eastern equine encephalitis virus
ggccgccaucaagcugaagaag

SEQ ID NO: 1197722 - RNA, 12 nt, Eastern equine encephalitis virus
gugcguccuggc

SEQ ID NO: 1197723 - RNA, 13 nt, Eastern equine encephalitis virus
aacauacugaaga

SEQ ID NO: 1197724 - RNA, 18 nt, Eastern equine encephalitis virus
cagugguugcccuaguuc

SEQ ID NO: 1197725 - RNA, 12 nt, Eastern equine encephalitis virus
caagcgugcaga

SEQ ID NO: 1197726 - RNA, 13 nt, Eastern equine encephalitis virus
acaaccugcaugu

SEQ ID NO: 1197727 - RNA, 13 nt, Eastern equine encephalitis virus
caacaacugucaa

SEQ ID NO: 1197728 - RNA, 23 nt, Eastern equine encephalitis virus
gcaagaagccugcgccaagccua

SEQ ID NO: 1197729 - RNA, 22 nt, Eastern equine encephalitis virus
cauggaguugaauuaccaugca

SEQ ID NO: 1197730 - RNA, 16 nt, Eastern equine encephalitis virus
gccacaaugcaugaaa

SEQ ID NO: 1197731 - RNA, 20 nt, Eastern equine encephalitis virus
aggagucauccgcauccaga

SEQ ID NO: 1197732 - RNA, 16 nt, Eastern equine encephalitis virus
cuggagaucugcagau

SEQ ID NO: 1197733 - RNA, 15 nt, Eastern equine encephalitis virus
uggaaagggugacag

SEQ ID NO: 1197734 - RNA, 15 nt, Eastern equine encephalitis virus
gcaccuguguggcua

SEQ ID NO: 1197735 - RNA, 12 nt, Eastern equine encephalitis virus
uaaaccuaaacc

SEQ ID NO: 1197736 - RNA, 17 nt, Eastern equine encephalitis virus
gcaaaacgcagaaauca

SEQ ID NO: 1197737 - RNA, 12 nt, Eastern equine encephalitis virus
cuggcucaaugc

SEQ ID NO: 1197738 - RNA, 16 nt, Eastern equine encephalitis virus
cacguagaaggcagaa

SEQ ID NO: 1197739 - RNA, 20 nt, Eastern equine encephalitis virus
cauuccacuucuccacugca

SEQ ID NO: 1197740 - RNA, 23 nt, Eastern equine encephalitis virus
cccauguauucaaguacugcaag

SEQ ID NO: 1197741 - RNA, 16 nt, Eastern equine encephalitis virus
gauauccgccacugcg

SEQ ID NO: 1197742 - RNA, 15 nt, Eastern equine encephalitis virus
ugacgaccaggucac

SEQ ID NO: 1197743 - RNA, 14 nt, Eastern equine encephalitis virus
ccacaagcgugcag

SEQ ID NO: 1197744 - RNA, 12 nt, Eastern equine encephalitis virus
cgacgacaacau

SEQ ID NO: 1197745 - RNA, 21 nt, Eastern equine encephalitis virus
caccugccaagaaacaaaaac

SEQ ID NO: 1197746 - RNA, 14 nt, Eastern equine encephalitis virus
gggacaagggcacc

SEQ ID NO: 1197747 - RNA, 20 nt, Eastern equine encephalitis virus
caagucccaauacuccuggc

SEQ ID NO: 1197748 - RNA, 19 nt, Eastern equine encephalitis virus
gccacaaugcaugaaauca

SEQ ID NO: 1197749 - RNA, 23 nt, Eastern equine encephalitis virus
cugcuguuuagauacugccaccu

SEQ ID NO: 1197750 - RNA, 20 nt, Eastern equine encephalitis virus
ggcuaguugccgaccacucu

SEQ ID NO: 1197751 - RNA, 12 nt, Eastern equine encephalitis virus
gggcaccugcaa

SEQ ID NO: 1197752 - RNA, 22 nt, Eastern equine encephalitis virus
uggaacagaauuacgacagccg

SEQ ID NO: 1197753 - RNA, 14 nt, Eastern equine encephalitis virus
guagaaggcagaau

SEQ ID NO: 1197754 - RNA, 16 nt, Eastern equine encephalitis virus
ccugcaugugcgcacc

SEQ ID NO: 1197755 - RNA, 12 nt, Eastern equine encephalitis virus
cuaaacacuaaa

SEQ ID NO: 1197756 - RNA, 19 nt, Eastern equine encephalitis virus
cugucaugugcguccuggc

SEQ ID NO: 1197757 - RNA, 22 nt, Eastern equine encephalitis virus
cugcauuaagccgacgagggca

SEQ ID NO: 1197758 - RNA, 12 nt, Eastern equine encephalitis virus
uucaaguacugc

SEQ ID NO: 1197759 - RNA, 18 nt, Eastern equine encephalitis virus
gccaccacuugcagcuca

SEQ ID NO: 1197760 - RNA, 22 nt, Eastern equine encephalitis virus
gcgaccaacaacugucaauuuc

SEQ ID NO: 1197761 - RNA, 18 nt, Eastern equine encephalitis virus
guucgauugcccuggagc

SEQ ID NO: 1197762 - RNA, 18 nt, Eastern equine encephalitis virus
cgcauccagacaucagcu

SEQ ID NO: 1197763 - RNA, 22 nt, Eastern equine encephalitis virus
cucuccuuagcauccacagugc

SEQ ID NO: 1197764 - RNA, 13 nt, Eastern equine encephalitis virus
auuguaugcaugc

SEQ ID NO: 1197765 - RNA, 23 nt, Eastern equine encephalitis virus
ccacauaacacuauaggcagugu

SEQ ID NO: 1197766 - RNA, 20 nt, Eastern equine encephalitis virus
accauguuggaacagaauua

SEQ ID NO: 1197767 - RNA, 15 nt, Eastern equine encephalitis virus
aacgaugaguacugg

SEQ ID NO: 1197768 - RNA, 14 nt, Eastern equine encephalitis virus
uccaguagugaaau

SEQ ID NO: 1197769 - RNA, 20 nt, Eastern equine encephalitis virus
uggagcuguacaguaugaga

SEQ ID NO: 1197770 - RNA, 15 nt, Eastern equine encephalitis virus
uccaucgcuaaccug

SEQ ID NO: 1197771 - RNA, 13 nt, Eastern equine encephalitis virus
ugaaaacacccag

SEQ ID NO: 1197772 - RNA, 18 nt, Eastern equine encephalitis virus
gccgagccuaugaucagc

SEQ ID NO: 1197773 - RNA, 14 nt, Eastern equine encephalitis virus
caagggcaccugca

SEQ ID NO: 1197774 - RNA, 22 nt, Eastern equine encephalitis virus
gcaacuuuaaacacauaagagg

SEQ ID NO: 1197775 - RNA, 16 nt, Eastern equine encephalitis virus
cgcaaucuuugcauaa

SEQ ID NO: 1197776 - RNA, 16 nt, Eastern equine encephalitis virus
ggauggccgcacgaag

SEQ ID NO: 1197777 - RNA, 17 nt, Eastern equine encephalitis virus
gccgacccccugaagag

SEQ ID NO: 1197778 - RNA, 21 nt, Eastern equine encephalitis virus
caugaaaucagauacccucca

SEQ ID NO: 1197779 - RNA, 19 nt, Eastern equine encephalitis virus
ucagcauuuaucguucugg

SEQ ID NO: 1197780 - RNA, 20 nt, Eastern equine encephalitis virus
ccaguguuggauucagcugc

SEQ ID NO: 1197781 - RNA, 14 nt, Eastern equine encephalitis virus
ggaguauaccuggg

SEQ ID NO: 1197782 - RNA, 15 nt, Eastern equine encephalitis virus
cgccgaugcagugca

SEQ ID NO: 1197783 - RNA, 23 nt, Eastern equine encephalitis virus
cccgccaaacgcaagaagccugc

SEQ ID NO: 1197784 - RNA, 17 nt, Eastern equine encephalitis virus
gaccaccaccaccugcc

SEQ ID NO: 1197785 - RNA, 12 nt, Eastern equine encephalitis virus
aaagcagcugcc

SEQ ID NO: 1197786 - RNA, 16 nt, Eastern equine encephalitis virus
agauacgaucagcagu

SEQ ID NO: 1197787 - RNA, 15 nt, Eastern equine encephalitis virus
caucagguguugcag

SEQ ID NO: 1197788 - RNA, 15 nt, Eastern equine encephalitis virus
ggcaucacugaagag

SEQ ID NO: 1197789 - RNA, 21 nt, Eastern equine encephalitis virus
acacgaaacacucaccauguu

SEQ ID NO: 1197790 - RNA, 21 nt, Eastern equine encephalitis virus
cgugagaagcuguugcagaag

SEQ ID NO: 1197791 - RNA, 14 nt, Eastern equine encephalitis virus
gaaagggugacagc

SEQ ID NO: 1197792 - RNA, 14 nt, Eastern equine encephalitis virus
aacacacagcagug

SEQ ID NO: 1197793 - RNA, 21 nt, Eastern equine encephalitis virus
cgagccuaugaucagcugcuc

SEQ ID NO: 1197794 - RNA, 24 nt, Eastern equine encephalitis virus
uugacaugguggacggagcauccu

SEQ ID NO: 1197795 - RNA, 23 nt, Eastern equine encephalitis virus
uaaagggacccaaagcagcugcc

SEQ ID NO: 1197796 - RNA, 23 nt, Eastern equine encephalitis virus
aaacuguccaauucauucuccau

SEQ ID NO: 1197797 - RNA, 14 nt, Eastern equine encephalitis virus
cugacuuugaaaca

SEQ ID NO: 1197798 - RNA, 17 nt, Eastern equine encephalitis virus
gccaagccuaagccugc

SEQ ID NO: 1197799 - RNA, 21 nt, Eastern equine encephalitis virus
gcagugguugcccuaguucug

SEQ ID NO: 1197800 - RNA, 16 nt, Eastern equine encephalitis virus
caacucuggaagacug

SEQ ID NO: 1197801 - RNA, 16 nt, Eastern equine encephalitis virus
ucaaccacccugcaug

SEQ ID NO: 1197802 - RNA, 20 nt, Eastern equine encephalitis virus
cagaaaauugugcaguggga

SEQ ID NO: 1197803 - RNA, 15 nt, Eastern equine encephalitis virus
caacuaaccuggagu

SEQ ID NO: 1197804 - RNA, 23 nt, Eastern equine encephalitis virus
uuccaguguuggauucagcugcc

SEQ ID NO: 1197805 - RNA, 20 nt, Eastern equine encephalitis virus
gugcacuuaccaacaggcac

SEQ ID NO: 1197806 - RNA, 16 nt, Eastern equine encephalitis virus
cagugcauaaggcugc

SEQ ID NO: 1197807 - RNA, 22 nt, Eastern equine encephalitis virus
auaacuggcaccauggagcugu

SEQ ID NO: 1197808 - RNA, 15 nt, Eastern equine encephalitis virus
accuaguacugcaag

SEQ ID NO: 1197809 - RNA, 16 nt, Eastern equine encephalitis virus
acgcuuaucccacuug

SEQ ID NO: 1197810 - RNA, 14 nt, Eastern equine encephalitis virus
gguggacggagcau

SEQ ID NO: 1197811 - RNA, 17 nt, Eastern equine encephalitis virus
gccuccuauaaacacua

SEQ ID NO: 1197812 - RNA, 18 nt, Eastern equine encephalitis virus
ugcacccguucaccuaca

SEQ ID NO: 1197813 - RNA, 18 nt, Eastern equine encephalitis virus
cuugucaaccacauaaca

SEQ ID NO: 1197814 - RNA, 18 nt, Eastern equine encephalitis virus
cauaucucucugcagaac

SEQ ID NO: 1197815 - RNA, 13 nt, Eastern equine encephalitis virus
cgacaaccugcau

SEQ ID NO: 1197816 - RNA, 20 nt, Eastern equine encephalitis virus
uaccuccaaaccccauccug

SEQ ID NO: 1197817 - RNA, 16 nt, Eastern equine encephalitis virus
acccgaccuugcugac

SEQ ID NO: 1197818 - RNA, 15 nt, Eastern equine encephalitis virus
uaauuuuucuuuuau

SEQ ID NO: 1197819 - RNA, 22 nt, Eastern equine encephalitis virus
caagugcugaauuaccugugga

SEQ ID NO: 1197820 - RNA, 18 nt, Eastern equine encephalitis virus
gccaucaagcugaagaag

SEQ ID NO: 1197821 - RNA, 16 nt, Eastern equine encephalitis virus
ggcaaagcaggcucuu

SEQ ID NO: 1197822 - RNA, 17 nt, Eastern equine encephalitis virus
aaacacauaagagguca

SEQ ID NO: 1197823 - RNA, 17 nt, Eastern equine encephalitis virus
guagagcgcucggaaga

SEQ ID NO: 1197824 - RNA, 21 nt, Eastern equine encephalitis virus
gccagcuauaacauaacggau

SEQ ID NO: 1197825 - RNA, 22 nt, Eastern equine encephalitis virus
gaucaaccacccugcaugccau

SEQ ID NO: 1197826 - RNA, 23 nt, Eastern equine encephalitis virus
gcagcucaaauugaggaccugag

SEQ ID NO: 1197827 - RNA, 17 nt, Eastern equine encephalitis virus
cgagacgggacaagggc

SEQ ID NO: 1197828 - RNA, 18 nt, Eastern equine encephalitis virus
gcaaccguuacacccaca

SEQ ID NO: 1197829 - RNA, 16 nt, Eastern equine encephalitis virus
guacuagcagcagcca

SEQ ID NO: 1197830 - RNA, 13 nt, Eastern equine encephalitis virus
caggccagugggu

SEQ ID NO: 1197831 - RNA, 19 nt, Eastern equine encephalitis virus
ggaccgcccgccaaacgca

SEQ ID NO: 1197832 - RNA, 20 nt, Eastern equine encephalitis virus
cgauugcccuggagccgcuc

SEQ ID NO: 1197833 - RNA, 20 nt, Eastern equine encephalitis virus
agcuauguucggucugaaga

SEQ ID NO: 1197834 - RNA, 18 nt, Eastern equine encephalitis virus
aaacguuuccaaucaugu

SEQ ID NO: 1197835 - RNA, 16 nt, Eastern equine encephalitis virus
acgaaggauccaggac

SEQ ID NO: 1197836 - RNA, 20 nt, Eastern equine encephalitis virus
cauccuggcucaaugcccac

SEQ ID NO: 1197837 - RNA, 19 nt, Eastern equine encephalitis virus
acccguucaccuacagaua

SEQ ID NO: 1197838 - RNA, 17 nt, Eastern equine encephalitis virus
cacccaccugaacaugg

SEQ ID NO: 1197839 - RNA, 17 nt, Eastern equine encephalitis virus
gacggcucuaucagugg

SEQ ID NO: 1197840 - RNA, 15 nt, Eastern equine encephalitis virus
gagaaccaggagaga

SEQ ID NO: 1197841 - RNA, 18 nt, Eastern equine encephalitis virus
gaugccuaucuugacaug

SEQ ID NO: 1197842 - RNA, 17 nt, Eastern equine encephalitis virus
uguacuagcagcagcca

SEQ ID NO: 1197843 - RNA, 16 nt, Eastern equine encephalitis virus
agcgugcagaccaagg

SEQ ID NO: 1197844 - RNA, 19 nt, Eastern equine encephalitis virus
gacacucauuucacccagu

SEQ ID NO: 1197845 - RNA, 23 nt, Eastern equine encephalitis virus
cauggucgcuugccacugucaug

SEQ ID NO: 1197846 - RNA, 21 nt, Eastern equine encephalitis virus
gcagugaugccgaacaaggug

SEQ ID NO: 1197847 - RNA, 20 nt, Eastern equine encephalitis virus
ucacccuaguucgauguacu

SEQ ID NO: 1197848 - RNA, 16 nt, Eastern equine encephalitis virus
cugaagaaagaccaaa

SEQ ID NO: 1197849 - RNA, 16 nt, Eastern equine encephalitis virus
augcuguuaugaaaag

SEQ ID NO: 1197850 - RNA, 21 nt, Eastern equine encephalitis virus
ccucuaguugagcacaaacac

SEQ ID NO: 1197851 - RNA, 17 nt, Eastern equine encephalitis virus
gugauacaggcagcuga

SEQ ID NO: 1197852 - RNA, 22 nt, Eastern equine encephalitis virus
gccgagccuaugaucagcugcu

SEQ ID NO: 1197853 - RNA, 19 nt, Eastern equine encephalitis virus
cagaggggucagagccaug

SEQ ID NO: 1197854 - RNA, 23 nt, Eastern equine encephalitis virus
uagguccacugucaucugcgugg

SEQ ID NO: 1197855 - RNA, 21 nt, Eastern equine encephalitis virus
uauaccgccuccuauaaacac

SEQ ID NO: 1197856 - RNA, 14 nt, Eastern equine encephalitis virus
gacacgguuacagu

SEQ ID NO: 1197857 - RNA, 13 nt, Eastern equine encephalitis virus
uauuacuacaaca

SEQ ID NO: 1197858 - RNA, 12 nt, Eastern equine encephalitis virus
uccacacuuugu

SEQ ID NO: 1197859 - RNA, 19 nt, Eastern equine encephalitis virus
guauucaaguacugcaagc

SEQ ID NO: 1197860 - RNA, 20 nt, Eastern equine encephalitis virus
gaaaacgcauaacuuacagc

SEQ ID NO: 1197861 - RNA, 17 nt, Eastern equine encephalitis virus
gguucaugggcaugaag

SEQ ID NO: 1197862 - RNA, 22 nt, Eastern equine encephalitis virus
guuaaggccaagugcaucgcca

SEQ ID NO: 1197863 - RNA, 20 nt, Eastern equine encephalitis virus
gagaaauaccgucacccacc

SEQ ID NO: 1197864 - RNA, 22 nt, Eastern equine encephalitis virus
acaggcgcagagcucugcauga

SEQ ID NO: 1197865 - RNA, 19 nt, Eastern equine encephalitis virus
acccuccaguacaccagug

SEQ ID NO: 1197866 - RNA, 12 nt, Eastern equine encephalitis virus
ccaccaccugcc

SEQ ID NO: 1197867 - RNA, 22 nt, Eastern equine encephalitis virus
aaucacgcacaucaaccagcaa

SEQ ID NO: 1197868 - RNA, 15 nt, Eastern equine encephalitis virus
gccgaugcagugcau

SEQ ID NO: 1197869 - RNA, 24 nt, Eastern equine encephalitis virus
cacggcuauuacauccuggcucaa

SEQ ID NO: 1197870 - RNA, 21 nt, Eastern equine encephalitis virus
cagacgcuuaucccacuugca

SEQ ID NO: 1197871 - RNA, 19 nt, Eastern equine encephalitis virus
ggcagaugacaccuugcaa

SEQ ID NO: 1197872 - RNA, 23 nt, Eastern equine encephalitis virus
cuuaccugauugacaacaaaaaa

SEQ ID NO: 1197873 - RNA, 21 nt, Eastern equine encephalitis virus
acuuacagccauugcaugaga

SEQ ID NO: 1197874 - RNA, 21 nt, Eastern equine encephalitis virus
aggggaugcgcacgcaggagu

SEQ ID NO: 1197875 - RNA, 16 nt, Eastern equine encephalitis virus
aggugauacaggcagc

SEQ ID NO: 1197876 - RNA, 22 nt, Eastern equine encephalitis virus
cacuaaauucacccuaguucga

SEQ ID NO: 1197877 - RNA, 16 nt, Eastern equine encephalitis virus
cugcaaguauaagaca

SEQ ID NO: 1197878 - RNA, 19 nt, Eastern equine encephalitis virus
cuggaagacugccucgagg

SEQ ID NO: 1197879 - RNA, 20 nt, Eastern equine encephalitis virus
agcugguuaauaccaggaua

SEQ ID NO: 1197880 - RNA, 20 nt, Eastern equine encephalitis virus
uggaguugaauuaccaugca

SEQ ID NO: 1197881 - RNA, 17 nt, Eastern equine encephalitis virus
cacugaaaacacccaga

SEQ ID NO: 1197882 - RNA, 21 nt, Eastern equine encephalitis virus
guuuccaugugaucaaccacc

SEQ ID NO: 1197883 - RNA, 16 nt, Eastern equine encephalitis virus
ccacacuuuguuugac

SEQ ID NO: 1197884 - RNA, 20 nt, Eastern equine encephalitis virus
cucuggaagacugccucgag

SEQ ID NO: 1197885 - RNA, 21 nt, Eastern equine encephalitis virus
cacaggcacuguucaggcaau

SEQ ID NO: 1197886 - RNA, 18 nt, Eastern equine encephalitis virus
gggaugcgcacgcaggag

SEQ ID NO: 1197887 - RNA, 20 nt, Eastern equine encephalitis virus
auauacaauuacacuacagg

SEQ ID NO: 1197888 - RNA, 16 nt, Eastern equine encephalitis virus
agcucugcaugaugaa

SEQ ID NO: 1197889 - RNA, 16 nt, Eastern equine encephalitis virus
cgucacucuugcugag

SEQ ID NO: 1197890 - RNA, 19 nt, Eastern equine encephalitis virus
ggacacucauuucacccag

SEQ ID NO: 1197891 - RNA, 16 nt, Eastern equine encephalitis virus
agacggauggaguuga

SEQ ID NO: 1197892 - RNA, 12 nt, Eastern equine encephalitis virus
cuggggaaacca

SEQ ID NO: 1197893 - RNA, 19 nt, Eastern equine encephalitis virus
aggcucuuuuggagaccug

SEQ ID NO: 1197894 - RNA, 14 nt, Eastern equine encephalitis virus
cagcacaacauacu

SEQ ID NO: 1197895 - RNA, 16 nt, Eastern equine encephalitis virus
cuaggagaaccaggag

SEQ ID NO: 1197896 - RNA, 15 nt, Eastern equine encephalitis virus
cuccaguagugaaau

SEQ ID NO: 1197897 - RNA, 20 nt, Eastern equine encephalitis virus
aguuugcaaccuaguacugc

SEQ ID NO: 1197898 - RNA, 21 nt, Eastern equine encephalitis virus
acaagcgugcagaccaaggac

SEQ ID NO: 1197899 - RNA, 14 nt, Eastern equine encephalitis virus
agacaucagcuaug

SEQ ID NO: 1197900 - RNA, 14 nt, Eastern equine encephalitis virus
gacccaaagcagcu

SEQ ID NO: 1197901 - RNA, 21 nt, Eastern equine encephalitis virus
uccuggcucaaugcccaccag

SEQ ID NO: 1197902 - RNA, 15 nt, Eastern equine encephalitis virus
auccgcauccagaca

SEQ ID NO: 1197903 - RNA, 22 nt, Eastern equine encephalitis virus
ggcauagucggugcgacagccc

SEQ ID NO: 1197904 - RNA, 20 nt, Eastern equine encephalitis virus
ggcgcagagcucugcaugau

SEQ ID NO: 1197905 - RNA, 21 nt, Eastern equine encephalitis virus
uggacacucauuucacccagu

SEQ ID NO: 1197906 - RNA, 15 nt, Eastern equine encephalitis virus
acuacaggcagcgca

SEQ ID NO: 1197907 - RNA, 19 nt, Eastern equine encephalitis virus
ggcgauauccgccacugcg

SEQ ID NO: 1197908 - RNA, 21 nt, Eastern equine encephalitis virus
ggagcuguacaguaugagaac

SEQ ID NO: 1197909 - RNA, 15 nt, Eastern equine encephalitis virus
cacuguucaggcaau

SEQ ID NO: 1197910 - RNA, 21 nt, Eastern equine encephalitis virus
ccauggucgcuugccacuguc

SEQ ID NO: 1197911 - RNA, 19 nt, Eastern equine encephalitis virus
accauggagcuguacagua

SEQ ID NO: 1197912 - RNA, 19 nt, Eastern equine encephalitis virus
aggcaaacgacagcgaaug

SEQ ID NO: 1197913 - RNA, 16 nt, Eastern equine encephalitis virus
guacaacucuggaaga

SEQ ID NO: 1197914 - RNA, 16 nt, Eastern equine encephalitis virus
agcauccacagugcca

SEQ ID NO: 1197915 - RNA, 13 nt, Eastern equine encephalitis virus
ucaagcugaagaa

SEQ ID NO: 1197916 - RNA, 16 nt, Eastern equine encephalitis virus
gccgccgaugcagugc

SEQ ID NO: 1197917 - RNA, 19 nt, Eastern equine encephalitis virus
cagaaaauugugcaguggg

SEQ ID NO: 1197918 - RNA, 20 nt, Eastern equine encephalitis virus
cacuagugcaguuaccugca

SEQ ID NO: 1197919 - RNA, 19 nt, Eastern equine encephalitis virus
ugcacacaccuuucaccca

SEQ ID NO: 1197920 - RNA, 17 nt, Eastern equine encephalitis virus
caccugcaaguauaaga

SEQ ID NO: 1197921 - RNA, 17 nt, Eastern equine encephalitis virus
gccaaacgcaagaagcc

SEQ ID NO: 1197922 - RNA, 19 nt, Eastern equine encephalitis virus
caggcugguaucgugcaca

SEQ ID NO: 1197923 - RNA, 20 nt, Eastern equine encephalitis virus
ccuuagcauccacagugcca

SEQ ID NO: 1197924 - RNA, 14 nt, Eastern equine encephalitis virus
aacgaccccaggcu

SEQ ID NO: 1197925 - RNA, 16 nt, Eastern equine encephalitis virus
guguucaaaccgcugc

SEQ ID NO: 1197926 - RNA, 16 nt, Eastern equine encephalitis virus
gaccugagacguucca

SEQ ID NO: 1197927 - RNA, 22 nt, Eastern equine encephalitis virus
cauaacgccgccgaugcagugc

SEQ ID NO: 1197928 - RNA, 15 nt, Eastern equine encephalitis virus
uccuuagcauccaca

SEQ ID NO: 1197929 - RNA, 17 nt, Eastern equine encephalitis virus
caucuugucaaccacau

SEQ ID NO: 1197930 - RNA, 12 nt, Eastern equine encephalitis virus
gccgcugugaaa

SEQ ID NO: 1197931 - RNA, 20 nt, Eastern equine encephalitis virus
cuaaccuggaguacaucacc

SEQ ID NO: 1197932 - RNA, 14 nt, Eastern equine encephalitis virus
cagucucagaccug

SEQ ID NO: 1197933 - RNA, 22 nt, Eastern equine encephalitis virus
uagagagaaauaccgucaccca

SEQ ID NO: 1197934 - RNA, 12 nt, Eastern equine encephalitis virus
aacaucugugca

SEQ ID NO: 1197935 - RNA, 19 nt, Eastern equine encephalitis virus
ccuccaguacaccagugac

SEQ ID NO: 1197936 - RNA, 16 nt, Eastern equine encephalitis virus
uggugacauggaacca

SEQ ID NO: 1197937 - RNA, 16 nt, Eastern equine encephalitis virus
augccgaacaaggugg

SEQ ID NO: 1197938 - RNA, 15 nt, Eastern equine encephalitis virus
gacagccgagccuau

SEQ ID NO: 1197939 - RNA, 15 nt, Eastern equine encephalitis virus
ugaaagggguuacau

SEQ ID NO: 1197940 - RNA, 15 nt, Eastern equine encephalitis virus
cuuuccaaagaagca

SEQ ID NO: 1197941 - RNA, 23 nt, Eastern equine encephalitis virus
cacgugguugaacauggaaguga

SEQ ID NO: 1197942 - RNA, 12 nt, Eastern equine encephalitis virus
caaccaccugca

SEQ ID NO: 1197943 - RNA, 19 nt, Eastern equine encephalitis virus
gcauagucggugcgacagc

SEQ ID NO: 1197944 - RNA, 18 nt, Eastern equine encephalitis virus
auaggcaguguauaaggc

SEQ ID NO: 1197945 - RNA, 13 nt, Eastern equine encephalitis virus
caagccuccuggc

SEQ ID NO: 1197946 - RNA, 12 nt, Eastern equine encephalitis virus
agcucugcauga

SEQ ID NO: 1197947 - RNA, 22 nt, Eastern equine encephalitis virus
uaccagcagcgacuauacaacc

SEQ ID NO: 1197948 - RNA, 13 nt, Eastern equine encephalitis virus
cuccacugcaaac

SEQ ID NO: 1197949 - RNA, 22 nt, Eastern equine encephalitis virus
acccaccugaacauggaguuga

SEQ ID NO: 1197950 - RNA, 21 nt, Eastern equine encephalitis virus
uaccuauccugcucccaugua

SEQ ID NO: 1197951 - RNA, 18 nt, Eastern equine encephalitis virus
cugucuuacuaaacacua

SEQ ID NO: 1197952 - RNA, 16 nt, Eastern equine encephalitis virus
gagucauccgcaucca

SEQ ID NO: 1197953 - RNA, 17 nt, Eastern equine encephalitis virus
cuccuuagcauccacag

SEQ ID NO: 1197954 - RNA, 18 nt, Eastern equine encephalitis virus
agaaauaccgucacccac

SEQ ID NO: 1197955 - RNA, 17 nt, Eastern equine encephalitis virus
aggaguugaucaggcau

SEQ ID NO: 1197956 - RNA, 18 nt, Eastern equine encephalitis virus
acgggccuaaccgccaua

SEQ ID NO: 1197957 - RNA, 22 nt, Eastern equine encephalitis virus
aauugccgcauauacaauuaca

SEQ ID NO: 1197958 - RNA, 20 nt, Eastern equine encephalitis virus
gacgcacugauggcagagcg

SEQ ID NO: 1197959 - RNA, 21 nt, Eastern equine encephalitis virus
uaccaggauaauuccaucaac

SEQ ID NO: 1197960 - RNA, 23 nt, Eastern equine encephalitis virus
aguggccgucaaaguuugcaacc

SEQ ID NO: 1197961 - RNA, 13 nt, Eastern equine encephalitis virus
uacaucaccugca

SEQ ID NO: 1197962 - RNA, 15 nt, Eastern equine encephalitis virus
agugcauaaggcugc

SEQ ID NO: 1197963 - RNA, 21 nt, Eastern equine encephalitis virus
gcggugcuagagacagacaua

SEQ ID NO: 1197964 - RNA, 14 nt, Eastern equine encephalitis virus
acccuccagcagga

SEQ ID NO: 1197965 - RNA, 12 nt, Eastern equine encephalitis virus
agggcagugcau

SEQ ID NO: 1197966 - RNA, 20 nt, Eastern equine encephalitis virus
aaaguucaggugauacaggc

SEQ ID NO: 1197967 - RNA, 20 nt, Eastern equine encephalitis virus
cuuccacuggacgaugacca

SEQ ID NO: 1197968 - RNA, 19 nt, Eastern equine encephalitis virus
aguguuggauucagcugcc

SEQ ID NO: 1197969 - RNA, 17 nt, Eastern equine encephalitis virus
caccacuugcagcucaa

SEQ ID NO: 1197970 - RNA, 16 nt, Eastern equine encephalitis virus
agccuaugaucagcug

SEQ ID NO: 1197971 - RNA, 17 nt, Eastern equine encephalitis virus
ucacagucaccggagaa

SEQ ID NO: 1197972 - RNA, 17 nt, Eastern equine encephalitis virus
acuaagggcagugcaua

SEQ ID NO: 1197973 - RNA, 18 nt, Eastern equine encephalitis virus
acaccuuucacccaggcg

SEQ ID NO: 1197974 - RNA, 17 nt, Eastern equine encephalitis virus
acacgaaacacucacca

SEQ ID NO: 1197975 - RNA, 23 nt, Eastern equine encephalitis virus
gugcugcuaccgaauauccacac

SEQ ID NO: 1197976 - RNA, 15 nt, Eastern equine encephalitis virus
gaguaugaugccuau

SEQ ID NO: 1197977 - RNA, 16 nt, Eastern equine encephalitis virus
cauccgagacgggaca

SEQ ID NO: 1197978 - RNA, 13 nt, Eastern equine encephalitis virus
cgaaggauccagg

SEQ ID NO: 1197979 - RNA, 14 nt, Eastern equine encephalitis virus
acgaugaguacugg

SEQ ID NO: 1197980 - RNA, 21 nt, Eastern equine encephalitis virus
acaggcgcagagcucugcaug

SEQ ID NO: 1197981 - RNA, 19 nt, Eastern equine encephalitis virus
caguggugacauggaacca

SEQ ID NO: 1197982 - RNA, 12 nt, Eastern equine encephalitis virus
uguaagccaccg

SEQ ID NO: 1197983 - RNA, 21 nt, Eastern equine encephalitis virus
gcugcacguagaaggcagaau

SEQ ID NO: 1197984 - RNA, 13 nt, Eastern equine encephalitis virus
ccaccacuugcag

SEQ ID NO: 1197985 - RNA, 21 nt, Eastern equine encephalitis virus
ggacggcucuaucagugguga

SEQ ID NO: 1197986 - RNA, 15 nt, Eastern equine encephalitis virus
cacuucuccacugca

SEQ ID NO: 1197987 - RNA, 17 nt, Eastern equine encephalitis virus
ggacccaaagcagcugc

SEQ ID NO: 1197988 - RNA, 17 nt, Eastern equine encephalitis virus
cagaggggucagagcca

SEQ ID NO: 1197989 - RNA, 20 nt, Eastern equine encephalitis virus
ugccacaaugcaugaaauca

SEQ ID NO: 1197990 - RNA, 15 nt, Eastern equine encephalitis virus
cagguguugcaguua

SEQ ID NO: 1197991 - RNA, 13 nt, Eastern equine encephalitis virus
acccugcaugcca

SEQ ID NO: 1197992 - RNA, 13 nt, Eastern equine encephalitis virus
acaaugcaugaaa

SEQ ID NO: 1197993 - RNA, 19 nt, Eastern equine encephalitis virus
aagaauccacacgaaacac

SEQ ID NO: 1197994 - RNA, 24 nt, Eastern equine encephalitis virus
cuugcugagagcggaucauuuaca

SEQ ID NO: 1197995 - RNA, 17 nt, Eastern equine encephalitis virus
uggcaucacugaagagc

SEQ ID NO: 1197996 - RNA, 23 nt, Eastern equine encephalitis virus
ggggcuuauugcuacagcagugg

SEQ ID NO: 1197997 - RNA, 15 nt, Eastern equine encephalitis virus
ugcugacgaccaggu

SEQ ID NO: 1197998 - RNA, 19 nt, Eastern equine encephalitis virus
caaguauaagacaaaagug

SEQ ID NO: 1197999 - RNA, 22 nt, Eastern equine encephalitis virus
caggcagcugauccacuugcaa

SEQ ID NO: 1198000 - RNA, 20 nt, Eastern equine encephalitis virus
ugaccaagacgucgacaggc

SEQ ID NO: 1198001 - RNA, 22 nt, Eastern equine encephalitis virus
ccacaucgucgauuauccagca

SEQ ID NO: 1198002 - RNA, 17 nt, Eastern equine encephalitis virus
auguauucaaguacugc

SEQ ID NO: 1198003 - RNA, 16 nt, Eastern equine encephalitis virus
uuauuuugcugugggc

SEQ ID NO: 1198004 - RNA, 23 nt, Eastern equine encephalitis virus
acaccagugacaagccuccuggc

SEQ ID NO: 1198005 - RNA, 14 nt, Eastern equine encephalitis virus
gaacaugaaggcaa

SEQ ID NO: 1198006 - RNA, 19 nt, Eastern equine encephalitis virus
agggacccaaagcagcugc

SEQ ID NO: 1198007 - RNA, 15 nt, Eastern equine encephalitis virus
uccgccacugcgugg

SEQ ID NO: 1198008 - RNA, 19 nt, Eastern equine encephalitis virus
ggcaucacugaagagcugg

SEQ ID NO: 1198009 - RNA, 14 nt, Eastern equine encephalitis virus
cguauauugcugau

SEQ ID NO: 1198010 - RNA, 13 nt, Eastern equine encephalitis virus
gaucgacaaccug

SEQ ID NO: 1198011 - RNA, 13 nt, Eastern equine encephalitis virus
gcaguguauaagg

SEQ ID NO: 1198012 - RNA, 20 nt, Eastern equine encephalitis virus
cuucugcgacacugaaaaca

SEQ ID NO: 1198013 - RNA, 12 nt, Eastern equine encephalitis virus
gaaugguuacgc

SEQ ID NO: 1198014 - RNA, 21 nt, Eastern equine encephalitis virus
cugagauacgaucagcagugc

SEQ ID NO: 1198015 - RNA, 21 nt, Eastern equine encephalitis virus
gcuaggagaaccaggagagau

SEQ ID NO: 1198016 - RNA, 21 nt, Eastern equine encephalitis virus
gcagcgacuauacaaccaccu

SEQ ID NO: 1198017 - RNA, 16 nt, Eastern equine encephalitis virus
gcaugcugcgcugcuu

SEQ ID NO: 1198018 - RNA, 13 nt, Eastern equine encephalitis virus
gcucuaucagugg

SEQ ID NO: 1198019 - RNA, 21 nt, Eastern equine encephalitis virus
auggcgccgauuaacccgaug

SEQ ID NO: 1198020 - RNA, 14 nt, Eastern equine encephalitis virus
accuuucacccagg

SEQ ID NO: 1198021 - RNA, 20 nt, Eastern equine encephalitis virus
agcgucagcuggagaucugc

SEQ ID NO: 1198022 - RNA, 16 nt, Eastern equine encephalitis virus
cagagcucugcaugau

SEQ ID NO: 1198023 - RNA, 20 nt, Eastern equine encephalitis virus
cacuaaauucacccuaguuc

SEQ ID NO: 1198024 - RNA, 20 nt, Eastern equine encephalitis virus
ucaagcugaagaaggccagc

SEQ ID NO: 1198025 - RNA, 18 nt, Eastern equine encephalitis virus
acaacgagcaccuaaccc

SEQ ID NO: 1198026 - RNA, 14 nt, Eastern equine encephalitis virus
acgagggcagauga

SEQ ID NO: 1198027 - RNA, 16 nt, Eastern equine encephalitis virus
gaaaauugugcagugg

SEQ ID NO: 1198028 - RNA, 13 nt, Eastern equine encephalitis virus
aauuuuucuuuua

SEQ ID NO: 1198029 - RNA, 17 nt, Eastern equine encephalitis virus
gaaauacuacugcaagu

SEQ ID NO: 1198030 - RNA, 21 nt, Eastern equine encephalitis virus
auacaccagaggggucagagc

SEQ ID NO: 1198031 - RNA, 17 nt, Eastern equine encephalitis virus
cugauugacaacaaaaa

SEQ ID NO: 1198032 - RNA, 14 nt, Eastern equine encephalitis virus
acauaacacuauag

SEQ ID NO: 1198033 - RNA, 22 nt, Eastern equine encephalitis virus
gcaucgccacgcuggcaccaga

SEQ ID NO: 1198034 - RNA, 23 nt, Eastern equine encephalitis virus
uuauaacacuaagggcagugcau

SEQ ID NO: 1198035 - RNA, 17 nt, Eastern equine encephalitis virus
cacauuagcaucuucag

SEQ ID NO: 1198036 - RNA, 23 nt, Eastern equine encephalitis virus
agguagaauucaggccagugggu

SEQ ID NO: 1198037 - RNA, 16 nt, Eastern equine encephalitis virus
uaccugcaaaggagau

SEQ ID NO: 1198038 - RNA, 18 nt, Eastern equine encephalitis virus
ccugaagagacuguuuaa

SEQ ID NO: 1198039 - RNA, 17 nt, Eastern equine encephalitis virus
caaagauacaccagagg

SEQ ID NO: 1198040 - RNA, 23 nt, Eastern equine encephalitis virus
gcacugauggcagagcggugcgc

SEQ ID NO: 1198041 - RNA, 12 nt, Eastern equine encephalitis virus
agaacaugaagg

SEQ ID NO: 1198042 - RNA, 15 nt, Eastern equine encephalitis virus
gcuggcaccagagcc

SEQ ID NO: 1198043 - RNA, 13 nt, Eastern equine encephalitis virus
cuugccacuguca

SEQ ID NO: 1198044 - RNA, 23 nt, Eastern equine encephalitis virus
gcuguuaugaaaagaauccacac

SEQ ID NO: 1198045 - RNA, 23 nt, Eastern equine encephalitis virus
gccucgaucucgagcgugagaag

SEQ ID NO: 1198046 - RNA, 17 nt, Eastern equine encephalitis virus
ggcuauuacauccuggc

SEQ ID NO: 1198047 - RNA, 18 nt, Eastern equine encephalitis virus
ggaaagggugacagcggg

SEQ ID NO: 1198048 - RNA, 16 nt, Eastern equine encephalitis virus
auuuaauacacacuuu

SEQ ID NO: 1198049 - RNA, 16 nt, Eastern equine encephalitis virus
aacacgcuccaagaug

SEQ ID NO: 1198050 - RNA, 12 nt, Eastern equine encephalitis virus
ccacugcguggu

SEQ ID NO: 1198051 - RNA, 21 nt, Eastern equine encephalitis virus
cacccacaagcgugcagacca

SEQ ID NO: 1198052 - RNA, 21 nt, Eastern equine encephalitis virus
acguuggaacagaauuggcau

SEQ ID NO: 1198053 - RNA, 15 nt, Eastern equine encephalitis virus
cagagcggugcgcca

SEQ ID NO: 1198054 - RNA, 20 nt, Eastern equine encephalitis virus
agcguugaccacauuagcau

SEQ ID NO: 1198055 - RNA, 17 nt, Eastern equine encephalitis virus
agguugugcauuaguau

SEQ ID NO: 1198056 - RNA, 19 nt, Eastern equine encephalitis virus
cucuccuuagcauccacag

SEQ ID NO: 1198057 - RNA, 20 nt, Eastern equine encephalitis virus
cugcuaccgaauauccacac

SEQ ID NO: 1198058 - RNA, 22 nt, Eastern equine encephalitis virus
cuguuaugaaaagaauccacac

SEQ ID NO: 1198059 - RNA, 19 nt, Eastern equine encephalitis virus
ccgaccuugcugacgacca

SEQ ID NO: 1198060 - RNA, 23 nt, Eastern equine encephalitis virus
cucgacaauggauugagcgacca

SEQ ID NO: 1198061 - RNA, 19 nt, Eastern equine encephalitis virus
ccuauggcgccgauuaacc

SEQ ID NO: 1198062 - RNA, 18 nt, Eastern equine encephalitis virus
gugguauacaucgagagc

SEQ ID NO: 1198063 - RNA, 19 nt, Eastern equine encephalitis virus
gcuacgaggugaacuacgu

SEQ ID NO: 1198064 - RNA, 19 nt, Eastern equine encephalitis virus
caggaaaaagaagcgacca

SEQ ID NO: 1198065 - RNA, 20 nt, Eastern equine encephalitis virus
caggagaagggaauccacau

SEQ ID NO: 1198066 - RNA, 20 nt, Eastern equine encephalitis virus
gauccuaauccgccuaggcg

SEQ ID NO: 1198067 - RNA, 15 nt, Human
aaaaaauauuuuccu

SEQ ID NO: 1198068 - RNA, 23 nt, Human
aguggcuuaaaacaacacucaca

SEQ ID NO: 1198069 - RNA, 18 nt, Human
aguguauuuuuuuacuaa

SEQ ID NO: 1198070 - RNA, 17 nt, Human
aguguauuuuuuuacua

SEQ ID NO: 1198071 - RNA, 16 nt, Human
agugggagcugccugu

SEQ ID NO: 1198072 - RNA, 15 nt, Human
agugggagcugccug

SEQ ID NO: 1198073 - RNA, 14 nt, Human
agugggagcugccu

SEQ ID NO: 1198074 - RNA, 20 nt, Human
aguucagguaacaggcagau

SEQ ID NO: 1198075 - RNA, 19 nt, Human
aguucagguaacaggcaga

SEQ ID NO: 1198076 - RNA, 17 nt, Human
aguuacagacaaagcgu

SEQ ID NO: 1198077 - RNA, 16 nt, Human
aguuacagacaaagcg

SEQ ID NO: 1198078 - RNA, 14 nt, Human
aguuacagacaaag

SEQ ID NO: 1198079 - RNA, 12 nt, Human
aguuaaauaaau

SEQ ID NO: 1198080 - RNA, 14 nt, Human
aguugaagacagag

SEQ ID NO: 1198081 - RNA, 20 nt, Human
aguuguuugauucagacagc

SEQ ID NO: 1198082 - RNA, 15 nt, Human
aguaucuugaagacu

SEQ ID NO: 1198083 - RNA, 12 nt, Human
aguaucuugaag

SEQ ID NO: 1198084 - RNA, 11 nt, Human
aguaucuugaa

SEQ ID NO: 1198085 - RNA, 17 nt, Human
aguaugaggcauuuguu

SEQ ID NO: 1198086 - RNA, 16 nt, Human
aguaugaggcauuugu

SEQ ID NO: 1198087 - RNA, 15 nt, Human
aguaugaggcauuug

SEQ ID NO: 1198088 - RNA, 14 nt, Human
aguaugguggcugg

SEQ ID NO: 1198089 - RNA, 16 nt, Human
agugaagacaaugacu

SEQ ID NO: 1198090 - RNA, 14 nt, Human
agugaagacaauga

SEQ ID NO: 1198091 - RNA, 18 nt, Human
agucuggaaugcaguggu

SEQ ID NO: 1198092 - RNA, 17 nt, Human
agucuggaaugcagugg

SEQ ID NO: 1198093 - RNA, 20 nt, Human
agucugauucccaagcucug

SEQ ID NO: 1198094 - RNA, 18 nt, Human
agucugauucccaagcuc

SEQ ID NO: 1198095 - RNA, 16 nt, Human
agucugauucccaagc

SEQ ID NO: 1198096 - RNA, 21 nt, Human
aguccuggcaugggaaugaau

SEQ ID NO: 1198097 - RNA, 20 nt, Human
aguccuggcaugggaaugaa

SEQ ID NO: 1198098 - RNA, 22 nt, Human
aguccuggcaugggaaugaaug

SEQ ID NO: 1198099 - RNA, 17 nt, Human
agucugaaggcuggguu

SEQ ID NO: 1198100 - RNA, 16 nt, Human
agucugaaggcugggu

SEQ ID NO: 1198101 - RNA, 15 nt, Human
agucugaaggcuggg

SEQ ID NO: 1198102 - RNA, 13 nt, Human
agucugaaggcug

SEQ ID NO: 1198103 - RNA, 18 nt, Human
auaguaugguggcugggu

SEQ ID NO: 1198104 - RNA, 17 nt, Human
auaguaugguggcuggg

SEQ ID NO: 1198105 - RNA, 21 nt, Human
auagccaaggccaaaggaagc

SEQ ID NO: 1198106 - RNA, 15 nt, Human
auagccaaggccaaa

SEQ ID NO: 1198107 - RNA, 19 nt, Human
auauuuacuucuuauacau

SEQ ID NO: 1198108 - RNA, 22 nt, Human
auauuaccacagacauacuaac

SEQ ID NO: 1198109 - RNA, 16 nt, Human
auaugcucugcauguu

SEQ ID NO: 1198110 - RNA, 21 nt, Human
auacaccacuacauucuguua

SEQ ID NO: 1198111 - RNA, 20 nt, Human
auacaccacuacauucuguu

SEQ ID NO: 1198112 - RNA, 19 nt, Human
auacaccacuacauucugu

SEQ ID NO: 1198113 - RNA, 15 nt, Human
auaauguaagcucua

SEQ ID NO: 1198114 - RNA, 21 nt, Human
auaaugcgugcauaccacuuu

SEQ ID NO: 1198115 - RNA, 12 nt, Human
auacccaccccc

SEQ ID NO: 1198116 - RNA, 11 nt, Human
auacccacccc

SEQ ID NO: 1198117 - RNA, 18 nt, Human
auaccugucccccugaca

SEQ ID NO: 1198118 - RNA, 15 nt, Human
auaaaacuuuuuaaa

SEQ ID NO: 1198119 - RNA, 24 nt, Human
auaaacuuuaccuuuuuuauacau

SEQ ID NO: 1198120 - RNA, 17 nt, Human
auaaaacuuuuuaaaau

SEQ ID NO: 1198121 - RNA, 21 nt, Human
auaaacuuuaccuuuuuuaua

SEQ ID NO: 1198122 - RNA, 20 nt, Human
auaaagcagcguuucuauga

SEQ ID NO: 1198123 - RNA, 19 nt, Human
auaaagcagcguuucuaug

SEQ ID NO: 1198124 - RNA, 18 nt, Human
auaaagcagcguuucuau

SEQ ID NO: 1198125 - RNA, 14 nt, Human
auaaagcagcguuu

SEQ ID NO: 1198126 - RNA, 13 nt, Human
auaaagcagcguu

SEQ ID NO: 1198127 - RNA, 20 nt, Human
aucagccugcuccagcuguu

SEQ ID NO: 1198128 - RNA, 19 nt, Human
aucagccugcuccagcugu

SEQ ID NO: 1198129 - RNA, 18 nt, Human
aucagccugcuccagcug

SEQ ID NO: 1198130 - RNA, 23 nt, Human
aucagcacgauuucuguuuagau

SEQ ID NO: 1198131 - RNA, 20 nt, Human
aucagcacgauuucuguuua

SEQ ID NO: 1198132 - RNA, 19 nt, Human
aucagcacgauuucuguuu

SEQ ID NO: 1198133 - RNA, 21 nt, Human
aucaccgaaaacguggcugcu

SEQ ID NO: 1198134 - RNA, 19 nt, Human
aucaccgaaaacguggcug

SEQ ID NO: 1198135 - RNA, 14 nt, Human
aucaccgaaaacgu

SEQ ID NO: 1198136 - RNA, 21 nt, Human
aucacagccucugaaaaccaa

SEQ ID NO: 1198137 - RNA, 20 nt, Human
aucaccaacgucugugccau

SEQ ID NO: 1198138 - RNA, 19 nt, Human
aucaccaacgucugugcca

SEQ ID NO: 1198139 - RNA, 18 nt, Human
aucaccaacgucugugcc

SEQ ID NO: 1198140 - RNA, 12 nt, Human
aucagcugcuac

SEQ ID NO: 1198141 - RNA, 15 nt, Human
auccucccaccucag

SEQ ID NO: 1198142 - RNA, 13 nt, Human
auccuccaggugc

SEQ ID NO: 1198143 - RNA, 23 nt, Human
auccuccaggugcacaagcucca

SEQ ID NO: 1198144 - RNA, 11 nt, Human
auccuccaggu

SEQ ID NO: 1198145 - RNA, 15 nt, Human
auccccuguagagug

SEQ ID NO: 1198146 - RNA, 15 nt, Human
auccagacccggcug

SEQ ID NO: 1198147 - RNA, 14 nt, Human
aucccauuuaaaaa

SEQ ID NO: 1198148 - RNA, 15 nt, Human
aucccauuuaaaaaa

SEQ ID NO: 1198149 - RNA, 19 nt, Human
auccucccaccucagccuc

SEQ ID NO: 1198150 - RNA, 18 nt, Human
auccucccaccucagccu

SEQ ID NO: 1198151 - RNA, 20 nt, Human
auccucccaccucagccucc

SEQ ID NO: 1198152 - RNA, 23 nt, Human
augaccuuucaauaggaaaaacu

SEQ ID NO: 1198153 - RNA, 22 nt, Human
augaccuuucaauaggaaaaac

SEQ ID NO: 1198154 - RNA, 21 nt, Human
augaccuuucaauaggaaaaa

SEQ ID NO: 1198155 - RNA, 19 nt, Human
augaaagacuguacaaagu

SEQ ID NO: 1198156 - RNA, 17 nt, Human
augaaagacuguacaaa

SEQ ID NO: 1198157 - RNA, 16 nt, Human
augaaagacuguacaa

SEQ ID NO: 1198158 - RNA, 13 nt, Human
augaaagacugua

SEQ ID NO: 1198159 - RNA, 22 nt, Human
aucugcuuuuuaaagaaugcuc

SEQ ID NO: 1198160 - RNA, 14 nt, Human
aucuucuuuauaau

SEQ ID NO: 1198161 - RNA, 17 nt, Human
aucuugaauuguaagga

SEQ ID NO: 1198162 - RNA, 22 nt, Human
augugaaacuggauuaaacuua

SEQ ID NO: 1198163 - RNA, 14 nt, Human
augucuuuucuugc

SEQ ID NO: 1198164 - RNA, 23 nt, Human
auguaauuaaguacuauguauca

SEQ ID NO: 1198165 - RNA, 17 nt, Human
auguaauuaaguacuau

SEQ ID NO: 1198166 - RNA, 15 nt, Human
auguaauuaaguacu

SEQ ID NO: 1198167 - RNA, 15 nt, Human
auggucggaaaacau

SEQ ID NO: 1198168 - RNA, 19 nt, Human
auggucaccaaaucagcug

SEQ ID NO: 1198169 - RNA, 12 nt, Human
auguucugggac

SEQ ID NO: 1198170 - RNA, 11 nt, Human
auguucuggga

SEQ ID NO: 1198171 - RNA, 16 nt, Human
auguucucucuucucc

SEQ ID NO: 1198172 - RNA, 20 nt, Human
augugggcuaguugggcuuc

SEQ ID NO: 1198173 - RNA, 22 nt, Human
auguuugccucugccucugaca

SEQ ID NO: 1198174 - RNA, 19 nt, Human
auguuugccucugccucug

SEQ ID NO: 1198175 - RNA, 13 nt, Human
auguucugggaca

SEQ ID NO: 1198176 - RNA, 11 nt, Human
augcugcccug

SEQ ID NO: 1198177 - RNA, 16 nt, Human
augcucuuuacuucau

SEQ ID NO: 1198178 - RNA, 14 nt, Human
augcuuguacauaa

SEQ ID NO: 1198179 - RNA, 13 nt, Human
augcuuguacaua

SEQ ID NO: 1198180 - RNA, 12 nt, Human
augcuuguacau

SEQ ID NO: 1198181 - RNA, 12 nt, Human
augcugcccugu

SEQ ID NO: 1198182 - RNA, 15 nt, Human
augcuuguacauaau

SEQ ID NO: 1198183 - RNA, 15 nt, Human
auggauuuccagcca

SEQ ID NO: 1198184 - RNA, 19 nt, Human
augccucucucaggccaaa

SEQ ID NO: 1198185 - RNA, 20 nt, Human
augcaugaaguaauaugcac

SEQ ID NO: 1198186 - RNA, 16 nt, Human
augcaugaaguaauau

SEQ ID NO: 1198187 - RNA, 18 nt, Human
augcacagaguuguuaca

SEQ ID NO: 1198188 - RNA, 17 nt, Human
augcacagaguuguuac

SEQ ID NO: 1198189 - RNA, 16 nt, Human
augcacagaguuguua

SEQ ID NO: 1198190 - RNA, 17 nt, Human
augcacaaacagaggcc

SEQ ID NO: 1198191 - RNA, 16 nt, Human
augcacaaacagaggc

SEQ ID NO: 1198192 - RNA, 15 nt, Human
augcacaaacagagg

SEQ ID NO: 1198193 - RNA, 24 nt, Human
augauguuuuccaugaguccccug

SEQ ID NO: 1198194 - RNA, 17 nt, Human
augaugccaugaggaac

SEQ ID NO: 1198195 - RNA, 16 nt, Human
augaugccaugaggaa

SEQ ID NO: 1198196 - RNA, 16 nt, Human
agaggagagaggaccc

SEQ ID NO: 1198197 - RNA, 15 nt, Human
agaggagagaggacc

SEQ ID NO: 1198198 - RNA, 14 nt, Human
agaggacuuuucuu

SEQ ID NO: 1198199 - RNA, 16 nt, Human
agaggaaggagaggag

SEQ ID NO: 1198200 - RNA, 12 nt, Human
agagggcacaga

SEQ ID NO: 1198201 - RNA, 22 nt, Human
agaggguggugaccucugccug

SEQ ID NO: 1198202 - RNA, 20 nt, Human
agaggguggugaccucugcc

SEQ ID NO: 1198203 - RNA, 14 nt, Human
agagugugccugaa

SEQ ID NO: 1198204 - RNA, 19 nt, Human
agaguggggauaugauuua

SEQ ID NO: 1198205 - RNA, 11 nt, Human
agagugggagc

SEQ ID NO: 1198206 - RNA, 23 nt, Human
agaggguggugaccucugccuga

SEQ ID NO: 1198207 - RNA, 14 nt, Human
agagcccaggccuc

SEQ ID NO: 1198208 - RNA, 13 nt, Human
agagcccaggccu

SEQ ID NO: 1198209 - RNA, 15 nt, Human
agagcccaggccucc

SEQ ID NO: 1198210 - RNA, 19 nt, Human
agauauaugcucugcaugu

SEQ ID NO: 1198211 - RNA, 21 nt, Human
agacgcugugcugcccugccc

SEQ ID NO: 1198212 - RNA, 12 nt, Human
agacagcugccu

SEQ ID NO: 1198213 - RNA, 12 nt, Human
agacagcucuua

SEQ ID NO: 1198214 - RNA, 11 nt, Human
agacagcucuu

SEQ ID NO: 1198215 - RNA, 18 nt, Human
agacggagucccaccuug

SEQ ID NO: 1198216 - RNA, 22 nt, Human
agacgcugugcugcccugccca

SEQ ID NO: 1198217 - RNA, 16 nt, Human
agacagcccgggcucu

SEQ ID NO: 1198218 - RNA, 15 nt, Human
agacagcccgggcuc

SEQ ID NO: 1198219 - RNA, 14 nt, Human
agacagcccgggcu

SEQ ID NO: 1198220 - RNA, 15 nt, Human
agacagauacuccuc

SEQ ID NO: 1198221 - RNA, 21 nt, Human
agacagauacuccuccaaggu

SEQ ID NO: 1198222 - RNA, 22 nt, Human
agacagauacuccuccaagguu

SEQ ID NO: 1198223 - RNA, 17 nt, Human
agagcccacgcccccac

SEQ ID NO: 1198224 - RNA, 16 nt, Human
agagcccacgccccca

SEQ ID NO: 1198225 - RNA, 13 nt, Human
agagcccacgccc

SEQ ID NO: 1198226 - RNA, 19 nt, Human
agagcccaccuuggcucaa

SEQ ID NO: 1198227 - RNA, 21 nt, Human
agagaggguggugaccucugc

SEQ ID NO: 1198228 - RNA, 20 nt, Human
agagaggguggugaccucug

SEQ ID NO: 1198229 - RNA, 22 nt, Human
agagaggguggugaccucugcc

SEQ ID NO: 1198230 - RNA, 23 nt, Human
agagaggguggugaccucugccu

SEQ ID NO: 1198231 - RNA, 19 nt, Human
agacuggaagcacagcuuc

SEQ ID NO: 1198232 - RNA, 17 nt, Human
agacuggaagcacagcu

SEQ ID NO: 1198233 - RNA, 13 nt, Human
agccgcuggggcc

SEQ ID NO: 1198234 - RNA, 21 nt, Human
agccgccaugcuccuggccca

SEQ ID NO: 1198235 - RNA, 14 nt, Human
agccuccuccagcc

SEQ ID NO: 1198236 - RNA, 22 nt, Human
agccucccgaguagcugggacu

SEQ ID NO: 1198237 - RNA, 20 nt, Human
agccucccgaguagcuggga

SEQ ID NO: 1198238 - RNA, 19 nt, Human
agccucccgaguagcuggg

SEQ ID NO: 1198239 - RNA, 18 nt, Human
agccucccgaguagcugg

SEQ ID NO: 1198240 - RNA, 22 nt, Human
agccucccacgacugcccggca

SEQ ID NO: 1198241 - RNA, 21 nt, Human
agccucccaaagugcugggau

SEQ ID NO: 1198242 - RNA, 21 nt, Human
agccagcaggcucucaggcca

SEQ ID NO: 1198243 - RNA, 20 nt, Human
agccagcaggcucucaggcc

SEQ ID NO: 1198244 - RNA, 19 nt, Human
agccagcaggcucucaggc

SEQ ID NO: 1198245 - RNA, 18 nt, Human
agccagcaggcucucagg

SEQ ID NO: 1198246 - RNA, 15 nt, Human
agccccagugcccac

SEQ ID NO: 1198247 - RNA, 14 nt, Human
agccccagugccca

SEQ ID NO: 1198248 - RNA, 13 nt, Human
agccccagugccc

SEQ ID NO: 1198249 - RNA, 16 nt, Human
agccccauucugccug

SEQ ID NO: 1198250 - RNA, 13 nt, Human
agccccauucugc

SEQ ID NO: 1198251 - RNA, 23 nt, Human
agccaagugugguagagugugcc

SEQ ID NO: 1198252 - RNA, 23 nt, Human
agcaugccuggauggggcugcac

SEQ ID NO: 1198253 - RNA, 23 nt, Human
agcauccuggcacccggccccug

SEQ ID NO: 1198254 - RNA, 22 nt, Human
agcauccuggcacccggccccu

SEQ ID NO: 1198255 - RNA, 20 nt, Human
agcacagacccugcccugug

SEQ ID NO: 1198256 - RNA, 19 nt, Human
agcacagacccugcccugu

SEQ ID NO: 1198257 - RNA, 18 nt, Human
agcacagacccugcccug

SEQ ID NO: 1198258 - RNA, 12 nt, Human
agcacagacccu

SEQ ID NO: 1198259 - RNA, 23 nt, Human
agcacacuugacaucaacugcau

SEQ ID NO: 1198260 - RNA, 20 nt, Human
agcagugcaugcugucccuu

SEQ ID NO: 1198261 - RNA, 19 nt, Human
agcagugcaugcugucccu

SEQ ID NO: 1198262 - RNA, 18 nt, Human
agcagcguuucuaugaca

SEQ ID NO: 1198263 - RNA, 13 nt, Human
agcagcguuucua

SEQ ID NO: 1198264 - RNA, 23 nt, Human
aggaugcuuguacauaaugcgug

SEQ ID NO: 1198265 - RNA, 21 nt, Human
aggaugcuuguacauaaugcg

SEQ ID NO: 1198266 - RNA, 13 nt, Human
aggaccucaggug

SEQ ID NO: 1198267 - RNA, 16 nt, Human
aggauguucugggaca

SEQ ID NO: 1198268 - RNA, 15 nt, Human
aggauguucugggac

SEQ ID NO: 1198269 - RNA, 14 nt, Human
aggauuauuggaaa

SEQ ID NO: 1198270 - RNA, 18 nt, Human
aggauguucugggacaca

SEQ ID NO: 1198271 - RNA, 17 nt, Human
aggaauccagacccggc

SEQ ID NO: 1198272 - RNA, 21 nt, Human
aggaaucaugugccaagcaga

SEQ ID NO: 1198273 - RNA, 20 nt, Human
aggaauccagacccggcugc

SEQ ID NO: 1198274 - RNA, 23 nt, Human
agcugcgguccacccaggagccc

SEQ ID NO: 1198275 - RNA, 12 nt, Human
agcuccuucugu

SEQ ID NO: 1198276 - RNA, 13 nt, Human
agcuccuucuguc

SEQ ID NO: 1198277 - RNA, 23 nt, Human
agcuccgcuuucuacccagcgag

SEQ ID NO: 1198278 - RNA, 21 nt, Human
agcuccgcuuucuacccagcg

SEQ ID NO: 1198279 - RNA, 20 nt, Human
agcuccgcuuucuacccagc

SEQ ID NO: 1198280 - RNA, 23 nt, Human
aggugcuaggaacacuccuucac

SEQ ID NO: 1198281 - RNA, 22 nt, Human
aggugcuaggaacacuccuuca

SEQ ID NO: 1198282 - RNA, 19 nt, Human
aggugcuaggaacacuccu

SEQ ID NO: 1198283 - RNA, 15 nt, Human
agguuaauaaaguaa

SEQ ID NO: 1198284 - RNA, 23 nt, Human
agguucccuuugacgccauccca

SEQ ID NO: 1198285 - RNA, 22 nt, Human
agguucccuuugacgccauccc

SEQ ID NO: 1198286 - RNA, 15 nt, Human
agguucaaagauauu

SEQ ID NO: 1198287 - RNA, 14 nt, Human
agguucaaagauau

SEQ ID NO: 1198288 - RNA, 23 nt, Human
aggucuguucuuuccaaaguaca

SEQ ID NO: 1198289 - RNA, 22 nt, Human
aggucuguucuuuccaaaguac

SEQ ID NO: 1198290 - RNA, 15 nt, Human
aggguaucuggugac

SEQ ID NO: 1198291 - RNA, 21 nt, Human
aggguaucaggugcugccauc

SEQ ID NO: 1198292 - RNA, 19 nt, Human
aggguaucaggugcugcca

SEQ ID NO: 1198293 - RNA, 21 nt, Human
aggggccucuuaugggcuggg

SEQ ID NO: 1198294 - RNA, 20 nt, Human
aggggccucuuaugggcugg

SEQ ID NO: 1198295 - RNA, 19 nt, Human
aggggccucuuaugggcug

SEQ ID NO: 1198296 - RNA, 11 nt, Human
agggucccugg

SEQ ID NO: 1198297 - RNA, 23 nt, Human
agggacagaggggguggccuccc

SEQ ID NO: 1198298 - RNA, 22 nt, Human
agggacagaggggguggccucc

SEQ ID NO: 1198299 - RNA, 21 nt, Human
aggcugucaauuacaggaagu

SEQ ID NO: 1198300 - RNA, 20 nt, Human
aggcugucaauuacaggaag

SEQ ID NO: 1198301 - RNA, 18 nt, Human
aggcuguaucccaugagc

SEQ ID NO: 1198302 - RNA, 13 nt, Human
aggcuguauccca

SEQ ID NO: 1198303 - RNA, 17 nt, Human
agggacgcuacccggga

SEQ ID NO: 1198304 - RNA, 21 nt, Human
aggcccuucucuccagccccu

SEQ ID NO: 1198305 - RNA, 20 nt, Human
aggcccuucucuccagcccc

SEQ ID NO: 1198306 - RNA, 23 nt, Human
aggcccuucucuccagccccugg

SEQ ID NO: 1198307 - RNA, 22 nt, Human
aggcccuucucuccagccccug

SEQ ID NO: 1198308 - RNA, 19 nt, Human
accccuccaugugggcuag

SEQ ID NO: 1198309 - RNA, 16 nt, Human
accccuccaugugggc

SEQ ID NO: 1198310 - RNA, 16 nt, Human
accauauuaccacaga

SEQ ID NO: 1198311 - RNA, 14 nt, Human
accauauuaccaca

SEQ ID NO: 1198312 - RNA, 15 nt, Human
acccaccucagccuc

SEQ ID NO: 1198313 - RNA, 14 nt, Human
acccaccucagccu

SEQ ID NO: 1198314 - RNA, 13 nt, Human
acccaccucagcc

SEQ ID NO: 1198315 - RNA, 23 nt, Human
acccaagggccuggccugagcug

SEQ ID NO: 1198316 - RNA, 22 nt, Human
acccaagggccuggccugagcu

SEQ ID NO: 1198317 - RNA, 19 nt, Human
acccaagggccuggccuga

SEQ ID NO: 1198318 - RNA, 20 nt, Human
accauauuaccacagacaua

SEQ ID NO: 1198319 - RNA, 16 nt, Human
acccaccucagccucc

SEQ ID NO: 1198320 - RNA, 11 nt, Human
acccccugaau

SEQ ID NO: 1198321 - RNA, 17 nt, Human
accagccaguaaauggg

SEQ ID NO: 1198322 - RNA, 14 nt, Human
accagcagaaaugc

SEQ ID NO: 1198323 - RNA, 13 nt, Human
accagcagaaaug

SEQ ID NO: 1198324 - RNA, 12 nt, Human
accaagcccagu

SEQ ID NO: 1198325 - RNA, 15 nt, Human
acauuuauucugcuc

SEQ ID NO: 1198326 - RNA, 22 nt, Human
acauaaugcgugcauaccacuu

SEQ ID NO: 1198327 - RNA, 23 nt, Human
acauaaugcgugcauaccacuuu

SEQ ID NO: 1198328 - RNA, 14 nt, Human
acaggcacccacca

SEQ ID NO: 1198329 - RNA, 23 nt, Human
acaggcaaugcuggcuguuggcu

SEQ ID NO: 1198330 - RNA, 19 nt, Human
acaggcaaugcuggcuguu

SEQ ID NO: 1198331 - RNA, 19 nt, Human
acaggguuuugccauguug

SEQ ID NO: 1198332 - RNA, 18 nt, Human
acaugugcacaugcacgu

SEQ ID NO: 1198333 - RNA, 16 nt, Human
acaugugcacaugcac

SEQ ID NO: 1198334 - RNA, 19 nt, Human
acaucagcacgauuucugu

SEQ ID NO: 1198335 - RNA, 18 nt, Human
acaucagcacgauuucug

SEQ ID NO: 1198336 - RNA, 17 nt, Human
acaucagcacgauuucu

SEQ ID NO: 1198337 - RNA, 15 nt, Human
acaucagcacgauuu

SEQ ID NO: 1198338 - RNA, 15 nt, Human
acacugcauguuugu

SEQ ID NO: 1198339 - RNA, 14 nt, Human
acacugcauguuug

SEQ ID NO: 1198340 - RNA, 21 nt, Human
acagagugagacucugucuca

SEQ ID NO: 1198341 - RNA, 19 nt, Human
acagagugagacucugucu

SEQ ID NO: 1198342 - RNA, 15 nt, Human
acagagugagacucu

SEQ ID NO: 1198343 - RNA, 14 nt, Human
acagaggggguggc

SEQ ID NO: 1198344 - RNA, 15 nt, Human
acagacacaggcccg

SEQ ID NO: 1198345 - RNA, 23 nt, Human
acagaggcagccccauucugccu

SEQ ID NO: 1198346 - RNA, 19 nt, Human
acagaggcagccccauucu

SEQ ID NO: 1198347 - RNA, 15 nt, Human
acagaggcagcccca

SEQ ID NO: 1198348 - RNA, 14 nt, Human
acagacacaggccc

SEQ ID NO: 1198349 - RNA, 13 nt, Human
acagacacaggcc

SEQ ID NO: 1198350 - RNA, 13 nt, Human
acagacaaagcgu

SEQ ID NO: 1198351 - RNA, 11 nt, Human
acagacacagg

SEQ ID NO: 1198352 - RNA, 15 nt, Human
acacuguacugcaau

SEQ ID NO: 1198353 - RNA, 15 nt, Human
acaggcaagcaccuc

SEQ ID NO: 1198354 - RNA, 12 nt, Human
acaggcaagcac

SEQ ID NO: 1198355 - RNA, 18 nt, Human
acagcucuucuccaggcu

SEQ ID NO: 1198356 - RNA, 17 nt, Human
acagcucuucuccaggc

SEQ ID NO: 1198357 - RNA, 16 nt, Human
acagcucuucuccagg

SEQ ID NO: 1198358 - RNA, 17 nt, Human
acagccacggccaggcc

SEQ ID NO: 1198359 - RNA, 16 nt, Human
acagccacggccaggc

SEQ ID NO: 1198360 - RNA, 15 nt, Human
acagccacggccagg

SEQ ID NO: 1198361 - RNA, 18 nt, Human
acagccacggccaggcca

SEQ ID NO: 1198362 - RNA, 19 nt, Human
acagccacggccaggccag

SEQ ID NO: 1198363 - RNA, 15 nt, Human
acaaggcaaggcugu

SEQ ID NO: 1198364 - RNA, 22 nt, Human
acaaaauguaggguuauaauaa

SEQ ID NO: 1198365 - RNA, 14 nt, Human
acaaggcaaggcug

SEQ ID NO: 1198366 - RNA, 12 nt, Human
acaaggcaaggc

SEQ ID NO: 1198367 - RNA, 17 nt, Human
acaaggauugcuacugu

SEQ ID NO: 1198368 - RNA, 22 nt, Human
acacauuuuuuaaaugcaccug

SEQ ID NO: 1198369 - RNA, 20 nt, Human
acacauuuuuuaaaugcacc

SEQ ID NO: 1198370 - RNA, 12 nt, Human
acacauuuuucu

SEQ ID NO: 1198371 - RNA, 22 nt, Human
acacauuuuauuuuauuaugca

SEQ ID NO: 1198372 - RNA, 13 nt, Human
acacagcucuucu

SEQ ID NO: 1198373 - RNA, 11 nt, Human
acacagcucuu

SEQ ID NO: 1198374 - RNA, 19 nt, Human
acacagaggcugccucucc

SEQ ID NO: 1198375 - RNA, 20 nt, Human
acacagcucuguccugggag

SEQ ID NO: 1198376 - RNA, 17 nt, Human
acacgcgugcacacacc

SEQ ID NO: 1198377 - RNA, 15 nt, Human
acacgcgugcacaca

SEQ ID NO: 1198378 - RNA, 16 nt, Human
accugucccccugaca

SEQ ID NO: 1198379 - RNA, 15 nt, Human
accugucccccugac

SEQ ID NO: 1198380 - RNA, 12 nt, Human
accugucccccu

SEQ ID NO: 1198381 - RNA, 18 nt, Human
accuuggcugcagggagu

SEQ ID NO: 1198382 - RNA, 17 nt, Human
accuuggcugcagggag

SEQ ID NO: 1198383 - RNA, 15 nt, Human
accuuuaagagaaau

SEQ ID NO: 1198384 - RNA, 18 nt, Human
accuuucccaucuuccaa

SEQ ID NO: 1198385 - RNA, 13 nt, Human
accuuucccaucu

SEQ ID NO: 1198386 - RNA, 20 nt, Human
accucugcagcaauaaagca

SEQ ID NO: 1198387 - RNA, 18 nt, Human
accucugcagcaauaaag

SEQ ID NO: 1198388 - RNA, 21 nt, Human
accucugcagcaauaaagcag

SEQ ID NO: 1198389 - RNA, 13 nt, Human
acgucugacaggc

SEQ ID NO: 1198390 - RNA, 15 nt, Human
acgucugacaggcaa

SEQ ID NO: 1198391 - RNA, 14 nt, Human
acgucugacaggca

SEQ ID NO: 1198392 - RNA, 15 nt, Human
acgcugugcugcccu

SEQ ID NO: 1198393 - RNA, 14 nt, Human
acgcugugcugccc

SEQ ID NO: 1198394 - RNA, 12 nt, Human
acgcugugcugc

SEQ ID NO: 1198395 - RNA, 11 nt, Human
acgcugugcug

SEQ ID NO: 1198396 - RNA, 11 nt, Human
acgugaguccu

SEQ ID NO: 1198397 - RNA, 15 nt, Human
acuaaguuuuuaugg

SEQ ID NO: 1198398 - RNA, 19 nt, Human
acucaguccauagcagaga

SEQ ID NO: 1198399 - RNA, 18 nt, Human
acucaaaagcugggcagg

SEQ ID NO: 1198400 - RNA, 13 nt, Human
acucaaaagcugg

SEQ ID NO: 1198401 - RNA, 19 nt, Human
acucugucgcccagucugg

SEQ ID NO: 1198402 - RNA, 23 nt, Human
acucuaucaaguauuauaccuuu

SEQ ID NO: 1198403 - RNA, 17 nt, Human
acucuagggaaaaacca

SEQ ID NO: 1198404 - RNA, 15 nt, Human
acucuagggaaaaac

SEQ ID NO: 1198405 - RNA, 18 nt, Human
acugguuccauggccucu

SEQ ID NO: 1198406 - RNA, 15 nt, Human
acuggagaaaaugga

SEQ ID NO: 1198407 - RNA, 19 nt, Human
acuggaagcacagcuucau

SEQ ID NO: 1198408 - RNA, 17 nt, Human
acuggaagcacagcuuc

SEQ ID NO: 1198409 - RNA, 20 nt, Human
acugugcugagucugaaggc

SEQ ID NO: 1198410 - RNA, 22 nt, Human
acugugcugagucugaaggcug

SEQ ID NO: 1198411 - RNA, 15 nt, Human
acuugggccacugug

SEQ ID NO: 1198412 - RNA, 14 nt, Human
acuugggccacugu

SEQ ID NO: 1198413 - RNA, 16 nt, Human
acuugguuuuuaaaaa

SEQ ID NO: 1198414 - RNA, 14 nt, Human
acuuuucuuugugg

SEQ ID NO: 1198415 - RNA, 19 nt, Human
agaaaauaguggugugauu

SEQ ID NO: 1198416 - RNA, 15 nt, Human
agaaaauaccaagga

SEQ ID NO: 1198417 - RNA, 16 nt, Human
acuuuucuuucagcca

SEQ ID NO: 1198418 - RNA, 20 nt, Human
acuuuucauaaccuagccuu

SEQ ID NO: 1198419 - RNA, 15 nt, Human
acuuuuauaaacuuu

SEQ ID NO: 1198420 - RNA, 13 nt, Human
acuuuuauaaacu

SEQ ID NO: 1198421 - RNA, 20 nt, Human
acuuuguucuggcucuucca

SEQ ID NO: 1198422 - RNA, 19 nt, Human
acuuuguucuggcucuucc

SEQ ID NO: 1198423 - RNA, 17 nt, Human
acuuuguucuggcucuu

SEQ ID NO: 1198424 - RNA, 16 nt, Human
acuuuguucuggcucu

SEQ ID NO: 1198425 - RNA, 23 nt, Human
agaaaguacuucuccacccugcu

SEQ ID NO: 1198426 - RNA, 22 nt, Human
agaaaguacuucuccacccugc

SEQ ID NO: 1198427 - RNA, 21 nt, Human
aaugcuggcuguuggcugggg

SEQ ID NO: 1198428 - RNA, 17 nt, Human
aaugugaaaagaaaaau

SEQ ID NO: 1198429 - RNA, 15 nt, Human
aaugugaaaagaaaa

SEQ ID NO: 1198430 - RNA, 16 nt, Human
aauguuugccucugcc

SEQ ID NO: 1198431 - RNA, 15 nt, Human
aauguuugccucugc

SEQ ID NO: 1198432 - RNA, 23 nt, Human
aaugccuuacccucauguucuua

SEQ ID NO: 1198433 - RNA, 19 nt, Human
aaugcgugcauaccacuuu

SEQ ID NO: 1198434 - RNA, 18 nt, Human
aaugcgugcauaccacuu

SEQ ID NO: 1198435 - RNA, 22 nt, Human
aauacucuacccucuuagaaaa

SEQ ID NO: 1198436 - RNA, 20 nt, Human
aauacucuacccucuuagaa

SEQ ID NO: 1198437 - RNA, 13 nt, Human
aauagacaauuua

SEQ ID NO: 1198438 - RNA, 15 nt, Human
aaucaccgaaaacgu

SEQ ID NO: 1198439 - RNA, 14 nt, Human
aaucaccgaaaacg

SEQ ID NO: 1198440 - RNA, 18 nt, Human
aaucucaaauuucuaaau

SEQ ID NO: 1198441 - RNA, 17 nt, Human
aaucucaaauuucuaaa

SEQ ID NO: 1198442 - RNA, 16 nt, Human
aaucucaaauuucuaa

SEQ ID NO: 1198443 - RNA, 19 nt, Human
aauccagacccggcugcgu

SEQ ID NO: 1198444 - RNA, 19 nt, Human
aaggucauuuuuuuuaaga

SEQ ID NO: 1198445 - RNA, 13 nt, Human
aagggcccagaga

SEQ ID NO: 1198446 - RNA, 18 nt, Human
aagggacgcuacccggga

SEQ ID NO: 1198447 - RNA, 23 nt, Human
aaguaucccuacuguaauuugug

SEQ ID NO: 1198448 - RNA, 18 nt, Human
aaguaucccuacuguaau

SEQ ID NO: 1198449 - RNA, 21 nt, Human
aaguagaagucuuagauguau

SEQ ID NO: 1198450 - RNA, 20 nt, Human
aaguagaagucuuagaugua

SEQ ID NO: 1198451 - RNA, 19 nt, Human
aaguagaagucuuagaugu

SEQ ID NO: 1198452 - RNA, 18 nt, Human
aaguccucuuuucugaga

SEQ ID NO: 1198453 - RNA, 22 nt, Human
aaguccucuuuucugagaggac

SEQ ID NO: 1198454 - RNA, 19 nt, Human
aaguggaaaaauagccugc

SEQ ID NO: 1198455 - RNA, 21 nt, Human
aaguggaaaaauagccugccu

SEQ ID NO: 1198456 - RNA, 21 nt, Human
aagcuggucccacucagucca

SEQ ID NO: 1198457 - RNA, 18 nt, Human
aagcuggucccacucagu

SEQ ID NO: 1198458 - RNA, 15 nt, Human
aaggauugcuacugu

SEQ ID NO: 1198459 - RNA, 15 nt, Human
aaggauguucuagca

SEQ ID NO: 1198460 - RNA, 21 nt, Human
aagcgauucuucugcuucagc

SEQ ID NO: 1198461 - RNA, 14 nt, Human
aagauaaaugugcu

SEQ ID NO: 1198462 - RNA, 13 nt, Human
aagauaaaugugc

SEQ ID NO: 1198463 - RNA, 12 nt, Human
aagauaaaugug

SEQ ID NO: 1198464 - RNA, 22 nt, Human
aagcagcguuucuaugacacau

SEQ ID NO: 1198465 - RNA, 21 nt, Human
aagcagcguuucuaugacaca

SEQ ID NO: 1198466 - RNA, 20 nt, Human
aagcagcguuucuaugacac

SEQ ID NO: 1198467 - RNA, 17 nt, Human
aagcagcguuucuauga

SEQ ID NO: 1198468 - RNA, 14 nt, Human
aagcagcguuucua

SEQ ID NO: 1198469 - RNA, 23 nt, Human
aagccagcaggcucucaggccag

SEQ ID NO: 1198470 - RNA, 20 nt, Human
aagccagcaggcucucaggc

SEQ ID NO: 1198471 - RNA, 24 nt, Human
aaauagcucaggugucccugcacu

SEQ ID NO: 1198472 - RNA, 16 nt, Human
aaagccuccuccagcc

SEQ ID NO: 1198473 - RNA, 16 nt, Human
aaaggcuccaggagca

SEQ ID NO: 1198474 - RNA, 14 nt, Human
aaaggcuaccuuug

SEQ ID NO: 1198475 - RNA, 19 nt, Human
aaauaaaacuuuuuaaaau

SEQ ID NO: 1198476 - RNA, 16 nt, Human
aaauaaaacuuuuuaa

SEQ ID NO: 1198477 - RNA, 13 nt, Human
aaauaaaacuuuu

SEQ ID NO: 1198478 - RNA, 13 nt, Human
aaaguggaaaaau

SEQ ID NO: 1198479 - RNA, 20 nt, Human
aaaggcuccaggagcagcca

SEQ ID NO: 1198480 - RNA, 19 nt, Human
aaaggcuccaggagcagcc

SEQ ID NO: 1198481 - RNA, 17 nt, Human
aaaauaaaacuuuuuaa

SEQ ID NO: 1198482 - RNA, 15 nt, Human
aaaaagaaaggaggg

SEQ ID NO: 1198483 - RNA, 16 nt, Human
aaacacuguucucugc

SEQ ID NO: 1198484 - RNA, 22 nt, Human
aaaaucucaaauuucuaaaucu

SEQ ID NO: 1198485 - RNA, 19 nt, Human
aaaaucucaaauuucuaaa

SEQ ID NO: 1198486 - RNA, 20 nt, Human
aaagauauuuugcuuuguga

SEQ ID NO: 1198487 - RNA, 17 nt, Human
aaagauauuuugcuuug

SEQ ID NO: 1198488 - RNA, 16 nt, Human
aaagauauuuugcuuu

SEQ ID NO: 1198489 - RNA, 12 nt, Human
aaagauauuuug

SEQ ID NO: 1198490 - RNA, 18 nt, Human
aaaccaucauugaaaucu

SEQ ID NO: 1198491 - RNA, 18 nt, Human
aaacucuccucugcugcu

SEQ ID NO: 1198492 - RNA, 13 nt, Human
aaccacgcuggac

SEQ ID NO: 1198493 - RNA, 15 nt, Human
aaccacuucagcuga

SEQ ID NO: 1198494 - RNA, 21 nt, Human
aaauucuugcaaaguaucccu

SEQ ID NO: 1198495 - RNA, 18 nt, Human
aacuuaaucuaaauggaa

SEQ ID NO: 1198496 - RNA, 16 nt, Human
aacuuaaucuaaaugg

SEQ ID NO: 1198497 - RNA, 15 nt, Human
aacuuaaucuaaaug

SEQ ID NO: 1198498 - RNA, 14 nt, Human
aacugauaaagaug

SEQ ID NO: 1198499 - RNA, 11 nt, Human
cucggugccuu

SEQ ID NO: 1198500 - RNA, 22 nt, Human
cuccuagccugugccucuggga

SEQ ID NO: 1198501 - RNA, 17 nt, Human
cuccuuuagcgcccagu

SEQ ID NO: 1198502 - RNA, 16 nt, Human
cuccuuuagcgcccag

SEQ ID NO: 1198503 - RNA, 22 nt, Human
cuccuuuagcgcccaguugggu

SEQ ID NO: 1198504 - RNA, 24 nt, Human
cuccuuuucacaguucucuccuuc

SEQ ID NO: 1198505 - RNA, 10 nt, Human
cucuccucug

SEQ ID NO: 1198506 - RNA, 20 nt, Human
cucuccuccuuuucacaguu

SEQ ID NO: 1198507 - RNA, 13 nt, Human
cucuccuccuuuu

SEQ ID NO: 1198508 - RNA, 21 nt, Human
cucuccgaccagacaccuuga

SEQ ID NO: 1198509 - RNA, 16 nt, Human
cucuccgaccagacac

SEQ ID NO: 1198510 - RNA, 13 nt, Human
cucucccuuggau

SEQ ID NO: 1198511 - RNA, 22 nt, Human
cuccgcuuucuacccagcgagc

SEQ ID NO: 1198512 - RNA, 23 nt, Human
cuccgcuuucuacccagcgagcc

SEQ ID NO: 1198513 - RNA, 21 nt, Human
cuccgcuuucuacccagcgag

SEQ ID NO: 1198514 - RNA, 15 nt, Human
cucccucuuucccuc

SEQ ID NO: 1198515 - RNA, 16 nt, Human
cucccucccucuuucc

SEQ ID NO: 1198516 - RNA, 19 nt, Human
cucccucuuucccucccuu

SEQ ID NO: 1198517 - RNA, 17 nt, Human
cucagaaucucaaauaa

SEQ ID NO: 1198518 - RNA, 16 nt, Human
cucagaaucucaaaua

SEQ ID NO: 1198519 - RNA, 11 nt, Human
cuccagacaca

SEQ ID NO: 1198520 - RNA, 22 nt, Human
cuccagaauuucccaaagcagu

SEQ ID NO: 1198521 - RNA, 16 nt, Human
cuccagacacaugucc

SEQ ID NO: 1198522 - RNA, 23 nt, Human
cuccaggcuguaucccaugagcc

SEQ ID NO: 1198523 - RNA, 22 nt, Human
cuccaggugcacaagcuccaag

SEQ ID NO: 1198524 - RNA, 20 nt, Human
cuccaggugcacaagcucca

SEQ ID NO: 1198525 - RNA, 19 nt, Human
cuccaggugcacaagcucc

SEQ ID NO: 1198526 - RNA, 18 nt, Human
cuccaggugcacaagcuc

SEQ ID NO: 1198527 - RNA, 17 nt, Human
cucccaccucagccucc

SEQ ID NO: 1198528 - RNA, 16 nt, Human
cucccaccucagccuc

SEQ ID NO: 1198529 - RNA, 14 nt, Human
cucccaccucagcc

SEQ ID NO: 1198530 - RNA, 23 nt, Human
cugacacacagcucuguccuggg

SEQ ID NO: 1198531 - RNA, 22 nt, Human
cugacacacagcucuguccugg

SEQ ID NO: 1198532 - RNA, 21 nt, Human
cugacacacagcucuguccug

SEQ ID NO: 1198533 - RNA, 20 nt, Human
cugacacacagcucuguccu

SEQ ID NO: 1198534 - RNA, 19 nt, Human
cugacacacagcucugucc

SEQ ID NO: 1198535 - RNA, 18 nt, Human
cugacacacagcucuguc

SEQ ID NO: 1198536 - RNA, 17 nt, Human
cugacacacagcucugu

SEQ ID NO: 1198537 - RNA, 16 nt, Human
cugacacacagcucug

SEQ ID NO: 1198538 - RNA, 15 nt, Human
cugacacacagcucu

SEQ ID NO: 1198539 - RNA, 13 nt, Human
cugacacacagcu

SEQ ID NO: 1198540 - RNA, 14 nt, Human
cugaaaauguaugu

SEQ ID NO: 1198541 - RNA, 19 nt, Human
cucugcacaagcugcaccc

SEQ ID NO: 1198542 - RNA, 18 nt, Human
cucugcacaagcugcacc

SEQ ID NO: 1198543 - RNA, 17 nt, Human
cucugcacaagcugcac

SEQ ID NO: 1198544 - RNA, 24 nt, Human
cucuugauucauaaugacuuaagc

SEQ ID NO: 1198545 - RNA, 16 nt, Human
cucuugagccugggag

SEQ ID NO: 1198546 - RNA, 15 nt, Human
cucuugagccuggga

SEQ ID NO: 1198547 - RNA, 22 nt, Human
cucuugauucauaaugacuuaa

SEQ ID NO: 1198548 - RNA, 14 nt, Human
cucuugagccuggg

SEQ ID NO: 1198549 - RNA, 17 nt, Human
cugaguacguugugcau

SEQ ID NO: 1198550 - RNA, 14 nt, Human
cugaggaauccaga

SEQ ID NO: 1198551 - RNA, 19 nt, Human
cugacccugcuucaaauau

SEQ ID NO: 1198552 - RNA, 22 nt, Human
cugagcugggaugauuggaggg

SEQ ID NO: 1198553 - RNA, 12 nt, Human
cugagcugggau

SEQ ID NO: 1198554 - RNA, 23 nt, Human
cugacccugcuucaaauauuucc

SEQ ID NO: 1198555 - RNA, 22 nt, Human
cugaggugggaggaucucuuga

SEQ ID NO: 1198556 - RNA, 13 nt, Human
cugaggugggagg

SEQ ID NO: 1198557 - RNA, 14 nt, Human
cugaggggccucuu

SEQ ID NO: 1198558 - RNA, 23 nt, Human
cugaggaauccagacccggcugc

SEQ ID NO: 1198559 - RNA, 18 nt, Human
cugaucucucgugauuga

SEQ ID NO: 1198560 - RNA, 17 nt, Human
cugaucucucgugauug

SEQ ID NO: 1198561 - RNA, 13 nt, Human
cguuaaaauacca

SEQ ID NO: 1198562 - RNA, 22 nt, Human
cuaaaguguauuuuuuuacuaa

SEQ ID NO: 1198563 - RNA, 19 nt, Human
cuaaaggcuaccuuuguau

SEQ ID NO: 1198564 - RNA, 17 nt, Human
cuaaaggcuaccuuugu

SEQ ID NO: 1198565 - RNA, 16 nt, Human
cuaaaggcuaccuuug

SEQ ID NO: 1198566 - RNA, 15 nt, Human
cuaaaggcuaccuuu

SEQ ID NO: 1198567 - RNA, 15 nt, Human
cuaaagcugccagcc

SEQ ID NO: 1198568 - RNA, 14 nt, Human
cuaaagcugccagc

SEQ ID NO: 1198569 - RNA, 15 nt, Human
cggagacggaguccc

SEQ ID NO: 1198570 - RNA, 13 nt, Human
cgguguggagaag

SEQ ID NO: 1198571 - RNA, 16 nt, Human
cguacacauuuuauuu

SEQ ID NO: 1198572 - RNA, 13 nt, Human
cguacacauuuua

SEQ ID NO: 1198573 - RNA, 13 nt, Human
cgaguagcuggga

SEQ ID NO: 1198574 - RNA, 23 nt, Human
cgcuggaccuugaacuggguacu

SEQ ID NO: 1198575 - RNA, 19 nt, Human
cgcuggaccuugaacuggg

SEQ ID NO: 1198576 - RNA, 18 nt, Human
cgcugccccuggcagccc

SEQ ID NO: 1198577 - RNA, 17 nt, Human
cgcugccccuggcagcc

SEQ ID NO: 1198578 - RNA, 16 nt, Human
cgcugccccuggcagc

SEQ ID NO: 1198579 - RNA, 16 nt, Human
cgccuuaaggauguuc

SEQ ID NO: 1198580 - RNA, 20 nt, Human
cgcuggggccaguugguccc

SEQ ID NO: 1198581 - RNA, 17 nt, Human
cgcuggggccaguuggu

SEQ ID NO: 1198582 - RNA, 14 nt, Human
cuagggaagauaau

SEQ ID NO: 1198583 - RNA, 19 nt, Human
cuaguuugauuaaauucuu

SEQ ID NO: 1198584 - RNA, 17 nt, Human
cuaguuugauuaaauuc

SEQ ID NO: 1198585 - RNA, 21 nt, Human
cuaguuugauuaaauucuugc

SEQ ID NO: 1198586 - RNA, 20 nt, Human
cuaguuugauuaaauucuug

SEQ ID NO: 1198587 - RNA, 13 nt, Human
cuaggccugggga

SEQ ID NO: 1198588 - RNA, 12 nt, Human
cuaggccugggg

SEQ ID NO: 1198589 - RNA, 19 nt, Human
cuaggccuggccagaugca

SEQ ID NO: 1198590 - RNA, 18 nt, Human
cuaggccuggccagaugc

SEQ ID NO: 1198591 - RNA, 15 nt, Human
cuaggccuggccaga

SEQ ID NO: 1198592 - RNA, 14 nt, Human
cuaggccuggccag

SEQ ID NO: 1198593 - RNA, 13 nt, Human
cuaggccuggcca

SEQ ID NO: 1198594 - RNA, 19 nt, Human
cuagccagaggagagagga

SEQ ID NO: 1198595 - RNA, 20 nt, Human
cuagcauacguacacauuuu

SEQ ID NO: 1198596 - RNA, 19 nt, Human
cuagcauacguacacauuu

SEQ ID NO: 1198597 - RNA, 18 nt, Human
cuagcauacguacacauu

SEQ ID NO: 1198598 - RNA, 16 nt, Human
cuagcauacguacaca

SEQ ID NO: 1198599 - RNA, 23 nt, Human
cuaccugaggggccucuuauggg

SEQ ID NO: 1198600 - RNA, 19 nt, Human
cuaccugaggggccucuua

SEQ ID NO: 1198601 - RNA, 16 nt, Human
cuaccugaggggccuc

SEQ ID NO: 1198602 - RNA, 18 nt, Human
cucaccugccccucaacu

SEQ ID NO: 1198603 - RNA, 16 nt, Human
cucaccugccccucaa

SEQ ID NO: 1198604 - RNA, 14 nt, Human
cucaccugccccuc

SEQ ID NO: 1198605 - RNA, 13 nt, Human
cucaccugccccu

SEQ ID NO: 1198606 - RNA, 17 nt, Human
cucaccucucccuugga

SEQ ID NO: 1198607 - RNA, 16 nt, Human
cucaccucucccuugg

SEQ ID NO: 1198608 - RNA, 15 nt, Human
cucaccucucccuug

SEQ ID NO: 1198609 - RNA, 14 nt, Human
cucaccucucccuu

SEQ ID NO: 1198610 - RNA, 13 nt, Human
cucaccucucccu

SEQ ID NO: 1198611 - RNA, 14 nt, Human
cucacaaaggaugc

SEQ ID NO: 1198612 - RNA, 12 nt, Human
cucaaauaacua

SEQ ID NO: 1198613 - RNA, 21 nt, Human
cucacacaugagcaucaggcc

SEQ ID NO: 1198614 - RNA, 14 nt, Human
cucacacaugagca

SEQ ID NO: 1198615 - RNA, 18 nt, Human
cucaaaaaaagaaaaaga

SEQ ID NO: 1198616 - RNA, 17 nt, Human
cuauguugcccaggcag

SEQ ID NO: 1198617 - RNA, 16 nt, Human
cuauguugcccaggca

SEQ ID NO: 1198618 - RNA, 15 nt, Human
cuauguugcccaggc

SEQ ID NO: 1198619 - RNA, 22 nt, Human
cuauguguagggcgggaggaug

SEQ ID NO: 1198620 - RNA, 19 nt, Human
cuauguaucaaugaguaac

SEQ ID NO: 1198621 - RNA, 20 nt, Human
cuaucucccccagccccauc

SEQ ID NO: 1198622 - RNA, 20 nt, Human
ccugguggcagugggagcug

SEQ ID NO: 1198623 - RNA, 19 nt, Human
ccugguggcagugggagcu

SEQ ID NO: 1198624 - RNA, 18 nt, Human
ccugguggcagugggagc

SEQ ID NO: 1198625 - RNA, 13 nt, Human
ccugguguggaag

SEQ ID NO: 1198626 - RNA, 15 nt, Human
ccuggggagaaagua

SEQ ID NO: 1198627 - RNA, 21 nt, Human
ccuggccccucagggucccug

SEQ ID NO: 1198628 - RNA, 20 nt, Human
ccuggccccucagggucccu

SEQ ID NO: 1198629 - RNA, 18 nt, Human
ccuggccccucagggucc

SEQ ID NO: 1198630 - RNA, 18 nt, Human
ccuggauggggcugcacc

SEQ ID NO: 1198631 - RNA, 17 nt, Human
ccuggauggggcugcac

SEQ ID NO: 1198632 - RNA, 15 nt, Human
ccuggauggggcugc

SEQ ID NO: 1198633 - RNA, 17 nt, Human
ccugcccaccuggccuc

SEQ ID NO: 1198634 - RNA, 15 nt, Human
ccugcccaccuggcc

SEQ ID NO: 1198635 - RNA, 16 nt, Human
ccugccucagccuccc

SEQ ID NO: 1198636 - RNA, 15 nt, Human
ccugccucagccucc

SEQ ID NO: 1198637 - RNA, 22 nt, Human
ccugcccaggccccugccaccc

SEQ ID NO: 1198638 - RNA, 21 nt, Human
ccugcccaggccccugccacc

SEQ ID NO: 1198639 - RNA, 19 nt, Human
ccugcccaggccccugcca

SEQ ID NO: 1198640 - RNA, 19 nt, Human
ccugcccaccuggccucug

SEQ ID NO: 1198641 - RNA, 18 nt, Human
ccugcccaccuggccucu

SEQ ID NO: 1198642 - RNA, 15 nt, Human
ccugcaggcagccag

SEQ ID NO: 1198643 - RNA, 14 nt, Human
ccugcaggcagcca

SEQ ID NO: 1198644 - RNA, 13 nt, Human
ccugcaggcagcc

SEQ ID NO: 1198645 - RNA, 12 nt, Human
ccugcaggcagc

SEQ ID NO: 1198646 - RNA, 16 nt, Human
ccucuuugagugaagc

SEQ ID NO: 1198647 - RNA, 15 nt, Human
ccucuuugagugaag

SEQ ID NO: 1198648 - RNA, 19 nt, Human
ccucuuucccucccuuccu

SEQ ID NO: 1198649 - RNA, 14 nt, Human
ccuccgccucuugg

SEQ ID NO: 1198650 - RNA, 15 nt, Human
ccucgaacuggcugc

SEQ ID NO: 1198651 - RNA, 18 nt, Human
ccuccuuuucacaguucu

SEQ ID NO: 1198652 - RNA, 23 nt, Human
ccuccuuugugaggaagccgcug

SEQ ID NO: 1198653 - RNA, 23 nt, Human
ccucaacucuccuccagagucag

SEQ ID NO: 1198654 - RNA, 21 nt, Human
ccucaacucuccuccagaguc

SEQ ID NO: 1198655 - RNA, 15 nt, Human
ccucaaccuccuggg

SEQ ID NO: 1198656 - RNA, 16 nt, Human
ccucaacaccucugca

SEQ ID NO: 1198657 - RNA, 12 nt, Human
ccucccaucacc

SEQ ID NO: 1198658 - RNA, 20 nt, Human
ccuccaagaccuucuccuuc

SEQ ID NO: 1198659 - RNA, 19 nt, Human
ccuccaagaccuucuccuu

SEQ ID NO: 1198660 - RNA, 17 nt, Human
ccuccaagaccuucucc

SEQ ID NO: 1198661 - RNA, 16 nt, Human
ccuccaagaccuucuc

SEQ ID NO: 1198662 - RNA, 17 nt, Human
ccucccaucacccgcua

SEQ ID NO: 1198663 - RNA, 23 nt, Human
ccucaagugauucuccugccuca

SEQ ID NO: 1198664 - RNA, 20 nt, Human
ccucaagugauucuccugcc

SEQ ID NO: 1198665 - RNA, 16 nt, Human
ccucaaccuccugggc

SEQ ID NO: 1198666 - RNA, 18 nt, Human
ccucaggcaggugggaug

SEQ ID NO: 1198667 - RNA, 12 nt, Human
ccucaggcaggu

SEQ ID NO: 1198668 - RNA, 10 nt, Human
ccucaggccu

SEQ ID NO: 1198669 - RNA, 19 nt, Human
ccuagccuuagaagucaca

SEQ ID NO: 1198670 - RNA, 23 nt, Human
ccuagccugugccucugggacug

SEQ ID NO: 1198671 - RNA, 22 nt, Human
ccuagccuuagaagucacacag

SEQ ID NO: 1198672 - RNA, 18 nt, Human
ccggcaggguccuagaaa

SEQ ID NO: 1198673 - RNA, 18 nt, Human
ccggccaccugcggugcu

SEQ ID NO: 1198674 - RNA, 17 nt, Human
ccggccaccugcggugc

SEQ ID NO: 1198675 - RNA, 23 nt, Human
ccgcagcccugcagagggcacag

SEQ ID NO: 1198676 - RNA, 18 nt, Human
ccgcagcccugcagaggg

SEQ ID NO: 1198677 - RNA, 14 nt, Human
ccgcagcccugcag

SEQ ID NO: 1198678 - RNA, 15 nt, Human
cccugugggccccca

SEQ ID NO: 1198679 - RNA, 17 nt, Human
cccugugauggggcccu

SEQ ID NO: 1198680 - RNA, 15 nt, Human
cccugugauggggcc

SEQ ID NO: 1198681 - RNA, 23 nt, Human
cccugugaguacuacaguccucc

SEQ ID NO: 1198682 - RNA, 21 nt, Human
cccugugaguacuacaguccu

SEQ ID NO: 1198683 - RNA, 14 nt, Human
cccuccuuucacca

SEQ ID NO: 1198684 - RNA, 23 nt, Human
cccuuuuuuggcugcugaaggcu

SEQ ID NO: 1198685 - RNA, 22 nt, Human
cccuuuuuuggcugcugaaggc

SEQ ID NO: 1198686 - RNA, 21 nt, Human
cccuuuuuuggcugcugaagg

SEQ ID NO: 1198687 - RNA, 19 nt, Human
cccuucucuccagccccug

SEQ ID NO: 1198688 - RNA, 14 nt, Human
cccuucucuccagc

SEQ ID NO: 1198689 - RNA, 16 nt, Human
cccaacucaccccagc

SEQ ID NO: 1198690 - RNA, 15 nt, Human
cccaacucaccccag

SEQ ID NO: 1198691 - RNA, 23 nt, Human
cccacugcuuuuggucuguguga

SEQ ID NO: 1198692 - RNA, 13 nt, Human
cccacucccugca

SEQ ID NO: 1198693 - RNA, 12 nt, Human
cccacccccacc

SEQ ID NO: 1198694 - RNA, 15 nt, Human
cccaagcucugcucc

SEQ ID NO: 1198695 - RNA, 14 nt, Human
cccaagcucugcuc

SEQ ID NO: 1198696 - RNA, 13 nt, Human
cccaagcucugcu

SEQ ID NO: 1198697 - RNA, 20 nt, Human
cccaacucaccccagcccca

SEQ ID NO: 1198698 - RNA, 17 nt, Human
cccaacucaccccagcc

SEQ ID NO: 1198699 - RNA, 13 nt, Human
ccaguuggucccc

SEQ ID NO: 1198700 - RNA, 21 nt, Human
ccaucccauaugccugggcag

SEQ ID NO: 1198701 - RNA, 20 nt, Human
ccaucccauaugccugggca

SEQ ID NO: 1198702 - RNA, 19 nt, Human
ccaucccauaugccugggc

SEQ ID NO: 1198703 - RNA, 20 nt, Human
ccaucccaaacccuucagug

SEQ ID NO: 1198704 - RNA, 20 nt, Human
ccaguuggucccccuuccau

SEQ ID NO: 1198705 - RNA, 18 nt, Human
ccaguuggucccccuucc

SEQ ID NO: 1198706 - RNA, 19 nt, Human
ccauccagguucagcuugu

SEQ ID NO: 1198707 - RNA, 13 nt, Human
ccaugaguccccu

SEQ ID NO: 1198708 - RNA, 23 nt, Human
ccaugaggaacaaggcaaggcug

SEQ ID NO: 1198709 - RNA, 20 nt, Human
ccaugaggaacaaggcaagg

SEQ ID NO: 1198710 - RNA, 16 nt, Human
ccaggcuggcgugcag

SEQ ID NO: 1198711 - RNA, 12 nt, Human
ccaggcuggcgu

SEQ ID NO: 1198712 - RNA, 23 nt, Human
ccaggcaggucuugaacuccugg

SEQ ID NO: 1198713 - RNA, 14 nt, Human
ccaggcaggucuug

SEQ ID NO: 1198714 - RNA, 12 nt, Human
ccaggcaggucu

SEQ ID NO: 1198715 - RNA, 24 nt, Human
ccagccccuucugacccaugcugc

SEQ ID NO: 1198716 - RNA, 23 nt, Human
ccagccccuucugacccaugcug

SEQ ID NO: 1198717 - RNA, 18 nt, Human
ccagccccauccucugua

SEQ ID NO: 1198718 - RNA, 17 nt, Human
ccagccccauccucugu

SEQ ID NO: 1198719 - RNA, 15 nt, Human
ccagccccauccucu

SEQ ID NO: 1198720 - RNA, 17 nt, Human
ccagccccagugcccac

SEQ ID NO: 1198721 - RNA, 14 nt, Human
ccagcagagcaccu

SEQ ID NO: 1198722 - RNA, 13 nt, Human
ccagcagagcacc

SEQ ID NO: 1198723 - RNA, 12 nt, Human
ccagcagagcac

SEQ ID NO: 1198724 - RNA, 12 nt, Human
ccagcagaaaug

SEQ ID NO: 1198725 - RNA, 15 nt, Human
ccccugacaacacuc

SEQ ID NO: 1198726 - RNA, 16 nt, Human
ccccugccacccuggg

SEQ ID NO: 1198727 - RNA, 14 nt, Human
ccccugccacccug

SEQ ID NO: 1198728 - RNA, 22 nt, Human
cccgaauagcugggacuacagg

SEQ ID NO: 1198729 - RNA, 18 nt, Human
cccgaauagcugggacua

SEQ ID NO: 1198730 - RNA, 17 nt, Human
cccgaauagcugggacu

SEQ ID NO: 1198731 - RNA, 16 nt, Human
ccccuucugacccaug

SEQ ID NO: 1198732 - RNA, 14 nt, Human
ccccuucugaccca

SEQ ID NO: 1198733 - RNA, 13 nt, Human
ccccuucugaccc

SEQ ID NO: 1198734 - RNA, 16 nt, Human
cccggccccugcuggu

SEQ ID NO: 1198735 - RNA, 15 nt, Human
cccggccccugcugg

SEQ ID NO: 1198736 - RNA, 15 nt, Human
cccgggaagggggcu

SEQ ID NO: 1198737 - RNA, 11 nt, Human
cccggcuccag

SEQ ID NO: 1198738 - RNA, 16 nt, Human
cccucaacaccucugc

SEQ ID NO: 1198739 - RNA, 22 nt, Human
cccgggaagggggcugggacau

SEQ ID NO: 1198740 - RNA, 21 nt, Human
cccgggaagggggcugggaca

SEQ ID NO: 1198741 - RNA, 18 nt, Human
cccgggaagggggcuggg

SEQ ID NO: 1198742 - RNA, 16 nt, Human
cccucaacucuccucc

SEQ ID NO: 1198743 - RNA, 20 nt, Human
cccucaacucuccuccagag

SEQ ID NO: 1198744 - RNA, 23 nt, Human
ccccgacccuugccgucuaccug

SEQ ID NO: 1198745 - RNA, 14 nt, Human
ccccgcacugggcu

SEQ ID NO: 1198746 - RNA, 15 nt, Human
cccauuugcuccuuu

SEQ ID NO: 1198747 - RNA, 15 nt, Human
cccauucugccugcc

SEQ ID NO: 1198748 - RNA, 14 nt, Human
cccauucugccugc

SEQ ID NO: 1198749 - RNA, 19 nt, Human
cccauucugccugcccagg

SEQ ID NO: 1198750 - RNA, 20 nt, Human
cccauucugccugcccaggc

SEQ ID NO: 1198751 - RNA, 10 nt, Human
ccccagcccc

SEQ ID NO: 1198752 - RNA, 21 nt, Human
ccccagauugcaacaggcugg

SEQ ID NO: 1198753 - RNA, 20 nt, Human
ccccagauugcaacaggcug

SEQ ID NO: 1198754 - RNA, 15 nt, Human
ccccagauugcaaca

SEQ ID NO: 1198755 - RNA, 22 nt, Human
cccauccucuguacagagccca

SEQ ID NO: 1198756 - RNA, 21 nt, Human
cccauccucuguacagagccc

SEQ ID NO: 1198757 - RNA, 22 nt, Human
cccaggcuuagucacugagaca

SEQ ID NO: 1198758 - RNA, 18 nt, Human
cccaggaaaggcuccagg

SEQ ID NO: 1198759 - RNA, 17 nt, Human
cccaggaaaggcuccag

SEQ ID NO: 1198760 - RNA, 19 nt, Human
cccaggaaaggcuccagga

SEQ ID NO: 1198761 - RNA, 16 nt, Human
cccaggaaaggcucca

SEQ ID NO: 1198762 - RNA, 12 nt, Human
caccucagccuc

SEQ ID NO: 1198763 - RNA, 14 nt, Human
caccuuugaagaag

SEQ ID NO: 1198764 - RNA, 14 nt, Human
caccuuucccaucu

SEQ ID NO: 1198765 - RNA, 16 nt, Human
caccuuggcugcaggg

SEQ ID NO: 1198766 - RNA, 15 nt, Human
caccuuggcugcagg

SEQ ID NO: 1198767 - RNA, 18 nt, Human
caccuuggcugcagggag

SEQ ID NO: 1198768 - RNA, 14 nt, Human
cacuccagccuggg

SEQ ID NO: 1198769 - RNA, 13 nt, Human
cacuccagccugg

SEQ ID NO: 1198770 - RNA, 21 nt, Human
cacuacauucuguuaaucauu

SEQ ID NO: 1198771 - RNA, 17 nt, Human
cacuacauucuguuaau

SEQ ID NO: 1198772 - RNA, 16 nt, Human
cacuacauucuguuaa

SEQ ID NO: 1198773 - RNA, 21 nt, Human
cacuacauuauaaaugucucu

SEQ ID NO: 1198774 - RNA, 15 nt, Human
cacggcucacugcag

SEQ ID NO: 1198775 - RNA, 14 nt, Human
cacggcucacugca

SEQ ID NO: 1198776 - RNA, 13 nt, Human
cacggccaggcca

SEQ ID NO: 1198777 - RNA, 12 nt, Human
cacggccaggcc

SEQ ID NO: 1198778 - RNA, 22 nt, Human
cacucuuauugcccacgcugga

SEQ ID NO: 1198779 - RNA, 21 nt, Human
cacucuuauugcccacgcugg

SEQ ID NO: 1198780 - RNA, 20 nt, Human
cacucuuauugcccacgcug

SEQ ID NO: 1198781 - RNA, 13 nt, Human
cacuuucuagcca

SEQ ID NO: 1198782 - RNA, 17 nt, Human
cacuuucuagccagagg

SEQ ID NO: 1198783 - RNA, 16 nt, Human
cacuuucuagccagag

SEQ ID NO: 1198784 - RNA, 18 nt, Human
cacuuucuagccagagga

SEQ ID NO: 1198785 - RNA, 18 nt, Human
cacuuguguuaugaagca

SEQ ID NO: 1198786 - RNA, 17 nt, Human
cacugccaugccagcuu

SEQ ID NO: 1198787 - RNA, 23 nt, Human
cacugcagccucaaccuccuggg

SEQ ID NO: 1198788 - RNA, 22 nt, Human
cacugcagccucaaccuccugg

SEQ ID NO: 1198789 - RNA, 21 nt, Human
cacugcagccucaaccuccug

SEQ ID NO: 1198790 - RNA, 20 nt, Human
cacugcagccucaaccuccu

SEQ ID NO: 1198791 - RNA, 19 nt, Human
cacugcagccucaaccucc

SEQ ID NO: 1198792 - RNA, 23 nt, Human
cacuguugcccaggcuggcgugc

SEQ ID NO: 1198793 - RNA, 19 nt, Human
cacuguugcccaggcuggc

SEQ ID NO: 1198794 - RNA, 18 nt, Human
cacuguugcccaggcugg

SEQ ID NO: 1198795 - RNA, 20 nt, Human
cacugggcuuggggaccaga

SEQ ID NO: 1198796 - RNA, 17 nt, Human
cagaaauguguuaucac

SEQ ID NO: 1198797 - RNA, 16 nt, Human
cagaaauguacagcaa

SEQ ID NO: 1198798 - RNA, 16 nt, Human
cagaaguuucugccgc

SEQ ID NO: 1198799 - RNA, 14 nt, Human
cagaaguuucugcc

SEQ ID NO: 1198800 - RNA, 21 nt, Human
caaggccaaaggaagcacaug

SEQ ID NO: 1198801 - RNA, 20 nt, Human
caaggccaaaggaagcacau

SEQ ID NO: 1198802 - RNA, 19 nt, Human
caaggccaaaggaagcaca

SEQ ID NO: 1198803 - RNA, 18 nt, Human
caaggcaaggcugucaau

SEQ ID NO: 1198804 - RNA, 17 nt, Human
caaggcaaggcugucaa

SEQ ID NO: 1198805 - RNA, 21 nt, Human
cacaagcuccaagcucccagg

SEQ ID NO: 1198806 - RNA, 20 nt, Human
cacaagcuccaagcucccag

SEQ ID NO: 1198807 - RNA, 19 nt, Human
cacaagcuccaagcuccca

SEQ ID NO: 1198808 - RNA, 18 nt, Human
cacaagcuccaagcuccc

SEQ ID NO: 1198809 - RNA, 20 nt, Human
cacaagagcccaggccuccu

SEQ ID NO: 1198810 - RNA, 19 nt, Human
cacaagagcccaggccucc

SEQ ID NO: 1198811 - RNA, 18 nt, Human
cacaagagcccaggccuc

SEQ ID NO: 1198812 - RNA, 15 nt, Human
caaugggagcucaug

SEQ ID NO: 1198813 - RNA, 21 nt, Human
caaugcuggcuguuggcuggg

SEQ ID NO: 1198814 - RNA, 20 nt, Human
caaugcuggcuguuggcugg

SEQ ID NO: 1198815 - RNA, 13 nt, Human
caaugcuggcugu

SEQ ID NO: 1198816 - RNA, 18 nt, Human
cacagcucuucuccaggc

SEQ ID NO: 1198817 - RNA, 17 nt, Human
cacagcucuucuccagg

SEQ ID NO: 1198818 - RNA, 15 nt, Human
cacagcucuucucca

SEQ ID NO: 1198819 - RNA, 14 nt, Human
cacagcucuucucc

SEQ ID NO: 1198820 - RNA, 19 nt, Human
cacagcucuguccugggag

SEQ ID NO: 1198821 - RNA, 18 nt, Human
cacagcucuguccuggga

SEQ ID NO: 1198822 - RNA, 16 nt, Human
cacagcucuguccugg

SEQ ID NO: 1198823 - RNA, 15 nt, Human
cacagcucuguccug

SEQ ID NO: 1198824 - RNA, 14 nt, Human
cacagcucuguccu

SEQ ID NO: 1198825 - RNA, 11 nt, Human
cacagcucugu

SEQ ID NO: 1198826 - RNA, 18 nt, Human
cacagacccugcccugug

SEQ ID NO: 1198827 - RNA, 17 nt, Human
cacagacccugcccugu

SEQ ID NO: 1198828 - RNA, 16 nt, Human
cacagacccugcccug

SEQ ID NO: 1198829 - RNA, 14 nt, Human
cacagacccugccc

SEQ ID NO: 1198830 - RNA, 20 nt, Human
cacacauuuuuuaaaugcac

SEQ ID NO: 1198831 - RNA, 19 nt, Human
cacacauuuuuuaaaugca

SEQ ID NO: 1198832 - RNA, 16 nt, Human
cacacauuuuuuaaau

SEQ ID NO: 1198833 - RNA, 12 nt, Human
cacacauuuuuu

SEQ ID NO: 1198834 - RNA, 11 nt, Human
cacacauuuuu

SEQ ID NO: 1198835 - RNA, 10 nt, Human
cacacauuuu

SEQ ID NO: 1198836 - RNA, 21 nt, Human
cacauuuuauuuuauuaugca

SEQ ID NO: 1198837 - RNA, 20 nt, Human
cacauuuuauuuuauuaugc

SEQ ID NO: 1198838 - RNA, 19 nt, Human
cacauuuuauuuuauuaug

SEQ ID NO: 1198839 - RNA, 17 nt, Human
caccaacauacucccau

SEQ ID NO: 1198840 - RNA, 16 nt, Human
caccaacgucugugcc

SEQ ID NO: 1198841 - RNA, 14 nt, Human
caccaacgucugug

SEQ ID NO: 1198842 - RNA, 16 nt, Human
cacccaggagccccga

SEQ ID NO: 1198843 - RNA, 18 nt, Human
cacccaccucagccuccc

SEQ ID NO: 1198844 - RNA, 16 nt, Human
caccagccccagugcc

SEQ ID NO: 1198845 - RNA, 13 nt, Human
caccagccccagu

SEQ ID NO: 1198846 - RNA, 18 nt, Human
auucaacagguuuuccug

SEQ ID NO: 1198847 - RNA, 19 nt, Human
auuaaaugcccagccccuu

SEQ ID NO: 1198848 - RNA, 17 nt, Human
auuaaaugcccagcccc

SEQ ID NO: 1198849 - RNA, 11 nt, Human
auuaaauuaug

SEQ ID NO: 1198850 - RNA, 16 nt, Human
auucuugcaaaguauc

SEQ ID NO: 1198851 - RNA, 15 nt, Human
auucuugcaaaguau

SEQ ID NO: 1198852 - RNA, 14 nt, Human
auucuugcaaagua

SEQ ID NO: 1198853 - RNA, 22 nt, Human
auucuucuguacgucugacagg

SEQ ID NO: 1198854 - RNA, 20 nt, Human
auucuucugcuucagccucc

SEQ ID NO: 1198855 - RNA, 19 nt, Human
auucuucugcuucagccuc

SEQ ID NO: 1198856 - RNA, 19 nt, Human
auucucuaguuugauuaaa

SEQ ID NO: 1198857 - RNA, 18 nt, Human
auucucuaguuugauuaa

SEQ ID NO: 1198858 - RNA, 17 nt, Human
auucucuaguuugauua

SEQ ID NO: 1198859 - RNA, 22 nt, Human
auucuccuuguguuacuaaguu

SEQ ID NO: 1198860 - RNA, 21 nt, Human
auucuccuuguguuacuaagu

SEQ ID NO: 1198861 - RNA, 19 nt, Human
auucuccuuguguuacuaa

SEQ ID NO: 1198862 - RNA, 18 nt, Human
auucuccuuguguuacua

SEQ ID NO: 1198863 - RNA, 21 nt, Human
auuuaaugaaagacuguacaa

SEQ ID NO: 1198864 - RNA, 20 nt, Human
auuuaaugaaagacuguaca

SEQ ID NO: 1198865 - RNA, 16 nt, Human
auuuaaugaaagacug

SEQ ID NO: 1198866 - RNA, 18 nt, Human
caacucaccccagcccca

SEQ ID NO: 1198867 - RNA, 18 nt, Human
caagaccacguuucuaaa

SEQ ID NO: 1198868 - RNA, 17 nt, Human
caagaccacguuucuaa

SEQ ID NO: 1198869 - RNA, 22 nt, Human
caagaauugaagcaggacuaaa

SEQ ID NO: 1198870 - RNA, 14 nt, Human
caacucuccuccag

SEQ ID NO: 1198871 - RNA, 18 nt, Human
caaagauauuuugcuuug

SEQ ID NO: 1198872 - RNA, 22 nt, Human
caaagcagugcaugcugucccu

SEQ ID NO: 1198873 - RNA, 21 nt, Human
caaagcagugcaugcuguccc

SEQ ID NO: 1198874 - RNA, 18 nt, Human
caaagcagugcaugcugu

SEQ ID NO: 1198875 - RNA, 16 nt, Human
caaagauauuuugcuu

SEQ ID NO: 1198876 - RNA, 14 nt, Human
caaagauauuuugc

SEQ ID NO: 1198877 - RNA, 21 nt, Human
caaaguaucccuacuguaauu

SEQ ID NO: 1198878 - RNA, 19 nt, Human
caaaguaucccuacuguaa

SEQ ID NO: 1198879 - RNA, 23 nt, Human
caaaugcuguaacuuucugaaau

SEQ ID NO: 1198880 - RNA, 14 nt, Human
auuuuuagacagag

SEQ ID NO: 1198881 - RNA, 18 nt, Human
auuuuuaagugcugcauu

SEQ ID NO: 1198882 - RNA, 16 nt, Human
auuuuuaagugcugca

SEQ ID NO: 1198883 - RNA, 19 nt, Human
auuuuuaagugcugcauuu

SEQ ID NO: 1198884 - RNA, 23 nt, Human
auuuuuuuuuccuucagugccuu

SEQ ID NO: 1198885 - RNA, 22 nt, Human
auuuuuuuuuccuucagugccu

SEQ ID NO: 1198886 - RNA, 20 nt, Human
auuuuuuuuuccuucagugc

SEQ ID NO: 1198887 - RNA, 18 nt, Human
auuuuuuuuuccuucagu

SEQ ID NO: 1198888 - RNA, 16 nt, Human
auuuuuuugagacaga

SEQ ID NO: 1198889 - RNA, 14 nt, Human
caaacccuucagug

SEQ ID NO: 1198890 - RNA, 19 nt, Human
caucaggccaggcccucug

SEQ ID NO: 1198891 - RNA, 16 nt, Human
caucaggccaggcccu

SEQ ID NO: 1198892 - RNA, 20 nt, Human
caucaggccaggcccucugc

SEQ ID NO: 1198893 - RNA, 15 nt, Human
caucaggccaggccc

SEQ ID NO: 1198894 - RNA, 21 nt, Human
cauccccuguagagugggagc

SEQ ID NO: 1198895 - RNA, 14 nt, Human
cauccccuguagag

SEQ ID NO: 1198896 - RNA, 19 nt, Human
caucccauaugccugggca

SEQ ID NO: 1198897 - RNA, 23 nt, Human
cauagcagagaaugaaagggccc

SEQ ID NO: 1198898 - RNA, 22 nt, Human
cauagcagagaaugaaagggcc

SEQ ID NO: 1198899 - RNA, 19 nt, Human
cauagcagagaaugaaagg

SEQ ID NO: 1198900 - RNA, 15 nt, Human
cagugggagcugccu

SEQ ID NO: 1198901 - RNA, 22 nt, Human
cauauucaggaagcucagggcc

SEQ ID NO: 1198902 - RNA, 20 nt, Human
cauauucaggaagcucaggg

SEQ ID NO: 1198903 - RNA, 15 nt, Human
cauauucaggaagcu

SEQ ID NO: 1198904 - RNA, 14 nt, Human
cauauucaggaagc

SEQ ID NO: 1198905 - RNA, 22 nt, Human
cauaugccugggcagaaggaag

SEQ ID NO: 1198906 - RNA, 20 nt, Human
cauaugccugggcagaagga

SEQ ID NO: 1198907 - RNA, 15 nt, Human
cauaugccugggcag

SEQ ID NO: 1198908 - RNA, 13 nt, Human
caugcugcccugu

SEQ ID NO: 1198909 - RNA, 12 nt, Human
caugcugcccug

SEQ ID NO: 1198910 - RNA, 13 nt, Human
caugcuccuggcc

SEQ ID NO: 1198911 - RNA, 16 nt, Human
caugcacgugugugca

SEQ ID NO: 1198912 - RNA, 24 nt, Human
caugauuaaccacuucagcugacu

SEQ ID NO: 1198913 - RNA, 23 nt, Human
caugauuaaccacuucagcugac

SEQ ID NO: 1198914 - RNA, 22 nt, Human
caugauuaaccacuucagcuga

SEQ ID NO: 1198915 - RNA, 23 nt, Human
caugacacgaauauugcugaugg

SEQ ID NO: 1198916 - RNA, 21 nt, Human
caugacacgaauauugcugau

SEQ ID NO: 1198917 - RNA, 23 nt, Human
caugaaguaauaugcacacauuu

SEQ ID NO: 1198918 - RNA, 22 nt, Human
caugaaguaauaugcacacauu

SEQ ID NO: 1198919 - RNA, 19 nt, Human
caugaaguaauaugcacac

SEQ ID NO: 1198920 - RNA, 15 nt, Human
caugaaguaauaugc

SEQ ID NO: 1198921 - RNA, 15 nt, Human
caugcugcccuguga

SEQ ID NO: 1198922 - RNA, 14 nt, Human
caugcugcccugug

SEQ ID NO: 1198923 - RNA, 13 nt, Human
cauguuggccagg

SEQ ID NO: 1198924 - RNA, 12 nt, Human
cauguuggccag

SEQ ID NO: 1198925 - RNA, 20 nt, Human
cauguccaagaagcccagga

SEQ ID NO: 1198926 - RNA, 19 nt, Human
cauguccaagaagcccagg

SEQ ID NO: 1198927 - RNA, 18 nt, Human
cauguccaagaagcccag

SEQ ID NO: 1198928 - RNA, 23 nt, Human
cauuaucuagauacuguaucaug

SEQ ID NO: 1198929 - RNA, 22 nt, Human
cauuaggugugacugaauuucu

SEQ ID NO: 1198930 - RNA, 12 nt, Human
cauuccuguucc

SEQ ID NO: 1198931 - RNA, 16 nt, Human
ccaaggccaaaggaag

SEQ ID NO: 1198932 - RNA, 13 nt, Human
ccaagaagcccag

SEQ ID NO: 1198933 - RNA, 16 nt, Human
ccaacgucugugccau

SEQ ID NO: 1198934 - RNA, 15 nt, Human
ccaacgucugugcca

SEQ ID NO: 1198935 - RNA, 13 nt, Human
ccaacgucugugc

SEQ ID NO: 1198936 - RNA, 22 nt, Human
ccaaauggaaaugggcagagca

SEQ ID NO: 1198937 - RNA, 19 nt, Human
ccaagcuggucccacucag

SEQ ID NO: 1198938 - RNA, 12 nt, Human
ccaagcuggucc

SEQ ID NO: 1198939 - RNA, 15 nt, Human
ccaagaagcccagga

SEQ ID NO: 1198940 - RNA, 14 nt, Human
ccaagaagcccagg

SEQ ID NO: 1198941 - RNA, 15 nt, Human
ccaaggccaaaggaa

SEQ ID NO: 1198942 - RNA, 20 nt, Human
ccaagcuggucccacucagu

SEQ ID NO: 1198943 - RNA, 16 nt, Human
cauuuuuuaaaugcac

SEQ ID NO: 1198944 - RNA, 15 nt, Human
cauuuuuuaaaugca

SEQ ID NO: 1198945 - RNA, 19 nt, Human
cauuuuuuaaaugcaccug

SEQ ID NO: 1198946 - RNA, 15 nt, Human
cauuuauucugcuca

SEQ ID NO: 1198947 - RNA, 14 nt, Human
cauuuauucugcuc

SEQ ID NO: 1198948 - RNA, 15 nt, Human
cauuuggauuggaug

SEQ ID NO: 1198949 - RNA, 17 nt, Human
cauuugucacacacuuu

SEQ ID NO: 1198950 - RNA, 22 nt, Human
ccacagagaaaguacuucucca

SEQ ID NO: 1198951 - RNA, 13 nt, Human
ccacgcccccacu

SEQ ID NO: 1198952 - RNA, 19 nt, Human
ccaccuuggcugcagggag

SEQ ID NO: 1198953 - RNA, 18 nt, Human
ccaccuuggcugcaggga

SEQ ID NO: 1198954 - RNA, 18 nt, Human
ccacgcuggaccuugaac

SEQ ID NO: 1198955 - RNA, 13 nt, Human
ccacgcuggagug

SEQ ID NO: 1198956 - RNA, 16 nt, Human
ccaccuuggcugcagg

SEQ ID NO: 1198957 - RNA, 15 nt, Human
ccaccuuggcugcag

SEQ ID NO: 1198958 - RNA, 14 nt, Human
ccaccuuggcugca

SEQ ID NO: 1198959 - RNA, 12 nt, Human
ccaccuuggcug

SEQ ID NO: 1198960 - RNA, 19 nt, Human
ccaccaucaugucuggcua

SEQ ID NO: 1198961 - RNA, 18 nt, Human
ccaccaucaugucuggcu

SEQ ID NO: 1198962 - RNA, 12 nt, Human
caggccuccuac

SEQ ID NO: 1198963 - RNA, 19 nt, Human
caggcugggcuucaguggc

SEQ ID NO: 1198964 - RNA, 17 nt, Human
caggcugggcuucagug

SEQ ID NO: 1198965 - RNA, 16 nt, Human
caggcugggcuucagu

SEQ ID NO: 1198966 - RNA, 15 nt, Human
caggcuggcgugcag

SEQ ID NO: 1198967 - RNA, 22 nt, Human
cagggaguccgaaagggacuug

SEQ ID NO: 1198968 - RNA, 18 nt, Human
cagggaggugaccccagg

SEQ ID NO: 1198969 - RNA, 18 nt, Human
caggcacccaccaucaug

SEQ ID NO: 1198970 - RNA, 23 nt, Human
caggcacccaccaucaugucugg

SEQ ID NO: 1198971 - RNA, 22 nt, Human
caggcacccaccaucaugucug

SEQ ID NO: 1198972 - RNA, 18 nt, Human
caggaggccagccuugac

SEQ ID NO: 1198973 - RNA, 17 nt, Human
caggaggccagccuuga

SEQ ID NO: 1198974 - RNA, 16 nt, Human
caggaggccagccuug

SEQ ID NO: 1198975 - RNA, 15 nt, Human
caggaggccagccuu

SEQ ID NO: 1198976 - RNA, 21 nt, Human
caggccagagggagugacaga

SEQ ID NO: 1198977 - RNA, 19 nt, Human
caggccagagggagugaca

SEQ ID NO: 1198978 - RNA, 23 nt, Human
caggccagagggagugacagagg

SEQ ID NO: 1198979 - RNA, 20 nt, Human
cagucugauucccaagcucu

SEQ ID NO: 1198980 - RNA, 19 nt, Human
cagucugauucccaagcuc

SEQ ID NO: 1198981 - RNA, 23 nt, Human
cagugcaugcugucccuuacgug

SEQ ID NO: 1198982 - RNA, 22 nt, Human
cagugcaugcugucccuuacgu

SEQ ID NO: 1198983 - RNA, 19 nt, Human
cagugcaugcugucccuua

SEQ ID NO: 1198984 - RNA, 15 nt, Human
cagugccaaaaacaa

SEQ ID NO: 1198985 - RNA, 11 nt, Human
cagugggagcu

SEQ ID NO: 1198986 - RNA, 12 nt, Human
cagugcccacag

SEQ ID NO: 1198987 - RNA, 18 nt, Human
cagguuuaagcuguuacu

SEQ ID NO: 1198988 - RNA, 16 nt, Human
cagguuuaagcuguua

SEQ ID NO: 1198989 - RNA, 21 nt, Human
cagguuggugggggccucggu

SEQ ID NO: 1198990 - RNA, 22 nt, Human
cagucaccccggccaccugcgg

SEQ ID NO: 1198991 - RNA, 20 nt, Human
cagucaccccggccaccugc

SEQ ID NO: 1198992 - RNA, 14 nt, Human
cagguugguggggg

SEQ ID NO: 1198993 - RNA, 20 nt, Human
caggugcuaggaacacuccu

SEQ ID NO: 1198994 - RNA, 18 nt, Human
caggugcuaggaacacuc

SEQ ID NO: 1198995 - RNA, 14 nt, Human
caggugcgaaagga

SEQ ID NO: 1198996 - RNA, 20 nt, Human
caggugauccacccaccuca

SEQ ID NO: 1198997 - RNA, 17 nt, Human
caggugauccacccacc

SEQ ID NO: 1198998 - RNA, 16 nt, Human
caggugauccacccac

SEQ ID NO: 1198999 - RNA, 14 nt, Human
caggguuggccccu

SEQ ID NO: 1199000 - RNA, 12 nt, Human
caggguuggccc

SEQ ID NO: 1199001 - RNA, 18 nt, Human
cagggucucacucugucg

SEQ ID NO: 1199002 - RNA, 21 nt, Human
cagggucucacucugucgccc

SEQ ID NO: 1199003 - RNA, 22 nt, Human
cagggucucacucugucgccca

SEQ ID NO: 1199004 - RNA, 13 nt, Human
cagcuccagcuca

SEQ ID NO: 1199005 - RNA, 15 nt, Human
cagcuccagcucacc

SEQ ID NO: 1199006 - RNA, 14 nt, Human
cagcuccagcucac

SEQ ID NO: 1199007 - RNA, 20 nt, Human
cagcuccagcucaccagccc

SEQ ID NO: 1199008 - RNA, 18 nt, Human
cagcuccagcucaccagc

SEQ ID NO: 1199009 - RNA, 17 nt, Human
cagcuccagcucaccag

SEQ ID NO: 1199010 - RNA, 16 nt, Human
cagcuccagcucacca

SEQ ID NO: 1199011 - RNA, 22 nt, Human
cagcuccagcucaccagcccca

SEQ ID NO: 1199012 - RNA, 15 nt, Human
caggaaaggcuccag

SEQ ID NO: 1199013 - RNA, 14 nt, Human
caggaaaggcucca

SEQ ID NO: 1199014 - RNA, 19 nt, Human
cagcuucauuuccuguguc

SEQ ID NO: 1199015 - RNA, 18 nt, Human
cagcuucauuuccugugu

SEQ ID NO: 1199016 - RNA, 15 nt, Human
cagcuucauuuccug

SEQ ID NO: 1199017 - RNA, 19 nt, Human
cagcugugcucuggacagg

SEQ ID NO: 1199018 - RNA, 18 nt, Human
cagcugugcucuggacag

SEQ ID NO: 1199019 - RNA, 21 nt, Human
cagccgagauagccaaggcca

SEQ ID NO: 1199020 - RNA, 21 nt, Human
cagccccuggaugcagccuca

SEQ ID NO: 1199021 - RNA, 19 nt, Human
cagccccuggaugcagccu

SEQ ID NO: 1199022 - RNA, 18 nt, Human
cagccccuggaugcagcc

SEQ ID NO: 1199023 - RNA, 17 nt, Human
cagccccuggaugcagc

SEQ ID NO: 1199024 - RNA, 21 nt, Human
cagcccuuagcagggaaacag

SEQ ID NO: 1199025 - RNA, 16 nt, Human
cagcccuuagcaggga

SEQ ID NO: 1199026 - RNA, 22 nt, Human
cagccccuggaugcagccucac

SEQ ID NO: 1199027 - RNA, 14 nt, Human
cagccccuggaugc

SEQ ID NO: 1199028 - RNA, 13 nt, Human
cagccccuggaug

SEQ ID NO: 1199029 - RNA, 12 nt, Human
cagccccuggau

SEQ ID NO: 1199030 - RNA, 17 nt, Human
cagcggggacagcuccu

SEQ ID NO: 1199031 - RNA, 16 nt, Human
cagcggggacagcucc

SEQ ID NO: 1199032 - RNA, 15 nt, Human
cagcggggacagcuc

SEQ ID NO: 1199033 - RNA, 23 nt, Human
cagcauauucaggaagcucaggg

SEQ ID NO: 1199034 - RNA, 22 nt, Human
cagcauauucaggaagcucagg

SEQ ID NO: 1199035 - RNA, 19 nt, Human
cagcauauucaggaagcuc

SEQ ID NO: 1199036 - RNA, 13 nt, Human
cagccaggccaca

SEQ ID NO: 1199037 - RNA, 12 nt, Human
cagccaggccac

SEQ ID NO: 1199038 - RNA, 22 nt, Human
cagccaggccacaagacccuug

SEQ ID NO: 1199039 - RNA, 20 nt, Human
cagagucagaaguuucugcc

SEQ ID NO: 1199040 - RNA, 20 nt, Human
cagaggggguggccucccaa

SEQ ID NO: 1199041 - RNA, 19 nt, Human
cagaggggguggccuccca

SEQ ID NO: 1199042 - RNA, 18 nt, Human
cagaggggguggccuccc

SEQ ID NO: 1199043 - RNA, 22 nt, Human
cagagggccugcaagggaguga

SEQ ID NO: 1199044 - RNA, 18 nt, Human
cagagcugccaccugccu

SEQ ID NO: 1199045 - RNA, 23 nt, Human
cagaaguuugagaucagccuggg

SEQ ID NO: 1199046 - RNA, 22 nt, Human
cagaaguuugagaucagccugg

SEQ ID NO: 1199047 - RNA, 20 nt, Human
cagaaguuugagaucagccu

SEQ ID NO: 1199048 - RNA, 19 nt, Human
cagaaguuucugccgcagc

SEQ ID NO: 1199049 - RNA, 20 nt, Human
ggccagugugacaaggauug

SEQ ID NO: 1199050 - RNA, 17 nt, Human
ggccaguuggucccccu

SEQ ID NO: 1199051 - RNA, 14 nt, Human
ggccaguugguccc

SEQ ID NO: 1199052 - RNA, 21 nt, Human
ggcccuucucuccagccccug

SEQ ID NO: 1199053 - RNA, 20 nt, Human
ggcccuucucuccagccccu

SEQ ID NO: 1199054 - RNA, 15 nt, Human
ggcccggcuccaggc

SEQ ID NO: 1199055 - RNA, 14 nt, Human
ggccccugcugguu

SEQ ID NO: 1199056 - RNA, 13 nt, Human
ggccccugcuggu

SEQ ID NO: 1199057 - RNA, 13 nt, Human
ggcccggcuccag

SEQ ID NO: 1199058 - RNA, 23 nt, Human
ggccccugcugguucaggguugg

SEQ ID NO: 1199059 - RNA, 23 nt, Human
ggcccuucucuccagccccugga

SEQ ID NO: 1199060 - RNA, 22 nt, Human
ggcccuucucuccagccccugg

SEQ ID NO: 1199061 - RNA, 16 nt, Human
ggagagaagagaaugc

SEQ ID NO: 1199062 - RNA, 23 nt, Human
ggcacucagaagacacugauggg

SEQ ID NO: 1199063 - RNA, 18 nt, Human
ggcacaucagcacgauuu

SEQ ID NO: 1199064 - RNA, 13 nt, Human
ggcacaucagcac

SEQ ID NO: 1199065 - RNA, 23 nt, Human
ggcacagaaaauggaagacagcu

SEQ ID NO: 1199066 - RNA, 21 nt, Human
ggcacagaaaauggaagacag

SEQ ID NO: 1199067 - RNA, 20 nt, Human
ggcacagaaaauggaagaca

SEQ ID NO: 1199068 - RNA, 11 nt, Human
ggcagccccug

SEQ ID NO: 1199069 - RNA, 21 nt, Human
ggcaguggugguuuucuguuc

SEQ ID NO: 1199070 - RNA, 20 nt, Human
ggcaguggugguuuucuguu

SEQ ID NO: 1199071 - RNA, 22 nt, Human
ggcagccccuguucuggcagag

SEQ ID NO: 1199072 - RNA, 11 nt, Human
ggcucucaggc

SEQ ID NO: 1199073 - RNA, 14 nt, Human
ggcucucaggccag

SEQ ID NO: 1199074 - RNA, 13 nt, Human
ggcucucaggcca

SEQ ID NO: 1199075 - RNA, 12 nt, Human
ggcucuuccagg

SEQ ID NO: 1199076 - RNA, 14 nt, Human
ggcucuuccaggcu

SEQ ID NO: 1199077 - RNA, 22 nt, Human
ggcugcggaaugaaccacaucu

SEQ ID NO: 1199078 - RNA, 21 nt, Human
ggcugccaaugggagcucaug

SEQ ID NO: 1199079 - RNA, 20 nt, Human
ggcugccaaugggagcucau

SEQ ID NO: 1199080 - RNA, 19 nt, Human
ggcugccaaugggagcuca

SEQ ID NO: 1199081 - RNA, 18 nt, Human
ggcugggagagccuucca

SEQ ID NO: 1199082 - RNA, 16 nt, Human
ggcugggagagccuuc

SEQ ID NO: 1199083 - RNA, 15 nt, Human
ggcugggagagccuu

SEQ ID NO: 1199084 - RNA, 14 nt, Human
ggcugggagagccu

SEQ ID NO: 1199085 - RNA, 13 nt, Human
ggcugcugaaggc

SEQ ID NO: 1199086 - RNA, 18 nt, Human
ggcucagcggggacagcu

SEQ ID NO: 1199087 - RNA, 19 nt, Human
ggcucagcaaaagaugcuu

SEQ ID NO: 1199088 - RNA, 20 nt, Human
ggcucagguggggucacucu

SEQ ID NO: 1199089 - RNA, 19 nt, Human
ggcucagguggggucacuc

SEQ ID NO: 1199090 - RNA, 20 nt, Human
ggcucagcggggacagcucc

SEQ ID NO: 1199091 - RNA, 19 nt, Human
ggcucagcggggacagcuc

SEQ ID NO: 1199092 - RNA, 13 nt, Human
gggaagagacuug

SEQ ID NO: 1199093 - RNA, 13 nt, Human
gggacagcuccuu

SEQ ID NO: 1199094 - RNA, 12 nt, Human
gggacagcuccu

SEQ ID NO: 1199095 - RNA, 16 nt, Human
gggacagcuccuucug

SEQ ID NO: 1199096 - RNA, 15 nt, Human
gggacagcuccuucu

SEQ ID NO: 1199097 - RNA, 18 nt, Human
gggaagaagcucucuccu

SEQ ID NO: 1199098 - RNA, 21 nt, Human
ggcuuccuccugguguggaag

SEQ ID NO: 1199099 - RNA, 22 nt, Human
ggcuucauccuccucagaucuu

SEQ ID NO: 1199100 - RNA, 18 nt, Human
ggcuucauccuccucaga

SEQ ID NO: 1199101 - RNA, 16 nt, Human
ggcuuccucauaguau

SEQ ID NO: 1199102 - RNA, 20 nt, Human
ggcuucaguggcagcugcuu

SEQ ID NO: 1199103 - RNA, 19 nt, Human
ggcuucaguggcagcugcu

SEQ ID NO: 1199104 - RNA, 18 nt, Human
ggcuucaguggcagcugc

SEQ ID NO: 1199105 - RNA, 18 nt, Human
ggcuguaucccaugagcc

SEQ ID NO: 1199106 - RNA, 22 nt, Human
ggcuggguucuacccaggugcu

SEQ ID NO: 1199107 - RNA, 21 nt, Human
ggcuggguucuacccaggugc

SEQ ID NO: 1199108 - RNA, 19 nt, Human
ggcuggguucuacccaggu

SEQ ID NO: 1199109 - RNA, 19 nt, Human
ggcuggguggcaccagcag

SEQ ID NO: 1199110 - RNA, 19 nt, Human
ggcugggggccucagugcc

SEQ ID NO: 1199111 - RNA, 17 nt, Human
ggcugggggccucagug

SEQ ID NO: 1199112 - RNA, 16 nt, Human
ggcugggggccucagu

SEQ ID NO: 1199113 - RNA, 15 nt, Human
ggcugggggccucag

SEQ ID NO: 1199114 - RNA, 21 nt, Human
gggagaaccaaaaagaggcua

SEQ ID NO: 1199115 - RNA, 23 nt, Human
gggacuuggaagcuccgcuuucu

SEQ ID NO: 1199116 - RNA, 18 nt, Human
gggacuuggaagcuccgc

SEQ ID NO: 1199117 - RNA, 17 nt, Human
gggacuuggaagcuccg

SEQ ID NO: 1199118 - RNA, 15 nt, Human
gggacuuggaagcuc

SEQ ID NO: 1199119 - RNA, 15 nt, Human
gggaggucgaggcag

SEQ ID NO: 1199120 - RNA, 18 nt, Human
gggaggucaaggcugcag

SEQ ID NO: 1199121 - RNA, 16 nt, Human
gggagggagggcucca

SEQ ID NO: 1199122 - RNA, 15 nt, Human
gggagggagggcucc

SEQ ID NO: 1199123 - RNA, 23 nt, Human
gggagcaggcucgggcuccccag

SEQ ID NO: 1199124 - RNA, 19 nt, Human
gggagagccuuccaggggu

SEQ ID NO: 1199125 - RNA, 15 nt, Human
gggagagccuuccag

SEQ ID NO: 1199126 - RNA, 20 nt, Human
gggaccagagcugccaccug

SEQ ID NO: 1199127 - RNA, 14 nt, Human
gggaccagagcugc

SEQ ID NO: 1199128 - RNA, 14 nt, Human
aaaacaugcuacac

SEQ ID NO: 1199129 - RNA, 13 nt, Human
aaaacaugcuaca

SEQ ID NO: 1199130 - RNA, 12 nt, Human
aaaacccaagug

SEQ ID NO: 1199131 - RNA, 15 nt, Human
aaaacaugcuacaca

SEQ ID NO: 1199132 - RNA, 14 nt, Human
aaaacguggcugcu

SEQ ID NO: 1199133 - RNA, 18 nt, Human
aaaacucuccucugcugc

SEQ ID NO: 1199134 - RNA, 22 nt, Human
aaaacuugauguguuaucucuu

SEQ ID NO: 1199135 - RNA, 11 nt, Human
guagagccagg

SEQ ID NO: 1199136 - RNA, 10 nt, Human
guagagccag

SEQ ID NO: 1199137 - RNA, 13 nt, Human
guagagacagggu

SEQ ID NO: 1199138 - RNA, 18 nt, Human
guagagccagggucucac

SEQ ID NO: 1199139 - RNA, 15 nt, Human
guagagccagggucu

SEQ ID NO: 1199140 - RNA, 12 nt, Human
guagagacaggg

SEQ ID NO: 1199141 - RNA, 11 nt, Human
guagagacagg

SEQ ID NO: 1199142 - RNA, 21 nt, Human
guagaagucuuagauguauau

SEQ ID NO: 1199143 - RNA, 18 nt, Human
guagaagcccuucuaccu

SEQ ID NO: 1199144 - RNA, 23 nt, Human
guagaaauaucugaaaauguaug

SEQ ID NO: 1199145 - RNA, 21 nt, Human
guagaaauaucugaaaaugua

SEQ ID NO: 1199146 - RNA, 20 nt, Human
guagaaauaucugaaaaugu

SEQ ID NO: 1199147 - RNA, 16 nt, Human
guacuggagaaaaugg

SEQ ID NO: 1199148 - RNA, 13 nt, Human
guacuauguauca

SEQ ID NO: 1199149 - RNA, 19 nt, Human
guacuacaguccucccauc

SEQ ID NO: 1199150 - RNA, 18 nt, Human
guacuacaguccucccau

SEQ ID NO: 1199151 - RNA, 14 nt, Human
guacccacugcucu

SEQ ID NO: 1199152 - RNA, 13 nt, Human
guacccacugcuc

SEQ ID NO: 1199153 - RNA, 17 nt, Human
guacuauguaucaauga

SEQ ID NO: 1199154 - RNA, 15 nt, Human
guacuauguaucaau

SEQ ID NO: 1199155 - RNA, 19 nt, Human
guacauggaauaacaugua

SEQ ID NO: 1199156 - RNA, 20 nt, Human
guacaugaaaacacauuuuu

SEQ ID NO: 1199157 - RNA, 19 nt, Human
guacaugaaaacacauuuu

SEQ ID NO: 1199158 - RNA, 18 nt, Human
guacaugaaaacacauuu

SEQ ID NO: 1199159 - RNA, 17 nt, Human
guacaugaaaacacauu

SEQ ID NO: 1199160 - RNA, 16 nt, Human
guacaugaaaacacau

SEQ ID NO: 1199161 - RNA, 15 nt, Human
guacaugaaaacaca

SEQ ID NO: 1199162 - RNA, 14 nt, Human
guacaugaaaacac

SEQ ID NO: 1199163 - RNA, 12 nt, Human
guacccacugcu

SEQ ID NO: 1199164 - RNA, 18 nt, Human
aaaucagccugcuccagc

SEQ ID NO: 1199165 - RNA, 12 nt, Human
aaaucagccugc

SEQ ID NO: 1199166 - RNA, 19 nt, Human
aaaucagccguguaaccau

SEQ ID NO: 1199167 - RNA, 18 nt, Human
guaauaugcacacauuuu

SEQ ID NO: 1199168 - RNA, 17 nt, Human
guaauaugcacacauuu

SEQ ID NO: 1199169 - RNA, 16 nt, Human
guaauaugcacacauu

SEQ ID NO: 1199170 - RNA, 14 nt, Human
guaauaugcacaca

SEQ ID NO: 1199171 - RNA, 18 nt, Human
aaauaccagccaguaaau

SEQ ID NO: 1199172 - RNA, 17 nt, Human
aaauacagauagauaua

SEQ ID NO: 1199173 - RNA, 21 nt, Human
guaauuuuuuuaucgucacug

SEQ ID NO: 1199174 - RNA, 18 nt, Human
aaaguaucccuacuguaa

SEQ ID NO: 1199175 - RNA, 23 nt, Human
aaaguacuucuccacccugcucu

SEQ ID NO: 1199176 - RNA, 21 nt, Human
aaaguacuucuccacccugcu

SEQ ID NO: 1199177 - RNA, 20 nt, Human
aaaguacuucuccacccugc

SEQ ID NO: 1199178 - RNA, 19 nt, Human
aaaguacuucuccacccug

SEQ ID NO: 1199179 - RNA, 13 nt, Human
gguggaugccugg

SEQ ID NO: 1199180 - RNA, 21 nt, Human
ggugcauuugaggucuguucu

SEQ ID NO: 1199181 - RNA, 16 nt, Human
ggugcaaugaccuuuc

SEQ ID NO: 1199182 - RNA, 13 nt, Human
ggugcaaugaccu

SEQ ID NO: 1199183 - RNA, 12 nt, Human
ggugcaaugacc

SEQ ID NO: 1199184 - RNA, 24 nt, Human
ggugauccacccaccucagccucc

SEQ ID NO: 1199185 - RNA, 23 nt, Human
ggugauccacccaccucagccuc

SEQ ID NO: 1199186 - RNA, 18 nt, Human
ggugauccacccaccuca

SEQ ID NO: 1199187 - RNA, 13 nt, Human
ggugaacagaaca

SEQ ID NO: 1199188 - RNA, 13 nt, Human
ggucgaggcagga

SEQ ID NO: 1199189 - RNA, 22 nt, Human
aaagggacuuggaagcuccgcu

SEQ ID NO: 1199190 - RNA, 17 nt, Human
aaaggagauuggaagga

SEQ ID NO: 1199191 - RNA, 21 nt, Human
aaaggagagcuagcagcaggg

SEQ ID NO: 1199192 - RNA, 13 nt, Human
aaagcugcugaca

SEQ ID NO: 1199193 - RNA, 15 nt, Human
aaagcucacuuuacu

SEQ ID NO: 1199194 - RNA, 14 nt, Human
ggguggccucccaa

SEQ ID NO: 1199195 - RNA, 14 nt, Human
aaagacuguacaaa

SEQ ID NO: 1199196 - RNA, 13 nt, Human
aaagacuguacaa

SEQ ID NO: 1199197 - RNA, 23 nt, Human
aaagacugaguacguugugcauu

SEQ ID NO: 1199198 - RNA, 19 nt, Human
aaagaugcuucucacugcc

SEQ ID NO: 1199199 - RNA, 17 nt, Human
aaagaugcuucucacug

SEQ ID NO: 1199200 - RNA, 14 nt, Human
gguccugcugcagu

SEQ ID NO: 1199201 - RNA, 12 nt, Human
gguccugcugca

SEQ ID NO: 1199202 - RNA, 11 nt, Human
gguccugcugc

SEQ ID NO: 1199203 - RNA, 15 nt, Human
aaacgggcucagcaa

SEQ ID NO: 1199204 - RNA, 23 nt, Human
aaaccaagucaagugaaaaagga

SEQ ID NO: 1199205 - RNA, 19 nt, Human
aaacuuaaucuaaauggaa

SEQ ID NO: 1199206 - RNA, 18 nt, Human
aaacuuaaucuaaaugga

SEQ ID NO: 1199207 - RNA, 17 nt, Human
aaacuuaaucuaaaugg

SEQ ID NO: 1199208 - RNA, 16 nt, Human
aaacuuaaucuaaaug

SEQ ID NO: 1199209 - RNA, 19 nt, Human
aaacuguuaauaguucagg

SEQ ID NO: 1199210 - RNA, 13 nt, Human
aaacucuccucug

SEQ ID NO: 1199211 - RNA, 15 nt, Human
ggggccucagugcca

SEQ ID NO: 1199212 - RNA, 18 nt, Human
gggggccucagugccacu

SEQ ID NO: 1199213 - RNA, 17 nt, Human
gggggccucagugccac

SEQ ID NO: 1199214 - RNA, 15 nt, Human
gggggccucagugcc

SEQ ID NO: 1199215 - RNA, 12 nt, Human
gggggccucagu

SEQ ID NO: 1199216 - RNA, 11 nt, Human
ggggagaaagu

SEQ ID NO: 1199217 - RNA, 13 nt, Human
ggggaccucaggc

SEQ ID NO: 1199218 - RNA, 16 nt, Human
aaacauggccuuugcu

SEQ ID NO: 1199219 - RNA, 17 nt, Human
aaacauggccuuugcuu

SEQ ID NO: 1199220 - RNA, 16 nt, Human
ggggaccagagcugcc

SEQ ID NO: 1199221 - RNA, 22 nt, Human
ggggaauguuugccucugccuc

SEQ ID NO: 1199222 - RNA, 18 nt, Human
ggggaauguuugccucug

SEQ ID NO: 1199223 - RNA, 20 nt, Human
aaaauuuugauguuuuaagg

SEQ ID NO: 1199224 - RNA, 19 nt, Human
aaaauuuagaaauauaauu

SEQ ID NO: 1199225 - RNA, 13 nt, Human
gggaugagaaagg

SEQ ID NO: 1199226 - RNA, 19 nt, Human
aaacacaaacgggcucagc

SEQ ID NO: 1199227 - RNA, 11 nt, Human
aaacacauuuu

SEQ ID NO: 1199228 - RNA, 12 nt, Human
aaacacauuuuu

SEQ ID NO: 1199229 - RNA, 13 nt, Human
gcugcuggcuggu

SEQ ID NO: 1199230 - RNA, 18 nt, Human
gcugcugaaggcucgagc

SEQ ID NO: 1199231 - RNA, 15 nt, Human
gcugcugaaggcucg

SEQ ID NO: 1199232 - RNA, 14 nt, Human
gcugcugaaggcuc

SEQ ID NO: 1199233 - RNA, 13 nt, Human
gcugcugaaggcu

SEQ ID NO: 1199234 - RNA, 23 nt, Human
gcucugguccauagagagcaaga

SEQ ID NO: 1199235 - RNA, 16 nt, Human
gcucugguccauagag

SEQ ID NO: 1199236 - RNA, 15 nt, Human
gcucugguccauaga

SEQ ID NO: 1199237 - RNA, 13 nt, Human
gcucugcccuugg

SEQ ID NO: 1199238 - RNA, 20 nt, Human
gcuggccuggccccucaggg

SEQ ID NO: 1199239 - RNA, 22 nt, Human
gcuggagugcagugagccgaga

SEQ ID NO: 1199240 - RNA, 18 nt, Human
gcuggagugcagugagcc

SEQ ID NO: 1199241 - RNA, 23 nt, Human
gcuggguggcaccagcagccugg

SEQ ID NO: 1199242 - RNA, 22 nt, Human
gcuggguggcaccagcagccug

SEQ ID NO: 1199243 - RNA, 21 nt, Human
gcuggguggcaccagcagccu

SEQ ID NO: 1199244 - RNA, 12 nt, Human
gcugggcucccu

SEQ ID NO: 1199245 - RNA, 17 nt, Human
gcuggcuguuggcuggg

SEQ ID NO: 1199246 - RNA, 16 nt, Human
gcuggcuguuggcugg

SEQ ID NO: 1199247 - RNA, 15 nt, Human
gcuggcuguuggcug

SEQ ID NO: 1199248 - RNA, 12 nt, Human
gcuucagccucc

SEQ ID NO: 1199249 - RNA, 19 nt, Human
gcuucacggaagagccuug

SEQ ID NO: 1199250 - RNA, 18 nt, Human
gcuucacggaagagccuu

SEQ ID NO: 1199251 - RNA, 17 nt, Human
gcuucacggaagagccu

SEQ ID NO: 1199252 - RNA, 21 nt, Human
gcuucaaggauccugagccag

SEQ ID NO: 1199253 - RNA, 20 nt, Human
gcuucaaggauccugagcca

SEQ ID NO: 1199254 - RNA, 19 nt, Human
gcuucaaggauccugagcc

SEQ ID NO: 1199255 - RNA, 22 nt, Human
gcuuccucauaguaugguggcu

SEQ ID NO: 1199256 - RNA, 12 nt, Human
gcuuguacauaa

SEQ ID NO: 1199257 - RNA, 20 nt, Human
gcuuguaaauagcucaggug

SEQ ID NO: 1199258 - RNA, 14 nt, Human
gcuugagcucagga

SEQ ID NO: 1199259 - RNA, 12 nt, Human
ggacccccugaa

SEQ ID NO: 1199260 - RNA, 11 nt, Human
ggacccugagg

SEQ ID NO: 1199261 - RNA, 20 nt, Human
ggacguguuaugacuccaga

SEQ ID NO: 1199262 - RNA, 20 nt, Human
ggaccucaggccugggggcu

SEQ ID NO: 1199263 - RNA, 15 nt, Human
ggaccucaggccugg

SEQ ID NO: 1199264 - RNA, 14 nt, Human
ggaccucaggccug

SEQ ID NO: 1199265 - RNA, 13 nt, Human
ggaccucaggccu

SEQ ID NO: 1199266 - RNA, 13 nt, Human
ggacccugaggcc

SEQ ID NO: 1199267 - RNA, 12 nt, Human
ggacccugaggc

SEQ ID NO: 1199268 - RNA, 18 nt, Human
ggacucaaugcacugaca

SEQ ID NO: 1199269 - RNA, 16 nt, Human
ggacucaaugcacuga

SEQ ID NO: 1199270 - RNA, 15 nt, Human
ggacucaaugcacug

SEQ ID NO: 1199271 - RNA, 14 nt, Human
ggacuacaggugug

SEQ ID NO: 1199272 - RNA, 24 nt, Human
ggacuaacuugucuuuggacccug

SEQ ID NO: 1199273 - RNA, 20 nt, Human
ggacuaacuugucuuuggac

SEQ ID NO: 1199274 - RNA, 16 nt, Human
ggagaaaggaagggcu

SEQ ID NO: 1199275 - RNA, 9 nt, Human
ggacuuugu

SEQ ID NO: 1199276 - RNA, 15 nt, Human
ggacuuggaagcucc

SEQ ID NO: 1199277 - RNA, 14 nt, Human
ggacuuggaagcuc

SEQ ID NO: 1199278 - RNA, 23 nt, Human
ggacaggcauguucucugaggac

SEQ ID NO: 1199279 - RNA, 14 nt, Human
ggaacacucugaga

SEQ ID NO: 1199280 - RNA, 12 nt, Human
ggaacacucuga

SEQ ID NO: 1199281 - RNA, 17 nt, Human
ggaacagacuggaagca

SEQ ID NO: 1199282 - RNA, 16 nt, Human
ggaacacucugagacu

SEQ ID NO: 1199283 - RNA, 15 nt, Human
ggaacacucugagac

SEQ ID NO: 1199284 - RNA, 15 nt, Human
ggaagagaaaaaaua

SEQ ID NO: 1199285 - RNA, 13 nt, Human
ggaagagaaaaaa

SEQ ID NO: 1199286 - RNA, 18 nt, Human
ggaagacuuuggaaagag

SEQ ID NO: 1199287 - RNA, 17 nt, Human
ggaagacuuuggaaaga

SEQ ID NO: 1199288 - RNA, 13 nt, Human
ggaagacuuugga

SEQ ID NO: 1199289 - RNA, 14 nt, Human
ggaagacagcucuu

SEQ ID NO: 1199290 - RNA, 13 nt, Human
ggaagacagcucu

SEQ ID NO: 1199291 - RNA, 20 nt, Human
ggaaggaaacccagcucugg

SEQ ID NO: 1199292 - RNA, 19 nt, Human
ggaaggaaacccagcucug

SEQ ID NO: 1199293 - RNA, 16 nt, Human
ggaaggaaacccagcu

SEQ ID NO: 1199294 - RNA, 11 nt, Human
ggaagcuccgc

SEQ ID NO: 1199295 - RNA, 23 nt, Human
ggaagcucagggccuggcucagg

SEQ ID NO: 1199296 - RNA, 15 nt, Human
ggaagcucagggccu

SEQ ID NO: 1199297 - RNA, 15 nt, Human
ggaagccgcuggggc

SEQ ID NO: 1199298 - RNA, 23 nt, Human
ggacaaggaugaucuaggaagac

SEQ ID NO: 1199299 - RNA, 22 nt, Human
ggacaaggaugaucuaggaaga

SEQ ID NO: 1199300 - RNA, 13 nt, Human
ggacaagagcagg

SEQ ID NO: 1199301 - RNA, 16 nt, Human
ggaauccagacccggc

SEQ ID NO: 1199302 - RNA, 18 nt, Human
ggaauaacauguaauuaa

SEQ ID NO: 1199303 - RNA, 20 nt, Human
ggacagcuccuucuguccua

SEQ ID NO: 1199304 - RNA, 19 nt, Human
ggacagcuccuucuguccu

SEQ ID NO: 1199305 - RNA, 22 nt, Human
ggacacuaaccacgcuggaccu

SEQ ID NO: 1199306 - RNA, 17 nt, Human
ggacacuaaccacgcug

SEQ ID NO: 1199307 - RNA, 21 nt, Human
ggacacagcucuucuccaggc

SEQ ID NO: 1199308 - RNA, 18 nt, Human
ggacacagcucuucucca

SEQ ID NO: 1199309 - RNA, 15 nt, Human
ggacacagcucuucu

SEQ ID NO: 1199310 - RNA, 11 nt, Human
gcucugcccuu

SEQ ID NO: 1199311 - RNA, 23 nt, Human
gcucugcaagaauugaagcagga

SEQ ID NO: 1199312 - RNA, 17 nt, Human
gcucugaucauccacug

SEQ ID NO: 1199313 - RNA, 20 nt, Human
gcuccuggcccacugcaucg

SEQ ID NO: 1199314 - RNA, 19 nt, Human
gcuccuggcccacugcauc

SEQ ID NO: 1199315 - RNA, 18 nt, Human
gcuccuggcccacugcau

SEQ ID NO: 1199316 - RNA, 15 nt, Human
gcuccuggcccacug

SEQ ID NO: 1199317 - RNA, 14 nt, Human
gcuccuggcccacu

SEQ ID NO: 1199318 - RNA, 17 nt, Human
gcucccaggcauucccc

SEQ ID NO: 1199319 - RNA, 18 nt, Human
gcuccagcucaccagccc

SEQ ID NO: 1199320 - RNA, 21 nt, Human
gcuccagcucaccagccccag

SEQ ID NO: 1199321 - RNA, 20 nt, Human
gcuccagcucaccagcccca

SEQ ID NO: 1199322 - RNA, 22 nt, Human
gcgggaggauguucugggacac

SEQ ID NO: 1199323 - RNA, 21 nt, Human
gcgggaggauguucugggaca

SEQ ID NO: 1199324 - RNA, 20 nt, Human
gcgugcacacaccagagccc

SEQ ID NO: 1199325 - RNA, 23 nt, Human
gcgugcacacaccagagcccacc

SEQ ID NO: 1199326 - RNA, 18 nt, Human
gcguuucuaugacacaug

SEQ ID NO: 1199327 - RNA, 15 nt, Human
gcuaaugggacacua

SEQ ID NO: 1199328 - RNA, 13 nt, Human
gcuaaugggacac

SEQ ID NO: 1199329 - RNA, 23 nt, Human
gcuaagugauccucccaccucag

SEQ ID NO: 1199330 - RNA, 12 nt, Human
gcuaugcauuug

SEQ ID NO: 1199331 - RNA, 22 nt, Human
gcuagugugguguuuccuggca

SEQ ID NO: 1199332 - RNA, 21 nt, Human
gcuagugugguguuuccuggc

SEQ ID NO: 1199333 - RNA, 19 nt, Human
gcuauucaguaauaacucu

SEQ ID NO: 1199334 - RNA, 13 nt, Human
gcuaugcauuuga

SEQ ID NO: 1199335 - RNA, 23 nt, Human
gcuaggccuggccagaugcacca

SEQ ID NO: 1199336 - RNA, 17 nt, Human
gcuaggccuggccagau

SEQ ID NO: 1199337 - RNA, 16 nt, Human
gcuaggccuggccaga

SEQ ID NO: 1199338 - RNA, 14 nt, Human
gcucagagagggug

SEQ ID NO: 1199339 - RNA, 13 nt, Human
gcucagagagggu

SEQ ID NO: 1199340 - RNA, 17 nt, Human
gcucaggugucccugca

SEQ ID NO: 1199341 - RNA, 16 nt, Human
gcucaggugucccugc

SEQ ID NO: 1199342 - RNA, 14 nt, Human
gcucaggugucccu

SEQ ID NO: 1199343 - RNA, 20 nt, Human
gcuauucaguaauaacucua

SEQ ID NO: 1199344 - RNA, 14 nt, Human
gcucacugcagccu

SEQ ID NO: 1199345 - RNA, 13 nt, Human
gcucacugcagcc

SEQ ID NO: 1199346 - RNA, 12 nt, Human
gcucacugcagc

SEQ ID NO: 1199347 - RNA, 11 nt, Human
gcucacugcag

SEQ ID NO: 1199348 - RNA, 16 nt, Human
gcucacugcagccuca

SEQ ID NO: 1199349 - RNA, 15 nt, Human
gcucacugcagccuc

SEQ ID NO: 1199350 - RNA, 17 nt, Human
gcucacugcagccucaa

SEQ ID NO: 1199351 - RNA, 18 nt, Human
gcccugcagagggcacag

SEQ ID NO: 1199352 - RNA, 22 nt, Human
gcccugcccaccuggccucugc

SEQ ID NO: 1199353 - RNA, 21 nt, Human
gcccugcccaccuggccucug

SEQ ID NO: 1199354 - RNA, 20 nt, Human
gcccugcccaccuggccucu

SEQ ID NO: 1199355 - RNA, 17 nt, Human
gcccugcccaccuggcc

SEQ ID NO: 1199356 - RNA, 11 nt, Human
gcccugccucc

SEQ ID NO: 1199357 - RNA, 20 nt, Human
gccgcagcccugcagagggc

SEQ ID NO: 1199358 - RNA, 22 nt, Human
gcccuuagcagggaaacagcua

SEQ ID NO: 1199359 - RNA, 20 nt, Human
gcccuuagcagggaaacagc

SEQ ID NO: 1199360 - RNA, 13 nt, Human
gcccugccuccuu

SEQ ID NO: 1199361 - RNA, 12 nt, Human
gcccugccuccu

SEQ ID NO: 1199362 - RNA, 14 nt, Human
gcccugccuccuuu

SEQ ID NO: 1199363 - RNA, 20 nt, Human
gccuaggugacagagugaga

SEQ ID NO: 1199364 - RNA, 15 nt, Human
gccuaggugacagag

SEQ ID NO: 1199365 - RNA, 14 nt, Human
gccuaggugacaga

SEQ ID NO: 1199366 - RNA, 13 nt, Human
gccuaggugacag

SEQ ID NO: 1199367 - RNA, 23 nt, Human
gccuagcauacguacacauuuua

SEQ ID NO: 1199368 - RNA, 22 nt, Human
gccuagcauacguacacauuuu

SEQ ID NO: 1199369 - RNA, 21 nt, Human
gccuagcauacguacacauuu

SEQ ID NO: 1199370 - RNA, 20 nt, Human
gccuagcauacguacacauu

SEQ ID NO: 1199371 - RNA, 12 nt, Human
gcccccacuggu

SEQ ID NO: 1199372 - RNA, 17 nt, Human
gccccugccacccuggg

SEQ ID NO: 1199373 - RNA, 23 nt, Human
gcccgggcucugccucccaucac

SEQ ID NO: 1199374 - RNA, 20 nt, Human
gccuggccugagcugggaug

SEQ ID NO: 1199375 - RNA, 18 nt, Human
gccuggccugagcuggga

SEQ ID NO: 1199376 - RNA, 14 nt, Human
gccuggccugagcu

SEQ ID NO: 1199377 - RNA, 13 nt, Human
gccuggccugagc

SEQ ID NO: 1199378 - RNA, 20 nt, Human
gccuguugggccaggagccu

SEQ ID NO: 1199379 - RNA, 18 nt, Human
gccuguugggccaggagc

SEQ ID NO: 1199380 - RNA, 16 nt, Human
gccuguugggccagga

SEQ ID NO: 1199381 - RNA, 15 nt, Human
gccuguugggccagg

SEQ ID NO: 1199382 - RNA, 14 nt, Human
gccuguugggccag

SEQ ID NO: 1199383 - RNA, 19 nt, Human
gccugugccucugggacug

SEQ ID NO: 1199384 - RNA, 18 nt, Human
gccugugccucugggacu

SEQ ID NO: 1199385 - RNA, 17 nt, Human
gccugugccucugggac

SEQ ID NO: 1199386 - RNA, 16 nt, Human
gccugugccucuggga

SEQ ID NO: 1199387 - RNA, 13 nt, Human
gccuggcucaggu

SEQ ID NO: 1199388 - RNA, 20 nt, Human
gcgcagcauauucaggaagc

SEQ ID NO: 1199389 - RNA, 22 nt, Human
gcgaucuggguucacugcaacc

SEQ ID NO: 1199390 - RNA, 17 nt, Human
gcgagcccugguggcag

SEQ ID NO: 1199391 - RNA, 21 nt, Human
gccuugaccauucuccaccug

SEQ ID NO: 1199392 - RNA, 20 nt, Human
gccuugaccauucuccaccu

SEQ ID NO: 1199393 - RNA, 19 nt, Human
gccuugaccauucuccacc

SEQ ID NO: 1199394 - RNA, 17 nt, Human
gccuugaccauucucca

SEQ ID NO: 1199395 - RNA, 21 nt, Human
gccuguugggccaggagccuc

SEQ ID NO: 1199396 - RNA, 22 nt, Human
gccugcccaggccccugccacc

SEQ ID NO: 1199397 - RNA, 17 nt, Human
gccugcccaggccccug

SEQ ID NO: 1199398 - RNA, 15 nt, Human
gccugcccaggcccc

SEQ ID NO: 1199399 - RNA, 17 nt, Human
gccucgaacuggcugca

SEQ ID NO: 1199400 - RNA, 23 nt, Human
gccuccugugugugcgccuacag

SEQ ID NO: 1199401 - RNA, 19 nt, Human
gccuccugugugugcgccu

SEQ ID NO: 1199402 - RNA, 17 nt, Human
gccucccaaagugcugg

SEQ ID NO: 1199403 - RNA, 16 nt, Human
gccucccaaagugcug

SEQ ID NO: 1199404 - RNA, 22 nt, Human
gccucgaacuggcugcaaaggg

SEQ ID NO: 1199405 - RNA, 20 nt, Human
gccucgaacuggcugcaaag

SEQ ID NO: 1199406 - RNA, 18 nt, Human
gccucuuaugggcugggu

SEQ ID NO: 1199407 - RNA, 17 nt, Human
gccucuuaugggcuggg

SEQ ID NO: 1199408 - RNA, 16 nt, Human
gccucuuaugggcugg

SEQ ID NO: 1199409 - RNA, 14 nt, Human
gccugcccaggccc

SEQ ID NO: 1199410 - RNA, 13 nt, Human
gccugcccaggcc

SEQ ID NO: 1199411 - RNA, 21 nt, Human
gccucuuaugggcuggguucu

SEQ ID NO: 1199412 - RNA, 14 nt, Human
gccucuuggguuca

SEQ ID NO: 1199413 - RNA, 19 nt, Human
gcacacaccagagcccacc

SEQ ID NO: 1199414 - RNA, 18 nt, Human
gcacacaccagagcccac

SEQ ID NO: 1199415 - RNA, 17 nt, Human
gcacacaccagagccca

SEQ ID NO: 1199416 - RNA, 16 nt, Human
gcacacaccagagccc

SEQ ID NO: 1199417 - RNA, 15 nt, Human
gcacacaccagagcc

SEQ ID NO: 1199418 - RNA, 14 nt, Human
gcacacaccagagc

SEQ ID NO: 1199419 - RNA, 12 nt, Human
gcacacaccaga

SEQ ID NO: 1199420 - RNA, 21 nt, Human
gcaauaaagcagcguuucuau

SEQ ID NO: 1199421 - RNA, 11 nt, Human
gcaauaaagca

SEQ ID NO: 1199422 - RNA, 19 nt, Human
gcaaccuccgccucuuggg

SEQ ID NO: 1199423 - RNA, 18 nt, Human
gcaaccuccgccucuugg

SEQ ID NO: 1199424 - RNA, 22 nt, Human
gcaacccuggugaccagcacca

SEQ ID NO: 1199425 - RNA, 18 nt, Human
gcaacccccagccugcua

SEQ ID NO: 1199426 - RNA, 17 nt, Human
gcaaaagaugcuucuca

SEQ ID NO: 1199427 - RNA, 16 nt, Human
gcaaaagaugcuucuc

SEQ ID NO: 1199428 - RNA, 15 nt, Human
gcaaaagaugcuucu

SEQ ID NO: 1199429 - RNA, 22 nt, Human
gcacuauagccuaggugacaga

SEQ ID NO: 1199430 - RNA, 12 nt, Human
gcacuccccugc

SEQ ID NO: 1199431 - RNA, 17 nt, Human
gcacuccagccugggug

SEQ ID NO: 1199432 - RNA, 12 nt, Human
gcaccuccugcc

SEQ ID NO: 1199433 - RNA, 18 nt, Human
gcaccggcuggccuggcc

SEQ ID NO: 1199434 - RNA, 17 nt, Human
gcaccggcuggccuggc

SEQ ID NO: 1199435 - RNA, 16 nt, Human
gcaccggcuggccugg

SEQ ID NO: 1199436 - RNA, 15 nt, Human
gcaccggcuggccug

SEQ ID NO: 1199437 - RNA, 14 nt, Human
gcacacauuuuuua

SEQ ID NO: 1199438 - RNA, 12 nt, Human
gcacacauuuuu

SEQ ID NO: 1199439 - RNA, 11 nt, Human
gcacacauuuu

SEQ ID NO: 1199440 - RNA, 20 nt, Human
gcacacaccagagcccaccu

SEQ ID NO: 1199441 - RNA, 19 nt, Human
gauucuccugccucagccu

SEQ ID NO: 1199442 - RNA, 21 nt, Human
gauucuccugccucagccucc

SEQ ID NO: 1199443 - RNA, 20 nt, Human
gauucuccugccucagccuc

SEQ ID NO: 1199444 - RNA, 23 nt, Human
gauuuaacagaaauguacagcaa

SEQ ID NO: 1199445 - RNA, 20 nt, Human
gauuuaacagaaauguacag

SEQ ID NO: 1199446 - RNA, 21 nt, Human
gauucuucugcuucagccucc

SEQ ID NO: 1199447 - RNA, 23 nt, Human
gauucuuauggacaaugacccag

SEQ ID NO: 1199448 - RNA, 23 nt, Human
gauuuuuuuuuccuucagugccu

SEQ ID NO: 1199449 - RNA, 22 nt, Human
gauuuuuuuuuccuucagugcc

SEQ ID NO: 1199450 - RNA, 16 nt, Human
gauuucacucuccuug

SEQ ID NO: 1199451 - RNA, 13 nt, Human
gauuucacucucc

SEQ ID NO: 1199452 - RNA, 12 nt, Human
gauucuuuccug

SEQ ID NO: 1199453 - RNA, 18 nt, Human
gauuucacucuccuuggu

SEQ ID NO: 1199454 - RNA, 17 nt, Human
gauuucacucuccuugg

SEQ ID NO: 1199455 - RNA, 23 nt, Human
gaugcuucucacugccaugccag

SEQ ID NO: 1199456 - RNA, 16 nt, Human
gaugcuuguacauaau

SEQ ID NO: 1199457 - RNA, 14 nt, Human
gaugcuuguacaua

SEQ ID NO: 1199458 - RNA, 20 nt, Human
gaucuggguucacugcaacc

SEQ ID NO: 1199459 - RNA, 18 nt, Human
gaucuggguucacugcaa

SEQ ID NO: 1199460 - RNA, 22 nt, Human
gaguugauagcacagacccugc

SEQ ID NO: 1199461 - RNA, 16 nt, Human
gcacuuuguucuggcu

SEQ ID NO: 1199462 - RNA, 16 nt, Human
gcagcuugaggguugg

SEQ ID NO: 1199463 - RNA, 20 nt, Human
gcagcugcuuuugucuaugg

SEQ ID NO: 1199464 - RNA, 13 nt, Human
gcagcugcuuuug

SEQ ID NO: 1199465 - RNA, 23 nt, Human
gcagcugcgguccacccaggagc

SEQ ID NO: 1199466 - RNA, 22 nt, Human
gcagcugcgguccacccaggag

SEQ ID NO: 1199467 - RNA, 16 nt, Human
gcaggcucucaggcca

SEQ ID NO: 1199468 - RNA, 15 nt, Human
gcaggcucucaggcc

SEQ ID NO: 1199469 - RNA, 14 nt, Human
gcaggcucucaggc

SEQ ID NO: 1199470 - RNA, 13 nt, Human
gcaggcucucagg

SEQ ID NO: 1199471 - RNA, 12 nt, Human
gcaggcucucag

SEQ ID NO: 1199472 - RNA, 22 nt, Human
gcaggcucgggcuccccagccc

SEQ ID NO: 1199473 - RNA, 21 nt, Human
gcagcuugaggguugggcugg

SEQ ID NO: 1199474 - RNA, 19 nt, Human
gcagcuugaggguugggcu

SEQ ID NO: 1199475 - RNA, 18 nt, Human
gcaggcucucaggccagc

SEQ ID NO: 1199476 - RNA, 17 nt, Human
gcaggcucucaggccag

SEQ ID NO: 1199477 - RNA, 22 nt, Human
gcagggaaacagcuaaugggac

SEQ ID NO: 1199478 - RNA, 16 nt, Human
gcauaccacuuuuguu

SEQ ID NO: 1199479 - RNA, 15 nt, Human
gcauaccacuuuugu

SEQ ID NO: 1199480 - RNA, 15 nt, Human
gcauaaaaauuagcc

SEQ ID NO: 1199481 - RNA, 23 nt, Human
gcaguugccagucaccccggcca

SEQ ID NO: 1199482 - RNA, 14 nt, Human
gcaguugccaguca

SEQ ID NO: 1199483 - RNA, 19 nt, Human
gccaaggccaaaggaagca

SEQ ID NO: 1199484 - RNA, 17 nt, Human
gccaaggccaaaggaag

SEQ ID NO: 1199485 - RNA, 11 nt, Human
gccaaggccaa

SEQ ID NO: 1199486 - RNA, 15 nt, Human
gcauuuaaaagauac

SEQ ID NO: 1199487 - RNA, 12 nt, Human
gcauuuaaaaga

SEQ ID NO: 1199488 - RNA, 16 nt, Human
gcauuugaaaauuuug

SEQ ID NO: 1199489 - RNA, 14 nt, Human
gcauuugaaaauuu

SEQ ID NO: 1199490 - RNA, 18 nt, Human
gccaagaauucuuaaaua

SEQ ID NO: 1199491 - RNA, 14 nt, Human
gccaagaauucuua

SEQ ID NO: 1199492 - RNA, 21 nt, Human
gcauccuggcacccggccccu

SEQ ID NO: 1199493 - RNA, 17 nt, Human
gcauccuggcacccggc

SEQ ID NO: 1199494 - RNA, 23 nt, Human
gcauccuggcacccggccccugc

SEQ ID NO: 1199495 - RNA, 22 nt, Human
gcauccuggcacccggccccug

SEQ ID NO: 1199496 - RNA, 19 nt, Human
gcaugggaaugaaugucag

SEQ ID NO: 1199497 - RNA, 16 nt, Human
gcaugggaaugaaugu

SEQ ID NO: 1199498 - RNA, 18 nt, Human
gcaugugaugagaggaaa

SEQ ID NO: 1199499 - RNA, 17 nt, Human
gcaugugaugagaggaa

SEQ ID NO: 1199500 - RNA, 20 nt, Human
gagcugccuguucagcucca

SEQ ID NO: 1199501 - RNA, 19 nt, Human
gagcugccuguucagcucc

SEQ ID NO: 1199502 - RNA, 16 nt, Human
gagcugccuguucagc

SEQ ID NO: 1199503 - RNA, 17 nt, Human
gagcggagaaaggaagg

SEQ ID NO: 1199504 - RNA, 13 nt, Human
gagccuuccaggg

SEQ ID NO: 1199505 - RNA, 12 nt, Human
gagccuuccagg

SEQ ID NO: 1199506 - RNA, 22 nt, Human
gagcaucaggccaggcccucug

SEQ ID NO: 1199507 - RNA, 20 nt, Human
gagcaucaggccaggcccuc

SEQ ID NO: 1199508 - RNA, 12 nt, Human
gaggggaacaga

SEQ ID NO: 1199509 - RNA, 15 nt, Human
gagggcuccagacac

SEQ ID NO: 1199510 - RNA, 14 nt, Human
gagggcuccagaca

SEQ ID NO: 1199511 - RNA, 13 nt, Human
gagggcuccagac

SEQ ID NO: 1199512 - RNA, 12 nt, Human
gagggcuccaga

SEQ ID NO: 1199513 - RNA, 14 nt, Human
gaggcugccucucc

SEQ ID NO: 1199514 - RNA, 17 nt, Human
gaggcucugcccuuggu

SEQ ID NO: 1199515 - RNA, 15 nt, Human
gaggcucugcccuug

SEQ ID NO: 1199516 - RNA, 14 nt, Human
gaggcucugcccuu

SEQ ID NO: 1199517 - RNA, 13 nt, Human
gaggcucugcccu

SEQ ID NO: 1199518 - RNA, 12 nt, Human
gaggcucugccc

SEQ ID NO: 1199519 - RNA, 20 nt, Human
gaggccagagacacaagccu

SEQ ID NO: 1199520 - RNA, 21 nt, Human
gagucacuggaacacuaauga

SEQ ID NO: 1199521 - RNA, 14 nt, Human
gagucacuggaaca

SEQ ID NO: 1199522 - RNA, 18 nt, Human
gaggugggauccuccagg

SEQ ID NO: 1199523 - RNA, 17 nt, Human
gaggugggauccuccag

SEQ ID NO: 1199524 - RNA, 16 nt, Human
gaggugggauccucca

SEQ ID NO: 1199525 - RNA, 15 nt, Human
gaggugggauccucc

SEQ ID NO: 1199526 - RNA, 21 nt, Human
gaguugauagcacagacccug

SEQ ID NO: 1199527 - RNA, 22 nt, Human
gaguugauacuacaguuuguua

SEQ ID NO: 1199528 - RNA, 19 nt, Human
gaguugauacuacaguuug

SEQ ID NO: 1199529 - RNA, 18 nt, Human
gagugccuuacacaaugg

SEQ ID NO: 1199530 - RNA, 18 nt, Human
gagugcagugagccgaga

SEQ ID NO: 1199531 - RNA, 24 nt, Human
gagugagcacuaaggugugcucug

SEQ ID NO: 1199532 - RNA, 18 nt, Human
gagugagacucugucuca

SEQ ID NO: 1199533 - RNA, 14 nt, Human
gagugagacucugu

SEQ ID NO: 1199534 - RNA, 18 nt, Human
gagucagaaguuucugcc

SEQ ID NO: 1199535 - RNA, 15 nt, Human
gaccaucccugaagg

SEQ ID NO: 1199536 - RNA, 16 nt, Human
gacccuauugcugcuu

SEQ ID NO: 1199537 - RNA, 13 nt, Human
gacccggcugcgu

SEQ ID NO: 1199538 - RNA, 12 nt, Human
gacccggcugcg

SEQ ID NO: 1199539 - RNA, 18 nt, Human
gaccaucccugaaggccc

SEQ ID NO: 1199540 - RNA, 17 nt, Human
gaccaucccugaaggcc

SEQ ID NO: 1199541 - RNA, 16 nt, Human
gaccaucccugaaggc

SEQ ID NO: 1199542 - RNA, 16 nt, Human
gaccauucuccaccug

SEQ ID NO: 1199543 - RNA, 17 nt, Human
gaccauucuccaccugc

SEQ ID NO: 1199544 - RNA, 16 nt, Human
gacagcuccuucuguc

SEQ ID NO: 1199545 - RNA, 15 nt, Human
gacagcuccuucugu

SEQ ID NO: 1199546 - RNA, 14 nt, Human
gacagcuccuucug

SEQ ID NO: 1199547 - RNA, 13 nt, Human
gacagcuccuucu

SEQ ID NO: 1199548 - RNA, 17 nt, Human
gagaagcggcuggcagc

SEQ ID NO: 1199549 - RNA, 23 nt, Human
gacuuuucuguccgagcuuugaa

SEQ ID NO: 1199550 - RNA, 21 nt, Human
gacuuuucuguccgagcuuug

SEQ ID NO: 1199551 - RNA, 22 nt, Human
gacuuuguuaguuucuccaagc

SEQ ID NO: 1199552 - RNA, 14 nt, Human
gacuuuggaaagag

SEQ ID NO: 1199553 - RNA, 14 nt, Human
gacuuuggaaagac

SEQ ID NO: 1199554 - RNA, 18 nt, Human
gacuguuuucucuugaga

SEQ ID NO: 1199555 - RNA, 16 nt, Human
gacuguuuucucuuga

SEQ ID NO: 1199556 - RNA, 17 nt, Human
gacucaaugcacugaca

SEQ ID NO: 1199557 - RNA, 14 nt, Human
gacucaaugcacug

SEQ ID NO: 1199558 - RNA, 22 nt, Human
gacuguacaaaguagaagucuu

SEQ ID NO: 1199559 - RNA, 15 nt, Human
gacgcugugcugccc

SEQ ID NO: 1199560 - RNA, 13 nt, Human
gacgcugugcugc

SEQ ID NO: 1199561 - RNA, 12 nt, Human
gacgcugugcug

SEQ ID NO: 1199562 - RNA, 22 nt, Human
gaaccaccacacccagcccacu

SEQ ID NO: 1199563 - RNA, 21 nt, Human
gaaccaccacacccagcccac

SEQ ID NO: 1199564 - RNA, 20 nt, Human
gaaccaccacacccagccca

SEQ ID NO: 1199565 - RNA, 18 nt, Human
gaaccaccacacccagcc

SEQ ID NO: 1199566 - RNA, 14 nt, Human
gaagcacaugccuc

SEQ ID NO: 1199567 - RNA, 22 nt, Human
gaagcacaugccucucucaggc

SEQ ID NO: 1199568 - RNA, 14 nt, Human
gaagcacagcuuca

SEQ ID NO: 1199569 - RNA, 13 nt, Human
gaagcacagcuuc

SEQ ID NO: 1199570 - RNA, 18 nt, Human
gaagacucauucuucugu

SEQ ID NO: 1199571 - RNA, 17 nt, Human
gaagacucauucuucug

SEQ ID NO: 1199572 - RNA, 16 nt, Human
gaagacucauucuucu

SEQ ID NO: 1199573 - RNA, 16 nt, Human
gaagcaccauaacuuu

SEQ ID NO: 1199574 - RNA, 13 nt, Human
gaagacagcucuu

SEQ ID NO: 1199575 - RNA, 12 nt, Human
gaagacagcucu

SEQ ID NO: 1199576 - RNA, 15 nt, Human
gaagacagagcuaca

SEQ ID NO: 1199577 - RNA, 13 nt, Human
gaagacagagcua

SEQ ID NO: 1199578 - RNA, 21 nt, Human
gaagacacugaugggcaaccc

SEQ ID NO: 1199579 - RNA, 16 nt, Human
gaagacacugaugggc

SEQ ID NO: 1199580 - RNA, 15 nt, Human
gaagacagcucuuau

SEQ ID NO: 1199581 - RNA, 14 nt, Human
gaagacagcucuua

SEQ ID NO: 1199582 - RNA, 22 nt, Human
gaaccauggucggaaaacaugc

SEQ ID NO: 1199583 - RNA, 23 nt, Human
gaaccaccacacccagcccacuu

SEQ ID NO: 1199584 - RNA, 15 nt, Human
gaacuccuggccuca

SEQ ID NO: 1199585 - RNA, 14 nt, Human
gaacuccuggccuc

SEQ ID NO: 1199586 - RNA, 13 nt, Human
gaacuccuggccu

SEQ ID NO: 1199587 - RNA, 13 nt, Human
gaaagggcccaga

SEQ ID NO: 1199588 - RNA, 16 nt, Human
gaaaggcuccaggagc

SEQ ID NO: 1199589 - RNA, 15 nt, Human
gaaaggcuccaggag

SEQ ID NO: 1199590 - RNA, 14 nt, Human
gaaaggcuccagga

SEQ ID NO: 1199591 - RNA, 13 nt, Human
gaaaggcuccagg

SEQ ID NO: 1199592 - RNA, 17 nt, Human
gaaacuggauuaaacuu

SEQ ID NO: 1199593 - RNA, 13 nt, Human
gaaacuggauuaa

SEQ ID NO: 1199594 - RNA, 16 nt, Human
gaaagggcccagagag

SEQ ID NO: 1199595 - RNA, 15 nt, Human
gaaagggcccagaga

SEQ ID NO: 1199596 - RNA, 23 nt, Human
gaaaagaaaaaugagccuggcaa

SEQ ID NO: 1199597 - RNA, 24 nt, Human
cuuggauuguccccgacccuugcc

SEQ ID NO: 1199598 - RNA, 23 nt, Human
cuuggauuguccccgacccuugc

SEQ ID NO: 1199599 - RNA, 12 nt, Human
cuugcaaaguau

SEQ ID NO: 1199600 - RNA, 12 nt, Human
cuugauucauaa

SEQ ID NO: 1199601 - RNA, 18 nt, Human
cuugauguguuaucucuu

SEQ ID NO: 1199602 - RNA, 22 nt, Human
cuugauauccucuuugagugaa

SEQ ID NO: 1199603 - RNA, 16 nt, Human
cuugacaucaacugca

SEQ ID NO: 1199604 - RNA, 18 nt, Human
cuugaauuguaaggaaug

SEQ ID NO: 1199605 - RNA, 15 nt, Human
cuucugacccaugcu

SEQ ID NO: 1199606 - RNA, 18 nt, Human
cuucuucagagacuccug

SEQ ID NO: 1199607 - RNA, 14 nt, Human
cuucuucagagacu

SEQ ID NO: 1199608 - RNA, 13 nt, Human
cuucuucagagac

SEQ ID NO: 1199609 - RNA, 13 nt, Human
cuuccuccuggug

SEQ ID NO: 1199610 - RNA, 22 nt, Human
cuuccucuuuccaucuacccuc

SEQ ID NO: 1199611 - RNA, 20 nt, Human
cuuucagccaagaauucuua

SEQ ID NO: 1199612 - RNA, 20 nt, Human
cuuucacccuuuucuguuug

SEQ ID NO: 1199613 - RNA, 15 nt, Human
cuuucacccuuuucu

SEQ ID NO: 1199614 - RNA, 14 nt, Human
cuuucacccuuuuc

SEQ ID NO: 1199615 - RNA, 13 nt, Human
cuuguggacacag

SEQ ID NO: 1199616 - RNA, 19 nt, Human
cuugucuuuggacccugag

SEQ ID NO: 1199617 - RNA, 18 nt, Human
cuugucuuuggacccuga

SEQ ID NO: 1199618 - RNA, 15 nt, Human
cuugucuuuggaccc

SEQ ID NO: 1199619 - RNA, 13 nt, Human
cuugucuuuggac

SEQ ID NO: 1199620 - RNA, 20 nt, Human
cuuggugucgggcaugacac

SEQ ID NO: 1199621 - RNA, 19 nt, Human
cuuggugucgggcaugaca

SEQ ID NO: 1199622 - RNA, 15 nt, Human
cuugguccugcugca

SEQ ID NO: 1199623 - RNA, 14 nt, Human
cuugguccugcugc

SEQ ID NO: 1199624 - RNA, 22 nt, Human
cuugguagaagcccuucuaccu

SEQ ID NO: 1199625 - RNA, 21 nt, Human
cuuuuauaaacuuuaccuuuu

SEQ ID NO: 1199626 - RNA, 20 nt, Human
cuuuuauaaacuuuaccuuu

SEQ ID NO: 1199627 - RNA, 22 nt, Human
cuuuguauucucuccuguaccu

SEQ ID NO: 1199628 - RNA, 17 nt, Human
cuuuguauucucuccug

SEQ ID NO: 1199629 - RNA, 18 nt, Human
cuuugacgccaucccagc

SEQ ID NO: 1199630 - RNA, 17 nt, Human
cuuugacgccaucccag

SEQ ID NO: 1199631 - RNA, 16 nt, Human
cuuugacgccauccca

SEQ ID NO: 1199632 - RNA, 17 nt, Human
cuuucuacccagcgagc

SEQ ID NO: 1199633 - RNA, 16 nt, Human
cuuucuacccagcgag

SEQ ID NO: 1199634 - RNA, 15 nt, Human
cuuucuacccagcga

SEQ ID NO: 1199635 - RNA, 21 nt, Human
cugcugacuguuuucucuuga

SEQ ID NO: 1199636 - RNA, 18 nt, Human
cugcugacuguuuucucu

SEQ ID NO: 1199637 - RNA, 17 nt, Human
cugcuaucaaagagguu

SEQ ID NO: 1199638 - RNA, 20 nt, Human
cugccuguucagcuccagcu

SEQ ID NO: 1199639 - RNA, 23 nt, Human
cugccuguugggccaggagccuc

SEQ ID NO: 1199640 - RNA, 22 nt, Human
cugccuguugggccaggagccu

SEQ ID NO: 1199641 - RNA, 21 nt, Human
cugccuguugggccaggagcc

SEQ ID NO: 1199642 - RNA, 19 nt, Human
cugccuguucagcuccagc

SEQ ID NO: 1199643 - RNA, 20 nt, Human
cugccuguugggccaggagc

SEQ ID NO: 1199644 - RNA, 18 nt, Human
cugccuguucagcuccag

SEQ ID NO: 1199645 - RNA, 17 nt, Human
cugccuguucagcucca

SEQ ID NO: 1199646 - RNA, 23 nt, Human
cugccucucccaucacuucccua

SEQ ID NO: 1199647 - RNA, 22 nt, Human
cugccucucccaucacuucccu

SEQ ID NO: 1199648 - RNA, 15 nt, Human
cugccucucccauca

SEQ ID NO: 1199649 - RNA, 20 nt, Human
cugcuuuugucuaugggacu

SEQ ID NO: 1199650 - RNA, 23 nt, Human
cugcuucaaggauccugagccag

SEQ ID NO: 1199651 - RNA, 22 nt, Human
cugcuucaaggauccugagcca

SEQ ID NO: 1199652 - RNA, 21 nt, Human
cugcuucaaggauccugagcc

SEQ ID NO: 1199653 - RNA, 13 nt, Human
cugcuucaaggau

SEQ ID NO: 1199654 - RNA, 12 nt, Human
cugcuucaagga

SEQ ID NO: 1199655 - RNA, 19 nt, Human
cugcuucaaauauuucccu

SEQ ID NO: 1199656 - RNA, 14 nt, Human
cugcuucaaauauu

SEQ ID NO: 1199657 - RNA, 14 nt, Human
cuggagaaaaugga

SEQ ID NO: 1199658 - RNA, 14 nt, Human
cuggaagcacagcu

SEQ ID NO: 1199659 - RNA, 19 nt, Human
cugcuuuuuaaagaaugcu

SEQ ID NO: 1199660 - RNA, 21 nt, Human
cugcuuuugucuaugggacuc

SEQ ID NO: 1199661 - RNA, 18 nt, Human
cuggcagaguugaagaca

SEQ ID NO: 1199662 - RNA, 17 nt, Human
cuggcagaguugaagac

SEQ ID NO: 1199663 - RNA, 13 nt, Human
cuggcagccccug

SEQ ID NO: 1199664 - RNA, 12 nt, Human
cuggcagccccu

SEQ ID NO: 1199665 - RNA, 11 nt, Human
cuggcagccca

SEQ ID NO: 1199666 - RNA, 19 nt, Human
cuggcagaguugaagacag

SEQ ID NO: 1199667 - RNA, 11 nt, Human
cugggacacag

SEQ ID NO: 1199668 - RNA, 22 nt, Human
cuggccccucagggucccuggu

SEQ ID NO: 1199669 - RNA, 14 nt, Human
cuggccuagcauac

SEQ ID NO: 1199670 - RNA, 16 nt, Human
cugggcagaaggaaga

SEQ ID NO: 1199671 - RNA, 15 nt, Human
cugggcagaaggaag

SEQ ID NO: 1199672 - RNA, 12 nt, Human
cugggcagaagg

SEQ ID NO: 1199673 - RNA, 20 nt, Human
cuggguucacugcaaccucc

SEQ ID NO: 1199674 - RNA, 18 nt, Human
cuggguucacugcaaccu

SEQ ID NO: 1199675 - RNA, 14 nt, Human
cuguuggcuggggg

SEQ ID NO: 1199676 - RNA, 22 nt, Human
cuguuggcugggggccucagug

SEQ ID NO: 1199677 - RNA, 19 nt, Human
cuguuggcugggggccuca

SEQ ID NO: 1199678 - RNA, 13 nt, Human
cuuaaauaaugug

SEQ ID NO: 1199679 - RNA, 14 nt, Human
cuuaaaacaacacu

SEQ ID NO: 1199680 - RNA, 15 nt, Human
cuuaccagcagagca

SEQ ID NO: 1199681 - RNA, 13 nt, Human
cuuacacaauggu

SEQ ID NO: 1199682 - RNA, 21 nt, Human
cuuagggaaggauacaaaagc

SEQ ID NO: 1199683 - RNA, 19 nt, Human
cuuagggaaggauacaaaa

SEQ ID NO: 1199684 - RNA, 16 nt, Human
cuuaccagcagagcac

SEQ ID NO: 1199685 - RNA, 22 nt, Human
cuuagcucauucuccuuguguu

SEQ ID NO: 1199686 - RNA, 23 nt, Human
cuuagcucauucuccuuguguua

SEQ ID NO: 1199687 - RNA, 16 nt, Human
cugucgcccagucugg

SEQ ID NO: 1199688 - RNA, 23 nt, Human
cugucaauuacaggaaguacugg

SEQ ID NO: 1199689 - RNA, 20 nt, Human
cugucaauuacaggaaguac

SEQ ID NO: 1199690 - RNA, 22 nt, Human
cuggugacaugucuuuucuugc

SEQ ID NO: 1199691 - RNA, 13 nt, Human
cuguagaguggga

SEQ ID NO: 1199692 - RNA, 14 nt, Human
cugugcugcccugc

SEQ ID NO: 1199693 - RNA, 13 nt, Human
cugugcugcccug

SEQ ID NO: 1199694 - RNA, 12 nt, Human
cugugcugcccu

SEQ ID NO: 1199695 - RNA, 19 nt, Human
cugugucagcauagaagua

SEQ ID NO: 1199696 - RNA, 17 nt, Human
cugugucagcauagaag

SEQ ID NO: 1199697 - RNA, 21 nt, Human
cugugcugcccugcccaccug

SEQ ID NO: 1199698 - RNA, 19 nt, Human
cugugcugcccugcccacc

SEQ ID NO: 1199699 - RNA, 18 nt, Human
cugugcugcccugcccac

SEQ ID NO: 1199700 - RNA, 17 nt, Human
cugugcugcccugccca

SEQ ID NO: 1199701 - RNA, 15 nt, Human
cugugcugcccugcc

SEQ ID NO: 1199702 - RNA, 13 nt, Human
auucaggaagcuc

SEQ ID NO: 1199703 - RNA, 22 nt, Human
auuccccacccugaaagcccug

SEQ ID NO: 1199704 - RNA, 13 nt, Human
auucagacagcug

SEQ ID NO: 1199705 - RNA, 12 nt, Human
auucagacagcu

SEQ ID NO: 1199706 - RNA, 11 nt, Human
auucagacagc

SEQ ID NO: 1199707 - RNA, 17 nt, Human
auucagacagcugccug

SEQ ID NO: 1199708 - RNA, 16 nt, Human
auucagacagcugccu

SEQ ID NO: 1199709 - RNA, 15 nt, Human
auucagacagcugcc

SEQ ID NO: 1199710 - RNA, 14 nt, Human
auucagacagcugc

SEQ ID NO: 1199711 - RNA, 18 nt, Human
auucagacagcugccugg

SEQ ID NO: 1199712 - RNA, 12 nt, Human
auucaggaagcu

SEQ ID NO: 1199713 - RNA, 18 nt, Human
auuaucuagauacuguau

SEQ ID NO: 1199714 - RNA, 14 nt, Human
auuaucuagauacu

SEQ ID NO: 1199715 - RNA, 19 nt, Human
auucagacagcugccuggg

SEQ ID NO: 1199716 - RNA, 20 nt, Human
auugaaaucuuuuugcuuug

SEQ ID NO: 1199717 - RNA, 18 nt, Human
auugaaaucuuuuugcuu

SEQ ID NO: 1199718 - RNA, 17 nt, Human
auugaaaucuuuuugcu

SEQ ID NO: 1199719 - RNA, 15 nt, Human
auugaaaaaccauuu

SEQ ID NO: 1199720 - RNA, 13 nt, Human
auucuuccucccu

SEQ ID NO: 1199721 - RNA, 14 nt, Human
auucuuaaauaugu

SEQ ID NO: 1199722 - RNA, 21 nt, Human
auucuguuggccagugugaca

SEQ ID NO: 1199723 - RNA, 19 nt, Human
auucuguuggccaguguga

SEQ ID NO: 1199724 - RNA, 14 nt, Human
auucuguuggccag

SEQ ID NO: 1199725 - RNA, 22 nt, Human
auucugcucacauaucugucau

SEQ ID NO: 1199726 - RNA, 21 nt, Human
auucugcucacauaucuguca

SEQ ID NO: 1199727 - RNA, 20 nt, Human
auucugcucacauaucuguc

SEQ ID NO: 1199728 - RNA, 19 nt, Human
auucugcucacauaucugu

SEQ ID NO: 1199729 - RNA, 18 nt, Human
auucugcucacauaucug

SEQ ID NO: 1199730 - RNA, 21 nt, Human
auucugccugcccaggccccu

SEQ ID NO: 1199731 - RNA, 20 nt, Human
auucugccugcccaggcccc

SEQ ID NO: 1199732 - RNA, 19 nt, Human
auucugccugcccaggccc

SEQ ID NO: 1199733 - RNA, 18 nt, Human
auucugccugcccaggcc

SEQ ID NO: 1199734 - RNA, 17 nt, Human
auucugccugcccaggc

SEQ ID NO: 1199735 - RNA, 16 nt, Human
auucugccugcccagg

SEQ ID NO: 1199736 - RNA, 15 nt, Human
auucugccugcccag

SEQ ID NO: 1199737 - RNA, 14 nt, Human
auucugccugccca

SEQ ID NO: 1199738 - RNA, 13 nt, Human
auucugccugccc

SEQ ID NO: 1199739 - RNA, 11 nt, Human
auucugccugc

SEQ ID NO: 1199740 - RNA, 17 nt, Human
auucucauuugucacac

SEQ ID NO: 1199741 - RNA, 21 nt, Human
auuuuucuuagggaaggauac

SEQ ID NO: 1199742 - RNA, 21 nt, Human
auuuuguuuuugucuuaaaaa

SEQ ID NO: 1199743 - RNA, 22 nt, Human
auuuuucuuagggaaggauaca

SEQ ID NO: 1199744 - RNA, 19 nt, Human
auuuuuguagagccagggu

SEQ ID NO: 1199745 - RNA, 12 nt, Human
auuuuuguaauu

SEQ ID NO: 1199746 - RNA, 14 nt, Human
auuuuuuaaaugca

SEQ ID NO: 1199747 - RNA, 13 nt, Human
auuuuuuaaaugc

SEQ ID NO: 1199748 - RNA, 21 nt, Human
auuuugcugucccuuuuccuu

SEQ ID NO: 1199749 - RNA, 20 nt, Human
auuuugcuaaaugugaauga

SEQ ID NO: 1199750 - RNA, 17 nt, Human
auuuugauguuuuaagg

SEQ ID NO: 1199751 - RNA, 15 nt, Human
auuuugauguuuuaa

SEQ ID NO: 1199752 - RNA, 19 nt, Human
auuuugauccaagcugguc

SEQ ID NO: 1199753 - RNA, 16 nt, Human
auuuuccugccaggca

SEQ ID NO: 1199754 - RNA, 19 nt, Human
auuuucccuauuagagaag

SEQ ID NO: 1199755 - RNA, 19 nt, Human
auuuugugcccccauguaa

SEQ ID NO: 1199756 - RNA, 23 nt, Human
auuuugucauauaagauucauau

SEQ ID NO: 1199757 - RNA, 20 nt, Human
auuuuggaaaauaaauuauu

SEQ ID NO: 1199758 - RNA, 19 nt, Human
auuuuggaaaauaaauuau

SEQ ID NO: 1199759 - RNA, 14 nt, Human
auuuuggaaaauaa

SEQ ID NO: 1199760 - RNA, 20 nt, Human
auuuugcuuugugauuuuug

SEQ ID NO: 1199761 - RNA, 18 nt, Human
auuuugcuuugugauuuu

SEQ ID NO: 1199762 - RNA, 12 nt, Human
auuuugcuuugu

SEQ ID NO: 1199763 - RNA, 22 nt, Human
auuuuaaaaauacagauagaua

SEQ ID NO: 1199764 - RNA, 23 nt, Human
auuucuuccacaagagcccaggc

SEQ ID NO: 1199765 - RNA, 20 nt, Human
auuucuuccacaagagccca

SEQ ID NO: 1199766 - RNA, 16 nt, Human
auuugaaaauuuugau

SEQ ID NO: 1199767 - RNA, 19 nt, Human
auuucccaaagcagugcau

SEQ ID NO: 1199768 - RNA, 14 nt, Human
auuuauuuaaauuu

SEQ ID NO: 1199769 - RNA, 12 nt, Human
auuuauuuaaau

SEQ ID NO: 1199770 - RNA, 21 nt, Human
auugauuuccguuaaaauacc

SEQ ID NO: 1199771 - RNA, 17 nt, Human
auuuaaaagauacaguu

SEQ ID NO: 1199772 - RNA, 16 nt, Human
auuuaaaagauacagu

SEQ ID NO: 1199773 - RNA, 14 nt, Human
auuuaaaagauaca

SEQ ID NO: 1199774 - RNA, 14 nt, Human
auugugggaagggg

SEQ ID NO: 1199775 - RNA, 13 nt, Human
auugugggaaggg

SEQ ID NO: 1199776 - RNA, 23 nt, Human
auugucaaaguggugagaggcau

SEQ ID NO: 1199777 - RNA, 20 nt, Human
augggcuggguucuacccag

SEQ ID NO: 1199778 - RNA, 18 nt, Human
augggccuccugugugug

SEQ ID NO: 1199779 - RNA, 15 nt, Human
augggggugcauuug

SEQ ID NO: 1199780 - RNA, 24 nt, Human
auggggcugcaccggcuggccugg

SEQ ID NO: 1199781 - RNA, 13 nt, Human
auggggcccugcc

SEQ ID NO: 1199782 - RNA, 14 nt, Human
augggggugcauuu

SEQ ID NO: 1199783 - RNA, 18 nt, Human
augggcaacccccagccu

SEQ ID NO: 1199784 - RNA, 15 nt, Human
augggauccuggagu

SEQ ID NO: 1199785 - RNA, 19 nt, Human
uuucuggcuaugcauuuga

SEQ ID NO: 1199786 - RNA, 18 nt, Human
uuucuggcuaugcauuug

SEQ ID NO: 1199787 - RNA, 16 nt, Human
uuucuggcuaugcauu

SEQ ID NO: 1199788 - RNA, 15 nt, Human
uuucuggcuaugcau

SEQ ID NO: 1199789 - RNA, 19 nt, Human
uuucugcagccacuauugu

SEQ ID NO: 1199790 - RNA, 21 nt, Human
uuucugcagccacuauuguua

SEQ ID NO: 1199791 - RNA, 14 nt, Human
augguuuucuugug

SEQ ID NO: 1199792 - RNA, 16 nt, Human
augguuuucaaaauaa

SEQ ID NO: 1199793 - RNA, 15 nt, Human
augguuuucaaaaua

SEQ ID NO: 1199794 - RNA, 14 nt, Human
augguuuucaaaau

SEQ ID NO: 1199795 - RNA, 17 nt, Human
augguggcuggguugga

SEQ ID NO: 1199796 - RNA, 15 nt, Human
augguggcuggguug

SEQ ID NO: 1199797 - RNA, 13 nt, Human
augguggcugggu

SEQ ID NO: 1199798 - RNA, 12 nt, Human
augguggcuggg

SEQ ID NO: 1199799 - RNA, 19 nt, Human
auggugcaaugaccuuuca

SEQ ID NO: 1199800 - RNA, 17 nt, Human
auggugcaaugaccuuu

SEQ ID NO: 1199801 - RNA, 16 nt, Human
auggugcaaugaccuu

SEQ ID NO: 1199802 - RNA, 15 nt, Human
auggugcaaugaccu

SEQ ID NO: 1199803 - RNA, 13 nt, Human
auggugcaaugac

SEQ ID NO: 1199804 - RNA, 12 nt, Human
auggugcaauga

SEQ ID NO: 1199805 - RNA, 20 nt, Human
augggugcuuggaggaagga

SEQ ID NO: 1199806 - RNA, 20 nt, Human
auggugagggauacccaucc

SEQ ID NO: 1199807 - RNA, 15 nt, Human
augggugcuuggagg

SEQ ID NO: 1199808 - RNA, 16 nt, Human
augugaugagaggaaa

SEQ ID NO: 1199809 - RNA, 19 nt, Human
augugaugagaggaaauca

SEQ ID NO: 1199810 - RNA, 17 nt, Human
augugaugagaggaaau

SEQ ID NO: 1199811 - RNA, 23 nt, Human
augucucuuuaaugucacaggca

SEQ ID NO: 1199812 - RNA, 23 nt, Human
augugcacaugcacgugugugca

SEQ ID NO: 1199813 - RNA, 16 nt, Human
auguauguguaaguau

SEQ ID NO: 1199814 - RNA, 15 nt, Human
augucagugugacug

SEQ ID NO: 1199815 - RNA, 13 nt, Human
augucagugugac

SEQ ID NO: 1199816 - RNA, 12 nt, Human
augucaguguga

SEQ ID NO: 1199817 - RNA, 18 nt, Human
uuugaccucugcagcaau

SEQ ID NO: 1199818 - RNA, 12 nt, Human
uuugaccucugc

SEQ ID NO: 1199819 - RNA, 13 nt, Human
uuugccucugccu

SEQ ID NO: 1199820 - RNA, 15 nt, Human
uuugccguuauuaaa

SEQ ID NO: 1199821 - RNA, 22 nt, Human
uuugauucagacagcugccugg

SEQ ID NO: 1199822 - RNA, 21 nt, Human
uuugauucagacagcugccug

SEQ ID NO: 1199823 - RNA, 23 nt, Human
uuugauuaaauucuugcaaagua

SEQ ID NO: 1199824 - RNA, 21 nt, Human
uuugauuaaauucuugcaaag

SEQ ID NO: 1199825 - RNA, 18 nt, Human
uuugauuaaauucuugca

SEQ ID NO: 1199826 - RNA, 13 nt, Human
uuugauuaaauuc

SEQ ID NO: 1199827 - RNA, 22 nt, Human
uuugauguucuuucacccuuuu

SEQ ID NO: 1199828 - RNA, 20 nt, Human
uuugacgccaucccagcccc

SEQ ID NO: 1199829 - RNA, 19 nt, Human
uuugacgccaucccagccc

SEQ ID NO: 1199830 - RNA, 16 nt, Human
uuugacgccaucccag

SEQ ID NO: 1199831 - RNA, 14 nt, Human
uuugacgccauccc

SEQ ID NO: 1199832 - RNA, 13 nt, Human
uuugacgccaucc

SEQ ID NO: 1199833 - RNA, 18 nt, Human
augcagccucacaguccu

SEQ ID NO: 1199834 - RNA, 12 nt, Human
uuuaauucaguu

SEQ ID NO: 1199835 - RNA, 23 nt, Human
augcagugguaugaucacggcuc

SEQ ID NO: 1199836 - RNA, 20 nt, Human
augcgugcauaccacuuuug

SEQ ID NO: 1199837 - RNA, 15 nt, Human
augcccagccccuuc

SEQ ID NO: 1199838 - RNA, 14 nt, Human
augcccagccccuu

SEQ ID NO: 1199839 - RNA, 13 nt, Human
augcccagccccu

SEQ ID NO: 1199840 - RNA, 12 nt, Human
augcccagcccc

SEQ ID NO: 1199841 - RNA, 13 nt, Human
uuuaaagaaugcu

SEQ ID NO: 1199842 - RNA, 21 nt, Human
augcacuuuguucuggcucuu

SEQ ID NO: 1199843 - RNA, 20 nt, Human
augcacuuuguucuggcucu

SEQ ID NO: 1199844 - RNA, 19 nt, Human
augcacuuuguucuggcuc

SEQ ID NO: 1199845 - RNA, 17 nt, Human
augcacuuuguucuggc

SEQ ID NO: 1199846 - RNA, 14 nt, Human
augcaccuggaaua

SEQ ID NO: 1199847 - RNA, 13 nt, Human
augcaccuggaau

SEQ ID NO: 1199848 - RNA, 22 nt, Human
augcaccagcccuuagcaggga

SEQ ID NO: 1199849 - RNA, 20 nt, Human
augaucuaggaagacuuugg

SEQ ID NO: 1199850 - RNA, 17 nt, Human
augaucuaggaagacuu

SEQ ID NO: 1199851 - RNA, 20 nt, Human
uuguguuacuaaguuuuuau

SEQ ID NO: 1199852 - RNA, 15 nt, Human
uuguguuacuaaguu

SEQ ID NO: 1199853 - RNA, 13 nt, Human
uuguguuacuaag

SEQ ID NO: 1199854 - RNA, 21 nt, Human
uuguuccacaaguuaaauaaa

SEQ ID NO: 1199855 - RNA, 13 nt, Human
uuguguucaccuu

SEQ ID NO: 1199856 - RNA, 13 nt, Human
augcuucucacug

SEQ ID NO: 1199857 - RNA, 22 nt, Human
uuucaaacuuuacuauggcccu

SEQ ID NO: 1199858 - RNA, 16 nt, Human
uuucaaacuuuacuau

SEQ ID NO: 1199859 - RNA, 12 nt, Human
auggacuuuguu

SEQ ID NO: 1199860 - RNA, 11 nt, Human
auggacuuugu

SEQ ID NO: 1199861 - RNA, 18 nt, Human
uuuccaugaguccccugu

SEQ ID NO: 1199862 - RNA, 17 nt, Human
uuuccaugaguccccug

SEQ ID NO: 1199863 - RNA, 19 nt, Human
augggagagaagagaaugc

SEQ ID NO: 1199864 - RNA, 15 nt, Human
augggagagaagaga

SEQ ID NO: 1199865 - RNA, 18 nt, Human
auggcuaauguacugcau

SEQ ID NO: 1199866 - RNA, 20 nt, Human
aucaggccaggcccucugcc

SEQ ID NO: 1199867 - RNA, 15 nt, Human
aucagcacgauuucu

SEQ ID NO: 1199868 - RNA, 18 nt, Human
aucaggccaggcccucug

SEQ ID NO: 1199869 - RNA, 16 nt, Human
aucaggccaggcccuc

SEQ ID NO: 1199870 - RNA, 15 nt, Human
aucaggccaggcccu

SEQ ID NO: 1199871 - RNA, 13 nt, Human
aucagcacgauuu

SEQ ID NO: 1199872 - RNA, 12 nt, Human
aucagaauucuc

SEQ ID NO: 1199873 - RNA, 11 nt, Human
aucagaauucu

SEQ ID NO: 1199874 - RNA, 16 nt, Human
uucuagcauggcugcc

SEQ ID NO: 1199875 - RNA, 21 nt, Human
uucuaaaucuccaaaauaaaa

SEQ ID NO: 1199876 - RNA, 21 nt, Human
uucuaaaggcuaccuuuguau

SEQ ID NO: 1199877 - RNA, 20 nt, Human
uucuaaaggcuaccuuugua

SEQ ID NO: 1199878 - RNA, 19 nt, Human
uucgcuccugugucuugca

SEQ ID NO: 1199879 - RNA, 15 nt, Human
uucgcuccugugucu

SEQ ID NO: 1199880 - RNA, 18 nt, Human
uuccugaagaauugaaaa

SEQ ID NO: 1199881 - RNA, 14 nt, Human
uuccugaaccgaug

SEQ ID NO: 1199882 - RNA, 22 nt, Human
uuccucuuuccaucuacccucc

SEQ ID NO: 1199883 - RNA, 17 nt, Human
uuccucuuuccaucuac

SEQ ID NO: 1199884 - RNA, 13 nt, Human
uuccucuuuccau

SEQ ID NO: 1199885 - RNA, 16 nt, Human
uuccguuaaaauacca

SEQ ID NO: 1199886 - RNA, 14 nt, Human
uuccguuaaaauac

SEQ ID NO: 1199887 - RNA, 20 nt, Human
uucccucaccuuucccaucu

SEQ ID NO: 1199888 - RNA, 19 nt, Human
aucacggcucacugcagcc

SEQ ID NO: 1199889 - RNA, 18 nt, Human
aucacggcucacugcagc

SEQ ID NO: 1199890 - RNA, 15 nt, Human
aucacggcucacugc

SEQ ID NO: 1199891 - RNA, 14 nt, Human
aucacgccacugca

SEQ ID NO: 1199892 - RNA, 13 nt, Human
aucacgccacugc

SEQ ID NO: 1199893 - RNA, 14 nt, Human
aucaaugaguaaca

SEQ ID NO: 1199894 - RNA, 11 nt, Human
uuccugugucu

SEQ ID NO: 1199895 - RNA, 16 nt, Human
auccuccucagaucuu

SEQ ID NO: 1199896 - RNA, 16 nt, Human
auccuaggcauuugcu

SEQ ID NO: 1199897 - RNA, 12 nt, Human
auccuaagcuau

SEQ ID NO: 1199898 - RNA, 21 nt, Human
auccuaagcuauucaguaaua

SEQ ID NO: 1199899 - RNA, 15 nt, Human
uucuucugcuucagc

SEQ ID NO: 1199900 - RNA, 13 nt, Human
uucuucugcuuca

SEQ ID NO: 1199901 - RNA, 14 nt, Human
uucuucucccucag

SEQ ID NO: 1199902 - RNA, 13 nt, Human
uucuucucccuca

SEQ ID NO: 1199903 - RNA, 23 nt, Human
aucccucauccucauacccaccc

SEQ ID NO: 1199904 - RNA, 21 nt, Human
aucccucauccucauacccac

SEQ ID NO: 1199905 - RNA, 14 nt, Human
aucccucauccuca

SEQ ID NO: 1199906 - RNA, 13 nt, Human
aucccaugagccu

SEQ ID NO: 1199907 - RNA, 24 nt, Human
aucccauaugccugggcagaagga

SEQ ID NO: 1199908 - RNA, 20 nt, Human
uucuucugcuucagccuccc

SEQ ID NO: 1199909 - RNA, 21 nt, Human
auccaguaucuugaagacuuu

SEQ ID NO: 1199910 - RNA, 20 nt, Human
aucccaaacccuucagugcc

SEQ ID NO: 1199911 - RNA, 19 nt, Human
aucccaaacccuucagugc

SEQ ID NO: 1199912 - RNA, 18 nt, Human
aucccauaugccugggca

SEQ ID NO: 1199913 - RNA, 16 nt, Human
auccaguaucuugaag

SEQ ID NO: 1199914 - RNA, 16 nt, Human
auccacccaccucagc

SEQ ID NO: 1199915 - RNA, 15 nt, Human
auccacccaccucag

SEQ ID NO: 1199916 - RNA, 13 nt, Human
auccacccaccuc

SEQ ID NO: 1199917 - RNA, 21 nt, Human
auccaagcuggucccacucag

SEQ ID NO: 1199918 - RNA, 18 nt, Human
auccaagcuggucccacu

SEQ ID NO: 1199919 - RNA, 23 nt, Human
uucugaacuuggcgcugccccug

SEQ ID NO: 1199920 - RNA, 15 nt, Human
uucugccauauucug

SEQ ID NO: 1199921 - RNA, 22 nt, Human
uucugaacuuggcgcugccccu

SEQ ID NO: 1199922 - RNA, 19 nt, Human
uucugaacuuggcgcugcc

SEQ ID NO: 1199923 - RNA, 17 nt, Human
uucuggcucuuccaggc

SEQ ID NO: 1199924 - RNA, 16 nt, Human
uucuggcucuuccagg

SEQ ID NO: 1199925 - RNA, 21 nt, Human
uucugccugcccaggccccug

SEQ ID NO: 1199926 - RNA, 18 nt, Human
uucugccugcccaggccc

SEQ ID NO: 1199927 - RNA, 21 nt, Human
uucuccuuguguuacuaaguu

SEQ ID NO: 1199928 - RNA, 14 nt, Human
aucaggugcugcca

SEQ ID NO: 1199929 - RNA, 20 nt, Human
uucucuaguuugauuaaauu

SEQ ID NO: 1199930 - RNA, 17 nt, Human
uucucuaguuugauuaa

SEQ ID NO: 1199931 - RNA, 15 nt, Human
uucucuaguuugauu

SEQ ID NO: 1199932 - RNA, 14 nt, Human
uugauuaaauucuu

SEQ ID NO: 1199933 - RNA, 13 nt, Human
uugauuaaauucu

SEQ ID NO: 1199934 - RNA, 23 nt, Human
uugauguuuuaaggaugcuugua

SEQ ID NO: 1199935 - RNA, 23 nt, Human
aucugaaaauguauguguaagua

SEQ ID NO: 1199936 - RNA, 18 nt, Human
uugcaccacugcacucca

SEQ ID NO: 1199937 - RNA, 16 nt, Human
uugcaccacugcacuc

SEQ ID NO: 1199938 - RNA, 15 nt, Human
uugcaccacugcacu

SEQ ID NO: 1199939 - RNA, 19 nt, Human
uugcaauggcagccuuggc

SEQ ID NO: 1199940 - RNA, 17 nt, Human
uugcaauggcagccuug

SEQ ID NO: 1199941 - RNA, 16 nt, Human
uugcaauggcagccuu

SEQ ID NO: 1199942 - RNA, 21 nt, Human
aucuccaaaauaaaacuuuuu

SEQ ID NO: 1199943 - RNA, 20 nt, Human
aucuccaaaauaaaacuuuu

SEQ ID NO: 1199944 - RNA, 17 nt, Human
aucuccaaaauaaaacu

SEQ ID NO: 1199945 - RNA, 14 nt, Human
aucuccaaaauaaa

SEQ ID NO: 1199946 - RNA, 16 nt, Human
aucucagggccugguc

SEQ ID NO: 1199947 - RNA, 22 nt, Human
aucugaaaauguauguguaagu

SEQ ID NO: 1199948 - RNA, 20 nt, Human
aucugaaaauguauguguaa

SEQ ID NO: 1199949 - RNA, 19 nt, Human
aucugaaaauguaugugua

SEQ ID NO: 1199950 - RNA, 16 nt, Human
aucugaaaauguaugu

SEQ ID NO: 1199951 - RNA, 14 nt, Human
aucugaaaauguau

SEQ ID NO: 1199952 - RNA, 18 nt, Human
aucucuugagccugggag

SEQ ID NO: 1199953 - RNA, 15 nt, Human
aucucuugagccugg

SEQ ID NO: 1199954 - RNA, 15 nt, Human
aucucccccagcccc

SEQ ID NO: 1199955 - RNA, 17 nt, Human
aucucccccagccccau

SEQ ID NO: 1199956 - RNA, 16 nt, Human
aucucccccagcccca

SEQ ID NO: 1199957 - RNA, 21 nt, Human
aucucccccagccccauccuc

SEQ ID NO: 1199958 - RNA, 20 nt, Human
aucuaauauguaacaagcca

SEQ ID NO: 1199959 - RNA, 18 nt, Human
aucuaauauguaacaagc

SEQ ID NO: 1199960 - RNA, 15 nt, Human
uugauacuacaguuu

SEQ ID NO: 1199961 - RNA, 20 nt, Human
uugaguugauucagcucugc

SEQ ID NO: 1199962 - RNA, 11 nt, Human
uugagugccuu

SEQ ID NO: 1199963 - RNA, 20 nt, Human
uugagugaagcugggagaac

SEQ ID NO: 1199964 - RNA, 16 nt, Human
uugagaucagccuggg

SEQ ID NO: 1199965 - RNA, 19 nt, Human
aucuaaauggaaccacucu

SEQ ID NO: 1199966 - RNA, 18 nt, Human
aucuaaauggaaccacuc

SEQ ID NO: 1199967 - RNA, 17 nt, Human
aucuaaauggaaccacu

SEQ ID NO: 1199968 - RNA, 13 nt, Human
aucuaaauggaac

SEQ ID NO: 1199969 - RNA, 17 nt, Human
auccucuguacagagcc

SEQ ID NO: 1199970 - RNA, 16 nt, Human
auccucuguacagagc

SEQ ID NO: 1199971 - RNA, 23 nt, Human
aucugugaaaggaaagagggagg

SEQ ID NO: 1199972 - RNA, 18 nt, Human
aucugugaaaggaaagag

SEQ ID NO: 1199973 - RNA, 20 nt, Human
aucuuggucagauuugaacu

SEQ ID NO: 1199974 - RNA, 13 nt, Human
aucuugcucugcu

SEQ ID NO: 1199975 - RNA, 17 nt, Human
aucugugaaaggaaaga

SEQ ID NO: 1199976 - RNA, 17 nt, Human
aucuggugacuuuccuc

SEQ ID NO: 1199977 - RNA, 16 nt, Human
aucuggugacuuuccu

SEQ ID NO: 1199978 - RNA, 10 nt, Human
aucuggugac

SEQ ID NO: 1199979 - RNA, 19 nt, Human
augaaagggcccagagagg

SEQ ID NO: 1199980 - RNA, 18 nt, Human
uuggggaccagagcugcc

SEQ ID NO: 1199981 - RNA, 14 nt, Human
uuggggauauuuuu

SEQ ID NO: 1199982 - RNA, 18 nt, Human
augaaagggcccagagag

SEQ ID NO: 1199983 - RNA, 22 nt, Human
aucuuuucauuuaggugaggaa

SEQ ID NO: 1199984 - RNA, 18 nt, Human
aucuuugcagacaggcaa

SEQ ID NO: 1199985 - RNA, 17 nt, Human
aucuuugcagacaggca

SEQ ID NO: 1199986 - RNA, 18 nt, Human
uuggccccugcccggcug

SEQ ID NO: 1199987 - RNA, 16 nt, Human
uuggagggugucccaa

SEQ ID NO: 1199988 - RNA, 14 nt, Human
uugcuugaaagaaa

SEQ ID NO: 1199989 - RNA, 22 nt, Human
auaagccaaaaaaugcuugcuu

SEQ ID NO: 1199990 - RNA, 21 nt, Human
auaagauucauauuuacuucu

SEQ ID NO: 1199991 - RNA, 18 nt, Human
uuagguuggcaaaaaggc

SEQ ID NO: 1199992 - RNA, 15 nt, Human
uuaggugaggaagca

SEQ ID NO: 1199993 - RNA, 19 nt, Human
uuaggugugggggaagcac

SEQ ID NO: 1199994 - RNA, 13 nt, Human
uuauaaacuuuac

SEQ ID NO: 1199995 - RNA, 13 nt, Human
uuaguagagacag

SEQ ID NO: 1199996 - RNA, 14 nt, Human
uuaguagagacagg

SEQ ID NO: 1199997 - RNA, 17 nt, Human
uuaguagagacaggguu

SEQ ID NO: 1199998 - RNA, 19 nt, Human
uuaccagcagagcaccuua

SEQ ID NO: 1199999 - RNA, 20 nt, Human
uuacauaagauaaaugugcu

SEQ ID NO: 1200000 - RNA, 14 nt, Human
uuacaggugugaac

SEQ ID NO: 1200001 - RNA, 14 nt, Human
auaagauucauauu

SEQ ID NO: 1200002 - RNA, 16 nt, Human
uuagaagucacacagu

SEQ ID NO: 1200003 - RNA, 23 nt, Human
uuacuguacaugaaaacacauuu

SEQ ID NO: 1200004 - RNA, 22 nt, Human
uuacuguacaugaaaacacauu

SEQ ID NO: 1200005 - RNA, 14 nt, Human
uuacuguacaugaa

SEQ ID NO: 1200006 - RNA, 13 nt, Human
uuacuguacauga

SEQ ID NO: 1200007 - RNA, 12 nt, Human
uuacuguacaug

SEQ ID NO: 1200008 - RNA, 15 nt, Human
uuacugcagcuuugu

SEQ ID NO: 1200009 - RNA, 15 nt, Human
uuaaucuaaauggaa

SEQ ID NO: 1200010 - RNA, 23 nt, Human
uuaacuuuuauaaacuuuaccuu

SEQ ID NO: 1200011 - RNA, 22 nt, Human
uuaacuuuuauaaacuuuaccu

SEQ ID NO: 1200012 - RNA, 19 nt, Human
uuaagaaaaaggaugcaca

SEQ ID NO: 1200013 - RNA, 20 nt, Human
uuaaaaaucucaaauuucua

SEQ ID NO: 1200014 - RNA, 19 nt, Human
uuaaaaaucucaaauuucu

SEQ ID NO: 1200015 - RNA, 16 nt, Human
uuaacagaaauguaca

SEQ ID NO: 1200016 - RNA, 14 nt, Human
uuaacagaaaugua

SEQ ID NO: 1200017 - RNA, 13 nt, Human
uuaacagaaaugu

SEQ ID NO: 1200018 - RNA, 12 nt, Human
uuaacagaaaug

SEQ ID NO: 1200019 - RNA, 22 nt, Human
aguuuguuaguaugaggcauuu

SEQ ID NO: 1200020 - RNA, 19 nt, Human
aguuucugccgcagcccug

SEQ ID NO: 1200021 - RNA, 15 nt, Human
aguuucugccgcagc

SEQ ID NO: 1200022 - RNA, 14 nt, Human
aguuucucuuuuca

SEQ ID NO: 1200023 - RNA, 14 nt, Human
auagagagagacca

SEQ ID NO: 1200024 - RNA, 23 nt, Human
auagacaauuuauuauggcacau

SEQ ID NO: 1200025 - RNA, 22 nt, Human
auagacaauuuauuauggcaca

SEQ ID NO: 1200026 - RNA, 16 nt, Human
auagacaauuuauuau

SEQ ID NO: 1200027 - RNA, 16 nt, Human
auacucugcuuagaau

SEQ ID NO: 1200028 - RNA, 14 nt, Human
auacucccaucugu

SEQ ID NO: 1200029 - RNA, 17 nt, Human
auacuccuccaagguua

SEQ ID NO: 1200030 - RNA, 11 nt, Human
auacucccauc

SEQ ID NO: 1200031 - RNA, 12 nt, Human
uuauuaugcaug

SEQ ID NO: 1200032 - RNA, 13 nt, Human
uuauuaugcauga

SEQ ID NO: 1200033 - RNA, 22 nt, Human
uuaugggcuggguucuacccag

SEQ ID NO: 1200034 - RNA, 13 nt, Human
uuaugggcugggu

SEQ ID NO: 1200035 - RNA, 19 nt, Human
uuauggcuuuugugcauua

SEQ ID NO: 1200036 - RNA, 21 nt, Human
uuaucacccagaagaaaauag

SEQ ID NO: 1200037 - RNA, 19 nt, Human
uuaucacccagaagaaaau

SEQ ID NO: 1200038 - RNA, 18 nt, Human
uuaucacccagaagaaaa

SEQ ID NO: 1200039 - RNA, 17 nt, Human
uuaucacccagaagaaa

SEQ ID NO: 1200040 - RNA, 11 nt, Human
uuaugacucca

SEQ ID NO: 1200041 - RNA, 18 nt, Human
auacaguuacucagaauu

SEQ ID NO: 1200042 - RNA, 23 nt, Human
auacaggaaaagcugcugacagu

SEQ ID NO: 1200043 - RNA, 23 nt, Human
auacagauagauauaugcucugc

SEQ ID NO: 1200044 - RNA, 20 nt, Human
auacaguuacucagaauucu

SEQ ID NO: 1200045 - RNA, 18 nt, Human
uuauaaacuuuaccuuuu

SEQ ID NO: 1200046 - RNA, 17 nt, Human
uuauaaacuuuaccuuu

SEQ ID NO: 1200047 - RNA, 17 nt, Human
auacagaggcaacugca

SEQ ID NO: 1200048 - RNA, 16 nt, Human
auacagaggcaacugc

SEQ ID NO: 1200049 - RNA, 16 nt, Human
auacguacacauuuua

SEQ ID NO: 1200050 - RNA, 15 nt, Human
auacguacacauuuu

SEQ ID NO: 1200051 - RNA, 14 nt, Human
auacguacacauuu

SEQ ID NO: 1200052 - RNA, 13 nt, Human
auacguacacauu

SEQ ID NO: 1200053 - RNA, 14 nt, Human
auaccuuuuuuaga

SEQ ID NO: 1200054 - RNA, 17 nt, Human
auaccagccaguaaaug

SEQ ID NO: 1200055 - RNA, 18 nt, Human
auaccacuuuuguucuug

SEQ ID NO: 1200056 - RNA, 17 nt, Human
auaccacuuuuguucuu

SEQ ID NO: 1200057 - RNA, 20 nt, Human
auacuaaccagcagaaaugc

SEQ ID NO: 1200058 - RNA, 19 nt, Human
auacuaaccagcagaaaug

SEQ ID NO: 1200059 - RNA, 13 nt, Human
auacuaaccagca

SEQ ID NO: 1200060 - RNA, 11 nt, Human
uguguguuuau

SEQ ID NO: 1200061 - RNA, 20 nt, Human
ugugucuugcaauggcagcc

SEQ ID NO: 1200062 - RNA, 11 nt, Human
aguggcagcug

SEQ ID NO: 1200063 - RNA, 19 nt, Human
uguuacauaagauaaaugu

SEQ ID NO: 1200064 - RNA, 23 nt, Human
uguguuaucacccagaagaaaau

SEQ ID NO: 1200065 - RNA, 22 nt, Human
uguguuaucacccagaagaaaa

SEQ ID NO: 1200066 - RNA, 22 nt, Human
agugugguguuuccuggcacug

SEQ ID NO: 1200067 - RNA, 17 nt, Human
uguuaugacuccagaau

SEQ ID NO: 1200068 - RNA, 13 nt, Human
uguuaugacucca

SEQ ID NO: 1200069 - RNA, 19 nt, Human
uguuccacaaguuaaauaa

SEQ ID NO: 1200070 - RNA, 21 nt, Human
agugugccugaagucccagau

SEQ ID NO: 1200071 - RNA, 20 nt, Human
agugugacugaucucucgug

SEQ ID NO: 1200072 - RNA, 16 nt, Human
aguguuguggauuuaa

SEQ ID NO: 1200073 - RNA, 13 nt, Human
aguuacucagaau

SEQ ID NO: 1200074 - RNA, 20 nt, Human
aguguuguggauuuaacaga

SEQ ID NO: 1200075 - RNA, 19 nt, Human
aguguuguggauuuaacag

SEQ ID NO: 1200076 - RNA, 12 nt, Human
uguugcccaggc

SEQ ID NO: 1200077 - RNA, 23 nt, Human
uguugcccaggcuggcgugcagu

SEQ ID NO: 1200078 - RNA, 14 nt, Human
agugccaaaaacaa

SEQ ID NO: 1200079 - RNA, 16 nt, Human
agugcaugcugucccu

SEQ ID NO: 1200080 - RNA, 17 nt, Human
agugcagugagccgaga

SEQ ID NO: 1200081 - RNA, 12 nt, Human
agugaggcucug

SEQ ID NO: 1200082 - RNA, 14 nt, Human
agugaggcucugcc

SEQ ID NO: 1200083 - RNA, 13 nt, Human
agugaggcucugc

SEQ ID NO: 1200084 - RNA, 16 nt, Human
agugaggaugaaaaaa

SEQ ID NO: 1200085 - RNA, 12 nt, Human
ugugcucugauc

SEQ ID NO: 1200086 - RNA, 12 nt, Human
ugugcugcccug

SEQ ID NO: 1200087 - RNA, 19 nt, Human
ugugcugagucugaaggcu

SEQ ID NO: 1200088 - RNA, 18 nt, Human
ugugcugagucugaaggc

SEQ ID NO: 1200089 - RNA, 22 nt, Human
uguggauuuaacagaaauguac

SEQ ID NO: 1200090 - RNA, 23 nt, Human
agugagcugguuuuuagcggaga

SEQ ID NO: 1200091 - RNA, 20 nt, Human
uguggauuuaacagaaaugu

SEQ ID NO: 1200092 - RNA, 19 nt, Human
uguggauuuaacagaaaug

SEQ ID NO: 1200093 - RNA, 14 nt, Human
uguggaugauaaaa

SEQ ID NO: 1200094 - RNA, 21 nt, Human
ugugcugcccugcccaccugg

SEQ ID NO: 1200095 - RNA, 20 nt, Human
ugugcugcccugcccaccug

SEQ ID NO: 1200096 - RNA, 19 nt, Human
ugugcugcccugcccaccu

SEQ ID NO: 1200097 - RNA, 18 nt, Human
ugugcugcccugcccacc

SEQ ID NO: 1200098 - RNA, 22 nt, Human
ugugaugaugaaaugaggucag

SEQ ID NO: 1200099 - RNA, 19 nt, Human
ugugaugagaggaaaucac

SEQ ID NO: 1200100 - RNA, 12 nt, Human
agugagcugguu

SEQ ID NO: 1200101 - RNA, 22 nt, Human
agugagcacuaaggugugcucu

SEQ ID NO: 1200102 - RNA, 14 nt, Human
agugagcacuaagg

SEQ ID NO: 1200103 - RNA, 21 nt, Human
agugacugauggcuaauguac

SEQ ID NO: 1200104 - RNA, 20 nt, Human
agugaacuugggccacugug

SEQ ID NO: 1200105 - RNA, 16 nt, Human
agugaacuugggccac

SEQ ID NO: 1200106 - RNA, 23 nt, Human
agucuuagauguauauauuuccu

SEQ ID NO: 1200107 - RNA, 16 nt, Human
agucuuagauguauau

SEQ ID NO: 1200108 - RNA, 14 nt, Human
agucuuagauguau

SEQ ID NO: 1200109 - RNA, 13 nt, Human
agucuuagaugua

SEQ ID NO: 1200110 - RNA, 12 nt, Human
agucugaaggcu

SEQ ID NO: 1200111 - RNA, 17 nt, Human
agucucuugauucauaa

SEQ ID NO: 1200112 - RNA, 16 nt, Human
agucucuugauucaua

SEQ ID NO: 1200113 - RNA, 12 nt, Human
ugugaggaagcc

SEQ ID NO: 1200114 - RNA, 11 nt, Human
ugugaggaagc

SEQ ID NO: 1200115 - RNA, 19 nt, Human
aguauucuuauuuaaugaa

SEQ ID NO: 1200116 - RNA, 17 nt, Human
agucaccccggccaccu

SEQ ID NO: 1200117 - RNA, 15 nt, Human
agucaccaagcccag

SEQ ID NO: 1200118 - RNA, 15 nt, Human
aguauuacuucugcu

SEQ ID NO: 1200119 - RNA, 23 nt, Human
ugucccugcacuugcagacucua

SEQ ID NO: 1200120 - RNA, 22 nt, Human
ugucccugcacuugcagacucu

SEQ ID NO: 1200121 - RNA, 20 nt, Human
ugucccugcacuugcagacu

SEQ ID NO: 1200122 - RNA, 22 nt, Human
uguccaagaagcccaggaaagg

SEQ ID NO: 1200123 - RNA, 18 nt, Human
uguccaagaagcccagga

SEQ ID NO: 1200124 - RNA, 17 nt, Human
uguccaagaagcccagg

SEQ ID NO: 1200125 - RNA, 16 nt, Human
uguccaagaagcccag

SEQ ID NO: 1200126 - RNA, 15 nt, Human
uguccaagaagccca

SEQ ID NO: 1200127 - RNA, 14 nt, Human
uguccaagaagccc

SEQ ID NO: 1200128 - RNA, 22 nt, Human
ugucauuugagcagggcucagc

SEQ ID NO: 1200129 - RNA, 21 nt, Human
ugucauuugagcagggcucag

SEQ ID NO: 1200130 - RNA, 20 nt, Human
ugucauuugagcagggcuca

SEQ ID NO: 1200131 - RNA, 20 nt, Human
ugucagguggggcagcuuga

SEQ ID NO: 1200132 - RNA, 18 nt, Human
ugucagguggggcagcuu

SEQ ID NO: 1200133 - RNA, 17 nt, Human
ugucagguggggcagcu

SEQ ID NO: 1200134 - RNA, 23 nt, Human
agucucacuguugcccaggcugg

SEQ ID NO: 1200135 - RNA, 16 nt, Human
aguccucccaucucac

SEQ ID NO: 1200136 - RNA, 14 nt, Human
aguccucccaucuc

SEQ ID NO: 1200137 - RNA, 16 nt, Human
agucccaccuuggcug

SEQ ID NO: 1200138 - RNA, 15 nt, Human
agucccaccuuggcu

SEQ ID NO: 1200139 - RNA, 20 nt, Human
agucccaccuuggcugcagg

SEQ ID NO: 1200140 - RNA, 19 nt, Human
agucccaccuuggcugcag

SEQ ID NO: 1200141 - RNA, 18 nt, Human
agucccaccuuggcugca

SEQ ID NO: 1200142 - RNA, 22 nt, Human
agucagaaguuucugccgcagc

SEQ ID NO: 1200143 - RNA, 23 nt, Human
ugucccuuacgugaguccuggca

SEQ ID NO: 1200144 - RNA, 19 nt, Human
ugucccuuacgugaguccu

SEQ ID NO: 1200145 - RNA, 17 nt, Human
uguaggguuauaauaau

SEQ ID NO: 1200146 - RNA, 16 nt, Human
uguaggguuauaauaa

SEQ ID NO: 1200147 - RNA, 22 nt, Human
uguauauauuuccuauauuguu

SEQ ID NO: 1200148 - RNA, 18 nt, Human
uguauauauuuccuauau

SEQ ID NO: 1200149 - RNA, 21 nt, Human
uguacauggaauaacauguaa

SEQ ID NO: 1200150 - RNA, 23 nt, Human
aguacacuguuucaaacuuuacu

SEQ ID NO: 1200151 - RNA, 21 nt, Human
aguacacuguuucaaacuuua

SEQ ID NO: 1200152 - RNA, 12 nt, Human
aggugugcucug

SEQ ID NO: 1200153 - RNA, 14 nt, Human
agguugaagcacca

SEQ ID NO: 1200154 - RNA, 22 nt, Human
aggugugagucaccaagcccag

SEQ ID NO: 1200155 - RNA, 21 nt, Human
aggugugagucaccaagccca

SEQ ID NO: 1200156 - RNA, 20 nt, Human
aggugucccugcacuugcag

SEQ ID NO: 1200157 - RNA, 16 nt, Human
aggugucccugcacuu

SEQ ID NO: 1200158 - RNA, 12 nt, Human
aggugggaggau

SEQ ID NO: 1200159 - RNA, 23 nt, Human
uguaauuaaguacuauguaucaa

SEQ ID NO: 1200160 - RNA, 21 nt, Human
uguaauuaaguacuauguauc

SEQ ID NO: 1200161 - RNA, 19 nt, Human
uguaauuaaguacuaugua

SEQ ID NO: 1200162 - RNA, 18 nt, Human
uguaauuaaguacuaugu

SEQ ID NO: 1200163 - RNA, 20 nt, Human
agguuggcaaaaaggcagga

SEQ ID NO: 1200164 - RNA, 20 nt, Human
uguacauaaugcgugcauac

SEQ ID NO: 1200165 - RNA, 19 nt, Human
uguacauaaugcgugcaua

SEQ ID NO: 1200166 - RNA, 20 nt, Human
uguaauuuuuuuaucgucac

SEQ ID NO: 1200167 - RNA, 16 nt, Human
uguacaugaaaacaca

SEQ ID NO: 1200168 - RNA, 14 nt, Human
uguacaugaaaaca

SEQ ID NO: 1200169 - RNA, 14 nt, Human
uggcuucacggaag

SEQ ID NO: 1200170 - RNA, 23 nt, Human
uggcuguuggcugggggccucag

SEQ ID NO: 1200171 - RNA, 18 nt, Human
uggcuguuggcugggggc

SEQ ID NO: 1200172 - RNA, 16 nt, Human
uggcuguuggcugggg

SEQ ID NO: 1200173 - RNA, 23 nt, Human
uggcugcaaaggguaucaggugc

SEQ ID NO: 1200174 - RNA, 16 nt, Human
uggcuuuugugcauua

SEQ ID NO: 1200175 - RNA, 22 nt, Human
uggcuucacggaagagccuugc

SEQ ID NO: 1200176 - RNA, 20 nt, Human
uggcuucacggaagagccuu

SEQ ID NO: 1200177 - RNA, 17 nt, Human
uggcuucacggaagagc

SEQ ID NO: 1200178 - RNA, 21 nt, Human
uggcuuuugugcauuaucuag

SEQ ID NO: 1200179 - RNA, 13 nt, Human
uggcucacgccug

SEQ ID NO: 1200180 - RNA, 19 nt, Human
uggcuaauguacugcauau

SEQ ID NO: 1200181 - RNA, 17 nt, Human
uggcuaauguacugcau

SEQ ID NO: 1200182 - RNA, 23 nt, Human
aggcuccaggagcagccacauuc

SEQ ID NO: 1200183 - RNA, 19 nt, Human
aggcuccaggagcagccac

SEQ ID NO: 1200184 - RNA, 18 nt, Human
aggcuccaggagcagcca

SEQ ID NO: 1200185 - RNA, 17 nt, Human
aggcuccaggagcagcc

SEQ ID NO: 1200186 - RNA, 17 nt, Human
aggcuggguucugaucc

SEQ ID NO: 1200187 - RNA, 14 nt, Human
aggcuggguucuga

SEQ ID NO: 1200188 - RNA, 22 nt, Human
aggcugggggaagaagcucucu

SEQ ID NO: 1200189 - RNA, 17 nt, Human
aggcugggggaagaagc

SEQ ID NO: 1200190 - RNA, 23 nt, Human
aggcugggcuucaguggcagcug

SEQ ID NO: 1200191 - RNA, 22 nt, Human
aggcugggcuucaguggcagcu

SEQ ID NO: 1200192 - RNA, 21 nt, Human
aggcugggcuucaguggcagc

SEQ ID NO: 1200193 - RNA, 20 nt, Human
aggcugggcuucaguggcag

SEQ ID NO: 1200194 - RNA, 19 nt, Human
aggcugggcuucaguggca

SEQ ID NO: 1200195 - RNA, 18 nt, Human
aggcugggcuucaguggc

SEQ ID NO: 1200196 - RNA, 14 nt, Human
aggcugggcuucag

SEQ ID NO: 1200197 - RNA, 23 nt, Human
aggcugggcucccuucccaccuc

SEQ ID NO: 1200198 - RNA, 21 nt, Human
aggcugggcucccuucccacc

SEQ ID NO: 1200199 - RNA, 18 nt, Human
aggcugggcucccuuccc

SEQ ID NO: 1200200 - RNA, 14 nt, Human
aggcugggcucccu

SEQ ID NO: 1200201 - RNA, 13 nt, Human
aggcugggcuccc

SEQ ID NO: 1200202 - RNA, 22 nt, Human
aggcugggagagccuuccaggg

SEQ ID NO: 1200203 - RNA, 21 nt, Human
aggcugggagagccuuccagg

SEQ ID NO: 1200204 - RNA, 20 nt, Human
aggcugggagagccuuccag

SEQ ID NO: 1200205 - RNA, 19 nt, Human
aggcugggagagccuucca

SEQ ID NO: 1200206 - RNA, 23 nt, Human
aggcuuagucacugagacagccc

SEQ ID NO: 1200207 - RNA, 22 nt, Human
aggcuuagucacugagacagcc

SEQ ID NO: 1200208 - RNA, 23 nt, Human
ugggcagaaggaagacuucaucc

SEQ ID NO: 1200209 - RNA, 20 nt, Human
ugggcagaaggaagacuuca

SEQ ID NO: 1200210 - RNA, 16 nt, Human
ugggcagaaggaagac

SEQ ID NO: 1200211 - RNA, 13 nt, Human
ugggcagaaggaa

SEQ ID NO: 1200212 - RNA, 16 nt, Human
ugggcaacccccagcc

SEQ ID NO: 1200213 - RNA, 17 nt, Human
ugggaggucaaggcugc

SEQ ID NO: 1200214 - RNA, 22 nt, Human
ugggaggauugcuugagcucag

SEQ ID NO: 1200215 - RNA, 21 nt, Human
ugggaggauugcuugagcuca

SEQ ID NO: 1200216 - RNA, 18 nt, Human
ugggaggauugcuugagc

SEQ ID NO: 1200217 - RNA, 22 nt, Human
ugggagaaccaaaaagaggcua

SEQ ID NO: 1200218 - RNA, 21 nt, Human
ugggagaaccaaaaagaggcu

SEQ ID NO: 1200219 - RNA, 20 nt, Human
agggacuuggaagcuccgcu

SEQ ID NO: 1200220 - RNA, 19 nt, Human
agggacuuggaagcuccgc

SEQ ID NO: 1200221 - RNA, 18 nt, Human
agggacuuggaagcuccg

SEQ ID NO: 1200222 - RNA, 15 nt, Human
agggacuuggaagcu

SEQ ID NO: 1200223 - RNA, 18 nt, Human
ugggacucaaugcacuga

SEQ ID NO: 1200224 - RNA, 16 nt, Human
ugggacuacaggugug

SEQ ID NO: 1200225 - RNA, 18 nt, Human
ugggacuacaggcaccca

SEQ ID NO: 1200226 - RNA, 15 nt, Human
ugggcucccuuccca

SEQ ID NO: 1200227 - RNA, 14 nt, Human
ugggcucccuuccc

SEQ ID NO: 1200228 - RNA, 20 nt, Human
agggcuccagacacaugucc

SEQ ID NO: 1200229 - RNA, 18 nt, Human
agggcccagagagggugg

SEQ ID NO: 1200230 - RNA, 14 nt, Human
agggcccagagagg

SEQ ID NO: 1200231 - RNA, 20 nt, Human
agggagugaguugauagcac

SEQ ID NO: 1200232 - RNA, 23 nt, Human
agggaguccgaaagggacuugga

SEQ ID NO: 1200233 - RNA, 20 nt, Human
agggaguccgaaagggacuu

SEQ ID NO: 1200234 - RNA, 15 nt, Human
agggagggcuucugc

SEQ ID NO: 1200235 - RNA, 22 nt, Human
agggagggcuccagacacaugu

SEQ ID NO: 1200236 - RNA, 19 nt, Human
agggagggcuccagacaca

SEQ ID NO: 1200237 - RNA, 13 nt, Human
agggagggcucca

SEQ ID NO: 1200238 - RNA, 12 nt, Human
agggagggcucc

SEQ ID NO: 1200239 - RNA, 13 nt, Human
agggcccagagag

SEQ ID NO: 1200240 - RNA, 12 nt, Human
agggcccagaga

SEQ ID NO: 1200241 - RNA, 16 nt, Human
agggauacccauccca

SEQ ID NO: 1200242 - RNA, 15 nt, Human
aggaggccagccuug

SEQ ID NO: 1200243 - RNA, 21 nt, Human
aggaguuugagaccaaccugg

SEQ ID NO: 1200244 - RNA, 20 nt, Human
uggaaguacuauaauuuacc

SEQ ID NO: 1200245 - RNA, 13 nt, Human
uggaagcuccgcu

SEQ ID NO: 1200246 - RNA, 14 nt, Human
uggaacacucugag

SEQ ID NO: 1200247 - RNA, 12 nt, Human
uggaacacucug

SEQ ID NO: 1200248 - RNA, 12 nt, Human
ugcugcccugcc

SEQ ID NO: 1200249 - RNA, 10 nt, Human
ugcugcccug

SEQ ID NO: 1200250 - RNA, 15 nt, Human
uggacaccggaaaca

SEQ ID NO: 1200251 - RNA, 17 nt, Human
aggcaagcaccuccugc

SEQ ID NO: 1200252 - RNA, 14 nt, Human
aggcaagcaccucc

SEQ ID NO: 1200253 - RNA, 18 nt, Human
aggaugcuuguacauaau

SEQ ID NO: 1200254 - RNA, 16 nt, Human
aggaugcuuguacaua

SEQ ID NO: 1200255 - RNA, 15 nt, Human
aggaugcuuguacau

SEQ ID NO: 1200256 - RNA, 12 nt, Human
aggaucucuuga

SEQ ID NO: 1200257 - RNA, 21 nt, Human
aggauccugagccagauuuca

SEQ ID NO: 1200258 - RNA, 12 nt, Human
aggaucagucug

SEQ ID NO: 1200259 - RNA, 16 nt, Human
aggcaaugcuggcugu

SEQ ID NO: 1200260 - RNA, 15 nt, Human
aggcaaugcuggcug

SEQ ID NO: 1200261 - RNA, 14 nt, Human
uggagaaaauggac

SEQ ID NO: 1200262 - RNA, 24 nt, Human
uggacuuuguuaguuucuccaagc

SEQ ID NO: 1200263 - RNA, 22 nt, Human
uggacuuuguuaguuucuccaa

SEQ ID NO: 1200264 - RNA, 14 nt, Human
aggcagguccaggg

SEQ ID NO: 1200265 - RNA, 22 nt, Human
aggcagggucucacucugucgc

SEQ ID NO: 1200266 - RNA, 21 nt, Human
aggcagggucucacucugucg

SEQ ID NO: 1200267 - RNA, 20 nt, Human
aggcagggucucacucuguc

SEQ ID NO: 1200268 - RNA, 19 nt, Human
aggcagggucucacucugu

SEQ ID NO: 1200269 - RNA, 22 nt, Human
aggcaggucuugaacuccuggc

SEQ ID NO: 1200270 - RNA, 21 nt, Human
aggcaggucuugaacuccugg

SEQ ID NO: 1200271 - RNA, 22 nt, Human
aggcagccccauucugccugcc

SEQ ID NO: 1200272 - RNA, 21 nt, Human
aggcagccccauucugccugc

SEQ ID NO: 1200273 - RNA, 20 nt, Human
aggcagccccauucugccug

SEQ ID NO: 1200274 - RNA, 15 nt, Human
aggcacccaccauca

SEQ ID NO: 1200275 - RNA, 19 nt, Human
aggcagccccauucugccu

SEQ ID NO: 1200276 - RNA, 12 nt, Human
aggcaggauggc

SEQ ID NO: 1200277 - RNA, 16 nt, Human
aggcuccaggagcagc

SEQ ID NO: 1200278 - RNA, 14 nt, Human
aggcuccaggagca

SEQ ID NO: 1200279 - RNA, 13 nt, Human
aggcuccaggagc

SEQ ID NO: 1200280 - RNA, 18 nt, Human
aggccuucucugaaggac

SEQ ID NO: 1200281 - RNA, 17 nt, Human
aggccuucucugaagga

SEQ ID NO: 1200282 - RNA, 19 nt, Human
uggccucugcacuccccug

SEQ ID NO: 1200283 - RNA, 20 nt, Human
uggccucugcacuccccugc

SEQ ID NO: 1200284 - RNA, 14 nt, Human
uggcccacugcauc

SEQ ID NO: 1200285 - RNA, 13 nt, Human
uggcccacugcau

SEQ ID NO: 1200286 - RNA, 19 nt, Human
uggcccacgcacuucggga

SEQ ID NO: 1200287 - RNA, 12 nt, Human
aggccuggccag

SEQ ID NO: 1200288 - RNA, 15 nt, Human
aggccuggccagaug

SEQ ID NO: 1200289 - RNA, 13 nt, Human
aggccuggccaga

SEQ ID NO: 1200290 - RNA, 17 nt, Human
aggcccggcuccaggcu

SEQ ID NO: 1200291 - RNA, 16 nt, Human
aggcccggcuccaggc

SEQ ID NO: 1200292 - RNA, 15 nt, Human
aggcccggcuccagg

SEQ ID NO: 1200293 - RNA, 21 nt, Human
aggccccugccacccugggga

SEQ ID NO: 1200294 - RNA, 18 nt, Human
aggccccugccacccugg

SEQ ID NO: 1200295 - RNA, 17 nt, Human
aggccccugccacccug

SEQ ID NO: 1200296 - RNA, 15 nt, Human
aggccccugccaccc

SEQ ID NO: 1200297 - RNA, 13 nt, Human
aggccccugccac

SEQ ID NO: 1200298 - RNA, 20 nt, Human
aggcccagagggccugcaag

SEQ ID NO: 1200299 - RNA, 19 nt, Human
aggcccagagggccugcaa

SEQ ID NO: 1200300 - RNA, 16 nt, Human
aggcccagagggccug

SEQ ID NO: 1200301 - RNA, 18 nt, Human
aggccaugggccuccugu

SEQ ID NO: 1200302 - RNA, 23 nt, Human
aggccagagacacaagccuucgg

SEQ ID NO: 1200303 - RNA, 18 nt, Human
aggccagagacacaagcc

SEQ ID NO: 1200304 - RNA, 13 nt, Human
aggccagagacac

SEQ ID NO: 1200305 - RNA, 18 nt, Human
uggcagcucagagagggu

SEQ ID NO: 1200306 - RNA, 16 nt, Human
uggcagcucagagagg

SEQ ID NO: 1200307 - RNA, 15 nt, Human
uggcagcucagagag

SEQ ID NO: 1200308 - RNA, 14 nt, Human
uggcagcucagaga

SEQ ID NO: 1200309 - RNA, 18 nt, Human
uggcaccagcagccugga

SEQ ID NO: 1200310 - RNA, 17 nt, Human
uggcaccagcagccugg

SEQ ID NO: 1200311 - RNA, 16 nt, Human
uggcaccagcagccug

SEQ ID NO: 1200312 - RNA, 17 nt, Human
ugccuguucagcuccag

SEQ ID NO: 1200313 - RNA, 16 nt, Human
ugccuguucagcucca

SEQ ID NO: 1200314 - RNA, 15 nt, Human
ugccuguucagcucc

SEQ ID NO: 1200315 - RNA, 18 nt, Human
ugcggacagccacggcca

SEQ ID NO: 1200316 - RNA, 19 nt, Human
ugcgaaaggaugaaaguga

SEQ ID NO: 1200317 - RNA, 13 nt, Human
ugcgaaaggauga

SEQ ID NO: 1200318 - RNA, 10 nt, Human
agcugccugu

SEQ ID NO: 1200319 - RNA, 21 nt, Human
agcugccugggaucccucauc

SEQ ID NO: 1200320 - RNA, 19 nt, Human
agcugccugggaucccuca

SEQ ID NO: 1200321 - RNA, 13 nt, Human
agcugccugggau

SEQ ID NO: 1200322 - RNA, 22 nt, Human
ugccucugacacacagcucugu

SEQ ID NO: 1200323 - RNA, 14 nt, Human
agcugggcagguug

SEQ ID NO: 1200324 - RNA, 19 nt, Human
agcugggacuacaggugug

SEQ ID NO: 1200325 - RNA, 23 nt, Human
agcugggaugauuggagggggga

SEQ ID NO: 1200326 - RNA, 21 nt, Human
ugccucugacacacagcucug

SEQ ID NO: 1200327 - RNA, 20 nt, Human
ugccucugacacacagcucu

SEQ ID NO: 1200328 - RNA, 16 nt, Human
ugccucucucaggcca

SEQ ID NO: 1200329 - RNA, 15 nt, Human
ugccucucucaggcc

SEQ ID NO: 1200330 - RNA, 14 nt, Human
ugccucucucaggc

SEQ ID NO: 1200331 - RNA, 13 nt, Human
ugccucucucagg

SEQ ID NO: 1200332 - RNA, 19 nt, Human
ugccucccaucacccgcua

SEQ ID NO: 1200333 - RNA, 14 nt, Human
ugccucccaucacc

SEQ ID NO: 1200334 - RNA, 13 nt, Human
ugccucccaucac

SEQ ID NO: 1200335 - RNA, 14 nt, Human
agcugccagccgag

SEQ ID NO: 1200336 - RNA, 13 nt, Human
agcugccaccugc

SEQ ID NO: 1200337 - RNA, 22 nt, Human
agcugcacccucaggcaggugg

SEQ ID NO: 1200338 - RNA, 20 nt, Human
agcugcacccucaggcaggu

SEQ ID NO: 1200339 - RNA, 19 nt, Human
agcugcacccucaggcagg

SEQ ID NO: 1200340 - RNA, 18 nt, Human
agcugcacccucaggcag

SEQ ID NO: 1200341 - RNA, 17 nt, Human
agcugcacccucaggca

SEQ ID NO: 1200342 - RNA, 13 nt, Human
agcugcacccuca

SEQ ID NO: 1200343 - RNA, 18 nt, Human
agcucuucuccaggcugu

SEQ ID NO: 1200344 - RNA, 14 nt, Human
agcucuguccuggg

SEQ ID NO: 1200345 - RNA, 12 nt, Human
agcucuguccug

SEQ ID NO: 1200346 - RNA, 22 nt, Human
agcucugcuccucuccccagca

SEQ ID NO: 1200347 - RNA, 12 nt, Human
agcucugcuccu

SEQ ID NO: 1200348 - RNA, 16 nt, Human
agcucucuccucccuu

SEQ ID NO: 1200349 - RNA, 22 nt, Human
ugcccuccaagaccuucuccuu

SEQ ID NO: 1200350 - RNA, 20 nt, Human
ugcccuccaagaccuucucc

SEQ ID NO: 1200351 - RNA, 19 nt, Human
ugcccuccaagaccuucuc

SEQ ID NO: 1200352 - RNA, 17 nt, Human
ugcugacuguuuucucu

SEQ ID NO: 1200353 - RNA, 18 nt, Human
ugcucugcauguuacaua

SEQ ID NO: 1200354 - RNA, 15 nt, Human
ugcucugcauguuac

SEQ ID NO: 1200355 - RNA, 22 nt, Human
ugcucugaucauccacugugcc

SEQ ID NO: 1200356 - RNA, 23 nt, Human
aggaaaggcuccaggagcagcca

SEQ ID NO: 1200357 - RNA, 22 nt, Human
aggaaaggcuccaggagcagcc

SEQ ID NO: 1200358 - RNA, 20 nt, Human
aggaaaggcuccaggagcag

SEQ ID NO: 1200359 - RNA, 18 nt, Human
aggaaaggcuccaggagc

SEQ ID NO: 1200360 - RNA, 24 nt, Human
ugcugacuguuuucucuugagagg

SEQ ID NO: 1200361 - RNA, 21 nt, Human
ugcugacuguuuucucuugag

SEQ ID NO: 1200362 - RNA, 14 nt, Human
ugcugagucugaag

SEQ ID NO: 1200363 - RNA, 23 nt, Human
aggaauccagacccggcugcgug

SEQ ID NO: 1200364 - RNA, 22 nt, Human
aggaagcucagggccuggcuca

SEQ ID NO: 1200365 - RNA, 18 nt, Human
aggaagcucagggccugg

SEQ ID NO: 1200366 - RNA, 17 nt, Human
aggaagcucagggccug

SEQ ID NO: 1200367 - RNA, 14 nt, Human
aggaagagaaaaaa

SEQ ID NO: 1200368 - RNA, 15 nt, Human
aggaagacuuuggaa

SEQ ID NO: 1200369 - RNA, 15 nt, Human
ugcugccauccaggu

SEQ ID NO: 1200370 - RNA, 14 nt, Human
ugcugccauccagg

SEQ ID NO: 1200371 - RNA, 13 nt, Human
ugcugccauccag

SEQ ID NO: 1200372 - RNA, 12 nt, Human
ugcugccaucca

SEQ ID NO: 1200373 - RNA, 22 nt, Human
ugcugccauccagguucagcuu

SEQ ID NO: 1200374 - RNA, 21 nt, Human
ugcugccauccagguucagcu

SEQ ID NO: 1200375 - RNA, 11 nt, Human
ugcugccaucc

SEQ ID NO: 1200376 - RNA, 15 nt, Human
agcuuaucucagggg

SEQ ID NO: 1200377 - RNA, 14 nt, Human
agcuuaucucaggg

SEQ ID NO: 1200378 - RNA, 12 nt, Human
agcuuaucucag

SEQ ID NO: 1200379 - RNA, 20 nt, Human
agcuuaaaggggcuagagug

SEQ ID NO: 1200380 - RNA, 21 nt, Human
ugcggacagccacggccaggc

SEQ ID NO: 1200381 - RNA, 20 nt, Human
ugcggacagccacggccagg

SEQ ID NO: 1200382 - RNA, 21 nt, Human
agcuuguaaauagcucaggug

SEQ ID NO: 1200383 - RNA, 20 nt, Human
agcuuguaaauagcucaggu

SEQ ID NO: 1200384 - RNA, 19 nt, Human
agcuuguaaauagcucagg

SEQ ID NO: 1200385 - RNA, 21 nt, Human
aggaaacccagcucuggucca

SEQ ID NO: 1200386 - RNA, 20 nt, Human
aggaaacccagcucuggucc

SEQ ID NO: 1200387 - RNA, 18 nt, Human
aggaaacccagcucuggu

SEQ ID NO: 1200388 - RNA, 17 nt, Human
aggaaacccagcucugg

SEQ ID NO: 1200389 - RNA, 16 nt, Human
aggaaacccagcucug

SEQ ID NO: 1200390 - RNA, 15 nt, Human
aggaaacccagcucu

SEQ ID NO: 1200391 - RNA, 19 nt, Human
agcuuugaaaauucagugg

SEQ ID NO: 1200392 - RNA, 18 nt, Human
agcuuugaaaauucagug

SEQ ID NO: 1200393 - RNA, 16 nt, Human
agcuuugaaaauucag

SEQ ID NO: 1200394 - RNA, 12 nt, Human
agcuuugaaaau

SEQ ID NO: 1200395 - RNA, 13 nt, Human
aggaaagaggcuc

SEQ ID NO: 1200396 - RNA, 12 nt, Human
aggaaagaggcu

SEQ ID NO: 1200397 - RNA, 19 nt, Human
aggaaagcaaaggagauug

SEQ ID NO: 1200398 - RNA, 17 nt, Human
aggaaagcaaaggagau

SEQ ID NO: 1200399 - RNA, 16 nt, Human
aggaaagaggcucugg

SEQ ID NO: 1200400 - RNA, 16 nt, Human
agccucagcauccugg

SEQ ID NO: 1200401 - RNA, 15 nt, Human
agccucagcauccug

SEQ ID NO: 1200402 - RNA, 19 nt, Human
agccucaaccuccugggcu

SEQ ID NO: 1200403 - RNA, 14 nt, Human
agccucagcauccu

SEQ ID NO: 1200404 - RNA, 13 nt, Human
agccucagcaucc

SEQ ID NO: 1200405 - RNA, 18 nt, Human
agccucaaccuccugggc

SEQ ID NO: 1200406 - RNA, 17 nt, Human
agccucaaccuccuggg

SEQ ID NO: 1200407 - RNA, 20 nt, Human
ugcagccucaaccuccuggg

SEQ ID NO: 1200408 - RNA, 19 nt, Human
ugcagccucaaccuccugg

SEQ ID NO: 1200409 - RNA, 18 nt, Human
ugcagccucaaccuccug

SEQ ID NO: 1200410 - RNA, 14 nt, Human
ugcagugagccgag

SEQ ID NO: 1200411 - RNA, 16 nt, Human
ugcaugcugucccuua

SEQ ID NO: 1200412 - RNA, 19 nt, Human
agccugccucuucucuacu

SEQ ID NO: 1200413 - RNA, 16 nt, Human
agccugccucuucucu

SEQ ID NO: 1200414 - RNA, 23 nt, Human
agccugcaguuauuaacacuaac

SEQ ID NO: 1200415 - RNA, 15 nt, Human
ugcaugcugucccuu

SEQ ID NO: 1200416 - RNA, 14 nt, Human
ugcaugcugucccu

SEQ ID NO: 1200417 - RNA, 13 nt, Human
ugcaugcuguccc

SEQ ID NO: 1200418 - RNA, 21 nt, Human
ugcaugaggcuaguguggugu

SEQ ID NO: 1200419 - RNA, 22 nt, Human
ugcaugaaguaauaugcacaca

SEQ ID NO: 1200420 - RNA, 22 nt, Human
ugcauaccacuuuuguucuugg

SEQ ID NO: 1200421 - RNA, 13 nt, Human
ugcacuccccugc

SEQ ID NO: 1200422 - RNA, 12 nt, Human
ugcacuccccug

SEQ ID NO: 1200423 - RNA, 22 nt, Human
ugcacuauagccuaggugacag

SEQ ID NO: 1200424 - RNA, 15 nt, Human
ugcaccacugcacuc

SEQ ID NO: 1200425 - RNA, 14 nt, Human
ugcaccacugcacu

SEQ ID NO: 1200426 - RNA, 17 nt, Human
ugcacacaccagagccc

SEQ ID NO: 1200427 - RNA, 15 nt, Human
ugcacacaccagagc

SEQ ID NO: 1200428 - RNA, 14 nt, Human
ugcacaagcugcac

SEQ ID NO: 1200429 - RNA, 23 nt, Human
ugcacaagcuccaagcucccagg

SEQ ID NO: 1200430 - RNA, 22 nt, Human
ugcacaagcuccaagcucccag

SEQ ID NO: 1200431 - RNA, 20 nt, Human
ugcacaagcuccaagcuccc

SEQ ID NO: 1200432 - RNA, 18 nt, Human
ugcacaagcuccaagcuc

SEQ ID NO: 1200433 - RNA, 16 nt, Human
ugcacaagcuccaagc

SEQ ID NO: 1200434 - RNA, 15 nt, Human
ugcacaagcuccaag

SEQ ID NO: 1200435 - RNA, 15 nt, Human
agccucaaccuccug

SEQ ID NO: 1200436 - RNA, 17 nt, Human
agccuaggugacagagu

SEQ ID NO: 1200437 - RNA, 15 nt, Human
agccuaggugacaga

SEQ ID NO: 1200438 - RNA, 15 nt, Human
ugcacuccccugcug

SEQ ID NO: 1200439 - RNA, 20 nt, Human
ugcagacucuacagaggcca

SEQ ID NO: 1200440 - RNA, 19 nt, Human
ugcagacucuacagaggcc

SEQ ID NO: 1200441 - RNA, 22 nt, Human
ugcagacucuacagaggccaug

SEQ ID NO: 1200442 - RNA, 23 nt, Human
ugcauuugaaaauuuugauguuu

SEQ ID NO: 1200443 - RNA, 19 nt, Human
ugcauuugaaaauuuugau

SEQ ID NO: 1200444 - RNA, 18 nt, Human
ugcauuugaggucuguuc

SEQ ID NO: 1200445 - RNA, 22 nt, Human
agcgcccaguuggguggaugcc

SEQ ID NO: 1200446 - RNA, 14 nt, Human
agcgcccaguuggg

SEQ ID NO: 1200447 - RNA, 14 nt, Human
agccugcuccagcu

SEQ ID NO: 1200448 - RNA, 23 nt, Human
agcgugguggacaugcacagcua

SEQ ID NO: 1200449 - RNA, 20 nt, Human
agcgugguggacaugcacag

SEQ ID NO: 1200450 - RNA, 17 nt, Human
agcgugagccacugcac

SEQ ID NO: 1200451 - RNA, 16 nt, Human
agcgugagccacugca

SEQ ID NO: 1200452 - RNA, 15 nt, Human
agcgugagccacugc

SEQ ID NO: 1200453 - RNA, 17 nt, Human
agcggggacagcuccuu

SEQ ID NO: 1200454 - RNA, 16 nt, Human
agcggggacagcuccu

SEQ ID NO: 1200455 - RNA, 15 nt, Human
agcggggacagcucc

SEQ ID NO: 1200456 - RNA, 21 nt, Human
ugccauauucuguuggccagu

SEQ ID NO: 1200457 - RNA, 20 nt, Human
ugccauauucuguuggccag

SEQ ID NO: 1200458 - RNA, 17 nt, Human
ugccauauucuguuggc

SEQ ID NO: 1200459 - RNA, 16 nt, Human
ugccauauucuguugg

SEQ ID NO: 1200460 - RNA, 15 nt, Human
ugccauauucuguug

SEQ ID NO: 1200461 - RNA, 23 nt, Human
ugccagucaccccggccaccugc

SEQ ID NO: 1200462 - RNA, 22 nt, Human
ugccagucaccccggccaccug

SEQ ID NO: 1200463 - RNA, 20 nt, Human
ugccagucaccccggccacc

SEQ ID NO: 1200464 - RNA, 18 nt, Human
ugccagucaccccggcca

SEQ ID NO: 1200465 - RNA, 16 nt, Human
ugccagucaccccggc

SEQ ID NO: 1200466 - RNA, 15 nt, Human
ugccagucaccccgg

SEQ ID NO: 1200467 - RNA, 19 nt, Human
ugccccucaacucuccucc

SEQ ID NO: 1200468 - RNA, 11 nt, Human
ugcccaggccc

SEQ ID NO: 1200469 - RNA, 20 nt, Human
ugcccaggcaggucuugaac

SEQ ID NO: 1200470 - RNA, 17 nt, Human
ugcccaggcaggucuug

SEQ ID NO: 1200471 - RNA, 16 nt, Human
ugcccaggcaggucuu

SEQ ID NO: 1200472 - RNA, 15 nt, Human
ugcccaggcaggucu

SEQ ID NO: 1200473 - RNA, 14 nt, Human
ugcccacaggauca

SEQ ID NO: 1200474 - RNA, 22 nt, Human
ugcccaggccccugccacccug

SEQ ID NO: 1200475 - RNA, 20 nt, Human
ugcccaggccccugccaccc

SEQ ID NO: 1200476 - RNA, 14 nt, Human
ugcccaggccccug

SEQ ID NO: 1200477 - RNA, 16 nt, Human
ugcccacaggaucagu

SEQ ID NO: 1200478 - RNA, 12 nt, Human
ugcccaggcccc

SEQ ID NO: 1200479 - RNA, 19 nt, Human
ugccauguuggccaggcug

SEQ ID NO: 1200480 - RNA, 18 nt, Human
ugccauguuggccaggcu

SEQ ID NO: 1200481 - RNA, 17 nt, Human
ugccauguuggccaggc

SEQ ID NO: 1200482 - RNA, 17 nt, Human
agcucagggccuggcuc

SEQ ID NO: 1200483 - RNA, 16 nt, Human
agcucagggccuggcu

SEQ ID NO: 1200484 - RNA, 15 nt, Human
agcucagggccuggc

SEQ ID NO: 1200485 - RNA, 18 nt, Human
agcucagggccuggcuca

SEQ ID NO: 1200486 - RNA, 21 nt, Human
ugccauguuggccaggcuggu

SEQ ID NO: 1200487 - RNA, 20 nt, Human
ugccauguuggccaggcugg

SEQ ID NO: 1200488 - RNA, 16 nt, Human
ucuggcagcucagaga

SEQ ID NO: 1200489 - RNA, 16 nt, Human
agaagcggcuggcagc

SEQ ID NO: 1200490 - RNA, 15 nt, Human
agaagcggcuggcag

SEQ ID NO: 1200491 - RNA, 15 nt, Human
ucuggcagcucagag

SEQ ID NO: 1200492 - RNA, 14 nt, Human
ucuggcagcucaga

SEQ ID NO: 1200493 - RNA, 18 nt, Human
ucugcccuccaagaccuu

SEQ ID NO: 1200494 - RNA, 14 nt, Human
ucugcccuccaaga

SEQ ID NO: 1200495 - RNA, 13 nt, Human
ucugcuucagccu

SEQ ID NO: 1200496 - RNA, 17 nt, Human
ucugcucacauaucugu

SEQ ID NO: 1200497 - RNA, 16 nt, Human
ucugcucacauaucug

SEQ ID NO: 1200498 - RNA, 21 nt, Human
ucugauucccaagcucugcuc

SEQ ID NO: 1200499 - RNA, 20 nt, Human
ucugauucccaagcucugcu

SEQ ID NO: 1200500 - RNA, 19 nt, Human
ucugauucccaagcucugc

SEQ ID NO: 1200501 - RNA, 19 nt, Human
ucugacccugcuucaaaua

SEQ ID NO: 1200502 - RNA, 17 nt, Human
agaaauguacagcaagg

SEQ ID NO: 1200503 - RNA, 11 nt, Human
agaaauguguu

SEQ ID NO: 1200504 - RNA, 23 nt, Human
acuuugaccucugcagcaauaaa

SEQ ID NO: 1200505 - RNA, 19 nt, Human
acuuugaccucugcagcaa

SEQ ID NO: 1200506 - RNA, 23 nt, Human
acuuuaccuuuuuuauacauaaa

SEQ ID NO: 1200507 - RNA, 22 nt, Human
acuuuaccuuuuuuauacauaa

SEQ ID NO: 1200508 - RNA, 19 nt, Human
acuuuaccuuuuuuauaca

SEQ ID NO: 1200509 - RNA, 18 nt, Human
acuuuaccuuuuuuauac

SEQ ID NO: 1200510 - RNA, 23 nt, Human
acuuuggaaagacuuuuccaacc

SEQ ID NO: 1200511 - RNA, 17 nt, Human
acuuuggaaagacuuuu

SEQ ID NO: 1200512 - RNA, 14 nt, Human
acuuuggaaagacu

SEQ ID NO: 1200513 - RNA, 13 nt, Human
acuuuggaaagac

SEQ ID NO: 1200514 - RNA, 12 nt, Human
ucuccucugcug

SEQ ID NO: 1200515 - RNA, 21 nt, Human
ucucccuuggauuguccccga

SEQ ID NO: 1200516 - RNA, 19 nt, Human
ucucccuuggauugucccc

SEQ ID NO: 1200517 - RNA, 15 nt, Human
ucuccucugcugcug

SEQ ID NO: 1200518 - RNA, 14 nt, Human
ucuccucugcugcu

SEQ ID NO: 1200519 - RNA, 13 nt, Human
ucuccucugcugc

SEQ ID NO: 1200520 - RNA, 18 nt, Human
ucucccuuggauuguccc

SEQ ID NO: 1200521 - RNA, 11 nt, Human
ucucccuugga

SEQ ID NO: 1200522 - RNA, 14 nt, Human
ucucuugagccugg

SEQ ID NO: 1200523 - RNA, 13 nt, Human
ucucuugagccug

SEQ ID NO: 1200524 - RNA, 15 nt, Human
ucucuugagccuggg

SEQ ID NO: 1200525 - RNA, 17 nt, Human
ucucuugagccugggag

SEQ ID NO: 1200526 - RNA, 22 nt, Human
ucucuuuaaugucacaggcagg

SEQ ID NO: 1200527 - RNA, 17 nt, Human
agaaaaaugagccuggc

SEQ ID NO: 1200528 - RNA, 22 nt, Human
ucucuccuguaccucuugagcc

SEQ ID NO: 1200529 - RNA, 20 nt, Human
ucucuccuguaccucuugag

SEQ ID NO: 1200530 - RNA, 16 nt, Human
ucucuccagccccugg

SEQ ID NO: 1200531 - RNA, 15 nt, Human
ucucuccagccccug

SEQ ID NO: 1200532 - RNA, 14 nt, Human
ucucuccagccccu

SEQ ID NO: 1200533 - RNA, 13 nt, Human
ucucuccagcccc

SEQ ID NO: 1200534 - RNA, 20 nt, Human
ucuccuucaccuuugucccc

SEQ ID NO: 1200535 - RNA, 14 nt, Human
ucucuugagagggu

SEQ ID NO: 1200536 - RNA, 11 nt, Human
ucucugcccuc

SEQ ID NO: 1200537 - RNA, 23 nt, Human
agaauuucccaaagcagugcaug

SEQ ID NO: 1200538 - RNA, 18 nt, Human
agaauuucccaaagcagu

SEQ ID NO: 1200539 - RNA, 17 nt, Human
agaauuucccaaagcag

SEQ ID NO: 1200540 - RNA, 20 nt, Human
ucuguuggccagugugacaa

SEQ ID NO: 1200541 - RNA, 19 nt, Human
ucuguuggccagugugaca

SEQ ID NO: 1200542 - RNA, 22 nt, Human
ucugugaaaggaaagagggagg

SEQ ID NO: 1200543 - RNA, 21 nt, Human
ucugugaaaggaaagagggag

SEQ ID NO: 1200544 - RNA, 15 nt, Human
ucugugaaaggaaag

SEQ ID NO: 1200545 - RNA, 23 nt, Human
ucugucauuugagcagggcucag

SEQ ID NO: 1200546 - RNA, 20 nt, Human
ucugucauuugagcagggcu

SEQ ID NO: 1200547 - RNA, 15 nt, Human
ucugucauuugagca

SEQ ID NO: 1200548 - RNA, 16 nt, Human
ucuggguucacugcaa

SEQ ID NO: 1200549 - RNA, 14 nt, Human
ucuggguucacugc

SEQ ID NO: 1200550 - RNA, 11 nt, Human
ucuggggcugu

SEQ ID NO: 1200551 - RNA, 18 nt, Human
ucugguccauagagagca

SEQ ID NO: 1200552 - RNA, 19 nt, Human
agacagucccugccaaugg

SEQ ID NO: 1200553 - RNA, 17 nt, Human
agacagucccugccaau

SEQ ID NO: 1200554 - RNA, 16 nt, Human
agacagucccugccaa

SEQ ID NO: 1200555 - RNA, 15 nt, Human
agacagucccugcca

SEQ ID NO: 1200556 - RNA, 21 nt, Human
agacaggguuuugccauguug

SEQ ID NO: 1200557 - RNA, 23 nt, Human
agacaggcaagcaccuccugccu

SEQ ID NO: 1200558 - RNA, 16 nt, Human
agacaggaccagggau

SEQ ID NO: 1200559 - RNA, 15 nt, Human
agacaggaccaggga

SEQ ID NO: 1200560 - RNA, 22 nt, Human
ucuuauugcccacgcuggagug

SEQ ID NO: 1200561 - RNA, 18 nt, Human
ucuuauugcccacgcugg

SEQ ID NO: 1200562 - RNA, 18 nt, Human
ucuuaugggcuggguucu

SEQ ID NO: 1200563 - RNA, 14 nt, Human
ucuuauugcccacg

SEQ ID NO: 1200564 - RNA, 16 nt, Human
ucuuaugggcuggguu

SEQ ID NO: 1200565 - RNA, 15 nt, Human
ucuuaugggcugggu

SEQ ID NO: 1200566 - RNA, 14 nt, Human
ucuuaugggcuggg

SEQ ID NO: 1200567 - RNA, 12 nt, Human
ucuucagagacu

SEQ ID NO: 1200568 - RNA, 22 nt, Human
ucuuccaggcugggagagccuu

SEQ ID NO: 1200569 - RNA, 17 nt, Human
ucuuauuuaaugaaaga

SEQ ID NO: 1200570 - RNA, 18 nt, Human
ucuugcaauggcagccuu

SEQ ID NO: 1200571 - RNA, 17 nt, Human
ucuugcaauggcagccu

SEQ ID NO: 1200572 - RNA, 16 nt, Human
ucuugcaauggcagcc

SEQ ID NO: 1200573 - RNA, 13 nt, Human
ucuugcaauggca

SEQ ID NO: 1200574 - RNA, 18 nt, Human
agacucauucuucuguac

SEQ ID NO: 1200575 - RNA, 17 nt, Human
agacucauucuucugua

SEQ ID NO: 1200576 - RNA, 18 nt, Human
agacuaucuaaauguuga

SEQ ID NO: 1200577 - RNA, 17 nt, Human
agacuaucuaaauguug

SEQ ID NO: 1200578 - RNA, 19 nt, Human
agacuaucuaaauguugaa

SEQ ID NO: 1200579 - RNA, 23 nt, Human
agacccuuguggucccaccccac

SEQ ID NO: 1200580 - RNA, 22 nt, Human
agacccuuguggucccacccca

SEQ ID NO: 1200581 - RNA, 20 nt, Human
agacccuuguggucccaccc

SEQ ID NO: 1200582 - RNA, 19 nt, Human
agacccuuguggucccacc

SEQ ID NO: 1200583 - RNA, 15 nt, Human
agacccuuguggucc

SEQ ID NO: 1200584 - RNA, 13 nt, Human
agacccuuguggu

SEQ ID NO: 1200585 - RNA, 23 nt, Human
agacccugcccugugggccccca

SEQ ID NO: 1200586 - RNA, 21 nt, Human
agacccugcccugugggcccc

SEQ ID NO: 1200587 - RNA, 19 nt, Human
agacccugcccugugggcc

SEQ ID NO: 1200588 - RNA, 16 nt, Human
agacccugcccugugg

SEQ ID NO: 1200589 - RNA, 14 nt, Human
agacccugcccugu

SEQ ID NO: 1200590 - RNA, 13 nt, Human
agacccugcccug

SEQ ID NO: 1200591 - RNA, 12 nt, Human
agacccugcccu

SEQ ID NO: 1200592 - RNA, 15 nt, Human
ucuuuacuucaugga

SEQ ID NO: 1200593 - RNA, 19 nt, Human
agacucuacagaggccaug

SEQ ID NO: 1200594 - RNA, 17 nt, Human
agacucuacagaggcca

SEQ ID NO: 1200595 - RNA, 23 nt, Human
agacuccugcaggcagccaggcc

SEQ ID NO: 1200596 - RNA, 20 nt, Human
agacuccugcaggcagccag

SEQ ID NO: 1200597 - RNA, 19 nt, Human
agacuccugcaggcagcca

SEQ ID NO: 1200598 - RNA, 18 nt, Human
agacuccugcaggcagcc

SEQ ID NO: 1200599 - RNA, 17 nt, Human
agacuccugcaggcagc

SEQ ID NO: 1200600 - RNA, 16 nt, Human
agacuccugcaggcag

SEQ ID NO: 1200601 - RNA, 15 nt, Human
agacuccugcaggca

SEQ ID NO: 1200602 - RNA, 16 nt, Human
ucuuuccugaggcugg

SEQ ID NO: 1200603 - RNA, 15 nt, Human
ucuuuccugaggcug

SEQ ID NO: 1200604 - RNA, 14 nt, Human
ucuuuccugaggcu

SEQ ID NO: 1200605 - RNA, 13 nt, Human
ucuuuccugaggc

SEQ ID NO: 1200606 - RNA, 18 nt, Human
agagaccaucccugaagg

SEQ ID NO: 1200607 - RNA, 15 nt, Human
agagaccaucccuga

SEQ ID NO: 1200608 - RNA, 14 nt, Human
agagaccaucccug

SEQ ID NO: 1200609 - RNA, 13 nt, Human
agagaccaucccu

SEQ ID NO: 1200610 - RNA, 15 nt, Human
agacuuuggaaagac

SEQ ID NO: 1200611 - RNA, 18 nt, Human
agagaaugaaagggccca

SEQ ID NO: 1200612 - RNA, 14 nt, Human
agacuuuggaaaga

SEQ ID NO: 1200613 - RNA, 12 nt, Human
agacuuuggaaa

SEQ ID NO: 1200614 - RNA, 17 nt, Human
agacuucaucccucugg

SEQ ID NO: 1200615 - RNA, 14 nt, Human
agacuucaucccuc

SEQ ID NO: 1200616 - RNA, 21 nt, Human
agagggagggagggcuccaga

SEQ ID NO: 1200617 - RNA, 15 nt, Human
agagggagguaagga

SEQ ID NO: 1200618 - RNA, 22 nt, Human
agagggagggagggcuccagac

SEQ ID NO: 1200619 - RNA, 17 nt, Human
agaggcuaugugagcac

SEQ ID NO: 1200620 - RNA, 17 nt, Human
ugaagacaaugacuuac

SEQ ID NO: 1200621 - RNA, 13 nt, Human
ugaagacaaugac

SEQ ID NO: 1200622 - RNA, 11 nt, Human
ugaagacaaug

SEQ ID NO: 1200623 - RNA, 17 nt, Human
ugaacuuugaccucugc

SEQ ID NO: 1200624 - RNA, 16 nt, Human
ugaacuuugaccucug

SEQ ID NO: 1200625 - RNA, 11 nt, Human
ugaacuuugac

SEQ ID NO: 1200626 - RNA, 21 nt, Human
ucuuuggucuacacugugcug

SEQ ID NO: 1200627 - RNA, 14 nt, Human
ucuuuggucuacac

SEQ ID NO: 1200628 - RNA, 18 nt, Human
agaggcaacugcauuggc

SEQ ID NO: 1200629 - RNA, 21 nt, Human
agaggaaaucaccgaaaacgu

SEQ ID NO: 1200630 - RNA, 12 nt, Human
agaggaaaucac

SEQ ID NO: 1200631 - RNA, 11 nt, Human
agaggaaauca

SEQ ID NO: 1200632 - RNA, 19 nt, Human
agaggaaagcaaaggagau

SEQ ID NO: 1200633 - RNA, 18 nt, Human
agaggaaagcaaaggaga

SEQ ID NO: 1200634 - RNA, 16 nt, Human
agaggaaagcaaagga

SEQ ID NO: 1200635 - RNA, 12 nt, Human
agaggaaagcaa

SEQ ID NO: 1200636 - RNA, 19 nt, Human
agagcugggugucaagagg

SEQ ID NO: 1200637 - RNA, 21 nt, Human
ugaagacaaugacuuacugua

SEQ ID NO: 1200638 - RNA, 16 nt, Human
agagugagacucuguc

SEQ ID NO: 1200639 - RNA, 15 nt, Human
agagugagacucugu

SEQ ID NO: 1200640 - RNA, 22 nt, Human
agagucucacuguugcccaggc

SEQ ID NO: 1200641 - RNA, 20 nt, Human
agagucucacuguugcccag

SEQ ID NO: 1200642 - RNA, 18 nt, Human
ugaaugucagugugacug

SEQ ID NO: 1200643 - RNA, 15 nt, Human
ugaaugucaguguga

SEQ ID NO: 1200644 - RNA, 14 nt, Human
ugaaugucagugug

SEQ ID NO: 1200645 - RNA, 21 nt, Human
agaucaaccccuucgcuccug

SEQ ID NO: 1200646 - RNA, 19 nt, Human
agaucaaccccuucgcucc

SEQ ID NO: 1200647 - RNA, 14 nt, Human
agaucaaccccuuc

SEQ ID NO: 1200648 - RNA, 19 nt, Human
agauacaggaaaagcugcu

SEQ ID NO: 1200649 - RNA, 19 nt, Human
agagugagacucugucuca

SEQ ID NO: 1200650 - RNA, 19 nt, Human
agauaaggguaucugguga

SEQ ID NO: 1200651 - RNA, 18 nt, Human
agauaauacaccacuaca

SEQ ID NO: 1200652 - RNA, 18 nt, Human
agaugcuucucacugcca

SEQ ID NO: 1200653 - RNA, 12 nt, Human
ugacccaugcug

SEQ ID NO: 1200654 - RNA, 12 nt, Human
ugaccugaggcc

SEQ ID NO: 1200655 - RNA, 14 nt, Human
ugaccucugccuga

SEQ ID NO: 1200656 - RNA, 13 nt, Human
ugaccucugccug

SEQ ID NO: 1200657 - RNA, 21 nt, Human
ugacuguuuucucuugagagg

SEQ ID NO: 1200658 - RNA, 23 nt, Human
ugacuccagaauuucccaaagca

SEQ ID NO: 1200659 - RNA, 20 nt, Human
ugacuccagaauuucccaaa

SEQ ID NO: 1200660 - RNA, 19 nt, Human
ugacuccagaauuucccaa

SEQ ID NO: 1200661 - RNA, 17 nt, Human
ugacuccagaauuuccc

SEQ ID NO: 1200662 - RNA, 17 nt, Human
ugaccugaggcccuucu

SEQ ID NO: 1200663 - RNA, 15 nt, Human
ugaccugaggcccuu

SEQ ID NO: 1200664 - RNA, 14 nt, Human
ugaccugaggcccu

SEQ ID NO: 1200665 - RNA, 17 nt, Human
agauuucacucuccuug

SEQ ID NO: 1200666 - RNA, 14 nt, Human
agauuucacucucc

SEQ ID NO: 1200667 - RNA, 13 nt, Human
agauuucacucuc

SEQ ID NO: 1200668 - RNA, 20 nt, Human
ugaggguugggcugguguca

SEQ ID NO: 1200669 - RNA, 16 nt, Human
ugaggucagagccugc

SEQ ID NO: 1200670 - RNA, 14 nt, Human
ugaggucagagccu

SEQ ID NO: 1200671 - RNA, 13 nt, Human
ugaggucagagcc

SEQ ID NO: 1200672 - RNA, 19 nt, Human
agcagagaccaucccugaa

SEQ ID NO: 1200673 - RNA, 18 nt, Human
agcagagaccaucccuga

SEQ ID NO: 1200674 - RNA, 17 nt, Human
ugaggucagagccugca

SEQ ID NO: 1200675 - RNA, 20 nt, Human
agcagagcaccuuagacagu

SEQ ID NO: 1200676 - RNA, 20 nt, Human
agcagagaccaucccugaag

SEQ ID NO: 1200677 - RNA, 19 nt, Human
agcagauggagaccccuug

SEQ ID NO: 1200678 - RNA, 17 nt, Human
agcagaggaaggagagg

SEQ ID NO: 1200679 - RNA, 13 nt, Human
ugaggggccucuu

SEQ ID NO: 1200680 - RNA, 12 nt, Human
ugaggggccucu

SEQ ID NO: 1200681 - RNA, 24 nt, Human
ugaggcccuucucuccagccccug

SEQ ID NO: 1200682 - RNA, 23 nt, Human
ugaggcccuucucuccagccccu

SEQ ID NO: 1200683 - RNA, 22 nt, Human
ugaggcccuucucuccagcccc

SEQ ID NO: 1200684 - RNA, 20 nt, Human
ugaggcccuucucuccagcc

SEQ ID NO: 1200685 - RNA, 19 nt, Human
ugaggcccuucucuccagc

SEQ ID NO: 1200686 - RNA, 18 nt, Human
ugaggcccuucucuccag

SEQ ID NO: 1200687 - RNA, 16 nt, Human
ugaggcccuucucucc

SEQ ID NO: 1200688 - RNA, 19 nt, Human
ugagggauacccaucccau

SEQ ID NO: 1200689 - RNA, 21 nt, Human
ugaggaagccgcuggggccag

SEQ ID NO: 1200690 - RNA, 19 nt, Human
ugaggaagccgcuggggcc

SEQ ID NO: 1200691 - RNA, 18 nt, Human
ugaggaagccgcuggggc

SEQ ID NO: 1200692 - RNA, 17 nt, Human
ugaggaagccgcugggg

SEQ ID NO: 1200693 - RNA, 14 nt, Human
ugaggaagccgcug

SEQ ID NO: 1200694 - RNA, 22 nt, Human
ugaggaagcaaaagcaucuaug

SEQ ID NO: 1200695 - RNA, 15 nt, Human
ugaggaagcaaaagc

SEQ ID NO: 1200696 - RNA, 23 nt, Human
ugaggcccagagggccugcaagg

SEQ ID NO: 1200697 - RNA, 22 nt, Human
ugaggcccagagggccugcaag

SEQ ID NO: 1200698 - RNA, 21 nt, Human
ugaggcccagagggccugcaa

SEQ ID NO: 1200699 - RNA, 20 nt, Human
ugaggcccagagggccugca

SEQ ID NO: 1200700 - RNA, 18 nt, Human
ugaggcccagagggccug

SEQ ID NO: 1200701 - RNA, 17 nt, Human
ugaggcccagagggccu

SEQ ID NO: 1200702 - RNA, 15 nt, Human
ugaggcccagagggc

SEQ ID NO: 1200703 - RNA, 13 nt, Human
ugaggcccagagg

SEQ ID NO: 1200704 - RNA, 12 nt, Human
ugaggcccagag

SEQ ID NO: 1200705 - RNA, 20 nt, Human
ugaggccagagacacaagcc

SEQ ID NO: 1200706 - RNA, 16 nt, Human
ugaggccagagacaca

SEQ ID NO: 1200707 - RNA, 14 nt, Human
ugaggccagagaca

SEQ ID NO: 1200708 - RNA, 12 nt, Human
ugaggccagaga

SEQ ID NO: 1200709 - RNA, 21 nt, Human
ugaggacacuaaccacgcugg

SEQ ID NO: 1200710 - RNA, 22 nt, Human
ugaggaauccagacccggcugc

SEQ ID NO: 1200711 - RNA, 21 nt, Human
ugaggaauccagacccggcug

SEQ ID NO: 1200712 - RNA, 16 nt, Human
agcacagcuucauuuc

SEQ ID NO: 1200713 - RNA, 16 nt, Human
agcacaugccucucuc

SEQ ID NO: 1200714 - RNA, 14 nt, Human
agcacaugccucuc

SEQ ID NO: 1200715 - RNA, 13 nt, Human
agcacaugccucu

SEQ ID NO: 1200716 - RNA, 13 nt, Human
agcaagugagagc

SEQ ID NO: 1200717 - RNA, 20 nt, Human
agcaagugagacccugucuc

SEQ ID NO: 1200718 - RNA, 22 nt, Human
ugagccagauuucacucuccuu

SEQ ID NO: 1200719 - RNA, 17 nt, Human
ugagccagauuucacuc

SEQ ID NO: 1200720 - RNA, 22 nt, Human
agcaagugagagcuggguguca

SEQ ID NO: 1200721 - RNA, 14 nt, Human
agcaagugagagcu

SEQ ID NO: 1200722 - RNA, 16 nt, Human
ugagccagauuucacu

SEQ ID NO: 1200723 - RNA, 14 nt, Human
ugagccagauuuca

SEQ ID NO: 1200724 - RNA, 13 nt, Human
ugagccagauuuc

SEQ ID NO: 1200725 - RNA, 23 nt, Human
ugagccacugcaccgggccacag

SEQ ID NO: 1200726 - RNA, 21 nt, Human
ugagccacugcaccgggccac

SEQ ID NO: 1200727 - RNA, 24 nt, Human
ugagcaucaggccaggcccucugc

SEQ ID NO: 1200728 - RNA, 22 nt, Human
ugagcaucaggccaggcccucu

SEQ ID NO: 1200729 - RNA, 23 nt, Human
ugagcacuaaggugugcucugau

SEQ ID NO: 1200730 - RNA, 22 nt, Human
ugagcacuaaggugugcucuga

SEQ ID NO: 1200731 - RNA, 21 nt, Human
ugagcacuaaggugugcucug

SEQ ID NO: 1200732 - RNA, 20 nt, Human
ugagcacuaaggugugcucu

SEQ ID NO: 1200733 - RNA, 15 nt, Human
ugagcaauccugcaa

SEQ ID NO: 1200734 - RNA, 19 nt, Human
ugagccuugaacuuugacc

SEQ ID NO: 1200735 - RNA, 18 nt, Human
ugagccuugaacuuugac

SEQ ID NO: 1200736 - RNA, 17 nt, Human
ugagccuugaacuuuga

SEQ ID NO: 1200737 - RNA, 15 nt, Human
ugagccuugaacuuu

SEQ ID NO: 1200738 - RNA, 14 nt, Human
ugagccuugaacuu

SEQ ID NO: 1200739 - RNA, 22 nt, Human
ugagccugggaggucaaggcug

SEQ ID NO: 1200740 - RNA, 19 nt, Human
ugagccugggaggucaagg

SEQ ID NO: 1200741 - RNA, 14 nt, Human
ugagccugggaggu

SEQ ID NO: 1200742 - RNA, 16 nt, Human
ugagccuggcaagaau

SEQ ID NO: 1200743 - RNA, 11 nt, Human
ugagccuggca

SEQ ID NO: 1200744 - RNA, 17 nt, Human
agcagagaccaucccug

SEQ ID NO: 1200745 - RNA, 16 nt, Human
agcagagaccaucccu

SEQ ID NO: 1200746 - RNA, 15 nt, Human
agcagagaccauccc

SEQ ID NO: 1200747 - RNA, 21 nt, Human
agcagagaauucucuuaucca

SEQ ID NO: 1200748 - RNA, 14 nt, Human
agcagagaauucuc

SEQ ID NO: 1200749 - RNA, 23 nt, Human
agcagagaaugaaagggcccaga

SEQ ID NO: 1200750 - RNA, 22 nt, Human
agcagagaaugaaagggcccag

SEQ ID NO: 1200751 - RNA, 21 nt, Human
agcagagaaugaaagggccca

SEQ ID NO: 1200752 - RNA, 19 nt, Human
agcagaaaugccuuacccu

SEQ ID NO: 1200753 - RNA, 13 nt, Human
agcagaaaugccu

SEQ ID NO: 1200754 - RNA, 12 nt, Human
agcagaaaugcc

SEQ ID NO: 1200755 - RNA, 23 nt, Human
agcacuuugggaggccaaggugg

SEQ ID NO: 1200756 - RNA, 22 nt, Human
agcacuuugggaggccaaggug

SEQ ID NO: 1200757 - RNA, 17 nt, Human
agcacgauuucuguuua

SEQ ID NO: 1200758 - RNA, 16 nt, Human
agcacgauuucuguuu

SEQ ID NO: 1200759 - RNA, 15 nt, Human
agcacgauuucuguu

SEQ ID NO: 1200760 - RNA, 14 nt, Human
agcacgauuucugu

SEQ ID NO: 1200761 - RNA, 13 nt, Human
agcacgauuucug

SEQ ID NO: 1200762 - RNA, 23 nt, Human
agcaccuuagacagucccugcca

SEQ ID NO: 1200763 - RNA, 22 nt, Human
agcaccuuagacagucccugcc

SEQ ID NO: 1200764 - RNA, 21 nt, Human
agcaccuuagacagucccugc

SEQ ID NO: 1200765 - RNA, 20 nt, Human
agcaccuuagacagucccug

SEQ ID NO: 1200766 - RNA, 19 nt, Human
agcaccuuagacagucccu

SEQ ID NO: 1200767 - RNA, 19 nt, Human
acuggguacuuguggacac

SEQ ID NO: 1200768 - RNA, 23 nt, Human
acuggguacuuguggacacagcu

SEQ ID NO: 1200769 - RNA, 20 nt, Human
acuggguacuuguggacaca

SEQ ID NO: 1200770 - RNA, 14 nt, Human
ucgcuccugugucu

SEQ ID NO: 1200771 - RNA, 13 nt, Human
ucgcuccuguguc

SEQ ID NO: 1200772 - RNA, 12 nt, Human
ucgcuccugugu

SEQ ID NO: 1200773 - RNA, 13 nt, Human
acuguacaaagua

SEQ ID NO: 1200774 - RNA, 19 nt, Human
acuguaauuugugauacaa

SEQ ID NO: 1200775 - RNA, 15 nt, Human
acuguacaaaguaga

SEQ ID NO: 1200776 - RNA, 14 nt, Human
acuguacaaaguag

SEQ ID NO: 1200777 - RNA, 23 nt, Human
acuguacaugaaaacacauuuuu

SEQ ID NO: 1200778 - RNA, 16 nt, Human
acuguacaugaaaaca

SEQ ID NO: 1200779 - RNA, 14 nt, Human
acuguacaugaaaa

SEQ ID NO: 1200780 - RNA, 13 nt, Human
acuguacaugaaa

SEQ ID NO: 1200781 - RNA, 15 nt, Human
ucgagcaugccugga

SEQ ID NO: 1200782 - RNA, 14 nt, Human
ucgagcaugccugg

SEQ ID NO: 1200783 - RNA, 14 nt, Human
ucgcgacaaugcaa

SEQ ID NO: 1200784 - RNA, 13 nt, Human
ucgcgacaaugca

SEQ ID NO: 1200785 - RNA, 17 nt, Human
ucgaggacagggaggug

SEQ ID NO: 1200786 - RNA, 14 nt, Human
ucgaggacagggag

SEQ ID NO: 1200787 - RNA, 15 nt, Human
ucgaacuggcugcaa

SEQ ID NO: 1200788 - RNA, 14 nt, Human
ucgaacuggcugca

SEQ ID NO: 1200789 - RNA, 15 nt, Human
uccuuucaccacaug

SEQ ID NO: 1200790 - RNA, 14 nt, Human
uccuucagugccuu

SEQ ID NO: 1200791 - RNA, 22 nt, Human
uccuucagugccuuauggaaca

SEQ ID NO: 1200792 - RNA, 13 nt, Human
uccuucagugccu

SEQ ID NO: 1200793 - RNA, 12 nt, Human
uccuucagugcc

SEQ ID NO: 1200794 - RNA, 11 nt, Human
uccuucagugc

SEQ ID NO: 1200795 - RNA, 22 nt, Human
acuggcugcaaaggguaucagg

SEQ ID NO: 1200796 - RNA, 21 nt, Human
acugcuugugaaaggaaagag

SEQ ID NO: 1200797 - RNA, 23 nt, Human
acugcuuccagugaggcucugcc

SEQ ID NO: 1200798 - RNA, 22 nt, Human
acugcuuccagugaggcucugc

SEQ ID NO: 1200799 - RNA, 21 nt, Human
acugcuuccagugaggcucug

SEQ ID NO: 1200800 - RNA, 18 nt, Human
acugcuuccagugaggcu

SEQ ID NO: 1200801 - RNA, 19 nt, Human
uccugccucagccucccaa

SEQ ID NO: 1200802 - RNA, 22 nt, Human
uccugcaggcagccaggccaca

SEQ ID NO: 1200803 - RNA, 20 nt, Human
uccugcaggcagccaggcca

SEQ ID NO: 1200804 - RNA, 19 nt, Human
uccugcaggcagccaggcc

SEQ ID NO: 1200805 - RNA, 17 nt, Human
uccugcaggcagccagg

SEQ ID NO: 1200806 - RNA, 16 nt, Human
uccugcaggcagccag

SEQ ID NO: 1200807 - RNA, 21 nt, Human
uccugccucgaacuggcugca

SEQ ID NO: 1200808 - RNA, 20 nt, Human
uccugccucgaacuggcugc

SEQ ID NO: 1200809 - RNA, 15 nt, Human
uccucuccccagcaa

SEQ ID NO: 1200810 - RNA, 14 nt, Human
acugcaaccuccgc

SEQ ID NO: 1200811 - RNA, 13 nt, Human
acugcaaccuccg

SEQ ID NO: 1200812 - RNA, 22 nt, Human
acugcaaccuccgccucuuggg

SEQ ID NO: 1200813 - RNA, 16 nt, Human
acugcaaccuccgccu

SEQ ID NO: 1200814 - RNA, 21 nt, Human
acugaguacguugugcauuug

SEQ ID NO: 1200815 - RNA, 19 nt, Human
acugaguacguugugcauu

SEQ ID NO: 1200816 - RNA, 18 nt, Human
acugaguacguugugcau

SEQ ID NO: 1200817 - RNA, 23 nt, Human
acugaguacguugugcauuuggu

SEQ ID NO: 1200818 - RNA, 22 nt, Human
acugaguacguugugcauuugg

SEQ ID NO: 1200819 - RNA, 19 nt, Human
uccuguucccaugagauga

SEQ ID NO: 1200820 - RNA, 18 nt, Human
uccugugugugcgccuac

SEQ ID NO: 1200821 - RNA, 14 nt, Human
uccugugugugcgc

SEQ ID NO: 1200822 - RNA, 13 nt, Human
uccugugugugcg

SEQ ID NO: 1200823 - RNA, 24 nt, Human
uccugugucuugcaauggcagccu

SEQ ID NO: 1200824 - RNA, 23 nt, Human
uccugugucuugcaauggcagcc

SEQ ID NO: 1200825 - RNA, 22 nt, Human
acugcagccucaaccuccuggg

SEQ ID NO: 1200826 - RNA, 21 nt, Human
acugcagccucaaccuccugg

SEQ ID NO: 1200827 - RNA, 19 nt, Human
acugcagccucaaccuccu

SEQ ID NO: 1200828 - RNA, 23 nt, Human
acugcagccucaaccuccugggc

SEQ ID NO: 1200829 - RNA, 21 nt, Human
uccugcugcaguugccaguca

SEQ ID NO: 1200830 - RNA, 13 nt, Human
uccugcugcaguu

SEQ ID NO: 1200831 - RNA, 21 nt, Human
acucuccucugcugcuggcug

SEQ ID NO: 1200832 - RNA, 19 nt, Human
acucuccucugcugcuggc

SEQ ID NO: 1200833 - RNA, 18 nt, Human
acucuccucugcugcugg

SEQ ID NO: 1200834 - RNA, 17 nt, Human
acucuccucugcugcug

SEQ ID NO: 1200835 - RNA, 23 nt, Human
acucgcgacaaugcaaaccauca

SEQ ID NO: 1200836 - RNA, 20 nt, Human
acucgcgacaaugcaaacca

SEQ ID NO: 1200837 - RNA, 18 nt, Human
acucgcgacaaugcaaac

SEQ ID NO: 1200838 - RNA, 19 nt, Human
uccuaggcauuugcugaau

SEQ ID NO: 1200839 - RNA, 20 nt, Human
uccucagaucuucugugggu

SEQ ID NO: 1200840 - RNA, 19 nt, Human
acucuuauugcccacgcug

SEQ ID NO: 1200841 - RNA, 16 nt, Human
acucuuauugcccacg

SEQ ID NO: 1200842 - RNA, 19 nt, Human
uccucccucccucuuuccc

SEQ ID NO: 1200843 - RNA, 17 nt, Human
uccucccucccucuuuc

SEQ ID NO: 1200844 - RNA, 12 nt, Human
uccucuccccag

SEQ ID NO: 1200845 - RNA, 18 nt, Human
uccucauacccaccccca

SEQ ID NO: 1200846 - RNA, 14 nt, Human
uccucauacccacc

SEQ ID NO: 1200847 - RNA, 22 nt, Human
uccucauacccacccccaccca

SEQ ID NO: 1200848 - RNA, 22 nt, Human
ucccucauccucauacccaccc

SEQ ID NO: 1200849 - RNA, 21 nt, Human
ucccucagucuggcccuuccu

SEQ ID NO: 1200850 - RNA, 20 nt, Human
uccuagcacuuugggaggcc

SEQ ID NO: 1200851 - RNA, 14 nt, Human
uccuaggcauuugc

SEQ ID NO: 1200852 - RNA, 23 nt, Human
ucccuuugacgccaucccagccc

SEQ ID NO: 1200853 - RNA, 22 nt, Human
ucccuuugacgccaucccagcc

SEQ ID NO: 1200854 - RNA, 22 nt, Human
ucccuuuccaaaugcccagcuu

SEQ ID NO: 1200855 - RNA, 22 nt, Human
ucccuuacgugaguccuggcau

SEQ ID NO: 1200856 - RNA, 18 nt, Human
ucccuuacgugaguccug

SEQ ID NO: 1200857 - RNA, 12 nt, Human
acuccugcaggc

SEQ ID NO: 1200858 - RNA, 16 nt, Human
ucccgaauagcuggga

SEQ ID NO: 1200859 - RNA, 15 nt, Human
ucccgaauagcuggg

SEQ ID NO: 1200860 - RNA, 18 nt, Human
ucccuauuagagaagaga

SEQ ID NO: 1200861 - RNA, 18 nt, Human
ucccgaauagcugggacu

SEQ ID NO: 1200862 - RNA, 24 nt, Human
uccccaccgcagacaggaccaggg

SEQ ID NO: 1200863 - RNA, 18 nt, Human
acuauagccuaggugaca

SEQ ID NO: 1200864 - RNA, 17 nt, Human
acuauagccuaggugac

SEQ ID NO: 1200865 - RNA, 23 nt, Human
acuauaauuuaccugaagucuuu

SEQ ID NO: 1200866 - RNA, 23 nt, Human
acuauguugcccaggcaggucuu

SEQ ID NO: 1200867 - RNA, 20 nt, Human
acuauguugcccaggcaggu

SEQ ID NO: 1200868 - RNA, 19 nt, Human
acuauguugcccaggcagg

SEQ ID NO: 1200869 - RNA, 18 nt, Human
acuauguugcccaggcag

SEQ ID NO: 1200870 - RNA, 16 nt, Human
acuaucuaaauguuga

SEQ ID NO: 1200871 - RNA, 24 nt, Human
uccagccugggugacagagcaagu

SEQ ID NO: 1200872 - RNA, 13 nt, Human
uccagccugggug

SEQ ID NO: 1200873 - RNA, 15 nt, Human
uccagcucaccagcc

SEQ ID NO: 1200874 - RNA, 14 nt, Human
uccagcucaccagc

SEQ ID NO: 1200875 - RNA, 12 nt, Human
acguuucuaaag

SEQ ID NO: 1200876 - RNA, 14 nt, Human
acguuucuaaaggc

SEQ ID NO: 1200877 - RNA, 15 nt, Human
acguuucuaaaggcu

SEQ ID NO: 1200878 - RNA, 15 nt, Human
acuacaguccuccca

SEQ ID NO: 1200879 - RNA, 17 nt, Human
acuaaccagcagaaaug

SEQ ID NO: 1200880 - RNA, 16 nt, Human
acuaaccagcagaaau

SEQ ID NO: 1200881 - RNA, 13 nt, Human
acuaaccacgcug

SEQ ID NO: 1200882 - RNA, 22 nt, Human
ucccagugccgagaaggaagcc

SEQ ID NO: 1200883 - RNA, 19 nt, Human
ucccagugccgagaaggaa

SEQ ID NO: 1200884 - RNA, 11 nt, Human
acuacauucug

SEQ ID NO: 1200885 - RNA, 17 nt, Human
acuacaguccucccauc

SEQ ID NO: 1200886 - RNA, 16 nt, Human
acuacaguccucccau

SEQ ID NO: 1200887 - RNA, 19 nt, Human
ucccaucucacacaugagc

SEQ ID NO: 1200888 - RNA, 14 nt, Human
ucccaucucacaca

SEQ ID NO: 1200889 - RNA, 13 nt, Human
ucccaucucacac

SEQ ID NO: 1200890 - RNA, 16 nt, Human
ucccauaugccugggc

SEQ ID NO: 1200891 - RNA, 15 nt, Human
ucccauaugccuggg

SEQ ID NO: 1200892 - RNA, 19 nt, Human
ucaugacaaagacugagua

SEQ ID NO: 1200893 - RNA, 23 nt, Human
ucauccacugugccaugugccag

SEQ ID NO: 1200894 - RNA, 21 nt, Human
ucauccacugugccaugugcc

SEQ ID NO: 1200895 - RNA, 19 nt, Human
ucauccacugugccaugug

SEQ ID NO: 1200896 - RNA, 17 nt, Human
ucauguucuuaauucuu

SEQ ID NO: 1200897 - RNA, 11 nt, Human
ucauguucuua

SEQ ID NO: 1200898 - RNA, 13 nt, Human
ucaugucuggcua

SEQ ID NO: 1200899 - RNA, 15 nt, Human
accucucccuuggau

SEQ ID NO: 1200900 - RNA, 14 nt, Human
accucucccuugga

SEQ ID NO: 1200901 - RNA, 13 nt, Human
accucucccuugg

SEQ ID NO: 1200902 - RNA, 12 nt, Human
accucugcacaa

SEQ ID NO: 1200903 - RNA, 19 nt, Human
accucucucacuccuugaa

SEQ ID NO: 1200904 - RNA, 14 nt, Human
accucucucacucc

SEQ ID NO: 1200905 - RNA, 23 nt, Human
accucucccuuggauuguccccg

SEQ ID NO: 1200906 - RNA, 17 nt, Human
accucggugccuuccuc

SEQ ID NO: 1200907 - RNA, 22 nt, Human
ucauugaccugaggcccuucuc

SEQ ID NO: 1200908 - RNA, 21 nt, Human
ucauucuccuuguguuacuaa

SEQ ID NO: 1200909 - RNA, 17 nt, Human
accgccaaggcuggggg

SEQ ID NO: 1200910 - RNA, 20 nt, Human
accgcagacaggaccaggga

SEQ ID NO: 1200911 - RNA, 22 nt, Human
ucauauuuacuucuuauacauu

SEQ ID NO: 1200912 - RNA, 21 nt, Human
ucauauuuacuucuuauacau

SEQ ID NO: 1200913 - RNA, 20 nt, Human
ucauauuuacuucuuauaca

SEQ ID NO: 1200914 - RNA, 10 nt, Human
acccuuuucu

SEQ ID NO: 1200915 - RNA, 13 nt, Human
accuagccuuaga

SEQ ID NO: 1200916 - RNA, 20 nt, Human
accuccgccucuuggguuca

SEQ ID NO: 1200917 - RNA, 11 nt, Human
accucagccuc

SEQ ID NO: 1200918 - RNA, 22 nt, Human
accugaagucuuuguacagaca

SEQ ID NO: 1200919 - RNA, 15 nt, Human
accugaagucuuugu

SEQ ID NO: 1200920 - RNA, 22 nt, Human
accugcggugcuaucuccccca

SEQ ID NO: 1200921 - RNA, 19 nt, Human
accugcggugcuaucuccc

SEQ ID NO: 1200922 - RNA, 23 nt, Human
accugcggugcuaucucccccag

SEQ ID NO: 1200923 - RNA, 19 nt, Human
ucauuugagcagggcucag

SEQ ID NO: 1200924 - RNA, 17 nt, Human
accuggaauauauaacc

SEQ ID NO: 1200925 - RNA, 14 nt, Human
accuggaauauaua

SEQ ID NO: 1200926 - RNA, 21 nt, Human
ucauuugagcagggcucagcg

SEQ ID NO: 1200927 - RNA, 17 nt, Human
ucauuuuuuuuaagaaa

SEQ ID NO: 1200928 - RNA, 13 nt, Human
ucauuuuuuuuaa

SEQ ID NO: 1200929 - RNA, 16 nt, Human
uccaagcuggucccac

SEQ ID NO: 1200930 - RNA, 11 nt, Human
uccaagcuggu

SEQ ID NO: 1200931 - RNA, 13 nt, Human
uccaagcucccag

SEQ ID NO: 1200932 - RNA, 12 nt, Human
uccaagcuccca

SEQ ID NO: 1200933 - RNA, 15 nt, Human
uccaagcucccaggc

SEQ ID NO: 1200934 - RNA, 14 nt, Human
uccaagcucccagg

SEQ ID NO: 1200935 - RNA, 16 nt, Human
uccaagcucccaggca

SEQ ID NO: 1200936 - RNA, 12 nt, Human
accuucuccuuc

SEQ ID NO: 1200937 - RNA, 16 nt, Human
accuugacagggcaca

SEQ ID NO: 1200938 - RNA, 15 nt, Human
accuugacagggcac

SEQ ID NO: 1200939 - RNA, 14 nt, Human
accuugacagggca

SEQ ID NO: 1200940 - RNA, 13 nt, Human
accuucuccuuca

SEQ ID NO: 1200941 - RNA, 14 nt, Human
accuucuccuucac

SEQ ID NO: 1200942 - RNA, 17 nt, Human
accuuagacagucccug

SEQ ID NO: 1200943 - RNA, 18 nt, Human
uccaccaucaagccacca

SEQ ID NO: 1200944 - RNA, 15 nt, Human
uccaccaucaagcca

SEQ ID NO: 1200945 - RNA, 22 nt, Human
uccagccccuggaugcagccuc

SEQ ID NO: 1200946 - RNA, 21 nt, Human
uccagccccuggaugcagccu

SEQ ID NO: 1200947 - RNA, 19 nt, Human
uccagccccuggaugcagc

SEQ ID NO: 1200948 - RNA, 17 nt, Human
uccagccccuggaugca

SEQ ID NO: 1200949 - RNA, 16 nt, Human
uccagccccuggaugc

SEQ ID NO: 1200950 - RNA, 15 nt, Human
uccagccccuggaug

SEQ ID NO: 1200951 - RNA, 14 nt, Human
uccagacccggcug

SEQ ID NO: 1200952 - RNA, 22 nt, Human
uccagaaguuugagaucagccu

SEQ ID NO: 1200953 - RNA, 13 nt, Human
accuuugucccca

SEQ ID NO: 1200954 - RNA, 23 nt, Human
accuuuguauucucuccuguacc

SEQ ID NO: 1200955 - RNA, 19 nt, Human
accuuuguauucucuccug

SEQ ID NO: 1200956 - RNA, 15 nt, Human
accuuuguauucucu

SEQ ID NO: 1200957 - RNA, 12 nt, Human
ucaggccaggcc

SEQ ID NO: 1200958 - RNA, 11 nt, Human
ucaggccaggc

SEQ ID NO: 1200959 - RNA, 20 nt, Human
ucaggccagcugcuugggcu

SEQ ID NO: 1200960 - RNA, 15 nt, Human
ucaggccagcugcuu

SEQ ID NO: 1200961 - RNA, 19 nt, Human
accccuucgcuccuguguc

SEQ ID NO: 1200962 - RNA, 16 nt, Human
ucagguaacaggcaga

SEQ ID NO: 1200963 - RNA, 15 nt, Human
ucagguaacaggcag

SEQ ID NO: 1200964 - RNA, 13 nt, Human
ucagguaacaggc

SEQ ID NO: 1200965 - RNA, 18 nt, Human
ucagggucccugguggca

SEQ ID NO: 1200966 - RNA, 14 nt, Human
ucagggucccuggu

SEQ ID NO: 1200967 - RNA, 13 nt, Human
ucagggucccugg

SEQ ID NO: 1200968 - RNA, 18 nt, Human
ucagcggggacagcuccu

SEQ ID NO: 1200969 - RNA, 17 nt, Human
ucagcggggacagcucc

SEQ ID NO: 1200970 - RNA, 16 nt, Human
ucagcggggacagcuc

SEQ ID NO: 1200971 - RNA, 23 nt, Human
ucaggccaaacucaccugccccu

SEQ ID NO: 1200972 - RNA, 20 nt, Human
ucaggccaaacucaccugcc

SEQ ID NO: 1200973 - RNA, 20 nt, Human
ucaggaagcucagggccugg

SEQ ID NO: 1200974 - RNA, 19 nt, Human
ucaggaagcucagggccug

SEQ ID NO: 1200975 - RNA, 17 nt, Human
ucaggaagcucagggcc

SEQ ID NO: 1200976 - RNA, 12 nt, Human
ucaggaagcuca

SEQ ID NO: 1200977 - RNA, 20 nt, Human
accccuucgcuccugugucu

SEQ ID NO: 1200978 - RNA, 20 nt, Human
acccuuguggucccacccca

SEQ ID NO: 1200979 - RNA, 19 nt, Human
acccuuguggucccacccc

SEQ ID NO: 1200980 - RNA, 17 nt, Human
acccuuguggucccacc

SEQ ID NO: 1200981 - RNA, 16 nt, Human
acccuuguggucccac

SEQ ID NO: 1200982 - RNA, 14 nt, Human
acccugcccugugg

SEQ ID NO: 1200983 - RNA, 13 nt, Human
acccugcccugug

SEQ ID NO: 1200984 - RNA, 12 nt, Human
acccugcccugu

SEQ ID NO: 1200985 - RNA, 11 nt, Human
acccugcccug

SEQ ID NO: 1200986 - RNA, 14 nt, Human
acccucuuagaaaa

SEQ ID NO: 1200987 - RNA, 15 nt, Human
acccagcucuggucc

SEQ ID NO: 1200988 - RNA, 13 nt, Human
acccagcucuggu

SEQ ID NO: 1200989 - RNA, 13 nt, Human
ucagaucuucugu

SEQ ID NO: 1200990 - RNA, 14 nt, Human
ucagaagacacuga

SEQ ID NO: 1200991 - RNA, 13 nt, Human
ucagaagacacug

SEQ ID NO: 1200992 - RNA, 12 nt, Human
ucagccugggca

SEQ ID NO: 1200993 - RNA, 10 nt, Human
ucagccuggg

SEQ ID NO: 1200994 - RNA, 15 nt, Human
acccccagccugcua

SEQ ID NO: 1200995 - RNA, 11 nt, Human
accagacaggu

SEQ ID NO: 1200996 - RNA, 23 nt, Human
accagacaccuugacagggcaca

SEQ ID NO: 1200997 - RNA, 22 nt, Human
accagacaccuugacagggcac

SEQ ID NO: 1200998 - RNA, 12 nt, Human
accacuuuuguu

SEQ ID NO: 1200999 - RNA, 12 nt, Human
accagagcugcc

SEQ ID NO: 1201000 - RNA, 12 nt, Human
accagagcccac

SEQ ID NO: 1201001 - RNA, 22 nt, Human
accagagcccaccuuggcucaa

SEQ ID NO: 1201002 - RNA, 19 nt, Human
accagagcccaccuuggcu

SEQ ID NO: 1201003 - RNA, 23 nt, Human
ucaccugaagacucauucuucug

SEQ ID NO: 1201004 - RNA, 19 nt, Human
ucaccugaagacucauucu

SEQ ID NO: 1201005 - RNA, 14 nt, Human
accacaucuugcuc

SEQ ID NO: 1201006 - RNA, 22 nt, Human
accacagacauacuaaccagca

SEQ ID NO: 1201007 - RNA, 21 nt, Human
accacagacauacuaaccagc

SEQ ID NO: 1201008 - RNA, 20 nt, Human
accacucuaucaaguauuau

SEQ ID NO: 1201009 - RNA, 24 nt, Human
accacaucuugcucugcugacaga

SEQ ID NO: 1201010 - RNA, 21 nt, Human
accacaucuugcucugcugac

SEQ ID NO: 1201011 - RNA, 20 nt, Human
accacaucuugcucugcuga

SEQ ID NO: 1201012 - RNA, 16 nt, Human
accacaucuugcucug

SEQ ID NO: 1201013 - RNA, 17 nt, Human
accacugcacuccagcc

SEQ ID NO: 1201014 - RNA, 14 nt, Human
accacuucagcuga

SEQ ID NO: 1201015 - RNA, 13 nt, Human
accacuucagcug

SEQ ID NO: 1201016 - RNA, 15 nt, Human
accacuucagcugac

SEQ ID NO: 1201017 - RNA, 18 nt, Human
acccagcccacuucugcc

SEQ ID NO: 1201018 - RNA, 17 nt, Human
acccagcccacuucugc

SEQ ID NO: 1201019 - RNA, 16 nt, Human
acccagcccacuucug

SEQ ID NO: 1201020 - RNA, 16 nt, Human
acccagaagaaaauag

SEQ ID NO: 1201021 - RNA, 23 nt, Human
accauuuugggguacccacugcu

SEQ ID NO: 1201022 - RNA, 16 nt, Human
accauucuccaccugc

SEQ ID NO: 1201023 - RNA, 13 nt, Human
accauucuccacc

SEQ ID NO: 1201024 - RNA, 18 nt, Human
accauucuccaccugcca

SEQ ID NO: 1201025 - RNA, 22 nt, Human
accaugauuaaccacuucagcu

SEQ ID NO: 1201026 - RNA, 23 nt, Human
accaugauuaaccacuucagcug

SEQ ID NO: 1201027 - RNA, 19 nt, Human
ucacuguugcccaggcugg

SEQ ID NO: 1201028 - RNA, 18 nt, Human
ucacuguugcccaggcug

SEQ ID NO: 1201029 - RNA, 17 nt, Human
ucacuguugcccaggcu

SEQ ID NO: 1201030 - RNA, 21 nt, Human
accaguguuguggauuuaaca

SEQ ID NO: 1201031 - RNA, 15 nt, Human
ucacugagacagccc

SEQ ID NO: 1201032 - RNA, 14 nt, Human
ucacugagacagcc

SEQ ID NO: 1201033 - RNA, 13 nt, Human
ucacugagacagc

SEQ ID NO: 1201034 - RNA, 16 nt, Human
ucacugagacagcccg

SEQ ID NO: 1201035 - RNA, 13 nt, Human
ucacugcagccuc

SEQ ID NO: 1201036 - RNA, 12 nt, Human
ucacugcagccu

SEQ ID NO: 1201037 - RNA, 19 nt, Human
uauguuuuaagaggcaggg

SEQ ID NO: 1201038 - RNA, 17 nt, Human
uauguuuuaagaggcag

SEQ ID NO: 1201039 - RNA, 22 nt, Human
uauuaaaaaucucaaauuucua

SEQ ID NO: 1201040 - RNA, 20 nt, Human
uauuaaaaaucucaaauuuc

SEQ ID NO: 1201041 - RNA, 18 nt, Human
uauuaaaaaucucaaauu

SEQ ID NO: 1201042 - RNA, 16 nt, Human
uauuaaaaaucucaaa

SEQ ID NO: 1201043 - RNA, 23 nt, Human
uauuaaaaaucucaaauuucuaa

SEQ ID NO: 1201044 - RNA, 12 nt, Human
uauuagagaaga

SEQ ID NO: 1201045 - RNA, 16 nt, Human
uauuaccacagacaua

SEQ ID NO: 1201046 - RNA, 22 nt, Human
uauucaggaagcucagggccug

SEQ ID NO: 1201047 - RNA, 18 nt, Human
uauucaggaagcucaggg

SEQ ID NO: 1201048 - RNA, 15 nt, Human
acaguuaagagaaau

SEQ ID NO: 1201049 - RNA, 22 nt, Human
acaguccuuaccagcagagcac

SEQ ID NO: 1201050 - RNA, 21 nt, Human
acaguccuuaccagcagagca

SEQ ID NO: 1201051 - RNA, 20 nt, Human
acaguccuuaccagcagagc

SEQ ID NO: 1201052 - RNA, 18 nt, Human
acaguccuuaccagcaga

SEQ ID NO: 1201053 - RNA, 17 nt, Human
acaguccucccaucuca

SEQ ID NO: 1201054 - RNA, 15 nt, Human
acaguccucccaucu

SEQ ID NO: 1201055 - RNA, 14 nt, Human
acaguccucccauc

SEQ ID NO: 1201056 - RNA, 13 nt, Human
acaguccucccau

SEQ ID NO: 1201057 - RNA, 15 nt, Human
acagucccugccaau

SEQ ID NO: 1201058 - RNA, 13 nt, Human
acagucccugcca

SEQ ID NO: 1201059 - RNA, 19 nt, Human
acaguauuacuucugcuac

SEQ ID NO: 1201060 - RNA, 17 nt, Human
acaguauuacuucugcu

SEQ ID NO: 1201061 - RNA, 16 nt, Human
acaguauuacuucugc

SEQ ID NO: 1201062 - RNA, 15 nt, Human
acaguauuacuucug

SEQ ID NO: 1201063 - RNA, 22 nt, Human
acagggcacaccgggcacucag

SEQ ID NO: 1201064 - RNA, 22 nt, Human
acagguuuuccugaagaauuga

SEQ ID NO: 1201065 - RNA, 21 nt, Human
acaggcugggcuucaguggca

SEQ ID NO: 1201066 - RNA, 17 nt, Human
acaggcugggcuucagu

SEQ ID NO: 1201067 - RNA, 14 nt, Human
acaggcugggcuuc

SEQ ID NO: 1201068 - RNA, 17 nt, Human
uauugucaaagugguga

SEQ ID NO: 1201069 - RNA, 13 nt, Human
uauugucaaagug

SEQ ID NO: 1201070 - RNA, 21 nt, Human
uauuuaaugaaagacuguaca

SEQ ID NO: 1201071 - RNA, 15 nt, Human
uauuuaaugaaagac

SEQ ID NO: 1201072 - RNA, 13 nt, Human
uauuuauuuaaau

SEQ ID NO: 1201073 - RNA, 14 nt, Human
uauuuauuuaaauu

SEQ ID NO: 1201074 - RNA, 23 nt, Human
uauuuaauuuuuuugagacagag

SEQ ID NO: 1201075 - RNA, 18 nt, Human
uauuuacuucuuauacau

SEQ ID NO: 1201076 - RNA, 15 nt, Human
uauucuuauuuaaug

SEQ ID NO: 1201077 - RNA, 16 nt, Human
uauucuguuggccagu

SEQ ID NO: 1201078 - RNA, 24 nt, Human
uauucucuccuguaccucuugagc

SEQ ID NO: 1201079 - RNA, 20 nt, Human
uauucucuccuguaccucuu

SEQ ID NO: 1201080 - RNA, 17 nt, Human
acaguucucuccuucuu

SEQ ID NO: 1201081 - RNA, 20 nt, Human
acaguucaauucucauuugu

SEQ ID NO: 1201082 - RNA, 20 nt, Human
acaguuacucagaauucucu

SEQ ID NO: 1201083 - RNA, 13 nt, Human
acaguuacucaga

SEQ ID NO: 1201084 - RNA, 16 nt, Human
acaguucucuccuucu

SEQ ID NO: 1201085 - RNA, 17 nt, Human
acagacccugcccugug

SEQ ID NO: 1201086 - RNA, 23 nt, Human
acagacacaggcccggcuccagg

SEQ ID NO: 1201087 - RNA, 13 nt, Human
acacuccuucaca

SEQ ID NO: 1201088 - RNA, 11 nt, Human
acacuccuuca

SEQ ID NO: 1201089 - RNA, 17 nt, Human
acagacuggaagcacag

SEQ ID NO: 1201090 - RNA, 14 nt, Human
acagacuggaagca

SEQ ID NO: 1201091 - RNA, 20 nt, Human
acagacccugcccugugggc

SEQ ID NO: 1201092 - RNA, 18 nt, Human
acagacccugcccugugg

SEQ ID NO: 1201093 - RNA, 18 nt, Human
uaucacccagaagaaaau

SEQ ID NO: 1201094 - RNA, 21 nt, Human
uaucaaguauuauaccuuuuu

SEQ ID NO: 1201095 - RNA, 18 nt, Human
acagagcuacacagggga

SEQ ID NO: 1201096 - RNA, 16 nt, Human
acagagcuacacaggg

SEQ ID NO: 1201097 - RNA, 16 nt, Human
uaucuagauacuguau

SEQ ID NO: 1201098 - RNA, 15 nt, Human
uaucuagauacugua

SEQ ID NO: 1201099 - RNA, 10 nt, Human
uaucagaauu

SEQ ID NO: 1201100 - RNA, 19 nt, Human
uaucuagauacuguaucau

SEQ ID NO: 1201101 - RNA, 18 nt, Human
uaucucccccagccccau

SEQ ID NO: 1201102 - RNA, 17 nt, Human
uaucucccccagcccca

SEQ ID NO: 1201103 - RNA, 16 nt, Human
uauggcuuuugugcau

SEQ ID NO: 1201104 - RNA, 17 nt, Human
acagcuaacauggaagu

SEQ ID NO: 1201105 - RNA, 15 nt, Human
acagcuaacauggaa

SEQ ID NO: 1201106 - RNA, 14 nt, Human
acagcuaacaugga

SEQ ID NO: 1201107 - RNA, 19 nt, Human
uaugcucugcauguuacau

SEQ ID NO: 1201108 - RNA, 18 nt, Human
uaugcucugcauguuaca

SEQ ID NO: 1201109 - RNA, 20 nt, Human
acagaguuuucacucuuauu

SEQ ID NO: 1201110 - RNA, 18 nt, Human
acagaguuuucacucuua

SEQ ID NO: 1201111 - RNA, 15 nt, Human
acagaguuguuacau

SEQ ID NO: 1201112 - RNA, 23 nt, Human
uaugaucacggcucacugcagcc

SEQ ID NO: 1201113 - RNA, 21 nt, Human
uaugaucacggcucacugcag

SEQ ID NO: 1201114 - RNA, 13 nt, Human
uaugaggcauuug

SEQ ID NO: 1201115 - RNA, 15 nt, Human
uaucuugaagacuuu

SEQ ID NO: 1201116 - RNA, 20 nt, Human
uauaaccaguguuguggauu

SEQ ID NO: 1201117 - RNA, 14 nt, Human
uauacauuugauaa

SEQ ID NO: 1201118 - RNA, 14 nt, Human
uauacauaaacaag

SEQ ID NO: 1201119 - RNA, 13 nt, Human
uauacauaaacaa

SEQ ID NO: 1201120 - RNA, 21 nt, Human
uauacacuuacacuuuaugca

SEQ ID NO: 1201121 - RNA, 23 nt, Human
acacucauugaccugaggcccuu

SEQ ID NO: 1201122 - RNA, 21 nt, Human
acacucauugaccugaggccc

SEQ ID NO: 1201123 - RNA, 20 nt, Human
uauagccuaggugacagagu

SEQ ID NO: 1201124 - RNA, 20 nt, Human
uaguuccucauuagcauuuu

SEQ ID NO: 1201125 - RNA, 23 nt, Human
acaagcugcacccucaggcaggu

SEQ ID NO: 1201126 - RNA, 22 nt, Human
acaagcugcacccucaggcagg

SEQ ID NO: 1201127 - RNA, 21 nt, Human
acaagcugcacccucaggcag

SEQ ID NO: 1201128 - RNA, 19 nt, Human
acaagcugcacccucaggc

SEQ ID NO: 1201129 - RNA, 21 nt, Human
uagucaggugccucaagagaa

SEQ ID NO: 1201130 - RNA, 19 nt, Human
acacccugugauggggccc

SEQ ID NO: 1201131 - RNA, 18 nt, Human
acacccugugauggggcc

SEQ ID NO: 1201132 - RNA, 12 nt, Human
acacccugugau

SEQ ID NO: 1201133 - RNA, 11 nt, Human
acacccuguga

SEQ ID NO: 1201134 - RNA, 21 nt, Human
acacccagcccacuucugcca

SEQ ID NO: 1201135 - RNA, 20 nt, Human
acacccagcccacuucugcc

SEQ ID NO: 1201136 - RNA, 21 nt, Human
acacaugcaaggucauuuuuu

SEQ ID NO: 1201137 - RNA, 20 nt, Human
acacaugcaaggucauuuuu

SEQ ID NO: 1201138 - RNA, 19 nt, Human
acacaugcaaggucauuuu

SEQ ID NO: 1201139 - RNA, 15 nt, Human
uacguacacauuuua

SEQ ID NO: 1201140 - RNA, 22 nt, Human
aauucuucuccacuuucuagcc

SEQ ID NO: 1201141 - RNA, 20 nt, Human
aauucuugcaaaguaucccu

SEQ ID NO: 1201142 - RNA, 14 nt, Human
aauucuugcaaagu

SEQ ID NO: 1201143 - RNA, 16 nt, Human
uacuauguaucaauga

SEQ ID NO: 1201144 - RNA, 16 nt, Human
uacuauaauuuaccug

SEQ ID NO: 1201145 - RNA, 14 nt, Human
uacguugugcauuu

SEQ ID NO: 1201146 - RNA, 13 nt, Human
uacguugugcauu

SEQ ID NO: 1201147 - RNA, 14 nt, Human
uacgucugacaggc

SEQ ID NO: 1201148 - RNA, 21 nt, Human
aauuucuaaaucuccaaaaua

SEQ ID NO: 1201149 - RNA, 13 nt, Human
aauuucuaaaucu

SEQ ID NO: 1201150 - RNA, 17 nt, Human
aauuuagaaauauaauu

SEQ ID NO: 1201151 - RNA, 15 nt, Human
aauuuaccugaaguc

SEQ ID NO: 1201152 - RNA, 19 nt, Human
aauuuacauacucugcuua

SEQ ID NO: 1201153 - RNA, 13 nt, Human
aauuuaaaagucu

SEQ ID NO: 1201154 - RNA, 22 nt, Human
aauuguuuggggaugagaaagg

SEQ ID NO: 1201155 - RNA, 16 nt, Human
uagaagucacacagua

SEQ ID NO: 1201156 - RNA, 17 nt, Human
uagaagucuuagaugua

SEQ ID NO: 1201157 - RNA, 16 nt, Human
uagaagucuuagaugu

SEQ ID NO: 1201158 - RNA, 20 nt, Human
uagaagucuuagauguauau

SEQ ID NO: 1201159 - RNA, 19 nt, Human
uagaagucuuagauguaua

SEQ ID NO: 1201160 - RNA, 18 nt, Human
uagaagucuuagauguau

SEQ ID NO: 1201161 - RNA, 18 nt, Human
uagacaauuuauuauggc

SEQ ID NO: 1201162 - RNA, 16 nt, Human
uagacaauuuauuaug

SEQ ID NO: 1201163 - RNA, 18 nt, Human
aauuuuuauuaaauuaug

SEQ ID NO: 1201164 - RNA, 17 nt, Human
aauuuuuauuaaauuau

SEQ ID NO: 1201165 - RNA, 16 nt, Human
uagacagucccugcca

SEQ ID NO: 1201166 - RNA, 14 nt, Human
uagacagucccugc

SEQ ID NO: 1201167 - RNA, 12 nt, Human
uagacagucccu

SEQ ID NO: 1201168 - RNA, 17 nt, Human
aauuuuuuugagacaga

SEQ ID NO: 1201169 - RNA, 13 nt, Human
acaaaaacauggc

SEQ ID NO: 1201170 - RNA, 21 nt, Human
acaacacucauugaccugagg

SEQ ID NO: 1201171 - RNA, 12 nt, Human
acaacacucaca

SEQ ID NO: 1201172 - RNA, 15 nt, Human
acaacaacaaaauga

SEQ ID NO: 1201173 - RNA, 21 nt, Human
acaagcgugagccacugcacc

SEQ ID NO: 1201174 - RNA, 20 nt, Human
acaagcgugagccacugcac

SEQ ID NO: 1201175 - RNA, 13 nt, Human
acaagcugcaccc

SEQ ID NO: 1201176 - RNA, 12 nt, Human
acaagccacccc

SEQ ID NO: 1201177 - RNA, 18 nt, Human
acaagagcccaggccucc

SEQ ID NO: 1201178 - RNA, 17 nt, Human
acaagagcccaggccuc

SEQ ID NO: 1201179 - RNA, 19 nt, Human
uagcacagacccugcccug

SEQ ID NO: 1201180 - RNA, 18 nt, Human
uagcacagacccugcccu

SEQ ID NO: 1201181 - RNA, 17 nt, Human
uagcacagacccugccc

SEQ ID NO: 1201182 - RNA, 22 nt, Human
uagauuuuagacccuauugcug

SEQ ID NO: 1201183 - RNA, 16 nt, Human
acaaaaagcauaaaaa

SEQ ID NO: 1201184 - RNA, 17 nt, Human
uaccacuuuuguucuug

SEQ ID NO: 1201185 - RNA, 17 nt, Human
uaccauccccuguagag

SEQ ID NO: 1201186 - RNA, 22 nt, Human
uacccuggcacuauaauguaag

SEQ ID NO: 1201187 - RNA, 20 nt, Human
uacccuggcacuauaaugua

SEQ ID NO: 1201188 - RNA, 16 nt, Human
uacccucauguucuua

SEQ ID NO: 1201189 - RNA, 20 nt, Human
uacccgggaagggggcuggg

SEQ ID NO: 1201190 - RNA, 15 nt, Human
aaugucacaggcagg

SEQ ID NO: 1201191 - RNA, 22 nt, Human
aauuaacuuuuauaaacuuuac

SEQ ID NO: 1201192 - RNA, 20 nt, Human
aauuaacuuuuauaaacuuu

SEQ ID NO: 1201193 - RNA, 18 nt, Human
aauuaacuuuuauaaacu

SEQ ID NO: 1201194 - RNA, 13 nt, Human
aauuaaguacuau

SEQ ID NO: 1201195 - RNA, 15 nt, Human
uacauaaugcgugca

SEQ ID NO: 1201196 - RNA, 15 nt, Human
uacaguccucccauc

SEQ ID NO: 1201197 - RNA, 12 nt, Human
uacaguccuccc

SEQ ID NO: 1201198 - RNA, 18 nt, Human
uacaguaucucagggccu

SEQ ID NO: 1201199 - RNA, 24 nt, Human
uacagcaaggagauuuacaacugg

SEQ ID NO: 1201200 - RNA, 18 nt, Human
uacaguccucccaucuca

SEQ ID NO: 1201201 - RNA, 17 nt, Human
uacaguccucccaucuc

SEQ ID NO: 1201202 - RNA, 14 nt, Human
aaugucacaggcag

SEQ ID NO: 1201203 - RNA, 13 nt, Human
aaugucacaggca

SEQ ID NO: 1201204 - RNA, 15 nt, Human
aauguaagcucuacu

SEQ ID NO: 1201205 - RNA, 13 nt, Human
aauguaagcucua

SEQ ID NO: 1201206 - RNA, 22 nt, Human
aaugguuuucuuguguguuuau

SEQ ID NO: 1201207 - RNA, 18 nt, Human
aaugguuuucuugugugu

SEQ ID NO: 1201208 - RNA, 17 nt, Human
aaugguuuucuugugug

SEQ ID NO: 1201209 - RNA, 23 nt, Human
aauguacagcaaggagauuuaca

SEQ ID NO: 1201210 - RNA, 21 nt, Human
aauguacagcaaggagauuua

SEQ ID NO: 1201211 - RNA, 22 nt, Human
uacagcaaggagauuuacaacu

SEQ ID NO: 1201212 - RNA, 18 nt, Human
uaauuuaccugaagucuu

SEQ ID NO: 1201213 - RNA, 17 nt, Human
uaauuuaccugaagucu

SEQ ID NO: 1201214 - RNA, 15 nt, Human
uacaaaaagcauaaa

SEQ ID NO: 1201215 - RNA, 16 nt, Human
uacaaaaacauggccu

SEQ ID NO: 1201216 - RNA, 20 nt, Human
uacaagcgugagccacugca

SEQ ID NO: 1201217 - RNA, 19 nt, Human
uacaagcgugagccacugc

SEQ ID NO: 1201218 - RNA, 18 nt, Human
uacaagcgugagccacug

SEQ ID NO: 1201219 - RNA, 16 nt, Human
uacaagcgugagccac

SEQ ID NO: 1201220 - RNA, 21 nt, Human
uacaagcgugagccacugcac

SEQ ID NO: 1201221 - RNA, 18 nt, Human
aaugcacaaacagaggcc

SEQ ID NO: 1201222 - RNA, 23 nt, Human
aaugcaaaccaucauugaaaucu

SEQ ID NO: 1201223 - RNA, 22 nt, Human
aaugcaaaccaucauugaaauc

SEQ ID NO: 1201224 - RNA, 16 nt, Human
aaugcaaaccaucauu

SEQ ID NO: 1201225 - RNA, 15 nt, Human
aaugaccuuucaaua

SEQ ID NO: 1201226 - RNA, 14 nt, Human
aaugaccuuucaau

SEQ ID NO: 1201227 - RNA, 13 nt, Human
aaugaccuuucaa

SEQ ID NO: 1201228 - RNA, 21 nt, Human
aaugaaugucagugugacuga

SEQ ID NO: 1201229 - RNA, 20 nt, Human
aaugaaugucagugugacug

SEQ ID NO: 1201230 - RNA, 16 nt, Human
aaugcacuuuguucug

SEQ ID NO: 1201231 - RNA, 13 nt, Human
aaugcacuuuguu

SEQ ID NO: 1201232 - RNA, 20 nt, Human
aaugcacaaacagaggccgc

SEQ ID NO: 1201233 - RNA, 19 nt, Human
aaugcacaaacagaggccg

SEQ ID NO: 1201234 - RNA, 20 nt, Human
aaugcacuuuguucuggcuc

SEQ ID NO: 1201235 - RNA, 19 nt, Human
aaugcacuuuguucuggcu

SEQ ID NO: 1201236 - RNA, 23 nt, Human
uaauuaguuccucauuagcauuu

SEQ ID NO: 1201237 - RNA, 23 nt, Human
uaaugugaaacuggauuaaacuu

SEQ ID NO: 1201238 - RNA, 22 nt, Human
uaaugugaaacuggauuaaacu

SEQ ID NO: 1201239 - RNA, 20 nt, Human
uaaugugaaacuggauuaaa

SEQ ID NO: 1201240 - RNA, 12 nt, Human
uaaugugaaacu

SEQ ID NO: 1201241 - RNA, 17 nt, Human
uaaugucacaggcaggu

SEQ ID NO: 1201242 - RNA, 16 nt, Human
uaaugucacaggcagg

SEQ ID NO: 1201243 - RNA, 15 nt, Human
uaaugucacaggcag

SEQ ID NO: 1201244 - RNA, 17 nt, Human
uaauguaagcucuacug

SEQ ID NO: 1201245 - RNA, 16 nt, Human
uaauguaagcucuacu

SEQ ID NO: 1201246 - RNA, 15 nt, Human
aaugaaugucagugu

SEQ ID NO: 1201247 - RNA, 14 nt, Human
aaugaaugaaacau

SEQ ID NO: 1201248 - RNA, 21 nt, Human
uaauauugauaugcuuauaca

SEQ ID NO: 1201249 - RNA, 14 nt, Human
uaauagacaauuua

SEQ ID NO: 1201250 - RNA, 23 nt, Human
uaauacaccacuacauucuguua

SEQ ID NO: 1201251 - RNA, 22 nt, Human
uaauacaccacuacauucuguu

SEQ ID NO: 1201252 - RNA, 20 nt, Human
aauacaguaucucagggccu

SEQ ID NO: 1201253 - RNA, 11 nt, Human
aagcucccagg

SEQ ID NO: 1201254 - RNA, 13 nt, Human
guguuuauuguca

SEQ ID NO: 1201255 - RNA, 23 nt, Human
aagcucccaggcauuccccagga

SEQ ID NO: 1201256 - RNA, 22 nt, Human
aagcucccaggcauuccccagg

SEQ ID NO: 1201257 - RNA, 12 nt, Human
aagcucccaggc

SEQ ID NO: 1201258 - RNA, 17 nt, Human
aagcucugcuccucucc

SEQ ID NO: 1201259 - RNA, 18 nt, Human
aagcuguuacugucuuca

SEQ ID NO: 1201260 - RNA, 13 nt, Human
aagcucugcuccu

SEQ ID NO: 1201261 - RNA, 23 nt, Human
guugauagcacagacccugcccu

SEQ ID NO: 1201262 - RNA, 13 nt, Human
guucucugcccuc

SEQ ID NO: 1201263 - RNA, 12 nt, Human
guucucugcccu

SEQ ID NO: 1201264 - RNA, 11 nt, Human
guucucugccc

SEQ ID NO: 1201265 - RNA, 16 nt, Human
guucucugaggacacu

SEQ ID NO: 1201266 - RNA, 17 nt, Human
guugggcuggugucacc

SEQ ID NO: 1201267 - RNA, 13 nt, Human
guuggguggaugc

SEQ ID NO: 1201268 - RNA, 17 nt, Human
guugcccaggcuggcgu

SEQ ID NO: 1201269 - RNA, 16 nt, Human
guugcccaggcuggcg

SEQ ID NO: 1201270 - RNA, 15 nt, Human
guugcccaggcuggc

SEQ ID NO: 1201271 - RNA, 15 nt, Human
aaggcuaccuuugua

SEQ ID NO: 1201272 - RNA, 13 nt, Human
aaggcuaccuuug

SEQ ID NO: 1201273 - RNA, 19 nt, Human
aaggccccgcccaggcuua

SEQ ID NO: 1201274 - RNA, 16 nt, Human
aaggccccgcccaggc

SEQ ID NO: 1201275 - RNA, 14 nt, Human
aaggccccgcccag

SEQ ID NO: 1201276 - RNA, 19 nt, Human
aaggaugcccaaagaugca

SEQ ID NO: 1201277 - RNA, 14 nt, Human
aaggaugcccaaag

SEQ ID NO: 1201278 - RNA, 24 nt, Human
aaggaugcacagaguuguuacauu

SEQ ID NO: 1201279 - RNA, 18 nt, Human
aaggagauuuacaacugg

SEQ ID NO: 1201280 - RNA, 16 nt, Human
aaggaaacccagcucu

SEQ ID NO: 1201281 - RNA, 15 nt, Human
aaggaaacccagcuc

SEQ ID NO: 1201282 - RNA, 22 nt, Human
aaggauccugagccagauuuca

SEQ ID NO: 1201283 - RNA, 13 nt, Human
aaggauccugagc

SEQ ID NO: 1201284 - RNA, 12 nt, Human
aaggauccugag

SEQ ID NO: 1201285 - RNA, 11 nt, Human
aaggauccuga

SEQ ID NO: 1201286 - RNA, 20 nt, Human
aaggaggaagagaaaaaaua

SEQ ID NO: 1201287 - RNA, 13 nt, Human
aagucacacagug

SEQ ID NO: 1201288 - RNA, 19 nt, Human
aaguauucuuauuuaauga

SEQ ID NO: 1201289 - RNA, 18 nt, Human
aaguauucuuauuuaaug

SEQ ID NO: 1201290 - RNA, 21 nt, Human
aagucaagugaaaaaggagga

SEQ ID NO: 1201291 - RNA, 24 nt, Human
aagucacacaguauuacuucugcu

SEQ ID NO: 1201292 - RNA, 23 nt, Human
aaguacuucuccacccugcucuc

SEQ ID NO: 1201293 - RNA, 22 nt, Human
aaguacuucuccacccugcucu

SEQ ID NO: 1201294 - RNA, 21 nt, Human
aaguacuucuccacccugcuc

SEQ ID NO: 1201295 - RNA, 15 nt, Human
aaguacuggagaaaa

SEQ ID NO: 1201296 - RNA, 16 nt, Human
aaguacuauguaucaa

SEQ ID NO: 1201297 - RNA, 16 nt, Human
guuuuugucuuaaaaa

SEQ ID NO: 1201298 - RNA, 18 nt, Human
guuuuucuaggccugggg

SEQ ID NO: 1201299 - RNA, 19 nt, Human
aagucuuagauguauauau

SEQ ID NO: 1201300 - RNA, 18 nt, Human
aagucuuagauguauaua

SEQ ID NO: 1201301 - RNA, 18 nt, Human
guuuuacugcagcuuugu

SEQ ID NO: 1201302 - RNA, 16 nt, Human
guuuuacugcagcuuu

SEQ ID NO: 1201303 - RNA, 18 nt, Human
guuuuaaggaugcuugua

SEQ ID NO: 1201304 - RNA, 16 nt, Human
guuuuaagaggcaggg

SEQ ID NO: 1201305 - RNA, 14 nt, Human
guuuuaagaggcag

SEQ ID NO: 1201306 - RNA, 13 nt, Human
guuugcuaaguga

SEQ ID NO: 1201307 - RNA, 17 nt, Human
guuugccucugccucug

SEQ ID NO: 1201308 - RNA, 22 nt, Human
guuucugccgcagcccugcaga

SEQ ID NO: 1201309 - RNA, 22 nt, Human
guuucuaugacacaugcaaggu

SEQ ID NO: 1201310 - RNA, 16 nt, Human
aaggguaucuggugac

SEQ ID NO: 1201311 - RNA, 19 nt, Human
aaggguaucaggugcugcc

SEQ ID NO: 1201312 - RNA, 17 nt, Human
aaggggcaguggugguu

SEQ ID NO: 1201313 - RNA, 14 nt, Human
aaggggcaguggug

SEQ ID NO: 1201314 - RNA, 13 nt, Human
aagggccuggccu

SEQ ID NO: 1201315 - RNA, 14 nt, Human
aaggcugggggaag

SEQ ID NO: 1201316 - RNA, 15 nt, Human
aagggcccagagagg

SEQ ID NO: 1201317 - RNA, 15 nt, Human
aauaacuaaaaggua

SEQ ID NO: 1201318 - RNA, 12 nt, Human
aauaaauuauuu

SEQ ID NO: 1201319 - RNA, 22 nt, Human
aauaacauguaauuaaguacua

SEQ ID NO: 1201320 - RNA, 19 nt, Human
aauaacauguaauuaagua

SEQ ID NO: 1201321 - RNA, 12 nt, Human
aauaacauguaa

SEQ ID NO: 1201322 - RNA, 20 nt, Human
uaaaguguauuuuuuuacua

SEQ ID NO: 1201323 - RNA, 19 nt, Human
uaaaguguauuuuuuuacu

SEQ ID NO: 1201324 - RNA, 15 nt, Human
uaaaguguauuuuuu

SEQ ID NO: 1201325 - RNA, 14 nt, Human
uaaaguguauuuuu

SEQ ID NO: 1201326 - RNA, 13 nt, Human
uaaagucaggggu

SEQ ID NO: 1201327 - RNA, 14 nt, Human
aauaaaguaauuau

SEQ ID NO: 1201328 - RNA, 19 nt, Human
uaaaucuccaaaauaaaac

SEQ ID NO: 1201329 - RNA, 21 nt, Human
aauacaccacuacauucuguu

SEQ ID NO: 1201330 - RNA, 20 nt, Human
aauacaccacuacauucugu

SEQ ID NO: 1201331 - RNA, 18 nt, Human
aauacaccacuacauucu

SEQ ID NO: 1201332 - RNA, 16 nt, Human
aauacaccacuacauu

SEQ ID NO: 1201333 - RNA, 15 nt, Human
aauacaccacuacau

SEQ ID NO: 1201334 - RNA, 22 nt, Human
uaaaucuccaaaauaaaacuuu

SEQ ID NO: 1201335 - RNA, 21 nt, Human
uaaaucuccaaaauaaaacuu

SEQ ID NO: 1201336 - RNA, 20 nt, Human
uaaaucuccaaaauaaaacu

SEQ ID NO: 1201337 - RNA, 13 nt, Human
uaacaagccaccc

SEQ ID NO: 1201338 - RNA, 18 nt, Human
uaaaccgccaaggcuggg

SEQ ID NO: 1201339 - RNA, 16 nt, Human
uaaaccgccaaggcug

SEQ ID NO: 1201340 - RNA, 21 nt, Human
uaaaggcuaccuuuguauucu

SEQ ID NO: 1201341 - RNA, 19 nt, Human
uaaaggcuaccuuuguauu

SEQ ID NO: 1201342 - RNA, 14 nt, Human
aaguuaaauaaauc

SEQ ID NO: 1201343 - RNA, 12 nt, Human
aaguuaaauaaa

SEQ ID NO: 1201344 - RNA, 19 nt, Human
gugugguguuuccuggcac

SEQ ID NO: 1201345 - RNA, 15 nt, Human
gugugguguuuccug

SEQ ID NO: 1201346 - RNA, 20 nt, Human
gugugagucaccaagcccag

SEQ ID NO: 1201347 - RNA, 18 nt, Human
gugugagucaccaagccc

SEQ ID NO: 1201348 - RNA, 13 nt, Human
gugugagucacca

SEQ ID NO: 1201349 - RNA, 21 nt, Human
gugucuugcaauggcagccuu

SEQ ID NO: 1201350 - RNA, 20 nt, Human
gugucccaaaaagaaaggag

SEQ ID NO: 1201351 - RNA, 18 nt, Human
gugguuauggagagggug

SEQ ID NO: 1201352 - RNA, 19 nt, Human
gugguguuuccuggcacug

SEQ ID NO: 1201353 - RNA, 19 nt, Human
aagaguaggaagacuuugg

SEQ ID NO: 1201354 - RNA, 18 nt, Human
aagaguaggaagacuuug

SEQ ID NO: 1201355 - RNA, 16 nt, Human
aagaguaggaagacuu

SEQ ID NO: 1201356 - RNA, 20 nt, Human
aagaguaggaagacuuugga

SEQ ID NO: 1201357 - RNA, 22 nt, Human
aagauauuuugcuuugugauuu

SEQ ID NO: 1201358 - RNA, 20 nt, Human
aagauauuuugcuuugugau

SEQ ID NO: 1201359 - RNA, 17 nt, Human
aagauauuuugcuuugu

SEQ ID NO: 1201360 - RNA, 16 nt, Human
gugguguuuccuggca

SEQ ID NO: 1201361 - RNA, 15 nt, Human
gugguguuuccuggc

SEQ ID NO: 1201362 - RNA, 18 nt, Human
gugggauccuccaggugc

SEQ ID NO: 1201363 - RNA, 15 nt, Human
gugggauccuccagg

SEQ ID NO: 1201364 - RNA, 12 nt, Human
gugggagcugag

SEQ ID NO: 1201365 - RNA, 15 nt, Human
guggccucccaacuc

SEQ ID NO: 1201366 - RNA, 14 nt, Human
guggccucccaacu

SEQ ID NO: 1201367 - RNA, 13 nt, Human
guggccucccaac

SEQ ID NO: 1201368 - RNA, 16 nt, Human
aagacuguacaaagua

SEQ ID NO: 1201369 - RNA, 19 nt, Human
aagagauugugguuucauu

SEQ ID NO: 1201370 - RNA, 16 nt, Human
aagagauugugguuuc

SEQ ID NO: 1201371 - RNA, 16 nt, Human
aagagcccaggccucc

SEQ ID NO: 1201372 - RNA, 14 nt, Human
aagagcccaggccu

SEQ ID NO: 1201373 - RNA, 12 nt, Human
aagagcccaggc

SEQ ID NO: 1201374 - RNA, 17 nt, Human
aagacucauucuucugu

SEQ ID NO: 1201375 - RNA, 23 nt, Human
aagacgcugugcugcccugccca

SEQ ID NO: 1201376 - RNA, 22 nt, Human
aagacgcugugcugcccugccc

SEQ ID NO: 1201377 - RNA, 21 nt, Human
aagacgcugugcugcccugcc

SEQ ID NO: 1201378 - RNA, 18 nt, Human
guggcaccagcagccugg

SEQ ID NO: 1201379 - RNA, 14 nt, Human
guggcaccagcagc

SEQ ID NO: 1201380 - RNA, 13 nt, Human
guggcaccagcag

SEQ ID NO: 1201381 - RNA, 14 nt, Human
guggcagcugcggu

SEQ ID NO: 1201382 - RNA, 22 nt, Human
guggcagcucaccucucccuug

SEQ ID NO: 1201383 - RNA, 23 nt, Human
guggauuuaacagaaauguacag

SEQ ID NO: 1201384 - RNA, 21 nt, Human
guggauuuaacagaaauguac

SEQ ID NO: 1201385 - RNA, 19 nt, Human
guggcagcugcgguccacc

SEQ ID NO: 1201386 - RNA, 17 nt, Human
guggcagcugcggucca

SEQ ID NO: 1201387 - RNA, 24 nt, Human
guggacacagcucuucuccaggcu

SEQ ID NO: 1201388 - RNA, 17 nt, Human
guggacacagcucuucu

SEQ ID NO: 1201389 - RNA, 15 nt, Human
guggacacagcucuu

SEQ ID NO: 1201390 - RNA, 14 nt, Human
guggacacagcucu

SEQ ID NO: 1201391 - RNA, 21 nt, Human
gugcugcccugcccaccuggc

SEQ ID NO: 1201392 - RNA, 20 nt, Human
gugcugcccugcccaccugg

SEQ ID NO: 1201393 - RNA, 19 nt, Human
gugcugcccugcccaccug

SEQ ID NO: 1201394 - RNA, 22 nt, Human
gugcauuugaggucuguucuuu

SEQ ID NO: 1201395 - RNA, 21 nt, Human
gugcauuugaggucuguucuu

SEQ ID NO: 1201396 - RNA, 14 nt, Human
gugccaagcagagg

SEQ ID NO: 1201397 - RNA, 15 nt, Human
gugcauuuggugguu

SEQ ID NO: 1201398 - RNA, 18 nt, Human
gugcacguacacacacau

SEQ ID NO: 1201399 - RNA, 17 nt, Human
gugcacacaccagagcc

SEQ ID NO: 1201400 - RNA, 14 nt, Human
gugcacacaccaga

SEQ ID NO: 1201401 - RNA, 12 nt, Human
gugcacacacca

SEQ ID NO: 1201402 - RNA, 14 nt, Human
aacuuggcgcugcc

SEQ ID NO: 1201403 - RNA, 17 nt, Human
aacuuggcgcugccccu

SEQ ID NO: 1201404 - RNA, 23 nt, Human
aacuugguucccauuugcuccuu

SEQ ID NO: 1201405 - RNA, 15 nt, Human
gugccucugggacug

SEQ ID NO: 1201406 - RNA, 15 nt, Human
aagaagcucucuccu

SEQ ID NO: 1201407 - RNA, 14 nt, Human
aagaagcucucucc

SEQ ID NO: 1201408 - RNA, 17 nt, Human
aagaagcccaggaaagg

SEQ ID NO: 1201409 - RNA, 16 nt, Human
aagaagcccaggaaag

SEQ ID NO: 1201410 - RNA, 16 nt, Human
aagaaaauaccaagga

SEQ ID NO: 1201411 - RNA, 22 nt, Human
aagaaaaaggaugcacagaguu

SEQ ID NO: 1201412 - RNA, 20 nt, Human
aagaaaaaggaugcacagag

SEQ ID NO: 1201413 - RNA, 17 nt, Human
guccugcugcaguugcc

SEQ ID NO: 1201414 - RNA, 16 nt, Human
guccugcugcaguugc

SEQ ID NO: 1201415 - RNA, 13 nt, Human
guccugcugcagu

SEQ ID NO: 1201416 - RNA, 23 nt, Human
gucgcccagucuggaaugcagug

SEQ ID NO: 1201417 - RNA, 14 nt, Human
gucgaggacaggga

SEQ ID NO: 1201418 - RNA, 14 nt, Human
gucgcccagucugg

SEQ ID NO: 1201419 - RNA, 13 nt, Human
gucgcccagucug

SEQ ID NO: 1201420 - RNA, 16 nt, Human
aacauuuugucauaua

SEQ ID NO: 1201421 - RNA, 13 nt, Human
gucuccauguuug

SEQ ID NO: 1201422 - RNA, 18 nt, Human
aaccacaucuugcucugc

SEQ ID NO: 1201423 - RNA, 13 nt, Human
aaccacaucuugc

SEQ ID NO: 1201424 - RNA, 22 nt, Human
gucucaaacucuugaccucagg

SEQ ID NO: 1201425 - RNA, 15 nt, Human
gucuaugggacucaa

SEQ ID NO: 1201426 - RNA, 14 nt, Human
gucuaugggacuca

SEQ ID NO: 1201427 - RNA, 13 nt, Human
guccgagcuuuga

SEQ ID NO: 1201428 - RNA, 22 nt, Human
guccgaaagggacuuggaagcu

SEQ ID NO: 1201429 - RNA, 21 nt, Human
guccgaaagggacuuggaagc

SEQ ID NO: 1201430 - RNA, 13 nt, Human
gucccuuuuccuu

SEQ ID NO: 1201431 - RNA, 23 nt, Human
guccccuguuuguuucugaaagg

SEQ ID NO: 1201432 - RNA, 16 nt, Human
guccccgcacugggcu

SEQ ID NO: 1201433 - RNA, 15 nt, Human
guccccgcacugggc

SEQ ID NO: 1201434 - RNA, 18 nt, Human
gucccccugacaacacuc

SEQ ID NO: 1201435 - RNA, 13 nt, Human
gucccccugacaa

SEQ ID NO: 1201436 - RNA, 22 nt, Human
guagcucuaggagggcuggcaa

SEQ ID NO: 1201437 - RNA, 18 nt, Human
gucccaccuuggcugcag

SEQ ID NO: 1201438 - RNA, 17 nt, Human
gucccaccuuggcugca

SEQ ID NO: 1201439 - RNA, 20 nt, Human
gucccaccuuggcugcaggg

SEQ ID NO: 1201440 - RNA, 19 nt, Human
gucccaccuuggcugcagg

SEQ ID NO: 1201441 - RNA, 22 nt, Human
aacauguuuuucuucucccuca

SEQ ID NO: 1201442 - RNA, 14 nt, Human
aacaucaacaucuu

SEQ ID NO: 1201443 - RNA, 20 nt, Human
aacauacucccaucugugaa

SEQ ID NO: 1201444 - RNA, 18 nt, Human
aacauacucccaucugug

SEQ ID NO: 1201445 - RNA, 15 nt, Human
guccuacccacccuc

SEQ ID NO: 1201446 - RNA, 13 nt, Human
guccuacccaccc

SEQ ID NO: 1201447 - RNA, 19 nt, Human
aacagguuuuccugaagaa

SEQ ID NO: 1201448 - RNA, 15 nt, Human
gugagucgaggacag

SEQ ID NO: 1201449 - RNA, 20 nt, Human
gugaguccuggcaugggaau

SEQ ID NO: 1201450 - RNA, 17 nt, Human
gugaguccuggcauggg

SEQ ID NO: 1201451 - RNA, 21 nt, Human
gugaguacuacaguccuccca

SEQ ID NO: 1201452 - RNA, 19 nt, Human
gugaguacuacaguccucc

SEQ ID NO: 1201453 - RNA, 12 nt, Human
gugagagcuggg

SEQ ID NO: 1201454 - RNA, 12 nt, Human
gugaccccaggu

SEQ ID NO: 1201455 - RNA, 16 nt, Human
gugagaggggaacaga

SEQ ID NO: 1201456 - RNA, 13 nt, Human
gugagagcugggu

SEQ ID NO: 1201457 - RNA, 21 nt, Human
gugagcacuaaggugugcucu

SEQ ID NO: 1201458 - RNA, 17 nt, Human
gugaguacuacaguccu

SEQ ID NO: 1201459 - RNA, 18 nt, Human
gugaccauguuuuguuua

SEQ ID NO: 1201460 - RNA, 21 nt, Human
gugaccagcaccaucucuccu

SEQ ID NO: 1201461 - RNA, 18 nt, Human
gugaccagcaccaucucu

SEQ ID NO: 1201462 - RNA, 17 nt, Human
gugaccaaugaugguca

SEQ ID NO: 1201463 - RNA, 14 nt, Human
gugacaugucuuuu

SEQ ID NO: 1201464 - RNA, 23 nt, Human
gugacagaggcagccccauucug

SEQ ID NO: 1201465 - RNA, 19 nt, Human
gugacagaggcagccccau

SEQ ID NO: 1201466 - RNA, 18 nt, Human
gugacagaggcagcccca

SEQ ID NO: 1201467 - RNA, 16 nt, Human
gugacagaggcagccc

SEQ ID NO: 1201468 - RNA, 14 nt, Human
gugaagugaagaca

SEQ ID NO: 1201469 - RNA, 23 nt, Human
gugaagacaaugacuuacuguac

SEQ ID NO: 1201470 - RNA, 23 nt, Human
aacguggcugcuucaaggauccu

SEQ ID NO: 1201471 - RNA, 16 nt, Human
gucuuuguacagacaa

SEQ ID NO: 1201472 - RNA, 15 nt, Human
gucuuuguacagaca

SEQ ID NO: 1201473 - RNA, 16 nt, Human
gucuucaguaagccgu

SEQ ID NO: 1201474 - RNA, 19 nt, Human
aaccugauugugucucuug

SEQ ID NO: 1201475 - RNA, 18 nt, Human
aaccugauugugucucuu

SEQ ID NO: 1201476 - RNA, 13 nt, Human
gucugacccacug

SEQ ID NO: 1201477 - RNA, 23 nt, Human
gucugacaggcaaugcuggcugu

SEQ ID NO: 1201478 - RNA, 22 nt, Human
gucugacaggcaaugcuggcug

SEQ ID NO: 1201479 - RNA, 21 nt, Human
gucugacaggcaaugcuggcu

SEQ ID NO: 1201480 - RNA, 20 nt, Human
gucucuugguccugcugcag

SEQ ID NO: 1201481 - RNA, 19 nt, Human
gucucuugguccugcugca

SEQ ID NO: 1201482 - RNA, 18 nt, Human
gucucuugguccugcugc

SEQ ID NO: 1201483 - RNA, 17 nt, Human
gucucuugguccugcug

SEQ ID NO: 1201484 - RNA, 20 nt, Human
gucucuuuaaugucacaggc

SEQ ID NO: 1201485 - RNA, 19 nt, Human
gucucuuuaaugucacagg

SEQ ID NO: 1201486 - RNA, 18 nt, Human
gucucuuuaaugucacag

SEQ ID NO: 1201487 - RNA, 23 nt, Human
gucucuuuaaugucacaggcagg

SEQ ID NO: 1201488 - RNA, 22 nt, Human
gucucuuuaaugucacaggcag

SEQ ID NO: 1201489 - RNA, 19 nt, Human
gucugaaggcuggguucug

SEQ ID NO: 1201490 - RNA, 22 nt, Human
cacccccacccaagggccuggc

SEQ ID NO: 1201491 - RNA, 17 nt, Human
caccccggccaccugcg

SEQ ID NO: 1201492 - RNA, 16 nt, Human
caccccggccaccugc

SEQ ID NO: 1201493 - RNA, 15 nt, Human
caccccggccaccug

SEQ ID NO: 1201494 - RNA, 14 nt, Human
caccccggccaccu

SEQ ID NO: 1201495 - RNA, 18 nt, Human
cacccaagggccuggccu

SEQ ID NO: 1201496 - RNA, 17 nt, Human
cacccaagggccuggcc

SEQ ID NO: 1201497 - RNA, 23 nt, Human
cacccaagggccuggccugagcu

SEQ ID NO: 1201498 - RNA, 21 nt, Human
cacccaagggccuggccugag

SEQ ID NO: 1201499 - RNA, 20 nt, Human
cacccaagggccuggccuga

SEQ ID NO: 1201500 - RNA, 19 nt, Human
cacccaagggccuggccug

SEQ ID NO: 1201501 - RNA, 13 nt, Human
caccccagcccca

SEQ ID NO: 1201502 - RNA, 17 nt, Human
cacccaccucagccucc

SEQ ID NO: 1201503 - RNA, 16 nt, Human
cacccaccucagccuc

SEQ ID NO: 1201504 - RNA, 14 nt, Human
cacccaccucagcc

SEQ ID NO: 1201505 - RNA, 13 nt, Human
cacccaccucagc

SEQ ID NO: 1201506 - RNA, 12 nt, Human
cacccaccucag

SEQ ID NO: 1201507 - RNA, 22 nt, Human
cacccaccaucaugucuggcua

SEQ ID NO: 1201508 - RNA, 20 nt, Human
cacccaccaucaugucuggc

SEQ ID NO: 1201509 - RNA, 12 nt, Human
caaaggaagcac

SEQ ID NO: 1201510 - RNA, 16 nt, Human
caaagcuuguuaagau

SEQ ID NO: 1201511 - RNA, 18 nt, Human
caaagcuaggccuggcca

SEQ ID NO: 1201512 - RNA, 17 nt, Human
caaagcuaggccuggcc

SEQ ID NO: 1201513 - RNA, 16 nt, Human
caaagcuaggccuggc

SEQ ID NO: 1201514 - RNA, 22 nt, Human
caaagccaaagcuaggccuggc

SEQ ID NO: 1201515 - RNA, 21 nt, Human
caaagccaaagcuaggccugg

SEQ ID NO: 1201516 - RNA, 20 nt, Human
caaagccaaagcuaggccug

SEQ ID NO: 1201517 - RNA, 18 nt, Human
auuuuuuuacuaauagac

SEQ ID NO: 1201518 - RNA, 16 nt, Human
caaaaaaugcuugcuu

SEQ ID NO: 1201519 - RNA, 21 nt, Human
caaaggaugcccaaagaugca

SEQ ID NO: 1201520 - RNA, 22 nt, Human
caaauucugcuugcuugcuuuu

SEQ ID NO: 1201521 - RNA, 13 nt, Human
caaaucagcugcu

SEQ ID NO: 1201522 - RNA, 16 nt, Human
caaaucagcugcuacu

SEQ ID NO: 1201523 - RNA, 20 nt, Human
caacucuccuccagagucag

SEQ ID NO: 1201524 - RNA, 15 nt, Human
caacccucaucacca

SEQ ID NO: 1201525 - RNA, 12 nt, Human
caacccucauca

SEQ ID NO: 1201526 - RNA, 16 nt, Human
caaccugauugugucu

SEQ ID NO: 1201527 - RNA, 19 nt, Human
caacucuccuccagaguca

SEQ ID NO: 1201528 - RNA, 22 nt, Human
caacaucuuggucagauuugaa

SEQ ID NO: 1201529 - RNA, 19 nt, Human
caacagguuuuccugaaga

SEQ ID NO: 1201530 - RNA, 15 nt, Human
caacagguuuuccug

SEQ ID NO: 1201531 - RNA, 18 nt, Human
caacaggguuuuuuucca

SEQ ID NO: 1201532 - RNA, 24 nt, Human
caacaggcugggcuucaguggcag

SEQ ID NO: 1201533 - RNA, 23 nt, Human
caacaggcugggcuucaguggca

SEQ ID NO: 1201534 - RNA, 19 nt, Human
caaccccuucgcuccugug

SEQ ID NO: 1201535 - RNA, 18 nt, Human
caaccccuucgcuccugu

SEQ ID NO: 1201536 - RNA, 21 nt, Human
caaccccuucgcuccuguguc

SEQ ID NO: 1201537 - RNA, 22 nt, Human
caaccccuucgcuccugugucu

SEQ ID NO: 1201538 - RNA, 22 nt, Human
caagccaccaacauacucccau

SEQ ID NO: 1201539 - RNA, 23 nt, Human
caaggugggaggauugcuugagc

SEQ ID NO: 1201540 - RNA, 12 nt, Human
caaggugggagg

SEQ ID NO: 1201541 - RNA, 19 nt, Human
caagggccuggccugagcu

SEQ ID NO: 1201542 - RNA, 19 nt, Human
caaggauugcuacuguccu

SEQ ID NO: 1201543 - RNA, 15 nt, Human
caaggauugcuacug

SEQ ID NO: 1201544 - RNA, 22 nt, Human
caagugugguagagugugccug

SEQ ID NO: 1201545 - RNA, 22 nt, Human
caagugauucuccugccucagc

SEQ ID NO: 1201546 - RNA, 18 nt, Human
caagugauucuccugccu

SEQ ID NO: 1201547 - RNA, 17 nt, Human
caagugauucuccugcc

SEQ ID NO: 1201548 - RNA, 16 nt, Human
caagugauucuccugc

SEQ ID NO: 1201549 - RNA, 19 nt, Human
caagugaaaaaggaggaag

SEQ ID NO: 1201550 - RNA, 18 nt, Human
caagcgugagccacugca

SEQ ID NO: 1201551 - RNA, 17 nt, Human
caagcgugagccacugc

SEQ ID NO: 1201552 - RNA, 13 nt, Human
caaggauccugag

SEQ ID NO: 1201553 - RNA, 21 nt, Human
caaggaugaucuaggaagacu

SEQ ID NO: 1201554 - RNA, 21 nt, Human
caagccaccaacauacuccca

SEQ ID NO: 1201555 - RNA, 16 nt, Human
caagcgugagccacug

SEQ ID NO: 1201556 - RNA, 16 nt, Human
cacauuccugaugcuu

SEQ ID NO: 1201557 - RNA, 15 nt, Human
cacaugugcacaugc

SEQ ID NO: 1201558 - RNA, 14 nt, Human
cacaugugcacaug

SEQ ID NO: 1201559 - RNA, 17 nt, Human
cacaugugcacaugcac

SEQ ID NO: 1201560 - RNA, 19 nt, Human
cacaugccucucucaggcc

SEQ ID NO: 1201561 - RNA, 18 nt, Human
cacaugccucucucaggc

SEQ ID NO: 1201562 - RNA, 17 nt, Human
cacaugccucucucagg

SEQ ID NO: 1201563 - RNA, 19 nt, Human
cacaucagcacgauuucug

SEQ ID NO: 1201564 - RNA, 18 nt, Human
cacaucagcacgauuucu

SEQ ID NO: 1201565 - RNA, 14 nt, Human
cacauaucugucau

SEQ ID NO: 1201566 - RNA, 12 nt, Human
cacauaucuguc

SEQ ID NO: 1201567 - RNA, 15 nt, Human
caccacacccagccc

SEQ ID NO: 1201568 - RNA, 13 nt, Human
caccacacccagc

SEQ ID NO: 1201569 - RNA, 17 nt, Human
caccacacccagcccac

SEQ ID NO: 1201570 - RNA, 20 nt, Human
caccacuacauucuguuaau

SEQ ID NO: 1201571 - RNA, 19 nt, Human
caccacuacauucuguuaa

SEQ ID NO: 1201572 - RNA, 18 nt, Human
caccacuacauucuguua

SEQ ID NO: 1201573 - RNA, 17 nt, Human
caccacuacauucuguu

SEQ ID NO: 1201574 - RNA, 16 nt, Human
caccacuacauucugu

SEQ ID NO: 1201575 - RNA, 14 nt, Human
caccaccucuuugg

SEQ ID NO: 1201576 - RNA, 19 nt, Human
caccacaugugcacaugca

SEQ ID NO: 1201577 - RNA, 18 nt, Human
caccacaugugcacaugc

SEQ ID NO: 1201578 - RNA, 15 nt, Human
caccacaugugcaca

SEQ ID NO: 1201579 - RNA, 21 nt, Human
cacagugagucgaggacaggg

SEQ ID NO: 1201580 - RNA, 19 nt, Human
cacaggcccggcuccaggc

SEQ ID NO: 1201581 - RNA, 18 nt, Human
cacaggcccggcuccagg

SEQ ID NO: 1201582 - RNA, 17 nt, Human
cacaggcccggcuccag

SEQ ID NO: 1201583 - RNA, 16 nt, Human
cacaggcccggcucca

SEQ ID NO: 1201584 - RNA, 10 nt, Human
cacaggcagg

SEQ ID NO: 1201585 - RNA, 17 nt, Human
cacaggaucagucugau

SEQ ID NO: 1201586 - RNA, 16 nt, Human
cacaggaucagucuga

SEQ ID NO: 1201587 - RNA, 15 nt, Human
cacaggaucagucug

SEQ ID NO: 1201588 - RNA, 12 nt, Human
cacaggaucagu

SEQ ID NO: 1201589 - RNA, 17 nt, Human
cacauacacacacacgc

SEQ ID NO: 1201590 - RNA, 20 nt, Human
cacagugagucgaggacagg

SEQ ID NO: 1201591 - RNA, 19 nt, Human
cacagugagucgaggacag

SEQ ID NO: 1201592 - RNA, 23 nt, Human
cacaggcccggcuccaggcuccu

SEQ ID NO: 1201593 - RNA, 20 nt, Human
cacaggcccggcuccaggcu

SEQ ID NO: 1201594 - RNA, 18 nt, Human
cacagugagucgaggaca

SEQ ID NO: 1201595 - RNA, 23 nt, Human
cacagaugggugcuuggaggaag

SEQ ID NO: 1201596 - RNA, 18 nt, Human
cacagaugggugcuugga

SEQ ID NO: 1201597 - RNA, 14 nt, Human
cacagaugggugcu

SEQ ID NO: 1201598 - RNA, 21 nt, Human
cacagaguuguuacauuuuua

SEQ ID NO: 1201599 - RNA, 20 nt, Human
cacagaguuguuacauuuuu

SEQ ID NO: 1201600 - RNA, 20 nt, Human
cacagaugggugcuuggagg

SEQ ID NO: 1201601 - RNA, 17 nt, Human
cacagaguuguuacauu

SEQ ID NO: 1201602 - RNA, 16 nt, Human
cacagaguuguuacau

SEQ ID NO: 1201603 - RNA, 12 nt, Human
cacagagaaagu

SEQ ID NO: 1201604 - RNA, 21 nt, Human
cacacuugacaucaacugcau

SEQ ID NO: 1201605 - RNA, 12 nt, Human
cacacagcucug

SEQ ID NO: 1201606 - RNA, 21 nt, Human
cacacagaggcugccucuccc

SEQ ID NO: 1201607 - RNA, 19 nt, Human
cacacagaggcugccucuc

SEQ ID NO: 1201608 - RNA, 15 nt, Human
cacacaccagagccc

SEQ ID NO: 1201609 - RNA, 14 nt, Human
cacacaccagagcc

SEQ ID NO: 1201610 - RNA, 13 nt, Human
cacacccagccca

SEQ ID NO: 1201611 - RNA, 15 nt, Human
cacaccagagcccac

SEQ ID NO: 1201612 - RNA, 13 nt, Human
cacaccagagccc

SEQ ID NO: 1201613 - RNA, 12 nt, Human
cacaccagagcc

SEQ ID NO: 1201614 - RNA, 17 nt, Human
cacaccgggcacucaga

SEQ ID NO: 1201615 - RNA, 19 nt, Human
caaugugaaaagaaaaaug

SEQ ID NO: 1201616 - RNA, 23 nt, Human
caaugcacuuuguucuggcucuu

SEQ ID NO: 1201617 - RNA, 20 nt, Human
caaugcaaaccaucauugaa

SEQ ID NO: 1201618 - RNA, 19 nt, Human
caaugcaaaccaucauuga

SEQ ID NO: 1201619 - RNA, 18 nt, Human
caaugcaaaccaucauug

SEQ ID NO: 1201620 - RNA, 17 nt, Human
caaugcaaaccaucauu

SEQ ID NO: 1201621 - RNA, 13 nt, Human
caaugaccuuuca

SEQ ID NO: 1201622 - RNA, 21 nt, Human
caauaggaaaaacugauuuuu

SEQ ID NO: 1201623 - RNA, 20 nt, Human
caauaggaaaaacugauuuu

SEQ ID NO: 1201624 - RNA, 18 nt, Human
cacaaaaguuucucuuuu

SEQ ID NO: 1201625 - RNA, 16 nt, Human
cacaaaaguuucucuu

SEQ ID NO: 1201626 - RNA, 15 nt, Human
uuggauuguccccga

SEQ ID NO: 1201627 - RNA, 21 nt, Human
uuggacccugaggcccagagg

SEQ ID NO: 1201628 - RNA, 19 nt, Human
uuggacccugaggcccaga

SEQ ID NO: 1201629 - RNA, 18 nt, Human
uuggacccugaggcccag

SEQ ID NO: 1201630 - RNA, 11 nt, Human
uuggaaggaac

SEQ ID NO: 1201631 - RNA, 19 nt, Human
uuggaagcuccgcuuucua

SEQ ID NO: 1201632 - RNA, 18 nt, Human
uugcugucccuuuuccuu

SEQ ID NO: 1201633 - RNA, 16 nt, Human
uugcugucccuuuucc

SEQ ID NO: 1201634 - RNA, 16 nt, Human
uugcugcuugaggcaa

SEQ ID NO: 1201635 - RNA, 14 nt, Human
uugcugcuugaggc

SEQ ID NO: 1201636 - RNA, 23 nt, Human
uugcccacgcuggagugcaguga

SEQ ID NO: 1201637 - RNA, 21 nt, Human
uugccauguuggccaggcugg

SEQ ID NO: 1201638 - RNA, 20 nt, Human
uugccauguuggccaggcug

SEQ ID NO: 1201639 - RNA, 20 nt, Human
uugucuaugggacucaaugc

SEQ ID NO: 1201640 - RNA, 14 nt, Human
uugucuaugggacu

SEQ ID NO: 1201641 - RNA, 22 nt, Human
uugucaaaguggugagaggcau

SEQ ID NO: 1201642 - RNA, 23 nt, Human
uuggcuucacggaagagccuugc

SEQ ID NO: 1201643 - RNA, 20 nt, Human
uuggucugacccacugcuuu

SEQ ID NO: 1201644 - RNA, 20 nt, Human
uugaacuuugaccucugcag

SEQ ID NO: 1201645 - RNA, 18 nt, Human
uugaacuuugaccucugc

SEQ ID NO: 1201646 - RNA, 17 nt, Human
uugaacuuugaccucug

SEQ ID NO: 1201647 - RNA, 16 nt, Human
uugaaugaugccauga

SEQ ID NO: 1201648 - RNA, 12 nt, Human
uugaaugaugcc

SEQ ID NO: 1201649 - RNA, 15 nt, Human
uugaacuuugaccuc

SEQ ID NO: 1201650 - RNA, 21 nt, Human
uucuuuccugaggcugggcuc

SEQ ID NO: 1201651 - RNA, 16 nt, Human
uucuggcuaugcauuu

SEQ ID NO: 1201652 - RNA, 20 nt, Human
uucuggcagaguugaagaca

SEQ ID NO: 1201653 - RNA, 14 nt, Human
uucuuguguguuua

SEQ ID NO: 1201654 - RNA, 17 nt, Human
uucuuagggaaggauac

SEQ ID NO: 1201655 - RNA, 13 nt, Human
uucuucagagacu

SEQ ID NO: 1201656 - RNA, 16 nt, Human
uugauaugcuuauaca

SEQ ID NO: 1201657 - RNA, 16 nt, Human
uugauucagcucugca

SEQ ID NO: 1201658 - RNA, 23 nt, Human
uugauucagacagcugccuggga

SEQ ID NO: 1201659 - RNA, 21 nt, Human
uugauucagacagcugccugg

SEQ ID NO: 1201660 - RNA, 17 nt, Human
uugauucagacagcugc

SEQ ID NO: 1201661 - RNA, 16 nt, Human
uugagccuugaacuuu

SEQ ID NO: 1201662 - RNA, 15 nt, Human
uugagccuugaacuu

SEQ ID NO: 1201663 - RNA, 14 nt, Human
uugagccuugaacu

SEQ ID NO: 1201664 - RNA, 14 nt, Human
uugaauuguaagga

SEQ ID NO: 1201665 - RNA, 19 nt, Human
uugagccuugaacuuugac

SEQ ID NO: 1201666 - RNA, 19 nt, Human
uugccauguuggccaggcu

SEQ ID NO: 1201667 - RNA, 18 nt, Human
uugccauguuggccaggc

SEQ ID NO: 1201668 - RNA, 17 nt, Human
uugccauguuggccagg

SEQ ID NO: 1201669 - RNA, 16 nt, Human
uugccauguuggccag

SEQ ID NO: 1201670 - RNA, 13 nt, Human
uugccagucaccc

SEQ ID NO: 1201671 - RNA, 23 nt, Human
uugcagacaggcaagcaccuccu

SEQ ID NO: 1201672 - RNA, 17 nt, Human
uugauucauaaugacuu

SEQ ID NO: 1201673 - RNA, 13 nt, Human
uugauucauaaug

SEQ ID NO: 1201674 - RNA, 24 nt, Human
uugucuuuggacccugaggcccag

SEQ ID NO: 1201675 - RNA, 20 nt, Human
uugucuuuggacccugaggc

SEQ ID NO: 1201676 - RNA, 15 nt, Human
uugucuuuggacccu

SEQ ID NO: 1201677 - RNA, 20 nt, Human
uuguuuggggaugagaaagg

SEQ ID NO: 1201678 - RNA, 13 nt, Human
uuuaacagaaaug

SEQ ID NO: 1201679 - RNA, 13 nt, Human
uuuaaaagauaca

SEQ ID NO: 1201680 - RNA, 18 nt, Human
uuuaacagaaauguacag

SEQ ID NO: 1201681 - RNA, 15 nt, Human
uuuaacagaaaugua

SEQ ID NO: 1201682 - RNA, 14 nt, Human
uuuaacagaaaugu

SEQ ID NO: 1201683 - RNA, 19 nt, Human
uuuagacccuauugcugcu

SEQ ID NO: 1201684 - RNA, 22 nt, Human
uuuagacccuauugcugcuuga

SEQ ID NO: 1201685 - RNA, 20 nt, Human
uuuauacauaaacaagacca

SEQ ID NO: 1201686 - RNA, 12 nt, Human
uuuauacauaaa

SEQ ID NO: 1201687 - RNA, 16 nt, Human
uuuaucgucacugcuu

SEQ ID NO: 1201688 - RNA, 17 nt, Human
uuucagccaagaauucu

SEQ ID NO: 1201689 - RNA, 14 nt, Human
uuucugaaauaaca

SEQ ID NO: 1201690 - RNA, 23 nt, Human
uuucuacucgaguuacagacaaa

SEQ ID NO: 1201691 - RNA, 22 nt, Human
uuucuacccagcgagcccuggu

SEQ ID NO: 1201692 - RNA, 18 nt, Human
uuucuacccagcgagccc

SEQ ID NO: 1201693 - RNA, 15 nt, Human
uuucuacccagcgag

SEQ ID NO: 1201694 - RNA, 19 nt, Human
uuucuaaaucuccaaaaua

SEQ ID NO: 1201695 - RNA, 19 nt, Human
uuuccuggcacugcuucca

SEQ ID NO: 1201696 - RNA, 23 nt, Human
uuuccuggcacugcuuccaguga

SEQ ID NO: 1201697 - RNA, 14 nt, Human
uuugauccaagcug

SEQ ID NO: 1201698 - RNA, 19 nt, Human
uuuggacccugaggcccag

SEQ ID NO: 1201699 - RNA, 15 nt, Human
uuuggacccugaggc

SEQ ID NO: 1201700 - RNA, 14 nt, Human
uuugcuugaaagaa

SEQ ID NO: 1201701 - RNA, 16 nt, Human
uuugcuugaaagaaaa

SEQ ID NO: 1201702 - RNA, 15 nt, Human
uuuguauucucuccu

SEQ ID NO: 1201703 - RNA, 17 nt, Human
uuugaggucuguucuuu

SEQ ID NO: 1201704 - RNA, 17 nt, Human
uuugagaucagccuggg

SEQ ID NO: 1201705 - RNA, 16 nt, Human
uuugagaucagccugg

SEQ ID NO: 1201706 - RNA, 19 nt, Human
uuucuuguguguuuauugu

SEQ ID NO: 1201707 - RNA, 16 nt, Human
uguuuagauaauacac

SEQ ID NO: 1201708 - RNA, 20 nt, Human
uguuuagauaauacaccacu

SEQ ID NO: 1201709 - RNA, 15 nt, Human
uguuucaaacuuuac

SEQ ID NO: 1201710 - RNA, 13 nt, Human
uguuugugauuga

SEQ ID NO: 1201711 - RNA, 21 nt, Human
uuaaaauaccagccaguaaau

SEQ ID NO: 1201712 - RNA, 17 nt, Human
uuaaaagauacaguuac

SEQ ID NO: 1201713 - RNA, 14 nt, Human
uuaaaagauacagu

SEQ ID NO: 1201714 - RNA, 19 nt, Human
uguuuuaaggaugcuugua

SEQ ID NO: 1201715 - RNA, 18 nt, Human
uguuuuaaggaugcuugu

SEQ ID NO: 1201716 - RNA, 22 nt, Human
uguuuuaagaggcagggucuca

SEQ ID NO: 1201717 - RNA, 18 nt, Human
uuaacuuuuauaaacuuu

SEQ ID NO: 1201718 - RNA, 17 nt, Human
uuaacuuuuauaaacuu

SEQ ID NO: 1201719 - RNA, 16 nt, Human
uuaacuuuuauaaacu

SEQ ID NO: 1201720 - RNA, 15 nt, Human
uuaacuuuuauaaac

SEQ ID NO: 1201721 - RNA, 16 nt, Human
uuaacuucacauauug

SEQ ID NO: 1201722 - RNA, 17 nt, Human
uuaaccacuucagcuga

SEQ ID NO: 1201723 - RNA, 22 nt, Human
uuaauuaaaacacaacaucuuu

SEQ ID NO: 1201724 - RNA, 21 nt, Human
uuacaagcgugagccacugca

SEQ ID NO: 1201725 - RNA, 20 nt, Human
uuacaagcgugagccacugc

SEQ ID NO: 1201726 - RNA, 22 nt, Human
uuaauauugauaugcuuauaca

SEQ ID NO: 1201727 - RNA, 18 nt, Human
uuaauauugauaugcuua

SEQ ID NO: 1201728 - RNA, 17 nt, Human
uuaagcuguuacugucu

SEQ ID NO: 1201729 - RNA, 16 nt, Human
uuacuaauagacaauu

SEQ ID NO: 1201730 - RNA, 14 nt, Human
uuacuaaguuuuua

SEQ ID NO: 1201731 - RNA, 13 nt, Human
uuacuaaguuuuu

SEQ ID NO: 1201732 - RNA, 21 nt, Human
uuacuuaaaccgccaaggcug

SEQ ID NO: 1201733 - RNA, 19 nt, Human
uuacuauggcccuggccua

SEQ ID NO: 1201734 - RNA, 23 nt, Human
uuacuucuuauacauuugauaaa

SEQ ID NO: 1201735 - RNA, 12 nt, Human
uuacuucugcua

SEQ ID NO: 1201736 - RNA, 11 nt, Human
uuacuucugcu

SEQ ID NO: 1201737 - RNA, 18 nt, Human
uuacuuagguguggggga

SEQ ID NO: 1201738 - RNA, 18 nt, Human
uuagacagucccugccaa

SEQ ID NO: 1201739 - RNA, 17 nt, Human
uuagacagucccugcca

SEQ ID NO: 1201740 - RNA, 16 nt, Human
uuagacagucccugcc

SEQ ID NO: 1201741 - RNA, 15 nt, Human
uuagacagucccugc

SEQ ID NO: 1201742 - RNA, 14 nt, Human
uuacuuuguguuca

SEQ ID NO: 1201743 - RNA, 18 nt, Human
uuacuuuaaaaggagcca

SEQ ID NO: 1201744 - RNA, 17 nt, Human
uuacuuuaaaaggagcc

SEQ ID NO: 1201745 - RNA, 16 nt, Human
uuaguaugaggcauuu

SEQ ID NO: 1201746 - RNA, 18 nt, Human
uuaguaugaggcauuugu

SEQ ID NO: 1201747 - RNA, 22 nt, Human
uuagauaauacaccacuacauu

SEQ ID NO: 1201748 - RNA, 14 nt, Human
uuagaguugauacu

SEQ ID NO: 1201749 - RNA, 16 nt, Human
uuauggaacacucuga

SEQ ID NO: 1201750 - RNA, 22 nt, Human
uuaugcaugaaguaauaugcac

SEQ ID NO: 1201751 - RNA, 16 nt, Human
uuaugcaugaaguaau

SEQ ID NO: 1201752 - RNA, 16 nt, Human
uuaucuagauacugua

SEQ ID NO: 1201753 - RNA, 14 nt, Human
uuaguuccuugagu

SEQ ID NO: 1201754 - RNA, 16 nt, Human
uuaguuccucauuagc

SEQ ID NO: 1201755 - RNA, 17 nt, Human
uuaucuagauacuguau

SEQ ID NO: 1201756 - RNA, 15 nt, Human
uuauugcccacgcug

SEQ ID NO: 1201757 - RNA, 11 nt, Human
uuauucugcuc

SEQ ID NO: 1201758 - RNA, 20 nt, Human
uucaauaggaaaaacugauu

SEQ ID NO: 1201759 - RNA, 18 nt, Human
uucaauaggaaaaacuga

SEQ ID NO: 1201760 - RNA, 15 nt, Human
uucaauaggaaaaac

SEQ ID NO: 1201761 - RNA, 13 nt, Human
uucaauaggaaaa

SEQ ID NO: 1201762 - RNA, 15 nt, Human
uucacgugguccuaa

SEQ ID NO: 1201763 - RNA, 13 nt, Human
uucacucuccuug

SEQ ID NO: 1201764 - RNA, 18 nt, Human
uuauugucaaagugguga

SEQ ID NO: 1201765 - RNA, 17 nt, Human
uuauugucaaaguggug

SEQ ID NO: 1201766 - RNA, 15 nt, Human
uuccaaauucugcuu

SEQ ID NO: 1201767 - RNA, 21 nt, Human
uucaucuugaauuguaaggaa

SEQ ID NO: 1201768 - RNA, 15 nt, Human
uucaggaagcucagg

SEQ ID NO: 1201769 - RNA, 13 nt, Human
uucaggaagcuca

SEQ ID NO: 1201770 - RNA, 11 nt, Human
uucaggaagcu

SEQ ID NO: 1201771 - RNA, 16 nt, Human
uucauuuccugugucu

SEQ ID NO: 1201772 - RNA, 15 nt, Human
uucauuuccuguguc

SEQ ID NO: 1201773 - RNA, 20 nt, Human
uucccucccuuccucuuucc

SEQ ID NO: 1201774 - RNA, 17 nt, Human
uucccucccuuccucuu

SEQ ID NO: 1201775 - RNA, 11 nt, Human
uucccucccuu

SEQ ID NO: 1201776 - RNA, 20 nt, Human
uuccccaggaggccagccuu

SEQ ID NO: 1201777 - RNA, 19 nt, Human
uuccccaggaggccagccu

SEQ ID NO: 1201778 - RNA, 18 nt, Human
uuccccaggaggccagcc

SEQ ID NO: 1201779 - RNA, 17 nt, Human
uuccccaggaggccagc

SEQ ID NO: 1201780 - RNA, 21 nt, Human
uuccccaggaggccagccuug

SEQ ID NO: 1201781 - RNA, 16 nt, Human
uuccccaggaggccag

SEQ ID NO: 1201782 - RNA, 15 nt, Human
uuccccaggaggcca

SEQ ID NO: 1201783 - RNA, 16 nt, Human
uucccauuugcuccuu

SEQ ID NO: 1201784 - RNA, 13 nt, Human
uuccucauuagca

SEQ ID NO: 1201785 - RNA, 22 nt, Human
uucccuuugacgccaucccagc

SEQ ID NO: 1201786 - RNA, 21 nt, Human
uucccuuugacgccaucccag

SEQ ID NO: 1201787 - RNA, 20 nt, Human
uucccuuugacgccauccca

SEQ ID NO: 1201788 - RNA, 20 nt, Human
uucgggaggucgaggcagga

SEQ ID NO: 1201789 - RNA, 17 nt, Human
uucuaaagcugccagcc

SEQ ID NO: 1201790 - RNA, 13 nt, Human
uucuaaagcugcc

SEQ ID NO: 1201791 - RNA, 20 nt, Human
uuccuugaguugauucagcu

SEQ ID NO: 1201792 - RNA, 19 nt, Human
uuccuggcacugcuuccag

SEQ ID NO: 1201793 - RNA, 14 nt, Human
uuccuggcacugcu

SEQ ID NO: 1201794 - RNA, 19 nt, Human
uuccugaugcuucuucaga

SEQ ID NO: 1201795 - RNA, 18 nt, Human
uuccugaugcuucuucag

SEQ ID NO: 1201796 - RNA, 15 nt, Human
uuccugaugcuucuu

SEQ ID NO: 1201797 - RNA, 17 nt, Human
uuccugccaggcauggu

SEQ ID NO: 1201798 - RNA, 23 nt, Human
uuccugaugcuucuucagagacu

SEQ ID NO: 1201799 - RNA, 16 nt, Human
ugggggaguggccaca

SEQ ID NO: 1201800 - RNA, 18 nt, Human
uggguacuuguggacaca

SEQ ID NO: 1201801 - RNA, 17 nt, Human
uggguacuuguggacac

SEQ ID NO: 1201802 - RNA, 21 nt, Human
uggggccaguuggucccccuu

SEQ ID NO: 1201803 - RNA, 20 nt, Human
uggggccaguuggucccccu

SEQ ID NO: 1201804 - RNA, 23 nt, Human
uggggaugagaaagguugaagca

SEQ ID NO: 1201805 - RNA, 15 nt, Human
uggggaugagaaagg

SEQ ID NO: 1201806 - RNA, 16 nt, Human
ugggagugggcccaau

SEQ ID NO: 1201807 - RNA, 14 nt, Human
ugggagugggccca

SEQ ID NO: 1201808 - RNA, 20 nt, Human
uggcugggggccucagugcc

SEQ ID NO: 1201809 - RNA, 17 nt, Human
uggcugggggccucagu

SEQ ID NO: 1201810 - RNA, 16 nt, Human
uggcugggggccucag

SEQ ID NO: 1201811 - RNA, 14 nt, Human
ugggauccuccagg

SEQ ID NO: 1201812 - RNA, 13 nt, Human
ugggauccuccag

SEQ ID NO: 1201813 - RNA, 12 nt, Human
ugggauccucca

SEQ ID NO: 1201814 - RNA, 22 nt, Human
ugggauuacaagcgugagccac

SEQ ID NO: 1201815 - RNA, 22 nt, Human
ugggcagagcagagaccauccc

SEQ ID NO: 1201816 - RNA, 23 nt, Human
ugggcagagcagagaccaucccu

SEQ ID NO: 1201817 - RNA, 19 nt, Human
ugguccuaaucuucugaac

SEQ ID NO: 1201818 - RNA, 17 nt, Human
ugguccuaaucuucuga

SEQ ID NO: 1201819 - RNA, 23 nt, Human
ugguccugcugcaguugccaguc

SEQ ID NO: 1201820 - RNA, 15 nt, Human
ugguccugcugcagu

SEQ ID NO: 1201821 - RNA, 13 nt, Human
ugguccugcugca

SEQ ID NO: 1201822 - RNA, 23 nt, Human
uggucccccuuccauggacuuug

SEQ ID NO: 1201823 - RNA, 18 nt, Human
uggucccccuuccaugga

SEQ ID NO: 1201824 - RNA, 16 nt, Human
uggucccccuuccaug

SEQ ID NO: 1201825 - RNA, 15 nt, Human
uggucccccuuccau

SEQ ID NO: 1201826 - RNA, 14 nt, Human
uggucccccuucca

SEQ ID NO: 1201827 - RNA, 19 nt, Human
uggugacuuuccucuuugg

SEQ ID NO: 1201828 - RNA, 22 nt, Human
uggugaccucugccugaaguca

SEQ ID NO: 1201829 - RNA, 17 nt, Human
uggugaccucugccuga

SEQ ID NO: 1201830 - RNA, 16 nt, Human
uggugaccucugccug

SEQ ID NO: 1201831 - RNA, 15 nt, Human
uggugaccucugccu

SEQ ID NO: 1201832 - RNA, 21 nt, Human
uggugcaaugaccuuucaaua

SEQ ID NO: 1201833 - RNA, 14 nt, Human
uggugaccucugcc

SEQ ID NO: 1201834 - RNA, 13 nt, Human
uggugaccucugc

SEQ ID NO: 1201835 - RNA, 19 nt, Human
uggucuacacugugcugag

SEQ ID NO: 1201836 - RNA, 18 nt, Human
uggucuacacugugcuga

SEQ ID NO: 1201837 - RNA, 17 nt, Human
uggucuacacugugcug

SEQ ID NO: 1201838 - RNA, 16 nt, Human
uggucuacacugugcu

SEQ ID NO: 1201839 - RNA, 15 nt, Human
uggucuacacugugc

SEQ ID NO: 1201840 - RNA, 17 nt, Human
uggucggaaaacaugcu

SEQ ID NO: 1201841 - RNA, 14 nt, Human
uggucggaaaacau

SEQ ID NO: 1201842 - RNA, 23 nt, Human
uggaggaaggaaacccagcucug

SEQ ID NO: 1201843 - RNA, 21 nt, Human
uggaggaaggaaacccagcuc

SEQ ID NO: 1201844 - RNA, 12 nt, Human
uggcaaaaaggc

SEQ ID NO: 1201845 - RNA, 16 nt, Human
uggcaaaaaggcagga

SEQ ID NO: 1201846 - RNA, 16 nt, Human
uggcacuauaauguaa

SEQ ID NO: 1201847 - RNA, 15 nt, Human
uggcacuauaaugua

SEQ ID NO: 1201848 - RNA, 23 nt, Human
uggcgcugccccuggcagccccu

SEQ ID NO: 1201849 - RNA, 16 nt, Human
uggcgcugccccuggc

SEQ ID NO: 1201850 - RNA, 23 nt, Human
uggcgcagcauauucaggaagcu

SEQ ID NO: 1201851 - RNA, 22 nt, Human
uggcgcagcauauucaggaagc

SEQ ID NO: 1201852 - RNA, 16 nt, Human
uggcugcuucaaggau

SEQ ID NO: 1201853 - RNA, 15 nt, Human
uggcugcuucaagga

SEQ ID NO: 1201854 - RNA, 11 nt, Human
uggcugcuuca

SEQ ID NO: 1201855 - RNA, 20 nt, Human
uggccccugcccggcugcgg

SEQ ID NO: 1201856 - RNA, 16 nt, Human
uggccccugcccggcu

SEQ ID NO: 1201857 - RNA, 15 nt, Human
uggccccugcccggc

SEQ ID NO: 1201858 - RNA, 13 nt, Human
uggccaggcuggu

SEQ ID NO: 1201859 - RNA, 15 nt, Human
uggccaggcuggucu

SEQ ID NO: 1201860 - RNA, 20 nt, Human
uggccagaugcaccagcccu

SEQ ID NO: 1201861 - RNA, 19 nt, Human
uggccagaugcaccagccc

SEQ ID NO: 1201862 - RNA, 18 nt, Human
uggccagaugcaccagcc

SEQ ID NO: 1201863 - RNA, 17 nt, Human
uggccagaugcaccagc

SEQ ID NO: 1201864 - RNA, 19 nt, Human
uggcagaguugaagacaga

SEQ ID NO: 1201865 - RNA, 17 nt, Human
uggcagaguugaagaca

SEQ ID NO: 1201866 - RNA, 21 nt, Human
uggcagaguggauucuugaac

SEQ ID NO: 1201867 - RNA, 15 nt, Human
uggcagaguugaaga

SEQ ID NO: 1201868 - RNA, 22 nt, Human
ugcuacuguccuacccacccuc

SEQ ID NO: 1201869 - RNA, 21 nt, Human
ugcuacuguccuacccacccu

SEQ ID NO: 1201870 - RNA, 17 nt, Human
ugcggacagccacggcc

SEQ ID NO: 1201871 - RNA, 22 nt, Human
ugcuaggaacacuccuucacag

SEQ ID NO: 1201872 - RNA, 21 nt, Human
ugcuaggaacacuccuucaca

SEQ ID NO: 1201873 - RNA, 23 nt, Human
ugcucuccgaccagacaccuuga

SEQ ID NO: 1201874 - RNA, 18 nt, Human
ugcuguaacuuucugaaa

SEQ ID NO: 1201875 - RNA, 13 nt, Human
ugcuggguguggc

SEQ ID NO: 1201876 - RNA, 17 nt, Human
ugcugggcuugucugua

SEQ ID NO: 1201877 - RNA, 23 nt, Human
ugcugcauuuaaaagauacaguu

SEQ ID NO: 1201878 - RNA, 19 nt, Human
ugcugcauuuaaaagauac

SEQ ID NO: 1201879 - RNA, 18 nt, Human
ugcugcauuuaaaagaua

SEQ ID NO: 1201880 - RNA, 17 nt, Human
ugcugcauuuaaaagau

SEQ ID NO: 1201881 - RNA, 19 nt, Human
ugcugcuugaggcaacuca

SEQ ID NO: 1201882 - RNA, 12 nt, Human
ugcugcuugagg

SEQ ID NO: 1201883 - RNA, 15 nt, Human
ugcccugcccaccug

SEQ ID NO: 1201884 - RNA, 20 nt, Human
ugcccugcccaccuggccuc

SEQ ID NO: 1201885 - RNA, 16 nt, Human
ugcccugcccaccugg

SEQ ID NO: 1201886 - RNA, 21 nt, Human
ugcccugcccaccuggccucu

SEQ ID NO: 1201887 - RNA, 23 nt, Human
ugcccugugaguacuacaguccu

SEQ ID NO: 1201888 - RNA, 15 nt, Human
ugccucaagagaagg

SEQ ID NO: 1201889 - RNA, 14 nt, Human
ugccucaagagaag

SEQ ID NO: 1201890 - RNA, 20 nt, Human
ugcccaggcuggcgugcagu

SEQ ID NO: 1201891 - RNA, 19 nt, Human
ugcccaggcuggcgugcag

SEQ ID NO: 1201892 - RNA, 18 nt, Human
ugcccaggcuggcgugca

SEQ ID NO: 1201893 - RNA, 14 nt, Human
ugcccggcugcgga

SEQ ID NO: 1201894 - RNA, 12 nt, Human
ugcccggcugcg

SEQ ID NO: 1201895 - RNA, 17 nt, Human
ugccccuggcagccccu

SEQ ID NO: 1201896 - RNA, 16 nt, Human
ugccccuggcagcccc

SEQ ID NO: 1201897 - RNA, 14 nt, Human
ugccaggcauggug

SEQ ID NO: 1201898 - RNA, 22 nt, Human
ugccaggaagccagcaggcucu

SEQ ID NO: 1201899 - RNA, 20 nt, Human
ugccaggaagccagcaggcu

SEQ ID NO: 1201900 - RNA, 23 nt, Human
ugcauuuggugguuucagaaaug

SEQ ID NO: 1201901 - RNA, 21 nt, Human
ugcauuuggugguuucagaaa

SEQ ID NO: 1201902 - RNA, 16 nt, Human
ugcaguugccagucac

SEQ ID NO: 1201903 - RNA, 13 nt, Human
ugcagggaguccg

SEQ ID NO: 1201904 - RNA, 21 nt, Human
ugcaguggugcgaucuggguu

SEQ ID NO: 1201905 - RNA, 21 nt, Human
ugcaguuacacuaaaagguga

SEQ ID NO: 1201906 - RNA, 22 nt, Human
ugacagagugagacucugucuc

SEQ ID NO: 1201907 - RNA, 19 nt, Human
ugacagagugagacucugu

SEQ ID NO: 1201908 - RNA, 17 nt, Human
ugacagagugagacucu

SEQ ID NO: 1201909 - RNA, 14 nt, Human
ugacagagugagac

SEQ ID NO: 1201910 - RNA, 23 nt, Human
ugacagaggcagccccauucugc

SEQ ID NO: 1201911 - RNA, 18 nt, Human
ugacagaggcagccccau

SEQ ID NO: 1201912 - RNA, 17 nt, Human
ugacagaggcagcccca

SEQ ID NO: 1201913 - RNA, 16 nt, Human
ugacagaggcagcccc

SEQ ID NO: 1201914 - RNA, 15 nt, Human
ugacagaggcagccc

SEQ ID NO: 1201915 - RNA, 14 nt, Human
ugacagaggcagcc

SEQ ID NO: 1201916 - RNA, 23 nt, Human
ugacagacacaggcccggcucca

SEQ ID NO: 1201917 - RNA, 20 nt, Human
ugacagacacaggcccggcu

SEQ ID NO: 1201918 - RNA, 18 nt, Human
ugacaaggauugcuacug

SEQ ID NO: 1201919 - RNA, 20 nt, Human
ugaccgugaggccagagaca

SEQ ID NO: 1201920 - RNA, 16 nt, Human
ugaccgugaggccaga

SEQ ID NO: 1201921 - RNA, 14 nt, Human
ugaccgugaggcca

SEQ ID NO: 1201922 - RNA, 13 nt, Human
ugaccgugaggcc

SEQ ID NO: 1201923 - RNA, 19 nt, Human
ugaccauucuccaccugcc

SEQ ID NO: 1201924 - RNA, 18 nt, Human
ugaccauucuccaccugc

SEQ ID NO: 1201925 - RNA, 17 nt, Human
ugaccauucuccaccug

SEQ ID NO: 1201926 - RNA, 16 nt, Human
ugaccauucuccaccu

SEQ ID NO: 1201927 - RNA, 20 nt, Human
ugaccagcaccaucucuccu

SEQ ID NO: 1201928 - RNA, 19 nt, Human
ugaccagcaccaucucucc

SEQ ID NO: 1201929 - RNA, 15 nt, Human
ugacaugucuuuucu

SEQ ID NO: 1201930 - RNA, 13 nt, Human
ugacaugucuuuu

SEQ ID NO: 1201931 - RNA, 17 nt, Human
ugaacuccuggccucaa

SEQ ID NO: 1201932 - RNA, 22 nt, Human
ugaaggacauugcggacagcca

SEQ ID NO: 1201933 - RNA, 20 nt, Human
ugaaggacauugcggacagc

SEQ ID NO: 1201934 - RNA, 19 nt, Human
ugaaggacauugcggacag

SEQ ID NO: 1201935 - RNA, 16 nt, Human
ugaaggccccgcccag

SEQ ID NO: 1201936 - RNA, 15 nt, Human
ugaaggccccgccca

SEQ ID NO: 1201937 - RNA, 17 nt, Human
ugaaggccccgcccagg

SEQ ID NO: 1201938 - RNA, 23 nt, Human
ugaaugaugauccuaggcauuug

SEQ ID NO: 1201939 - RNA, 17 nt, Human
ucuuuccaaaguacacu

SEQ ID NO: 1201940 - RNA, 14 nt, Human
ucuuuccaaaguac

SEQ ID NO: 1201941 - RNA, 13 nt, Human
ucuuuccaaagua

SEQ ID NO: 1201942 - RNA, 21 nt, Human
ucuuucagccaagaauucuua

SEQ ID NO: 1201943 - RNA, 20 nt, Human
ucuuucagccaagaauucuu

SEQ ID NO: 1201944 - RNA, 19 nt, Human
ucuuucagccaagaauucu

SEQ ID NO: 1201945 - RNA, 16 nt, Human
ucuuucagccaagaau

SEQ ID NO: 1201946 - RNA, 17 nt, Human
ucuuuggacacucacac

SEQ ID NO: 1201947 - RNA, 23 nt, Human
ucuuucacccuuuucuguuugcu

SEQ ID NO: 1201948 - RNA, 21 nt, Human
ucuuguguguuuauugucaaa

SEQ ID NO: 1201949 - RNA, 16 nt, Human
ucuuguguguuuauug

SEQ ID NO: 1201950 - RNA, 15 nt, Human
ucuugcaugaggcua

SEQ ID NO: 1201951 - RNA, 16 nt, Human
ucucccuucauccuuc

SEQ ID NO: 1201952 - RNA, 21 nt, Human
ugaaccaccacacccagccca

SEQ ID NO: 1201953 - RNA, 20 nt, Human
ugaaccaccacacccagccc

SEQ ID NO: 1201954 - RNA, 17 nt, Human
ugaaccaccacacccag

SEQ ID NO: 1201955 - RNA, 23 nt, Human
ugaaccacaucuugcucugcuga

SEQ ID NO: 1201956 - RNA, 19 nt, Human
ugaaccacaucuugcucug

SEQ ID NO: 1201957 - RNA, 22 nt, Human
ugaaccaagaacuuuccaggaa

SEQ ID NO: 1201958 - RNA, 14 nt, Human
ugaaacauuuuguc

SEQ ID NO: 1201959 - RNA, 21 nt, Human
ugaaaauuuugauguuuuaag

SEQ ID NO: 1201960 - RNA, 19 nt, Human
ugaaaauuuugauguuuua

SEQ ID NO: 1201961 - RNA, 13 nt, Human
ugaaaauuuugau

SEQ ID NO: 1201962 - RNA, 15 nt, Human
ugaaagggcccagag

SEQ ID NO: 1201963 - RNA, 13 nt, Human
ugaaagggcccag

SEQ ID NO: 1201964 - RNA, 23 nt, Human
ugaaagggaguauuacaaaaaca

SEQ ID NO: 1201965 - RNA, 18 nt, Human
ugaaagcccugagcuuuc

SEQ ID NO: 1201966 - RNA, 13 nt, Human
ugagcugggauga

SEQ ID NO: 1201967 - RNA, 23 nt, Human
ugaggcauuuguuugaacugaua

SEQ ID NO: 1201968 - RNA, 23 nt, Human
ugaggcuagugugguguuuccug

SEQ ID NO: 1201969 - RNA, 17 nt, Human
ugaggcuaguguggugu

SEQ ID NO: 1201970 - RNA, 21 nt, Human
ugaggcauuuguuugaacuga

SEQ ID NO: 1201971 - RNA, 20 nt, Human
ugaggcauuuguuugaacug

SEQ ID NO: 1201972 - RNA, 19 nt, Human
ugaggcauuuguuugaacu

SEQ ID NO: 1201973 - RNA, 12 nt, Human
ugaggcauuugu

SEQ ID NO: 1201974 - RNA, 13 nt, Human
ugaggugggagga

SEQ ID NO: 1201975 - RNA, 12 nt, Human
ugaggugggagg

SEQ ID NO: 1201976 - RNA, 17 nt, Human
ugagggaacagagaggu

SEQ ID NO: 1201977 - RNA, 15 nt, Human
ugaggcucugcccuu

SEQ ID NO: 1201978 - RNA, 14 nt, Human
ugaggcucugcccu

SEQ ID NO: 1201979 - RNA, 13 nt, Human
ugaggcucugccc

SEQ ID NO: 1201980 - RNA, 20 nt, Human
ugaguugauagcacagaccc

SEQ ID NO: 1201981 - RNA, 16 nt, Human
ugaguugauagcacag

SEQ ID NO: 1201982 - RNA, 14 nt, Human
ugagugagcaugcc

SEQ ID NO: 1201983 - RNA, 21 nt, Human
ugaguugauagcacagacccu

SEQ ID NO: 1201984 - RNA, 18 nt, Human
ugagucugaaggcugggu

SEQ ID NO: 1201985 - RNA, 17 nt, Human
ugagucugaaggcuggg

SEQ ID NO: 1201986 - RNA, 15 nt, Human
ugagucugaaggcug

SEQ ID NO: 1201987 - RNA, 13 nt, Human
ugagucugaaggc

SEQ ID NO: 1201988 - RNA, 19 nt, Human
ugagucgaggacagggagg

SEQ ID NO: 1201989 - RNA, 19 nt, Human
ugaguccagaaguuugaga

SEQ ID NO: 1201990 - RNA, 21 nt, Human
ugaggugggaggaucucuuga

SEQ ID NO: 1201991 - RNA, 10 nt, Human
ugagccuggc

SEQ ID NO: 1201992 - RNA, 21 nt, Human
ugagccucagcauccuggcac

SEQ ID NO: 1201993 - RNA, 18 nt, Human
ugagccucagcauccugg

SEQ ID NO: 1201994 - RNA, 22 nt, Human
ugagccucagcauccuggcacc

SEQ ID NO: 1201995 - RNA, 17 nt, Human
ugagccucagcauccug

SEQ ID NO: 1201996 - RNA, 21 nt, Human
ugagccgagaucacgccacug

SEQ ID NO: 1201997 - RNA, 19 nt, Human
ugagccgagaucacgccac

SEQ ID NO: 1201998 - RNA, 21 nt, Human
ugagcaucaggccaggcccuc

SEQ ID NO: 1201999 - RNA, 20 nt, Human
ugagcaucaggccaggcccu

SEQ ID NO: 1202000 - RNA, 19 nt, Human
ugagcaucaggccaggccc

SEQ ID NO: 1202001 - RNA, 18 nt, Human
ugagcaucaggccaggcc

SEQ ID NO: 1202002 - RNA, 19 nt, Human
ugagcagggcucagcgggg

SEQ ID NO: 1202003 - RNA, 17 nt, Human
ugagcagggcucagcgg

SEQ ID NO: 1202004 - RNA, 16 nt, Human
ugagcagggcucagcg

SEQ ID NO: 1202005 - RNA, 15 nt, Human
ugagcagggcucagc

SEQ ID NO: 1202006 - RNA, 14 nt, Human
ugagcagggcucag

SEQ ID NO: 1202007 - RNA, 13 nt, Human
ugagcagggcuca

SEQ ID NO: 1202008 - RNA, 15 nt, Human
ugagaucagccuggg

SEQ ID NO: 1202009 - RNA, 14 nt, Human
ugagaucagccugg

SEQ ID NO: 1202010 - RNA, 15 nt, Human
ugagaucaaaacggu

SEQ ID NO: 1202011 - RNA, 23 nt, Human
ugagacucgcgacaaugcaaacc

SEQ ID NO: 1202012 - RNA, 22 nt, Human
ugagacucgcgacaaugcaaac

SEQ ID NO: 1202013 - RNA, 21 nt, Human
ugagacucgcgacaaugcaaa

SEQ ID NO: 1202014 - RNA, 20 nt, Human
ugagacucgcgacaaugcaa

SEQ ID NO: 1202015 - RNA, 19 nt, Human
ugagacucgcgacaaugca

SEQ ID NO: 1202016 - RNA, 21 nt, Human
ugaccucaggugauccaccca

SEQ ID NO: 1202017 - RNA, 20 nt, Human
ugaccucaggugauccaccc

SEQ ID NO: 1202018 - RNA, 21 nt, Human
ugauucuccugccucagccuc

SEQ ID NO: 1202019 - RNA, 23 nt, Human
ugauucagacagcugccugggau

SEQ ID NO: 1202020 - RNA, 21 nt, Human
ugauucagacagcugccuggg

SEQ ID NO: 1202021 - RNA, 20 nt, Human
ugauucagacagcugccugg

SEQ ID NO: 1202022 - RNA, 19 nt, Human
ugauucagacagcugccug

SEQ ID NO: 1202023 - RNA, 18 nt, Human
ugauucagacagcugccu

SEQ ID NO: 1202024 - RNA, 16 nt, Human
ugauugugucucuugg

SEQ ID NO: 1202025 - RNA, 21 nt, Human
ugauuggaggggggagguggg

SEQ ID NO: 1202026 - RNA, 13 nt, Human
ugauuggaggggg

SEQ ID NO: 1202027 - RNA, 20 nt, Human
ugauguucuuucacccuuuu

SEQ ID NO: 1202028 - RNA, 20 nt, Human
ugauucaacagguuuuccug

SEQ ID NO: 1202029 - RNA, 16 nt, Human
ugauucagacagcugc

SEQ ID NO: 1202030 - RNA, 15 nt, Human
ugauucagacagcug

SEQ ID NO: 1202031 - RNA, 14 nt, Human
ugauucagacagcu

SEQ ID NO: 1202032 - RNA, 13 nt, Human
ugauucagacagc

SEQ ID NO: 1202033 - RNA, 16 nt, Human
ugauguguuaucucuu

SEQ ID NO: 1202034 - RNA, 18 nt, Human
ugaugcuucuucagagac

SEQ ID NO: 1202035 - RNA, 17 nt, Human
ugaugcuucuucagaga

SEQ ID NO: 1202036 - RNA, 16 nt, Human
ugaugcuucuucagag

SEQ ID NO: 1202037 - RNA, 18 nt, Human
ugaucuuugcagacaggc

SEQ ID NO: 1202038 - RNA, 16 nt, Human
ugaucuuugcagacag

SEQ ID NO: 1202039 - RNA, 17 nt, Human
ugauccaagcugguccc

SEQ ID NO: 1202040 - RNA, 15 nt, Human
ugauccaagcugguc

SEQ ID NO: 1202041 - RNA, 14 nt, Human
ugauccaagcuggu

SEQ ID NO: 1202042 - RNA, 13 nt, Human
ugauccaagcugg

SEQ ID NO: 1202043 - RNA, 14 nt, Human
ugauagcacagacc

SEQ ID NO: 1202044 - RNA, 13 nt, Human
ugauagcacagac

SEQ ID NO: 1202045 - RNA, 20 nt, Human
ugauaagaaccuuuugagug

SEQ ID NO: 1202046 - RNA, 17 nt, Human
ugaucucucgugauuga

SEQ ID NO: 1202047 - RNA, 19 nt, Human
ugauccacccaccucagcc

SEQ ID NO: 1202048 - RNA, 18 nt, Human
ugauccacccaccucagc

SEQ ID NO: 1202049 - RNA, 17 nt, Human
ugauccacccaccucag

SEQ ID NO: 1202050 - RNA, 20 nt, Human
ugaucuucuuuauaauucua

SEQ ID NO: 1202051 - RNA, 23 nt, Human
ucucccucagucuggcccuuccu

SEQ ID NO: 1202052 - RNA, 18 nt, Human
ucucccucagucuggccc

SEQ ID NO: 1202053 - RNA, 13 nt, Human
ucucccccagccc

SEQ ID NO: 1202054 - RNA, 12 nt, Human
ucucccccagcc

SEQ ID NO: 1202055 - RNA, 11 nt, Human
ucuccaggcug

SEQ ID NO: 1202056 - RNA, 22 nt, Human
ucuccagccccuggaugcagcc

SEQ ID NO: 1202057 - RNA, 18 nt, Human
ucuccagccccuggaugc

SEQ ID NO: 1202058 - RNA, 16 nt, Human
ucuccagccccuggau

SEQ ID NO: 1202059 - RNA, 15 nt, Human
ucuccagccccugga

SEQ ID NO: 1202060 - RNA, 14 nt, Human
ucuccagccccugg

SEQ ID NO: 1202061 - RNA, 13 nt, Human
ucuccagccccug

SEQ ID NO: 1202062 - RNA, 12 nt, Human
ucuccagccccu

SEQ ID NO: 1202063 - RNA, 18 nt, Human
ucucauacucaccucacc

SEQ ID NO: 1202064 - RNA, 16 nt, Human
ucucauacucaccuca

SEQ ID NO: 1202065 - RNA, 23 nt, Human
ucuaugggacucaaugcacugac

SEQ ID NO: 1202066 - RNA, 19 nt, Human
ucuaugggacucaaugcac

SEQ ID NO: 1202067 - RNA, 13 nt, Human
ucuaugggacuca

SEQ ID NO: 1202068 - RNA, 12 nt, Human
ucuaugggacuc

SEQ ID NO: 1202069 - RNA, 16 nt, Human
ucuccaccugccaggg

SEQ ID NO: 1202070 - RNA, 15 nt, Human
ucuccaccugccagg

SEQ ID NO: 1202071 - RNA, 14 nt, Human
ucuccaccugccag

SEQ ID NO: 1202072 - RNA, 19 nt, Human
ucuccaccugccagggaca

SEQ ID NO: 1202073 - RNA, 17 nt, Human
ucuccaccugccaggga

SEQ ID NO: 1202074 - RNA, 22 nt, Human
ucuccaccugccagggacagag

SEQ ID NO: 1202075 - RNA, 16 nt, Human
ucuccacccugcucuc

SEQ ID NO: 1202076 - RNA, 14 nt, Human
ucuccacccugcuc

SEQ ID NO: 1202077 - RNA, 17 nt, Human
ucuccacccugcucucc

SEQ ID NO: 1202078 - RNA, 13 nt, Human
ucuccacccugcu

SEQ ID NO: 1202079 - RNA, 14 nt, Human
ucuaccuuccugca

SEQ ID NO: 1202080 - RNA, 16 nt, Human
ucuacagaggccaugg

SEQ ID NO: 1202081 - RNA, 15 nt, Human
ucuacagaggccaug

SEQ ID NO: 1202082 - RNA, 21 nt, Human
ucuaggaagacuuuggaaaga

SEQ ID NO: 1202083 - RNA, 19 nt, Human
ucuaggaagacuuuggaaa

SEQ ID NO: 1202084 - RNA, 16 nt, Human
ucuaggaagacuuugg

SEQ ID NO: 1202085 - RNA, 15 nt, Human
ucuaggaagacuuug

SEQ ID NO: 1202086 - RNA, 17 nt, Human
ucuaugacacaugcaag

SEQ ID NO: 1202087 - RNA, 14 nt, Human
ucuaugacacaugc

SEQ ID NO: 1202088 - RNA, 13 nt, Human
ucgugacaacacu

SEQ ID NO: 1202089 - RNA, 20 nt, Human
ucuaaaggcuaccuuuguau

SEQ ID NO: 1202090 - RNA, 19 nt, Human
ucuaaaggcuaccuuugua

SEQ ID NO: 1202091 - RNA, 18 nt, Human
ucuaaaggcuaccuuugu

SEQ ID NO: 1202092 - RNA, 13 nt, Human
uccuguagcccua

SEQ ID NO: 1202093 - RNA, 11 nt, Human
uccuguagccc

SEQ ID NO: 1202094 - RNA, 12 nt, Human
uccuggccucaa

SEQ ID NO: 1202095 - RNA, 17 nt, Human
uccuggcacugcuucca

SEQ ID NO: 1202096 - RNA, 16 nt, Human
uccuggcacugcuucc

SEQ ID NO: 1202097 - RNA, 13 nt, Human
uccuggcacugcu

SEQ ID NO: 1202098 - RNA, 23 nt, Human
uccuggcacccggccccugcugg

SEQ ID NO: 1202099 - RNA, 14 nt, Human
uccuggaguucugg

SEQ ID NO: 1202100 - RNA, 20 nt, Human
uccugcccuuaccugccagg

SEQ ID NO: 1202101 - RNA, 17 nt, Human
uccugcccuuaccugcc

SEQ ID NO: 1202102 - RNA, 14 nt, Human
uccugccaggcaug

SEQ ID NO: 1202103 - RNA, 13 nt, Human
uccugccaggcau

SEQ ID NO: 1202104 - RNA, 23 nt, Human
uccuauauuguuuucaguguaca

SEQ ID NO: 1202105 - RNA, 12 nt, Human
uccuaguuccac

SEQ ID NO: 1202106 - RNA, 13 nt, Human
uccucccaccuca

SEQ ID NO: 1202107 - RNA, 12 nt, Human
uccucccaccuc

SEQ ID NO: 1202108 - RNA, 10 nt, Human
uccuccaggu

SEQ ID NO: 1202109 - RNA, 18 nt, Human
uccucauuagcauuuugc

SEQ ID NO: 1202110 - RNA, 21 nt, Human
uccuaagcuauucaguaauaa

SEQ ID NO: 1202111 - RNA, 20 nt, Human
uccuaagcuauucaguaaua

SEQ ID NO: 1202112 - RNA, 20 nt, Human
uccgcuuucuacccagcgag

SEQ ID NO: 1202113 - RNA, 18 nt, Human
uccgcuuucuacccagcg

SEQ ID NO: 1202114 - RNA, 16 nt, Human
uccgcuuucuacccag

SEQ ID NO: 1202115 - RNA, 14 nt, Human
uccgccucuugggu

SEQ ID NO: 1202116 - RNA, 16 nt, Human
ucccuuccucuuucca

SEQ ID NO: 1202117 - RNA, 15 nt, Human
ucccuuccucuuucc

SEQ ID NO: 1202118 - RNA, 21 nt, Human
ucccccuuccauggacuuugu

SEQ ID NO: 1202119 - RNA, 15 nt, Human
ucccccuuccaugga

SEQ ID NO: 1202120 - RNA, 21 nt, Human
uccacuuucuagccagaggag

SEQ ID NO: 1202121 - RNA, 20 nt, Human
uccacuuucuagccagagga

SEQ ID NO: 1202122 - RNA, 16 nt, Human
uccaaaguacacuguu

SEQ ID NO: 1202123 - RNA, 14 nt, Human
uccaaaguacacug

SEQ ID NO: 1202124 - RNA, 20 nt, Human
uccaggggugggacacccug

SEQ ID NO: 1202125 - RNA, 19 nt, Human
uccaggggugggacacccu

SEQ ID NO: 1202126 - RNA, 15 nt, Human
uccaggagcagccac

SEQ ID NO: 1202127 - RNA, 14 nt, Human
uccaggagcagcca

SEQ ID NO: 1202128 - RNA, 13 nt, Human
uccaggagcagcc

SEQ ID NO: 1202129 - RNA, 12 nt, Human
uccaggagcagc

SEQ ID NO: 1202130 - RNA, 13 nt, Human
uccauggacuuug

SEQ ID NO: 1202131 - RNA, 15 nt, Human
uccauagagagcaag

SEQ ID NO: 1202132 - RNA, 14 nt, Human
uccauagagagcaa

SEQ ID NO: 1202133 - RNA, 20 nt, Human
uccagguuuaagcuguuacu

SEQ ID NO: 1202134 - RNA, 22 nt, Human
uccaggggugggacacccugug

SEQ ID NO: 1202135 - RNA, 22 nt, Human
ucccccagccccauccucugua

SEQ ID NO: 1202136 - RNA, 21 nt, Human
ucccccagccccauccucugu

SEQ ID NO: 1202137 - RNA, 20 nt, Human
ucccccagccccauccucug

SEQ ID NO: 1202138 - RNA, 17 nt, Human
uccccaggaggccagcc

SEQ ID NO: 1202139 - RNA, 17 nt, Human
ucccccagccccauccu

SEQ ID NO: 1202140 - RNA, 16 nt, Human
uccccaggaggccagc

SEQ ID NO: 1202141 - RNA, 15 nt, Human
uccccaggaggccag

SEQ ID NO: 1202142 - RNA, 14 nt, Human
uccccaggaggcca

SEQ ID NO: 1202143 - RNA, 22 nt, Human
uccccagcaagugagagcuggg

SEQ ID NO: 1202144 - RNA, 21 nt, Human
uccccagcaagugagagcugg

SEQ ID NO: 1202145 - RNA, 20 nt, Human
uccccagcaagugagagcug

SEQ ID NO: 1202146 - RNA, 23 nt, Human
uccccagauugcaacaggcuggg

SEQ ID NO: 1202147 - RNA, 22 nt, Human
uccccagauugcaacaggcugg

SEQ ID NO: 1202148 - RNA, 20 nt, Human
uccccagauugcaacaggcu

SEQ ID NO: 1202149 - RNA, 19 nt, Human
uccccagauugcaacaggc

SEQ ID NO: 1202150 - RNA, 18 nt, Human
uccccagauugcaacagg

SEQ ID NO: 1202151 - RNA, 13 nt, Human
uccccagauugca

SEQ ID NO: 1202152 - RNA, 20 nt, Human
ucccaugagccucagcaucc

SEQ ID NO: 1202153 - RNA, 18 nt, Human
ucccaccuuggcugcagg

SEQ ID NO: 1202154 - RNA, 17 nt, Human
ucccaccuuggcugcag

SEQ ID NO: 1202155 - RNA, 16 nt, Human
ucccaccuuggcugca

SEQ ID NO: 1202156 - RNA, 13 nt, Human
ucccaccuuggcu

SEQ ID NO: 1202157 - RNA, 22 nt, Human
ucccaccucucucacuccuuga

SEQ ID NO: 1202158 - RNA, 20 nt, Human
uccaugugggcuaguugggc

SEQ ID NO: 1202159 - RNA, 24 nt, Human
ucccaggcauuccccaggaggcca

SEQ ID NO: 1202160 - RNA, 23 nt, Human
ucccagcugugcucuggacaggc

SEQ ID NO: 1202161 - RNA, 22 nt, Human
ucccagcugugcucuggacagg

SEQ ID NO: 1202162 - RNA, 21 nt, Human
ucccagcugugcucuggacag

SEQ ID NO: 1202163 - RNA, 19 nt, Human
ucccaugagccucagcauc

SEQ ID NO: 1202164 - RNA, 18 nt, Human
ucccaugagccucagcau

SEQ ID NO: 1202165 - RNA, 15 nt, Human
ucccaucuuccaagg

SEQ ID NO: 1202166 - RNA, 18 nt, Human
ucauccacugugccaugu

SEQ ID NO: 1202167 - RNA, 17 nt, Human
ucauccacugugccaug

SEQ ID NO: 1202168 - RNA, 14 nt, Human
ucauccacugugcc

SEQ ID NO: 1202169 - RNA, 16 nt, Human
ucagugccaaaaacaa

SEQ ID NO: 1202170 - RNA, 20 nt, Human
ucaguguacauggaauaaca

SEQ ID NO: 1202171 - RNA, 13 nt, Human
uccaaaguacacu

SEQ ID NO: 1202172 - RNA, 23 nt, Human
ucagucugauucccaagcucugc

SEQ ID NO: 1202173 - RNA, 22 nt, Human
ucagucugauucccaagcucug

SEQ ID NO: 1202174 - RNA, 21 nt, Human
ucagucugauucccaagcucu

SEQ ID NO: 1202175 - RNA, 21 nt, Human
ucagguggggcagcuugaggg

SEQ ID NO: 1202176 - RNA, 20 nt, Human
ucagguggggcagcuugagg

SEQ ID NO: 1202177 - RNA, 19 nt, Human
ucagguggggcagcuugag

SEQ ID NO: 1202178 - RNA, 18 nt, Human
ucagguggggcagcuuga

SEQ ID NO: 1202179 - RNA, 23 nt, Human
ucaggugccucaagagaaggcaa

SEQ ID NO: 1202180 - RNA, 23 nt, Human
ucaggugauccacccaccucagc

SEQ ID NO: 1202181 - RNA, 16 nt, Human
ucaggugauccaccca

SEQ ID NO: 1202182 - RNA, 23 nt, Human
ucagcucugcaagaauugaagca

SEQ ID NO: 1202183 - RNA, 23 nt, Human
ucaggaagcucagggccuggcuc

SEQ ID NO: 1202184 - RNA, 24 nt, Human
ucagcuccagcucaccagccccag

SEQ ID NO: 1202185 - RNA, 23 nt, Human
ucagcuccagcucaccagcccca

SEQ ID NO: 1202186 - RNA, 21 nt, Human
ucaggccugggggcugggcag

SEQ ID NO: 1202187 - RNA, 23 nt, Human
uaugacuccagaauuucccaaag

SEQ ID NO: 1202188 - RNA, 17 nt, Human
uaugacuccagaauuuc

SEQ ID NO: 1202189 - RNA, 16 nt, Human
uaugacuccagaauuu

SEQ ID NO: 1202190 - RNA, 14 nt, Human
uaugcacacauuuu

SEQ ID NO: 1202191 - RNA, 13 nt, Human
uaugcacacauuu

SEQ ID NO: 1202192 - RNA, 18 nt, Human
uaugcaaucaaaucugcu

SEQ ID NO: 1202193 - RNA, 18 nt, Human
uaugcaugaaguaauaug

SEQ ID NO: 1202194 - RNA, 13 nt, Human
uaugcaugaagua

SEQ ID NO: 1202195 - RNA, 18 nt, Human
uauggaacacucugagac

SEQ ID NO: 1202196 - RNA, 17 nt, Human
uauggaacacucugaga

SEQ ID NO: 1202197 - RNA, 16 nt, Human
uauggaacacucugag

SEQ ID NO: 1202198 - RNA, 13 nt, Human
uauggaacacucu

SEQ ID NO: 1202199 - RNA, 17 nt, Human
uauggacaaugacccag

SEQ ID NO: 1202200 - RNA, 19 nt, Human
uauggaacacucugagacu

SEQ ID NO: 1202201 - RNA, 14 nt, Human
uaucuugaagacuu

SEQ ID NO: 1202202 - RNA, 23 nt, Human
uaucugucauuugagcagggcuc

SEQ ID NO: 1202203 - RNA, 21 nt, Human
uaucugucauuugagcagggc

SEQ ID NO: 1202204 - RNA, 20 nt, Human
uaucugucauuugagcaggg

SEQ ID NO: 1202205 - RNA, 12 nt, Human
uaugacacaugc

SEQ ID NO: 1202206 - RNA, 22 nt, Human
uaugacacaugcaaggucauuu

SEQ ID NO: 1202207 - RNA, 19 nt, Human
uauauguuuuaagaggcag

SEQ ID NO: 1202208 - RNA, 21 nt, Human
uaucuaauauguaacaagcca

SEQ ID NO: 1202209 - RNA, 16 nt, Human
uaucgucacugcuuaa

SEQ ID NO: 1202210 - RNA, 21 nt, Human
uagggaaaaaccagcguguga

SEQ ID NO: 1202211 - RNA, 20 nt, Human
uagggaaaaaccagcgugug

SEQ ID NO: 1202212 - RNA, 19 nt, Human
uagggaaaaaccagcgugu

SEQ ID NO: 1202213 - RNA, 15 nt, Human
uaggccuggccagau

SEQ ID NO: 1202214 - RNA, 18 nt, Human
uaggccuggccagaugca

SEQ ID NO: 1202215 - RNA, 15 nt, Human
uaguaugaggcauuu

SEQ ID NO: 1202216 - RNA, 23 nt, Human
uaggugacagagugagacucugu

SEQ ID NO: 1202217 - RNA, 21 nt, Human
uauaugcucugcauguuacau

SEQ ID NO: 1202218 - RNA, 22 nt, Human
uauuuauuaaaugcccagcccc

SEQ ID NO: 1202219 - RNA, 17 nt, Human
uauuuaugggauccugg

SEQ ID NO: 1202220 - RNA, 23 nt, Human
uauugcugauggugcaaugaccu

SEQ ID NO: 1202221 - RNA, 15 nt, Human
uauugcccacgcugg

SEQ ID NO: 1202222 - RNA, 14 nt, Human
uauugcccacgcug

SEQ ID NO: 1202223 - RNA, 13 nt, Human
uauugcccacgcu

SEQ ID NO: 1202224 - RNA, 21 nt, Human
uauugauaugcuuauacacuu

SEQ ID NO: 1202225 - RNA, 20 nt, Human
uauugauaugcuuauacacu

SEQ ID NO: 1202226 - RNA, 13 nt, Human
uauuauaccuuuu

SEQ ID NO: 1202227 - RNA, 12 nt, Human
uauuauaccuuu

SEQ ID NO: 1202228 - RNA, 14 nt, Human
uauuaaggaagaca

SEQ ID NO: 1202229 - RNA, 24 nt, Human
uauuaagaaagacuaucuaaaugu

SEQ ID NO: 1202230 - RNA, 14 nt, Human
uauuauaccuuuuu

SEQ ID NO: 1202231 - RNA, 16 nt, Human
uauuaagaaagacuau

SEQ ID NO: 1202232 - RNA, 19 nt, Human
uauuaaaugcccagccccu

SEQ ID NO: 1202233 - RNA, 17 nt, Human
uauuaaaugcccagccc

SEQ ID NO: 1202234 - RNA, 15 nt, Human
uauuaaaugcccagc

SEQ ID NO: 1202235 - RNA, 22 nt, Human
uauguucuuaguggauguucug

SEQ ID NO: 1202236 - RNA, 21 nt, Human
uauguugcccaggcaggucuu

SEQ ID NO: 1202237 - RNA, 23 nt, Human
ucaaagagguuuuaaaaaaaucc

SEQ ID NO: 1202238 - RNA, 12 nt, Human
ucaaagagguuu

SEQ ID NO: 1202239 - RNA, 13 nt, Human
ucaaacuuuacua

SEQ ID NO: 1202240 - RNA, 17 nt, Human
ucaaggauccugagcca

SEQ ID NO: 1202241 - RNA, 16 nt, Human
ucaaggauccugagcc

SEQ ID NO: 1202242 - RNA, 15 nt, Human
ucaaggauccugagc

SEQ ID NO: 1202243 - RNA, 14 nt, Human
ucaaggauccugag

SEQ ID NO: 1202244 - RNA, 13 nt, Human
ucaaggauccuga

SEQ ID NO: 1202245 - RNA, 21 nt, Human
ucaagcgauucuucugcuuca

SEQ ID NO: 1202246 - RNA, 19 nt, Human
ucaagcgauucuucugcuu

SEQ ID NO: 1202247 - RNA, 18 nt, Human
ucaagcgauucuucugcu

SEQ ID NO: 1202248 - RNA, 20 nt, Human
ucaagccaccaacauacucc

SEQ ID NO: 1202249 - RNA, 12 nt, Human
ucaagccaccaa

SEQ ID NO: 1202250 - RNA, 16 nt, Human
ucaaccuccugggcua

SEQ ID NO: 1202251 - RNA, 15 nt, Human
ucaaccuccugggcu

SEQ ID NO: 1202252 - RNA, 20 nt, Human
ucaaccccuucgcuccugug

SEQ ID NO: 1202253 - RNA, 19 nt, Human
ucaaccccuucgcuccugu

SEQ ID NO: 1202254 - RNA, 18 nt, Human
ucaaccccuucgcuccug

SEQ ID NO: 1202255 - RNA, 20 nt, Human
ucaacucuccuccagaguca

SEQ ID NO: 1202256 - RNA, 23 nt, Human
ucacacaugagcaucaggccagg

SEQ ID NO: 1202257 - RNA, 15 nt, Human
ucacacacuuuggcu

SEQ ID NO: 1202258 - RNA, 18 nt, Human
ucaccaacgucugugcca

SEQ ID NO: 1202259 - RNA, 17 nt, Human
ucaccaacgucugugcc

SEQ ID NO: 1202260 - RNA, 14 nt, Human
ucacauuuauucug

SEQ ID NO: 1202261 - RNA, 18 nt, Human
ucacccgcuaagagggag

SEQ ID NO: 1202262 - RNA, 13 nt, Human
ucaccaagcccag

SEQ ID NO: 1202263 - RNA, 23 nt, Human
ucaccgaaaacguggcugcuuca

SEQ ID NO: 1202264 - RNA, 22 nt, Human
ucaccgaaaacguggcugcuuc

SEQ ID NO: 1202265 - RNA, 21 nt, Human
ucaccgaaaacguggcugcuu

SEQ ID NO: 1202266 - RNA, 20 nt, Human
ucaccgaaaacguggcugcu

SEQ ID NO: 1202267 - RNA, 19 nt, Human
ucaccgaaaacguggcugc

SEQ ID NO: 1202268 - RNA, 15 nt, Human
ucaccgaaaacgugg

SEQ ID NO: 1202269 - RNA, 19 nt, Human
ucacccgcuaagagggagg

SEQ ID NO: 1202270 - RNA, 14 nt, Human
ucaccgaaaacgug

SEQ ID NO: 1202271 - RNA, 12 nt, Human
ucacccuuuucu

SEQ ID NO: 1202272 - RNA, 21 nt, Human
guggcagugggagcugccugu

SEQ ID NO: 1202273 - RNA, 19 nt, Human
guggcagugggagcugccu

SEQ ID NO: 1202274 - RNA, 17 nt, Human
guggcagugggagcugc

SEQ ID NO: 1202275 - RNA, 16 nt, Human
guggcagugggagcug

SEQ ID NO: 1202276 - RNA, 15 nt, Human
guggcagugggagcu

SEQ ID NO: 1202277 - RNA, 19 nt, Human
guggcagcugcuuuugucu

SEQ ID NO: 1202278 - RNA, 13 nt, Human
guggcagcugcuu

SEQ ID NO: 1202279 - RNA, 12 nt, Human
guggcagcugcu

SEQ ID NO: 1202280 - RNA, 23 nt, Human
guggcagcugcgguccacccagg

SEQ ID NO: 1202281 - RNA, 22 nt, Human
guggcagcugcgguccacccag

SEQ ID NO: 1202282 - RNA, 21 nt, Human
guggcagcugcgguccaccca

SEQ ID NO: 1202283 - RNA, 20 nt, Human
guggaugccugguggcagcu

SEQ ID NO: 1202284 - RNA, 18 nt, Human
guggaugccugguggcag

SEQ ID NO: 1202285 - RNA, 16 nt, Human
guggaugccugguggc

SEQ ID NO: 1202286 - RNA, 17 nt, Human
guggaguucaucuugaa

SEQ ID NO: 1202287 - RNA, 20 nt, Human
guggagaagcggcuggcagc

SEQ ID NO: 1202288 - RNA, 15 nt, Human
gugcuuggaggaagg

SEQ ID NO: 1202289 - RNA, 13 nt, Human
gugcuuggaggaa

SEQ ID NO: 1202290 - RNA, 12 nt, Human
gugcuuggagga

SEQ ID NO: 1202291 - RNA, 12 nt, Human
gugcugcccugc

SEQ ID NO: 1202292 - RNA, 11 nt, Human
gugcugcccug

SEQ ID NO: 1202293 - RNA, 22 nt, Human
gugcugccauccagguucagcu

SEQ ID NO: 1202294 - RNA, 18 nt, Human
guggaaaaauagccugcc

SEQ ID NO: 1202295 - RNA, 16 nt, Human
gugcucuggacaggca

SEQ ID NO: 1202296 - RNA, 15 nt, Human
gugcucuggacaggc

SEQ ID NO: 1202297 - RNA, 21 nt, Human
gugccuuggggacaagagcag

SEQ ID NO: 1202298 - RNA, 22 nt, Human
gugccgagaaggaagccuccca

SEQ ID NO: 1202299 - RNA, 23 nt, Human
gugcugaaugguuuucaaaauaa

SEQ ID NO: 1202300 - RNA, 20 nt, Human
gugcugaaugguuuucaaaa

SEQ ID NO: 1202301 - RNA, 19 nt, Human
gugcugaaugguuuucaaa

SEQ ID NO: 1202302 - RNA, 18 nt, Human
gugcucuggacaggcaug

SEQ ID NO: 1202303 - RNA, 17 nt, Human
gugcucuggacaggcau

SEQ ID NO: 1202304 - RNA, 19 nt, Human
gugcugagucugaaggcug

SEQ ID NO: 1202305 - RNA, 18 nt, Human
gugcugagucugaaggcu

SEQ ID NO: 1202306 - RNA, 17 nt, Human
gugcugagucugaaggc

SEQ ID NO: 1202307 - RNA, 16 nt, Human
gugcugagucugaagg

SEQ ID NO: 1202308 - RNA, 12 nt, Human
gugcugagucug

SEQ ID NO: 1202309 - RNA, 20 nt, Human
gugcugcauuuaaaagauac

SEQ ID NO: 1202310 - RNA, 19 nt, Human
gugcugcauuuaaaagaua

SEQ ID NO: 1202311 - RNA, 12 nt, Human
gugcugcauuua

SEQ ID NO: 1202312 - RNA, 19 nt, Human
gugcugccauccagguuca

SEQ ID NO: 1202313 - RNA, 18 nt, Human
gugcugccauccagguuc

SEQ ID NO: 1202314 - RNA, 15 nt, Human
gugcugccauccagg

SEQ ID NO: 1202315 - RNA, 23 nt, Human
gugauucuccugccucagccucc

SEQ ID NO: 1202316 - RNA, 22 nt, Human
gugauucuccugccucagccuc

SEQ ID NO: 1202317 - RNA, 20 nt, Human
gugauucuccugccucagcc

SEQ ID NO: 1202318 - RNA, 19 nt, Human
gugauucuccugccucagc

SEQ ID NO: 1202319 - RNA, 18 nt, Human
gugauucuccugccucag

SEQ ID NO: 1202320 - RNA, 17 nt, Human
gugauucuccugccuca

SEQ ID NO: 1202321 - RNA, 16 nt, Human
gugauucuccugccuc

SEQ ID NO: 1202322 - RNA, 14 nt, Human
gugauucuccugcc

SEQ ID NO: 1202323 - RNA, 23 nt, Human
gugauccucccaccucagccucc

SEQ ID NO: 1202324 - RNA, 22 nt, Human
gugauccucccaccucagccuc

SEQ ID NO: 1202325 - RNA, 20 nt, Human
gugauccucccaccucagcc

SEQ ID NO: 1202326 - RNA, 18 nt, Human
gugauccucccaccucag

SEQ ID NO: 1202327 - RNA, 15 nt, Human
gugauccucccaccu

SEQ ID NO: 1202328 - RNA, 14 nt, Human
gugauccucccacc

SEQ ID NO: 1202329 - RNA, 22 nt, Human
gugauccacccaccucagccuc

SEQ ID NO: 1202330 - RNA, 20 nt, Human
gugauccacccaccucagcc

SEQ ID NO: 1202331 - RNA, 18 nt, Human
gugauccacccaccucag

SEQ ID NO: 1202332 - RNA, 15 nt, Human
gugauccacccaccu

SEQ ID NO: 1202333 - RNA, 13 nt, Human
gugaggccagaga

SEQ ID NO: 1202334 - RNA, 11 nt, Human
gugaggccaga

SEQ ID NO: 1202335 - RNA, 20 nt, Human
gugcccacaggaucagucug

SEQ ID NO: 1202336 - RNA, 22 nt, Human
gugccagguuuuuggucugacc

SEQ ID NO: 1202337 - RNA, 22 nt, Human
gugcaugcugucccuuacguga

SEQ ID NO: 1202338 - RNA, 14 nt, Human
gugcauaccacuuu

SEQ ID NO: 1202339 - RNA, 13 nt, Human
gugcauaccacuu

SEQ ID NO: 1202340 - RNA, 21 nt, Human
gugcauaccacuuuuguucuu

SEQ ID NO: 1202341 - RNA, 19 nt, Human
gugcauaaguuaacuucca

SEQ ID NO: 1202342 - RNA, 15 nt, Human
gugacugaauuucuu

SEQ ID NO: 1202343 - RNA, 18 nt, Human
gugacugaauuucuuuug

SEQ ID NO: 1202344 - RNA, 16 nt, Human
gugacugaauuucuuu

SEQ ID NO: 1202345 - RNA, 16 nt, Human
gugacaacacuugugu

SEQ ID NO: 1202346 - RNA, 12 nt, Human
gugaccucugcc

SEQ ID NO: 1202347 - RNA, 19 nt, Human
gugaggaagccgcuggggc

SEQ ID NO: 1202348 - RNA, 16 nt, Human
gugaggaagccgcugg

SEQ ID NO: 1202349 - RNA, 11 nt, Human
gugaggaagcc

SEQ ID NO: 1202350 - RNA, 14 nt, Human
gugagccacugcac

SEQ ID NO: 1202351 - RNA, 17 nt, Human
gugacugaucucucgug

SEQ ID NO: 1202352 - RNA, 13 nt, Human
gugagccacugca

SEQ ID NO: 1202353 - RNA, 19 nt, Human
gugaaaggaaagagggagg

SEQ ID NO: 1202354 - RNA, 12 nt, Human
gugaaacuggau

SEQ ID NO: 1202355 - RNA, 23 nt, Human
gugaaaagaaaaaugagccuggc

SEQ ID NO: 1202356 - RNA, 14 nt, Human
gugaaaagaaaaau

SEQ ID NO: 1202357 - RNA, 12 nt, Human
gucccagugccg

SEQ ID NO: 1202358 - RNA, 23 nt, Human
guccuagaaauuccccacccuga

SEQ ID NO: 1202359 - RNA, 23 nt, Human
guccuacucugugucaggugggg

SEQ ID NO: 1202360 - RNA, 15 nt, Human
guccuacucuguguc

SEQ ID NO: 1202361 - RNA, 18 nt, Human
gucccugguggcagcuca

SEQ ID NO: 1202362 - RNA, 17 nt, Human
gucccugguggcagcuc

SEQ ID NO: 1202363 - RNA, 16 nt, Human
gucccugguggcagcu

SEQ ID NO: 1202364 - RNA, 16 nt, Human
guccugggagugagcu

SEQ ID NO: 1202365 - RNA, 15 nt, Human
guccugggagugagc

SEQ ID NO: 1202366 - RNA, 23 nt, Human
guccucccaucucacacaugagc

SEQ ID NO: 1202367 - RNA, 14 nt, Human
guccucccaucuca

SEQ ID NO: 1202368 - RNA, 13 nt, Human
guccucccaucuc

SEQ ID NO: 1202369 - RNA, 12 nt, Human
guccucccaucu

SEQ ID NO: 1202370 - RNA, 19 nt, Human
guccugggagugagcuggu

SEQ ID NO: 1202371 - RNA, 18 nt, Human
guccugggagugagcugg

SEQ ID NO: 1202372 - RNA, 17 nt, Human
guccugggagugagcug

SEQ ID NO: 1202373 - RNA, 11 nt, Human
gucucacucug

SEQ ID NO: 1202374 - RNA, 13 nt, Human
gucuaccugaggg

SEQ ID NO: 1202375 - RNA, 23 nt, Human
gucucacuguugcccaggcuggc

SEQ ID NO: 1202376 - RNA, 22 nt, Human
gucucacuguugcccaggcugg

SEQ ID NO: 1202377 - RNA, 21 nt, Human
gucucacuguugcccaggcug

SEQ ID NO: 1202378 - RNA, 20 nt, Human
gucucacuguugcccaggcu

SEQ ID NO: 1202379 - RNA, 19 nt, Human
gucucacuguugcccaggc

SEQ ID NO: 1202380 - RNA, 18 nt, Human
gucucacuguugcccagg

SEQ ID NO: 1202381 - RNA, 17 nt, Human
gucucacuguugcccag

SEQ ID NO: 1202382 - RNA, 16 nt, Human
gucucacuguugccca

SEQ ID NO: 1202383 - RNA, 23 nt, Human
gucucacuauguugcccaggcag

SEQ ID NO: 1202384 - RNA, 21 nt, Human
gucucacuauguugcccaggc

SEQ ID NO: 1202385 - RNA, 20 nt, Human
gucucacuauguugcccagg

SEQ ID NO: 1202386 - RNA, 18 nt, Human
guccuuaccagcagagca

SEQ ID NO: 1202387 - RNA, 17 nt, Human
guccuuaccagcagagc

SEQ ID NO: 1202388 - RNA, 16 nt, Human
guccuuaccagcagag

SEQ ID NO: 1202389 - RNA, 15 nt, Human
guccuuaccagcaga

SEQ ID NO: 1202390 - RNA, 15 nt, Human
gucuacacugugcug

SEQ ID NO: 1202391 - RNA, 21 nt, Human
gucugauucccaagcucugcu

SEQ ID NO: 1202392 - RNA, 20 nt, Human
gucugauucccaagcucugc

SEQ ID NO: 1202393 - RNA, 19 nt, Human
gucugauucccaagcucug

SEQ ID NO: 1202394 - RNA, 18 nt, Human
gucugauucccaagcucu

SEQ ID NO: 1202395 - RNA, 17 nt, Human
gucugauucccaagcuc

SEQ ID NO: 1202396 - RNA, 21 nt, Human
gucugaggaauccagacccgg

SEQ ID NO: 1202397 - RNA, 19 nt, Human
gucugaggaauccagaccc

SEQ ID NO: 1202398 - RNA, 18 nt, Human
gucugaggaauccagacc

SEQ ID NO: 1202399 - RNA, 15 nt, Human
gucugacccacugcu

SEQ ID NO: 1202400 - RNA, 14 nt, Human
gucugacccacugc

SEQ ID NO: 1202401 - RNA, 17 nt, Human
gucccagauacuugggg

SEQ ID NO: 1202402 - RNA, 15 nt, Human
gucccacucagucca

SEQ ID NO: 1202403 - RNA, 14 nt, Human
gucccacucagucc

SEQ ID NO: 1202404 - RNA, 16 nt, Human
guccacccaggagccc

SEQ ID NO: 1202405 - RNA, 15 nt, Human
guccacccaggagcc

SEQ ID NO: 1202406 - RNA, 14 nt, Human
guccacccaggagc

SEQ ID NO: 1202407 - RNA, 21 nt, Human
gucauauaagauucauauuua

SEQ ID NO: 1202408 - RNA, 15 nt, Human
guagagugggagcug

SEQ ID NO: 1202409 - RNA, 13 nt, Human
guagagugggagc

SEQ ID NO: 1202410 - RNA, 15 nt, Human
guagagugugccuga

SEQ ID NO: 1202411 - RNA, 13 nt, Human
guauuacuucugc

SEQ ID NO: 1202412 - RNA, 15 nt, Human
guauuacuucugcua

SEQ ID NO: 1202413 - RNA, 14 nt, Human
guauuacuucugcu

SEQ ID NO: 1202414 - RNA, 14 nt, Human
guauuauaccuuuu

SEQ ID NO: 1202415 - RNA, 20 nt, Human
gucaccugaagacucauucu

SEQ ID NO: 1202416 - RNA, 15 nt, Human
gucaccccggccacc

SEQ ID NO: 1202417 - RNA, 13 nt, Human
gucaccccggcca

SEQ ID NO: 1202418 - RNA, 16 nt, Human
gucaauuacaggaagu

SEQ ID NO: 1202419 - RNA, 15 nt, Human
gucaauuacaggaag

SEQ ID NO: 1202420 - RNA, 13 nt, Human
gucaauuacagga

SEQ ID NO: 1202421 - RNA, 19 nt, Human
gucaagagggucugaggaa

SEQ ID NO: 1202422 - RNA, 18 nt, Human
gucaagagggucugagga

SEQ ID NO: 1202423 - RNA, 19 nt, Human
gucaagugaaaaaggagga

SEQ ID NO: 1202424 - RNA, 18 nt, Human
gucaagugaaaaaggagg

SEQ ID NO: 1202425 - RNA, 16 nt, Human
gucaagugaaaaagga

SEQ ID NO: 1202426 - RNA, 17 nt, Human
ggggaucacagccucug

SEQ ID NO: 1202427 - RNA, 13 nt, Human
ggggaguggccac

SEQ ID NO: 1202428 - RNA, 22 nt, Human
gggcuuggggaccagagcugcc

SEQ ID NO: 1202429 - RNA, 21 nt, Human
gggcuuggggaccagagcugc

SEQ ID NO: 1202430 - RNA, 19 nt, Human
gggcuucauccuccucaga

SEQ ID NO: 1202431 - RNA, 20 nt, Human
gggcuucaguggcagcugcu

SEQ ID NO: 1202432 - RNA, 19 nt, Human
gggcuucaguggcagcugc

SEQ ID NO: 1202433 - RNA, 18 nt, Human
gggcuucaguggcagcug

SEQ ID NO: 1202434 - RNA, 17 nt, Human
gggcuucaguggcagcu

SEQ ID NO: 1202435 - RNA, 16 nt, Human
gggcuucaguggcagc

SEQ ID NO: 1202436 - RNA, 15 nt, Human
gggcuucaguggcag

SEQ ID NO: 1202437 - RNA, 20 nt, Human
gggcuucauccuccucagau

SEQ ID NO: 1202438 - RNA, 20 nt, Human
gggcuuggggaccagagcug

SEQ ID NO: 1202439 - RNA, 17 nt, Human
ggggcugggcagaggaa

SEQ ID NO: 1202440 - RNA, 16 nt, Human
ggggcugggcagagga

SEQ ID NO: 1202441 - RNA, 13 nt, Human
ggggcugggacau

SEQ ID NO: 1202442 - RNA, 23 nt, Human
ggguagagcggagaaaggaaggg

SEQ ID NO: 1202443 - RNA, 23 nt, Human
ggguacuuguggacacagcucuu

SEQ ID NO: 1202444 - RNA, 22 nt, Human
ggguacuuguggacacagcucu

SEQ ID NO: 1202445 - RNA, 19 nt, Human
ggguacuuguggacacagc

SEQ ID NO: 1202446 - RNA, 18 nt, Human
ggguacccacugcucugg

SEQ ID NO: 1202447 - RNA, 15 nt, Human
ggguacccacugcuc

SEQ ID NO: 1202448 - RNA, 13 nt, Human
ggguacccacugc

SEQ ID NO: 1202449 - RNA, 23 nt, Human
gggguucccuuuuuuggcugcug

SEQ ID NO: 1202450 - RNA, 16 nt, Human
gggcgcgguggcucac

SEQ ID NO: 1202451 - RNA, 13 nt, Human
gggcucccuuccc

SEQ ID NO: 1202452 - RNA, 23 nt, Human
gggcucccuucccaccucucuca

SEQ ID NO: 1202453 - RNA, 18 nt, Human
gggcucccuucccaccuc

SEQ ID NO: 1202454 - RNA, 17 nt, Human
gggcucccuucccaccu

SEQ ID NO: 1202455 - RNA, 14 nt, Human
gggcucccuuccca

SEQ ID NO: 1202456 - RNA, 17 nt, Human
gggccuggcucaggugg

SEQ ID NO: 1202457 - RNA, 18 nt, Human
gggccuggucguuuucaa

SEQ ID NO: 1202458 - RNA, 16 nt, Human
gggccuggcucaggug

SEQ ID NO: 1202459 - RNA, 14 nt, Human
gggccuggcucagg

SEQ ID NO: 1202460 - RNA, 12 nt, Human
gggccuggcuca

SEQ ID NO: 1202461 - RNA, 12 nt, Human
gggccuggccug

SEQ ID NO: 1202462 - RNA, 14 nt, Human
gggcuucaguggca

SEQ ID NO: 1202463 - RNA, 17 nt, Human
gggcugcaccggcuggc

SEQ ID NO: 1202464 - RNA, 14 nt, Human
gggcugcaccggcu

SEQ ID NO: 1202465 - RNA, 16 nt, Human
gggcugaggugggagg

SEQ ID NO: 1202466 - RNA, 20 nt, Human
gggcucugccucccaucacc

SEQ ID NO: 1202467 - RNA, 17 nt, Human
gggcucugccucccauc

SEQ ID NO: 1202468 - RNA, 16 nt, Human
gggcucugccucccau

SEQ ID NO: 1202469 - RNA, 15 nt, Human
gggcucugccuccca

SEQ ID NO: 1202470 - RNA, 13 nt, Human
gggcucugccucc

SEQ ID NO: 1202471 - RNA, 22 nt, Human
ggguucuacccaggugcuagga

SEQ ID NO: 1202472 - RNA, 23 nt, Human
ggguucccuuuuuuggcugcuga

SEQ ID NO: 1202473 - RNA, 19 nt, Human
ggguuggccccugcccggc

SEQ ID NO: 1202474 - RNA, 22 nt, Human
gguacuuguggacacagcucuu

SEQ ID NO: 1202475 - RNA, 21 nt, Human
gguacuuguggacacagcucu

SEQ ID NO: 1202476 - RNA, 15 nt, Human
ggguugggcuggugu

SEQ ID NO: 1202477 - RNA, 17 nt, Human
gguacccacugcucugg

SEQ ID NO: 1202478 - RNA, 22 nt, Human
ggucccacucaguccauagcag

SEQ ID NO: 1202479 - RNA, 14 nt, Human
ggucccacucaguc

SEQ ID NO: 1202480 - RNA, 12 nt, Human
ggucccacucag

SEQ ID NO: 1202481 - RNA, 23 nt, Human
ggucccccuuccauggacuuugu

SEQ ID NO: 1202482 - RNA, 18 nt, Human
ggucccccuuccauggac

SEQ ID NO: 1202483 - RNA, 13 nt, Human
ggucccccuucca

SEQ ID NO: 1202484 - RNA, 16 nt, Human
ggucagagccugcagu

SEQ ID NO: 1202485 - RNA, 15 nt, Human
ggucagagccugcag

SEQ ID NO: 1202486 - RNA, 14 nt, Human
ggucagagccugca

SEQ ID NO: 1202487 - RNA, 13 nt, Human
ggucagagccugc

SEQ ID NO: 1202488 - RNA, 12 nt, Human
ggucagagccug

SEQ ID NO: 1202489 - RNA, 22 nt, Human
ggucacucuggcagcucagaga

SEQ ID NO: 1202490 - RNA, 20 nt, Human
ggucacucuggcagcucaga

SEQ ID NO: 1202491 - RNA, 16 nt, Human
ggucacucuggcagcu

SEQ ID NO: 1202492 - RNA, 22 nt, Human
gguagaaauaucugaaaaugua

SEQ ID NO: 1202493 - RNA, 16 nt, Human
gguggcagugggagcu

SEQ ID NO: 1202494 - RNA, 23 nt, Human
gguggcagcugcgguccacccag

SEQ ID NO: 1202495 - RNA, 15 nt, Human
gguggcagcugcggu

SEQ ID NO: 1202496 - RNA, 13 nt, Human
gguggcagcugcg

SEQ ID NO: 1202497 - RNA, 12 nt, Human
gguggcagcugc

SEQ ID NO: 1202498 - RNA, 11 nt, Human
gguggcagcug

SEQ ID NO: 1202499 - RNA, 13 nt, Human
gguggcagcucac

SEQ ID NO: 1202500 - RNA, 23 nt, Human
ggugcuaucucccccagccccau

SEQ ID NO: 1202501 - RNA, 22 nt, Human
ggugcuaucucccccagcccca

SEQ ID NO: 1202502 - RNA, 21 nt, Human
ggugaccucugccugaaguca

SEQ ID NO: 1202503 - RNA, 16 nt, Human
ggugaccucugccuga

SEQ ID NO: 1202504 - RNA, 14 nt, Human
ggugaccucugccu

SEQ ID NO: 1202505 - RNA, 21 nt, Human
ggugacagagugagacucugu

SEQ ID NO: 1202506 - RNA, 22 nt, Human
ggucucacuauguugcccaggc

SEQ ID NO: 1202507 - RNA, 23 nt, Human
gguccuagaaauuccccacccug

SEQ ID NO: 1202508 - RNA, 22 nt, Human
ggucccugguggcagcucaccu

SEQ ID NO: 1202509 - RNA, 14 nt, Human
ggucccugguggca

SEQ ID NO: 1202510 - RNA, 18 nt, Human
ggugaagugaagacaaug

SEQ ID NO: 1202511 - RNA, 16 nt, Human
ggugaacuugguuccc

SEQ ID NO: 1202512 - RNA, 19 nt, Human
ggucugaggaauccagacc

SEQ ID NO: 1202513 - RNA, 16 nt, Human
ggucucacucugucgc

SEQ ID NO: 1202514 - RNA, 12 nt, Human
ggucucacucug

SEQ ID NO: 1202515 - RNA, 16 nt, Human
ggucugacccacugcu

SEQ ID NO: 1202516 - RNA, 15 nt, Human
ggucugacccacugc

SEQ ID NO: 1202517 - RNA, 20 nt, Human
guaaaugggggugcauuuga

SEQ ID NO: 1202518 - RNA, 19 nt, Human
guaaaugggggugcauuug

SEQ ID NO: 1202519 - RNA, 18 nt, Human
guaaaugggggugcauuu

SEQ ID NO: 1202520 - RNA, 22 nt, Human
guaaauuaacuuuuauaaacuu

SEQ ID NO: 1202521 - RNA, 21 nt, Human
guaaauuaacuuuuauaaacu

SEQ ID NO: 1202522 - RNA, 17 nt, Human
guaaauuaacuuuuaua

SEQ ID NO: 1202523 - RNA, 16 nt, Human
guaaauuaacuuuuau

SEQ ID NO: 1202524 - RNA, 15 nt, Human
guaaauuaacuuuua

SEQ ID NO: 1202525 - RNA, 22 nt, Human
guaaguauucuuauuuaaugaa

SEQ ID NO: 1202526 - RNA, 13 nt, Human
guaaggaaugauu

SEQ ID NO: 1202527 - RNA, 23 nt, Human
guaaggaauaccugucccccuga

SEQ ID NO: 1202528 - RNA, 21 nt, Human
guaaggaauaccugucccccu

SEQ ID NO: 1202529 - RNA, 20 nt, Human
guaaggaauaccuguccccc

SEQ ID NO: 1202530 - RNA, 18 nt, Human
guaaggaauaccuguccc

SEQ ID NO: 1202531 - RNA, 23 nt, Human
guaaauuaacuuuuauaaacuuu

SEQ ID NO: 1202532 - RNA, 15 nt, Human
gguuuucuguucuuu

SEQ ID NO: 1202533 - RNA, 13 nt, Human
gguuuucuguucu

SEQ ID NO: 1202534 - RNA, 12 nt, Human
gguuuucuguuc

SEQ ID NO: 1202535 - RNA, 23 nt, Human
gguuuugccauguuggccaggcu

SEQ ID NO: 1202536 - RNA, 13 nt, Human
gguuuaagcuguu

SEQ ID NO: 1202537 - RNA, 13 nt, Human
gguuggugggggc

SEQ ID NO: 1202538 - RNA, 14 nt, Human
gguugggcuggugu

SEQ ID NO: 1202539 - RNA, 18 nt, Human
gguuggcaaaaaggcagg

SEQ ID NO: 1202540 - RNA, 23 nt, Human
gguucaagcgauucuucugcuuc

SEQ ID NO: 1202541 - RNA, 22 nt, Human
gguucaagcgauucuucugcuu

SEQ ID NO: 1202542 - RNA, 12 nt, Human
gguucagcuugu

SEQ ID NO: 1202543 - RNA, 14 nt, Human
gguugaagcaccaa

SEQ ID NO: 1202544 - RNA, 21 nt, Human
gguucaagcgauucuucugcu

SEQ ID NO: 1202545 - RNA, 17 nt, Human
gguggccucccaacuca

SEQ ID NO: 1202546 - RNA, 13 nt, Human
gguggccucccaa

SEQ ID NO: 1202547 - RNA, 18 nt, Human
guacacuguuucaaacuu

SEQ ID NO: 1202548 - RNA, 21 nt, Human
guaauuaaguacuauguauca

SEQ ID NO: 1202549 - RNA, 20 nt, Human
guaauuaaguacuauguauc

SEQ ID NO: 1202550 - RNA, 17 nt, Human
guaauuaaguacuaugu

SEQ ID NO: 1202551 - RNA, 14 nt, Human
guaauuaaguacua

SEQ ID NO: 1202552 - RNA, 20 nt, Human
guacagcaaggagauuuaca

SEQ ID NO: 1202553 - RNA, 22 nt, Human
guacagagcccacgcccccacu

SEQ ID NO: 1202554 - RNA, 18 nt, Human
guacagagcccacgcccc

SEQ ID NO: 1202555 - RNA, 12 nt, Human
guacagagccca

SEQ ID NO: 1202556 - RNA, 16 nt, Human
guacagacaacaaacc

SEQ ID NO: 1202557 - RNA, 21 nt, Human
guacacuguuucaaacuuuac

SEQ ID NO: 1202558 - RNA, 20 nt, Human
guacacuguuucaaacuuua

SEQ ID NO: 1202559 - RNA, 19 nt, Human
guacacuguuucaaacuuu

SEQ ID NO: 1202560 - RNA, 20 nt, Human
guacauaaugcgugcauacc

SEQ ID NO: 1202561 - RNA, 15 nt, Human
guacccacugcucug

SEQ ID NO: 1202562 - RNA, 15 nt, Human
guacuucuccacccu

SEQ ID NO: 1202563 - RNA, 14 nt, Human
guacuucuccaccc

SEQ ID NO: 1202564 - RNA, 17 nt, Human
guacuacaguccuccca

SEQ ID NO: 1202565 - RNA, 23 nt, Human
guacuaaggaaucuuucugcuuu

SEQ ID NO: 1202566 - RNA, 15 nt, Human
guacuaaggaaucuu

SEQ ID NO: 1202567 - RNA, 17 nt, Human
guacguugugcauuugg

SEQ ID NO: 1202568 - RNA, 16 nt, Human
guacguugugcauuug

SEQ ID NO: 1202569 - RNA, 15 nt, Human
guacguugugcauuu

SEQ ID NO: 1202570 - RNA, 14 nt, Human
guacguugugcauu

SEQ ID NO: 1202571 - RNA, 17 nt, Human
guacgucugacaggcaa

SEQ ID NO: 1202572 - RNA, 15 nt, Human
guacgucugacaggc

SEQ ID NO: 1202573 - RNA, 14 nt, Human
guacgucugacagg

SEQ ID NO: 1202574 - RNA, 22 nt, Human
guaccucuugagccuugaacuu

SEQ ID NO: 1202575 - RNA, 21 nt, Human
guaccucuugagccuugaacu

SEQ ID NO: 1202576 - RNA, 13 nt, Human
guaccucuugagc

SEQ ID NO: 1202577 - RNA, 16 nt, Human
guacccacugcucugg

SEQ ID NO: 1202578 - RNA, 20 nt, Human
guacuuguggacacagcucu

SEQ ID NO: 1202579 - RNA, 16 nt, Human
guacuuguggacacag

SEQ ID NO: 1202580 - RNA, 21 nt, Human
guacuucuccacccugcucuc

SEQ ID NO: 1202581 - RNA, 20 nt, Human
guacuucuccacccugcucu

SEQ ID NO: 1202582 - RNA, 19 nt, Human
guacuucuccacccugcuc

SEQ ID NO: 1202583 - RNA, 18 nt, Human
guacuucuccacccugcu

SEQ ID NO: 1202584 - RNA, 17 nt, Human
guacuucuccacccugc

SEQ ID NO: 1202585 - RNA, 16 nt, Human
guacuucuccacccug

SEQ ID NO: 1202586 - RNA, 16 nt, Human
guagagcggagaaagg

SEQ ID NO: 1202587 - RNA, 21 nt, Human
guacuuguggacacagcucuu

SEQ ID NO: 1202588 - RNA, 15 nt, Human
ggcgcgguggcucac

SEQ ID NO: 1202589 - RNA, 23 nt, Human
ggcgcugccccuggcagccccug

SEQ ID NO: 1202590 - RNA, 21 nt, Human
ggcgcugccccuggcagcccc

SEQ ID NO: 1202591 - RNA, 19 nt, Human
ggcgcugccccuggcagcc

SEQ ID NO: 1202592 - RNA, 14 nt, Human
ggccugggggcugg

SEQ ID NO: 1202593 - RNA, 22 nt, Human
ggccugggggcugggcagagga

SEQ ID NO: 1202594 - RNA, 20 nt, Human
ggccugggggcugggcagag

SEQ ID NO: 1202595 - RNA, 15 nt, Human
ggcuaugcauuugaa

SEQ ID NO: 1202596 - RNA, 16 nt, Human
ggcuaguugggcuucc

SEQ ID NO: 1202597 - RNA, 15 nt, Human
ggcuaguugggcuuc

SEQ ID NO: 1202598 - RNA, 23 nt, Human
ggcuagugugguguuuccuggca

SEQ ID NO: 1202599 - RNA, 22 nt, Human
ggcuaggaccccuccauguggg

SEQ ID NO: 1202600 - RNA, 16 nt, Human
ggcuaggaccccucca

SEQ ID NO: 1202601 - RNA, 22 nt, Human
ggcuagagguucaaagauauuu

SEQ ID NO: 1202602 - RNA, 17 nt, Human
ggcuagagguucaaaga

SEQ ID NO: 1202603 - RNA, 11 nt, Human
ggcuccaggcu

SEQ ID NO: 1202604 - RNA, 16 nt, Human
ggcuccaggcuccuuu

SEQ ID NO: 1202605 - RNA, 21 nt, Human
ggcucaaguccucuuuucuga

SEQ ID NO: 1202606 - RNA, 15 nt, Human
ggcucaaguccucuu

SEQ ID NO: 1202607 - RNA, 19 nt, Human
ggcuccaggagcagccaca

SEQ ID NO: 1202608 - RNA, 13 nt, Human
ggcuccaggagca

SEQ ID NO: 1202609 - RNA, 12 nt, Human
ggcuccaggagc

SEQ ID NO: 1202610 - RNA, 18 nt, Human
ggccucuuaugggcuggg

SEQ ID NO: 1202611 - RNA, 17 nt, Human
ggccucuuaugggcugg

SEQ ID NO: 1202612 - RNA, 20 nt, Human
ggccucgguguggagaagcg

SEQ ID NO: 1202613 - RNA, 16 nt, Human
ggccucugcacucccc

SEQ ID NO: 1202614 - RNA, 15 nt, Human
ggccucugcacuccc

SEQ ID NO: 1202615 - RNA, 14 nt, Human
ggccucugcacucc

SEQ ID NO: 1202616 - RNA, 13 nt, Human
ggccucugcacuc

SEQ ID NO: 1202617 - RNA, 21 nt, Human
ggcccucugcccacucccugc

SEQ ID NO: 1202618 - RNA, 20 nt, Human
ggcccucugcccacucccug

SEQ ID NO: 1202619 - RNA, 19 nt, Human
ggcccucugcccacucccu

SEQ ID NO: 1202620 - RNA, 17 nt, Human
ggcccucugcccacucc

SEQ ID NO: 1202621 - RNA, 16 nt, Human
ggcccucugcccacuc

SEQ ID NO: 1202622 - RNA, 15 nt, Human
ggcccucugcccacu

SEQ ID NO: 1202623 - RNA, 13 nt, Human
ggcccucugccca

SEQ ID NO: 1202624 - RNA, 12 nt, Human
ggcccagagagg

SEQ ID NO: 1202625 - RNA, 11 nt, Human
ggcccagagag

SEQ ID NO: 1202626 - RNA, 15 nt, Human
ggcccugccuccuuu

SEQ ID NO: 1202627 - RNA, 14 nt, Human
ggcccugccuccuu

SEQ ID NO: 1202628 - RNA, 13 nt, Human
ggcccugccuccu

SEQ ID NO: 1202629 - RNA, 19 nt, Human
ggauuacaagcgugagcca

SEQ ID NO: 1202630 - RNA, 15 nt, Human
ggaugcuuguacaua

SEQ ID NO: 1202631 - RNA, 19 nt, Human
ggaugcagccucacagucc

SEQ ID NO: 1202632 - RNA, 17 nt, Human
ggaugcagccucacagu

SEQ ID NO: 1202633 - RNA, 16 nt, Human
ggaugcagccucacag

SEQ ID NO: 1202634 - RNA, 23 nt, Human
ggaugcacagaguuguuacauuu

SEQ ID NO: 1202635 - RNA, 21 nt, Human
ggaugauuggaggggggaggu

SEQ ID NO: 1202636 - RNA, 14 nt, Human
ggauccuccaggug

SEQ ID NO: 1202637 - RNA, 13 nt, Human
ggauccuccaggu

SEQ ID NO: 1202638 - RNA, 12 nt, Human
ggauccuccagg

SEQ ID NO: 1202639 - RNA, 15 nt, Human
ggagugcagugagcc

SEQ ID NO: 1202640 - RNA, 14 nt, Human
ggagugcagugagc

SEQ ID NO: 1202641 - RNA, 12 nt, Human
ggagugcaguga

SEQ ID NO: 1202642 - RNA, 18 nt, Human
ggauacaaaagcauguga

SEQ ID NO: 1202643 - RNA, 22 nt, Human
ggaucccucauccucauaccca

SEQ ID NO: 1202644 - RNA, 17 nt, Human
ggaucccucauccucau

SEQ ID NO: 1202645 - RNA, 13 nt, Human
ggaucccucaucc

SEQ ID NO: 1202646 - RNA, 17 nt, Human
ggauugcuacuguccua

SEQ ID NO: 1202647 - RNA, 17 nt, Human
ggcaacccccagccugc

SEQ ID NO: 1202648 - RNA, 16 nt, Human
ggcaacccccagccug

SEQ ID NO: 1202649 - RNA, 16 nt, Human
ggauucuuccucccuc

SEQ ID NO: 1202650 - RNA, 16 nt, Human
ggauucuuauggacaa

SEQ ID NO: 1202651 - RNA, 23 nt, Human
ggauuacaagcgugagccacugc

SEQ ID NO: 1202652 - RNA, 23 nt, Human
ggcaaugcuggcuguuggcuggg

SEQ ID NO: 1202653 - RNA, 15 nt, Human
ggcaaugcuggcugu

SEQ ID NO: 1202654 - RNA, 14 nt, Human
ggcaaugcuggcug

SEQ ID NO: 1202655 - RNA, 19 nt, Human
ggcaacccccagccugcua

SEQ ID NO: 1202656 - RNA, 18 nt, Human
ggcaacccccagccugcu

SEQ ID NO: 1202657 - RNA, 23 nt, Human
ggcacccaccaucaugucuggcu

SEQ ID NO: 1202658 - RNA, 22 nt, Human
ggcacccggccccugcugguuc

SEQ ID NO: 1202659 - RNA, 18 nt, Human
ggccaggcccucugccca

SEQ ID NO: 1202660 - RNA, 23 nt, Human
ggccagcugcuugggcuucaucc

SEQ ID NO: 1202661 - RNA, 17 nt, Human
ggccagcugcuugggcu

SEQ ID NO: 1202662 - RNA, 22 nt, Human
ggccagccuugaccauucucca

SEQ ID NO: 1202663 - RNA, 20 nt, Human
ggccagccuugaccauucuc

SEQ ID NO: 1202664 - RNA, 19 nt, Human
ggcauuccccaggaggcca

SEQ ID NO: 1202665 - RNA, 18 nt, Human
ggcauuccccaggaggcc

SEQ ID NO: 1202666 - RNA, 17 nt, Human
ggcauuccccaggaggc

SEQ ID NO: 1202667 - RNA, 22 nt, Human
ggcaugggaaugaaugucagug

SEQ ID NO: 1202668 - RNA, 18 nt, Human
ggcaugggaaugaauguc

SEQ ID NO: 1202669 - RNA, 21 nt, Human
ggcagcucagagaggguggga

SEQ ID NO: 1202670 - RNA, 16 nt, Human
ggcagcucaccucucc

SEQ ID NO: 1202671 - RNA, 17 nt, Human
ggcagcuugaggguugg

SEQ ID NO: 1202672 - RNA, 14 nt, Human
ggcagcucaccucu

SEQ ID NO: 1202673 - RNA, 12 nt, Human
ggcagcucaccu

SEQ ID NO: 1202674 - RNA, 16 nt, Human
ggcagugggagcugcc

SEQ ID NO: 1202675 - RNA, 14 nt, Human
ggcagugggagcug

SEQ ID NO: 1202676 - RNA, 13 nt, Human
ggcagugggagcu

SEQ ID NO: 1202677 - RNA, 20 nt, Human
ggcagggucucacucugucg

SEQ ID NO: 1202678 - RNA, 19 nt, Human
ggcagggucucacucuguc

SEQ ID NO: 1202679 - RNA, 22 nt, Human
ggcaugacacgaauauugcuga

SEQ ID NO: 1202680 - RNA, 18 nt, Human
ggcaugacacgaauauug

SEQ ID NO: 1202681 - RNA, 15 nt, Human
ggcaugaagacagau

SEQ ID NO: 1202682 - RNA, 18 nt, Human
ggagaagcggcuggcagc

SEQ ID NO: 1202683 - RNA, 17 nt, Human
ggagaagcggcuggcag

SEQ ID NO: 1202684 - RNA, 20 nt, Human
ggacgcuacccgggaagggg

SEQ ID NO: 1202685 - RNA, 19 nt, Human
ggacgcuacccgggaaggg

SEQ ID NO: 1202686 - RNA, 17 nt, Human
ggacgcuacccgggaag

SEQ ID NO: 1202687 - RNA, 17 nt, Human
ggaccuugaacugggua

SEQ ID NO: 1202688 - RNA, 15 nt, Human
ggaccuugaacuggg

SEQ ID NO: 1202689 - RNA, 23 nt, Human
ggaccucaggugagaagcagagg

SEQ ID NO: 1202690 - RNA, 19 nt, Human
ggaccucaggugagaagca

SEQ ID NO: 1202691 - RNA, 14 nt, Human
ggaccagagcugcc

SEQ ID NO: 1202692 - RNA, 13 nt, Human
ggaccagagcugc

SEQ ID NO: 1202693 - RNA, 20 nt, Human
ggacauugcggacagccacg

SEQ ID NO: 1202694 - RNA, 22 nt, Human
ggacagccacggccaggccaga

SEQ ID NO: 1202695 - RNA, 21 nt, Human
ggacagccacggccaggccag

SEQ ID NO: 1202696 - RNA, 20 nt, Human
ggacagccacggccaggcca

SEQ ID NO: 1202697 - RNA, 19 nt, Human
ggacagccacggccaggcc

SEQ ID NO: 1202698 - RNA, 15 nt, Human
ggacagccacggcca

SEQ ID NO: 1202699 - RNA, 22 nt, Human
ggacacucaaaagcugggcagg

SEQ ID NO: 1202700 - RNA, 17 nt, Human
ggacacucaaaagcugg

SEQ ID NO: 1202701 - RNA, 23 nt, Human
ggaaggggagauaaggguaucug

SEQ ID NO: 1202702 - RNA, 18 nt, Human
ggaaguacuggagaaaau

SEQ ID NO: 1202703 - RNA, 16 nt, Human
ggaaguacuggagaaa

SEQ ID NO: 1202704 - RNA, 12 nt, Human
ggaaguacugga

SEQ ID NO: 1202705 - RNA, 19 nt, Human
ggaauguuugccucugccu

SEQ ID NO: 1202706 - RNA, 12 nt, Human
ggaaugcagugg

SEQ ID NO: 1202707 - RNA, 24 nt, Human
ggaaugauuaauuaaaacacaaca

SEQ ID NO: 1202708 - RNA, 15 nt, Human
gcuuugugauuuuug

SEQ ID NO: 1202709 - RNA, 22 nt, Human
gcuugaggguugggcugguguc

SEQ ID NO: 1202710 - RNA, 20 nt, Human
gcuugaggguugggcuggug

SEQ ID NO: 1202711 - RNA, 18 nt, Human
gcuugaggguugggcugg

SEQ ID NO: 1202712 - RNA, 14 nt, Human
ggaaaagcugcuga

SEQ ID NO: 1202713 - RNA, 20 nt, Human
ggaaaagcugcugacagugu

SEQ ID NO: 1202714 - RNA, 18 nt, Human
ggaaaagcugcugacagu

SEQ ID NO: 1202715 - RNA, 18 nt, Human
ggaaaacaugcuacacac

SEQ ID NO: 1202716 - RNA, 21 nt, Human
gcuuuguuuguugucagcuga

SEQ ID NO: 1202717 - RNA, 23 nt, Human
ggaaaucaccgaaaacguggcug

SEQ ID NO: 1202718 - RNA, 16 nt, Human
ggaacaggaaacugau

SEQ ID NO: 1202719 - RNA, 21 nt, Human
ggaaaucaccgaaaacguggc

SEQ ID NO: 1202720 - RNA, 14 nt, Human
ggaaaucaccgaaa

SEQ ID NO: 1202721 - RNA, 22 nt, Human
ggaaaggcuccaggagcagcca

SEQ ID NO: 1202722 - RNA, 21 nt, Human
ggaaaggcuccaggagcagcc

SEQ ID NO: 1202723 - RNA, 20 nt, Human
ggaaaggcuccaggagcagc

SEQ ID NO: 1202724 - RNA, 19 nt, Human
ggaaaggcuccaggagcag

SEQ ID NO: 1202725 - RNA, 17 nt, Human
ggaaaggcuccaggagc

SEQ ID NO: 1202726 - RNA, 14 nt, Human
ggaaaggcuccagg

SEQ ID NO: 1202727 - RNA, 13 nt, Human
ggaaaggcuccag

SEQ ID NO: 1202728 - RNA, 12 nt, Human
ggaaaggcucca

SEQ ID NO: 1202729 - RNA, 23 nt, Human
ggaaaaucagccugcuccagcug

SEQ ID NO: 1202730 - RNA, 19 nt, Human
ggaaaaucagccugcucca

SEQ ID NO: 1202731 - RNA, 14 nt, Human
gcuguucagcuggu

SEQ ID NO: 1202732 - RNA, 17 nt, Human
gcugucuccauguuuga

SEQ ID NO: 1202733 - RNA, 20 nt, Human
gcugccaaugggagcucaug

SEQ ID NO: 1202734 - RNA, 19 nt, Human
gcugccaaugggagcucau

SEQ ID NO: 1202735 - RNA, 16 nt, Human
gcugccaaugggagcu

SEQ ID NO: 1202736 - RNA, 15 nt, Human
gcugccaaugggagc

SEQ ID NO: 1202737 - RNA, 21 nt, Human
gcuuagucacugagacagccc

SEQ ID NO: 1202738 - RNA, 20 nt, Human
gcuuagucacugagacagcc

SEQ ID NO: 1202739 - RNA, 19 nt, Human
gcuuagucacugagacagc

SEQ ID NO: 1202740 - RNA, 17 nt, Human
gcuuagucacugagaca

SEQ ID NO: 1202741 - RNA, 15 nt, Human
gcuuagucacugaga

SEQ ID NO: 1202742 - RNA, 18 nt, Human
gcuucaguggcagcugcu

SEQ ID NO: 1202743 - RNA, 17 nt, Human
gcuucaguggcagcugc

SEQ ID NO: 1202744 - RNA, 16 nt, Human
gcuucauuuccugugu

SEQ ID NO: 1202745 - RNA, 13 nt, Human
gcuucauuuccug

SEQ ID NO: 1202746 - RNA, 15 nt, Human
gcuucauccuccuca

SEQ ID NO: 1202747 - RNA, 12 nt, Human
gcuucauccucc

SEQ ID NO: 1202748 - RNA, 16 nt, Human
gcuucaguggcagcug

SEQ ID NO: 1202749 - RNA, 19 nt, Human
gcuuaucucaggggugugc

SEQ ID NO: 1202750 - RNA, 20 nt, Human
gcuuauacacuuacacuuua

SEQ ID NO: 1202751 - RNA, 12 nt, Human
gcuuauacacuu

SEQ ID NO: 1202752 - RNA, 18 nt, Human
gcuuccagugaggcucug

SEQ ID NO: 1202753 - RNA, 16 nt, Human
gcuuccagugaggcuc

SEQ ID NO: 1202754 - RNA, 15 nt, Human
gcuuccagugaggcu

SEQ ID NO: 1202755 - RNA, 18 nt, Human
gcuucauuuccugugucu

SEQ ID NO: 1202756 - RNA, 21 nt, Human
gcuucauccuccucagaucuu

SEQ ID NO: 1202757 - RNA, 17 nt, Human
gcuucauuuccuguguc

SEQ ID NO: 1202758 - RNA, 16 nt, Human
gcuugaggguugggcu

SEQ ID NO: 1202759 - RNA, 14 nt, Human
gcucaccucucccu

SEQ ID NO: 1202760 - RNA, 19 nt, Human
gcucaccagccccagugcc

SEQ ID NO: 1202761 - RNA, 23 nt, Human
gcucaccagccccagugcccaca

SEQ ID NO: 1202762 - RNA, 20 nt, Human
gcucaccagccccagugccc

SEQ ID NO: 1202763 - RNA, 23 nt, Human
gcucagcaaaagaugcuucucac

SEQ ID NO: 1202764 - RNA, 22 nt, Human
gcucagcaaaagaugcuucuca

SEQ ID NO: 1202765 - RNA, 20 nt, Human
gcucagcaaaagaugcuucu

SEQ ID NO: 1202766 - RNA, 17 nt, Human
gcucagcaaaagaugcu

SEQ ID NO: 1202767 - RNA, 19 nt, Human
gcucaggugucccugcacu

SEQ ID NO: 1202768 - RNA, 18 nt, Human
gcucaggugucccugcac

SEQ ID NO: 1202769 - RNA, 22 nt, Human
gcucagcggggacagcuccuuc

SEQ ID NO: 1202770 - RNA, 21 nt, Human
gcucagcggggacagcuccuu

SEQ ID NO: 1202771 - RNA, 20 nt, Human
gcucagcggggacagcuccu

SEQ ID NO: 1202772 - RNA, 16 nt, Human
gcucagcggggacagc

SEQ ID NO: 1202773 - RNA, 15 nt, Human
gcucagcggggacag

SEQ ID NO: 1202774 - RNA, 15 nt, Human
gcuccaagcucccag

SEQ ID NO: 1202775 - RNA, 14 nt, Human
gcuccaagcuccca

SEQ ID NO: 1202776 - RNA, 13 nt, Human
gcuccaagcuccc

SEQ ID NO: 1202777 - RNA, 19 nt, Human
gcuccaagcucccaggcau

SEQ ID NO: 1202778 - RNA, 18 nt, Human
gcuccaagcucccaggca

SEQ ID NO: 1202779 - RNA, 17 nt, Human
gcuccaagcucccaggc

SEQ ID NO: 1202780 - RNA, 16 nt, Human
gcuccaagcucccagg

SEQ ID NO: 1202781 - RNA, 21 nt, Human
gcuccaagcucccaggcauuc

SEQ ID NO: 1202782 - RNA, 23 nt, Human
gcuccaggcuccuuuagcgccca

SEQ ID NO: 1202783 - RNA, 16 nt, Human
gcuccaggcuccuuua

SEQ ID NO: 1202784 - RNA, 11 nt, Human
gcuccagcugu

SEQ ID NO: 1202785 - RNA, 24 nt, Human
gcuccaggcuccuuuagcgcccag

SEQ ID NO: 1202786 - RNA, 20 nt, Human
gcuccagcuguucagcuggu

SEQ ID NO: 1202787 - RNA, 23 nt, Human
gcuaucucccccagccccauccu

SEQ ID NO: 1202788 - RNA, 22 nt, Human
gcuaucucccccagccccaucc

SEQ ID NO: 1202789 - RNA, 21 nt, Human
gcuaucucccccagccccauc

SEQ ID NO: 1202790 - RNA, 20 nt, Human
gcuaucucccccagccccau

SEQ ID NO: 1202791 - RNA, 19 nt, Human
gcuaucucccccagcccca

SEQ ID NO: 1202792 - RNA, 18 nt, Human
gcuaucucccccagcccc

SEQ ID NO: 1202793 - RNA, 17 nt, Human
gcuaucucccccagccc

SEQ ID NO: 1202794 - RNA, 16 nt, Human
gcuaucucccccagcc

SEQ ID NO: 1202795 - RNA, 21 nt, Human
gcuagagguucaaagauauuu

SEQ ID NO: 1202796 - RNA, 19 nt, Human
gcuagagguucaaagauau

SEQ ID NO: 1202797 - RNA, 18 nt, Human
gcuagagguucaaagaua

SEQ ID NO: 1202798 - RNA, 21 nt, Human
gcuacccgggaagggggcugg

SEQ ID NO: 1202799 - RNA, 15 nt, Human
gcuacccgggaaggg

SEQ ID NO: 1202800 - RNA, 14 nt, Human
gcuacccgggaagg

SEQ ID NO: 1202801 - RNA, 23 nt, Human
gcuaagagggagggagggcucca

SEQ ID NO: 1202802 - RNA, 22 nt, Human
gcuaagagggagggagggcucc

SEQ ID NO: 1202803 - RNA, 14 nt, Human
gcuaacauggaagu

SEQ ID NO: 1202804 - RNA, 16 nt, Human
gcuaaaugugaaugau

SEQ ID NO: 1202805 - RNA, 13 nt, Human
gcuaaaugugaau

SEQ ID NO: 1202806 - RNA, 23 nt, Human
gcgugagccacugcaccgggcca

SEQ ID NO: 1202807 - RNA, 18 nt, Human
gcgugagccacugcaccg

SEQ ID NO: 1202808 - RNA, 20 nt, Human
gcgguccacccaggagcccc

SEQ ID NO: 1202809 - RNA, 19 nt, Human
gcgguccacccaggagccc

SEQ ID NO: 1202810 - RNA, 18 nt, Human
gcgguccacccaggagcc

SEQ ID NO: 1202811 - RNA, 16 nt, Human
gcgguccacccaggag

SEQ ID NO: 1202812 - RNA, 13 nt, Human
gcggggacagcuc

SEQ ID NO: 1202813 - RNA, 12 nt, Human
gcggggacagcu

SEQ ID NO: 1202814 - RNA, 15 nt, Human
gcgggcuuccuccug

SEQ ID NO: 1202815 - RNA, 17 nt, Human
gcugcauuuaaaagaua

SEQ ID NO: 1202816 - RNA, 21 nt, Human
gcugcaguugccagucacccc

SEQ ID NO: 1202817 - RNA, 20 nt, Human
gcugcaguugccagucaccc

SEQ ID NO: 1202818 - RNA, 18 nt, Human
gcugcaguugccagucac

SEQ ID NO: 1202819 - RNA, 21 nt, Human
gcugauggugcaaugaccuuu

SEQ ID NO: 1202820 - RNA, 18 nt, Human
gcugauggugcaaugacc

SEQ ID NO: 1202821 - RNA, 16 nt, Human
gcugauggugcaauga

SEQ ID NO: 1202822 - RNA, 15 nt, Human
gcugauggugcaaug

SEQ ID NO: 1202823 - RNA, 23 nt, Human
gcugagugggggaucacagccuc

SEQ ID NO: 1202824 - RNA, 22 nt, Human
gcugagugggggaucacagccu

SEQ ID NO: 1202825 - RNA, 19 nt, Human
gcugagucugaaggcuggg

SEQ ID NO: 1202826 - RNA, 18 nt, Human
gcugagucugaaggcugg

SEQ ID NO: 1202827 - RNA, 16 nt, Human
gcugagucugaaggcu

SEQ ID NO: 1202828 - RNA, 15 nt, Human
gcugagucugaaggc

SEQ ID NO: 1202829 - RNA, 21 nt, Human
gcugacagacacaggcccggc

SEQ ID NO: 1202830 - RNA, 12 nt, Human
gcucuucuccag

SEQ ID NO: 1202831 - RNA, 22 nt, Human
gcucuuccaggcugggagagcc

SEQ ID NO: 1202832 - RNA, 19 nt, Human
gcucuuccaggcugggaga

SEQ ID NO: 1202833 - RNA, 16 nt, Human
gcucuucuccaggcug

SEQ ID NO: 1202834 - RNA, 14 nt, Human
gcucuucuccaggc

SEQ ID NO: 1202835 - RNA, 22 nt, Human
gcucuggacaggcauguucucu

SEQ ID NO: 1202836 - RNA, 21 nt, Human
gcucuggacaggcauguucuc

SEQ ID NO: 1202837 - RNA, 16 nt, Human
gcucuggacaggcaug

SEQ ID NO: 1202838 - RNA, 15 nt, Human
gcucuggacaggcau

SEQ ID NO: 1202839 - RNA, 14 nt, Human
gcucuggacaggca

SEQ ID NO: 1202840 - RNA, 23 nt, Human
gcucugcugacagacacaggccc

SEQ ID NO: 1202841 - RNA, 20 nt, Human
gcucugcugacagacacagg

SEQ ID NO: 1202842 - RNA, 19 nt, Human
gcucugcugacagacacag

SEQ ID NO: 1202843 - RNA, 18 nt, Human
gcucugcugacagacaca

SEQ ID NO: 1202844 - RNA, 14 nt, Human
gcucugcugacaga

SEQ ID NO: 1202845 - RNA, 13 nt, Human
gcucugcugacag

SEQ ID NO: 1202846 - RNA, 21 nt, Human
gcucugcuccucuccccagca

SEQ ID NO: 1202847 - RNA, 19 nt, Human
gcucugcuccucuccccag

SEQ ID NO: 1202848 - RNA, 14 nt, Human
gcucugcuccucuc

SEQ ID NO: 1202849 - RNA, 13 nt, Human
gcucugcuccucu

SEQ ID NO: 1202850 - RNA, 22 nt, Human
gcucugccucccaucacccgcu

SEQ ID NO: 1202851 - RNA, 15 nt, Human
gcucugccucccauc

SEQ ID NO: 1202852 - RNA, 14 nt, Human
gcucugccucccau

SEQ ID NO: 1202853 - RNA, 13 nt, Human
gcucugccuccca

SEQ ID NO: 1202854 - RNA, 11 nt, Human
gcucugccucc

SEQ ID NO: 1202855 - RNA, 23 nt, Human
gcucugcccuugguuaggcauug

SEQ ID NO: 1202856 - RNA, 14 nt, Human
gcucugcccuuggu

SEQ ID NO: 1202857 - RNA, 17 nt, Human
gcucgagcaugccugga

SEQ ID NO: 1202858 - RNA, 16 nt, Human
gcucgagcaugccugg

SEQ ID NO: 1202859 - RNA, 21 nt, Human
gcuccuucuguccuacucugu

SEQ ID NO: 1202860 - RNA, 19 nt, Human
gcucccuucccaccucucu

SEQ ID NO: 1202861 - RNA, 18 nt, Human
gcucccuucccaccucuc

SEQ ID NO: 1202862 - RNA, 16 nt, Human
gcucccuucccaccuc

SEQ ID NO: 1202863 - RNA, 15 nt, Human
gcucccuucccaccu

SEQ ID NO: 1202864 - RNA, 17 nt, Human
gcucuccgaccagacac

SEQ ID NO: 1202865 - RNA, 13 nt, Human
gcucuccgaccag

SEQ ID NO: 1202866 - RNA, 19 nt, Human
gcucuccgaccagacaccu

SEQ ID NO: 1202867 - RNA, 22 nt, Human
gccugaagucacacagugaguc

SEQ ID NO: 1202868 - RNA, 15 nt, Human
gccugcuccagcugu

SEQ ID NO: 1202869 - RNA, 18 nt, Human
gccugcuccagcuguuca

SEQ ID NO: 1202870 - RNA, 16 nt, Human
gccugcuccagcuguu

SEQ ID NO: 1202871 - RNA, 16 nt, Human
gccuggccagaugcac

SEQ ID NO: 1202872 - RNA, 15 nt, Human
gccuggccagaugca

SEQ ID NO: 1202873 - RNA, 14 nt, Human
gccuggccagaugc

SEQ ID NO: 1202874 - RNA, 15 nt, Human
gccugggcagaagga

SEQ ID NO: 1202875 - RNA, 15 nt, Human
gccuggauggggcug

SEQ ID NO: 1202876 - RNA, 14 nt, Human
gccuggauggggcu

SEQ ID NO: 1202877 - RNA, 21 nt, Human
gccugggggcugggcagagga

SEQ ID NO: 1202878 - RNA, 20 nt, Human
gccugggggcugggcagagg

SEQ ID NO: 1202879 - RNA, 18 nt, Human
gccugggcagaaggaaga

SEQ ID NO: 1202880 - RNA, 17 nt, Human
gccugggcagaaggaag

SEQ ID NO: 1202881 - RNA, 16 nt, Human
gccugggcagaaggaa

SEQ ID NO: 1202882 - RNA, 21 nt, Human
gccucccacgacugcccggca

SEQ ID NO: 1202883 - RNA, 14 nt, Human
gccucccacgacug

SEQ ID NO: 1202884 - RNA, 23 nt, Human
gccucccaacucaccccagcccc

SEQ ID NO: 1202885 - RNA, 22 nt, Human
gccucccaacucaccccagccc

SEQ ID NO: 1202886 - RNA, 15 nt, Human
gccucagugccacua

SEQ ID NO: 1202887 - RNA, 15 nt, Human
gccucccgaguagcu

SEQ ID NO: 1202888 - RNA, 23 nt, Human
gccucccgaauagcugggacuac

SEQ ID NO: 1202889 - RNA, 17 nt, Human
gccucccgaguagcugg

SEQ ID NO: 1202890 - RNA, 14 nt, Human
gccucagugccacu

SEQ ID NO: 1202891 - RNA, 12 nt, Human
gccucagugcca

SEQ ID NO: 1202892 - RNA, 22 nt, Human
gccucaagugauucuccugccu

SEQ ID NO: 1202893 - RNA, 23 nt, Human
gccucagccucccaaagugcugg

SEQ ID NO: 1202894 - RNA, 21 nt, Human
gccucaagugauucuccugcc

SEQ ID NO: 1202895 - RNA, 20 nt, Human
gccucaagugauucuccugc

SEQ ID NO: 1202896 - RNA, 19 nt, Human
gccucaagugauucuccug

SEQ ID NO: 1202897 - RNA, 17 nt, Human
gccucaaccuccugggc

SEQ ID NO: 1202898 - RNA, 16 nt, Human
gccucaaccuccuggg

SEQ ID NO: 1202899 - RNA, 14 nt, Human
gccucaaccuccug

SEQ ID NO: 1202900 - RNA, 23 nt, Human
gcccugguggcagugggagcugc

SEQ ID NO: 1202901 - RNA, 22 nt, Human
gcccugguggcagugggagcug

SEQ ID NO: 1202902 - RNA, 21 nt, Human
gcccugguggcagugggagcu

SEQ ID NO: 1202903 - RNA, 20 nt, Human
gcccugguggcagugggagc

SEQ ID NO: 1202904 - RNA, 19 nt, Human
gcccugguggcagugggag

SEQ ID NO: 1202905 - RNA, 18 nt, Human
gcccugguggcaguggga

SEQ ID NO: 1202906 - RNA, 17 nt, Human
gcccugguggcaguggg

SEQ ID NO: 1202907 - RNA, 14 nt, Human
gcccugguggcagu

SEQ ID NO: 1202908 - RNA, 18 nt, Human
gccgagauugcaccacug

SEQ ID NO: 1202909 - RNA, 19 nt, Human
gccgagaucacgccacugc

SEQ ID NO: 1202910 - RNA, 18 nt, Human
gccgagaucacgccacug

SEQ ID NO: 1202911 - RNA, 16 nt, Human
gccgagaucacgccac

SEQ ID NO: 1202912 - RNA, 22 nt, Human
gcccuucucuccagccccugga

SEQ ID NO: 1202913 - RNA, 21 nt, Human
gcccuucucuccagccccugg

SEQ ID NO: 1202914 - RNA, 23 nt, Human
gcccuucucuccagccccuggau

SEQ ID NO: 1202915 - RNA, 19 nt, Human
gcccuucucuccagccccu

SEQ ID NO: 1202916 - RNA, 16 nt, Human
gcccugagcuuucugc

SEQ ID NO: 1202917 - RNA, 12 nt, Human
gcccucugccca

SEQ ID NO: 1202918 - RNA, 18 nt, Human
gcccggcuccaggcuccu

SEQ ID NO: 1202919 - RNA, 17 nt, Human
gcccggcuccaggcucc

SEQ ID NO: 1202920 - RNA, 16 nt, Human
gcccggcuccaggcuc

SEQ ID NO: 1202921 - RNA, 12 nt, Human
gcccggcuccag

SEQ ID NO: 1202922 - RNA, 21 nt, Human
gccccuguucuggcagaguug

SEQ ID NO: 1202923 - RNA, 16 nt, Human
gccccugccacccugg

SEQ ID NO: 1202924 - RNA, 15 nt, Human
gccccugccacccug

SEQ ID NO: 1202925 - RNA, 14 nt, Human
gccccugccacccu

SEQ ID NO: 1202926 - RNA, 13 nt, Human
gccccugccaccc

SEQ ID NO: 1202927 - RNA, 17 nt, Human
gcagacucuacagaggc

SEQ ID NO: 1202928 - RNA, 15 nt, Human
gcagacucuacagag

SEQ ID NO: 1202929 - RNA, 19 nt, Human
gaugggugcuuggaggaag

SEQ ID NO: 1202930 - RNA, 19 nt, Human
gauggggcugcaccggcug

SEQ ID NO: 1202931 - RNA, 15 nt, Human
gauggggcugcaccg

SEQ ID NO: 1202932 - RNA, 13 nt, Human
gauggggcugcac

SEQ ID NO: 1202933 - RNA, 22 nt, Human
gaugggcaacccccagccugcu

SEQ ID NO: 1202934 - RNA, 21 nt, Human
gaugggcaacccccagccugc

SEQ ID NO: 1202935 - RNA, 20 nt, Human
gaugggcaacccccagccug

SEQ ID NO: 1202936 - RNA, 22 nt, Human
gauggccgggcgcgguggcuca

SEQ ID NO: 1202937 - RNA, 20 nt, Human
gaugcccaaagaugcagccg

SEQ ID NO: 1202938 - RNA, 19 nt, Human
gaugcccaaagaugcagcc

SEQ ID NO: 1202939 - RNA, 17 nt, Human
gauggugcaaugaccuu

SEQ ID NO: 1202940 - RNA, 16 nt, Human
gauggugcaaugaccu

SEQ ID NO: 1202941 - RNA, 15 nt, Human
gauggugcaaugacc

SEQ ID NO: 1202942 - RNA, 14 nt, Human
gauggugcaaugac

SEQ ID NO: 1202943 - RNA, 12 nt, Human
gauggugcaaug

SEQ ID NO: 1202944 - RNA, 22 nt, Human
gauuacaagcgugagccacugc

SEQ ID NO: 1202945 - RNA, 15 nt, Human
gauuaaacuuaaucu

SEQ ID NO: 1202946 - RNA, 23 nt, Human
gauuacaagcgugagccacugca

SEQ ID NO: 1202947 - RNA, 20 nt, Human
gauuacaggugugaaccacc

SEQ ID NO: 1202948 - RNA, 15 nt, Human
gauugcaacaggcug

SEQ ID NO: 1202949 - RNA, 14 nt, Human
gauucuccugccuc

SEQ ID NO: 1202950 - RNA, 14 nt, Human
gauuuaacagaaau

SEQ ID NO: 1202951 - RNA, 13 nt, Human
gauuuaacagaaa

SEQ ID NO: 1202952 - RNA, 22 nt, Human
gauuuccguuaaaauaccagcc

SEQ ID NO: 1202953 - RNA, 15 nt, Human
gauuuaacagaaaug

SEQ ID NO: 1202954 - RNA, 12 nt, Human
gcaaaccaucau

SEQ ID NO: 1202955 - RNA, 19 nt, Human
gauuuugauccaagcuggu

SEQ ID NO: 1202956 - RNA, 21 nt, Human
gauuuugaaauuuuuauuaaa

SEQ ID NO: 1202957 - RNA, 15 nt, Human
gcaaaccaucauuga

SEQ ID NO: 1202958 - RNA, 23 nt, Human
gcacugcuuccagugaggcucug

SEQ ID NO: 1202959 - RNA, 16 nt, Human
gcacgauuucuguuua

SEQ ID NO: 1202960 - RNA, 14 nt, Human
gcagacaggcaagc

SEQ ID NO: 1202961 - RNA, 13 nt, Human
gcagacaggcaag

SEQ ID NO: 1202962 - RNA, 12 nt, Human
gcagacaggcaa

SEQ ID NO: 1202963 - RNA, 15 nt, Human
gcacgauuucuguuu

SEQ ID NO: 1202964 - RNA, 13 nt, Human
gcacgauuucugu

SEQ ID NO: 1202965 - RNA, 21 nt, Human
gcaccuuagacagucccugcc

SEQ ID NO: 1202966 - RNA, 20 nt, Human
gcaccuuagacagucccugc

SEQ ID NO: 1202967 - RNA, 12 nt, Human
gcaccauaacuu

SEQ ID NO: 1202968 - RNA, 22 nt, Human
gcacagaguuguuacauuuuua

SEQ ID NO: 1202969 - RNA, 21 nt, Human
gcacagaguuguuacauuuuu

SEQ ID NO: 1202970 - RNA, 19 nt, Human
gcacagaguuguuacauuu

SEQ ID NO: 1202971 - RNA, 18 nt, Human
gcacagaguuguuacauu

SEQ ID NO: 1202972 - RNA, 16 nt, Human
gcacagaguuguuaca

SEQ ID NO: 1202973 - RNA, 15 nt, Human
gcaauggcagccuug

SEQ ID NO: 1202974 - RNA, 14 nt, Human
gcaacucaucuuag

SEQ ID NO: 1202975 - RNA, 14 nt, Human
gcaaugugauaaaa

SEQ ID NO: 1202976 - RNA, 16 nt, Human
gcacaaacagaggccg

SEQ ID NO: 1202977 - RNA, 15 nt, Human
gcacaaacagaggcc

SEQ ID NO: 1202978 - RNA, 14 nt, Human
gcacaaacagaggc

SEQ ID NO: 1202979 - RNA, 15 nt, Human
gcacagaguuguuac

SEQ ID NO: 1202980 - RNA, 22 nt, Human
gcacagacccugcccugugggc

SEQ ID NO: 1202981 - RNA, 21 nt, Human
gcacagacccugcccuguggg

SEQ ID NO: 1202982 - RNA, 20 nt, Human
gcacagacccugcccugugg

SEQ ID NO: 1202983 - RNA, 19 nt, Human
gcacagacccugcccugug

SEQ ID NO: 1202984 - RNA, 18 nt, Human
gcacagacccugcccugu

SEQ ID NO: 1202985 - RNA, 17 nt, Human
gcacagacccugcccug

SEQ ID NO: 1202986 - RNA, 16 nt, Human
gcacagacccugcccu

SEQ ID NO: 1202987 - RNA, 15 nt, Human
gcacagacccugccc

SEQ ID NO: 1202988 - RNA, 14 nt, Human
gcacagacccugcc

SEQ ID NO: 1202989 - RNA, 23 nt, Human
gcacagaaaauggaagacagcuc

SEQ ID NO: 1202990 - RNA, 22 nt, Human
gcacagaaaauggaagacagcu

SEQ ID NO: 1202991 - RNA, 21 nt, Human
gcacagaaaauggaagacagc

SEQ ID NO: 1202992 - RNA, 20 nt, Human
gcacagaaaauggaagacag

SEQ ID NO: 1202993 - RNA, 21 nt, Human
gcacaagcuccaagcucccag

SEQ ID NO: 1202994 - RNA, 18 nt, Human
gcacaagcuccaagcucc

SEQ ID NO: 1202995 - RNA, 17 nt, Human
gcacaagcuccaagcuc

SEQ ID NO: 1202996 - RNA, 15 nt, Human
gcacaagcuccaagc

SEQ ID NO: 1202997 - RNA, 20 nt, Human
gagugugccugaagucccag

SEQ ID NO: 1202998 - RNA, 12 nt, Human
gaguuacagaca

SEQ ID NO: 1202999 - RNA, 13 nt, Human
gagugggugaaua

SEQ ID NO: 1203000 - RNA, 17 nt, Human
gagugacagaggcagcc

SEQ ID NO: 1203001 - RNA, 20 nt, Human
gaguucaucuugaauuguaa

SEQ ID NO: 1203002 - RNA, 19 nt, Human
gaguucaucuugaauugua

SEQ ID NO: 1203003 - RNA, 14 nt, Human
gaguucaucuugaa

SEQ ID NO: 1203004 - RNA, 15 nt, Human
gaguuacagacaaag

SEQ ID NO: 1203005 - RNA, 13 nt, Human
gaguuacagacaa

SEQ ID NO: 1203006 - RNA, 21 nt, Human
gaguugaagacagagcuacac

SEQ ID NO: 1203007 - RNA, 17 nt, Human
gaguugaagacagagcu

SEQ ID NO: 1203008 - RNA, 15 nt, Human
gaguugaagacagag

SEQ ID NO: 1203009 - RNA, 23 nt, Human
gauacaggaaaagcugcugacag

SEQ ID NO: 1203010 - RNA, 21 nt, Human
gauacaggaaaagcugcugac

SEQ ID NO: 1203011 - RNA, 20 nt, Human
gauacaggaaaagcugcuga

SEQ ID NO: 1203012 - RNA, 22 nt, Human
gauaagaaccuuuugagugccu

SEQ ID NO: 1203013 - RNA, 22 nt, Human
gauagccaaggccaaaggaagc

SEQ ID NO: 1203014 - RNA, 16 nt, Human
gauagcacagacccug

SEQ ID NO: 1203015 - RNA, 15 nt, Human
gauagcacagacccu

SEQ ID NO: 1203016 - RNA, 20 nt, Human
gaucacggcucacugcagcc

SEQ ID NO: 1203017 - RNA, 14 nt, Human
gaucacagccucug

SEQ ID NO: 1203018 - RNA, 18 nt, Human
gaucacggcucacugcag

SEQ ID NO: 1203019 - RNA, 16 nt, Human
gaucacggcucacugc

SEQ ID NO: 1203020 - RNA, 15 nt, Human
gaucacggcucacug

SEQ ID NO: 1203021 - RNA, 11 nt, Human
gaguauauguc

SEQ ID NO: 1203022 - RNA, 19 nt, Human
gaguaggaagacuuuggaa

SEQ ID NO: 1203023 - RNA, 18 nt, Human
gaguaggaagacuuugga

SEQ ID NO: 1203024 - RNA, 16 nt, Human
gagucgaggacaggga

SEQ ID NO: 1203025 - RNA, 15 nt, Human
gagucgaggacaggg

SEQ ID NO: 1203026 - RNA, 14 nt, Human
gagucgaggacagg

SEQ ID NO: 1203027 - RNA, 19 nt, Human
gaguccgaaagggacuugg

SEQ ID NO: 1203028 - RNA, 19 nt, Human
gagucucacuguugcccag

SEQ ID NO: 1203029 - RNA, 13 nt, Human
gagucugaaggcu

SEQ ID NO: 1203030 - RNA, 12 nt, Human
gagucugaaggc

SEQ ID NO: 1203031 - RNA, 15 nt, Human
gagucugaaggcugg

SEQ ID NO: 1203032 - RNA, 14 nt, Human
gagucugaaggcug

SEQ ID NO: 1203033 - RNA, 16 nt, Human
gagugacagaggcagc

SEQ ID NO: 1203034 - RNA, 15 nt, Human
gagugacagaggcag

SEQ ID NO: 1203035 - RNA, 14 nt, Human
gagugacagaggca

SEQ ID NO: 1203036 - RNA, 17 nt, Human
gagugaagcugggagaa

SEQ ID NO: 1203037 - RNA, 17 nt, Human
gaguaggaagacuuugg

SEQ ID NO: 1203038 - RNA, 13 nt, Human
gaguaggaagacu

SEQ ID NO: 1203039 - RNA, 12 nt, Human
gaguaggaagac

SEQ ID NO: 1203040 - RNA, 22 nt, Human
gaguagcugggacuacaggcac

SEQ ID NO: 1203041 - RNA, 23 nt, Human
gaguacuacaguccucccaucuc

SEQ ID NO: 1203042 - RNA, 21 nt, Human
gaguacuacaguccucccauc

SEQ ID NO: 1203043 - RNA, 20 nt, Human
gaguacuacaguccucccau

SEQ ID NO: 1203044 - RNA, 16 nt, Human
gagguuucaaaccucc

SEQ ID NO: 1203045 - RNA, 17 nt, Human
gagguugggaggccauu

SEQ ID NO: 1203046 - RNA, 15 nt, Human
gagguugggaggcca

SEQ ID NO: 1203047 - RNA, 20 nt, Human
gaggucagagccugcaguua

SEQ ID NO: 1203048 - RNA, 17 nt, Human
gaggucagagccugcag

SEQ ID NO: 1203049 - RNA, 14 nt, Human
gaggguugggcugg

SEQ ID NO: 1203050 - RNA, 15 nt, Human
gaggguugggcuggu

SEQ ID NO: 1203051 - RNA, 24 nt, Human
gagguaaggaauaccugucccccu

SEQ ID NO: 1203052 - RNA, 21 nt, Human
gagguaaggaauaccuguccc

SEQ ID NO: 1203053 - RNA, 17 nt, Human
gaggucaaggcugcagu

SEQ ID NO: 1203054 - RNA, 13 nt, Human
gaggucagagccu

SEQ ID NO: 1203055 - RNA, 12 nt, Human
gaggucagagcc

SEQ ID NO: 1203056 - RNA, 14 nt, Human
gagggucugaggaa

SEQ ID NO: 1203057 - RNA, 13 nt, Human
gagggucugagga

SEQ ID NO: 1203058 - RNA, 22 nt, Human
gagggugucccaaaaagaaagg

SEQ ID NO: 1203059 - RNA, 21 nt, Human
gaggguggugaccucugccug

SEQ ID NO: 1203060 - RNA, 14 nt, Human
gaggguggugaccu

SEQ ID NO: 1203061 - RNA, 15 nt, Human
gagggugggaguggg

SEQ ID NO: 1203062 - RNA, 12 nt, Human
gaggguggaaua

SEQ ID NO: 1203063 - RNA, 21 nt, Human
gagggugaagugaagacaaug

SEQ ID NO: 1203064 - RNA, 14 nt, Human
gagggcacagaaaa

SEQ ID NO: 1203065 - RNA, 13 nt, Human
gaggguaaggcug

SEQ ID NO: 1203066 - RNA, 17 nt, Human
gaggggguggccuccca

SEQ ID NO: 1203067 - RNA, 19 nt, Human
gagggagggcuccagacac

SEQ ID NO: 1203068 - RNA, 20 nt, Human
gaggcugggcucccuuccca

SEQ ID NO: 1203069 - RNA, 22 nt, Human
gagggagugacagaggcagccc

SEQ ID NO: 1203070 - RNA, 21 nt, Human
gagggagugacagaggcagcc

SEQ ID NO: 1203071 - RNA, 18 nt, Human
gagggagugacagaggca

SEQ ID NO: 1203072 - RNA, 14 nt, Human
gagggagguaagga

SEQ ID NO: 1203073 - RNA, 20 nt, Human
gagggagggcuccagacaca

SEQ ID NO: 1203074 - RNA, 16 nt, Human
gaggccuucucugaag

SEQ ID NO: 1203075 - RNA, 19 nt, Human
gaggccuucucugaaggac

SEQ ID NO: 1203076 - RNA, 18 nt, Human
gaggccuucucugaagga

SEQ ID NO: 1203077 - RNA, 22 nt, Human
gaggcccuucucuccagccccu

SEQ ID NO: 1203078 - RNA, 21 nt, Human
gaggcccuucucuccagcccc

SEQ ID NO: 1203079 - RNA, 20 nt, Human
gaggcccuucucuccagccc

SEQ ID NO: 1203080 - RNA, 15 nt, Human
gaggcccuucucucc

SEQ ID NO: 1203081 - RNA, 19 nt, Human
gaggcccagagggccugca

SEQ ID NO: 1203082 - RNA, 16 nt, Human
gaggcccagagggccu

SEQ ID NO: 1203083 - RNA, 15 nt, Human
gaggcccagagggcc

SEQ ID NO: 1203084 - RNA, 14 nt, Human
gaggcccagagggc

SEQ ID NO: 1203085 - RNA, 13 nt, Human
gaggcccagaggg

SEQ ID NO: 1203086 - RNA, 11 nt, Human
gaggcccagag

SEQ ID NO: 1203087 - RNA, 21 nt, Human
gaggcagccccauucugccug

SEQ ID NO: 1203088 - RNA, 9 nt, Human
gaggcaggg

SEQ ID NO: 1203089 - RNA, 20 nt, Human
gaggcagccccauucugccu

SEQ ID NO: 1203090 - RNA, 19 nt, Human
gaggcagccccauucugcc

SEQ ID NO: 1203091 - RNA, 23 nt, Human
gaggccaugggccuccugugugu

SEQ ID NO: 1203092 - RNA, 21 nt, Human
gaggccaugggccuccugugu

SEQ ID NO: 1203093 - RNA, 20 nt, Human
gaggccaugggccuccugug

SEQ ID NO: 1203094 - RNA, 18 nt, Human
gaggccaugggccuccug

SEQ ID NO: 1203095 - RNA, 17 nt, Human
gaggccaugggccuccu

SEQ ID NO: 1203096 - RNA, 14 nt, Human
gaggccaugggccu

SEQ ID NO: 1203097 - RNA, 20 nt, Human
gaggauugcuugagcucagg

SEQ ID NO: 1203098 - RNA, 22 nt, Human
gaggaucucuugagccugggag

SEQ ID NO: 1203099 - RNA, 19 nt, Human
gaggaucucuugagccugg

SEQ ID NO: 1203100 - RNA, 16 nt, Human
gaggaucucuugagcc

SEQ ID NO: 1203101 - RNA, 13 nt, Human
gaggaucucuuga

SEQ ID NO: 1203102 - RNA, 19 nt, Human
gagaucacgccacugcacu

SEQ ID NO: 1203103 - RNA, 18 nt, Human
gagaucacgccacugcac

SEQ ID NO: 1203104 - RNA, 19 nt, Human
gagauagccaaggccaaag

SEQ ID NO: 1203105 - RNA, 16 nt, Human
gagauagccaaggcca

SEQ ID NO: 1203106 - RNA, 14 nt, Human
gagauagccaaggc

SEQ ID NO: 1203107 - RNA, 21 nt, Human
gagcacuaaggugugcucuga

SEQ ID NO: 1203108 - RNA, 15 nt, Human
gagcacuaaggugug

SEQ ID NO: 1203109 - RNA, 22 nt, Human
gagcaccuuagacagucccugc

SEQ ID NO: 1203110 - RNA, 21 nt, Human
gagcaccuuagacagucccug

SEQ ID NO: 1203111 - RNA, 20 nt, Human
gagcaccuuagacagucccu

SEQ ID NO: 1203112 - RNA, 18 nt, Human
gagcaagacgcugugcug

SEQ ID NO: 1203113 - RNA, 19 nt, Human
gagccagggucucacuaug

SEQ ID NO: 1203114 - RNA, 23 nt, Human
gagccagauuucacucuccuugg

SEQ ID NO: 1203115 - RNA, 14 nt, Human
gagccagggucuca

SEQ ID NO: 1203116 - RNA, 16 nt, Human
gagcagagaccauccc

SEQ ID NO: 1203117 - RNA, 12 nt, Human
gagcagagacca

SEQ ID NO: 1203118 - RNA, 16 nt, Human
gagcagagaauucucu

SEQ ID NO: 1203119 - RNA, 19 nt, Human
gagccaauuuaaagaaaac

SEQ ID NO: 1203120 - RNA, 23 nt, Human
gagaaugcacaaacagaggccgc

SEQ ID NO: 1203121 - RNA, 21 nt, Human
gagaccaucccugaaggcccc

SEQ ID NO: 1203122 - RNA, 18 nt, Human
gagaccaucccugaaggc

SEQ ID NO: 1203123 - RNA, 14 nt, Human
gagaccaucccuga

SEQ ID NO: 1203124 - RNA, 22 nt, Human
gagacaggguuuugccauguug

SEQ ID NO: 1203125 - RNA, 13 nt, Human
gagacucugucuc

SEQ ID NO: 1203126 - RNA, 22 nt, Human
gagacuccugcaggcagccagg

SEQ ID NO: 1203127 - RNA, 21 nt, Human
gagacucgcgacaaugcaaac

SEQ ID NO: 1203128 - RNA, 20 nt, Human
gagacucgcgacaaugcaaa

SEQ ID NO: 1203129 - RNA, 21 nt, Human
gagacuccugcaggcagccag

SEQ ID NO: 1203130 - RNA, 20 nt, Human
gagacuccugcaggcagcca

SEQ ID NO: 1203131 - RNA, 19 nt, Human
gagacuccugcaggcagcc

SEQ ID NO: 1203132 - RNA, 20 nt, Human
gagagggugggagugggccc

SEQ ID NO: 1203133 - RNA, 16 nt, Human
gagagggugggagugg

SEQ ID NO: 1203134 - RNA, 14 nt, Human
gagagggugggagu

SEQ ID NO: 1203135 - RNA, 13 nt, Human
gagaggggcacag

SEQ ID NO: 1203136 - RNA, 19 nt, Human
gagaggggaacagacugga

SEQ ID NO: 1203137 - RNA, 16 nt, Human
gagaagcagaggaagg

SEQ ID NO: 1203138 - RNA, 16 nt, Human
gagaagagaaugcaca

SEQ ID NO: 1203139 - RNA, 14 nt, Human
gagaagagaaugca

SEQ ID NO: 1203140 - RNA, 14 nt, Human
gagaaaugagcuug

SEQ ID NO: 1203141 - RNA, 22 nt, Human
gagaaaguacuucuccacccug

SEQ ID NO: 1203142 - RNA, 16 nt, Human
gagaaagguugaagca

SEQ ID NO: 1203143 - RNA, 13 nt, Human
gacuuggaagcuc

SEQ ID NO: 1203144 - RNA, 19 nt, Human
gacuuaagcacacuugaca

SEQ ID NO: 1203145 - RNA, 18 nt, Human
gacuggaagcacagcuuc

SEQ ID NO: 1203146 - RNA, 16 nt, Human
gacuggaagcacagcu

SEQ ID NO: 1203147 - RNA, 15 nt, Human
gacuggaagcacagc

SEQ ID NO: 1203148 - RNA, 14 nt, Human
gacuggaagcacag

SEQ ID NO: 1203149 - RNA, 15 nt, Human
gacugcccggcaggg

SEQ ID NO: 1203150 - RNA, 13 nt, Human
gacugcccggcag

SEQ ID NO: 1203151 - RNA, 23 nt, Human
gacugaguacguugugcauuugg

SEQ ID NO: 1203152 - RNA, 22 nt, Human
gacugaguacguugugcauuug

SEQ ID NO: 1203153 - RNA, 21 nt, Human
gacugaguacguugugcauuu

SEQ ID NO: 1203154 - RNA, 18 nt, Human
gacucgcgacaaugcaaa

SEQ ID NO: 1203155 - RNA, 17 nt, Human
gacucgcgacaaugcaa

SEQ ID NO: 1203156 - RNA, 15 nt, Human
gacucauucuucugu

SEQ ID NO: 1203157 - RNA, 21 nt, Human
gacuacaggugugagucacca

SEQ ID NO: 1203158 - RNA, 18 nt, Human
gacuacaggugugaguca

SEQ ID NO: 1203159 - RNA, 13 nt, Human
gacucgcgacaau

SEQ ID NO: 1203160 - RNA, 13 nt, Human
gacuccugcaggc

SEQ ID NO: 1203161 - RNA, 14 nt, Human
gacuccugcaggca

SEQ ID NO: 1203162 - RNA, 12 nt, Human
gacuccugcagg

SEQ ID NO: 1203163 - RNA, 13 nt, Human
gaaugucagugug

SEQ ID NO: 1203164 - RNA, 15 nt, Human
gaauguuugccucug

SEQ ID NO: 1203165 - RNA, 20 nt, Human
gaauccagacccggcugcgu

SEQ ID NO: 1203166 - RNA, 12 nt, Human
gaaaggcuccag

SEQ ID NO: 1203167 - RNA, 20 nt, Human
gaaugcacaaacagaggccg

SEQ ID NO: 1203168 - RNA, 11 nt, Human
gaaugcagugg

SEQ ID NO: 1203169 - RNA, 18 nt, Human
gaaugaaccacaucuugc

SEQ ID NO: 1203170 - RNA, 21 nt, Human
gaaugcacaaacagaggccgc

SEQ ID NO: 1203171 - RNA, 22 nt, Human
gaauuucuuuugccguuauuaa

SEQ ID NO: 1203172 - RNA, 15 nt, Human
gaauuguaaggaaug

SEQ ID NO: 1203173 - RNA, 23 nt, Human
gacaacacucauugaccugaggc

SEQ ID NO: 1203174 - RNA, 22 nt, Human
gacaacacucauugaccugagg

SEQ ID NO: 1203175 - RNA, 23 nt, Human
gacacauguccaagaagcccagg

SEQ ID NO: 1203176 - RNA, 20 nt, Human
gacacauguccaagaagccc

SEQ ID NO: 1203177 - RNA, 15 nt, Human
gacacauguccaaga

SEQ ID NO: 1203178 - RNA, 19 nt, Human
gacacaugcaaggucauuu

SEQ ID NO: 1203179 - RNA, 14 nt, Human
gacacaugcaaggu

SEQ ID NO: 1203180 - RNA, 21 nt, Human
gacacaggcccggcuccaggc

SEQ ID NO: 1203181 - RNA, 20 nt, Human
gacacaggcccggcuccagg

SEQ ID NO: 1203182 - RNA, 19 nt, Human
gacacaggcccggcuccag

SEQ ID NO: 1203183 - RNA, 22 nt, Human
gacacaagccuucggcgccuua

SEQ ID NO: 1203184 - RNA, 16 nt, Human
gacacaagccuucggc

SEQ ID NO: 1203185 - RNA, 21 nt, Human
gacaaggauugcuacuguccu

SEQ ID NO: 1203186 - RNA, 19 nt, Human
gacaaggauugcuacuguc

SEQ ID NO: 1203187 - RNA, 18 nt, Human
gacaaggauugcuacugu

SEQ ID NO: 1203188 - RNA, 21 nt, Human
gacaaggaugaucuaggaaga

SEQ ID NO: 1203189 - RNA, 18 nt, Human
gacaaugugaaaagaaaa

SEQ ID NO: 1203190 - RNA, 12 nt, Human
gacaaugugaaa

SEQ ID NO: 1203191 - RNA, 22 nt, Human
gacaaugcaaaccaucauugaa

SEQ ID NO: 1203192 - RNA, 20 nt, Human
gacaaugugaaaagaaaaau

SEQ ID NO: 1203193 - RNA, 19 nt, Human
gacaaugugaaaagaaaaa

SEQ ID NO: 1203194 - RNA, 20 nt, Human
gaccauucuccaccugccag

SEQ ID NO: 1203195 - RNA, 19 nt, Human
gaccauucuccaccugcca

SEQ ID NO: 1203196 - RNA, 22 nt, Human
gaccauucuccaccugccaggg

SEQ ID NO: 1203197 - RNA, 21 nt, Human
gaccauucuccaccugccagg

SEQ ID NO: 1203198 - RNA, 17 nt, Human
gaccagagcugccaccu

SEQ ID NO: 1203199 - RNA, 15 nt, Human
gaccagagcugccac

SEQ ID NO: 1203200 - RNA, 14 nt, Human
gaccagagcugcca

SEQ ID NO: 1203201 - RNA, 13 nt, Human
gaccagagcugcc

SEQ ID NO: 1203202 - RNA, 19 nt, Human
gaccagagcugccaccugc

SEQ ID NO: 1203203 - RNA, 18 nt, Human
gaccagagcugccaccug

SEQ ID NO: 1203204 - RNA, 11 nt, Human
gaccagagcug

SEQ ID NO: 1203205 - RNA, 21 nt, Human
gaccagacaccuugacagggc

SEQ ID NO: 1203206 - RNA, 16 nt, Human
gaccacguuucuaaag

SEQ ID NO: 1203207 - RNA, 14 nt, Human
gaccacguuucuaa

SEQ ID NO: 1203208 - RNA, 18 nt, Human
gacaugggaaaggggaag

SEQ ID NO: 1203209 - RNA, 19 nt, Human
gaccgugaggccagagaca

SEQ ID NO: 1203210 - RNA, 18 nt, Human
gaccgugaggccagagac

SEQ ID NO: 1203211 - RNA, 17 nt, Human
gaccgugaggccagaga

SEQ ID NO: 1203212 - RNA, 16 nt, Human
gaccgugaggccagag

SEQ ID NO: 1203213 - RNA, 23 nt, Human
gacccugucucaaaaaaagaaaa

SEQ ID NO: 1203214 - RNA, 21 nt, Human
gacccuuguggucccacccca

SEQ ID NO: 1203215 - RNA, 20 nt, Human
gacccuuguggucccacccc

SEQ ID NO: 1203216 - RNA, 19 nt, Human
gacccuuguggucccaccc

SEQ ID NO: 1203217 - RNA, 12 nt, Human
gacccugucuca

SEQ ID NO: 1203218 - RNA, 12 nt, Human
gacccugcccug

SEQ ID NO: 1203219 - RNA, 23 nt, Human
gacccugaggcccagagggccug

SEQ ID NO: 1203220 - RNA, 21 nt, Human
gaccccuccaugugggcuagu

SEQ ID NO: 1203221 - RNA, 18 nt, Human
gaccccuccaugugggcu

SEQ ID NO: 1203222 - RNA, 14 nt, Human
gaccccuccaugug

SEQ ID NO: 1203223 - RNA, 14 nt, Human
gacaugggaaaggg

SEQ ID NO: 1203224 - RNA, 14 nt, Human
gacaugaucuucuu

SEQ ID NO: 1203225 - RNA, 22 nt, Human
gacaguuaagagaaaugagcuu

SEQ ID NO: 1203226 - RNA, 14 nt, Human
gacaguuaagagaa

SEQ ID NO: 1203227 - RNA, 24 nt, Human
gacagggcacaccgggcacucaga

SEQ ID NO: 1203228 - RNA, 23 nt, Human
gacagggcacaccgggcacucag

SEQ ID NO: 1203229 - RNA, 16 nt, Human
gacagggaggugaccc

SEQ ID NO: 1203230 - RNA, 23 nt, Human
gacaggaccagggauuuccauga

SEQ ID NO: 1203231 - RNA, 15 nt, Human
gacaggaccagggau

SEQ ID NO: 1203232 - RNA, 14 nt, Human
gacaggaccaggga

SEQ ID NO: 1203233 - RNA, 21 nt, Human
gacagcugccugggaucccuc

SEQ ID NO: 1203234 - RNA, 18 nt, Human
gacagcugccugggaucc

SEQ ID NO: 1203235 - RNA, 17 nt, Human
gacagcugccugggauc

SEQ ID NO: 1203236 - RNA, 16 nt, Human
gacagcugccugggau

SEQ ID NO: 1203237 - RNA, 21 nt, Human
gacagccacggccaggccaga

SEQ ID NO: 1203238 - RNA, 20 nt, Human
gacagccacggccaggccag

SEQ ID NO: 1203239 - RNA, 19 nt, Human
gacagccacggccaggcca

SEQ ID NO: 1203240 - RNA, 18 nt, Human
gacagccacggccaggcc

SEQ ID NO: 1203241 - RNA, 17 nt, Human
gacagccacggccaggc

SEQ ID NO: 1203242 - RNA, 14 nt, Human
gacagccacggcca

SEQ ID NO: 1203243 - RNA, 22 nt, Human
gacagagugagacucugucuca

SEQ ID NO: 1203244 - RNA, 20 nt, Human
gacagagugagacucugucu

SEQ ID NO: 1203245 - RNA, 14 nt, Human
gacagagucucacu

SEQ ID NO: 1203246 - RNA, 23 nt, Human
gacagaggggguggccucccaac

SEQ ID NO: 1203247 - RNA, 22 nt, Human
gacagaggggguggccucccaa

SEQ ID NO: 1203248 - RNA, 21 nt, Human
gacagaggggguggccuccca

SEQ ID NO: 1203249 - RNA, 19 nt, Human
gacagaggggguggccucc

SEQ ID NO: 1203250 - RNA, 18 nt, Human
gacagaggggguggccuc

SEQ ID NO: 1203251 - RNA, 15 nt, Human
gacagaggggguggc

SEQ ID NO: 1203252 - RNA, 17 nt, Human
gacagaggcagccccau

SEQ ID NO: 1203253 - RNA, 16 nt, Human
gacagaggcagcccca

SEQ ID NO: 1203254 - RNA, 14 nt, Human
gacagaggcagccc

SEQ ID NO: 1203255 - RNA, 21 nt, Human
gacagagcaagugagacccug

SEQ ID NO: 1203256 - RNA, 18 nt, Human
cuuuguuaguuucuccaa

SEQ ID NO: 1203257 - RNA, 12 nt, Human
cuuuuguucuug

SEQ ID NO: 1203258 - RNA, 11 nt, Human
cuuuuguucuu

SEQ ID NO: 1203259 - RNA, 20 nt, Human
cuuuuguucuugguuuguaa

SEQ ID NO: 1203260 - RNA, 18 nt, Human
gaaaacacuguucucugc

SEQ ID NO: 1203261 - RNA, 19 nt, Human
gaaaacacauuuuucuuag

SEQ ID NO: 1203262 - RNA, 18 nt, Human
gaaaacacauuuuucuua

SEQ ID NO: 1203263 - RNA, 17 nt, Human
gaaaaaggaugcacaga

SEQ ID NO: 1203264 - RNA, 15 nt, Human
gaaaaaggaggaaga

SEQ ID NO: 1203265 - RNA, 12 nt, Human
gaaaaaggagga

SEQ ID NO: 1203266 - RNA, 22 nt, Human
cuuuuuuggcugcugaaggcuc

SEQ ID NO: 1203267 - RNA, 20 nt, Human
cuuuuuuggcugcugaaggc

SEQ ID NO: 1203268 - RNA, 17 nt, Human
cuuuuuuggcugcugaa

SEQ ID NO: 1203269 - RNA, 22 nt, Human
gaaaaucagccugcuccagcug

SEQ ID NO: 1203270 - RNA, 20 nt, Human
gaaaaucagccugcuccagc

SEQ ID NO: 1203271 - RNA, 22 nt, Human
gaaaacguggcugcuucaagga

SEQ ID NO: 1203272 - RNA, 20 nt, Human
gaaaacguggcugcuucaag

SEQ ID NO: 1203273 - RNA, 24 nt, Human
gaaaacacuguucucugcccucca

SEQ ID NO: 1203274 - RNA, 22 nt, Human
gaaagcccugagcuuucugcua

SEQ ID NO: 1203275 - RNA, 21 nt, Human
gaaagcccugagcuuucugcu

SEQ ID NO: 1203276 - RNA, 17 nt, Human
gaaagcccugagcuuuc

SEQ ID NO: 1203277 - RNA, 16 nt, Human
gaaagaguaggaagac

SEQ ID NO: 1203278 - RNA, 15 nt, Human
gaaagaguaggaaga

SEQ ID NO: 1203279 - RNA, 19 nt, Human
gaaagacuuuuccaacccu

SEQ ID NO: 1203280 - RNA, 23 nt, Human
gaaacccagcucugguccauaga

SEQ ID NO: 1203281 - RNA, 19 nt, Human
gaaacccagcucuggucca

SEQ ID NO: 1203282 - RNA, 18 nt, Human
gaaacccagcucuggucc

SEQ ID NO: 1203283 - RNA, 16 nt, Human
gaaacccagcucuggu

SEQ ID NO: 1203284 - RNA, 15 nt, Human
gaaacccagcucugg

SEQ ID NO: 1203285 - RNA, 14 nt, Human
gaaacccagcucug

SEQ ID NO: 1203286 - RNA, 13 nt, Human
gaaacccagcucu

SEQ ID NO: 1203287 - RNA, 21 nt, Human
cuuguaaauagcucagguguc

SEQ ID NO: 1203288 - RNA, 22 nt, Human
cuuguacauaaugcgugcauac

SEQ ID NO: 1203289 - RNA, 21 nt, Human
cuuguacauaaugcgugcaua

SEQ ID NO: 1203290 - RNA, 19 nt, Human
cuuguacauaaugcgugca

SEQ ID NO: 1203291 - RNA, 15 nt, Human
cuuguacauaaugcg

SEQ ID NO: 1203292 - RNA, 18 nt, Human
cuuguaaauagcucaggu

SEQ ID NO: 1203293 - RNA, 17 nt, Human
cuuguaaauagcucagg

SEQ ID NO: 1203294 - RNA, 23 nt, Human
cuuggggggcugaggugggagga

SEQ ID NO: 1203295 - RNA, 15 nt, Human
cuuuaugcacaaaau

SEQ ID NO: 1203296 - RNA, 19 nt, Human
cuuuauaauucuacuuuga

SEQ ID NO: 1203297 - RNA, 15 nt, Human
cuuuagcgcccaguu

SEQ ID NO: 1203298 - RNA, 14 nt, Human
cuuuagcgcccagu

SEQ ID NO: 1203299 - RNA, 13 nt, Human
cuuuacuauggcc

SEQ ID NO: 1203300 - RNA, 15 nt, Human
cuuuccaucuacccu

SEQ ID NO: 1203301 - RNA, 12 nt, Human
cuuuccugaggc

SEQ ID NO: 1203302 - RNA, 16 nt, Human
cuuucccucccuuccu

SEQ ID NO: 1203303 - RNA, 14 nt, Human
cuuucccucccuuc

SEQ ID NO: 1203304 - RNA, 13 nt, Human
cuuucccucccuu

SEQ ID NO: 1203305 - RNA, 11 nt, Human
cuuucccuccc

SEQ ID NO: 1203306 - RNA, 16 nt, Human
cuuuccugaggcuggg

SEQ ID NO: 1203307 - RNA, 15 nt, Human
cuuuccugaggcugg

SEQ ID NO: 1203308 - RNA, 13 nt, Human
cuuuccugaggcu

SEQ ID NO: 1203309 - RNA, 20 nt, Human
cuuucuggcuaugcauuuga

SEQ ID NO: 1203310 - RNA, 19 nt, Human
cuuucuggcuaugcauuug

SEQ ID NO: 1203311 - RNA, 18 nt, Human
cuuucuggcuaugcauuu

SEQ ID NO: 1203312 - RNA, 17 nt, Human
cuuucuggcuaugcauu

SEQ ID NO: 1203313 - RNA, 19 nt, Human
cuuuggcuauuagagauca

SEQ ID NO: 1203314 - RNA, 14 nt, Human
cuuuguccccaccg

SEQ ID NO: 1203315 - RNA, 19 nt, Human
cuuugugaggaagccgcug

SEQ ID NO: 1203316 - RNA, 15 nt, Human
cuuugugaggaagcc

SEQ ID NO: 1203317 - RNA, 15 nt, Human
cuuuguccccaccgc

SEQ ID NO: 1203318 - RNA, 20 nt, Human
cuuugcagacaggcaagcac

SEQ ID NO: 1203319 - RNA, 24 nt, Human
cuuugaccucugcagcaauaaagc

SEQ ID NO: 1203320 - RNA, 20 nt, Human
cuuugaccucugcagcaaua

SEQ ID NO: 1203321 - RNA, 18 nt, Human
cuuugaccucugcagcaa

SEQ ID NO: 1203322 - RNA, 17 nt, Human
cuuugaccucugcagca

SEQ ID NO: 1203323 - RNA, 15 nt, Human
cuuugaccucugcag

SEQ ID NO: 1203324 - RNA, 14 nt, Human
cuuugaccucugca

SEQ ID NO: 1203325 - RNA, 20 nt, Human
cuuagucacugagacagccc

SEQ ID NO: 1203326 - RNA, 19 nt, Human
cuuagucacugagacagcc

SEQ ID NO: 1203327 - RNA, 18 nt, Human
cuuagucacugagacagc

SEQ ID NO: 1203328 - RNA, 16 nt, Human
cuuagucacugagaca

SEQ ID NO: 1203329 - RNA, 19 nt, Human
cuuagauguauauauuucc

SEQ ID NO: 1203330 - RNA, 13 nt, Human
cuuagauguauau

SEQ ID NO: 1203331 - RNA, 16 nt, Human
cuguucuggcagaguu

SEQ ID NO: 1203332 - RNA, 23 nt, Human
cuucacagaugggugcuuggagg

SEQ ID NO: 1203333 - RNA, 16 nt, Human
cuucaaggauccugag

SEQ ID NO: 1203334 - RNA, 15 nt, Human
cuucaaggauccuga

SEQ ID NO: 1203335 - RNA, 13 nt, Human
cuucaaggauccu

SEQ ID NO: 1203336 - RNA, 10 nt, Human
cuucaaggau

SEQ ID NO: 1203337 - RNA, 17 nt, Human
cuuauuuaaugaaagac

SEQ ID NO: 1203338 - RNA, 18 nt, Human
cuuauuuaaugaaagacu

SEQ ID NO: 1203339 - RNA, 15 nt, Human
cuucaaauauuuccc

SEQ ID NO: 1203340 - RNA, 21 nt, Human
cuuccaggggugggacacccu

SEQ ID NO: 1203341 - RNA, 17 nt, Human
cuuccaggggugggaca

SEQ ID NO: 1203342 - RNA, 15 nt, Human
cuuccagggguggga

SEQ ID NO: 1203343 - RNA, 14 nt, Human
cuuccagggguggg

SEQ ID NO: 1203344 - RNA, 19 nt, Human
cuuccaggcugggagagcc

SEQ ID NO: 1203345 - RNA, 16 nt, Human
cuuccaggcugggaga

SEQ ID NO: 1203346 - RNA, 15 nt, Human
cuuccaggcugggag

SEQ ID NO: 1203347 - RNA, 17 nt, Human
cuucccuacaguugaaa

SEQ ID NO: 1203348 - RNA, 14 nt, Human
cuuccaggcuggga

SEQ ID NO: 1203349 - RNA, 12 nt, Human
cuuccaggcugg

SEQ ID NO: 1203350 - RNA, 22 nt, Human
cuuccacaagagcccaggccuc

SEQ ID NO: 1203351 - RNA, 21 nt, Human
cuuccacaagagcccaggccu

SEQ ID NO: 1203352 - RNA, 19 nt, Human
cuuccacaagagcccaggc

SEQ ID NO: 1203353 - RNA, 17 nt, Human
cuuccacaagagcccag

SEQ ID NO: 1203354 - RNA, 17 nt, Human
cuucaguggcagcugcu

SEQ ID NO: 1203355 - RNA, 16 nt, Human
cuucaguggcagcugc

SEQ ID NO: 1203356 - RNA, 15 nt, Human
cuucaguggcagcug

SEQ ID NO: 1203357 - RNA, 14 nt, Human
cuucaguggcagcu

SEQ ID NO: 1203358 - RNA, 13 nt, Human
cuucaguggcagc

SEQ ID NO: 1203359 - RNA, 22 nt, Human
cuucagugccuuauggaacacu

SEQ ID NO: 1203360 - RNA, 18 nt, Human
cuucagugccuuauggaa

SEQ ID NO: 1203361 - RNA, 23 nt, Human
cuucaguaagccgugauuuucau

SEQ ID NO: 1203362 - RNA, 16 nt, Human
cuucaguaagccguga

SEQ ID NO: 1203363 - RNA, 13 nt, Human
cuucugcuucagc

SEQ ID NO: 1203364 - RNA, 21 nt, Human
cuucuguccuacucuguguca

SEQ ID NO: 1203365 - RNA, 19 nt, Human
cuucuguccuacucugugu

SEQ ID NO: 1203366 - RNA, 18 nt, Human
cuucuguccuacucugug

SEQ ID NO: 1203367 - RNA, 17 nt, Human
cuucuguccuacucugu

SEQ ID NO: 1203368 - RNA, 16 nt, Human
cuucuguccuacucug

SEQ ID NO: 1203369 - RNA, 21 nt, Human
cuucuguacgucugacaggca

SEQ ID NO: 1203370 - RNA, 20 nt, Human
cuucuguacgucugacaggc

SEQ ID NO: 1203371 - RNA, 18 nt, Human
cuucuguacgucugacag

SEQ ID NO: 1203372 - RNA, 15 nt, Human
cuucuguacgucuga

SEQ ID NO: 1203373 - RNA, 14 nt, Human
cuucuguacgucug

SEQ ID NO: 1203374 - RNA, 13 nt, Human
cuucucugaagga

SEQ ID NO: 1203375 - RNA, 19 nt, Human
cuucucuccagccccugga

SEQ ID NO: 1203376 - RNA, 17 nt, Human
cuucucuccagccccug

SEQ ID NO: 1203377 - RNA, 15 nt, Human
cuucucuccagcccc

SEQ ID NO: 1203378 - RNA, 13 nt, Human
cuucucuccagcc

SEQ ID NO: 1203379 - RNA, 19 nt, Human
cuucuccuucaccuuuguc

SEQ ID NO: 1203380 - RNA, 14 nt, Human
cuucuccaggcugu

SEQ ID NO: 1203381 - RNA, 13 nt, Human
cuucuccaggcug

SEQ ID NO: 1203382 - RNA, 12 nt, Human
cuucuccaggcu

SEQ ID NO: 1203383 - RNA, 20 nt, Human
cuucuccacuuucuagccag

SEQ ID NO: 1203384 - RNA, 11 nt, Human
cuucuccacuu

SEQ ID NO: 1203385 - RNA, 21 nt, Human
cuugaggguugggcugguguc

SEQ ID NO: 1203386 - RNA, 20 nt, Human
cuugaggguugggcuggugu

SEQ ID NO: 1203387 - RNA, 19 nt, Human
cuugaggguugggcuggug

SEQ ID NO: 1203388 - RNA, 18 nt, Human
cuugagccuugaacuuug

SEQ ID NO: 1203389 - RNA, 17 nt, Human
cuugagccuugaacuuu

SEQ ID NO: 1203390 - RNA, 15 nt, Human
cuugagccuugaacu

SEQ ID NO: 1203391 - RNA, 13 nt, Human
cuugaccucaggu

SEQ ID NO: 1203392 - RNA, 21 nt, Human
cuugaccgugaggccagagac

SEQ ID NO: 1203393 - RNA, 20 nt, Human
cuugaccgugaggccagaga

SEQ ID NO: 1203394 - RNA, 18 nt, Human
cuugaccgugaggccaga

SEQ ID NO: 1203395 - RNA, 17 nt, Human
cuugaccgugaggccag

SEQ ID NO: 1203396 - RNA, 16 nt, Human
cuugaagacuuuucuu

SEQ ID NO: 1203397 - RNA, 23 nt, Human
cuugaccauucuccaccugccag

SEQ ID NO: 1203398 - RNA, 22 nt, Human
cuugaccauucuccaccugcca

SEQ ID NO: 1203399 - RNA, 21 nt, Human
cuugaacuuugaccucugcag

SEQ ID NO: 1203400 - RNA, 17 nt, Human
cuugaacuuugaccucu

SEQ ID NO: 1203401 - RNA, 13 nt, Human
cuugaacuccugg

SEQ ID NO: 1203402 - RNA, 23 nt, Human
cuugaaaacacuguucucugccc

SEQ ID NO: 1203403 - RNA, 14 nt, Human
cuugaaaacacugu

SEQ ID NO: 1203404 - RNA, 22 nt, Human
cuucuuuauaauucuacuuuga

SEQ ID NO: 1203405 - RNA, 21 nt, Human
cuucuguggguuucuaaagcu

SEQ ID NO: 1203406 - RNA, 14 nt, Human
cuucuguggguuuc

SEQ ID NO: 1203407 - RNA, 13 nt, Human
cuucuguggguuu

SEQ ID NO: 1203408 - RNA, 20 nt, Human
cugugugugcgccuacagga

SEQ ID NO: 1203409 - RNA, 23 nt, Human
cugugucuugcaauggcagccuu

SEQ ID NO: 1203410 - RNA, 22 nt, Human
cugugucuugcaauggcagccu

SEQ ID NO: 1203411 - RNA, 21 nt, Human
cugugucuugcaauggcagcc

SEQ ID NO: 1203412 - RNA, 21 nt, Human
cuguucagcugguugagguuu

SEQ ID NO: 1203413 - RNA, 19 nt, Human
cuguucagcugguugaggu

SEQ ID NO: 1203414 - RNA, 13 nt, Human
cuguuacugucuu

SEQ ID NO: 1203415 - RNA, 20 nt, Human
cuguucucugcccuccaaga

SEQ ID NO: 1203416 - RNA, 19 nt, Human
cuguucucugcccuccaag

SEQ ID NO: 1203417 - RNA, 18 nt, Human
cuguucucugcccuccaa

SEQ ID NO: 1203418 - RNA, 17 nt, Human
cuguucucugcccucca

SEQ ID NO: 1203419 - RNA, 16 nt, Human
cuguucucugcccucc

SEQ ID NO: 1203420 - RNA, 15 nt, Human
cuguucucugcccuc

SEQ ID NO: 1203421 - RNA, 14 nt, Human
cuguucucugcccu

SEQ ID NO: 1203422 - RNA, 13 nt, Human
cuguucucugccc

SEQ ID NO: 1203423 - RNA, 18 nt, Human
cugucuccauguuugaug

SEQ ID NO: 1203424 - RNA, 18 nt, Human
cugugauggggcccugcc

SEQ ID NO: 1203425 - RNA, 23 nt, Human
cugugaguacuacaguccuccca

SEQ ID NO: 1203426 - RNA, 21 nt, Human
cugugaguacuacaguccucc

SEQ ID NO: 1203427 - RNA, 20 nt, Human
cugugaguacuacaguccuc

SEQ ID NO: 1203428 - RNA, 22 nt, Human
cugugccauuuuguauuuuacu

SEQ ID NO: 1203429 - RNA, 14 nt, Human
cugugccauuuugu

SEQ ID NO: 1203430 - RNA, 18 nt, Human
cugugccaugugccaggu

SEQ ID NO: 1203431 - RNA, 16 nt, Human
cugugccaugugccag

SEQ ID NO: 1203432 - RNA, 20 nt, Human
cugugauggggcccugccuc

SEQ ID NO: 1203433 - RNA, 19 nt, Human
cugugauggggcccugccu

SEQ ID NO: 1203434 - RNA, 17 nt, Human
cuguggaugauaaaaca

SEQ ID NO: 1203435 - RNA, 14 nt, Human
cugugggcccccaa

SEQ ID NO: 1203436 - RNA, 22 nt, Human
cugugcugcccugcccaccugg

SEQ ID NO: 1203437 - RNA, 18 nt, Human
cugugccucugggacugg

SEQ ID NO: 1203438 - RNA, 17 nt, Human
cugugccucugggacug

SEQ ID NO: 1203439 - RNA, 16 nt, Human
cugugccucugggacu

SEQ ID NO: 1203440 - RNA, 14 nt, Human
cugugccucuggga

SEQ ID NO: 1203441 - RNA, 20 nt, Human
cugucccuuacgugaguccu

SEQ ID NO: 1203442 - RNA, 22 nt, Human
cuguccccgcacugggcuuggg

SEQ ID NO: 1203443 - RNA, 19 nt, Human
cuguccccgcacugggcuu

SEQ ID NO: 1203444 - RNA, 18 nt, Human
cuguccccgcacugggcu

SEQ ID NO: 1203445 - RNA, 14 nt, Human
cuguccuacccacc

SEQ ID NO: 1203446 - RNA, 15 nt, Human
cuguccgagcuuuga

SEQ ID NO: 1203447 - RNA, 22 nt, Human
cugucccuuacgugaguccugg

SEQ ID NO: 1203448 - RNA, 16 nt, Human
cugucucaaaaaaaga

SEQ ID NO: 1203449 - RNA, 23 nt, Human
cugucucaaaaaaacacaaaagu

SEQ ID NO: 1203450 - RNA, 18 nt, Human
cugucucaaaaaaagaaa

SEQ ID NO: 1203451 - RNA, 14 nt, Human
cuguacagagccca

SEQ ID NO: 1203452 - RNA, 13 nt, Human
cuguacagagccc

SEQ ID NO: 1203453 - RNA, 14 nt, Human
cuguaucccaugag

SEQ ID NO: 1203454 - RNA, 23 nt, Human
cuguaucccaugagccucagcau

SEQ ID NO: 1203455 - RNA, 13 nt, Human
cugucaauuacag

SEQ ID NO: 1203456 - RNA, 19 nt, Human
cuggguucuacccaggugc

SEQ ID NO: 1203457 - RNA, 17 nt, Human
cuggguucuacccaggu

SEQ ID NO: 1203458 - RNA, 16 nt, Human
cuggguucuacccagg

SEQ ID NO: 1203459 - RNA, 15 nt, Human
cuggguucuacccag

SEQ ID NO: 1203460 - RNA, 14 nt, Human
cuggguacuugugg

SEQ ID NO: 1203461 - RNA, 22 nt, Human
cuggguaacuagggaagauaau

SEQ ID NO: 1203462 - RNA, 19 nt, Human
cugggggcugggcagagga

SEQ ID NO: 1203463 - RNA, 15 nt, Human
cugggggaagaagcu

SEQ ID NO: 1203464 - RNA, 13 nt, Human
cugggggaagaag

SEQ ID NO: 1203465 - RNA, 13 nt, Human
cugggcuugggga

SEQ ID NO: 1203466 - RNA, 24 nt, Human
cugggcuucaguggcagcugcuuu

SEQ ID NO: 1203467 - RNA, 20 nt, Human
cuguaauccuagcacuuugg

SEQ ID NO: 1203468 - RNA, 13 nt, Human
cuguacaaaguag

SEQ ID NO: 1203469 - RNA, 15 nt, Human
cuguacaaaguagaa

SEQ ID NO: 1203470 - RNA, 14 nt, Human
cugguggcagcugc

SEQ ID NO: 1203471 - RNA, 13 nt, Human
cugguggcagcug

SEQ ID NO: 1203472 - RNA, 23 nt, Human
cugguggcagcucaccucucccu

SEQ ID NO: 1203473 - RNA, 15 nt, Human
cuggcccacugcauc

SEQ ID NO: 1203474 - RNA, 14 nt, Human
cuggccagaugcac

SEQ ID NO: 1203475 - RNA, 21 nt, Human
cuggcacccggccccugcugg

SEQ ID NO: 1203476 - RNA, 20 nt, Human
cuggcacccggccccugcug

SEQ ID NO: 1203477 - RNA, 20 nt, Human
cuggagugcagugagccgag

SEQ ID NO: 1203478 - RNA, 23 nt, Human
cuggcacugcuuccagugaggcu

SEQ ID NO: 1203479 - RNA, 20 nt, Human
cuggcacugcuuccagugag

SEQ ID NO: 1203480 - RNA, 19 nt, Human
cuggcacugcuuccaguga

SEQ ID NO: 1203481 - RNA, 22 nt, Human
cuggcacccggccccugcuggu

SEQ ID NO: 1203482 - RNA, 24 nt, Human
cuggcucuuccaggcugggagagc

SEQ ID NO: 1203483 - RNA, 22 nt, Human
cuggcucuuccaggcugggaga

SEQ ID NO: 1203484 - RNA, 21 nt, Human
cuggcucuuccaggcugggag

SEQ ID NO: 1203485 - RNA, 15 nt, Human
cuggcgugcaguggu

SEQ ID NO: 1203486 - RNA, 14 nt, Human
cuggcgugcagugg

SEQ ID NO: 1203487 - RNA, 14 nt, Human
cuggccugugucua

SEQ ID NO: 1203488 - RNA, 24 nt, Human
cuggccuggccccucagggucccu

SEQ ID NO: 1203489 - RNA, 13 nt, Human
cuggccuggcccc

SEQ ID NO: 1203490 - RNA, 21 nt, Human
cuggccucugcacuccccugc

SEQ ID NO: 1203491 - RNA, 20 nt, Human
cuggccucugcacuccccug

SEQ ID NO: 1203492 - RNA, 18 nt, Human
cuggccucugcacucccc

SEQ ID NO: 1203493 - RNA, 17 nt, Human
cuggagugcagugagcc

SEQ ID NO: 1203494 - RNA, 16 nt, Human
cuggagugcagugagc

SEQ ID NO: 1203495 - RNA, 15 nt, Human
cuggagugcagugag

SEQ ID NO: 1203496 - RNA, 14 nt, Human
cuggagugcaguga

SEQ ID NO: 1203497 - RNA, 22 nt, Human
cuggagguacgaaaagagggga

SEQ ID NO: 1203498 - RNA, 17 nt, Human
cuggagguacgaaaaga

SEQ ID NO: 1203499 - RNA, 23 nt, Human
cuggacaggcauguucucugagg

SEQ ID NO: 1203500 - RNA, 17 nt, Human
cuggacaggcauguucu

SEQ ID NO: 1203501 - RNA, 16 nt, Human
cuggaccuugaacugg

SEQ ID NO: 1203502 - RNA, 15 nt, Human
cuggacccuguggau

SEQ ID NO: 1203503 - RNA, 21 nt, Human
cuggaccuugaacuggguacu

SEQ ID NO: 1203504 - RNA, 20 nt, Human
cuggaccuugaacuggguac

SEQ ID NO: 1203505 - RNA, 17 nt, Human
cuggaccuugaacuggg

SEQ ID NO: 1203506 - RNA, 23 nt, Human
cugcugguucaggguuggccccu

SEQ ID NO: 1203507 - RNA, 15 nt, Human
cugcugguucagggu

SEQ ID NO: 1203508 - RNA, 13 nt, Human
cugcugguucagg

SEQ ID NO: 1203509 - RNA, 23 nt, Human
cugcuuccagugaggcucugccc

SEQ ID NO: 1203510 - RNA, 21 nt, Human
cugcuuccagugaggcucugc

SEQ ID NO: 1203511 - RNA, 20 nt, Human
cugcuuccagugaggcucug

SEQ ID NO: 1203512 - RNA, 19 nt, Human
cugcuuccagugaggcucu

SEQ ID NO: 1203513 - RNA, 18 nt, Human
cugcuuccagugaggcuc

SEQ ID NO: 1203514 - RNA, 16 nt, Human
cugcuuccagugaggc

SEQ ID NO: 1203515 - RNA, 15 nt, Human
cugcuuccagugagg

SEQ ID NO: 1203516 - RNA, 15 nt, Human
cugcugcuggcuggu

SEQ ID NO: 1203517 - RNA, 12 nt, Human
cugcugaaggcu

SEQ ID NO: 1203518 - RNA, 11 nt, Human
cugcugaaggc

SEQ ID NO: 1203519 - RNA, 20 nt, Human
cugcuccagcuguucagcug

SEQ ID NO: 1203520 - RNA, 19 nt, Human
cugcuccagcuguucagcu

SEQ ID NO: 1203521 - RNA, 19 nt, Human
cugcgaccacaagaaggau

SEQ ID NO: 1203522 - RNA, 15 nt, Human
cugccgcagcccugc

SEQ ID NO: 1203523 - RNA, 19 nt, Human
cugccgcagcccugcagag

SEQ ID NO: 1203524 - RNA, 18 nt, Human
cugccgcagcccugcaga

SEQ ID NO: 1203525 - RNA, 17 nt, Human
cugccgcagcccugcag

SEQ ID NO: 1203526 - RNA, 12 nt, Human
cugcccuccaag

SEQ ID NO: 1203527 - RNA, 23 nt, Human
cucccuucccaccucucucacuc

SEQ ID NO: 1203528 - RNA, 17 nt, Human
cucccuucccaccucuc

SEQ ID NO: 1203529 - RNA, 16 nt, Human
cucccuucccaccucu

SEQ ID NO: 1203530 - RNA, 15 nt, Human
cucccuucccaccuc

SEQ ID NO: 1203531 - RNA, 14 nt, Human
cucccuucccaccu

SEQ ID NO: 1203532 - RNA, 19 nt, Human
cugcccuccaagaccuucu

SEQ ID NO: 1203533 - RNA, 23 nt, Human
cugccucugacacacagcucugu

SEQ ID NO: 1203534 - RNA, 22 nt, Human
cugccucugacacacagcucug

SEQ ID NO: 1203535 - RNA, 15 nt, Human
cugccucugacacac

SEQ ID NO: 1203536 - RNA, 19 nt, Human
cugccucccaucacccgcu

SEQ ID NO: 1203537 - RNA, 16 nt, Human
cugccucccaucaccc

SEQ ID NO: 1203538 - RNA, 14 nt, Human
cugccucccaucac

SEQ ID NO: 1203539 - RNA, 12 nt, Human
cugccucccauc

SEQ ID NO: 1203540 - RNA, 11 nt, Human
cugccucccau

SEQ ID NO: 1203541 - RNA, 22 nt, Human
cugccugggaucccucauccuc

SEQ ID NO: 1203542 - RNA, 21 nt, Human
cugccugggaucccucauccu

SEQ ID NO: 1203543 - RNA, 20 nt, Human
cugccugcccaggccccugc

SEQ ID NO: 1203544 - RNA, 17 nt, Human
cugccugcccaggcccc

SEQ ID NO: 1203545 - RNA, 16 nt, Human
cugccugcccaggccc

SEQ ID NO: 1203546 - RNA, 16 nt, Human
cugccugaagucacac

SEQ ID NO: 1203547 - RNA, 15 nt, Human
cugccugaagucaca

SEQ ID NO: 1203548 - RNA, 15 nt, Human
cugccucuucucuac

SEQ ID NO: 1203549 - RNA, 13 nt, Human
cuacucuguguca

SEQ ID NO: 1203550 - RNA, 12 nt, Human
cuacucuguguc

SEQ ID NO: 1203551 - RNA, 19 nt, Human
cuacuguccuacccacccu

SEQ ID NO: 1203552 - RNA, 19 nt, Human
cuacucgaguuacagacaa

SEQ ID NO: 1203553 - RNA, 16 nt, Human
cuacucgaguuacaga

SEQ ID NO: 1203554 - RNA, 15 nt, Human
cuacucgaguuacag

SEQ ID NO: 1203555 - RNA, 21 nt, Human
cuagagguucaaagauauuuu

SEQ ID NO: 1203556 - RNA, 18 nt, Human
cuagagguucaaagauau

SEQ ID NO: 1203557 - RNA, 17 nt, Human
cuagagguucaaagaua

SEQ ID NO: 1203558 - RNA, 20 nt, Human
cuacuguccuacccacccuc

SEQ ID NO: 1203559 - RNA, 23 nt, Human
cuagccuuagaagucacacagua

SEQ ID NO: 1203560 - RNA, 22 nt, Human
cuagccuuagaagucacacagu

SEQ ID NO: 1203561 - RNA, 21 nt, Human
cuagccuuagaagucacacag

SEQ ID NO: 1203562 - RNA, 22 nt, Human
cuagccugugccucugggacug

SEQ ID NO: 1203563 - RNA, 21 nt, Human
cuagccugugccucugggacu

SEQ ID NO: 1203564 - RNA, 24 nt, Human
cuagauacuguaucaugacaaaga

SEQ ID NO: 1203565 - RNA, 16 nt, Human
cuagauacuguaucau

SEQ ID NO: 1203566 - RNA, 13 nt, Human
cuagauacuguau

SEQ ID NO: 1203567 - RNA, 17 nt, Human
cuauucaguaauaacuc

SEQ ID NO: 1203568 - RNA, 16 nt, Human
cuauguaucaaugagu

SEQ ID NO: 1203569 - RNA, 13 nt, Human
cuauguaucaaug

SEQ ID NO: 1203570 - RNA, 23 nt, Human
cuauucaguaauaacucuacccu

SEQ ID NO: 1203571 - RNA, 21 nt, Human
cuauagccuaggugacagagu

SEQ ID NO: 1203572 - RNA, 20 nt, Human
cuauagccuaggugacagag

SEQ ID NO: 1203573 - RNA, 19 nt, Human
cuauagccuaggugacaga

SEQ ID NO: 1203574 - RNA, 17 nt, Human
cuaggaagacuuuggaa

SEQ ID NO: 1203575 - RNA, 15 nt, Human
cuaggaagacuuugg

SEQ ID NO: 1203576 - RNA, 20 nt, Human
cuaggaacacuccuucacag

SEQ ID NO: 1203577 - RNA, 23 nt, Human
cucacacggacacucaaaagcug

SEQ ID NO: 1203578 - RNA, 14 nt, Human
cucaaguccucuuu

SEQ ID NO: 1203579 - RNA, 19 nt, Human
cucaacucuccuccagagu

SEQ ID NO: 1203580 - RNA, 18 nt, Human
cucaacucuccuccagag

SEQ ID NO: 1203581 - RNA, 16 nt, Human
cucaacucuccuccag

SEQ ID NO: 1203582 - RNA, 14 nt, Human
cucaacucuccucc

SEQ ID NO: 1203583 - RNA, 17 nt, Human
cucaaauuucuaaaucu

SEQ ID NO: 1203584 - RNA, 15 nt, Human
cucaaauuucuaaau

SEQ ID NO: 1203585 - RNA, 14 nt, Human
cucaaauuucuaaa

SEQ ID NO: 1203586 - RNA, 16 nt, Human
cuauugcugcuugagg

SEQ ID NO: 1203587 - RNA, 20 nt, Human
cuccccagccccaucccaaa

SEQ ID NO: 1203588 - RNA, 23 nt, Human
cuccccugcuggguguggcgcag

SEQ ID NO: 1203589 - RNA, 21 nt, Human
cuccccugcuggguguggcgc

SEQ ID NO: 1203590 - RNA, 15 nt, Human
cucccgaguagcugg

SEQ ID NO: 1203591 - RNA, 23 nt, Human
cucccgaauagcugggacuacag

SEQ ID NO: 1203592 - RNA, 20 nt, Human
cucccgaauagcugggacua

SEQ ID NO: 1203593 - RNA, 18 nt, Human
cucccucagucuggcccu

SEQ ID NO: 1203594 - RNA, 15 nt, Human
cucccuucauccuuc

SEQ ID NO: 1203595 - RNA, 16 nt, Human
cucccaucacuucccu

SEQ ID NO: 1203596 - RNA, 15 nt, Human
cucccacaaaggaga

SEQ ID NO: 1203597 - RNA, 16 nt, Human
cucccaacucacccca

SEQ ID NO: 1203598 - RNA, 15 nt, Human
cucccaacucacccc

SEQ ID NO: 1203599 - RNA, 14 nt, Human
cucccaacucaccc

SEQ ID NO: 1203600 - RNA, 16 nt, Human
cucccaaagugcuggg

SEQ ID NO: 1203601 - RNA, 18 nt, Human
cuccagcucaccagcccc

SEQ ID NO: 1203602 - RNA, 16 nt, Human
cuccagcucaccagcc

SEQ ID NO: 1203603 - RNA, 15 nt, Human
cuccagcucaccagc

SEQ ID NO: 1203604 - RNA, 15 nt, Human
cuccagccccuggau

SEQ ID NO: 1203605 - RNA, 14 nt, Human
cuccagccccugga

SEQ ID NO: 1203606 - RNA, 13 nt, Human
cuccagccccugg

SEQ ID NO: 1203607 - RNA, 11 nt, Human
cuccagccccu

SEQ ID NO: 1203608 - RNA, 16 nt, Human
cuccagagucagaagu

SEQ ID NO: 1203609 - RNA, 21 nt, Human
cucauugaccugaggcccuuc

SEQ ID NO: 1203610 - RNA, 19 nt, Human
cucauugaccugaggcccu

SEQ ID NO: 1203611 - RNA, 12 nt, Human
cucauucuucug

SEQ ID NO: 1203612 - RNA, 17 nt, Human
cucauugaccugaggcc

SEQ ID NO: 1203613 - RNA, 22 nt, Human
cucauucuccuuguguuacuaa

SEQ ID NO: 1203614 - RNA, 18 nt, Human
cucauucuccuuguguua

SEQ ID NO: 1203615 - RNA, 21 nt, Human
cucauuugucacacacuuugg

SEQ ID NO: 1203616 - RNA, 20 nt, Human
cucagggccuggcucaggug

SEQ ID NO: 1203617 - RNA, 19 nt, Human
cucagggccuggcucaggu

SEQ ID NO: 1203618 - RNA, 13 nt, Human
cucagggccuggc

SEQ ID NO: 1203619 - RNA, 18 nt, Human
cucaggcaggugggaugg

SEQ ID NO: 1203620 - RNA, 15 nt, Human
cucaggcagguggga

SEQ ID NO: 1203621 - RNA, 21 nt, Human
cucagguggggucacucuggc

SEQ ID NO: 1203622 - RNA, 20 nt, Human
cucagguggggucacucugg

SEQ ID NO: 1203623 - RNA, 19 nt, Human
cucagguggggucacucug

SEQ ID NO: 1203624 - RNA, 23 nt, Human
cucaggugauccacccaccucag

SEQ ID NO: 1203625 - RNA, 22 nt, Human
cucagggucccugguggcagcu

SEQ ID NO: 1203626 - RNA, 21 nt, Human
cucagggucccugguggcagc

SEQ ID NO: 1203627 - RNA, 20 nt, Human
cucagggucccugguggcag

SEQ ID NO: 1203628 - RNA, 14 nt, Human
cucagggccugguc

SEQ ID NO: 1203629 - RNA, 24 nt, Human
cucagggucccugguggcagcuca

SEQ ID NO: 1203630 - RNA, 15 nt, Human
cucagcauccuggca

SEQ ID NO: 1203631 - RNA, 22 nt, Human
cucagcauccuggcacccggcc

SEQ ID NO: 1203632 - RNA, 21 nt, Human
cucagcauccuggcacccggc

SEQ ID NO: 1203633 - RNA, 13 nt, Human
cucagcauccugg

SEQ ID NO: 1203634 - RNA, 16 nt, Human
cucagcaggggagggu

SEQ ID NO: 1203635 - RNA, 21 nt, Human
cucagcaaaagaugcuucuca

SEQ ID NO: 1203636 - RNA, 20 nt, Human
cucagcaaaagaugcuucuc

SEQ ID NO: 1203637 - RNA, 19 nt, Human
cucagcaaaagaugcuucu

SEQ ID NO: 1203638 - RNA, 21 nt, Human
cucagcggggacagcuccuuc

SEQ ID NO: 1203639 - RNA, 20 nt, Human
cucagcggggacagcuccuu

SEQ ID NO: 1203640 - RNA, 19 nt, Human
cucagcggggacagcuccu

SEQ ID NO: 1203641 - RNA, 18 nt, Human
cucagcggggacagcucc

SEQ ID NO: 1203642 - RNA, 16 nt, Human
cucagcggggacagcu

SEQ ID NO: 1203643 - RNA, 15 nt, Human
cucagcggggacagc

SEQ ID NO: 1203644 - RNA, 14 nt, Human
cucagcggggacag

SEQ ID NO: 1203645 - RNA, 23 nt, Human
cucagcggggacagcuccuucug

SEQ ID NO: 1203646 - RNA, 16 nt, Human
cucagaucuucugugg

SEQ ID NO: 1203647 - RNA, 19 nt, Human
cucacuguugcccaggcug

SEQ ID NO: 1203648 - RNA, 18 nt, Human
cucacuguugcccaggcu

SEQ ID NO: 1203649 - RNA, 17 nt, Human
cucacuguugcccaggc

SEQ ID NO: 1203650 - RNA, 16 nt, Human
cucacuguugcccagg

SEQ ID NO: 1203651 - RNA, 19 nt, Human
cucagagagggugggagug

SEQ ID NO: 1203652 - RNA, 23 nt, Human
cucagagagggugggagugggcc

SEQ ID NO: 1203653 - RNA, 16 nt, Human
cucacugcagccucaa

SEQ ID NO: 1203654 - RNA, 15 nt, Human
cucacugcagccuca

SEQ ID NO: 1203655 - RNA, 15 nt, Human
cucacuguugcccag

SEQ ID NO: 1203656 - RNA, 14 nt, Human
cucacuguugccca

SEQ ID NO: 1203657 - RNA, 17 nt, Human
cuacccucuuagaaaaa

SEQ ID NO: 1203658 - RNA, 19 nt, Human
cuacccagcgagcccuggu

SEQ ID NO: 1203659 - RNA, 13 nt, Human
cuacccaggugcu

SEQ ID NO: 1203660 - RNA, 18 nt, Human
cuacccagcgagcccugg

SEQ ID NO: 1203661 - RNA, 17 nt, Human
cuacccagcgagcccug

SEQ ID NO: 1203662 - RNA, 15 nt, Human
cuacccagcgagccc

SEQ ID NO: 1203663 - RNA, 13 nt, Human
cuacccacccucc

SEQ ID NO: 1203664 - RNA, 22 nt, Human
cuacauuauaaaugucucuuua

SEQ ID NO: 1203665 - RNA, 14 nt, Human
cuacauucuguuaa

SEQ ID NO: 1203666 - RNA, 13 nt, Human
cuacauucuguua

SEQ ID NO: 1203667 - RNA, 20 nt, Human
cuacauggaguauaugucaa

SEQ ID NO: 1203668 - RNA, 18 nt, Human
cuacauggaguauauguc

SEQ ID NO: 1203669 - RNA, 13 nt, Human
cuacaguccuccc

SEQ ID NO: 1203670 - RNA, 16 nt, Human
cuacaggugugaguca

SEQ ID NO: 1203671 - RNA, 14 nt, Human
cuacaggugugagu

SEQ ID NO: 1203672 - RNA, 17 nt, Human
cuacaggcacccaccau

SEQ ID NO: 1203673 - RNA, 15 nt, Human
cuacaggcacccacc

SEQ ID NO: 1203674 - RNA, 16 nt, Human
cuacaggagugagcac

SEQ ID NO: 1203675 - RNA, 15 nt, Human
cuacaggagugagca

SEQ ID NO: 1203676 - RNA, 14 nt, Human
cuacaggagugagc

SEQ ID NO: 1203677 - RNA, 22 nt, Human
cuacagaggccaugggccuccu

SEQ ID NO: 1203678 - RNA, 20 nt, Human
cuacagaggccaugggccuc

SEQ ID NO: 1203679 - RNA, 18 nt, Human
cuacagaggccaugggcc

SEQ ID NO: 1203680 - RNA, 18 nt, Human
cuacacugugcugagucu

SEQ ID NO: 1203681 - RNA, 17 nt, Human
cuacacugugcugaguc

SEQ ID NO: 1203682 - RNA, 14 nt, Human
cuacacugugcuga

SEQ ID NO: 1203683 - RNA, 13 nt, Human
cuacacugugcug

SEQ ID NO: 1203684 - RNA, 23 nt, Human
cuacagcuugaccgugaggccag

SEQ ID NO: 1203685 - RNA, 22 nt, Human
cuacagcuugaccgugaggcca

SEQ ID NO: 1203686 - RNA, 19 nt, Human
cuacagcuugaccgugagg

SEQ ID NO: 1203687 - RNA, 23 nt, Human
cuaauagacaauuuauuauggca

SEQ ID NO: 1203688 - RNA, 19 nt, Human
cuaauagacaauuuauuau

SEQ ID NO: 1203689 - RNA, 17 nt, Human
cuaauagacaauuuauu

SEQ ID NO: 1203690 - RNA, 22 nt, Human
cuaagcuauucaguaauaacuc

SEQ ID NO: 1203691 - RNA, 21 nt, Human
cuacacaggggaaaagaggag

SEQ ID NO: 1203692 - RNA, 13 nt, Human
cuaaugggacacu

SEQ ID NO: 1203693 - RNA, 12 nt, Human
cuaaugggacac

SEQ ID NO: 1203694 - RNA, 18 nt, Human
cuaauauguaacaagcca

SEQ ID NO: 1203695 - RNA, 14 nt, Human
cuaaccacgcugga

SEQ ID NO: 1203696 - RNA, 12 nt, Human
cuaaccacgcug

SEQ ID NO: 1203697 - RNA, 23 nt, Human
cuaagagggagggagggcuccag

SEQ ID NO: 1203698 - RNA, 22 nt, Human
cuaagagggagggagggcucca

SEQ ID NO: 1203699 - RNA, 15 nt, Human
cuaagagggagggag

SEQ ID NO: 1203700 - RNA, 13 nt, Human
cuaagagggaggg

SEQ ID NO: 1203701 - RNA, 22 nt, Human
cuaaaugaaaaucgugacaaca

SEQ ID NO: 1203702 - RNA, 21 nt, Human
cuaaaucuccaaaauaaaacu

SEQ ID NO: 1203703 - RNA, 23 nt, Human
cgggaggauguucugggacacag

SEQ ID NO: 1203704 - RNA, 20 nt, Human
cgggaagggggcugggacau

SEQ ID NO: 1203705 - RNA, 19 nt, Human
cgggaagggggcugggaca

SEQ ID NO: 1203706 - RNA, 16 nt, Human
cgggaagggggcuggg

SEQ ID NO: 1203707 - RNA, 14 nt, Human
cggcuggccuggcc

SEQ ID NO: 1203708 - RNA, 13 nt, Human
cggcuggccuggc

SEQ ID NO: 1203709 - RNA, 23 nt, Human
cggcuggcagcccaccccucaac

SEQ ID NO: 1203710 - RNA, 24 nt, Human
cggccaggccagagggagugacag

SEQ ID NO: 1203711 - RNA, 20 nt, Human
cggccaggccagagggagug

SEQ ID NO: 1203712 - RNA, 12 nt, Human
cggccaggccag

SEQ ID NO: 1203713 - RNA, 11 nt, Human
cggccaggcca

SEQ ID NO: 1203714 - RNA, 19 nt, Human
cgcgguggcucacgccugu

SEQ ID NO: 1203715 - RNA, 15 nt, Human
cgcgacaaugcaaac

SEQ ID NO: 1203716 - RNA, 14 nt, Human
cgcgacaaugcaaa

SEQ ID NO: 1203717 - RNA, 24 nt, Human
cgcuacccgggaagggggcuggga

SEQ ID NO: 1203718 - RNA, 21 nt, Human
cgcuacccgggaagggggcug

SEQ ID NO: 1203719 - RNA, 18 nt, Human
cgcuacccgggaaggggg

SEQ ID NO: 1203720 - RNA, 21 nt, Human
cgcccagucuggaaugcagug

SEQ ID NO: 1203721 - RNA, 19 nt, Human
cgcccagucuggaaugcag

SEQ ID NO: 1203722 - RNA, 13 nt, Human
cgcccagucugga

SEQ ID NO: 1203723 - RNA, 19 nt, Human
cgcagcccugcagagggca

SEQ ID NO: 1203724 - RNA, 18 nt, Human
cgcagcccugcagagggc

SEQ ID NO: 1203725 - RNA, 23 nt, Human
cgcugugcugcccugcccaccug

SEQ ID NO: 1203726 - RNA, 21 nt, Human
cgcugugcugcccugcccacc

SEQ ID NO: 1203727 - RNA, 19 nt, Human
cgcugugcugcccugccca

SEQ ID NO: 1203728 - RNA, 14 nt, Human
cgcugugcugcccu

SEQ ID NO: 1203729 - RNA, 13 nt, Human
cgcugugcugccc

SEQ ID NO: 1203730 - RNA, 11 nt, Human
cgcugugcugc

SEQ ID NO: 1203731 - RNA, 17 nt, Human
cggaauaguuggcuagg

SEQ ID NO: 1203732 - RNA, 16 nt, Human
cggaauaguuggcuag

SEQ ID NO: 1203733 - RNA, 16 nt, Human
cgcuuucuacccagcg

SEQ ID NO: 1203734 - RNA, 14 nt, Human
cgcuuucuacccag

SEQ ID NO: 1203735 - RNA, 17 nt, Human
cggagaaaggaagggcu

SEQ ID NO: 1203736 - RNA, 15 nt, Human
cggagaaaggaaggg

SEQ ID NO: 1203737 - RNA, 22 nt, Human
cggacagccacggccaggccag

SEQ ID NO: 1203738 - RNA, 21 nt, Human
cggacagccacggccaggcca

SEQ ID NO: 1203739 - RNA, 17 nt, Human
cgcagcccugcagaggg

SEQ ID NO: 1203740 - RNA, 20 nt, Human
cgcagcauauucaggaagcu

SEQ ID NO: 1203741 - RNA, 19 nt, Human
cgcagcauauucaggaagc

SEQ ID NO: 1203742 - RNA, 23 nt, Human
cgcacuucgggaggucgaggcag

SEQ ID NO: 1203743 - RNA, 17 nt, Human
cgcacugggcuugggga

SEQ ID NO: 1203744 - RNA, 13 nt, Human
cgcacugggcuug

SEQ ID NO: 1203745 - RNA, 16 nt, Human
cgaggacagggaggug

SEQ ID NO: 1203746 - RNA, 19 nt, Human
cgagcccugguggcagugg

SEQ ID NO: 1203747 - RNA, 20 nt, Human
ccugugccucugggacugga

SEQ ID NO: 1203748 - RNA, 20 nt, Human
ccugugggcccccaaaugga

SEQ ID NO: 1203749 - RNA, 20 nt, Human
ccuguggaugauaaaacaca

SEQ ID NO: 1203750 - RNA, 19 nt, Human
ccuucauuuggcauucccc

SEQ ID NO: 1203751 - RNA, 16 nt, Human
ccuucucuccagcccc

SEQ ID NO: 1203752 - RNA, 15 nt, Human
ccuucucuccagccc

SEQ ID NO: 1203753 - RNA, 13 nt, Human
ccuucucuccagc

SEQ ID NO: 1203754 - RNA, 12 nt, Human
ccuucucuccag

SEQ ID NO: 1203755 - RNA, 13 nt, Human
ccuuccaggggug

SEQ ID NO: 1203756 - RNA, 17 nt, Human
ccuuccauggacuuugu

SEQ ID NO: 1203757 - RNA, 19 nt, Human
ccuucucuccagccccugg

SEQ ID NO: 1203758 - RNA, 21 nt, Human
ccuuggugucgggcaugacac

SEQ ID NO: 1203759 - RNA, 20 nt, Human
ccuuggugucgggcaugaca

SEQ ID NO: 1203760 - RNA, 19 nt, Human
ccuuggugucgggcaugac

SEQ ID NO: 1203761 - RNA, 14 nt, Human
ccuuggggagcagg

SEQ ID NO: 1203762 - RNA, 16 nt, Human
ccuuggcugcagggag

SEQ ID NO: 1203763 - RNA, 22 nt, Human
ccuuggcucaaguccucuuuuc

SEQ ID NO: 1203764 - RNA, 19 nt, Human
ccuuggauuguccccgacc

SEQ ID NO: 1203765 - RNA, 15 nt, Human
ccuuggauugucccc

SEQ ID NO: 1203766 - RNA, 21 nt, Human
ccuugacagggcacaccgggc

SEQ ID NO: 1203767 - RNA, 18 nt, Human
ccuugacagggcacaccg

SEQ ID NO: 1203768 - RNA, 18 nt, Human
ccuucucuccagccccug

SEQ ID NO: 1203769 - RNA, 17 nt, Human
ccuucucuccagccccu

SEQ ID NO: 1203770 - RNA, 14 nt, Human
ccuuuguccccacc

SEQ ID NO: 1203771 - RNA, 18 nt, Human
ccuuuguccccaccgcag

SEQ ID NO: 1203772 - RNA, 16 nt, Human
ccuuuguccccaccgc

SEQ ID NO: 1203773 - RNA, 23 nt, Human
ccuuuguauucucuccuguaccu

SEQ ID NO: 1203774 - RNA, 22 nt, Human
ccuuuguauucucuccuguacc

SEQ ID NO: 1203775 - RNA, 24 nt, Human
ccuuuguauucucuccuguaccuc

SEQ ID NO: 1203776 - RNA, 15 nt, Human
ccuuuuuuggcugcu

SEQ ID NO: 1203777 - RNA, 23 nt, Human
ccuuugugaggaagccgcugggg

SEQ ID NO: 1203778 - RNA, 17 nt, Human
ccuuugugaggaagccg

SEQ ID NO: 1203779 - RNA, 16 nt, Human
ccuuugugaggaagcc

SEQ ID NO: 1203780 - RNA, 15 nt, Human
ccuuugugaggaagc

SEQ ID NO: 1203781 - RNA, 23 nt, Human
ccuuuguccccaccgcagacagg

SEQ ID NO: 1203782 - RNA, 22 nt, Human
ccuuuguccccaccgcagacag

SEQ ID NO: 1203783 - RNA, 14 nt, Human
ccuuugugaggaag

SEQ ID NO: 1203784 - RNA, 23 nt, Human
cgaacauguuuuucuucucccuc

SEQ ID NO: 1203785 - RNA, 21 nt, Human
cgaacauguuuuucuucuccc

SEQ ID NO: 1203786 - RNA, 22 nt, Human
ccuuuuuuggcugcugaaggcu

SEQ ID NO: 1203787 - RNA, 20 nt, Human
ccuuuuuuggcugcugaagg

SEQ ID NO: 1203788 - RNA, 18 nt, Human
ccuuuuuuggcugcugaa

SEQ ID NO: 1203789 - RNA, 17 nt, Human
ccuuuuuuggcugcuga

SEQ ID NO: 1203790 - RNA, 23 nt, Human
cgaaagggacuuggaagcuccgc

SEQ ID NO: 1203791 - RNA, 17 nt, Human
cgaauauugcugauggu

SEQ ID NO: 1203792 - RNA, 15 nt, Human
cgaauauugcugaug

SEQ ID NO: 1203793 - RNA, 14 nt, Human
cgaauauugcugau

SEQ ID NO: 1203794 - RNA, 12 nt, Human
cgaauauugcug

SEQ ID NO: 1203795 - RNA, 11 nt, Human
cgaauauugcu

SEQ ID NO: 1203796 - RNA, 16 nt, Human
cgaauagcugggacua

SEQ ID NO: 1203797 - RNA, 22 nt, Human
ccugcccuuaccugccaggaag

SEQ ID NO: 1203798 - RNA, 21 nt, Human
ccugcccuuaccugccaggaa

SEQ ID NO: 1203799 - RNA, 19 nt, Human
ccugcccuuaccugccagg

SEQ ID NO: 1203800 - RNA, 15 nt, Human
ccugcccugugggcc

SEQ ID NO: 1203801 - RNA, 14 nt, Human
ccugccuguugggc

SEQ ID NO: 1203802 - RNA, 14 nt, Human
ccugccucagccuc

SEQ ID NO: 1203803 - RNA, 13 nt, Human
ccugccucagccu

SEQ ID NO: 1203804 - RNA, 12 nt, Human
ccugccucagcc

SEQ ID NO: 1203805 - RNA, 14 nt, Human
ccugcccugugggc

SEQ ID NO: 1203806 - RNA, 12 nt, Human
ccugcccugugg

SEQ ID NO: 1203807 - RNA, 11 nt, Human
ccugcccugug

SEQ ID NO: 1203808 - RNA, 15 nt, Human
ccugccaggcauggu

SEQ ID NO: 1203809 - RNA, 12 nt, Human
ccugccaggcau

SEQ ID NO: 1203810 - RNA, 16 nt, Human
ccugcccggcugcgga

SEQ ID NO: 1203811 - RNA, 14 nt, Human
ccugcccggcugcg

SEQ ID NO: 1203812 - RNA, 22 nt, Human
ccugccuguugggccaggagcc

SEQ ID NO: 1203813 - RNA, 18 nt, Human
ccugaaagcccugagcuu

SEQ ID NO: 1203814 - RNA, 14 nt, Human
ccugaaagcccuga

SEQ ID NO: 1203815 - RNA, 13 nt, Human
ccugaaagcccug

SEQ ID NO: 1203816 - RNA, 22 nt, Human
ccugaaggccccgcccaggcuu

SEQ ID NO: 1203817 - RNA, 21 nt, Human
ccugaaggccccgcccaggcu

SEQ ID NO: 1203818 - RNA, 20 nt, Human
ccugaaggccccgcccaggc

SEQ ID NO: 1203819 - RNA, 19 nt, Human
ccugaaggccccgcccagg

SEQ ID NO: 1203820 - RNA, 18 nt, Human
ccugaaggccccgcccag

SEQ ID NO: 1203821 - RNA, 15 nt, Human
ccugagcugggauga

SEQ ID NO: 1203822 - RNA, 22 nt, Human
ccugccacccuggggagaaagu

SEQ ID NO: 1203823 - RNA, 16 nt, Human
ccugccacccugggga

SEQ ID NO: 1203824 - RNA, 14 nt, Human
ccugccacccuggg

SEQ ID NO: 1203825 - RNA, 13 nt, Human
ccugccacccugg

SEQ ID NO: 1203826 - RNA, 12 nt, Human
ccugccacccug

SEQ ID NO: 1203827 - RNA, 19 nt, Human
ccugccaauggacuaacuu

SEQ ID NO: 1203828 - RNA, 16 nt, Human
ccugcacuugcagacu

SEQ ID NO: 1203829 - RNA, 16 nt, Human
ccugaggcugggcucc

SEQ ID NO: 1203830 - RNA, 15 nt, Human
ccugaggcugggcuc

SEQ ID NO: 1203831 - RNA, 14 nt, Human
ccugaggcugggcu

SEQ ID NO: 1203832 - RNA, 13 nt, Human
ccugaggcugggc

SEQ ID NO: 1203833 - RNA, 18 nt, Human
ccugaggcccagagggcc

SEQ ID NO: 1203834 - RNA, 17 nt, Human
ccugaggcccagagggc

SEQ ID NO: 1203835 - RNA, 16 nt, Human
ccugaggcccagaggg

SEQ ID NO: 1203836 - RNA, 15 nt, Human
ccugaggcccagagg

SEQ ID NO: 1203837 - RNA, 12 nt, Human
ccugagcuggga

SEQ ID NO: 1203838 - RNA, 20 nt, Human
ccugagccagauuucacucu

SEQ ID NO: 1203839 - RNA, 18 nt, Human
ccugagccagauuucacu

SEQ ID NO: 1203840 - RNA, 16 nt, Human
ccugagccagauuuca

SEQ ID NO: 1203841 - RNA, 15 nt, Human
ccugagccagauuuc

SEQ ID NO: 1203842 - RNA, 20 nt, Human
ccugaagucacacagugagu

SEQ ID NO: 1203843 - RNA, 22 nt, Human
ccugaagucuuuguacagacaa

SEQ ID NO: 1203844 - RNA, 12 nt, Human
ccuggcacugcu

SEQ ID NO: 1203845 - RNA, 21 nt, Human
ccuggcacccggccccugcug

SEQ ID NO: 1203846 - RNA, 20 nt, Human
ccuggcacccggccccugcu

SEQ ID NO: 1203847 - RNA, 19 nt, Human
ccuggcacccggccccugc

SEQ ID NO: 1203848 - RNA, 21 nt, Human
ccugcuaauuccccagauugc

SEQ ID NO: 1203849 - RNA, 20 nt, Human
ccugccuguugggccaggag

SEQ ID NO: 1203850 - RNA, 19 nt, Human
ccugccuguugggccagga

SEQ ID NO: 1203851 - RNA, 18 nt, Human
ccugccuguugggccagg

SEQ ID NO: 1203852 - RNA, 13 nt, Human
ccuggcaugggaa

SEQ ID NO: 1203853 - RNA, 17 nt, Human
ccuggcacugcuuccag

SEQ ID NO: 1203854 - RNA, 16 nt, Human
ccuggcacugcuucca

SEQ ID NO: 1203855 - RNA, 13 nt, Human
ccuggcacugcuu

SEQ ID NO: 1203856 - RNA, 23 nt, Human
ccuggccagaugcaccagcccuu

SEQ ID NO: 1203857 - RNA, 21 nt, Human
ccuggccagaugcaccagccc

SEQ ID NO: 1203858 - RNA, 14 nt, Human
ccuggcccacugca

SEQ ID NO: 1203859 - RNA, 13 nt, Human
ccuggcccacugc

SEQ ID NO: 1203860 - RNA, 21 nt, Human
ccugggggcugggcagaggaa

SEQ ID NO: 1203861 - RNA, 20 nt, Human
ccugggggcugggcagagga

SEQ ID NO: 1203862 - RNA, 19 nt, Human
ccugggggcugggcagagg

SEQ ID NO: 1203863 - RNA, 16 nt, Human
ccugggagugagcugg

SEQ ID NO: 1203864 - RNA, 22 nt, Human
ccugggaggucaaggcugcagu

SEQ ID NO: 1203865 - RNA, 16 nt, Human
ccugggcagaaggaag

SEQ ID NO: 1203866 - RNA, 18 nt, Human
ccugggagugagcugguu

SEQ ID NO: 1203867 - RNA, 16 nt, Human
ccuggcccacugcauc

SEQ ID NO: 1203868 - RNA, 14 nt, Human
ccuggcaugggaau

SEQ ID NO: 1203869 - RNA, 18 nt, Human
ccugguggcagcugcggu

SEQ ID NO: 1203870 - RNA, 17 nt, Human
ccugguggcagcugcgg

SEQ ID NO: 1203871 - RNA, 16 nt, Human
ccugguggcagcugcg

SEQ ID NO: 1203872 - RNA, 15 nt, Human
ccugguggcagcugc

SEQ ID NO: 1203873 - RNA, 14 nt, Human
ccugguggcagcug

SEQ ID NO: 1203874 - RNA, 22 nt, Human
ccugguggcagcucaccucucc

SEQ ID NO: 1203875 - RNA, 21 nt, Human
ccugguggcagcucaccucuc

SEQ ID NO: 1203876 - RNA, 19 nt, Human
ccugguggcagcucaccuc

SEQ ID NO: 1203877 - RNA, 12 nt, Human
ccuguaccucuu

SEQ ID NO: 1203878 - RNA, 10 nt, Human
ccuguaccuc

SEQ ID NO: 1203879 - RNA, 15 nt, Human
ccugguggcaguggg

SEQ ID NO: 1203880 - RNA, 14 nt, Human
ccugguggcagugg

SEQ ID NO: 1203881 - RNA, 13 nt, Human
ccugguggcagug

SEQ ID NO: 1203882 - RNA, 19 nt, Human
ccuguagagugggagcuga

SEQ ID NO: 1203883 - RNA, 16 nt, Human
ccuguagagugggagc

SEQ ID NO: 1203884 - RNA, 15 nt, Human
ccuguagagugggag

SEQ ID NO: 1203885 - RNA, 13 nt, Human
ccuguagcccuaa

SEQ ID NO: 1203886 - RNA, 16 nt, Human
ccugucccccugacaa

SEQ ID NO: 1203887 - RNA, 15 nt, Human
ccugucccccugaca

SEQ ID NO: 1203888 - RNA, 14 nt, Human
ccugucccccugac

SEQ ID NO: 1203889 - RNA, 13 nt, Human
ccugucccccuga

SEQ ID NO: 1203890 - RNA, 12 nt, Human
ccugucccccug

SEQ ID NO: 1203891 - RNA, 21 nt, Human
ccuacaguugaaaaacagcug

SEQ ID NO: 1203892 - RNA, 18 nt, Human
ccgugaggccagagacac

SEQ ID NO: 1203893 - RNA, 22 nt, Human
ccgggcucugccucccaucacc

SEQ ID NO: 1203894 - RNA, 18 nt, Human
ccgggcucugccucccau

SEQ ID NO: 1203895 - RNA, 15 nt, Human
ccgggcucugccucc

SEQ ID NO: 1203896 - RNA, 14 nt, Human
ccgggcucugccuc

SEQ ID NO: 1203897 - RNA, 13 nt, Human
ccgggccacagag

SEQ ID NO: 1203898 - RNA, 22 nt, Human
ccgggcacucagaagacacuga

SEQ ID NO: 1203899 - RNA, 21 nt, Human
ccggcuccaggcuccuuuagc

SEQ ID NO: 1203900 - RNA, 16 nt, Human
ccggcuccaggcuccu

SEQ ID NO: 1203901 - RNA, 11 nt, Human
ccgcuggggcc

SEQ ID NO: 1203902 - RNA, 14 nt, Human
ccgcuggggccagu

SEQ ID NO: 1203903 - RNA, 18 nt, Human
ccgagauagccaaggcca

SEQ ID NO: 1203904 - RNA, 21 nt, Human
ccgagauugcaccacugcacu

SEQ ID NO: 1203905 - RNA, 19 nt, Human
ccgagauugcaccacugca

SEQ ID NO: 1203906 - RNA, 15 nt, Human
ccgagauugcaccac

SEQ ID NO: 1203907 - RNA, 15 nt, Human
ccgcagacaggacca

SEQ ID NO: 1203908 - RNA, 23 nt, Human
ccgcacugggcuuggggaccaga

SEQ ID NO: 1203909 - RNA, 19 nt, Human
ccgagcuuugaaaauucag

SEQ ID NO: 1203910 - RNA, 16 nt, Human
ccgaguagcugggacu

SEQ ID NO: 1203911 - RNA, 14 nt, Human
ccgaguagcuggga

SEQ ID NO: 1203912 - RNA, 12 nt, Human
cccugaggccca

SEQ ID NO: 1203913 - RNA, 14 nt, Human
cccugccuccuuug

SEQ ID NO: 1203914 - RNA, 11 nt, Human
cccugccuccu

SEQ ID NO: 1203915 - RNA, 21 nt, Human
cccugcucuccgaccagacac

SEQ ID NO: 1203916 - RNA, 22 nt, Human
cccugcucuccgaccagacacc

SEQ ID NO: 1203917 - RNA, 12 nt, Human
cccuuccaugga

SEQ ID NO: 1203918 - RNA, 23 nt, Human
cccuuagcagggaaacagcuaau

SEQ ID NO: 1203919 - RNA, 17 nt, Human
cccuuacgugaguccug

SEQ ID NO: 1203920 - RNA, 15 nt, Human
cccuuacgugagucc

SEQ ID NO: 1203921 - RNA, 14 nt, Human
cccuuagcagggaa

SEQ ID NO: 1203922 - RNA, 23 nt, Human
cccuuaccugccaggaagccagc

SEQ ID NO: 1203923 - RNA, 20 nt, Human
cccuuaccugccaggaagcc

SEQ ID NO: 1203924 - RNA, 17 nt, Human
cccuuaccugccaggaa

SEQ ID NO: 1203925 - RNA, 19 nt, Human
cccuguuuguuucugaaag

SEQ ID NO: 1203926 - RNA, 14 nt, Human
cccuguucuggcag

SEQ ID NO: 1203927 - RNA, 13 nt, Human
cccuguucuggca

SEQ ID NO: 1203928 - RNA, 15 nt, Human
cccugguggcagugg

SEQ ID NO: 1203929 - RNA, 14 nt, Human
cccugguggcagug

SEQ ID NO: 1203930 - RNA, 13 nt, Human
cccugguggcagu

SEQ ID NO: 1203931 - RNA, 21 nt, Human
cccugguggcagcucaccucu

SEQ ID NO: 1203932 - RNA, 13 nt, Human
cccugaggcccag

SEQ ID NO: 1203933 - RNA, 20 nt, Human
cccucuuucccucccuuccu

SEQ ID NO: 1203934 - RNA, 17 nt, Human
cccucuuucccucccuu

SEQ ID NO: 1203935 - RNA, 12 nt, Human
cccucuuucccu

SEQ ID NO: 1203936 - RNA, 12 nt, Human
cccucuggggcu

SEQ ID NO: 1203937 - RNA, 18 nt, Human
cccucugcccacucccug

SEQ ID NO: 1203938 - RNA, 15 nt, Human
cccucugcccacucc

SEQ ID NO: 1203939 - RNA, 11 nt, Human
cccucugccca

SEQ ID NO: 1203940 - RNA, 19 nt, Human
cccucugcccacucccugc

SEQ ID NO: 1203941 - RNA, 20 nt, Human
ccccuguucuggcagaguug

SEQ ID NO: 1203942 - RNA, 20 nt, Human
ccccuuccauggacuuuguu

SEQ ID NO: 1203943 - RNA, 13 nt, Human
ccccuuccaugga

SEQ ID NO: 1203944 - RNA, 23 nt, Human
cccgcuaagagggagggagggcu

SEQ ID NO: 1203945 - RNA, 22 nt, Human
cccgcccaggcuuagucacuga

SEQ ID NO: 1203946 - RNA, 20 nt, Human
cccgcccaggcuuagucacu

SEQ ID NO: 1203947 - RNA, 19 nt, Human
ccccuggaugcagccucac

SEQ ID NO: 1203948 - RNA, 18 nt, Human
ccccuggaugcagccuca

SEQ ID NO: 1203949 - RNA, 15 nt, Human
ccccuggaugcagcc

SEQ ID NO: 1203950 - RNA, 20 nt, Human
ccccugcugguucaggguug

SEQ ID NO: 1203951 - RNA, 15 nt, Human
ccccugcugguucag

SEQ ID NO: 1203952 - RNA, 13 nt, Human
ccccugcugguuc

SEQ ID NO: 1203953 - RNA, 11 nt, Human
ccccugcuggu

SEQ ID NO: 1203954 - RNA, 17 nt, Human
ccccugcuggguguggc

SEQ ID NO: 1203955 - RNA, 14 nt, Human
ccccugcugggugu

SEQ ID NO: 1203956 - RNA, 19 nt, Human
ccccugcccggcugcggaa

SEQ ID NO: 1203957 - RNA, 17 nt, Human
ccccugcccggcugcgg

SEQ ID NO: 1203958 - RNA, 23 nt, Human
ccccucaacucuccuccagaguc

SEQ ID NO: 1203959 - RNA, 16 nt, Human
ccccucaacaccucug

SEQ ID NO: 1203960 - RNA, 15 nt, Human
ccccucaacaccucu

SEQ ID NO: 1203961 - RNA, 12 nt, Human
cccccagccugc

SEQ ID NO: 1203962 - RNA, 19 nt, Human
cccccugacaacacucauu

SEQ ID NO: 1203963 - RNA, 17 nt, Human
cccccugacaacacuca

SEQ ID NO: 1203964 - RNA, 16 nt, Human
ccccucagggucccug

SEQ ID NO: 1203965 - RNA, 12 nt, Human
ccccuccaugug

SEQ ID NO: 1203966 - RNA, 15 nt, Human
cccccacuggugaca

SEQ ID NO: 1203967 - RNA, 13 nt, Human
cccccacugguga

SEQ ID NO: 1203968 - RNA, 11 nt, Human
cccccacuggu

SEQ ID NO: 1203969 - RNA, 24 nt, Human
cccccacccaagggccuggccuga

SEQ ID NO: 1203970 - RNA, 13 nt, Human
cccccacccaagg

SEQ ID NO: 1203971 - RNA, 17 nt, Human
ccccauccucuguacag

SEQ ID NO: 1203972 - RNA, 14 nt, Human
ccccauccucugua

SEQ ID NO: 1203973 - RNA, 20 nt, Human
ccccagugcccacaggauca

SEQ ID NO: 1203974 - RNA, 16 nt, Human
ccccagugcccacagg

SEQ ID NO: 1203975 - RNA, 15 nt, Human
ccccagugcccacag

SEQ ID NO: 1203976 - RNA, 14 nt, Human
ccccagugcccaca

SEQ ID NO: 1203977 - RNA, 19 nt, Human
cccaucucuacaaaaagca

SEQ ID NO: 1203978 - RNA, 14 nt, Human
cccaguugggugga

SEQ ID NO: 1203979 - RNA, 14 nt, Human
cccaugagccucag

SEQ ID NO: 1203980 - RNA, 12 nt, Human
cccaucugugaa

SEQ ID NO: 1203981 - RNA, 19 nt, Human
ccccaccgcagacaggacc

SEQ ID NO: 1203982 - RNA, 15 nt, Human
ccccaccgcagacag

SEQ ID NO: 1203983 - RNA, 14 nt, Human
cccacgcuggagug

SEQ ID NO: 1203984 - RNA, 16 nt, Human
cccaccuuggcugcag

SEQ ID NO: 1203985 - RNA, 19 nt, Human
cccacgcccccacugguga

SEQ ID NO: 1203986 - RNA, 17 nt, Human
cccacgcccccacuggu

SEQ ID NO: 1203987 - RNA, 15 nt, Human
cccaccuuggcugca

SEQ ID NO: 1203988 - RNA, 14 nt, Human
cccaccuuggcugc

SEQ ID NO: 1203989 - RNA, 22 nt, Human
cccaccuuggcucaaguccucu

SEQ ID NO: 1203990 - RNA, 15 nt, Human
cccaccuuggcucaa

SEQ ID NO: 1203991 - RNA, 12 nt, Human
cccaccuuggcu

SEQ ID NO: 1203992 - RNA, 17 nt, Human
cccaccucagccucccg

SEQ ID NO: 1203993 - RNA, 19 nt, Human
cccaccucucucacuccuu

SEQ ID NO: 1203994 - RNA, 17 nt, Human
cccaccucucucacucc

SEQ ID NO: 1203995 - RNA, 14 nt, Human
cccaccucucucac

SEQ ID NO: 1203996 - RNA, 13 nt, Human
cccaccucucuca

SEQ ID NO: 1203997 - RNA, 21 nt, Human
cccaccucagccucccaaagu

SEQ ID NO: 1203998 - RNA, 15 nt, Human
cccaccucagccucc

SEQ ID NO: 1203999 - RNA, 14 nt, Human
cccaccucagccuc

SEQ ID NO: 1204000 - RNA, 12 nt, Human
cccaccucagcc

SEQ ID NO: 1204001 - RNA, 23 nt, Human
ccauuuuggauucuuauggacaa

SEQ ID NO: 1204002 - RNA, 20 nt, Human
ccauuuugcugucccuuuuc

SEQ ID NO: 1204003 - RNA, 14 nt, Human
cccaagggccuggc

SEQ ID NO: 1204004 - RNA, 12 nt, Human
cccaagggccug

SEQ ID NO: 1204005 - RNA, 17 nt, Human
cccaagggccuggccug

SEQ ID NO: 1204006 - RNA, 16 nt, Human
cccaagggccuggccu

SEQ ID NO: 1204007 - RNA, 17 nt, Human
cccacaggaucagucug

SEQ ID NO: 1204008 - RNA, 14 nt, Human
ccauucuccaccug

SEQ ID NO: 1204009 - RNA, 16 nt, Human
ccauucugccugccca

SEQ ID NO: 1204010 - RNA, 15 nt, Human
ccauucugccugccc

SEQ ID NO: 1204011 - RNA, 13 nt, Human
ccauuugcuccuu

SEQ ID NO: 1204012 - RNA, 20 nt, Human
ccaggaggccagccuugacc

SEQ ID NO: 1204013 - RNA, 18 nt, Human
ccaggaggccagccuuga

SEQ ID NO: 1204014 - RNA, 15 nt, Human
ccaggaggccagccu

SEQ ID NO: 1204015 - RNA, 19 nt, Human
ccaggccccugccacccug

SEQ ID NO: 1204016 - RNA, 14 nt, Human
ccaggcccucugcc

SEQ ID NO: 1204017 - RNA, 13 nt, Human
ccaggcccucugc

SEQ ID NO: 1204018 - RNA, 16 nt, Human
ccaggccccugccacc

SEQ ID NO: 1204019 - RNA, 15 nt, Human
ccaggccccugccac

SEQ ID NO: 1204020 - RNA, 14 nt, Human
ccaggccccugcca

SEQ ID NO: 1204021 - RNA, 12 nt, Human
ccaggccagagg

SEQ ID NO: 1204022 - RNA, 23 nt, Human
ccaggcuuagucacugagacagc

SEQ ID NO: 1204023 - RNA, 22 nt, Human
ccaggcuuagucacugagacag

SEQ ID NO: 1204024 - RNA, 21 nt, Human
ccaggcuuagucacugagaca

SEQ ID NO: 1204025 - RNA, 14 nt, Human
ccaggcuggucuca

SEQ ID NO: 1204026 - RNA, 16 nt, Human
ccaggcccucugccca

SEQ ID NO: 1204027 - RNA, 15 nt, Human
ccaggcccucugccc

SEQ ID NO: 1204028 - RNA, 23 nt, Human
ccagugcccacaggaucagucug

SEQ ID NO: 1204029 - RNA, 15 nt, Human
ccaucucuccuccuu

SEQ ID NO: 1204030 - RNA, 21 nt, Human
ccaucucacacaugagcauca

SEQ ID NO: 1204031 - RNA, 20 nt, Human
ccaucucacacaugagcauc

SEQ ID NO: 1204032 - RNA, 18 nt, Human
ccaucucacacaugagca

SEQ ID NO: 1204033 - RNA, 17 nt, Human
ccaucucacacaugagc

SEQ ID NO: 1204034 - RNA, 15 nt, Human
ccaucucacacauga

SEQ ID NO: 1204035 - RNA, 14 nt, Human
ccaucucacacaug

SEQ ID NO: 1204036 - RNA, 17 nt, Human
ccaucauugaaaucuuu

SEQ ID NO: 1204037 - RNA, 16 nt, Human
ccaucauugaaaucuu

SEQ ID NO: 1204038 - RNA, 14 nt, Human
ccaucauugaaauc

SEQ ID NO: 1204039 - RNA, 12 nt, Human
ccaucauugaaa

SEQ ID NO: 1204040 - RNA, 13 nt, Human
ccaucaugucugg

SEQ ID NO: 1204041 - RNA, 12 nt, Human
ccaucaugucug

SEQ ID NO: 1204042 - RNA, 19 nt, Human
ccauauuaccacagacaua

SEQ ID NO: 1204043 - RNA, 16 nt, Human
ccaucaagccaccaac

SEQ ID NO: 1204044 - RNA, 14 nt, Human
ccaucaagccacca

SEQ ID NO: 1204045 - RNA, 13 nt, Human
ccaucaagccacc

SEQ ID NO: 1204046 - RNA, 23 nt, Human
ccagugugacaaggauugcuacu

SEQ ID NO: 1204047 - RNA, 14 nt, Human
ccagugugacaagg

SEQ ID NO: 1204048 - RNA, 15 nt, Human
ccauaugccugggca

SEQ ID NO: 1204049 - RNA, 13 nt, Human
ccagugaggcucu

SEQ ID NO: 1204050 - RNA, 23 nt, Human
ccaguaaaugggggugcauuuga

SEQ ID NO: 1204051 - RNA, 22 nt, Human
ccaguaaaugggggugcauuug

SEQ ID NO: 1204052 - RNA, 21 nt, Human
ccaguaaaugggggugcauuu

SEQ ID NO: 1204053 - RNA, 20 nt, Human
ccaguaaaugggggugcauu

SEQ ID NO: 1204054 - RNA, 16 nt, Human
ccagguuucuaugugu

SEQ ID NO: 1204055 - RNA, 13 nt, Human
ccagguuuaagcu

SEQ ID NO: 1204056 - RNA, 15 nt, Human
ccagacccggcugcg

SEQ ID NO: 1204057 - RNA, 14 nt, Human
ccagacccggcugc

SEQ ID NO: 1204058 - RNA, 16 nt, Human
ccagacccggcugcgu

SEQ ID NO: 1204059 - RNA, 22 nt, Human
ccagacacauguccaagaagcc

SEQ ID NO: 1204060 - RNA, 20 nt, Human
ccagacacauguccaagaag

SEQ ID NO: 1204061 - RNA, 17 nt, Human
ccagacacauguccaag

SEQ ID NO: 1204062 - RNA, 22 nt, Human
ccagaagaaaauagugguguga

SEQ ID NO: 1204063 - RNA, 19 nt, Human
ccacugugccaugugccag

SEQ ID NO: 1204064 - RNA, 16 nt, Human
ccacugugccaugugc

SEQ ID NO: 1204065 - RNA, 15 nt, Human
ccacugugccaugug

SEQ ID NO: 1204066 - RNA, 15 nt, Human
ccacugugaagagaa

SEQ ID NO: 1204067 - RNA, 14 nt, Human
ccacugugaagaga

SEQ ID NO: 1204068 - RNA, 23 nt, Human
ccacuggugacaugucuuuucuu

SEQ ID NO: 1204069 - RNA, 15 nt, Human
ccacugcucugguua

SEQ ID NO: 1204070 - RNA, 13 nt, Human
ccacugcucuggu

SEQ ID NO: 1204071 - RNA, 12 nt, Human
ccacugcucugg

SEQ ID NO: 1204072 - RNA, 22 nt, Human
ccacugcuuuuggucuguguga

SEQ ID NO: 1204073 - RNA, 20 nt, Human
ccacugcuuuuggucugugu

SEQ ID NO: 1204074 - RNA, 23 nt, Human
ccacugcaucguuucaucuucca

SEQ ID NO: 1204075 - RNA, 21 nt, Human
ccacugcaucguuucaucuuc

SEQ ID NO: 1204076 - RNA, 19 nt, Human
ccacccccacccaagggcc

SEQ ID NO: 1204077 - RNA, 14 nt, Human
ccacccuccuuuca

SEQ ID NO: 1204078 - RNA, 14 nt, Human
ccaccuggccucug

SEQ ID NO: 1204079 - RNA, 20 nt, Human
ccaccuggccucugcacucc

SEQ ID NO: 1204080 - RNA, 13 nt, Human
ccaccuggccucu

SEQ ID NO: 1204081 - RNA, 16 nt, Human
ccaccugccagggaca

SEQ ID NO: 1204082 - RNA, 15 nt, Human
ccaccugccagggac

SEQ ID NO: 1204083 - RNA, 14 nt, Human
ccaccugccaggga

SEQ ID NO: 1204084 - RNA, 13 nt, Human
ccaccugccaggg

SEQ ID NO: 1204085 - RNA, 20 nt, Human
ccaccucucucacuccuuga

SEQ ID NO: 1204086 - RNA, 19 nt, Human
ccaccucucucacuccuug

SEQ ID NO: 1204087 - RNA, 16 nt, Human
ccaccucucucacucc

SEQ ID NO: 1204088 - RNA, 14 nt, Human
ccaccucucucacu

SEQ ID NO: 1204089 - RNA, 13 nt, Human
ccacccugcucuc

SEQ ID NO: 1204090 - RNA, 12 nt, Human
ccacccugcucu

SEQ ID NO: 1204091 - RNA, 11 nt, Human
ccacccugcuc

SEQ ID NO: 1204092 - RNA, 13 nt, Human
ccaccuuggcuca

SEQ ID NO: 1204093 - RNA, 19 nt, Human
ccagccccaaaacucuccu

SEQ ID NO: 1204094 - RNA, 23 nt, Human
ccagccgagauagccaaggccaa

SEQ ID NO: 1204095 - RNA, 22 nt, Human
ccagccgagauagccaaggcca

SEQ ID NO: 1204096 - RNA, 20 nt, Human
ccagccgagauagccaaggc

SEQ ID NO: 1204097 - RNA, 17 nt, Human
ccagccgagauagccaa

SEQ ID NO: 1204098 - RNA, 17 nt, Human
ccagcccacuucugcca

SEQ ID NO: 1204099 - RNA, 16 nt, Human
ccagcccacuucugcc

SEQ ID NO: 1204100 - RNA, 23 nt, Human
ccagcaggcucucaggccagcug

SEQ ID NO: 1204101 - RNA, 21 nt, Human
ccagcaggcucucaggccagc

SEQ ID NO: 1204102 - RNA, 20 nt, Human
ccagcaggcucucaggccag

SEQ ID NO: 1204103 - RNA, 19 nt, Human
ccagcaggcucucaggcca

SEQ ID NO: 1204104 - RNA, 13 nt, Human
ccagcgagcccug

SEQ ID NO: 1204105 - RNA, 23 nt, Human
ccagccuugaccauucuccaccu

SEQ ID NO: 1204106 - RNA, 13 nt, Human
ccagccuggguga

SEQ ID NO: 1204107 - RNA, 19 nt, Human
ccagauuucacucuccuug

SEQ ID NO: 1204108 - RNA, 18 nt, Human
ccagauuucacucuccuu

SEQ ID NO: 1204109 - RNA, 23 nt, Human
ccagauugcaacaggcugggcuu

SEQ ID NO: 1204110 - RNA, 22 nt, Human
ccagauugcaacaggcugggcu

SEQ ID NO: 1204111 - RNA, 18 nt, Human
ccagauugcaacaggcug

SEQ ID NO: 1204112 - RNA, 16 nt, Human
ccagauugcaacaggc

SEQ ID NO: 1204113 - RNA, 14 nt, Human
ccagauugcaacag

SEQ ID NO: 1204114 - RNA, 14 nt, Human
ccagagcccaccuu

SEQ ID NO: 1204115 - RNA, 20 nt, Human
ccagcaagugagagcugggu

SEQ ID NO: 1204116 - RNA, 19 nt, Human
ccagcaagugagagcuggg

SEQ ID NO: 1204117 - RNA, 18 nt, Human
ccagcaagugagagcugg

SEQ ID NO: 1204118 - RNA, 17 nt, Human
ccagcaagugagagcug

SEQ ID NO: 1204119 - RNA, 18 nt, Human
ccagcaggcucucaggcc

SEQ ID NO: 1204120 - RNA, 17 nt, Human
ccagcaggcucucaggc

SEQ ID NO: 1204121 - RNA, 16 nt, Human
ccagcaggcucucagg

SEQ ID NO: 1204122 - RNA, 18 nt, Human
ccagcaccaucucuccuc

SEQ ID NO: 1204123 - RNA, 17 nt, Human
ccagcaccaucucuccu

SEQ ID NO: 1204124 - RNA, 16 nt, Human
ggccugcaagggagug

SEQ ID NO: 1204125 - RNA, 16 nt, Human
ggccuggccagaugca

SEQ ID NO: 1204126 - RNA, 15 nt, Human
ggccuggccagaugc

SEQ ID NO: 1204127 - RNA, 12 nt, Human
ggccuggccaga

SEQ ID NO: 1204128 - RNA, 16 nt, Human
ggcuagagguucaaag

SEQ ID NO: 1204129 - RNA, 14 nt, Human
ggcuaccuuuguau

SEQ ID NO: 1204130 - RNA, 13 nt, Human
ggcuaccuuugua

SEQ ID NO: 1204131 - RNA, 16 nt, Human
ggcuaauguacugcau

SEQ ID NO: 1204132 - RNA, 20 nt, Human
ggcuaagugauccucccacc

SEQ ID NO: 1204133 - RNA, 14 nt, Human
ggcgugcaguggug

SEQ ID NO: 1204134 - RNA, 23 nt, Human
ggccucccaacucaccccagccc

SEQ ID NO: 1204135 - RNA, 22 nt, Human
ggccucccaacucaccccagcc

SEQ ID NO: 1204136 - RNA, 20 nt, Human
ggccucccaacucaccccag

SEQ ID NO: 1204137 - RNA, 19 nt, Human
ggccucccaacucacccca

SEQ ID NO: 1204138 - RNA, 18 nt, Human
ggccucccaacucacccc

SEQ ID NO: 1204139 - RNA, 13 nt, Human
ggccucagugcca

SEQ ID NO: 1204140 - RNA, 17 nt, Human
ggccagaugcaccagcc

SEQ ID NO: 1204141 - RNA, 16 nt, Human
ggccagaugcaccagc

SEQ ID NO: 1204142 - RNA, 15 nt, Human
ggccagaugcaccag

SEQ ID NO: 1204143 - RNA, 22 nt, Human
ggccagagggagugacagaggc

SEQ ID NO: 1204144 - RNA, 22 nt, Human
aaaaaacugcugacuguuuucu

SEQ ID NO: 1204145 - RNA, 14 nt, Human
ggcuggguuggagg

SEQ ID NO: 1204146 - RNA, 12 nt, Human
aaaaaggcagga

SEQ ID NO: 1204147 - RNA, 21 nt, Human
aaaaaggaugcacagaguugu

SEQ ID NO: 1204148 - RNA, 14 nt, Human
aaaaaggaggaaga

SEQ ID NO: 1204149 - RNA, 15 nt, Human
ggcuggccuggcccc

SEQ ID NO: 1204150 - RNA, 14 nt, Human
ggcuggccuggccc

SEQ ID NO: 1204151 - RNA, 13 nt, Human
ggcuggccuggcc

SEQ ID NO: 1204152 - RNA, 15 nt, Human
ggcucacugcagccu

SEQ ID NO: 1204153 - RNA, 14 nt, Human
ggcucacugcagcc

SEQ ID NO: 1204154 - RNA, 13 nt, Human
ggcucacugcagc

SEQ ID NO: 1204155 - RNA, 20 nt, Human
ggcucuuccaggcugggaga

SEQ ID NO: 1204156 - RNA, 18 nt, Human
ggcucuuccaggcuggga

SEQ ID NO: 1204157 - RNA, 17 nt, Human
ggcucuuccaggcuggg

SEQ ID NO: 1204158 - RNA, 15 nt, Human
ggcucuuccaggcug

SEQ ID NO: 1204159 - RNA, 13 nt, Human
ggcucccuuccca

SEQ ID NO: 1204160 - RNA, 15 nt, Human
ggaguggccacagaa

SEQ ID NO: 1204161 - RNA, 22 nt, Human
ggagugggcccaaugcacuuug

SEQ ID NO: 1204162 - RNA, 12 nt, Human
ggagugggccca

SEQ ID NO: 1204163 - RNA, 16 nt, Human
ggaguggccacagaaa

SEQ ID NO: 1204164 - RNA, 12 nt, Human
ggauuuaacaga

SEQ ID NO: 1204165 - RNA, 20 nt, Human
ggauuguccccgacccuugc

SEQ ID NO: 1204166 - RNA, 16 nt, Human
ggauuguccccgaccc

SEQ ID NO: 1204167 - RNA, 22 nt, Human
ggauuuaacagaaauguacagc

SEQ ID NO: 1204168 - RNA, 17 nt, Human
ggauuuaacagaaaugu

SEQ ID NO: 1204169 - RNA, 16 nt, Human
ggauuuaacagaaaug

SEQ ID NO: 1204170 - RNA, 13 nt, Human
ggauuguccccga

SEQ ID NO: 1204171 - RNA, 14 nt, Human
ggaugaaaaaauaa

SEQ ID NO: 1204172 - RNA, 23 nt, Human
ggauccugagccagauuucacuc

SEQ ID NO: 1204173 - RNA, 20 nt, Human
ggauccugagccagauuuca

SEQ ID NO: 1204174 - RNA, 19 nt, Human
ggauccugagccagauuuc

SEQ ID NO: 1204175 - RNA, 18 nt, Human
ggauccugagccagauuu

SEQ ID NO: 1204176 - RNA, 16 nt, Human
ggauccugagccagau

SEQ ID NO: 1204177 - RNA, 15 nt, Human
ggauccugagccaga

SEQ ID NO: 1204178 - RNA, 16 nt, Human
ggaguucaucuugaau

SEQ ID NO: 1204179 - RNA, 18 nt, Human
ggaucucuugagccuggg

SEQ ID NO: 1204180 - RNA, 13 nt, Human
ggaggggggaggu

SEQ ID NO: 1204181 - RNA, 14 nt, Human
ggaggggggaggug

SEQ ID NO: 1204182 - RNA, 23 nt, Human
ggaggugggauccuccaggugca

SEQ ID NO: 1204183 - RNA, 22 nt, Human
ggaggugggauccuccaggugc

SEQ ID NO: 1204184 - RNA, 22 nt, Human
ggagguaaggaauaccuguccc

SEQ ID NO: 1204185 - RNA, 21 nt, Human
ggagggugacgggggugaacu

SEQ ID NO: 1204186 - RNA, 14 nt, Human
ggcauuugcugaau

SEQ ID NO: 1204187 - RNA, 19 nt, Human
ggccagagggagugacaga

SEQ ID NO: 1204188 - RNA, 17 nt, Human
ggccagagggagugaca

SEQ ID NO: 1204189 - RNA, 18 nt, Human
ggccagagacacaagccu

SEQ ID NO: 1204190 - RNA, 17 nt, Human
ggccagagacacaagcc

SEQ ID NO: 1204191 - RNA, 16 nt, Human
ggccaaaggaagcaca

SEQ ID NO: 1204192 - RNA, 14 nt, Human
ggccaaaggaagca

SEQ ID NO: 1204193 - RNA, 17 nt, Human
ggcauuuguuugaacug

SEQ ID NO: 1204194 - RNA, 21 nt, Human
ggccaaaggaagcacaugccu

SEQ ID NO: 1204195 - RNA, 19 nt, Human
ggccaaaggaagcacaugc

SEQ ID NO: 1204196 - RNA, 18 nt, Human
ggcaggaggaucacuuga

SEQ ID NO: 1204197 - RNA, 14 nt, Human
ggcagccaggccac

SEQ ID NO: 1204198 - RNA, 13 nt, Human
ggcagccaggcca

SEQ ID NO: 1204199 - RNA, 22 nt, Human
ggcacugcuuccagugaggcuc

SEQ ID NO: 1204200 - RNA, 20 nt, Human
ggcacugcuuccagugaggc

SEQ ID NO: 1204201 - RNA, 21 nt, Human
ggcagccccauucugccugcc

SEQ ID NO: 1204202 - RNA, 20 nt, Human
ggcagccccauucugccugc

SEQ ID NO: 1204203 - RNA, 16 nt, Human
ggcagccccauucugc

SEQ ID NO: 1204204 - RNA, 23 nt, Human
ggcagccccauucugccugccca

SEQ ID NO: 1204205 - RNA, 22 nt, Human
ggcagccccauucugccugccc

SEQ ID NO: 1204206 - RNA, 18 nt, Human
ggcacaccgggcacucag

SEQ ID NO: 1204207 - RNA, 16 nt, Human
ggcacugcuuccagug

SEQ ID NO: 1204208 - RNA, 19 nt, Human
ggcacagaaaauggaagac

SEQ ID NO: 1204209 - RNA, 15 nt, Human
ggcaaaaaggcagga

SEQ ID NO: 1204210 - RNA, 20 nt, Human
gguuuguaaauuaacuuuua

SEQ ID NO: 1204211 - RNA, 22 nt, Human
gguuucuaaagcugccagccga

SEQ ID NO: 1204212 - RNA, 16 nt, Human
gguuucuaaagcugcc

SEQ ID NO: 1204213 - RNA, 21 nt, Human
aaaguguauuuuuuuacuaau

SEQ ID NO: 1204214 - RNA, 14 nt, Human
aaaguguauuuuuu

SEQ ID NO: 1204215 - RNA, 21 nt, Human
aaaguaucccuacuguaauuu

SEQ ID NO: 1204216 - RNA, 22 nt, Human
aaaguagaagucuuagauguau

SEQ ID NO: 1204217 - RNA, 20 nt, Human
aaaguagaagucuuagaugu

SEQ ID NO: 1204218 - RNA, 20 nt, Human
aaaguacacuguuucaaacu

SEQ ID NO: 1204219 - RNA, 19 nt, Human
aaaguacacuguuucaaac

SEQ ID NO: 1204220 - RNA, 18 nt, Human
aaaguacacuguuucaaa

SEQ ID NO: 1204221 - RNA, 23 nt, Human
gguguggagaagcggcuggcagc

SEQ ID NO: 1204222 - RNA, 14 nt, Human
gguguggagaagcg

SEQ ID NO: 1204223 - RNA, 13 nt, Human
ggugggggccucg

SEQ ID NO: 1204224 - RNA, 13 nt, Human
ggugugggggaag

SEQ ID NO: 1204225 - RNA, 11 nt, Human
gguguggggga

SEQ ID NO: 1204226 - RNA, 17 nt, Human
gguucccauuugcuccu

SEQ ID NO: 1204227 - RNA, 19 nt, Human
gguguuuccuggcacugcu

SEQ ID NO: 1204228 - RNA, 17 nt, Human
gguguuuccuggcacug

SEQ ID NO: 1204229 - RNA, 22 nt, Human
gguucccuuuuuuggcugcuga

SEQ ID NO: 1204230 - RNA, 23 nt, Human
gguucccuuugacgccaucccag

SEQ ID NO: 1204231 - RNA, 19 nt, Human
gguggggaccucaggccug

SEQ ID NO: 1204232 - RNA, 20 nt, Human
ggugggaggaucucuugagc

SEQ ID NO: 1204233 - RNA, 17 nt, Human
ggugggacacccuguga

SEQ ID NO: 1204234 - RNA, 16 nt, Human
ggugggacacccugug

SEQ ID NO: 1204235 - RNA, 13 nt, Human
ggugggacacccu

SEQ ID NO: 1204236 - RNA, 18 nt, Human
gguggcuggguuggaggg

SEQ ID NO: 1204237 - RNA, 20 nt, Human
aaagggcccagagagggugg

SEQ ID NO: 1204238 - RNA, 20 nt, Human
gguggcaccagcagccugga

SEQ ID NO: 1204239 - RNA, 14 nt, Human
gguggcaccagcag

SEQ ID NO: 1204240 - RNA, 22 nt, Human
aaagcugccagccgagauagcc

SEQ ID NO: 1204241 - RNA, 13 nt, Human
aaagcugccagcc

SEQ ID NO: 1204242 - RNA, 12 nt, Human
aaagcugccagc

SEQ ID NO: 1204243 - RNA, 17 nt, Human
aaagcuaggccuggcca

SEQ ID NO: 1204244 - RNA, 16 nt, Human
aaagcuaggccuggcc

SEQ ID NO: 1204245 - RNA, 14 nt, Human
aaagcuaggccugg

SEQ ID NO: 1204246 - RNA, 16 nt, Human
aaagcagugcaugcug

SEQ ID NO: 1204247 - RNA, 13 nt, Human
aaagcagugcaug

SEQ ID NO: 1204248 - RNA, 15 nt, Human
aaagcagcguuucua

SEQ ID NO: 1204249 - RNA, 15 nt, Human
aaauauaggaacuua

SEQ ID NO: 1204250 - RNA, 21 nt, Human
aaauaccagccaguaaauggg

SEQ ID NO: 1204251 - RNA, 20 nt, Human
aaauaccagccaguaaaugg

SEQ ID NO: 1204252 - RNA, 19 nt, Human
aaauaccagccaguaaaug

SEQ ID NO: 1204253 - RNA, 16 nt, Human
guacacacacauacac

SEQ ID NO: 1204254 - RNA, 23 nt, Human
aaauaucugaaaauguaugugua

SEQ ID NO: 1204255 - RNA, 22 nt, Human
aaauaucugaaaauguaugugu

SEQ ID NO: 1204256 - RNA, 21 nt, Human
aaauaucugaaaauguaugug

SEQ ID NO: 1204257 - RNA, 19 nt, Human
aaauaucugaaaauguaug

SEQ ID NO: 1204258 - RNA, 18 nt, Human
aaauaucugaaaauguau

SEQ ID NO: 1204259 - RNA, 17 nt, Human
aaauaucugaaaaugua

SEQ ID NO: 1204260 - RNA, 14 nt, Human
aaauaucugaaaau

SEQ ID NO: 1204261 - RNA, 12 nt, Human
aaauaucugaaa

SEQ ID NO: 1204262 - RNA, 16 nt, Human
aaaucagcugcuacua

SEQ ID NO: 1204263 - RNA, 23 nt, Human
aaaucagccugcuccagcuguuc

SEQ ID NO: 1204264 - RNA, 21 nt, Human
aaaucagccugcuccagcugu

SEQ ID NO: 1204265 - RNA, 19 nt, Human
aaaucagccugcuccagcu

SEQ ID NO: 1204266 - RNA, 19 nt, Human
aaauauuaagaaagacuau

SEQ ID NO: 1204267 - RNA, 20 nt, Human
guaacaggaaaauuuuaaaa

SEQ ID NO: 1204268 - RNA, 19 nt, Human
guaacaggaaaauuuuaaa

SEQ ID NO: 1204269 - RNA, 16 nt, Human
guaacaagccacccca

SEQ ID NO: 1204270 - RNA, 22 nt, Human
aaauaaugugaaacuggauuaa

SEQ ID NO: 1204271 - RNA, 12 nt, Human
aaaguggugaga

SEQ ID NO: 1204272 - RNA, 22 nt, Human
aaaguguauuuuuuuacuaaua

SEQ ID NO: 1204273 - RNA, 22 nt, Human
guaauuugugauacaaugcugu

SEQ ID NO: 1204274 - RNA, 20 nt, Human
guaauuugugauacaaugcu

SEQ ID NO: 1204275 - RNA, 17 nt, Human
guaauuugugauacaau

SEQ ID NO: 1204276 - RNA, 15 nt, Human
guaauuugugauaca

SEQ ID NO: 1204277 - RNA, 23 nt, Human
guaauccuagcacuuugggaggc

SEQ ID NO: 1204278 - RNA, 20 nt, Human
gguaaggaauaccugucccc

SEQ ID NO: 1204279 - RNA, 14 nt, Human
gguaucaggugcug

SEQ ID NO: 1204280 - RNA, 20 nt, Human
gguaggguaagugagagagg

SEQ ID NO: 1204281 - RNA, 19 nt, Human
gguaucaggugcugccauc

SEQ ID NO: 1204282 - RNA, 22 nt, Human
aaacuugauguguuaucucuua

SEQ ID NO: 1204283 - RNA, 19 nt, Human
gggugggacacccugugau

SEQ ID NO: 1204284 - RNA, 20 nt, Human
ggguuuugccauguuggcca

SEQ ID NO: 1204285 - RNA, 23 nt, Human
ggguuuugccauguuggccaggc

SEQ ID NO: 1204286 - RNA, 13 nt, Human
gguaacaggcaga

SEQ ID NO: 1204287 - RNA, 18 nt, Human
gggugggacacccuguga

SEQ ID NO: 1204288 - RNA, 15 nt, Human
gggugggacacccug

SEQ ID NO: 1204289 - RNA, 14 nt, Human
aaacuuaaucuaaa

SEQ ID NO: 1204290 - RNA, 21 nt, Human
aaacguggcugcuucaaggau

SEQ ID NO: 1204291 - RNA, 22 nt, Human
gggucacucuggcagcucagag

SEQ ID NO: 1204292 - RNA, 20 nt, Human
gggucacucuggcagcucag

SEQ ID NO: 1204293 - RNA, 14 nt, Human
gggucacucuggca

SEQ ID NO: 1204294 - RNA, 19 nt, Human
aaacauuuugucauauaag

SEQ ID NO: 1204295 - RNA, 22 nt, Human
aaaccugugucucugagaguag

SEQ ID NO: 1204296 - RNA, 11 nt, Human
gggggcuggga

SEQ ID NO: 1204297 - RNA, 15 nt, Human
ggggcccugccuccu

SEQ ID NO: 1204298 - RNA, 15 nt, Human
gggggcugggcagag

SEQ ID NO: 1204299 - RNA, 13 nt, Human
ggggguggccucc

SEQ ID NO: 1204300 - RNA, 21 nt, Human
ggggucacucuggcagcucag

SEQ ID NO: 1204301 - RNA, 15 nt, Human
ggggaccagagcugc

SEQ ID NO: 1204302 - RNA, 14 nt, Human
ggggaccagagcug

SEQ ID NO: 1204303 - RNA, 13 nt, Human
ggggaccagagcu

SEQ ID NO: 1204304 - RNA, 12 nt, Human
ggggaccagagc

SEQ ID NO: 1204305 - RNA, 18 nt, Human
aaaauguauguguaagua

SEQ ID NO: 1204306 - RNA, 16 nt, Human
aaaauauuuuccugcc

SEQ ID NO: 1204307 - RNA, 20 nt, Human
aaaauggaagacagcucuua

SEQ ID NO: 1204308 - RNA, 13 nt, Human
aaaauaccaagga

SEQ ID NO: 1204309 - RNA, 14 nt, Human
aaaauaccaaggaa

SEQ ID NO: 1204310 - RNA, 17 nt, Human
aaaagguuaauaaagua

SEQ ID NO: 1204311 - RNA, 16 nt, Human
aaaagguuaauaaagu

SEQ ID NO: 1204312 - RNA, 11 nt, Human
aaaaggcagga

SEQ ID NO: 1204313 - RNA, 22 nt, Human
aaaaggaugcacagaguuguua

SEQ ID NO: 1204314 - RNA, 19 nt, Human
aaaaggaugcacagaguug

SEQ ID NO: 1204315 - RNA, 15 nt, Human
aaaaggaugcacaga

SEQ ID NO: 1204316 - RNA, 14 nt, Human
aaaaggaugcacag

SEQ ID NO: 1204317 - RNA, 13 nt, Human
aaaaggaugcaca

SEQ ID NO: 1204318 - RNA, 22 nt, Human
aaaaggagccaauuuaaagaaa

SEQ ID NO: 1204319 - RNA, 17 nt, Human
gggcuggguucuaccca

SEQ ID NO: 1204320 - RNA, 15 nt, Human
gggcugggcagagga

SEQ ID NO: 1204321 - RNA, 21 nt, Human
gggcugcaccggcuggccugg

SEQ ID NO: 1204322 - RNA, 20 nt, Human
gggcugcaccggcuggccug

SEQ ID NO: 1204323 - RNA, 19 nt, Human
gggcugcaccggcuggccu

SEQ ID NO: 1204324 - RNA, 13 nt, Human
gggcuccagacac

SEQ ID NO: 1204325 - RNA, 10 nt, Human
gggcuccaga

SEQ ID NO: 1204326 - RNA, 21 nt, Human
gggcucagcggggacagcucc

SEQ ID NO: 1204327 - RNA, 19 nt, Human
gggcucagcggggacagcu

SEQ ID NO: 1204328 - RNA, 17 nt, Human
gggcucagcggggacag

SEQ ID NO: 1204329 - RNA, 22 nt, Human
gggcucagcaaaagaugcuucu

SEQ ID NO: 1204330 - RNA, 18 nt, Human
gggcuaguugggcuuccu

SEQ ID NO: 1204331 - RNA, 15 nt, Human
gggcuaguugggcuu

SEQ ID NO: 1204332 - RNA, 14 nt, Human
gggccaggagccuc

SEQ ID NO: 1204333 - RNA, 13 nt, Human
gggccaggagccu

SEQ ID NO: 1204334 - RNA, 19 nt, Human
gggccucuuaugggcuggg

SEQ ID NO: 1204335 - RNA, 18 nt, Human
gggccucuuaugggcugg

SEQ ID NO: 1204336 - RNA, 22 nt, Human
gggccucgguguggagaagcgg

SEQ ID NO: 1204337 - RNA, 15 nt, Human
gggccucagugccac

SEQ ID NO: 1204338 - RNA, 14 nt, Human
gggccucagugcca

SEQ ID NO: 1204339 - RNA, 13 nt, Human
gggccucagugcc

SEQ ID NO: 1204340 - RNA, 21 nt, Human
gggcggugagaggggaacaga

SEQ ID NO: 1204341 - RNA, 14 nt, Human
gcugcaccggcugg

SEQ ID NO: 1204342 - RNA, 13 nt, Human
gcugcaccggcug

SEQ ID NO: 1204343 - RNA, 19 nt, Human
gcugcacccucaggcaggu

SEQ ID NO: 1204344 - RNA, 18 nt, Human
gcugcacccucaggcagg

SEQ ID NO: 1204345 - RNA, 20 nt, Human
gcugccccuggcagccccug

SEQ ID NO: 1204346 - RNA, 19 nt, Human
gcugccccuggcagccccu

SEQ ID NO: 1204347 - RNA, 18 nt, Human
gcugccccuggcagcccc

SEQ ID NO: 1204348 - RNA, 21 nt, Human
gcugccugggaucccucaucc

SEQ ID NO: 1204349 - RNA, 13 nt, Human
gcugccuguucag

SEQ ID NO: 1204350 - RNA, 12 nt, Human
gcugccuguuca

SEQ ID NO: 1204351 - RNA, 17 nt, Human
gcugccuguucagcucc

SEQ ID NO: 1204352 - RNA, 18 nt, Human
gcugccuguucagcucca

SEQ ID NO: 1204353 - RNA, 16 nt, Human
gcugccucucccauca

SEQ ID NO: 1204354 - RNA, 20 nt, Human
gcugccugggaucccucauc

SEQ ID NO: 1204355 - RNA, 15 nt, Human
gcugaggugggagga

SEQ ID NO: 1204356 - RNA, 14 nt, Human
gcugaggugggagg

SEQ ID NO: 1204357 - RNA, 23 nt, Human
gcugagggugagugggugaauaa

SEQ ID NO: 1204358 - RNA, 19 nt, Human
gcuguaucccaugagccuc

SEQ ID NO: 1204359 - RNA, 17 nt, Human
gcuguaucccaugagcc

SEQ ID NO: 1204360 - RNA, 15 nt, Human
gcuguuggcuggggg

SEQ ID NO: 1204361 - RNA, 17 nt, Human
gcugugcugcccugccc

SEQ ID NO: 1204362 - RNA, 16 nt, Human
gcugugcugcccugcc

SEQ ID NO: 1204363 - RNA, 15 nt, Human
gcugugcugcccugc

SEQ ID NO: 1204364 - RNA, 20 nt, Human
gcuguuggcugggggccuca

SEQ ID NO: 1204365 - RNA, 16 nt, Human
gcuguuggcugggggc

SEQ ID NO: 1204366 - RNA, 18 nt, Human
gcugugcucuggacaggc

SEQ ID NO: 1204367 - RNA, 16 nt, Human
gcugugcucuggacag

SEQ ID NO: 1204368 - RNA, 15 nt, Human
gcugugcucuggaca

SEQ ID NO: 1204369 - RNA, 13 nt, Human
gcugugcucugga

SEQ ID NO: 1204370 - RNA, 14 nt, Human
gcuggcgugcagug

SEQ ID NO: 1204371 - RNA, 20 nt, Human
gcuggcgugcaguggugcga

SEQ ID NO: 1204372 - RNA, 18 nt, Human
gcuggcgugcaguggugc

SEQ ID NO: 1204373 - RNA, 15 nt, Human
gcuggcgugcagugg

SEQ ID NO: 1204374 - RNA, 19 nt, Human
gcuggcuguuggcuggggg

SEQ ID NO: 1204375 - RNA, 18 nt, Human
gcuggcuguuggcugggg

SEQ ID NO: 1204376 - RNA, 12 nt, Human
gcugcugaaggc

SEQ ID NO: 1204377 - RNA, 23 nt, Human
gcuggcuguuggcugggggccuc

SEQ ID NO: 1204378 - RNA, 20 nt, Human
gcuggcuguuggcugggggc

SEQ ID NO: 1204379 - RNA, 19 nt, Human
gcugggguggggaccucag

SEQ ID NO: 1204380 - RNA, 17 nt, Human
gcugggguggggaccuc

SEQ ID NO: 1204381 - RNA, 21 nt, Human
gcuggguucuacccaggugcu

SEQ ID NO: 1204382 - RNA, 20 nt, Human
gcuggguucuacccaggugc

SEQ ID NO: 1204383 - RNA, 18 nt, Human
gcuggguucuacccaggu

SEQ ID NO: 1204384 - RNA, 23 nt, Human
gcugggguggggaccucaggccu

SEQ ID NO: 1204385 - RNA, 22 nt, Human
gcugggguggggaccucaggcc

SEQ ID NO: 1204386 - RNA, 23 nt, Human
gcuuucuacccagcgagcccugg

SEQ ID NO: 1204387 - RNA, 22 nt, Human
gcuuucuacccagcgagcccug

SEQ ID NO: 1204388 - RNA, 19 nt, Human
gcuuucuacccagcgagcc

SEQ ID NO: 1204389 - RNA, 13 nt, Human
gcuuucuacccag

SEQ ID NO: 1204390 - RNA, 20 nt, Human
gcuugaccgugaggccagag

SEQ ID NO: 1204391 - RNA, 22 nt, Human
gcuuggggaccagagcugccac

SEQ ID NO: 1204392 - RNA, 21 nt, Human
gcuuggggaccagagcugcca

SEQ ID NO: 1204393 - RNA, 20 nt, Human
gcuuggggaccagagcugcc

SEQ ID NO: 1204394 - RNA, 18 nt, Human
gcuuggggaccagagcug

SEQ ID NO: 1204395 - RNA, 17 nt, Human
gcuuggggaccagagcu

SEQ ID NO: 1204396 - RNA, 16 nt, Human
gcuuggggaccagagc

SEQ ID NO: 1204397 - RNA, 23 nt, Human
gcuugggcuucauccuccucaga

SEQ ID NO: 1204398 - RNA, 19 nt, Human
gcuugaccgugaggccaga

SEQ ID NO: 1204399 - RNA, 18 nt, Human
gcuugaccgugaggccag

SEQ ID NO: 1204400 - RNA, 17 nt, Human
gcuugaccgugaggcca

SEQ ID NO: 1204401 - RNA, 23 nt, Human
gcuucuucagagacuccugcagg

SEQ ID NO: 1204402 - RNA, 21 nt, Human
gcuucuucagagacuccugca

SEQ ID NO: 1204403 - RNA, 19 nt, Human
gcuucuucagagacuccug

SEQ ID NO: 1204404 - RNA, 16 nt, Human
gcuucuucagagacuc

SEQ ID NO: 1204405 - RNA, 17 nt, Human
gcuuaacuucacauauu

SEQ ID NO: 1204406 - RNA, 16 nt, Human
gcuuaacuucacauau

SEQ ID NO: 1204407 - RNA, 19 nt, Human
ggaaagcaaaggagauugg

SEQ ID NO: 1204408 - RNA, 17 nt, Human
ggaaagaguaggaagac

SEQ ID NO: 1204409 - RNA, 16 nt, Human
ggaaagaguaggaaga

SEQ ID NO: 1204410 - RNA, 14 nt, Human
ggaaagaggcucug

SEQ ID NO: 1204411 - RNA, 20 nt, Human
ggaaagacuuuuccaacccu

SEQ ID NO: 1204412 - RNA, 15 nt, Human
ggaaacccagcucug

SEQ ID NO: 1204413 - RNA, 20 nt, Human
ggaaacagcuaaugggacac

SEQ ID NO: 1204414 - RNA, 19 nt, Human
gcuuuugugcauuaucuag

SEQ ID NO: 1204415 - RNA, 13 nt, Human
gcuuuugugcauu

SEQ ID NO: 1204416 - RNA, 15 nt, Human
gcuuuuuaauauuga

SEQ ID NO: 1204417 - RNA, 18 nt, Human
ggaagccgcuggggccag

SEQ ID NO: 1204418 - RNA, 23 nt, Human
ggaagccagcaggcucucaggcc

SEQ ID NO: 1204419 - RNA, 22 nt, Human
ggaagccagcaggcucucaggc

SEQ ID NO: 1204420 - RNA, 21 nt, Human
ggaagccagcaggcucucagg

SEQ ID NO: 1204421 - RNA, 12 nt, Human
ggacacccugug

SEQ ID NO: 1204422 - RNA, 14 nt, Human
ggacacagcucuuc

SEQ ID NO: 1204423 - RNA, 13 nt, Human
ggacacagcucuu

SEQ ID NO: 1204424 - RNA, 12 nt, Human
ggacacagcucu

SEQ ID NO: 1204425 - RNA, 14 nt, Human
ggaaugauuaauua

SEQ ID NO: 1204426 - RNA, 19 nt, Human
ggaaugaaugucaguguga

SEQ ID NO: 1204427 - RNA, 19 nt, Human
ggaauaccugucccccuga

SEQ ID NO: 1204428 - RNA, 16 nt, Human
ggaauaccuguccccc

SEQ ID NO: 1204429 - RNA, 16 nt, Human
ggaauauauaaccagu

SEQ ID NO: 1204430 - RNA, 15 nt, Human
ggaauaccugucccc

SEQ ID NO: 1204431 - RNA, 22 nt, Human
ggaagcucagggccuggcucag

SEQ ID NO: 1204432 - RNA, 21 nt, Human
ggaagcucagggccuggcuca

SEQ ID NO: 1204433 - RNA, 17 nt, Human
ggaagcucagggccugg

SEQ ID NO: 1204434 - RNA, 16 nt, Human
ggaagcucagggccug

SEQ ID NO: 1204435 - RNA, 23 nt, Human
ggacacccugugauggggcccug

SEQ ID NO: 1204436 - RNA, 13 nt, Human
ggacacccuguga

SEQ ID NO: 1204437 - RNA, 17 nt, Human
ggacagggaggugaccc

SEQ ID NO: 1204438 - RNA, 14 nt, Human
ggacauggacaagg

SEQ ID NO: 1204439 - RNA, 13 nt, Human
ggacauggacaag

SEQ ID NO: 1204440 - RNA, 22 nt, Human
gcuaagugauccucccaccuca

SEQ ID NO: 1204441 - RNA, 18 nt, Human
gcuaagugauccucccac

SEQ ID NO: 1204442 - RNA, 21 nt, Human
gcuaguugggcuuccucauag

SEQ ID NO: 1204443 - RNA, 16 nt, Human
gcuaguugggcuuccu

SEQ ID NO: 1204444 - RNA, 14 nt, Human
gcuaguugggcuuc

SEQ ID NO: 1204445 - RNA, 18 nt, Human
gcuauucaguaauaacuc

SEQ ID NO: 1204446 - RNA, 22 nt, Human
gcuaggaccccuccaugugggc

SEQ ID NO: 1204447 - RNA, 20 nt, Human
gcuaggaccccuccaugugg

SEQ ID NO: 1204448 - RNA, 20 nt, Human
gcucagggccuggcucaggu

SEQ ID NO: 1204449 - RNA, 19 nt, Human
gcucagggccuggcucagg

SEQ ID NO: 1204450 - RNA, 18 nt, Human
gcucagggccuggcucag

SEQ ID NO: 1204451 - RNA, 13 nt, Human
gcucaggaguuug

SEQ ID NO: 1204452 - RNA, 23 nt, Human
gcgauucuucugcuucagccucc

SEQ ID NO: 1204453 - RNA, 21 nt, Human
gcgcagcauauucaggaagcu

SEQ ID NO: 1204454 - RNA, 22 nt, Human
gcgauucuucugcuucagccuc

SEQ ID NO: 1204455 - RNA, 23 nt, Human
gccuugaccauucuccaccugcc

SEQ ID NO: 1204456 - RNA, 22 nt, Human
gccuugaccauucuccaccugc

SEQ ID NO: 1204457 - RNA, 16 nt, Human
gccuugaccauucucc

SEQ ID NO: 1204458 - RNA, 23 nt, Human
gccuugaacuuugaccucugcag

SEQ ID NO: 1204459 - RNA, 14 nt, Human
gccuugaacuuuga

SEQ ID NO: 1204460 - RNA, 16 nt, Human
gccuucucugaaggac

SEQ ID NO: 1204461 - RNA, 15 nt, Human
gccuucucugaagga

SEQ ID NO: 1204462 - RNA, 17 nt, Human
gccuguucagcuccagc

SEQ ID NO: 1204463 - RNA, 16 nt, Human
gccuguucagcuccag

SEQ ID NO: 1204464 - RNA, 15 nt, Human
gccuguucagcucca

SEQ ID NO: 1204465 - RNA, 11 nt, Human
gccugggcaga

SEQ ID NO: 1204466 - RNA, 23 nt, Human
gccugggaucccucauccucaua

SEQ ID NO: 1204467 - RNA, 20 nt, Human
gcgggaggauguucugggac

SEQ ID NO: 1204468 - RNA, 15 nt, Human
gcggcuggcagccca

SEQ ID NO: 1204469 - RNA, 19 nt, Human
gccuagcauacguacacau

SEQ ID NO: 1204470 - RNA, 12 nt, Human
gccuagcauacg

SEQ ID NO: 1204471 - RNA, 17 nt, Human
gccuacaggagugagca

SEQ ID NO: 1204472 - RNA, 16 nt, Human
gccucgaacuggcugc

SEQ ID NO: 1204473 - RNA, 13 nt, Human
gccucgaacuggc

SEQ ID NO: 1204474 - RNA, 22 nt, Human
gccuccuuugugaggaagccgc

SEQ ID NO: 1204475 - RNA, 18 nt, Human
gccuccugcccuuaccug

SEQ ID NO: 1204476 - RNA, 21 nt, Human
gccccugcugguucaggguug

SEQ ID NO: 1204477 - RNA, 17 nt, Human
gccccuggcagccccug

SEQ ID NO: 1204478 - RNA, 16 nt, Human
gccccuggcagccccu

SEQ ID NO: 1204479 - RNA, 16 nt, Human
gccuacaggagugagc

SEQ ID NO: 1204480 - RNA, 19 nt, Human
gcccuuagcagggaaacag

SEQ ID NO: 1204481 - RNA, 21 nt, Human
gcccugugggcccccaaaugg

SEQ ID NO: 1204482 - RNA, 23 nt, Human
gcccuuaccugccaggaagccag

SEQ ID NO: 1204483 - RNA, 22 nt, Human
gcccuuaccugccaggaagcca

SEQ ID NO: 1204484 - RNA, 17 nt, Human
gcccugugggcccccaa

SEQ ID NO: 1204485 - RNA, 16 nt, Human
gcccugugggccccca

SEQ ID NO: 1204486 - RNA, 15 nt, Human
gcccugcccaccugg

SEQ ID NO: 1204487 - RNA, 14 nt, Human
gcccugcccaccug

SEQ ID NO: 1204488 - RNA, 20 nt, Human
gccccaaaacucuccucugc

SEQ ID NO: 1204489 - RNA, 21 nt, Human
gccccaaaacucuccucugcu

SEQ ID NO: 1204490 - RNA, 15 nt, Human
gccccuggcagcccc

SEQ ID NO: 1204491 - RNA, 12 nt, Human
gccccuggcagc

SEQ ID NO: 1204492 - RNA, 16 nt, Human
gccccugcugguucag

SEQ ID NO: 1204493 - RNA, 15 nt, Human
gccccugcugguuca

SEQ ID NO: 1204494 - RNA, 12 nt, Human
gccccugcuggu

SEQ ID NO: 1204495 - RNA, 13 nt, Human
gcccaggccccug

SEQ ID NO: 1204496 - RNA, 22 nt, Human
gcccaggccccugccacccugg

SEQ ID NO: 1204497 - RNA, 21 nt, Human
gcccaggccccugccacccug

SEQ ID NO: 1204498 - RNA, 20 nt, Human
gcccaggccccugccacccu

SEQ ID NO: 1204499 - RNA, 12 nt, Human
gcccaggccccu

SEQ ID NO: 1204500 - RNA, 11 nt, Human
gcccaggcccc

SEQ ID NO: 1204501 - RNA, 12 nt, Human
gcccaggcaggu

SEQ ID NO: 1204502 - RNA, 11 nt, Human
gcccaggcagg

SEQ ID NO: 1204503 - RNA, 21 nt, Human
gcccacgcccccacuggugac

SEQ ID NO: 1204504 - RNA, 17 nt, Human
gcccacgcccccacugg

SEQ ID NO: 1204505 - RNA, 16 nt, Human
gcccacgcccccacug

SEQ ID NO: 1204506 - RNA, 18 nt, Human
gcauuuacuuuguguuca

SEQ ID NO: 1204507 - RNA, 14 nt, Human
gcccacuucugcca

SEQ ID NO: 1204508 - RNA, 24 nt, Human
gcccaggaaaggcuccaggagcag

SEQ ID NO: 1204509 - RNA, 23 nt, Human
gcccaggaaaggcuccaggagca

SEQ ID NO: 1204510 - RNA, 22 nt, Human
gcccaggaaaggcuccaggagc

SEQ ID NO: 1204511 - RNA, 13 nt, Human
gcccacuucugcc

SEQ ID NO: 1204512 - RNA, 23 nt, Human
gcccacgcuggagugcagugagc

SEQ ID NO: 1204513 - RNA, 21 nt, Human
gcccacgcuggagugcaguga

SEQ ID NO: 1204514 - RNA, 19 nt, Human
gcccacgcuggagugcagu

SEQ ID NO: 1204515 - RNA, 21 nt, Human
gaugcuucuucagagacuccu

SEQ ID NO: 1204516 - RNA, 20 nt, Human
gaugcuucuucagagacucc

SEQ ID NO: 1204517 - RNA, 17 nt, Human
gaugcuucuucagagac

SEQ ID NO: 1204518 - RNA, 22 nt, Human
gaugauuggaggggggaggugg

SEQ ID NO: 1204519 - RNA, 14 nt, Human
gaugauccuaggca

SEQ ID NO: 1204520 - RNA, 13 nt, Human
gaugauccuaggc

SEQ ID NO: 1204521 - RNA, 19 nt, Human
gaucucuugagccugggag

SEQ ID NO: 1204522 - RNA, 21 nt, Human
gauacuguaucaugacaaaga

SEQ ID NO: 1204523 - RNA, 17 nt, Human
gauacuguaucaugaca

SEQ ID NO: 1204524 - RNA, 23 nt, Human
gauacaguuacucagaauucucu

SEQ ID NO: 1204525 - RNA, 19 nt, Human
gauacaguuacucagaauu

SEQ ID NO: 1204526 - RNA, 16 nt, Human
gauacaguuacucaga

SEQ ID NO: 1204527 - RNA, 22 nt, Human
gauccacccaccucagccuccc

SEQ ID NO: 1204528 - RNA, 21 nt, Human
gauccacccaccucagccucc

SEQ ID NO: 1204529 - RNA, 20 nt, Human
gauccacccaccucagccuc

SEQ ID NO: 1204530 - RNA, 19 nt, Human
gauccacccaccucagccu

SEQ ID NO: 1204531 - RNA, 18 nt, Human
gauccacccaccucagcc

SEQ ID NO: 1204532 - RNA, 21 nt, Human
gauccaagcuggucccacuca

SEQ ID NO: 1204533 - RNA, 19 nt, Human
gauccaagcuggucccacu

SEQ ID NO: 1204534 - RNA, 17 nt, Human
gauccaagcugguccca

SEQ ID NO: 1204535 - RNA, 16 nt, Human
gauccaagcugguccc

SEQ ID NO: 1204536 - RNA, 12 nt, Human
gauccaagcugg

SEQ ID NO: 1204537 - RNA, 21 nt, Human
gaucaaccccuucgcuccugu

SEQ ID NO: 1204538 - RNA, 23 nt, Human
gaucaaaagguuaauaaaguaau

SEQ ID NO: 1204539 - RNA, 20 nt, Human
gaucaaaagguuaauaaagu

SEQ ID NO: 1204540 - RNA, 15 nt, Human
gauauuuugcuuugu

SEQ ID NO: 1204541 - RNA, 20 nt, Human
gcaaccuccgccucuugggu

SEQ ID NO: 1204542 - RNA, 17 nt, Human
gcaacccccagccugcu

SEQ ID NO: 1204543 - RNA, 16 nt, Human
gcaacccccagccugc

SEQ ID NO: 1204544 - RNA, 15 nt, Human
gcaacccccagccug

SEQ ID NO: 1204545 - RNA, 14 nt, Human
gcaacccccagccu

SEQ ID NO: 1204546 - RNA, 18 nt, Human
gcaaccaccaccaaccac

SEQ ID NO: 1204547 - RNA, 16 nt, Human
gcaaccaccaccaacc

SEQ ID NO: 1204548 - RNA, 13 nt, Human
gcaaccaccacca

SEQ ID NO: 1204549 - RNA, 19 nt, Human
gcaacaggcugggcuucag

SEQ ID NO: 1204550 - RNA, 16 nt, Human
gcaacaggcugggcuu

SEQ ID NO: 1204551 - RNA, 15 nt, Human
gcaacaggcugggcu

SEQ ID NO: 1204552 - RNA, 14 nt, Human
gcaacaggcugggc

SEQ ID NO: 1204553 - RNA, 13 nt, Human
gcaacaggcuggg

SEQ ID NO: 1204554 - RNA, 16 nt, Human
gcaagugagagcuggg

SEQ ID NO: 1204555 - RNA, 15 nt, Human
gauucuucugcuuca

SEQ ID NO: 1204556 - RNA, 13 nt, Human
gauucuucugcuu

SEQ ID NO: 1204557 - RNA, 19 nt, Human
gauuuaacagaaauguaca

SEQ ID NO: 1204558 - RNA, 18 nt, Human
gauuuaacagaaauguac

SEQ ID NO: 1204559 - RNA, 17 nt, Human
gauuuaacagaaaugua

SEQ ID NO: 1204560 - RNA, 20 nt, Human
gauucuucugcuucagccuc

SEQ ID NO: 1204561 - RNA, 16 nt, Human
gauuuaacagaaaugu

SEQ ID NO: 1204562 - RNA, 22 nt, Human
gcaaaagaugcuucucacugcc

SEQ ID NO: 1204563 - RNA, 14 nt, Human
gcaaaaaggcagga

SEQ ID NO: 1204564 - RNA, 21 nt, Human
gauuuuuuuuuccuucagugc

SEQ ID NO: 1204565 - RNA, 18 nt, Human
gauuuuuuuuuccuucag

SEQ ID NO: 1204566 - RNA, 17 nt, Human
gauuuuuuuuuccuuca

SEQ ID NO: 1204567 - RNA, 12 nt, Human
gauuucacucuc

SEQ ID NO: 1204568 - RNA, 11 nt, Human
gauuucacucu

SEQ ID NO: 1204569 - RNA, 15 nt, Human
gcagccacauuccug

SEQ ID NO: 1204570 - RNA, 18 nt, Human
gcagcccaccccucaaca

SEQ ID NO: 1204571 - RNA, 19 nt, Human
gcaagugagagcugggugu

SEQ ID NO: 1204572 - RNA, 18 nt, Human
gcaagugagagcugggug

SEQ ID NO: 1204573 - RNA, 20 nt, Human
gcacucagaagacacugaug

SEQ ID NO: 1204574 - RNA, 22 nt, Human
gcacuuuguucuggcucuucca

SEQ ID NO: 1204575 - RNA, 19 nt, Human
gcacuuuguucuggcucuu

SEQ ID NO: 1204576 - RNA, 18 nt, Human
gcacuuuguucuggcucu

SEQ ID NO: 1204577 - RNA, 16 nt, Human
gcacuccccugcuggg

SEQ ID NO: 1204578 - RNA, 15 nt, Human
gcacuccccugcugg

SEQ ID NO: 1204579 - RNA, 14 nt, Human
gcacuccccugcug

SEQ ID NO: 1204580 - RNA, 13 nt, Human
gcacuccccugcu

SEQ ID NO: 1204581 - RNA, 15 nt, Human
gcacuccagccuggg

SEQ ID NO: 1204582 - RNA, 14 nt, Human
gcacuccagccugg

SEQ ID NO: 1204583 - RNA, 21 nt, Human
gcagaggaaagcaaaggagau

SEQ ID NO: 1204584 - RNA, 20 nt, Human
gcagaggaaagcaaaggaga

SEQ ID NO: 1204585 - RNA, 18 nt, Human
gcagaggaaagcaaagga

SEQ ID NO: 1204586 - RNA, 14 nt, Human
gcagaggaaagcaa

SEQ ID NO: 1204587 - RNA, 13 nt, Human
gcagaggaaagca

SEQ ID NO: 1204588 - RNA, 23 nt, Human
gcagcauauucaggaagcucagg

SEQ ID NO: 1204589 - RNA, 19 nt, Human
gcagcauauucaggaagcu

SEQ ID NO: 1204590 - RNA, 18 nt, Human
gcagcauauucaggaagc

SEQ ID NO: 1204591 - RNA, 17 nt, Human
gcagcauauucaggaag

SEQ ID NO: 1204592 - RNA, 14 nt, Human
gcagagggcacaga

SEQ ID NO: 1204593 - RNA, 18 nt, Human
gcauacguacacauuuua

SEQ ID NO: 1204594 - RNA, 17 nt, Human
gcauacguacacauuuu

SEQ ID NO: 1204595 - RNA, 16 nt, Human
gcauacguacacauuu

SEQ ID NO: 1204596 - RNA, 15 nt, Human
gcauacguacacauu

SEQ ID NO: 1204597 - RNA, 17 nt, Human
gcauccaguaucuugaa

SEQ ID NO: 1204598 - RNA, 14 nt, Human
gcauccaguaucuu

SEQ ID NO: 1204599 - RNA, 18 nt, Human
gcauccaguaucuugaag

SEQ ID NO: 1204600 - RNA, 14 nt, Human
gcauccuggcaccc

SEQ ID NO: 1204601 - RNA, 13 nt, Human
gcauccuggcacc

SEQ ID NO: 1204602 - RNA, 13 nt, Human
gcaugggaaugaa

SEQ ID NO: 1204603 - RNA, 21 nt, Human
gcauggcugccaaugggagcu

SEQ ID NO: 1204604 - RNA, 15 nt, Human
gcauuuacuuugugu

SEQ ID NO: 1204605 - RNA, 22 nt, Human
gcauuuaaaagauacaguuacu

SEQ ID NO: 1204606 - RNA, 18 nt, Human
gcauuuaaaagauacagu

SEQ ID NO: 1204607 - RNA, 17 nt, Human
gcauuuaaaagauacag

SEQ ID NO: 1204608 - RNA, 16 nt, Human
gcauuuaaaagauaca

SEQ ID NO: 1204609 - RNA, 18 nt, Human
gcauugugggaaggggag

SEQ ID NO: 1204610 - RNA, 16 nt, Human
gcauugugggaagggg

SEQ ID NO: 1204611 - RNA, 15 nt, Human
gcauugugggaaggg

SEQ ID NO: 1204612 - RNA, 13 nt, Human
gcauugugggaag

SEQ ID NO: 1204613 - RNA, 21 nt, Human
gcaugugaugagaggaaauca

SEQ ID NO: 1204614 - RNA, 19 nt, Human
gcaugugaugagaggaaau

SEQ ID NO: 1204615 - RNA, 24 nt, Human
gaauauugcugauggugcaaugac

SEQ ID NO: 1204616 - RNA, 23 nt, Human
gaauauugcugauggugcaauga

SEQ ID NO: 1204617 - RNA, 22 nt, Human
gaauauugcugauggugcaaug

SEQ ID NO: 1204618 - RNA, 15 nt, Human
gaauauauaaccagu

SEQ ID NO: 1204619 - RNA, 13 nt, Human
gaauauugcugau

SEQ ID NO: 1204620 - RNA, 12 nt, Human
gaauauugcuga

SEQ ID NO: 1204621 - RNA, 11 nt, Human
gaauauugcug

SEQ ID NO: 1204622 - RNA, 14 nt, Human
gaaugauuaauuaa

SEQ ID NO: 1204623 - RNA, 14 nt, Human
gaaugaugccauga

SEQ ID NO: 1204624 - RNA, 20 nt, Human
gaaugaugauccuaggcauu

SEQ ID NO: 1204625 - RNA, 17 nt, Human
gaauguuugccucugcc

SEQ ID NO: 1204626 - RNA, 16 nt, Human
gaauguuugccucugc

SEQ ID NO: 1204627 - RNA, 19 nt, Human
gaaugcacaaacagaggcc

SEQ ID NO: 1204628 - RNA, 18 nt, Human
gaaugcacaaacagaggc

SEQ ID NO: 1204629 - RNA, 19 nt, Human
gaauguuugccucugccuc

SEQ ID NO: 1204630 - RNA, 18 nt, Human
gaauguuugccucugccu

SEQ ID NO: 1204631 - RNA, 13 nt, Human
gacacagcucuuc

SEQ ID NO: 1204632 - RNA, 21 nt, Human
gacacagcucuucuccaggcu

SEQ ID NO: 1204633 - RNA, 20 nt, Human
gacacagcucuucuccaggc

SEQ ID NO: 1204634 - RNA, 19 nt, Human
gacacagcucuucuccagg

SEQ ID NO: 1204635 - RNA, 12 nt, Human
gacacagcucuu

SEQ ID NO: 1204636 - RNA, 14 nt, Human
gaccucaggccugg

SEQ ID NO: 1204637 - RNA, 10 nt, Human
gacccugagg

SEQ ID NO: 1204638 - RNA, 21 nt, Human
gaccucaggugauccacccac

SEQ ID NO: 1204639 - RNA, 20 nt, Human
gaccucaggugauccaccca

SEQ ID NO: 1204640 - RNA, 19 nt, Human
gaccucaggugauccaccc

SEQ ID NO: 1204641 - RNA, 21 nt, Human
gaccucaggugagaagcagag

SEQ ID NO: 1204642 - RNA, 19 nt, Human
gaccucaggugagaagcag

SEQ ID NO: 1204643 - RNA, 18 nt, Human
gaccucaggugagaagca

SEQ ID NO: 1204644 - RNA, 19 nt, Human
gaccucaggccugggggcu

SEQ ID NO: 1204645 - RNA, 21 nt, Human
gacgcugugcugcccugccca

SEQ ID NO: 1204646 - RNA, 18 nt, Human
gacgcugugcugcccugc

SEQ ID NO: 1204647 - RNA, 17 nt, Human
gacgcugugcugcccug

SEQ ID NO: 1204648 - RNA, 16 nt, Human
gacgcugugcugcccu

SEQ ID NO: 1204649 - RNA, 23 nt, Human
gacgcuacccgggaagggggcug

SEQ ID NO: 1204650 - RNA, 22 nt, Human
gacgcuacccgggaagggggcu

SEQ ID NO: 1204651 - RNA, 21 nt, Human
gacgccaucccagccccaaug

SEQ ID NO: 1204652 - RNA, 15 nt, Human
gacgccaucccagcc

SEQ ID NO: 1204653 - RNA, 13 nt, Human
gacgccaucccag

SEQ ID NO: 1204654 - RNA, 12 nt, Human
gacgccauccca

SEQ ID NO: 1204655 - RNA, 13 nt, Human
gaccucugccuga

SEQ ID NO: 1204656 - RNA, 22 nt, Human
gaccucugcagcaauaaagcag

SEQ ID NO: 1204657 - RNA, 18 nt, Human
gaccucugcagcaauaaa

SEQ ID NO: 1204658 - RNA, 16 nt, Human
gaccucugcagcaaua

SEQ ID NO: 1204659 - RNA, 18 nt, Human
gacagcuccuucuguccu

SEQ ID NO: 1204660 - RNA, 17 nt, Human
gacagcuccuucugucc

SEQ ID NO: 1204661 - RNA, 16 nt, Human
gacagcccgggcucug

SEQ ID NO: 1204662 - RNA, 14 nt, Human
gacagcccgggcuc

SEQ ID NO: 1204663 - RNA, 20 nt, Human
gacagucccugccaauggac

SEQ ID NO: 1204664 - RNA, 16 nt, Human
gacagucccugccaau

SEQ ID NO: 1204665 - RNA, 15 nt, Human
gacagucccugccaa

SEQ ID NO: 1204666 - RNA, 14 nt, Human
gacagucccugcca

SEQ ID NO: 1204667 - RNA, 12 nt, Human
gacagucccugc

SEQ ID NO: 1204668 - RNA, 11 nt, Human
gacagcucuua

SEQ ID NO: 1204669 - RNA, 10 nt, Human
gacagcucuu

SEQ ID NO: 1204670 - RNA, 19 nt, Human
gacagcuccuucuguccua

SEQ ID NO: 1204671 - RNA, 23 nt, Human
gacauugcggacagccacggcca

SEQ ID NO: 1204672 - RNA, 14 nt, Human
gagcccugguggca

SEQ ID NO: 1204673 - RNA, 13 nt, Human
gagcccugguggc

SEQ ID NO: 1204674 - RNA, 17 nt, Human
gagccccgaggccuucu

SEQ ID NO: 1204675 - RNA, 14 nt, Human
gagccccgaggccu

SEQ ID NO: 1204676 - RNA, 21 nt, Human
gagcaugccuggauggggcug

SEQ ID NO: 1204677 - RNA, 13 nt, Human
gagcaugccugga

SEQ ID NO: 1204678 - RNA, 17 nt, Human
gagcaucaggccaggcc

SEQ ID NO: 1204679 - RNA, 16 nt, Human
gagcaucaggccaggc

SEQ ID NO: 1204680 - RNA, 15 nt, Human
gagcaucaggccagg

SEQ ID NO: 1204681 - RNA, 14 nt, Human
gagcaucaggccag

SEQ ID NO: 1204682 - RNA, 23 nt, Human
gaggacuuuucuuuguggcuucc

SEQ ID NO: 1204683 - RNA, 20 nt, Human
gaggacuuuucuuuguggcu

SEQ ID NO: 1204684 - RNA, 16 nt, Human
gaggacuuuucuuugu

SEQ ID NO: 1204685 - RNA, 22 nt, Human
gaggcagggucucacucugucg

SEQ ID NO: 1204686 - RNA, 20 nt, Human
gaggcagggucucacucugu

SEQ ID NO: 1204687 - RNA, 19 nt, Human
gaggcagggucucacucug

SEQ ID NO: 1204688 - RNA, 15 nt, Human
gaggagagaggaccc

SEQ ID NO: 1204689 - RNA, 14 nt, Human
gaggagagaggacc

SEQ ID NO: 1204690 - RNA, 12 nt, Human
gaggagagagga

SEQ ID NO: 1204691 - RNA, 17 nt, Human
gaggccaaggugggagg

SEQ ID NO: 1204692 - RNA, 21 nt, Human
gaggcauuuguuugaacugau

SEQ ID NO: 1204693 - RNA, 19 nt, Human
gaggcauuuguuugaacug

SEQ ID NO: 1204694 - RNA, 22 nt, Human
gaggcaugugaugagaggaaau

SEQ ID NO: 1204695 - RNA, 21 nt, Human
gaggcaugugaugagaggaaa

SEQ ID NO: 1204696 - RNA, 20 nt, Human
gaggcaugugaugagaggaa

SEQ ID NO: 1204697 - RNA, 21 nt, Human
gagggccugcaagggagugag

SEQ ID NO: 1204698 - RNA, 17 nt, Human
gagggccugcaagggag

SEQ ID NO: 1204699 - RNA, 14 nt, Human
gagggccugcaagg

SEQ ID NO: 1204700 - RNA, 19 nt, Human
gacuuuuccaacccucauc

SEQ ID NO: 1204701 - RNA, 14 nt, Human
gacuuuuccaaccc

SEQ ID NO: 1204702 - RNA, 20 nt, Human
gacuuuuccaacccucauca

SEQ ID NO: 1204703 - RNA, 18 nt, Human
gagacgggggcagagagg

SEQ ID NO: 1204704 - RNA, 19 nt, Human
gagacggagucccaccuug

SEQ ID NO: 1204705 - RNA, 16 nt, Human
gagacggagucccacc

SEQ ID NO: 1204706 - RNA, 14 nt, Human
gagacggaguccca

SEQ ID NO: 1204707 - RNA, 23 nt, Human
gagaaugaaagggcccagagagg

SEQ ID NO: 1204708 - RNA, 15 nt, Human
gagaaugaaagggcc

SEQ ID NO: 1204709 - RNA, 14 nt, Human
gagauuggaaggaa

SEQ ID NO: 1204710 - RNA, 16 nt, Human
gagagccuuccagggg

SEQ ID NO: 1204711 - RNA, 15 nt, Human
gagagccuuccaggg

SEQ ID NO: 1204712 - RNA, 14 nt, Human
gagacuccugcagg

SEQ ID NO: 1204713 - RNA, 13 nt, Human
gagacuccugcag

SEQ ID NO: 1204714 - RNA, 13 nt, Human
gagagcugggugu

SEQ ID NO: 1204715 - RNA, 21 nt, Human
gagagcuagcagcagggaggg

SEQ ID NO: 1204716 - RNA, 15 nt, Human
gagagcuagcagcag

SEQ ID NO: 1204717 - RNA, 20 nt, Human
gagagccuuccagggguggg

SEQ ID NO: 1204718 - RNA, 18 nt, Human
gagagccuuccaggggug

SEQ ID NO: 1204719 - RNA, 15 nt, Human
gagaggacccccuga

SEQ ID NO: 1204720 - RNA, 20 nt, Human
gagagcugggugucaagagg

SEQ ID NO: 1204721 - RNA, 12 nt, Human
gagaggaaauca

SEQ ID NO: 1204722 - RNA, 23 nt, Human
cuuggcgcugccccuggcagccc

SEQ ID NO: 1204723 - RNA, 22 nt, Human
cuuggcgcugccccuggcagcc

SEQ ID NO: 1204724 - RNA, 21 nt, Human
cuuggcgcugccccuggcagc

SEQ ID NO: 1204725 - RNA, 22 nt, Human
cuuggauuguccccgacccuug

SEQ ID NO: 1204726 - RNA, 20 nt, Human
cuuggauuguccccgacccu

SEQ ID NO: 1204727 - RNA, 18 nt, Human
cuuggauuguccccgacc

SEQ ID NO: 1204728 - RNA, 15 nt, Human
cuuggauuguccccg

SEQ ID NO: 1204729 - RNA, 19 nt, Human
cuugccgucuaccugaggg

SEQ ID NO: 1204730 - RNA, 18 nt, Human
cuugccgucuaccugagg

SEQ ID NO: 1204731 - RNA, 19 nt, Human
cuugauucauaaugacuua

SEQ ID NO: 1204732 - RNA, 15 nt, Human
cuugauguguuaucu

SEQ ID NO: 1204733 - RNA, 18 nt, Human
cuuucaauaggaaaaacu

SEQ ID NO: 1204734 - RNA, 17 nt, Human
cuuucaauaggaaaaac

SEQ ID NO: 1204735 - RNA, 15 nt, Human
cuuucaauaggaaaa

SEQ ID NO: 1204736 - RNA, 14 nt, Human
cuuucaauaggaaa

SEQ ID NO: 1204737 - RNA, 23 nt, Human
cuuuaaugucacaggcaggucca

SEQ ID NO: 1204738 - RNA, 22 nt, Human
cuuuaaugucacaggcaggucc

SEQ ID NO: 1204739 - RNA, 20 nt, Human
cuuuaaugucacaggcaggu

SEQ ID NO: 1204740 - RNA, 19 nt, Human
cuuuaaugucacaggcagg

SEQ ID NO: 1204741 - RNA, 18 nt, Human
cuuuaaugucacaggcag

SEQ ID NO: 1204742 - RNA, 17 nt, Human
cuuuaaugucacaggca

SEQ ID NO: 1204743 - RNA, 22 nt, Human
cuugucuuuggacccugaggcc

SEQ ID NO: 1204744 - RNA, 21 nt, Human
cuugucuuuggacccugaggc

SEQ ID NO: 1204745 - RNA, 20 nt, Human
cuugguccugcugcaguugc

SEQ ID NO: 1204746 - RNA, 18 nt, Human
cuugguccugcugcaguu

SEQ ID NO: 1204747 - RNA, 17 nt, Human
cuugguccugcugcagu

SEQ ID NO: 1204748 - RNA, 16 nt, Human
cuugguccugcugcag

SEQ ID NO: 1204749 - RNA, 16 nt, Human
cuugguucccauuugc

SEQ ID NO: 1204750 - RNA, 20 nt, Human
cuugguucccauuugcuccu

SEQ ID NO: 1204751 - RNA, 22 nt, Human
cuugguccugcugcaguugcca

SEQ ID NO: 1204752 - RNA, 20 nt, Human
cuugucuuuggacccugagg

SEQ ID NO: 1204753 - RNA, 13 nt, Human
cuugucuguagau

SEQ ID NO: 1204754 - RNA, 16 nt, Human
cuucuuauacauuuga

SEQ ID NO: 1204755 - RNA, 13 nt, Human
cuucuuauacauu

SEQ ID NO: 1204756 - RNA, 20 nt, Human
cuucugacccaugcugcccu

SEQ ID NO: 1204757 - RNA, 23 nt, Human
cuucugaacuuggcgcugccccu

SEQ ID NO: 1204758 - RNA, 18 nt, Human
cuucugacccaugcugcc

SEQ ID NO: 1204759 - RNA, 17 nt, Human
cuucugacccaugcugc

SEQ ID NO: 1204760 - RNA, 16 nt, Human
cuucugacccaugcug

SEQ ID NO: 1204761 - RNA, 18 nt, Human
cuuccucccucccucuuu

SEQ ID NO: 1204762 - RNA, 14 nt, Human
cuuccucccucccu

SEQ ID NO: 1204763 - RNA, 13 nt, Human
cuuccucccuccc

SEQ ID NO: 1204764 - RNA, 12 nt, Human
cuuccucccucc

SEQ ID NO: 1204765 - RNA, 21 nt, Human
cuuccucuuuccaucuacccu

SEQ ID NO: 1204766 - RNA, 22 nt, Human
cuucugaacuuggcgcugcccc

SEQ ID NO: 1204767 - RNA, 19 nt, Human
cuucugaacuuggcgcugc

SEQ ID NO: 1204768 - RNA, 19 nt, Human
gaaauuuuuauuaaauuau

SEQ ID NO: 1204769 - RNA, 18 nt, Human
gaaauuuuuauuaaauua

SEQ ID NO: 1204770 - RNA, 19 nt, Human
gaaaucaccgaaaacgugg

SEQ ID NO: 1204771 - RNA, 17 nt, Human
gaaaucaccgaaaacgu

SEQ ID NO: 1204772 - RNA, 22 nt, Human
gaaaguacuucuccacccugcu

SEQ ID NO: 1204773 - RNA, 21 nt, Human
gaaaguacuucuccacccugc

SEQ ID NO: 1204774 - RNA, 20 nt, Human
gaaaggcuccaggagcagcc

SEQ ID NO: 1204775 - RNA, 19 nt, Human
gaaaggcuccaggagcagc

SEQ ID NO: 1204776 - RNA, 18 nt, Human
gaaaggcuccaggagcag

SEQ ID NO: 1204777 - RNA, 17 nt, Human
gaaaggcuccaggagca

SEQ ID NO: 1204778 - RNA, 20 nt, Human
gaaagacuaucuaaauguug

SEQ ID NO: 1204779 - RNA, 18 nt, Human
gaaagacuaucuaaaugu

SEQ ID NO: 1204780 - RNA, 21 nt, Human
gaacaaggcaaggcugucaau

SEQ ID NO: 1204781 - RNA, 18 nt, Human
gaacaaggcaaggcuguc

SEQ ID NO: 1204782 - RNA, 17 nt, Human
gaacaaggcaaggcugu

SEQ ID NO: 1204783 - RNA, 15 nt, Human
gaacaaggcaaggcu

SEQ ID NO: 1204784 - RNA, 14 nt, Human
gaacaaggcaaggc

SEQ ID NO: 1204785 - RNA, 18 nt, Human
cuuuugccguuauuaaaa

SEQ ID NO: 1204786 - RNA, 17 nt, Human
cuuuugucuaugggacu

SEQ ID NO: 1204787 - RNA, 16 nt, Human
cuuuuggucuguguga

SEQ ID NO: 1204788 - RNA, 15 nt, Human
cuuuuggucugugug

SEQ ID NO: 1204789 - RNA, 19 nt, Human
gaaaaaauauuuuccugcc

SEQ ID NO: 1204790 - RNA, 21 nt, Human
cuuuuuuuuuuuuuuugacaa

SEQ ID NO: 1204791 - RNA, 18 nt, Human
cuuuugugcauuaucuag

SEQ ID NO: 1204792 - RNA, 14 nt, Human
cuuuugugcauuau

SEQ ID NO: 1204793 - RNA, 18 nt, Human
gaaaauuuugauguuuua

SEQ ID NO: 1204794 - RNA, 22 nt, Human
cugucuaaugaaaccugugucu

SEQ ID NO: 1204795 - RNA, 21 nt, Human
cuguccugggagugagcuggu

SEQ ID NO: 1204796 - RNA, 16 nt, Human
cugucauuugagcagg

SEQ ID NO: 1204797 - RNA, 20 nt, Human
cuguccugggagugagcugg

SEQ ID NO: 1204798 - RNA, 14 nt, Human
cuguccugggagug

SEQ ID NO: 1204799 - RNA, 13 nt, Human
cuguccugggagu

SEQ ID NO: 1204800 - RNA, 14 nt, Human
cugucauuugagca

SEQ ID NO: 1204801 - RNA, 18 nt, Human
cuguaggaagguuaaugu

SEQ ID NO: 1204802 - RNA, 15 nt, Human
cuguagagugggagc

SEQ ID NO: 1204803 - RNA, 18 nt, Human
cuggucuuauuuguaaag

SEQ ID NO: 1204804 - RNA, 15 nt, Human
cuguuggccagugug

SEQ ID NO: 1204805 - RNA, 12 nt, Human
cuguuggccagu

SEQ ID NO: 1204806 - RNA, 19 nt, Human
cuuaaauaaugugaaacug

SEQ ID NO: 1204807 - RNA, 16 nt, Human
cuuaaauaaugugaaa

SEQ ID NO: 1204808 - RNA, 14 nt, Human
cuuaaauaauguga

SEQ ID NO: 1204809 - RNA, 17 nt, Human
cugugcucuggacaggc

SEQ ID NO: 1204810 - RNA, 15 nt, Human
cuguucagcuccagc

SEQ ID NO: 1204811 - RNA, 18 nt, Human
cuguucagcugguugagg

SEQ ID NO: 1204812 - RNA, 12 nt, Human
cuguucagcugg

SEQ ID NO: 1204813 - RNA, 22 nt, Human
cuguucagcuccagcucaccag

SEQ ID NO: 1204814 - RNA, 19 nt, Human
cuguucagcuccagcucac

SEQ ID NO: 1204815 - RNA, 18 nt, Human
cuguucagcuccagcuca

SEQ ID NO: 1204816 - RNA, 16 nt, Human
cuguucagcuccagcu

SEQ ID NO: 1204817 - RNA, 17 nt, Human
cuguuacugucuucagu

SEQ ID NO: 1204818 - RNA, 19 nt, Human
cugugcucuggacaggcau

SEQ ID NO: 1204819 - RNA, 18 nt, Human
cugugcucuggacaggca

SEQ ID NO: 1204820 - RNA, 23 nt, Human
cugcccuuaccugccaggaagcc

SEQ ID NO: 1204821 - RNA, 22 nt, Human
cugcccuuaccugccaggaagc

SEQ ID NO: 1204822 - RNA, 12 nt, Human
cugcccuguggg

SEQ ID NO: 1204823 - RNA, 11 nt, Human
cugcccugugg

SEQ ID NO: 1204824 - RNA, 19 nt, Human
cugcccuuaccugccagga

SEQ ID NO: 1204825 - RNA, 14 nt, Human
cugcccugugggcc

SEQ ID NO: 1204826 - RNA, 24 nt, Human
cugcccugugaguacuacaguccu

SEQ ID NO: 1204827 - RNA, 24 nt, Human
cugcugaaggcucgagcaugccug

SEQ ID NO: 1204828 - RNA, 23 nt, Human
cugcugaaggcucgagcaugccu

SEQ ID NO: 1204829 - RNA, 14 nt, Human
cugcucacauaucu

SEQ ID NO: 1204830 - RNA, 23 nt, Human
cugccuguucagcuccagcucac

SEQ ID NO: 1204831 - RNA, 14 nt, Human
cugccuguugggcc

SEQ ID NO: 1204832 - RNA, 20 nt, Human
cugccucgaacuggcugcaa

SEQ ID NO: 1204833 - RNA, 14 nt, Human
cugccucgaacugg

SEQ ID NO: 1204834 - RNA, 23 nt, Human
cugccuccuuugugaggaagccg

SEQ ID NO: 1204835 - RNA, 21 nt, Human
cugccuccuuugugaggaagc

SEQ ID NO: 1204836 - RNA, 17 nt, Human
cugccuccuuugugagg

SEQ ID NO: 1204837 - RNA, 14 nt, Human
cugccuccuuugug

SEQ ID NO: 1204838 - RNA, 22 nt, Human
cuggaugcagccucacaguccu

SEQ ID NO: 1204839 - RNA, 18 nt, Human
cuggaugcagccucacag

SEQ ID NO: 1204840 - RNA, 17 nt, Human
cuggaugcagccucaca

SEQ ID NO: 1204841 - RNA, 16 nt, Human
cuggaugcagccucac

SEQ ID NO: 1204842 - RNA, 14 nt, Human
cugcuuccagugag

SEQ ID NO: 1204843 - RNA, 20 nt, Human
cugcuucaaggauccugagc

SEQ ID NO: 1204844 - RNA, 19 nt, Human
cugcuucaaggauccugag

SEQ ID NO: 1204845 - RNA, 16 nt, Human
cugcuucaaggauccu

SEQ ID NO: 1204846 - RNA, 14 nt, Human
cugcuucaaggauc

SEQ ID NO: 1204847 - RNA, 21 nt, Human
cuggagaaaauggacguguua

SEQ ID NO: 1204848 - RNA, 22 nt, Human
cuggcagaguugaagacagagc

SEQ ID NO: 1204849 - RNA, 23 nt, Human
cuggcagccccuguucuggcaga

SEQ ID NO: 1204850 - RNA, 21 nt, Human
cuggcagaguugaagacagag

SEQ ID NO: 1204851 - RNA, 20 nt, Human
cuggcagaguugaagacaga

SEQ ID NO: 1204852 - RNA, 19 nt, Human
cuggcagcucagagagggu

SEQ ID NO: 1204853 - RNA, 17 nt, Human
cuggcagcucagagagg

SEQ ID NO: 1204854 - RNA, 16 nt, Human
cuggcagcucagagag

SEQ ID NO: 1204855 - RNA, 17 nt, Human
cugggacuacaggugug

SEQ ID NO: 1204856 - RNA, 21 nt, Human
cugggacuacaggcacccacc

SEQ ID NO: 1204857 - RNA, 17 nt, Human
cugggacuacaggcacc

SEQ ID NO: 1204858 - RNA, 15 nt, Human
cuggcucuuccaggc

SEQ ID NO: 1204859 - RNA, 14 nt, Human
cuggcucuuccagg

SEQ ID NO: 1204860 - RNA, 13 nt, Human
cuggcucuuccag

SEQ ID NO: 1204861 - RNA, 20 nt, Human
caggggaaaaucagccugcu

SEQ ID NO: 1204862 - RNA, 19 nt, Human
caggggaaaaucagccugc

SEQ ID NO: 1204863 - RNA, 23 nt, Human
cagggcucagcggggacagcucc

SEQ ID NO: 1204864 - RNA, 21 nt, Human
cagggcucagcggggacagcu

SEQ ID NO: 1204865 - RNA, 23 nt, Human
caggcugggcuucaguggcagcu

SEQ ID NO: 1204866 - RNA, 22 nt, Human
caggcugggcuucaguggcagc

SEQ ID NO: 1204867 - RNA, 21 nt, Human
caggcugggcuucaguggcag

SEQ ID NO: 1204868 - RNA, 20 nt, Human
caggcugggcuucaguggca

SEQ ID NO: 1204869 - RNA, 15 nt, Human
caggcugggagagcc

SEQ ID NO: 1204870 - RNA, 14 nt, Human
caggcugggagagc

SEQ ID NO: 1204871 - RNA, 12 nt, Human
caggcugggaga

SEQ ID NO: 1204872 - RNA, 20 nt, Human
caggccaggcccucugccca

SEQ ID NO: 1204873 - RNA, 16 nt, Human
caggccagagggagug

SEQ ID NO: 1204874 - RNA, 19 nt, Human
caggccaggcccucugccc

SEQ ID NO: 1204875 - RNA, 18 nt, Human
caggccaggcccucugcc

SEQ ID NO: 1204876 - RNA, 17 nt, Human
caggccaggcccucugc

SEQ ID NO: 1204877 - RNA, 23 nt, Human
caggccagcugcuugggcuucau

SEQ ID NO: 1204878 - RNA, 21 nt, Human
caggccagcugcuugggcuuc

SEQ ID NO: 1204879 - RNA, 19 nt, Human
caggccagcugcuugggcu

SEQ ID NO: 1204880 - RNA, 15 nt, Human
caggccagagggagu

SEQ ID NO: 1204881 - RNA, 13 nt, Human
caggccagaggga

SEQ ID NO: 1204882 - RNA, 18 nt, Human
caggcagauacaggaaaa

SEQ ID NO: 1204883 - RNA, 14 nt, Human
cagugcaugcuguc

SEQ ID NO: 1204884 - RNA, 13 nt, Human
cagugcaugcugu

SEQ ID NO: 1204885 - RNA, 15 nt, Human
cagucuggaaugcag

SEQ ID NO: 1204886 - RNA, 17 nt, Human
cagucuggaaugcagug

SEQ ID NO: 1204887 - RNA, 18 nt, Human
cagucuggaaugcagugg

SEQ ID NO: 1204888 - RNA, 18 nt, Human
caguggugguuuucuguu

SEQ ID NO: 1204889 - RNA, 21 nt, Human
caguggugcgaucuggguuca

SEQ ID NO: 1204890 - RNA, 18 nt, Human
cagugcccacaggaucag

SEQ ID NO: 1204891 - RNA, 23 nt, Human
cagugggagcugccuguucagcu

SEQ ID NO: 1204892 - RNA, 20 nt, Human
cagugggagcugccuguuca

SEQ ID NO: 1204893 - RNA, 17 nt, Human
cagugcccacaggauca

SEQ ID NO: 1204894 - RNA, 15 nt, Human
cagugcccacaggau

SEQ ID NO: 1204895 - RNA, 13 nt, Human
cagugcccacagg

SEQ ID NO: 1204896 - RNA, 17 nt, Human
cagugcaugcugucccu

SEQ ID NO: 1204897 - RNA, 16 nt, Human
cagugcaugcuguccc

SEQ ID NO: 1204898 - RNA, 14 nt, Human
cagucaccccggcc

SEQ ID NO: 1204899 - RNA, 20 nt, Human
caggugcacaagcuccaagc

SEQ ID NO: 1204900 - RNA, 19 nt, Human
caggugcacaagcuccaag

SEQ ID NO: 1204901 - RNA, 18 nt, Human
caggugcacaagcuccaa

SEQ ID NO: 1204902 - RNA, 17 nt, Human
caggugcacaagcucca

SEQ ID NO: 1204903 - RNA, 23 nt, Human
caggugauccacccaccucagcc

SEQ ID NO: 1204904 - RNA, 22 nt, Human
caggugauccacccaccucagc

SEQ ID NO: 1204905 - RNA, 15 nt, Human
caggugcacaagcuc

SEQ ID NO: 1204906 - RNA, 21 nt, Human
caggugauccacccaccucag

SEQ ID NO: 1204907 - RNA, 16 nt, Human
cagguuuuccugaaga

SEQ ID NO: 1204908 - RNA, 12 nt, Human
cagguuuuccug

SEQ ID NO: 1204909 - RNA, 14 nt, Human
cagguuuaagcugu

SEQ ID NO: 1204910 - RNA, 22 nt, Human
caggugcacaagcuccaagcuc

SEQ ID NO: 1204911 - RNA, 21 nt, Human
caggugcacaagcuccaagcu

SEQ ID NO: 1204912 - RNA, 23 nt, Human
cagaggggguggccucccaacuc

SEQ ID NO: 1204913 - RNA, 22 nt, Human
cagaggggguggccucccaacu

SEQ ID NO: 1204914 - RNA, 19 nt, Human
cagauucuuuccugaggcu

SEQ ID NO: 1204915 - RNA, 18 nt, Human
cagauucuuuccugaggc

SEQ ID NO: 1204916 - RNA, 17 nt, Human
cagauucuuuccugagg

SEQ ID NO: 1204917 - RNA, 17 nt, Human
cagcauagaaguaacuu

SEQ ID NO: 1204918 - RNA, 20 nt, Human
cagcacgauuucuguuuaga

SEQ ID NO: 1204919 - RNA, 19 nt, Human
cagcacgauuucuguuuag

SEQ ID NO: 1204920 - RNA, 18 nt, Human
cagcacgauuucuguuua

SEQ ID NO: 1204921 - RNA, 16 nt, Human
cagcacgauuucuguu

SEQ ID NO: 1204922 - RNA, 22 nt, Human
cagauucuuuccugaggcuggg

SEQ ID NO: 1204923 - RNA, 20 nt, Human
cagauucuuuccugaggcug

SEQ ID NO: 1204924 - RNA, 17 nt, Human
cagauugcaacaggcug

SEQ ID NO: 1204925 - RNA, 20 nt, Human
cagcaucauggagguuugaa

SEQ ID NO: 1204926 - RNA, 13 nt, Human
cagccaguaaaug

SEQ ID NO: 1204927 - RNA, 20 nt, Human
cagccgagauagccaaggcc

SEQ ID NO: 1204928 - RNA, 19 nt, Human
cagccgagauagccaaggc

SEQ ID NO: 1204929 - RNA, 15 nt, Human
cagccugcuccagcu

SEQ ID NO: 1204930 - RNA, 12 nt, Human
cagccugcucca

SEQ ID NO: 1204931 - RNA, 19 nt, Human
cagccugcuaauuccccag

SEQ ID NO: 1204932 - RNA, 19 nt, Human
cagcggggacagcuccuuc

SEQ ID NO: 1204933 - RNA, 18 nt, Human
cagcggggacagcuccuu

SEQ ID NO: 1204934 - RNA, 21 nt, Human
cagcggggacagcuccuucug

SEQ ID NO: 1204935 - RNA, 24 nt, Human
cagcugugcucuggacaggcaugu

SEQ ID NO: 1204936 - RNA, 20 nt, Human
cagcugugcucuggacaggc

SEQ ID NO: 1204937 - RNA, 15 nt, Human
cagcugccugggauc

SEQ ID NO: 1204938 - RNA, 14 nt, Human
cagcugccugggau

SEQ ID NO: 1204939 - RNA, 13 nt, Human
cagcugccuggga

SEQ ID NO: 1204940 - RNA, 12 nt, Human
cagcugccuggg

SEQ ID NO: 1204941 - RNA, 16 nt, Human
caggaaaagcugcuga

SEQ ID NO: 1204942 - RNA, 15 nt, Human
caggaaaagcugcug

SEQ ID NO: 1204943 - RNA, 18 nt, Human
caggaaaagcugcugaca

SEQ ID NO: 1204944 - RNA, 17 nt, Human
cauggcugccaauggga

SEQ ID NO: 1204945 - RNA, 17 nt, Human
caugggaaugaauguca

SEQ ID NO: 1204946 - RNA, 16 nt, Human
caugggaaugaauguc

SEQ ID NO: 1204947 - RNA, 15 nt, Human
caugggaaugaaugu

SEQ ID NO: 1204948 - RNA, 14 nt, Human
caugggaaugaaug

SEQ ID NO: 1204949 - RNA, 13 nt, Human
caugauguuuucc

SEQ ID NO: 1204950 - RNA, 23 nt, Human
caugcuacacacugcauguuugu

SEQ ID NO: 1204951 - RNA, 20 nt, Human
caugcuacacacugcauguu

SEQ ID NO: 1204952 - RNA, 14 nt, Human
caugcuacacacug

SEQ ID NO: 1204953 - RNA, 16 nt, Human
cauucuccaccugcca

SEQ ID NO: 1204954 - RNA, 14 nt, Human
cauucuccaccugc

SEQ ID NO: 1204955 - RNA, 13 nt, Human
cauucuccaccug

SEQ ID NO: 1204956 - RNA, 15 nt, Human
cauguuggccaggcu

SEQ ID NO: 1204957 - RNA, 14 nt, Human
cauguuggccaggc

SEQ ID NO: 1204958 - RNA, 16 nt, Human
cauguuggccaggcug

SEQ ID NO: 1204959 - RNA, 23 nt, Human
cauccuggcacccggccccugcu

SEQ ID NO: 1204960 - RNA, 22 nt, Human
cauccuggcacccggccccugc

SEQ ID NO: 1204961 - RNA, 15 nt, Human
cauccuggcacccgg

SEQ ID NO: 1204962 - RNA, 14 nt, Human
caucacuucccuac

SEQ ID NO: 1204963 - RNA, 12 nt, Human
caucacuucccu

SEQ ID NO: 1204964 - RNA, 22 nt, Human
caguggugguuuucuguucuuu

SEQ ID NO: 1204965 - RNA, 21 nt, Human
caguggugguuuucuguucuu

SEQ ID NO: 1204966 - RNA, 20 nt, Human
caguggugguuuucuguucu

SEQ ID NO: 1204967 - RNA, 19 nt, Human
caguggugguuuucuguuc

SEQ ID NO: 1204968 - RNA, 18 nt, Human
cauauucuguuggccagu

SEQ ID NO: 1204969 - RNA, 17 nt, Human
cauauucuguuggccag

SEQ ID NO: 1204970 - RNA, 16 nt, Human
cauauuaccacagaca

SEQ ID NO: 1204971 - RNA, 21 nt, Human
ccaccuuugaagaaguaagga

SEQ ID NO: 1204972 - RNA, 22 nt, Human
ccaccgcagacaggaccaggga

SEQ ID NO: 1204973 - RNA, 13 nt, Human
ccaccgcagacag

SEQ ID NO: 1204974 - RNA, 17 nt, Human
ccacgcccccacuggug

SEQ ID NO: 1204975 - RNA, 16 nt, Human
ccacgcccccacuggu

SEQ ID NO: 1204976 - RNA, 19 nt, Human
ccacgcccccacuggugac

SEQ ID NO: 1204977 - RNA, 18 nt, Human
ccacgcccccacugguga

SEQ ID NO: 1204978 - RNA, 14 nt, Human
ccaccaucaagcca

SEQ ID NO: 1204979 - RNA, 13 nt, Human
ccaccaucaagcc

SEQ ID NO: 1204980 - RNA, 15 nt, Human
ccaccaucaagccac

SEQ ID NO: 1204981 - RNA, 21 nt, Human
ccaaaacucuccucugcugcu

SEQ ID NO: 1204982 - RNA, 22 nt, Human
cauuuuuuuuaagaaaaaggau

SEQ ID NO: 1204983 - RNA, 17 nt, Human
ccaaugggagcucaugg

SEQ ID NO: 1204984 - RNA, 14 nt, Human
ccaaugcacuuugu

SEQ ID NO: 1204985 - RNA, 15 nt, Human
ccaaugauggucacc

SEQ ID NO: 1204986 - RNA, 17 nt, Human
ccaauauuuaccagacc

SEQ ID NO: 1204987 - RNA, 18 nt, Human
ccaagcucugcuccucuc

SEQ ID NO: 1204988 - RNA, 13 nt, Human
ccaagcucugcuc

SEQ ID NO: 1204989 - RNA, 12 nt, Human
ccaagcucugcu

SEQ ID NO: 1204990 - RNA, 18 nt, Human
ccaacucaccccagcccc

SEQ ID NO: 1204991 - RNA, 17 nt, Human
ccaacucaccccagccc

SEQ ID NO: 1204992 - RNA, 16 nt, Human
ccaacucaccccagcc

SEQ ID NO: 1204993 - RNA, 23 nt, Human
ccaaauggaaaugggcagagcag

SEQ ID NO: 1204994 - RNA, 22 nt, Human
auucuuuccugaggcugggcuc

SEQ ID NO: 1204995 - RNA, 17 nt, Human
auucuuuccugaggcug

SEQ ID NO: 1204996 - RNA, 21 nt, Human
auucucuccuguaccucuuga

SEQ ID NO: 1204997 - RNA, 19 nt, Human
auucucuccuguaccucuu

SEQ ID NO: 1204998 - RNA, 21 nt, Human
auuccugaugcuucuucagag

SEQ ID NO: 1204999 - RNA, 20 nt, Human
auucauauuuacuucuuaua

SEQ ID NO: 1205000 - RNA, 19 nt, Human
auucauauuuacuucuuau

SEQ ID NO: 1205001 - RNA, 18 nt, Human
auucauauuuacuucuua

SEQ ID NO: 1205002 - RNA, 20 nt, Human
auuaaauucuugcaaaguau

SEQ ID NO: 1205003 - RNA, 18 nt, Human
auuaaauucuugcaaagu

SEQ ID NO: 1205004 - RNA, 14 nt, Human
auuaaauucuugca

SEQ ID NO: 1205005 - RNA, 19 nt, Human
auuguucuuaguuugcagu

SEQ ID NO: 1205006 - RNA, 15 nt, Human
auuguaaggaaugau

SEQ ID NO: 1205007 - RNA, 16 nt, Human
auuguaaggaaugauu

SEQ ID NO: 1205008 - RNA, 16 nt, Human
auuucuguuuagauaa

SEQ ID NO: 1205009 - RNA, 14 nt, Human
auuucuguuuagau

SEQ ID NO: 1205010 - RNA, 12 nt, Human
auuucuguuuag

SEQ ID NO: 1205011 - RNA, 19 nt, Human
auuucuguuuagauaauac

SEQ ID NO: 1205012 - RNA, 15 nt, Human
auuuaaugaaagacu

SEQ ID NO: 1205013 - RNA, 14 nt, Human
auuuaaugaaagac

SEQ ID NO: 1205014 - RNA, 22 nt, Human
caacaccucugcacaagcugca

SEQ ID NO: 1205015 - RNA, 20 nt, Human
caacaccuuguuucccucuc

SEQ ID NO: 1205016 - RNA, 21 nt, Human
caaaucugcuuuuuaaagaau

SEQ ID NO: 1205017 - RNA, 23 nt, Human
caacaaaccuguuucugcagcca

SEQ ID NO: 1205018 - RNA, 17 nt, Human
caaaucagcugcuacua

SEQ ID NO: 1205019 - RNA, 22 nt, Human
caaaguacacuguuucaaacuu

SEQ ID NO: 1205020 - RNA, 21 nt, Human
caaaguacacuguuucaaacu

SEQ ID NO: 1205021 - RNA, 20 nt, Human
caaaguacacuguuucaaac

SEQ ID NO: 1205022 - RNA, 16 nt, Human
caaaguacacuguuuc

SEQ ID NO: 1205023 - RNA, 14 nt, Human
caaagaugcagccg

SEQ ID NO: 1205024 - RNA, 13 nt, Human
caaagaugcagcc

SEQ ID NO: 1205025 - RNA, 23 nt, Human
caagacccuuguggucccacccc

SEQ ID NO: 1205026 - RNA, 22 nt, Human
caagacccuuguggucccaccc

SEQ ID NO: 1205027 - RNA, 19 nt, Human
caagacccuugugguccca

SEQ ID NO: 1205028 - RNA, 18 nt, Human
caagacccuugugguccc

SEQ ID NO: 1205029 - RNA, 17 nt, Human
caacucaccccagcccc

SEQ ID NO: 1205030 - RNA, 16 nt, Human
caacucaccccagccc

SEQ ID NO: 1205031 - RNA, 15 nt, Human
caacucaccccagcc

SEQ ID NO: 1205032 - RNA, 13 nt, Human
caacucaccccag

SEQ ID NO: 1205033 - RNA, 17 nt, Human
caacccccagccugcua

SEQ ID NO: 1205034 - RNA, 16 nt, Human
caacccccagccugcu

SEQ ID NO: 1205035 - RNA, 15 nt, Human
caacccccagccugc

SEQ ID NO: 1205036 - RNA, 18 nt, Human
caaccacugcgaccacaa

SEQ ID NO: 1205037 - RNA, 19 nt, Human
caaaagcugggcagguugg

SEQ ID NO: 1205038 - RNA, 15 nt, Human
caaaagcugggcagg

SEQ ID NO: 1205039 - RNA, 17 nt, Human
auuuuuuuuuccuucag

SEQ ID NO: 1205040 - RNA, 16 nt, Human
auuuuuuuuuccuuca

SEQ ID NO: 1205041 - RNA, 13 nt, Human
auuuuuuuuuccu

SEQ ID NO: 1205042 - RNA, 13 nt, Human
auuuuuaagugcu

SEQ ID NO: 1205043 - RNA, 18 nt, Human
auuuugauccaagcuggu

SEQ ID NO: 1205044 - RNA, 13 nt, Human
auuuguuugaacu

SEQ ID NO: 1205045 - RNA, 16 nt, Human
auuuguuugaacugau

SEQ ID NO: 1205046 - RNA, 14 nt, Human
auuuguuugaacug

SEQ ID NO: 1205047 - RNA, 20 nt, Human
auuuguuugaacugauaaag

SEQ ID NO: 1205048 - RNA, 17 nt, Human
cacuggugacaugucuu

SEQ ID NO: 1205049 - RNA, 16 nt, Human
cacuguugcccaggcu

SEQ ID NO: 1205050 - RNA, 15 nt, Human
cacuguugcccaggc

SEQ ID NO: 1205051 - RNA, 23 nt, Human
cacugggcuuggggaccagagcu

SEQ ID NO: 1205052 - RNA, 22 nt, Human
cacugggcuuggggaccagagc

SEQ ID NO: 1205053 - RNA, 17 nt, Human
cacuguugcccaggcug

SEQ ID NO: 1205054 - RNA, 19 nt, Human
cacuguuucaaacuuuacu

SEQ ID NO: 1205055 - RNA, 23 nt, Human
cagaaguuucugccgcagcccug

SEQ ID NO: 1205056 - RNA, 22 nt, Human
cagaaguuucugccgcagcccu

SEQ ID NO: 1205057 - RNA, 21 nt, Human
cagaaguuucugccgcagccc

SEQ ID NO: 1205058 - RNA, 20 nt, Human
cagaaguuucugccgcagcc

SEQ ID NO: 1205059 - RNA, 19 nt, Human
cacucuuauugcccacgcu

SEQ ID NO: 1205060 - RNA, 18 nt, Human
cacucuuauugcccacgc

SEQ ID NO: 1205061 - RNA, 17 nt, Human
cacucuuauugcccacg

SEQ ID NO: 1205062 - RNA, 16 nt, Human
cacggccaggccagag

SEQ ID NO: 1205063 - RNA, 15 nt, Human
cacggccaggccaga

SEQ ID NO: 1205064 - RNA, 14 nt, Human
cacggccaggccag

SEQ ID NO: 1205065 - RNA, 20 nt, Human
cacggagggugacgggggug

SEQ ID NO: 1205066 - RNA, 17 nt, Human
cacggccaggccagagg

SEQ ID NO: 1205067 - RNA, 23 nt, Human
cacuacggaauaguuggcuagga

SEQ ID NO: 1205068 - RNA, 14 nt, Human
caccuuggcucaag

SEQ ID NO: 1205069 - RNA, 13 nt, Human
caccuuggcucaa

SEQ ID NO: 1205070 - RNA, 19 nt, Human
caccuugacagggcacacc

SEQ ID NO: 1205071 - RNA, 17 nt, Human
caccugccagggacaga

SEQ ID NO: 1205072 - RNA, 15 nt, Human
caccuuuguccccac

SEQ ID NO: 1205073 - RNA, 14 nt, Human
caccuuugucccca

SEQ ID NO: 1205074 - RNA, 17 nt, Human
caccuuuguccccaccg

SEQ ID NO: 1205075 - RNA, 16 nt, Human
caccugccagggacag

SEQ ID NO: 1205076 - RNA, 14 nt, Human
caccugccagggac

SEQ ID NO: 1205077 - RNA, 17 nt, Human
cacccagcccacuucug

SEQ ID NO: 1205078 - RNA, 15 nt, Human
caccagcagccugga

SEQ ID NO: 1205079 - RNA, 14 nt, Human
caccagcagccugg

SEQ ID NO: 1205080 - RNA, 23 nt, Human
caccaacauacucccaucuguga

SEQ ID NO: 1205081 - RNA, 23 nt, Human
cacccaggagccccgaggccuuc

SEQ ID NO: 1205082 - RNA, 20 nt, Human
cacccaggagccccgaggcc

SEQ ID NO: 1205083 - RNA, 19 nt, Human
cacccagcccacuucugcc

SEQ ID NO: 1205084 - RNA, 24 nt, Human
cacccaggagccccgaggccuucu

SEQ ID NO: 1205085 - RNA, 21 nt, Human
caccaacauacucccaucugu

SEQ ID NO: 1205086 - RNA, 20 nt, Human
caccaacauacucccaucug

SEQ ID NO: 1205087 - RNA, 21 nt, Human
cacauuuuuuaaaugcaccug

SEQ ID NO: 1205088 - RNA, 17 nt, Human
cacauuuuuuaaaugca

SEQ ID NO: 1205089 - RNA, 14 nt, Human
cacauuuuucuuag

SEQ ID NO: 1205090 - RNA, 13 nt, Human
cacauuuuucuua

SEQ ID NO: 1205091 - RNA, 17 nt, Human
cacauuuuauuuuauua

SEQ ID NO: 1205092 - RNA, 15 nt, Human
cacauuuuauuuuau

SEQ ID NO: 1205093 - RNA, 19 nt, Human
cacaucuugcucugcugac

SEQ ID NO: 1205094 - RNA, 18 nt, Human
cacaucuugcucugcuga

SEQ ID NO: 1205095 - RNA, 17 nt, Human
cacaucuugcucugcug

SEQ ID NO: 1205096 - RNA, 22 nt, Human
cacaucagcacgauuucuguuu

SEQ ID NO: 1205097 - RNA, 21 nt, Human
cacaucagcacgauuucuguu

SEQ ID NO: 1205098 - RNA, 20 nt, Human
cacaucagcacgauuucugu

SEQ ID NO: 1205099 - RNA, 19 nt, Human
cacaguauuacuucugcua

SEQ ID NO: 1205100 - RNA, 18 nt, Human
cacaguauuacuucugcu

SEQ ID NO: 1205101 - RNA, 16 nt, Human
cacaguauuacuucug

SEQ ID NO: 1205102 - RNA, 10 nt, Human
cacagcucuu

SEQ ID NO: 1205103 - RNA, 23 nt, Human
cacagcucuguccugggagugag

SEQ ID NO: 1205104 - RNA, 20 nt, Human
cacagcucuguccugggagu

SEQ ID NO: 1205105 - RNA, 22 nt, Human
cacagcuaacauggaaguacua

SEQ ID NO: 1205106 - RNA, 16 nt, Human
cacagcuaacauggaa

SEQ ID NO: 1205107 - RNA, 15 nt, Human
cacagcuaacaugga

SEQ ID NO: 1205108 - RNA, 22 nt, Human
cacagacccugcccugugggcc

SEQ ID NO: 1205109 - RNA, 18 nt, Human
cacagacauacuaaccag

SEQ ID NO: 1205110 - RNA, 21 nt, Human
cacagacccugcccugugggc

SEQ ID NO: 1205111 - RNA, 20 nt, Human
cacagacccugcccuguggg

SEQ ID NO: 1205112 - RNA, 19 nt, Human
cacagacccugcccugugg

SEQ ID NO: 1205113 - RNA, 13 nt, Human
caaguauuauacc

SEQ ID NO: 1205114 - RNA, 16 nt, Human
cacaagacccuugugg

SEQ ID NO: 1205115 - RNA, 14 nt, Human
cacaagacccuugu

SEQ ID NO: 1205116 - RNA, 14 nt, Human
cacaagccuucggc

SEQ ID NO: 1205117 - RNA, 13 nt, Human
cacaagcuccaag

SEQ ID NO: 1205118 - RNA, 23 nt, Human
caaugcuggcuguuggcuggggg

SEQ ID NO: 1205119 - RNA, 22 nt, Human
caaugcuggcuguuggcugggg

SEQ ID NO: 1205120 - RNA, 22 nt, Human
caaugcugugcccuaaagugua

SEQ ID NO: 1205121 - RNA, 22 nt, Human
ccauccccuguagagugggagc

SEQ ID NO: 1205122 - RNA, 16 nt, Human
ccauccccuguagagu

SEQ ID NO: 1205123 - RNA, 13 nt, Human
ccaugggccuccu

SEQ ID NO: 1205124 - RNA, 16 nt, Human
ccaugaguccccuguu

SEQ ID NO: 1205125 - RNA, 15 nt, Human
ccaugaguccccugu

SEQ ID NO: 1205126 - RNA, 14 nt, Human
ccaugaguccccug

SEQ ID NO: 1205127 - RNA, 19 nt, Human
ccaugagccucagcauccu

SEQ ID NO: 1205128 - RNA, 18 nt, Human
ccaugagccucagcaucc

SEQ ID NO: 1205129 - RNA, 14 nt, Human
ccaugagccucagc

SEQ ID NO: 1205130 - RNA, 13 nt, Human
ccaucccagcccc

SEQ ID NO: 1205131 - RNA, 12 nt, Human
ccaucccagccc

SEQ ID NO: 1205132 - RNA, 23 nt, Human
ccaucccaaacccuucagugcca

SEQ ID NO: 1205133 - RNA, 15 nt, Human
ccaugggccuccugu

SEQ ID NO: 1205134 - RNA, 14 nt, Human
ccaugggccuccug

SEQ ID NO: 1205135 - RNA, 17 nt, Human
ccaugggccuccugugu

SEQ ID NO: 1205136 - RNA, 18 nt, Human
ccaugaguccccuguuug

SEQ ID NO: 1205137 - RNA, 21 nt, Human
ccagucaccccggccaccugc

SEQ ID NO: 1205138 - RNA, 20 nt, Human
ccagucaccccggccaccug

SEQ ID NO: 1205139 - RNA, 13 nt, Human
ccagucaccccgg

SEQ ID NO: 1205140 - RNA, 12 nt, Human
ccagucaccccg

SEQ ID NO: 1205141 - RNA, 23 nt, Human
ccaggcugggagagccuuccagg

SEQ ID NO: 1205142 - RNA, 22 nt, Human
ccaggcugggagagccuuccag

SEQ ID NO: 1205143 - RNA, 21 nt, Human
ccaggcugggagagccuucca

SEQ ID NO: 1205144 - RNA, 18 nt, Human
ccaggcugggagagccuu

SEQ ID NO: 1205145 - RNA, 17 nt, Human
ccaggcugggagagccu

SEQ ID NO: 1205146 - RNA, 15 nt, Human
ccaggcugggagagc

SEQ ID NO: 1205147 - RNA, 14 nt, Human
ccaggcugggagag

SEQ ID NO: 1205148 - RNA, 13 nt, Human
ccaggcugggaga

SEQ ID NO: 1205149 - RNA, 19 nt, Human
ccagcagagcaccuuagac

SEQ ID NO: 1205150 - RNA, 23 nt, Human
ccagcagagcaccuuagacaguc

SEQ ID NO: 1205151 - RNA, 10 nt, Human
ccagccccuu

SEQ ID NO: 1205152 - RNA, 21 nt, Human
ccagccccuggaugcagccuc

SEQ ID NO: 1205153 - RNA, 20 nt, Human
ccagcagccuggacccugug

SEQ ID NO: 1205154 - RNA, 19 nt, Human
ccagcagccuggacccugu

SEQ ID NO: 1205155 - RNA, 15 nt, Human
ccagcagccuggacc

SEQ ID NO: 1205156 - RNA, 23 nt, Human
ccaggaaaggcuccaggagcagc

SEQ ID NO: 1205157 - RNA, 22 nt, Human
ccaggaaaggcuccaggagcag

SEQ ID NO: 1205158 - RNA, 21 nt, Human
ccaggaaaggcuccaggagca

SEQ ID NO: 1205159 - RNA, 20 nt, Human
cccaggcuuagucacugaga

SEQ ID NO: 1205160 - RNA, 15 nt, Human
cccaggcuuagucac

SEQ ID NO: 1205161 - RNA, 23 nt, Human
cccaggaaaggcuccaggagcag

SEQ ID NO: 1205162 - RNA, 22 nt, Human
cccaggaaaggcuccaggagca

SEQ ID NO: 1205163 - RNA, 21 nt, Human
cccaggaaaggcuccaggagc

SEQ ID NO: 1205164 - RNA, 22 nt, Human
cccagcuuaaaggggcuagagu

SEQ ID NO: 1205165 - RNA, 23 nt, Human
cccagcugugcucuggacaggca

SEQ ID NO: 1205166 - RNA, 21 nt, Human
cccagcugugcucuggacagg

SEQ ID NO: 1205167 - RNA, 17 nt, Human
cccagcccacuucugcc

SEQ ID NO: 1205168 - RNA, 14 nt, Human
cccagcccacuucu

SEQ ID NO: 1205169 - RNA, 22 nt, Human
ccccauccucuguacagagccc

SEQ ID NO: 1205170 - RNA, 21 nt, Human
ccccauccucuguacagagcc

SEQ ID NO: 1205171 - RNA, 19 nt, Human
ccccauccucuguacagag

SEQ ID NO: 1205172 - RNA, 21 nt, Human
ccccagcaagugagagcuggg

SEQ ID NO: 1205173 - RNA, 20 nt, Human
ccccagcaagugagagcugg

SEQ ID NO: 1205174 - RNA, 19 nt, Human
ccccagcaagugagagcug

SEQ ID NO: 1205175 - RNA, 17 nt, Human
ccccagcaagugagagc

SEQ ID NO: 1205176 - RNA, 23 nt, Human
ccccagauugcaacaggcugggc

SEQ ID NO: 1205177 - RNA, 22 nt, Human
ccccagauugcaacaggcuggg

SEQ ID NO: 1205178 - RNA, 23 nt, Human
cccauucugccugcccaggcccc

SEQ ID NO: 1205179 - RNA, 22 nt, Human
cccauucugccugcccaggccc

SEQ ID NO: 1205180 - RNA, 21 nt, Human
cccauucugccugcccaggcc

SEQ ID NO: 1205181 - RNA, 14 nt, Human
ccccauucugccug

SEQ ID NO: 1205182 - RNA, 13 nt, Human
ccccauucugccu

SEQ ID NO: 1205183 - RNA, 15 nt, Human
ccccauucugccugc

SEQ ID NO: 1205184 - RNA, 19 nt, Human
ccccuucgcuccugugucu

SEQ ID NO: 1205185 - RNA, 17 nt, Human
ccccuucgcuccugugu

SEQ ID NO: 1205186 - RNA, 15 nt, Human
ccccuucgcuccugu

SEQ ID NO: 1205187 - RNA, 14 nt, Human
ccccuucgcuccug

SEQ ID NO: 1205188 - RNA, 17 nt, Human
ccccuucugacccaugc

SEQ ID NO: 1205189 - RNA, 12 nt, Human
cccgggaagggg

SEQ ID NO: 1205190 - RNA, 12 nt, Human
cccggcugcgga

SEQ ID NO: 1205191 - RNA, 22 nt, Human
cccuucucuccagccccuggau

SEQ ID NO: 1205192 - RNA, 21 nt, Human
cccuucucuccagccccugga

SEQ ID NO: 1205193 - RNA, 15 nt, Human
cccuucgcuccugug

SEQ ID NO: 1205194 - RNA, 14 nt, Human
cccuucgcuccugu

SEQ ID NO: 1205195 - RNA, 13 nt, Human
ccggccccugcug

SEQ ID NO: 1205196 - RNA, 13 nt, Human
cccuucgcuccug

SEQ ID NO: 1205197 - RNA, 20 nt, Human
cccugugauggggcccugcc

SEQ ID NO: 1205198 - RNA, 19 nt, Human
cccugugauggggcccugc

SEQ ID NO: 1205199 - RNA, 18 nt, Human
cccugugauggggcccug

SEQ ID NO: 1205200 - RNA, 23 nt, Human
cccugucucaaaaaaagaaaaag

SEQ ID NO: 1205201 - RNA, 20 nt, Human
cccugucucaaaaaaagaaa

SEQ ID NO: 1205202 - RNA, 16 nt, Human
cccugucuaaugaaac

SEQ ID NO: 1205203 - RNA, 15 nt, Human
ccggccccugcuggu

SEQ ID NO: 1205204 - RNA, 14 nt, Human
ccggccccugcugg

SEQ ID NO: 1205205 - RNA, 16 nt, Human
ccucccaucucacaca

SEQ ID NO: 1205206 - RNA, 13 nt, Human
ccucccaucucac

SEQ ID NO: 1205207 - RNA, 17 nt, Human
ccucccaccucagccuc

SEQ ID NO: 1205208 - RNA, 15 nt, Human
ccucccaccucagcc

SEQ ID NO: 1205209 - RNA, 21 nt, Human
ccuggccucugcacuccccug

SEQ ID NO: 1205210 - RNA, 20 nt, Human
ccuggccucugcacuccccu

SEQ ID NO: 1205211 - RNA, 22 nt, Human
ccuggccucaagugauucuccu

SEQ ID NO: 1205212 - RNA, 22 nt, Human
ccuggccuagcauacguacaca

SEQ ID NO: 1205213 - RNA, 22 nt, Human
ccuggccucugcacuccccugc

SEQ ID NO: 1205214 - RNA, 21 nt, Human
ccugguggcagugggagcugc

SEQ ID NO: 1205215 - RNA, 18 nt, Human
ccugggggcugggcagag

SEQ ID NO: 1205216 - RNA, 22 nt, Human
ccugucuaaugaaaccuguguc

SEQ ID NO: 1205217 - RNA, 15 nt, Human
ccugucuaaugaaac

SEQ ID NO: 1205218 - RNA, 11 nt, Human
ccucuuucccu

SEQ ID NO: 1205219 - RNA, 19 nt, Human
ccugcugcaguugccaguc

SEQ ID NO: 1205220 - RNA, 17 nt, Human
ccugcugcaguugccag

SEQ ID NO: 1205221 - RNA, 23 nt, Human
ccugccucgaacuggcugcaaag

SEQ ID NO: 1205222 - RNA, 21 nt, Human
ccugccucgaacuggcugcaa

SEQ ID NO: 1205223 - RNA, 19 nt, Human
ccugccucgaacuggcugc

SEQ ID NO: 1205224 - RNA, 21 nt, Human
ccugcugcaguugccagucac

SEQ ID NO: 1205225 - RNA, 20 nt, Human
ccugcugcaguugccaguca

SEQ ID NO: 1205226 - RNA, 20 nt, Human
ccugcccaccuggccucugc

SEQ ID NO: 1205227 - RNA, 14 nt, Human
ccugcccaccuggc

SEQ ID NO: 1205228 - RNA, 13 nt, Human
ccugcccaccugg

SEQ ID NO: 1205229 - RNA, 12 nt, Human
ccugcccaccug

SEQ ID NO: 1205230 - RNA, 13 nt, Human
ccugcccaggccc

SEQ ID NO: 1205231 - RNA, 19 nt, Human
ccugcacuugcagacucua

SEQ ID NO: 1205232 - RNA, 18 nt, Human
ccugcacuugcagacucu

SEQ ID NO: 1205233 - RNA, 17 nt, Human
ccugcacuugcagacuc

SEQ ID NO: 1205234 - RNA, 16 nt, Human
ccucuuucccucccuu

SEQ ID NO: 1205235 - RNA, 13 nt, Human
ccucuuucccucc

SEQ ID NO: 1205236 - RNA, 23 nt, Human
cuaaguuuuuauggcuuuugugc

SEQ ID NO: 1205237 - RNA, 21 nt, Human
cuaagugguacuaacuuuccu

SEQ ID NO: 1205238 - RNA, 23 nt, Human
cuaagugauccucccaccucagc

SEQ ID NO: 1205239 - RNA, 22 nt, Human
cuacaguugaaaaacagcugag

SEQ ID NO: 1205240 - RNA, 21 nt, Human
cuacaguugaaaaacagcuga

SEQ ID NO: 1205241 - RNA, 20 nt, Human
cuacaguccucccaucucac

SEQ ID NO: 1205242 - RNA, 19 nt, Human
cuacaguccucccaucuca

SEQ ID NO: 1205243 - RNA, 17 nt, Human
cuaccuuuguauucucu

SEQ ID NO: 1205244 - RNA, 23 nt, Human
cuagcauacguacacauuuuauu

SEQ ID NO: 1205245 - RNA, 21 nt, Human
cuagcauacguacacauuuua

SEQ ID NO: 1205246 - RNA, 22 nt, Human
cuagaagauuuugaaauuuuua

SEQ ID NO: 1205247 - RNA, 15 nt, Human
cuaguuugauuaaau

SEQ ID NO: 1205248 - RNA, 13 nt, Human
cuaguuugauuaa

SEQ ID NO: 1205249 - RNA, 23 nt, Human
cuaguuguuugauucagacagcu

SEQ ID NO: 1205250 - RNA, 17 nt, Human
cuagccagaggagagag

SEQ ID NO: 1205251 - RNA, 15 nt, Human
cuagccagaggagag

SEQ ID NO: 1205252 - RNA, 13 nt, Human
cuagccagaggag

SEQ ID NO: 1205253 - RNA, 12 nt, Human
cuagccagagga

SEQ ID NO: 1205254 - RNA, 22 nt, Human
cuaguuugauuaaauucuugca

SEQ ID NO: 1205255 - RNA, 15 nt, Human
cuaucucccccagcc

SEQ ID NO: 1205256 - RNA, 14 nt, Human
cuaucuaaauguug

SEQ ID NO: 1205257 - RNA, 18 nt, Human
cucaaaagcugggcaggu

SEQ ID NO: 1205258 - RNA, 17 nt, Human
cucaaaaaaagaaaaag

SEQ ID NO: 1205259 - RNA, 17 nt, Human
cuaucucccccagcccc

SEQ ID NO: 1205260 - RNA, 16 nt, Human
cuaucucccccagccc

SEQ ID NO: 1205261 - RNA, 18 nt, Human
cuaucucccccagcccca

SEQ ID NO: 1205262 - RNA, 20 nt, Human
cucaaacucuugaccucagg

SEQ ID NO: 1205263 - RNA, 15 nt, Human
cucaaugcacugaca

SEQ ID NO: 1205264 - RNA, 13 nt, Human
cucaaugcacuga

SEQ ID NO: 1205265 - RNA, 21 nt, Human
ccuuuuuuagaguugauacua

SEQ ID NO: 1205266 - RNA, 13 nt, Human
cgacaaugcaaac

SEQ ID NO: 1205267 - RNA, 12 nt, Human
cgacaaugcaaa

SEQ ID NO: 1205268 - RNA, 20 nt, Human
cgacccuugccgucuaccug

SEQ ID NO: 1205269 - RNA, 19 nt, Human
cgacccuugccgucuaccu

SEQ ID NO: 1205270 - RNA, 17 nt, Human
cgacugcccggcagggu

SEQ ID NO: 1205271 - RNA, 17 nt, Human
ccuugccgucuaccuga

SEQ ID NO: 1205272 - RNA, 16 nt, Human
ccuugccgucuaccug

SEQ ID NO: 1205273 - RNA, 17 nt, Human
ccuuuugagugccuuac

SEQ ID NO: 1205274 - RNA, 15 nt, Human
ccuuuugagugccuu

SEQ ID NO: 1205275 - RNA, 21 nt, Human
ccuuucaauaggaaaaacuga

SEQ ID NO: 1205276 - RNA, 22 nt, Human
cgcaggauucuuccucccuccc

SEQ ID NO: 1205277 - RNA, 14 nt, Human
cgauagugguggug

SEQ ID NO: 1205278 - RNA, 17 nt, Human
cgccagauucuuuccug

SEQ ID NO: 1205279 - RNA, 18 nt, Human
cgguguggagaagcggcu

SEQ ID NO: 1205280 - RNA, 22 nt, Human
cggggacagcuccuucuguccu

SEQ ID NO: 1205281 - RNA, 15 nt, Human
cggggacagcuccuu

SEQ ID NO: 1205282 - RNA, 14 nt, Human
cggggacagcuccu

SEQ ID NO: 1205283 - RNA, 17 nt, Human
cgggcucugccucccau

SEQ ID NO: 1205284 - RNA, 16 nt, Human
cgggcucugccuccca

SEQ ID NO: 1205285 - RNA, 14 nt, Human
cgggcucugccucc

SEQ ID NO: 1205286 - RNA, 19 nt, Human
cgggcucagcaaaagaugc

SEQ ID NO: 1205287 - RNA, 15 nt, Human
cgggcucagcaaaag

SEQ ID NO: 1205288 - RNA, 11 nt, Human
cgggcucagca

SEQ ID NO: 1205289 - RNA, 17 nt, Human
cgggccacagagaaagu

SEQ ID NO: 1205290 - RNA, 14 nt, Human
cgggccacagagaa

SEQ ID NO: 1205291 - RNA, 12 nt, Human
cgggccacagag

SEQ ID NO: 1205292 - RNA, 16 nt, Human
cggcuccaggcuccuu

SEQ ID NO: 1205293 - RNA, 15 nt, Human
cggcuccaggcuccu

SEQ ID NO: 1205294 - RNA, 14 nt, Human
cggcuccaggcucc

SEQ ID NO: 1205295 - RNA, 13 nt, Human
cggcuccaggcuc

SEQ ID NO: 1205296 - RNA, 12 nt, Human
cggcuccaggcu

SEQ ID NO: 1205297 - RNA, 17 nt, Human
cggcucacugcagccuc

SEQ ID NO: 1205298 - RNA, 16 nt, Human
cggcucacugcagccu

SEQ ID NO: 1205299 - RNA, 15 nt, Human
cggcucacugcagcc

SEQ ID NO: 1205300 - RNA, 21 nt, Human
cggagucccaccuuggcugca

SEQ ID NO: 1205301 - RNA, 20 nt, Human
cggagucccaccuuggcugc

SEQ ID NO: 1205302 - RNA, 18 nt, Human
cggagucccaccuuggcu

SEQ ID NO: 1205303 - RNA, 16 nt, Human
cggagucccaccuugg

SEQ ID NO: 1205304 - RNA, 13 nt, Human
cgcugccccuggc

SEQ ID NO: 1205305 - RNA, 20 nt, Human
cguguaaccauggacccaau

SEQ ID NO: 1205306 - RNA, 14 nt, Human
cgugcacacaccag

SEQ ID NO: 1205307 - RNA, 16 nt, Human
cgugaguccuggcaug

SEQ ID NO: 1205308 - RNA, 17 nt, Human
cgugaggccagagacac

SEQ ID NO: 1205309 - RNA, 17 nt, Human
cgugaguccuggcaugg

SEQ ID NO: 1205310 - RNA, 18 nt, Human
cgugaguccuggcauggg

SEQ ID NO: 1205311 - RNA, 16 nt, Human
cgguuuuacugcagcu

SEQ ID NO: 1205312 - RNA, 22 nt, Human
cugagaggacuuuucuuugugg

SEQ ID NO: 1205313 - RNA, 21 nt, Human
cugagaggacuuuucuuugug

SEQ ID NO: 1205314 - RNA, 17 nt, Human
cugagaguagagucacu

SEQ ID NO: 1205315 - RNA, 22 nt, Human
cugagacucgcgacaaugcaaa

SEQ ID NO: 1205316 - RNA, 21 nt, Human
cugagacucgcgacaaugcaa

SEQ ID NO: 1205317 - RNA, 23 nt, Human
cugagacagcccgggcucugccu

SEQ ID NO: 1205318 - RNA, 22 nt, Human
cugacccaugcugcccugugag

SEQ ID NO: 1205319 - RNA, 21 nt, Human
cugacccaugcugcccuguga

SEQ ID NO: 1205320 - RNA, 21 nt, Human
cugagaucaaaacgguuuuac

SEQ ID NO: 1205321 - RNA, 15 nt, Human
cugagcuuucugcua

SEQ ID NO: 1205322 - RNA, 14 nt, Human
cugagcuuucugcu

SEQ ID NO: 1205323 - RNA, 23 nt, Human
cugaggacacuaaccacgcugga

SEQ ID NO: 1205324 - RNA, 20 nt, Human
cugaggacacuaaccacgcu

SEQ ID NO: 1205325 - RNA, 21 nt, Human
cugaggaauccagacccggcu

SEQ ID NO: 1205326 - RNA, 20 nt, Human
cugaggaauccagacccggc

SEQ ID NO: 1205327 - RNA, 17 nt, Human
cugaggaauccagaccc

SEQ ID NO: 1205328 - RNA, 12 nt, Human
cugaggugggag

SEQ ID NO: 1205329 - RNA, 21 nt, Human
cugaguacguugugcauuugg

SEQ ID NO: 1205330 - RNA, 20 nt, Human
cugaguacguugugcauuug

SEQ ID NO: 1205331 - RNA, 19 nt, Human
cugaguacguugugcauuu

SEQ ID NO: 1205332 - RNA, 18 nt, Human
cugaguacguugugcauu

SEQ ID NO: 1205333 - RNA, 23 nt, Human
cucuugagccuugaacuuugacc

SEQ ID NO: 1205334 - RNA, 18 nt, Human
cucuugagccuugaacuu

SEQ ID NO: 1205335 - RNA, 17 nt, Human
cucuugagccuugaacu

SEQ ID NO: 1205336 - RNA, 16 nt, Human
cucuugagccuugaac

SEQ ID NO: 1205337 - RNA, 23 nt, Human
cugaaggacauugcggacagcca

SEQ ID NO: 1205338 - RNA, 17 nt, Human
cugaaggcuggguucug

SEQ ID NO: 1205339 - RNA, 21 nt, Human
cugaaggccccgcccaggcuu

SEQ ID NO: 1205340 - RNA, 19 nt, Human
cugaaggccccgcccaggc

SEQ ID NO: 1205341 - RNA, 23 nt, Human
cugacaacacucauugaccugag

SEQ ID NO: 1205342 - RNA, 22 nt, Human
cugacaacacucauugaccuga

SEQ ID NO: 1205343 - RNA, 20 nt, Human
cucuuauugcccacgcugga

SEQ ID NO: 1205344 - RNA, 19 nt, Human
cucuuauugcccacgcugg

SEQ ID NO: 1205345 - RNA, 15 nt, Human
cucuuauugcccacg

SEQ ID NO: 1205346 - RNA, 14 nt, Human
cucuuauugcccac

SEQ ID NO: 1205347 - RNA, 19 nt, Human
cucuucagaucucuaacuu

SEQ ID NO: 1205348 - RNA, 18 nt, Human
cucuucagaucucuaacu

SEQ ID NO: 1205349 - RNA, 14 nt, Human
cucuucaaucucuu

SEQ ID NO: 1205350 - RNA, 20 nt, Human
cucugcuccucuccccagca

SEQ ID NO: 1205351 - RNA, 18 nt, Human
cucugcuccucuccccag

SEQ ID NO: 1205352 - RNA, 13 nt, Human
cucugcuccucuc

SEQ ID NO: 1205353 - RNA, 13 nt, Human
cucugcagcaaua

SEQ ID NO: 1205354 - RNA, 21 nt, Human
cucugcacuccccugcugggu

SEQ ID NO: 1205355 - RNA, 20 nt, Human
cucugcacuccccugcuggg

SEQ ID NO: 1205356 - RNA, 14 nt, Human
cucugguccauaga

SEQ ID NO: 1205357 - RNA, 16 nt, Human
cucugcugacagacac

SEQ ID NO: 1205358 - RNA, 14 nt, Human
cucugcugacagac

SEQ ID NO: 1205359 - RNA, 13 nt, Human
cucugcugacaga

SEQ ID NO: 1205360 - RNA, 15 nt, Human
cucugguccauagag

SEQ ID NO: 1205361 - RNA, 15 nt, Human
cucugguuaucuaau

SEQ ID NO: 1205362 - RNA, 12 nt, Human
cucauguucuua

SEQ ID NO: 1205363 - RNA, 15 nt, Human
cuccaagaccuucuc

SEQ ID NO: 1205364 - RNA, 22 nt, Human
cuccaagaccuucuccuucacc

SEQ ID NO: 1205365 - RNA, 24 nt, Human
cuccaagcaggacauggacaagga

SEQ ID NO: 1205366 - RNA, 22 nt, Human
cuccaagcaggacauggacaag

SEQ ID NO: 1205367 - RNA, 14 nt, Human
cuccaagcaggaca

SEQ ID NO: 1205368 - RNA, 13 nt, Human
cuccaagcaggac

SEQ ID NO: 1205369 - RNA, 16 nt, Human
cuccaagcucccaggc

SEQ ID NO: 1205370 - RNA, 15 nt, Human
cuccaagcucccagg

SEQ ID NO: 1205371 - RNA, 14 nt, Human
cuccaagcucccag

SEQ ID NO: 1205372 - RNA, 13 nt, Human
cuccaagcuccca

SEQ ID NO: 1205373 - RNA, 17 nt, Human
cuccaagcucccaggca

SEQ ID NO: 1205374 - RNA, 20 nt, Human
cuccacuuucuagccagagg

SEQ ID NO: 1205375 - RNA, 19 nt, Human
cuccacuuucuagccagag

SEQ ID NO: 1205376 - RNA, 16 nt, Human
cuccacuuucuagcca

SEQ ID NO: 1205377 - RNA, 16 nt, Human
cucgaacuggcugcaa

SEQ ID NO: 1205378 - RNA, 15 nt, Human
cucgaacuggcugca

SEQ ID NO: 1205379 - RNA, 14 nt, Human
cucgaacuggcugc

SEQ ID NO: 1205380 - RNA, 13 nt, Human
cucgaacuggcug

SEQ ID NO: 1205381 - RNA, 18 nt, Human
cuccucugcugcuggcug

SEQ ID NO: 1205382 - RNA, 16 nt, Human
cuccucugcugcuggc

SEQ ID NO: 1205383 - RNA, 18 nt, Human
cuccuggcccacugcauc

SEQ ID NO: 1205384 - RNA, 16 nt, Human
cuccuggcccacugca

SEQ ID NO: 1205385 - RNA, 20 nt, Human
cucccccagccccauccucu

SEQ ID NO: 1205386 - RNA, 15 nt, Human
cucccccagccccau

SEQ ID NO: 1205387 - RNA, 22 nt, Human
cucccccagccccauccucugu

SEQ ID NO: 1205388 - RNA, 16 nt, Human
auugucaaagugguga

SEQ ID NO: 1205389 - RNA, 20 nt, Human
auuguccccgacccuugccg

SEQ ID NO: 1205390 - RNA, 19 nt, Human
auuguccccgacccuugcc

SEQ ID NO: 1205391 - RNA, 17 nt, Human
auuguccccgacccuug

SEQ ID NO: 1205392 - RNA, 18 nt, Human
auugugucucuugguccu

SEQ ID NO: 1205393 - RNA, 14 nt, Human
auugugucucuugg

SEQ ID NO: 1205394 - RNA, 17 nt, Human
auucuccuuguguuacu

SEQ ID NO: 1205395 - RNA, 13 nt, Human
auucuucuccacu

SEQ ID NO: 1205396 - RNA, 22 nt, Human
auucuuccucccucccucuuuc

SEQ ID NO: 1205397 - RNA, 13 nt, Human
auucuuauuuaau

SEQ ID NO: 1205398 - RNA, 18 nt, Human
auucuuauuuaaugaaag

SEQ ID NO: 1205399 - RNA, 14 nt, Human
auucuuauuuaaug

SEQ ID NO: 1205400 - RNA, 14 nt, Human
auuugaaaauuuug

SEQ ID NO: 1205401 - RNA, 15 nt, Human
auuugaaaauuuuga

SEQ ID NO: 1205402 - RNA, 17 nt, Human
auuuccguuaaaauacc

SEQ ID NO: 1205403 - RNA, 16 nt, Human
auuuccguuaaaauac

SEQ ID NO: 1205404 - RNA, 15 nt, Human
auuuccguuaaaaua

SEQ ID NO: 1205405 - RNA, 17 nt, Human
auuuccagccaaagccu

SEQ ID NO: 1205406 - RNA, 13 nt, Human
auuuauucugcuc

SEQ ID NO: 1205407 - RNA, 15 nt, Human
auuuagaaauauaau

SEQ ID NO: 1205408 - RNA, 17 nt, Human
auuuacuucuuauacau

SEQ ID NO: 1205409 - RNA, 16 nt, Human
auuuacuucuuauaca

SEQ ID NO: 1205410 - RNA, 14 nt, Human
auuuacuucuuaua

SEQ ID NO: 1205411 - RNA, 15 nt, Human
auuuaacagaaaugu

SEQ ID NO: 1205412 - RNA, 14 nt, Human
auuuaacagaaaug

SEQ ID NO: 1205413 - RNA, 12 nt, Human
auuuaacagaaa

SEQ ID NO: 1205414 - RNA, 14 nt, Human
auuuauucugcuca

SEQ ID NO: 1205415 - RNA, 15 nt, Human
auuuuaauucaguug

SEQ ID NO: 1205416 - RNA, 15 nt, Human
auuugugauacaaug

SEQ ID NO: 1205417 - RNA, 14 nt, Human
auuugugauacaau

SEQ ID NO: 1205418 - RNA, 24 nt, Human
auguggaguucaucuugaauugua

SEQ ID NO: 1205419 - RNA, 20 nt, Human
auguggaguucaucuugaau

SEQ ID NO: 1205420 - RNA, 22 nt, Human
augugccagguuuuuggucuga

SEQ ID NO: 1205421 - RNA, 12 nt, Human
auggggcugcac

SEQ ID NO: 1205422 - RNA, 20 nt, Human
auggggcccugccuccuuug

SEQ ID NO: 1205423 - RNA, 20 nt, Human
auguugcccaggcaggucuu

SEQ ID NO: 1205424 - RNA, 17 nt, Human
auguugcccaggcaggu

SEQ ID NO: 1205425 - RNA, 12 nt, Human
auguugcccagg

SEQ ID NO: 1205426 - RNA, 20 nt, Human
uuuucauuuaggugaggaag

SEQ ID NO: 1205427 - RNA, 13 nt, Human
uuuuauuaugcau

SEQ ID NO: 1205428 - RNA, 11 nt, Human
uuuuauuuuau

SEQ ID NO: 1205429 - RNA, 22 nt, Human
auuaaaaaucucaaauuucuaa

SEQ ID NO: 1205430 - RNA, 20 nt, Human
auuaaaaaucucaaauuucu

SEQ ID NO: 1205431 - RNA, 19 nt, Human
auuaaaaaucucaaauuuc

SEQ ID NO: 1205432 - RNA, 15 nt, Human
auuaaaaaucucaaa

SEQ ID NO: 1205433 - RNA, 16 nt, Human
auuaaacuuaaucuaa

SEQ ID NO: 1205434 - RNA, 21 nt, Human
uuuuguuccacaaguuaaaua

SEQ ID NO: 1205435 - RNA, 15 nt, Human
uuuuguuccacaagu

SEQ ID NO: 1205436 - RNA, 23 nt, Human
uuuugugcauuaucuagauacug

SEQ ID NO: 1205437 - RNA, 20 nt, Human
uuuugugcauuaucuagaua

SEQ ID NO: 1205438 - RNA, 17 nt, Human
uuuugugcauuaucuag

SEQ ID NO: 1205439 - RNA, 12 nt, Human
uuuuuauggcuu

SEQ ID NO: 1205440 - RNA, 20 nt, Human
uuuuuaucgucacugcuuaa

SEQ ID NO: 1205441 - RNA, 23 nt, Human
uuuuuauacauaaacaagaccac

SEQ ID NO: 1205442 - RNA, 11 nt, Human
uuuuuacuaau

SEQ ID NO: 1205443 - RNA, 22 nt, Human
uuuuuagacagagucucacugu

SEQ ID NO: 1205444 - RNA, 23 nt, Human
uuuugccauguuggccaggcugg

SEQ ID NO: 1205445 - RNA, 17 nt, Human
uuuugauccaagcuggu

SEQ ID NO: 1205446 - RNA, 17 nt, Human
uuuugagugccuuacac

SEQ ID NO: 1205447 - RNA, 16 nt, Human
auuaaguacuauguau

SEQ ID NO: 1205448 - RNA, 14 nt, Human
auuaaguacuaugu

SEQ ID NO: 1205449 - RNA, 22 nt, Human
uuuuuauggcuuuugugcauua

SEQ ID NO: 1205450 - RNA, 21 nt, Human
uuuuuauggcuuuugugcauu

SEQ ID NO: 1205451 - RNA, 20 nt, Human
uuuuuauggcuuuugugcau

SEQ ID NO: 1205452 - RNA, 22 nt, Human
uuuuuguuccacaaguuaaaua

SEQ ID NO: 1205453 - RNA, 20 nt, Human
uuuuuguagagccagggucu

SEQ ID NO: 1205454 - RNA, 19 nt, Human
uuuuuguagagccaggguc

SEQ ID NO: 1205455 - RNA, 12 nt, Human
auuacuucugcu

SEQ ID NO: 1205456 - RNA, 20 nt, Human
auucaggaagcucagggccu

SEQ ID NO: 1205457 - RNA, 19 nt, Human
auucaggaagcucagggcc

SEQ ID NO: 1205458 - RNA, 17 nt, Human
auucaggaagcucaggg

SEQ ID NO: 1205459 - RNA, 19 nt, Human
auucaguaauaacucuacc

SEQ ID NO: 1205460 - RNA, 15 nt, Human
auucaguaauaacuc

SEQ ID NO: 1205461 - RNA, 14 nt, Human
auucaggaagcuca

SEQ ID NO: 1205462 - RNA, 17 nt, Human
auucccaagcucugcuc

SEQ ID NO: 1205463 - RNA, 16 nt, Human
auucccaagcucugcu

SEQ ID NO: 1205464 - RNA, 15 nt, Human
auucccaagcucugc

SEQ ID NO: 1205465 - RNA, 14 nt, Human
auucccaagcucug

SEQ ID NO: 1205466 - RNA, 16 nt, Human
auucuccuuguguuac

SEQ ID NO: 1205467 - RNA, 20 nt, Human
auucuccugccucagccucc

SEQ ID NO: 1205468 - RNA, 19 nt, Human
auucuccugccucagccuc

SEQ ID NO: 1205469 - RNA, 17 nt, Human
auucuccugccucagcc

SEQ ID NO: 1205470 - RNA, 15 nt, Human
auucuccugccucag

SEQ ID NO: 1205471 - RNA, 14 nt, Human
auucuccugccuca

SEQ ID NO: 1205472 - RNA, 13 nt, Human
auucuccugccuc

SEQ ID NO: 1205473 - RNA, 11 nt, Human
auucuccugcc

SEQ ID NO: 1205474 - RNA, 21 nt, Human
auucuccaccugccagggaca

SEQ ID NO: 1205475 - RNA, 20 nt, Human
auucuccaccugccagggac

SEQ ID NO: 1205476 - RNA, 19 nt, Human
auucuccaccugccaggga

SEQ ID NO: 1205477 - RNA, 12 nt, Human
auugaaaucuuu

SEQ ID NO: 1205478 - RNA, 19 nt, Human
uugcugaauacagaggcaa

SEQ ID NO: 1205479 - RNA, 20 nt, Human
uugcuaagugaggaugaaaa

SEQ ID NO: 1205480 - RNA, 17 nt, Human
uuggaaagaguaggaag

SEQ ID NO: 1205481 - RNA, 19 nt, Human
uugcugauggugcaaugac

SEQ ID NO: 1205482 - RNA, 18 nt, Human
uugcugauggugcaauga

SEQ ID NO: 1205483 - RNA, 17 nt, Human
uugcugauggugcaaug

SEQ ID NO: 1205484 - RNA, 14 nt, Human
augaaaugagguca

SEQ ID NO: 1205485 - RNA, 20 nt, Human
augaaagacuguacaaagua

SEQ ID NO: 1205486 - RNA, 16 nt, Human
uuggcugcugaaggcu

SEQ ID NO: 1205487 - RNA, 22 nt, Human
uuggcgcugccccuggcagccc

SEQ ID NO: 1205488 - RNA, 15 nt, Human
uuggcugcugaaggc

SEQ ID NO: 1205489 - RNA, 11 nt, Human
uuggcugcuga

SEQ ID NO: 1205490 - RNA, 14 nt, Human
uuggcugcagggag

SEQ ID NO: 1205491 - RNA, 23 nt, Human
uuggcuauuagagaucaaccccu

SEQ ID NO: 1205492 - RNA, 22 nt, Human
uuggcuaggaccccuccaugug

SEQ ID NO: 1205493 - RNA, 22 nt, Human
uuggcuagagguucaaagauau

SEQ ID NO: 1205494 - RNA, 21 nt, Human
uuggcuagagguucaaagaua

SEQ ID NO: 1205495 - RNA, 23 nt, Human
uuggaaagaguaggaagacuuug

SEQ ID NO: 1205496 - RNA, 18 nt, Human
uuggaaagaguaggaaga

SEQ ID NO: 1205497 - RNA, 20 nt, Human
uuguaaggaaugauuaauua

SEQ ID NO: 1205498 - RNA, 20 nt, Human
augacacgaauauugcugau

SEQ ID NO: 1205499 - RNA, 19 nt, Human
augacacgaauauugcuga

SEQ ID NO: 1205500 - RNA, 17 nt, Human
uugggguacccacugcu

SEQ ID NO: 1205501 - RNA, 19 nt, Human
uuggggaagaacgaagcca

SEQ ID NO: 1205502 - RNA, 22 nt, Human
augaaccacaucuugcucugcu

SEQ ID NO: 1205503 - RNA, 20 nt, Human
augaaccacaucuugcucug

SEQ ID NO: 1205504 - RNA, 13 nt, Human
augaaccacaucu

SEQ ID NO: 1205505 - RNA, 19 nt, Human
uugguuaggcauuguggga

SEQ ID NO: 1205506 - RNA, 22 nt, Human
uugggguacccacugcucuggu

SEQ ID NO: 1205507 - RNA, 14 nt, Human
uuguaaggaaugau

SEQ ID NO: 1205508 - RNA, 19 nt, Human
augaucacggcucacugca

SEQ ID NO: 1205509 - RNA, 18 nt, Human
augaucacggcucacugc

SEQ ID NO: 1205510 - RNA, 15 nt, Human
augaucacggcucac

SEQ ID NO: 1205511 - RNA, 16 nt, Human
augauccuaggcauuu

SEQ ID NO: 1205512 - RNA, 23 nt, Human
augaucacggcucacugcagccu

SEQ ID NO: 1205513 - RNA, 14 nt, Human
augaucuucuuuau

SEQ ID NO: 1205514 - RNA, 15 nt, Human
augaucuaggaagac

SEQ ID NO: 1205515 - RNA, 16 nt, Human
augcaccuggaauaua

SEQ ID NO: 1205516 - RNA, 22 nt, Human
augcaaggucauuuuuuuuaag

SEQ ID NO: 1205517 - RNA, 16 nt, Human
augcaaggucauuuuu

SEQ ID NO: 1205518 - RNA, 14 nt, Human
augcaaggucauuu

SEQ ID NO: 1205519 - RNA, 22 nt, Human
augcaaaccaucauugaaaucu

SEQ ID NO: 1205520 - RNA, 21 nt, Human
augcaaaccaucauugaaauc

SEQ ID NO: 1205521 - RNA, 20 nt, Human
augcaaaccaucauugaaau

SEQ ID NO: 1205522 - RNA, 19 nt, Human
augcaaaccaucauugaaa

SEQ ID NO: 1205523 - RNA, 18 nt, Human
augcaaaccaucauugaa

SEQ ID NO: 1205524 - RNA, 16 nt, Human
augcaaaccaucauug

SEQ ID NO: 1205525 - RNA, 18 nt, Human
augaucuucuuuauaauu

SEQ ID NO: 1205526 - RNA, 15 nt, Human
augaucuucuuuaua

SEQ ID NO: 1205527 - RNA, 19 nt, Human
augcaccuggaauauauaa

SEQ ID NO: 1205528 - RNA, 15 nt, Human
augauaaaacacaaa

SEQ ID NO: 1205529 - RNA, 19 nt, Human
augagccucagcauccugg

SEQ ID NO: 1205530 - RNA, 18 nt, Human
augagccucagcauccug

SEQ ID NO: 1205531 - RNA, 17 nt, Human
augagccucagcauccu

SEQ ID NO: 1205532 - RNA, 16 nt, Human
augagccucagcaucc

SEQ ID NO: 1205533 - RNA, 15 nt, Human
augagccucagcauc

SEQ ID NO: 1205534 - RNA, 12 nt, Human
augagccucagc

SEQ ID NO: 1205535 - RNA, 22 nt, Human
augagcaucaggccaggcccuc

SEQ ID NO: 1205536 - RNA, 21 nt, Human
augagcaucaggccaggcccu

SEQ ID NO: 1205537 - RNA, 20 nt, Human
augagcaucaggccaggccc

SEQ ID NO: 1205538 - RNA, 19 nt, Human
augagcaucaggccaggcc

SEQ ID NO: 1205539 - RNA, 18 nt, Human
augagcaucaggccaggc

SEQ ID NO: 1205540 - RNA, 17 nt, Human
augagcaucaggccagg

SEQ ID NO: 1205541 - RNA, 16 nt, Human
augagcaucaggccag

SEQ ID NO: 1205542 - RNA, 15 nt, Human
augagcaucaggcca

SEQ ID NO: 1205543 - RNA, 16 nt, Human
augagaggaaaucacc

SEQ ID NO: 1205544 - RNA, 15 nt, Human
augagaggaaaucac

SEQ ID NO: 1205545 - RNA, 14 nt, Human
augagaggaaauca

SEQ ID NO: 1205546 - RNA, 13 nt, Human
augagaggaaauc

SEQ ID NO: 1205547 - RNA, 12 nt, Human
augagaggaaau

SEQ ID NO: 1205548 - RNA, 18 nt, Human
uuuacuaauagacaauuu

SEQ ID NO: 1205549 - RNA, 17 nt, Human
uuuacuaauagacaauu

SEQ ID NO: 1205550 - RNA, 14 nt, Human
uuuacuaauagaca

SEQ ID NO: 1205551 - RNA, 21 nt, Human
uuuaccuuuuuuauacauaaa

SEQ ID NO: 1205552 - RNA, 20 nt, Human
uuuaccuuuuuuauacauaa

SEQ ID NO: 1205553 - RNA, 19 nt, Human
uuuaccuuuuuuauacaua

SEQ ID NO: 1205554 - RNA, 14 nt, Human
uuuaccuuuuuuau

SEQ ID NO: 1205555 - RNA, 17 nt, Human
augcuacacacugcaug

SEQ ID NO: 1205556 - RNA, 18 nt, Human
augcuacacacugcaugu

SEQ ID NO: 1205557 - RNA, 19 nt, Human
uuuauuaaaugcccagccc

SEQ ID NO: 1205558 - RNA, 15 nt, Human
uuuagauaauacacc

SEQ ID NO: 1205559 - RNA, 13 nt, Human
uuuagauaauaca

SEQ ID NO: 1205560 - RNA, 15 nt, Human
uuuaguagagacagg

SEQ ID NO: 1205561 - RNA, 19 nt, Human
uuuccagguuuaagcuguu

SEQ ID NO: 1205562 - RNA, 24 nt, Human
uuucacucuuauugcccacgcugg

SEQ ID NO: 1205563 - RNA, 15 nt, Human
uuucacucuccuugg

SEQ ID NO: 1205564 - RNA, 14 nt, Human
uuucacucuccuug

SEQ ID NO: 1205565 - RNA, 21 nt, Human
auggaaguacuauaauuuacc

SEQ ID NO: 1205566 - RNA, 18 nt, Human
auggaacacucugagacu

SEQ ID NO: 1205567 - RNA, 15 nt, Human
auggaauaacaugua

SEQ ID NO: 1205568 - RNA, 14 nt, Human
auggaauaacaugu

SEQ ID NO: 1205569 - RNA, 13 nt, Human
uuuauuaugcaug

SEQ ID NO: 1205570 - RNA, 22 nt, Human
augcugugcccuaaaguguauu

SEQ ID NO: 1205571 - RNA, 19 nt, Human
augcugugcccuaaagugu

SEQ ID NO: 1205572 - RNA, 14 nt, Human
uuucuaaagcugcc

SEQ ID NO: 1205573 - RNA, 21 nt, Human
uuucuaugacacaugcaaggu

SEQ ID NO: 1205574 - RNA, 15 nt, Human
uuucuaugacacaug

SEQ ID NO: 1205575 - RNA, 16 nt, Human
uuucugccgcagcccu

SEQ ID NO: 1205576 - RNA, 14 nt, Human
uuucugccgcagcc

SEQ ID NO: 1205577 - RNA, 14 nt, Human
auggggcccugccu

SEQ ID NO: 1205578 - RNA, 23 nt, Human
augggcuggguucuacccaggug

SEQ ID NO: 1205579 - RNA, 13 nt, Human
uuucuuuguggcu

SEQ ID NO: 1205580 - RNA, 23 nt, Human
uuuccuucauucaacccaccugc

SEQ ID NO: 1205581 - RNA, 21 nt, Human
uuuccuucauucaacccaccu

SEQ ID NO: 1205582 - RNA, 22 nt, Human
uuuccuucagugccuuauggaa

SEQ ID NO: 1205583 - RNA, 21 nt, Human
uuuccuucagugccuuaugga

SEQ ID NO: 1205584 - RNA, 18 nt, Human
uuuccuucagugccuuau

SEQ ID NO: 1205585 - RNA, 15 nt, Human
uuuccuucagugccu

SEQ ID NO: 1205586 - RNA, 12 nt, Human
uuuccuucagug

SEQ ID NO: 1205587 - RNA, 11 nt, Human
uuuccuucagu

SEQ ID NO: 1205588 - RNA, 12 nt, Human
uuuccugugucu

SEQ ID NO: 1205589 - RNA, 17 nt, Human
augggccuccugugugu

SEQ ID NO: 1205590 - RNA, 22 nt, Human
uuucgcaggauucuuccucccu

SEQ ID NO: 1205591 - RNA, 18 nt, Human
uuucgcaggauucuuccu

SEQ ID NO: 1205592 - RNA, 18 nt, Human
auggccucuucagaucuc

SEQ ID NO: 1205593 - RNA, 21 nt, Human
auggacccaauauuuaccaga

SEQ ID NO: 1205594 - RNA, 15 nt, Human
augggccuccugugu

SEQ ID NO: 1205595 - RNA, 15 nt, Human
augggcagagcagag

SEQ ID NO: 1205596 - RNA, 14 nt, Human
augggcagagcaga

SEQ ID NO: 1205597 - RNA, 13 nt, Human
augggcagagcag

SEQ ID NO: 1205598 - RNA, 21 nt, Human
augggcaacccccagccugcu

SEQ ID NO: 1205599 - RNA, 19 nt, Human
augggcaacccccagccug

SEQ ID NO: 1205600 - RNA, 13 nt, Human
augggagcucaug

SEQ ID NO: 1205601 - RNA, 16 nt, Human
uucagaaauguguuau

SEQ ID NO: 1205602 - RNA, 14 nt, Human
uucagccaagaauu

SEQ ID NO: 1205603 - RNA, 16 nt, Human
uucagguaacaggcag

SEQ ID NO: 1205604 - RNA, 15 nt, Human
uucagguaacaggca

SEQ ID NO: 1205605 - RNA, 22 nt, Human
uucaggguuggccccugcccgg

SEQ ID NO: 1205606 - RNA, 19 nt, Human
uucaggguuggccccugcc

SEQ ID NO: 1205607 - RNA, 17 nt, Human
uucaggguuggccccug

SEQ ID NO: 1205608 - RNA, 16 nt, Human
uucaggguuggccccu

SEQ ID NO: 1205609 - RNA, 14 nt, Human
uucaggguuggccc

SEQ ID NO: 1205610 - RNA, 22 nt, Human
auauauguuuuaagaggcaggg

SEQ ID NO: 1205611 - RNA, 21 nt, Human
auauauguuuuaagaggcagg

SEQ ID NO: 1205612 - RNA, 18 nt, Human
uucaucauccuaagcuau

SEQ ID NO: 1205613 - RNA, 14 nt, Human
uucaguaagccgug

SEQ ID NO: 1205614 - RNA, 17 nt, Human
uucagguaacaggcaga

SEQ ID NO: 1205615 - RNA, 16 nt, Human
uucagugccaaaaaca

SEQ ID NO: 1205616 - RNA, 21 nt, Human
auauguggaguucaucuugaa

SEQ ID NO: 1205617 - RNA, 20 nt, Human
auauguggaguucaucuuga

SEQ ID NO: 1205618 - RNA, 22 nt, Human
uuccaauuuacauacucugcuu

SEQ ID NO: 1205619 - RNA, 18 nt, Human
uuccagguuuaagcuguu

SEQ ID NO: 1205620 - RNA, 17 nt, Human
uuccaggggugggacac

SEQ ID NO: 1205621 - RNA, 17 nt, Human
uuccaggcugggagagc

SEQ ID NO: 1205622 - RNA, 15 nt, Human
uuccaggcugggaga

SEQ ID NO: 1205623 - RNA, 22 nt, Human
uuccacaagagcccaggccucc

SEQ ID NO: 1205624 - RNA, 21 nt, Human
uuccacaagagcccaggccuc

SEQ ID NO: 1205625 - RNA, 18 nt, Human
uuccaccaucaagccacc

SEQ ID NO: 1205626 - RNA, 19 nt, Human
auauuaccacagacauacu

SEQ ID NO: 1205627 - RNA, 15 nt, Human
auauugauaugcuua

SEQ ID NO: 1205628 - RNA, 22 nt, Human
auauugcugauggugcaaugac

SEQ ID NO: 1205629 - RNA, 17 nt, Human
auauuguuuucagugua

SEQ ID NO: 1205630 - RNA, 13 nt, Human
auauuguuuucag

SEQ ID NO: 1205631 - RNA, 17 nt, Human
auauuaccacagacaua

SEQ ID NO: 1205632 - RNA, 22 nt, Human
auauuaagaaagacuaucuaaa

SEQ ID NO: 1205633 - RNA, 17 nt, Human
auauuaagaaagacuau

SEQ ID NO: 1205634 - RNA, 16 nt, Human
auauuaagaaagacua

SEQ ID NO: 1205635 - RNA, 17 nt, Human
uuccagugaggcucugc

SEQ ID NO: 1205636 - RNA, 16 nt, Human
uuccagugaggcucug

SEQ ID NO: 1205637 - RNA, 15 nt, Human
uuccagugaggcucu

SEQ ID NO: 1205638 - RNA, 22 nt, Human
uuccucuuuuuauuuaguuccu

SEQ ID NO: 1205639 - RNA, 22 nt, Human
uuccuggcacugcuuccaguga

SEQ ID NO: 1205640 - RNA, 20 nt, Human
uuccuggcacugcuuccagu

SEQ ID NO: 1205641 - RNA, 17 nt, Human
aucacgccacugcacua

SEQ ID NO: 1205642 - RNA, 15 nt, Human
aucacgccacugcac

SEQ ID NO: 1205643 - RNA, 21 nt, Human
aucaacugcaucaagauguga

SEQ ID NO: 1205644 - RNA, 16 nt, Human
aucauuaggugugacu

SEQ ID NO: 1205645 - RNA, 23 nt, Human
aucauccacugugccaugugcca

SEQ ID NO: 1205646 - RNA, 21 nt, Human
aucauccacugugccaugugc

SEQ ID NO: 1205647 - RNA, 15 nt, Human
aucauaaaacuugau

SEQ ID NO: 1205648 - RNA, 19 nt, Human
aucaggugcugccauccag

SEQ ID NO: 1205649 - RNA, 17 nt, Human
aucaggugcugccaucc

SEQ ID NO: 1205650 - RNA, 15 nt, Human
aucaggugcugccau

SEQ ID NO: 1205651 - RNA, 19 nt, Human
aucagucugauucccaagc

SEQ ID NO: 1205652 - RNA, 13 nt, Human
aucauugaaaucu

SEQ ID NO: 1205653 - RNA, 12 nt, Human
aucauugaaauc

SEQ ID NO: 1205654 - RNA, 21 nt, Human
uucucuaguuugauuaaauuc

SEQ ID NO: 1205655 - RNA, 16 nt, Human
aucccaugagccucag

SEQ ID NO: 1205656 - RNA, 12 nt, Human
aucccagcccca

SEQ ID NO: 1205657 - RNA, 11 nt, Human
aucccagcccc

SEQ ID NO: 1205658 - RNA, 22 nt, Human
aucccugaaggccccgcccagg

SEQ ID NO: 1205659 - RNA, 17 nt, Human
aucccugaaggccccgc

SEQ ID NO: 1205660 - RNA, 18 nt, Human
aucccaugagccucagca

SEQ ID NO: 1205661 - RNA, 17 nt, Human
aucccaugagccucagc

SEQ ID NO: 1205662 - RNA, 17 nt, Human
uucugccugcccaggcc

SEQ ID NO: 1205663 - RNA, 16 nt, Human
uucugccugcccaggc

SEQ ID NO: 1205664 - RNA, 15 nt, Human
uucugccugcccagg

SEQ ID NO: 1205665 - RNA, 15 nt, Human
auccaguaucuugaa

SEQ ID NO: 1205666 - RNA, 14 nt, Human
auccaguaucuuga

SEQ ID NO: 1205667 - RNA, 17 nt, Human
auccagguucagcuugu

SEQ ID NO: 1205668 - RNA, 20 nt, Human
uucuuucuggcuaugcauuu

SEQ ID NO: 1205669 - RNA, 17 nt, Human
uucuuucuggcuaugca

SEQ ID NO: 1205670 - RNA, 12 nt, Human
uucuuucuggcu

SEQ ID NO: 1205671 - RNA, 11 nt, Human
uucuucucccu

SEQ ID NO: 1205672 - RNA, 22 nt, Human
uucuucuccacuuucuagccag

SEQ ID NO: 1205673 - RNA, 18 nt, Human
uucuguuuagauaauaca

SEQ ID NO: 1205674 - RNA, 13 nt, Human
uucuguuuagaua

SEQ ID NO: 1205675 - RNA, 23 nt, Human
auccuggcacccggccccugcug

SEQ ID NO: 1205676 - RNA, 22 nt, Human
auccuggcacccggccccugcu

SEQ ID NO: 1205677 - RNA, 21 nt, Human
auccuggcacccggccccugc

SEQ ID NO: 1205678 - RNA, 20 nt, Human
auccuggcacccggccccug

SEQ ID NO: 1205679 - RNA, 19 nt, Human
auccuggcacccggccccu

SEQ ID NO: 1205680 - RNA, 17 nt, Human
auccuggcacccggccc

SEQ ID NO: 1205681 - RNA, 15 nt, Human
auccuggaguucugg

SEQ ID NO: 1205682 - RNA, 21 nt, Human
auccugagccagauuucacuc

SEQ ID NO: 1205683 - RNA, 17 nt, Human
auccugagccagauuuc

SEQ ID NO: 1205684 - RNA, 15 nt, Human
auccugagccagauu

SEQ ID NO: 1205685 - RNA, 14 nt, Human
auccugagccagau

SEQ ID NO: 1205686 - RNA, 13 nt, Human
auccugagccaga

SEQ ID NO: 1205687 - RNA, 12 nt, Human
auccugagccag

SEQ ID NO: 1205688 - RNA, 11 nt, Human
auccugagcca

SEQ ID NO: 1205689 - RNA, 17 nt, Human
auccucuuugagugaag

SEQ ID NO: 1205690 - RNA, 20 nt, Human
uucuuuugccguuauuaaaa

SEQ ID NO: 1205691 - RNA, 20 nt, Human
auccucuguacagagcccac

SEQ ID NO: 1205692 - RNA, 18 nt, Human
auccucuguacagagccc

SEQ ID NO: 1205693 - RNA, 19 nt, Human
uugaccauucuccaccugc

SEQ ID NO: 1205694 - RNA, 18 nt, Human
uugaccauucuccaccug

SEQ ID NO: 1205695 - RNA, 13 nt, Human
uugacaucaacug

SEQ ID NO: 1205696 - RNA, 24 nt, Human
uugaccauucuccaccugccaggg

SEQ ID NO: 1205697 - RNA, 12 nt, Human
uugauaaaguaa

SEQ ID NO: 1205698 - RNA, 16 nt, Human
uugaggucuguucuuu

SEQ ID NO: 1205699 - RNA, 15 nt, Human
uugagaucagccugg

SEQ ID NO: 1205700 - RNA, 15 nt, Human
aucgugacaacacuu

SEQ ID NO: 1205701 - RNA, 14 nt, Human
aucgugacaacacu

SEQ ID NO: 1205702 - RNA, 18 nt, Human
aucgucacugcuuaacuu

SEQ ID NO: 1205703 - RNA, 14 nt, Human
aucgucacugcuua

SEQ ID NO: 1205704 - RNA, 15 nt, Human
aucuaaauguugaaa

SEQ ID NO: 1205705 - RNA, 13 nt, Human
uguugggccagga

SEQ ID NO: 1205706 - RNA, 16 nt, Human
uguugggccaggagcc

SEQ ID NO: 1205707 - RNA, 13 nt, Human
uguugucagcuga

SEQ ID NO: 1205708 - RNA, 21 nt, Human
aguuauuuuuauuuauuuaaa

SEQ ID NO: 1205709 - RNA, 20 nt, Human
uguucuuuccaaaguacacu

SEQ ID NO: 1205710 - RNA, 18 nt, Human
uguucuuuccaaaguaca

SEQ ID NO: 1205711 - RNA, 13 nt, Human
aguggcagcugcu

SEQ ID NO: 1205712 - RNA, 12 nt, Human
aguggcagcugc

SEQ ID NO: 1205713 - RNA, 20 nt, Human
aguggcagcugcuuuugucu

SEQ ID NO: 1205714 - RNA, 14 nt, Human
aguggcagcugcuu

SEQ ID NO: 1205715 - RNA, 18 nt, Human
agugggugaauaauacag

SEQ ID NO: 1205716 - RNA, 13 nt, Human
agugggugaauaa

SEQ ID NO: 1205717 - RNA, 18 nt, Human
agugggggaucacagccu

SEQ ID NO: 1205718 - RNA, 20 nt, Human
agugggggaguggccacaga

SEQ ID NO: 1205719 - RNA, 19 nt, Human
agugggggaguggccacag

SEQ ID NO: 1205720 - RNA, 21 nt, Human
agugguuccuaauccucuagg

SEQ ID NO: 1205721 - RNA, 16 nt, Human
aguggugcgaucuggg

SEQ ID NO: 1205722 - RNA, 19 nt, Human
agugggugaauaauacagu

SEQ ID NO: 1205723 - RNA, 22 nt, Human
aguguacauggaauaacaugua

SEQ ID NO: 1205724 - RNA, 21 nt, Human
aguguacauggaauaacaugu

SEQ ID NO: 1205725 - RNA, 14 nt, Human
uguucuuuccaaag

SEQ ID NO: 1205726 - RNA, 13 nt, Human
uguucuuuccaaa

SEQ ID NO: 1205727 - RNA, 19 nt, Human
uguucuugguuuguaaauu

SEQ ID NO: 1205728 - RNA, 18 nt, Human
uguucuugguuuguaaau

SEQ ID NO: 1205729 - RNA, 17 nt, Human
uguucuugguuuguaaa

SEQ ID NO: 1205730 - RNA, 16 nt, Human
uguucuuaauucuuag

SEQ ID NO: 1205731 - RNA, 14 nt, Human
uguucuuaauucuu

SEQ ID NO: 1205732 - RNA, 15 nt, Human
uguucugggacacag

SEQ ID NO: 1205733 - RNA, 14 nt, Human
uguucugggacaca

SEQ ID NO: 1205734 - RNA, 13 nt, Human
uguucugggacac

SEQ ID NO: 1205735 - RNA, 23 nt, Human
aguguacauggaauaacauguaa

SEQ ID NO: 1205736 - RNA, 16 nt, Human
aguucucuccuucuuc

SEQ ID NO: 1205737 - RNA, 13 nt, Human
aguucucuccuuc

SEQ ID NO: 1205738 - RNA, 17 nt, Human
uguuuucaguguacaug

SEQ ID NO: 1205739 - RNA, 15 nt, Human
uguuuucucuugaga

SEQ ID NO: 1205740 - RNA, 15 nt, Human
uguuuucaguguaca

SEQ ID NO: 1205741 - RNA, 19 nt, Human
uguuuggggaugagaaagg

SEQ ID NO: 1205742 - RNA, 15 nt, Human
uguuuggggaugaga

SEQ ID NO: 1205743 - RNA, 16 nt, Human
uguuugccucugccuc

SEQ ID NO: 1205744 - RNA, 14 nt, Human
uguuugccucugcc

SEQ ID NO: 1205745 - RNA, 14 nt, Human
uguugucagcugaa

SEQ ID NO: 1205746 - RNA, 23 nt, Human
aguugauucagcucugcaagaau

SEQ ID NO: 1205747 - RNA, 18 nt, Human
aguugauucagcucugca

SEQ ID NO: 1205748 - RNA, 17 nt, Human
aguugauucagcucugc

SEQ ID NO: 1205749 - RNA, 15 nt, Human
aguugauucagcucu

SEQ ID NO: 1205750 - RNA, 14 nt, Human
aguugauucagcuc

SEQ ID NO: 1205751 - RNA, 13 nt, Human
aguugauucagcu

SEQ ID NO: 1205752 - RNA, 23 nt, Human
aguugauagcacagacccugccc

SEQ ID NO: 1205753 - RNA, 22 nt, Human
aguugauagcacagacccugcc

SEQ ID NO: 1205754 - RNA, 21 nt, Human
aguugauagcacagacccugc

SEQ ID NO: 1205755 - RNA, 20 nt, Human
aguugauagcacagacccug

SEQ ID NO: 1205756 - RNA, 19 nt, Human
aguugauagcacagacccu

SEQ ID NO: 1205757 - RNA, 15 nt, Human
aguugauagcacaga

SEQ ID NO: 1205758 - RNA, 22 nt, Human
aguuuucacucuuauugcccac

SEQ ID NO: 1205759 - RNA, 20 nt, Human
uuaaauucuugcaaaguauc

SEQ ID NO: 1205760 - RNA, 16 nt, Human
uuaaauucuugcaaag

SEQ ID NO: 1205761 - RNA, 13 nt, Human
uuaaauucuugca

SEQ ID NO: 1205762 - RNA, 15 nt, Human
aguuucuccaagcag

SEQ ID NO: 1205763 - RNA, 13 nt, Human
aguuucuccaagc

SEQ ID NO: 1205764 - RNA, 21 nt, Human
aguuucuccaagcaggacaug

SEQ ID NO: 1205765 - RNA, 17 nt, Human
uuaaaacaacacucaca

SEQ ID NO: 1205766 - RNA, 18 nt, Human
uuaaaaaguggaaaaaua

SEQ ID NO: 1205767 - RNA, 20 nt, Human
aguugccagucaccccggcc

SEQ ID NO: 1205768 - RNA, 22 nt, Human
uuaaauaaugugaaacuggauu

SEQ ID NO: 1205769 - RNA, 21 nt, Human
uuaaauaaugugaaacuggau

SEQ ID NO: 1205770 - RNA, 20 nt, Human
uuaaauaaugugaaacugga

SEQ ID NO: 1205771 - RNA, 15 nt, Human
uuaaauaaaucauaa

SEQ ID NO: 1205772 - RNA, 13 nt, Human
uuaaauaaaucau

SEQ ID NO: 1205773 - RNA, 17 nt, Human
uuaaaccgccaaggcug

SEQ ID NO: 1205774 - RNA, 20 nt, Human
auacuacaguuuguuaguau

SEQ ID NO: 1205775 - RNA, 16 nt, Human
auacuacaguuuguua

SEQ ID NO: 1205776 - RNA, 15 nt, Human
auacuacaguuuguu

SEQ ID NO: 1205777 - RNA, 13 nt, Human
auacuacaguuug

SEQ ID NO: 1205778 - RNA, 21 nt, Human
auacuaaccagcagaaaugcc

SEQ ID NO: 1205779 - RNA, 19 nt, Human
auaccagccaguaaauggg

SEQ ID NO: 1205780 - RNA, 22 nt, Human
auacaggaaaagcugcugacag

SEQ ID NO: 1205781 - RNA, 20 nt, Human
auacaggaaaagcugcugac

SEQ ID NO: 1205782 - RNA, 19 nt, Human
auacaggaaaagcugcuga

SEQ ID NO: 1205783 - RNA, 14 nt, Human
auacaggaaaagcu

SEQ ID NO: 1205784 - RNA, 20 nt, Human
auacauaaacaagaccacgu

SEQ ID NO: 1205785 - RNA, 16 nt, Human
auacauuugauaaagu

SEQ ID NO: 1205786 - RNA, 15 nt, Human
auacaaaagcaugug

SEQ ID NO: 1205787 - RNA, 13 nt, Human
auacaaaagcaug

SEQ ID NO: 1205788 - RNA, 12 nt, Human
auacaaaagcau

SEQ ID NO: 1205789 - RNA, 16 nt, Human
auaaacuuuaccuuuu

SEQ ID NO: 1205790 - RNA, 15 nt, Human
auaaacuuuaccuuu

SEQ ID NO: 1205791 - RNA, 13 nt, Human
auaaacuuuaccu

SEQ ID NO: 1205792 - RNA, 23 nt, Human
uuaccauuuugggguacccacug

SEQ ID NO: 1205793 - RNA, 22 nt, Human
uuacaggaaguacuggagaaaa

SEQ ID NO: 1205794 - RNA, 18 nt, Human
uuacaggaaguacuggag

SEQ ID NO: 1205795 - RNA, 16 nt, Human
uuacaggaaguacugg

SEQ ID NO: 1205796 - RNA, 20 nt, Human
auaaccaguguuguggauuu

SEQ ID NO: 1205797 - RNA, 23 nt, Human
auaauacaccacuacauucuguu

SEQ ID NO: 1205798 - RNA, 22 nt, Human
auaaguuaacuuccaauuuaca

SEQ ID NO: 1205799 - RNA, 17 nt, Human
auaaguuaacuuccaau

SEQ ID NO: 1205800 - RNA, 23 nt, Human
auaagaaccuuuugagugccuua

SEQ ID NO: 1205801 - RNA, 22 nt, Human
auaagaaccuuuugagugccuu

SEQ ID NO: 1205802 - RNA, 19 nt, Human
auaauacaguaucucaggg

SEQ ID NO: 1205803 - RNA, 14 nt, Human
auaauucuacuuug

SEQ ID NO: 1205804 - RNA, 16 nt, Human
aggggauagagagaga

SEQ ID NO: 1205805 - RNA, 18 nt, Human
aggguaucaggugcugcc

SEQ ID NO: 1205806 - RNA, 16 nt, Human
aggguaucaggugcug

SEQ ID NO: 1205807 - RNA, 19 nt, Human
aggguacuaaggaaucuuu

SEQ ID NO: 1205808 - RNA, 23 nt, Human
uggguggaugccugguggcagcu

SEQ ID NO: 1205809 - RNA, 14 nt, Human
uggguggaugccug

SEQ ID NO: 1205810 - RNA, 16 nt, Human
ugguccauagagagca

SEQ ID NO: 1205811 - RNA, 15 nt, Human
ugguccauagagagc

SEQ ID NO: 1205812 - RNA, 23 nt, Human
uggucaccaaaucagcugcuacu

SEQ ID NO: 1205813 - RNA, 21 nt, Human
uggucaccaaaucagcugcua

SEQ ID NO: 1205814 - RNA, 12 nt, Human
uggucuguguga

SEQ ID NO: 1205815 - RNA, 16 nt, Human
uggucuuauuuguaaa

SEQ ID NO: 1205816 - RNA, 19 nt, Human
ugguccauagagagcaaga

SEQ ID NO: 1205817 - RNA, 13 nt, Human
uggucccacccca

SEQ ID NO: 1205818 - RNA, 15 nt, Human
aggguugggcuggug

SEQ ID NO: 1205819 - RNA, 17 nt, Human
aggguuggccccugccc

SEQ ID NO: 1205820 - RNA, 14 nt, Human
aggguuggccccug

SEQ ID NO: 1205821 - RNA, 13 nt, Human
aggguuggccccu

SEQ ID NO: 1205822 - RNA, 21 nt, Human
aggguggugaccucugccuga

SEQ ID NO: 1205823 - RNA, 19 nt, Human
aggguggugaccucugccu

SEQ ID NO: 1205824 - RNA, 18 nt, Human
aggguggugaccucugcc

SEQ ID NO: 1205825 - RNA, 19 nt, Human
uggugaacagaacaaaagg

SEQ ID NO: 1205826 - RNA, 17 nt, Human
agguaugcaaucaaauc

SEQ ID NO: 1205827 - RNA, 17 nt, Human
aggguugggcugguguc

SEQ ID NO: 1205828 - RNA, 23 nt, Human
aggucauuuuuuuuaagaaaaag

SEQ ID NO: 1205829 - RNA, 22 nt, Human
aggucauuuuuuuuaagaaaaa

SEQ ID NO: 1205830 - RNA, 21 nt, Human
aggucaaggcugcagugagcc

SEQ ID NO: 1205831 - RNA, 22 nt, Human
aggucuugaacuccuggccuca

SEQ ID NO: 1205832 - RNA, 21 nt, Human
aggucuugaacuccuggccuc

SEQ ID NO: 1205833 - RNA, 20 nt, Human
aggucuugaacuccuggccu

SEQ ID NO: 1205834 - RNA, 13 nt, Human
ugguggcagcugc

SEQ ID NO: 1205835 - RNA, 12 nt, Human
ugguggcagcug

SEQ ID NO: 1205836 - RNA, 23 nt, Human
ugguggcagcucaccucucccuu

SEQ ID NO: 1205837 - RNA, 20 nt, Human
ugguggcagcucaccucucc

SEQ ID NO: 1205838 - RNA, 19 nt, Human
ugguggcagcucaccucuc

SEQ ID NO: 1205839 - RNA, 16 nt, Human
ugguggcagcucaccu

SEQ ID NO: 1205840 - RNA, 12 nt, Human
ugguggcagcuc

SEQ ID NO: 1205841 - RNA, 15 nt, Human
ugguggcagagugga

SEQ ID NO: 1205842 - RNA, 17 nt, Human
ugguguuuccuggcacu

SEQ ID NO: 1205843 - RNA, 15 nt, Human
ugguguuuccuggca

SEQ ID NO: 1205844 - RNA, 22 nt, Human
ugguucaggguuggccccugcc

SEQ ID NO: 1205845 - RNA, 20 nt, Human
ugguucaggguuggccccug

SEQ ID NO: 1205846 - RNA, 23 nt, Human
ugguucaggguuggccccugccc

SEQ ID NO: 1205847 - RNA, 12 nt, Human
ugguuuucuguu

SEQ ID NO: 1205848 - RNA, 15 nt, Human
ugguuucagaaaugu

SEQ ID NO: 1205849 - RNA, 14 nt, Human
ugguuucagaaaug

SEQ ID NO: 1205850 - RNA, 15 nt, Human
ugguuuucuguucuu

SEQ ID NO: 1205851 - RNA, 13 nt, Human
ugguuuucuguuc

SEQ ID NO: 1205852 - RNA, 23 nt, Human
aggugauccacccaccucagccu

SEQ ID NO: 1205853 - RNA, 20 nt, Human
uguacaugaaaacacauuuu

SEQ ID NO: 1205854 - RNA, 19 nt, Human
uguacaugaaaacacauuu

SEQ ID NO: 1205855 - RNA, 18 nt, Human
uguacaugaaaacacauu

SEQ ID NO: 1205856 - RNA, 17 nt, Human
uguacaugaaaacacau

SEQ ID NO: 1205857 - RNA, 23 nt, Human
uguacaaaguagaagucuuagau

SEQ ID NO: 1205858 - RNA, 19 nt, Human
uguacaaaguagaagucuu

SEQ ID NO: 1205859 - RNA, 21 nt, Human
uguaauuugugauacaaugcu

SEQ ID NO: 1205860 - RNA, 17 nt, Human
uguaauuugugauacaa

SEQ ID NO: 1205861 - RNA, 16 nt, Human
uguaauuugugauaca

SEQ ID NO: 1205862 - RNA, 18 nt, Human
uguaaggaaugauuaauu

SEQ ID NO: 1205863 - RNA, 15 nt, Human
uguaaggaaugauua

SEQ ID NO: 1205864 - RNA, 14 nt, Human
uguaaggaaugauu

SEQ ID NO: 1205865 - RNA, 13 nt, Human
uguaaggaaugau

SEQ ID NO: 1205866 - RNA, 18 nt, Human
aggugugacugaauuucu

SEQ ID NO: 1205867 - RNA, 23 nt, Human
aggugugaaccaccacacccagc

SEQ ID NO: 1205868 - RNA, 22 nt, Human
aggugugaaccaccacacccag

SEQ ID NO: 1205869 - RNA, 20 nt, Human
aggugugagucaccaagccc

SEQ ID NO: 1205870 - RNA, 14 nt, Human
aggugugagucacc

SEQ ID NO: 1205871 - RNA, 20 nt, Human
aggugugacugaauuucuuu

SEQ ID NO: 1205872 - RNA, 16 nt, Human
agguggggcagcuuga

SEQ ID NO: 1205873 - RNA, 14 nt, Human
agguggggcagcuu

SEQ ID NO: 1205874 - RNA, 13 nt, Human
agguggggcagcu

SEQ ID NO: 1205875 - RNA, 18 nt, Human
ugugauggggcccugccu

SEQ ID NO: 1205876 - RNA, 17 nt, Human
ugugauggggcccugcc

SEQ ID NO: 1205877 - RNA, 16 nt, Human
ugugauggggcccugc

SEQ ID NO: 1205878 - RNA, 15 nt, Human
ugugauggggcccug

SEQ ID NO: 1205879 - RNA, 14 nt, Human
agugagagcugggu

SEQ ID NO: 1205880 - RNA, 22 nt, Human
agugagacucugucucaaaaaa

SEQ ID NO: 1205881 - RNA, 17 nt, Human
agugagacucugucuca

SEQ ID NO: 1205882 - RNA, 16 nt, Human
agugagacucugucuc

SEQ ID NO: 1205883 - RNA, 13 nt, Human
agugagacucugu

SEQ ID NO: 1205884 - RNA, 21 nt, Human
agugagacccugucucaaaaa

SEQ ID NO: 1205885 - RNA, 17 nt, Human
agugagacccugucuca

SEQ ID NO: 1205886 - RNA, 23 nt, Human
agugaaaaaggaggaagagaaaa

SEQ ID NO: 1205887 - RNA, 20 nt, Human
agugaaaaaggaggaagaga

SEQ ID NO: 1205888 - RNA, 17 nt, Human
agugaaaaaggaggaag

SEQ ID NO: 1205889 - RNA, 11 nt, Human
agugaaaaagg

SEQ ID NO: 1205890 - RNA, 19 nt, Human
ugugagcacaaagguagcu

SEQ ID NO: 1205891 - RNA, 16 nt, Human
agucccugccaaugga

SEQ ID NO: 1205892 - RNA, 14 nt, Human
agucccugccaaug

SEQ ID NO: 1205893 - RNA, 13 nt, Human
agucccugccaau

SEQ ID NO: 1205894 - RNA, 23 nt, Human
aguccccuguuuguuucugaaag

SEQ ID NO: 1205895 - RNA, 13 nt, Human
ugucucugagagu

SEQ ID NO: 1205896 - RNA, 22 nt, Human
ugucucuuuaaugucacaggca

SEQ ID NO: 1205897 - RNA, 21 nt, Human
ugucucuuuaaugucacaggc

SEQ ID NO: 1205898 - RNA, 22 nt, Human
ugucucuugguccugcugcagu

SEQ ID NO: 1205899 - RNA, 21 nt, Human
ugucucuugguccugcugcag

SEQ ID NO: 1205900 - RNA, 20 nt, Human
ugucucuugguccugcugca

SEQ ID NO: 1205901 - RNA, 19 nt, Human
ugucucuugguccugcugc

SEQ ID NO: 1205902 - RNA, 18 nt, Human
ugucucuugguccugcug

SEQ ID NO: 1205903 - RNA, 23 nt, Human
ugugaaccaccacacccagccca

SEQ ID NO: 1205904 - RNA, 22 nt, Human
ugugaaccaccacacccagccc

SEQ ID NO: 1205905 - RNA, 17 nt, Human
ugugaaccaccacaccc

SEQ ID NO: 1205906 - RNA, 16 nt, Human
ugugaaccaccacacc

SEQ ID NO: 1205907 - RNA, 15 nt, Human
ugugaaccaccacac

SEQ ID NO: 1205908 - RNA, 21 nt, Human
ugucuugcaauggcagccuug

SEQ ID NO: 1205909 - RNA, 20 nt, Human
ugucuugcaauggcagccuu

SEQ ID NO: 1205910 - RNA, 18 nt, Human
ugucuugcaauggcagcc

SEQ ID NO: 1205911 - RNA, 17 nt, Human
ugucuugcaauggcagc

SEQ ID NO: 1205912 - RNA, 15 nt, Human
ugucuugcaauggca

SEQ ID NO: 1205913 - RNA, 15 nt, Human
uguagagccaggguc

SEQ ID NO: 1205914 - RNA, 12 nt, Human
uguagagccagg

SEQ ID NO: 1205915 - RNA, 14 nt, Human
uguauguguaagua

SEQ ID NO: 1205916 - RNA, 16 nt, Human
uguaucccaugagccu

SEQ ID NO: 1205917 - RNA, 15 nt, Human
uguaucccaugagcc

SEQ ID NO: 1205918 - RNA, 14 nt, Human
aguagcugggacua

SEQ ID NO: 1205919 - RNA, 13 nt, Human
aguagcugggacu

SEQ ID NO: 1205920 - RNA, 19 nt, Human
ugucaaaguggugagaggc

SEQ ID NO: 1205921 - RNA, 16 nt, Human
ugucaaaguggugaga

SEQ ID NO: 1205922 - RNA, 15 nt, Human
ugucaaaguggugag

SEQ ID NO: 1205923 - RNA, 14 nt, Human
ugucaaagugguga

SEQ ID NO: 1205924 - RNA, 15 nt, Human
ugucagcauagaagu

SEQ ID NO: 1205925 - RNA, 17 nt, Human
agucacugagacagccc

SEQ ID NO: 1205926 - RNA, 16 nt, Human
agucacugagacagcc

SEQ ID NO: 1205927 - RNA, 15 nt, Human
agucacugagacagc

SEQ ID NO: 1205928 - RNA, 22 nt, Human
aguagcugggacuacaggcacc

SEQ ID NO: 1205929 - RNA, 21 nt, Human
aguagcugggacuacaggcac

SEQ ID NO: 1205930 - RNA, 19 nt, Human
aguagcugggacuacaggc

SEQ ID NO: 1205931 - RNA, 14 nt, Human
aguauuauaccuuu

SEQ ID NO: 1205932 - RNA, 15 nt, Human
aguauuauaccuuuu

SEQ ID NO: 1205933 - RNA, 19 nt, Human
aguccccuguuuguuucug

SEQ ID NO: 1205934 - RNA, 14 nt, Human
aguccccuguuugu

SEQ ID NO: 1205935 - RNA, 23 nt, Human
agucccaccuuggcugcagggag

SEQ ID NO: 1205936 - RNA, 21 nt, Human
agucccaccuuggcugcaggg

SEQ ID NO: 1205937 - RNA, 17 nt, Human
ugucccuuuuccuuuuu

SEQ ID NO: 1205938 - RNA, 12 nt, Human
ugucccuuuucc

SEQ ID NO: 1205939 - RNA, 14 nt, Human
ugucccugcacuug

SEQ ID NO: 1205940 - RNA, 18 nt, Human
agucacugagacagcccg

SEQ ID NO: 1205941 - RNA, 16 nt, Human
ugucagccauuccugu

SEQ ID NO: 1205942 - RNA, 24 nt, Human
agcugcuuuugucuaugggacuca

SEQ ID NO: 1205943 - RNA, 23 nt, Human
agcugcuuuugucuaugggacuc

SEQ ID NO: 1205944 - RNA, 13 nt, Human
agcugccuguuca

SEQ ID NO: 1205945 - RNA, 20 nt, Human
ugccugcccaggccccugcc

SEQ ID NO: 1205946 - RNA, 19 nt, Human
ugccugcccaggccccugc

SEQ ID NO: 1205947 - RNA, 18 nt, Human
ugccugcccaggccccug

SEQ ID NO: 1205948 - RNA, 17 nt, Human
ugccugcccaggccccu

SEQ ID NO: 1205949 - RNA, 12 nt, Human
ugccucugccuc

SEQ ID NO: 1205950 - RNA, 16 nt, Human
ugccucugacacacag

SEQ ID NO: 1205951 - RNA, 14 nt, Human
ugccucugacacac

SEQ ID NO: 1205952 - RNA, 11 nt, Human
ugccucugccu

SEQ ID NO: 1205953 - RNA, 20 nt, Human
ugccgcagcccugcagaggg

SEQ ID NO: 1205954 - RNA, 22 nt, Human
ugcccuuaccugccaggaagcc

SEQ ID NO: 1205955 - RNA, 18 nt, Human
ugcccugugggcccccaa

SEQ ID NO: 1205956 - RNA, 15 nt, Human
ugcccugugggcccc

SEQ ID NO: 1205957 - RNA, 17 nt, Human
agcucuucuccaggcug

SEQ ID NO: 1205958 - RNA, 16 nt, Human
agcucuucuccaggcu

SEQ ID NO: 1205959 - RNA, 15 nt, Human
agcucuucuccaggc

SEQ ID NO: 1205960 - RNA, 17 nt, Human
ugccucucucaggccaa

SEQ ID NO: 1205961 - RNA, 22 nt, Human
ugccucccaucacccgcuaaga

SEQ ID NO: 1205962 - RNA, 23 nt, Human
agcuccuucuguccuacucugug

SEQ ID NO: 1205963 - RNA, 21 nt, Human
agcuccagcucaccagcccca

SEQ ID NO: 1205964 - RNA, 19 nt, Human
agcuccagcucaccagccc

SEQ ID NO: 1205965 - RNA, 18 nt, Human
agcuccagcucaccagcc

SEQ ID NO: 1205966 - RNA, 17 nt, Human
agcuccagcucaccagc

SEQ ID NO: 1205967 - RNA, 13 nt, Human
agcuccagcucac

SEQ ID NO: 1205968 - RNA, 19 nt, Human
agcuccaagcucccaggca

SEQ ID NO: 1205969 - RNA, 18 nt, Human
agcuccaagcucccaggc

SEQ ID NO: 1205970 - RNA, 17 nt, Human
agcuccaagcucccagg

SEQ ID NO: 1205971 - RNA, 14 nt, Human
ugcccugcccaccu

SEQ ID NO: 1205972 - RNA, 23 nt, Human
agcggcuggcagcccaccccuca

SEQ ID NO: 1205973 - RNA, 20 nt, Human
agcggggacagcuccuucug

SEQ ID NO: 1205974 - RNA, 19 nt, Human
agcggggacagcuccuucu

SEQ ID NO: 1205975 - RNA, 22 nt, Human
agcggggacagcuccuucuguc

SEQ ID NO: 1205976 - RNA, 13 nt, Human
agcggcuggcagc

SEQ ID NO: 1205977 - RNA, 18 nt, Human
ugccagcuuaucucaggg

SEQ ID NO: 1205978 - RNA, 21 nt, Human
ugcauuugaggucuguucuuu

SEQ ID NO: 1205979 - RNA, 20 nt, Human
ugcauuugaggucuguucuu

SEQ ID NO: 1205980 - RNA, 22 nt, Human
agcgauucuucugcuucagccu

SEQ ID NO: 1205981 - RNA, 23 nt, Human
agccuugaccauucuccaccugc

SEQ ID NO: 1205982 - RNA, 23 nt, Human
agccuugaacuuugaccucugca

SEQ ID NO: 1205983 - RNA, 22 nt, Human
agccuugaacuuugaccucugc

SEQ ID NO: 1205984 - RNA, 16 nt, Human
agccuugaacuuugac

SEQ ID NO: 1205985 - RNA, 15 nt, Human
agccuugaacuuuga

SEQ ID NO: 1205986 - RNA, 18 nt, Human
agccuuccagggguggga

SEQ ID NO: 1205987 - RNA, 20 nt, Human
ugcauuuaaaagauacaguu

SEQ ID NO: 1205988 - RNA, 19 nt, Human
ugcauuugaggucuguucu

SEQ ID NO: 1205989 - RNA, 17 nt, Human
agcucaggugucccugc

SEQ ID NO: 1205990 - RNA, 15 nt, Human
agcuccaagcuccca

SEQ ID NO: 1205991 - RNA, 16 nt, Human
agcuccaagcucccag

SEQ ID NO: 1205992 - RNA, 20 nt, Human
agcucagggccuggcucagg

SEQ ID NO: 1205993 - RNA, 19 nt, Human
agcucagggccuggcucag

SEQ ID NO: 1205994 - RNA, 14 nt, Human
agcucagggccugg

SEQ ID NO: 1205995 - RNA, 13 nt, Human
agcucagggccug

SEQ ID NO: 1205996 - RNA, 12 nt, Human
agcucagggccu

SEQ ID NO: 1205997 - RNA, 19 nt, Human
agcuauucaguaauaacuc

SEQ ID NO: 1205998 - RNA, 21 nt, Human
agcuaggccuggccagaugca

SEQ ID NO: 1205999 - RNA, 13 nt, Human
agcgugagccacu

SEQ ID NO: 1206000 - RNA, 18 nt, Human
ugcccaggccccugccac

SEQ ID NO: 1206001 - RNA, 17 nt, Human
ugcccaggccccugcca

SEQ ID NO: 1206002 - RNA, 15 nt, Human
ugcccaggccccugc

SEQ ID NO: 1206003 - RNA, 20 nt, Human
ugcccagccccuucugaccc

SEQ ID NO: 1206004 - RNA, 17 nt, Human
ugcccagccccuucuga

SEQ ID NO: 1206005 - RNA, 16 nt, Human
ugcccagccccuucug

SEQ ID NO: 1206006 - RNA, 13 nt, Human
ugcccagccccuu

SEQ ID NO: 1206007 - RNA, 20 nt, Human
ugcccaaagaugcagccggu

SEQ ID NO: 1206008 - RNA, 17 nt, Human
ugcccaaagaugcagcc

SEQ ID NO: 1206009 - RNA, 20 nt, Human
ugcccuaaaguguauuuuuu

SEQ ID NO: 1206010 - RNA, 23 nt, Human
ugccccgaacauguuuuucuucu

SEQ ID NO: 1206011 - RNA, 17 nt, Human
agccgagaucacgccac

SEQ ID NO: 1206012 - RNA, 21 nt, Human
agccgagauagccaaggccaa

SEQ ID NO: 1206013 - RNA, 21 nt, Human
agcccuuagcagggaaacagc

SEQ ID NO: 1206014 - RNA, 16 nt, Human
agcccuuagcagggaa

SEQ ID NO: 1206015 - RNA, 18 nt, Human
ugcagacucuacagaggc

SEQ ID NO: 1206016 - RNA, 17 nt, Human
ugcagacucuacagagg

SEQ ID NO: 1206017 - RNA, 16 nt, Human
ugcagacucuacagag

SEQ ID NO: 1206018 - RNA, 22 nt, Human
ugcagacaggcaagcaccuccu

SEQ ID NO: 1206019 - RNA, 20 nt, Human
ugcacacauuuuuuaaaugc

SEQ ID NO: 1206020 - RNA, 21 nt, Human
agcccugguggcagugggagc

SEQ ID NO: 1206021 - RNA, 19 nt, Human
ugcacuccccugcugggug

SEQ ID NO: 1206022 - RNA, 17 nt, Human
ugcacuccccugcuggg

SEQ ID NO: 1206023 - RNA, 16 nt, Human
ugcacuccccugcugg

SEQ ID NO: 1206024 - RNA, 15 nt, Human
ugcacacauuuuuua

SEQ ID NO: 1206025 - RNA, 13 nt, Human
ugcacacauuuuu

SEQ ID NO: 1206026 - RNA, 12 nt, Human
ugcacacauuuu

SEQ ID NO: 1206027 - RNA, 23 nt, Human
ugcagccucaaccuccugggcua

SEQ ID NO: 1206028 - RNA, 22 nt, Human
ugcagccucaaccuccugggcu

SEQ ID NO: 1206029 - RNA, 21 nt, Human
ugcagccucaaccuccugggc

SEQ ID NO: 1206030 - RNA, 23 nt, Human
agccucugaaaaccaauguucuc

SEQ ID NO: 1206031 - RNA, 18 nt, Human
agccucacaguccuuacc

SEQ ID NO: 1206032 - RNA, 17 nt, Human
agccucacaguccuuac

SEQ ID NO: 1206033 - RNA, 20 nt, Human
agccucaaccuccugggcua

SEQ ID NO: 1206034 - RNA, 18 nt, Human
agccgagaucacgccacu

SEQ ID NO: 1206035 - RNA, 22 nt, Human
agccccauucugccugcccagg

SEQ ID NO: 1206036 - RNA, 21 nt, Human
agccccauucugccugcccag

SEQ ID NO: 1206037 - RNA, 18 nt, Human
agccccaaaacucuccuc

SEQ ID NO: 1206038 - RNA, 17 nt, Human
agccccaaaacucuccu

SEQ ID NO: 1206039 - RNA, 16 nt, Human
agccccaaaacucucc

SEQ ID NO: 1206040 - RNA, 21 nt, Human
ugcaaaccaucauugaaaucu

SEQ ID NO: 1206041 - RNA, 23 nt, Human
agccccauucugccugcccaggc

SEQ ID NO: 1206042 - RNA, 22 nt, Human
ugcacacaccagagcccaccuu

SEQ ID NO: 1206043 - RNA, 21 nt, Human
ugcacacaccagagcccaccu

SEQ ID NO: 1206044 - RNA, 18 nt, Human
ugcacacaccagagccca

SEQ ID NO: 1206045 - RNA, 16 nt, Human
agcccugguggcagug

SEQ ID NO: 1206046 - RNA, 15 nt, Human
agcccugguggcagu

SEQ ID NO: 1206047 - RNA, 14 nt, Human
agcccugguggcag

SEQ ID NO: 1206048 - RNA, 13 nt, Human
agcccgggcucug

SEQ ID NO: 1206049 - RNA, 22 nt, Human
agcccacuucugccauauucug

SEQ ID NO: 1206050 - RNA, 15 nt, Human
agcccacuucugcca

SEQ ID NO: 1206051 - RNA, 14 nt, Human
agcccacuucugcc

SEQ ID NO: 1206052 - RNA, 13 nt, Human
agcccacuucugc

SEQ ID NO: 1206053 - RNA, 22 nt, Human
agccaguaaaugggggugcauu

SEQ ID NO: 1206054 - RNA, 21 nt, Human
agccaguaaaugggggugcau

SEQ ID NO: 1206055 - RNA, 13 nt, Human
agccaguaaaugg

SEQ ID NO: 1206056 - RNA, 17 nt, Human
ugauuuggggauauuuu

SEQ ID NO: 1206057 - RNA, 22 nt, Human
ugauuuccguuaaaauaccagc

SEQ ID NO: 1206058 - RNA, 23 nt, Human
ugauucccaagcucugcuccucu

SEQ ID NO: 1206059 - RNA, 22 nt, Human
ugauucccaagcucugcuccuc

SEQ ID NO: 1206060 - RNA, 13 nt, Human
ugauucuccugcc

SEQ ID NO: 1206061 - RNA, 21 nt, Human
ugauucauaaugacuuaagca

SEQ ID NO: 1206062 - RNA, 16 nt, Human
ugauucauaaugacuu

SEQ ID NO: 1206063 - RNA, 18 nt, Human
agcccaggaaaggcucca

SEQ ID NO: 1206064 - RNA, 14 nt, Human
agcccaggaaaggc

SEQ ID NO: 1206065 - RNA, 19 nt, Human
ugauggggcccugccuccu

SEQ ID NO: 1206066 - RNA, 16 nt, Human
ugauggggcccugccu

SEQ ID NO: 1206067 - RNA, 15 nt, Human
ugauggggcccugcc

SEQ ID NO: 1206068 - RNA, 21 nt, Human
ugaugggcaacccccagccug

SEQ ID NO: 1206069 - RNA, 16 nt, Human
ugaugagaggaaauca

SEQ ID NO: 1206070 - RNA, 15 nt, Human
ugaugagaggaaauc

SEQ ID NO: 1206071 - RNA, 14 nt, Human
ugaugagaggaaau

SEQ ID NO: 1206072 - RNA, 13 nt, Human
ugaugagaggaaa

SEQ ID NO: 1206073 - RNA, 22 nt, Human
ugauccucccaccucagccucc

SEQ ID NO: 1206074 - RNA, 21 nt, Human
ugauccucccaccucagccuc

SEQ ID NO: 1206075 - RNA, 16 nt, Human
ugauccucccaccuca

SEQ ID NO: 1206076 - RNA, 15 nt, Human
ugauccucccaccuc

SEQ ID NO: 1206077 - RNA, 16 nt, Human
ugauccuaguuccacc

SEQ ID NO: 1206078 - RNA, 11 nt, Human
agccagaggag

SEQ ID NO: 1206079 - RNA, 10 nt, Human
agccagagga

SEQ ID NO: 1206080 - RNA, 20 nt, Human
agccacugcaccgggccaca

SEQ ID NO: 1206081 - RNA, 19 nt, Human
agccacugcaccgggccac

SEQ ID NO: 1206082 - RNA, 18 nt, Human
agccacugcaccgggcca

SEQ ID NO: 1206083 - RNA, 20 nt, Human
ugauuaaccacuucagcuga

SEQ ID NO: 1206084 - RNA, 15 nt, Human
ugauuaauuaaaaca

SEQ ID NO: 1206085 - RNA, 19 nt, Human
ugauuaaccacuucagcug

SEQ ID NO: 1206086 - RNA, 20 nt, Human
ugauuaaauucuugcaaagu

SEQ ID NO: 1206087 - RNA, 19 nt, Human
ugauuaaauucuugcaaag

SEQ ID NO: 1206088 - RNA, 15 nt, Human
ugauggugcaaugac

SEQ ID NO: 1206089 - RNA, 13 nt, Human
ugauggugcaaug

SEQ ID NO: 1206090 - RNA, 11 nt, Human
uggcugcugaa

SEQ ID NO: 1206091 - RNA, 17 nt, Human
uggcuuaaaacaacacu

SEQ ID NO: 1206092 - RNA, 15 nt, Human
uggcuguuggcuggg

SEQ ID NO: 1206093 - RNA, 13 nt, Human
uggcuguuggcug

SEQ ID NO: 1206094 - RNA, 14 nt, Human
uggcugugucuccc

SEQ ID NO: 1206095 - RNA, 23 nt, Human
uggcuucacggaagagccuugcg

SEQ ID NO: 1206096 - RNA, 16 nt, Human
ugggaaaggggaaguu

SEQ ID NO: 1206097 - RNA, 12 nt, Human
uggcugcaaagg

SEQ ID NO: 1206098 - RNA, 21 nt, Human
uggcucuuccaggcugggaga

SEQ ID NO: 1206099 - RNA, 20 nt, Human
uggcucuuccaggcugggag

SEQ ID NO: 1206100 - RNA, 18 nt, Human
uggcucaaguccucuuuu

SEQ ID NO: 1206101 - RNA, 20 nt, Human
uggcugccaaugggagcuca

SEQ ID NO: 1206102 - RNA, 18 nt, Human
uggcugccaaugggagcu

SEQ ID NO: 1206103 - RNA, 15 nt, Human
uggcugcagggaguc

SEQ ID NO: 1206104 - RNA, 14 nt, Human
uggcugcagggagu

SEQ ID NO: 1206105 - RNA, 13 nt, Human
uggcugcagggag

SEQ ID NO: 1206106 - RNA, 22 nt, Human
uggcuauuagagaucaaccccu

SEQ ID NO: 1206107 - RNA, 19 nt, Human
uggcuaugcauuugaaaau

SEQ ID NO: 1206108 - RNA, 17 nt, Human
uggcuaugcauuugaaa

SEQ ID NO: 1206109 - RNA, 15 nt, Human
uggcuaugcauuuga

SEQ ID NO: 1206110 - RNA, 14 nt, Human
uggcuaugcauuug

SEQ ID NO: 1206111 - RNA, 20 nt, Human
aggcuggcgugcaguggugc

SEQ ID NO: 1206112 - RNA, 18 nt, Human
aggcuggcgugcaguggu

SEQ ID NO: 1206113 - RNA, 16 nt, Human
aggcugggagagccuu

SEQ ID NO: 1206114 - RNA, 22 nt, Human
uggcuagagguucaaagauauu

SEQ ID NO: 1206115 - RNA, 14 nt, Human
aggcugggagagcc

SEQ ID NO: 1206116 - RNA, 16 nt, Human
aggcucugcccuuggu

SEQ ID NO: 1206117 - RNA, 17 nt, Human
aggcuggcgugcagugg

SEQ ID NO: 1206118 - RNA, 13 nt, Human
aggcuggcgugca

SEQ ID NO: 1206119 - RNA, 15 nt, Human
aggcucugcccuugg

SEQ ID NO: 1206120 - RNA, 14 nt, Human
aggcucugcccuug

SEQ ID NO: 1206121 - RNA, 13 nt, Human
aggcucugcccuu

SEQ ID NO: 1206122 - RNA, 12 nt, Human
aggcucugcccu

SEQ ID NO: 1206123 - RNA, 11 nt, Human
aggcucugccc

SEQ ID NO: 1206124 - RNA, 21 nt, Human
aggcucucaggccagcugcuu

SEQ ID NO: 1206125 - RNA, 20 nt, Human
aggcucucaggccagcugcu

SEQ ID NO: 1206126 - RNA, 19 nt, Human
aggcucucaggccagcugc

SEQ ID NO: 1206127 - RNA, 18 nt, Human
aggcucucaggccagcug

SEQ ID NO: 1206128 - RNA, 16 nt, Human
aggcucucaggccagc

SEQ ID NO: 1206129 - RNA, 15 nt, Human
aggcucucaggccag

SEQ ID NO: 1206130 - RNA, 14 nt, Human
aggcucucaggcca

SEQ ID NO: 1206131 - RNA, 12 nt, Human
aggcucucaggc

SEQ ID NO: 1206132 - RNA, 11 nt, Human
aggcucucagg

SEQ ID NO: 1206133 - RNA, 21 nt, Human
aggcucgagcaugccuggaug

SEQ ID NO: 1206134 - RNA, 19 nt, Human
aggcucgagcaugccugga

SEQ ID NO: 1206135 - RNA, 18 nt, Human
aggcucgagcaugccugg

SEQ ID NO: 1206136 - RNA, 17 nt, Human
aggcucgagcaugccug

SEQ ID NO: 1206137 - RNA, 15 nt, Human
aggcucgagcaugcc

SEQ ID NO: 1206138 - RNA, 12 nt, Human
aggcucgagcau

SEQ ID NO: 1206139 - RNA, 19 nt, Human
aggcuccuuuagcgcccag

SEQ ID NO: 1206140 - RNA, 16 nt, Human
aggccaaacucaccug

SEQ ID NO: 1206141 - RNA, 18 nt, Human
aggcauuuguuugaacug

SEQ ID NO: 1206142 - RNA, 23 nt, Human
aggccaaaggaagcacaugccuc

SEQ ID NO: 1206143 - RNA, 15 nt, Human
aggccaaaggaagca

SEQ ID NO: 1206144 - RNA, 14 nt, Human
aggccaaaggaagc

SEQ ID NO: 1206145 - RNA, 20 nt, Human
aggccaaacucaccugcccc

SEQ ID NO: 1206146 - RNA, 20 nt, Human
uggaugccugguggcagcug

SEQ ID NO: 1206147 - RNA, 19 nt, Human
uggaugccugguggcagcu

SEQ ID NO: 1206148 - RNA, 18 nt, Human
uggaugccugguggcagc

SEQ ID NO: 1206149 - RNA, 20 nt, Human
uggaguucaucuugaauugu

SEQ ID NO: 1206150 - RNA, 17 nt, Human
uggaguucaucuugaau

SEQ ID NO: 1206151 - RNA, 16 nt, Human
uggaguucaucuugaa

SEQ ID NO: 1206152 - RNA, 16 nt, Human
aggccacaagacccuu

SEQ ID NO: 1206153 - RNA, 15 nt, Human
aggccacaagacccu

SEQ ID NO: 1206154 - RNA, 22 nt, Human
uggcagaguugaagacagagcu

SEQ ID NO: 1206155 - RNA, 21 nt, Human
uggcagaguugaagacagagc

SEQ ID NO: 1206156 - RNA, 16 nt, Human
uggcacccggccccug

SEQ ID NO: 1206157 - RNA, 15 nt, Human
uggcacccggccccu

SEQ ID NO: 1206158 - RNA, 21 nt, Human
uggcacaucagcacgauuucu

SEQ ID NO: 1206159 - RNA, 20 nt, Human
uggcacaucagcacgauuuc

SEQ ID NO: 1206160 - RNA, 22 nt, Human
uggauuaaacuuaaucuaaaug

SEQ ID NO: 1206161 - RNA, 12 nt, Human
uggauguucuga

SEQ ID NO: 1206162 - RNA, 12 nt, Human
aggccagagaca

SEQ ID NO: 1206163 - RNA, 13 nt, Human
uggcagccuuggc

SEQ ID NO: 1206164 - RNA, 12 nt, Human
uggcagccccug

SEQ ID NO: 1206165 - RNA, 20 nt, Human
aggccacaagacccuugugg

SEQ ID NO: 1206166 - RNA, 21 nt, Human
uggccccugcccggcugcgga

SEQ ID NO: 1206167 - RNA, 23 nt, Human
aggccugggggcugggcagagga

SEQ ID NO: 1206168 - RNA, 12 nt, Human
uggccuggcccc

SEQ ID NO: 1206169 - RNA, 23 nt, Human
aggccuggccagaugcaccagcc

SEQ ID NO: 1206170 - RNA, 22 nt, Human
aggccuggccagaugcaccagc

SEQ ID NO: 1206171 - RNA, 21 nt, Human
aggccuggccagaugcaccag

SEQ ID NO: 1206172 - RNA, 17 nt, Human
aggccuggccagaugca

SEQ ID NO: 1206173 - RNA, 16 nt, Human
aggccuggccagaugc

SEQ ID NO: 1206174 - RNA, 18 nt, Human
uggccucugcacuccccu

SEQ ID NO: 1206175 - RNA, 23 nt, Human
uggccgggcgcgguggcucacgc

SEQ ID NO: 1206176 - RNA, 17 nt, Human
uggccucugcacucccc

SEQ ID NO: 1206177 - RNA, 15 nt, Human
uggccucugcacucc

SEQ ID NO: 1206178 - RNA, 14 nt, Human
uggccucugcacuc

SEQ ID NO: 1206179 - RNA, 15 nt, Human
aggcccucugcccac

SEQ ID NO: 1206180 - RNA, 14 nt, Human
aggcccucugccca

SEQ ID NO: 1206181 - RNA, 13 nt, Human
aggcccucugccc

SEQ ID NO: 1206182 - RNA, 17 nt, Human
uggccaggcuggucuca

SEQ ID NO: 1206183 - RNA, 22 nt, Human
uggcaugggaaugaaugucagu

SEQ ID NO: 1206184 - RNA, 15 nt, Human
uggcaugggaaugaa

SEQ ID NO: 1206185 - RNA, 12 nt, Human
uggcaugggaau

SEQ ID NO: 1206186 - RNA, 21 nt, Human
uggacacagcucuucuccagg

SEQ ID NO: 1206187 - RNA, 18 nt, Human
uggacacagcucuucucc

SEQ ID NO: 1206188 - RNA, 16 nt, Human
uggacacagcucuucu

SEQ ID NO: 1206189 - RNA, 15 nt, Human
uggacacagcucuuc

SEQ ID NO: 1206190 - RNA, 15 nt, Human
uggacccugaggccc

SEQ ID NO: 1206191 - RNA, 14 nt, Human
uggacccugaggcc

SEQ ID NO: 1206192 - RNA, 13 nt, Human
uggacccugaggc

SEQ ID NO: 1206193 - RNA, 12 nt, Human
uggacccugagg

SEQ ID NO: 1206194 - RNA, 19 nt, Human
aggcaacugcauuggcuuu

SEQ ID NO: 1206195 - RNA, 17 nt, Human
aggcaacucaucuuagg

SEQ ID NO: 1206196 - RNA, 19 nt, Human
aggaugcccaaagaugcag

SEQ ID NO: 1206197 - RNA, 14 nt, Human
aggaugcccaaaga

SEQ ID NO: 1206198 - RNA, 20 nt, Human
aggaugaucuaggaagacuu

SEQ ID NO: 1206199 - RNA, 19 nt, Human
aggauuuugauccaagcug

SEQ ID NO: 1206200 - RNA, 23 nt, Human
uggaaaugggcagagcagagacc

SEQ ID NO: 1206201 - RNA, 20 nt, Human
uggaaauauuaagaaagacu

SEQ ID NO: 1206202 - RNA, 17 nt, Human
aggaugaucuaggaaga

SEQ ID NO: 1206203 - RNA, 16 nt, Human
aggaugaucuaggaag

SEQ ID NO: 1206204 - RNA, 22 nt, Human
aggaucucuugagccugggagg

SEQ ID NO: 1206205 - RNA, 21 nt, Human
aggaucucuugagccugggag

SEQ ID NO: 1206206 - RNA, 18 nt, Human
aggauccugagccagauu

SEQ ID NO: 1206207 - RNA, 17 nt, Human
aggauccugagccagau

SEQ ID NO: 1206208 - RNA, 16 nt, Human
aggauccugagccaga

SEQ ID NO: 1206209 - RNA, 15 nt, Human
aggauccugagccag

SEQ ID NO: 1206210 - RNA, 21 nt, Human
aggauacaaaagcaugugaga

SEQ ID NO: 1206211 - RNA, 23 nt, Human
aggacauugcggacagccacggc

SEQ ID NO: 1206212 - RNA, 19 nt, Human
aggacauugcggacagcca

SEQ ID NO: 1206213 - RNA, 18 nt, Human
aggacauugcggacagcc

SEQ ID NO: 1206214 - RNA, 17 nt, Human
aggacauugcggacagc

SEQ ID NO: 1206215 - RNA, 15 nt, Human
aggacauugcggaca

SEQ ID NO: 1206216 - RNA, 22 nt, Human
aggagccccgaggccuucucug

SEQ ID NO: 1206217 - RNA, 17 nt, Human
aggagauuggaaggaac

SEQ ID NO: 1206218 - RNA, 16 nt, Human
ugcuugggcuucaucc

SEQ ID NO: 1206219 - RNA, 12 nt, Human
ugcuugggcuuc

SEQ ID NO: 1206220 - RNA, 21 nt, Human
ugcuuggaggaaggaaaccca

SEQ ID NO: 1206221 - RNA, 15 nt, Human
uggaaauauuaagaa

SEQ ID NO: 1206222 - RNA, 19 nt, Human
ugcuugggcuucauccucc

SEQ ID NO: 1206223 - RNA, 17 nt, Human
ugcugucccuuacguga

SEQ ID NO: 1206224 - RNA, 15 nt, Human
ugcugcccugugagu

SEQ ID NO: 1206225 - RNA, 14 nt, Human
ugcugcccugugag

SEQ ID NO: 1206226 - RNA, 13 nt, Human
ugcugcccuguga

SEQ ID NO: 1206227 - RNA, 18 nt, Human
ugcuggcuguuggcuggg

SEQ ID NO: 1206228 - RNA, 16 nt, Human
ugcuggcugguuagag

SEQ ID NO: 1206229 - RNA, 23 nt, Human
aggacacuaaccacgcuggaccu

SEQ ID NO: 1206230 - RNA, 22 nt, Human
aggacagggaggugaccccagg

SEQ ID NO: 1206231 - RNA, 14 nt, Human
ugcuucagccuccc

SEQ ID NO: 1206232 - RNA, 13 nt, Human
ugcuucagccucc

SEQ ID NO: 1206233 - RNA, 20 nt, Human
ugcuucaaggauccugagcc

SEQ ID NO: 1206234 - RNA, 19 nt, Human
ugcuucaaggauccugagc

SEQ ID NO: 1206235 - RNA, 18 nt, Human
ugcuucaaggauccugag

SEQ ID NO: 1206236 - RNA, 16 nt, Human
ugcuucaaggauccug

SEQ ID NO: 1206237 - RNA, 13 nt, Human
ugcuuauacacuu

SEQ ID NO: 1206238 - RNA, 19 nt, Human
agcugggacuacaggcacc

SEQ ID NO: 1206239 - RNA, 18 nt, Human
agcugggacuacaggcac

SEQ ID NO: 1206240 - RNA, 16 nt, Human
agcugggacuacaggc

SEQ ID NO: 1206241 - RNA, 20 nt, Human
ugcuccagcuguucagcugg

SEQ ID NO: 1206242 - RNA, 19 nt, Human
ugcuccagcuguucagcug

SEQ ID NO: 1206243 - RNA, 16 nt, Human
ugcuccagcuguucag

SEQ ID NO: 1206244 - RNA, 22 nt, Human
ugcucugcugacagacacaggc

SEQ ID NO: 1206245 - RNA, 21 nt, Human
ugcucugcugacagacacagg

SEQ ID NO: 1206246 - RNA, 15 nt, Human
ugcugagucugaagg

SEQ ID NO: 1206247 - RNA, 15 nt, Human
aggaagccagcaggc

SEQ ID NO: 1206248 - RNA, 14 nt, Human
aggaagccagcagg

SEQ ID NO: 1206249 - RNA, 24 nt, Human
aggaagcacaugccucucucaggc

SEQ ID NO: 1206250 - RNA, 23 nt, Human
aggaagcacaugccucucucagg

SEQ ID NO: 1206251 - RNA, 14 nt, Human
aggaagacuuugga

SEQ ID NO: 1206252 - RNA, 13 nt, Human
aggaagacuuugg

SEQ ID NO: 1206253 - RNA, 19 nt, Human
aggaagacuucaucccucu

SEQ ID NO: 1206254 - RNA, 13 nt, Human
aggaagacuucau

SEQ ID NO: 1206255 - RNA, 23 nt, Human
ugcugagucugaaggcuggguuc

SEQ ID NO: 1206256 - RNA, 22 nt, Human
ugcugagucugaaggcuggguu

SEQ ID NO: 1206257 - RNA, 21 nt, Human
ugcugagucugaaggcugggu

SEQ ID NO: 1206258 - RNA, 18 nt, Human
ugcugagucugaaggcug

SEQ ID NO: 1206259 - RNA, 17 nt, Human
ugcugagucugaaggcu

SEQ ID NO: 1206260 - RNA, 16 nt, Human
ugcugagucugaaggc

SEQ ID NO: 1206261 - RNA, 15 nt, Human
aggaaggagaggaga

SEQ ID NO: 1206262 - RNA, 19 nt, Human
aggaaggaaacccagcucu

SEQ ID NO: 1206263 - RNA, 18 nt, Human
aggaaggaaacccagcuc

SEQ ID NO: 1206264 - RNA, 18 nt, Human
aggaagccagcaggcucu

SEQ ID NO: 1206265 - RNA, 17 nt, Human
aggaagccagcaggcuc

SEQ ID NO: 1206266 - RNA, 10 nt, Human
ugagaggaaa

SEQ ID NO: 1206267 - RNA, 14 nt, Human
ugagagcugggugu

SEQ ID NO: 1206268 - RNA, 14 nt, Human
ugagaggaaaucac

SEQ ID NO: 1206269 - RNA, 13 nt, Human
ugagaggaaauca

SEQ ID NO: 1206270 - RNA, 12 nt, Human
ugagaggaaauc

SEQ ID NO: 1206271 - RNA, 11 nt, Human
ugagaggaaau

SEQ ID NO: 1206272 - RNA, 23 nt, Human
ugagaggacuuuucuuuguggcu

SEQ ID NO: 1206273 - RNA, 17 nt, Human
ugagaggaaaucaccga

SEQ ID NO: 1206274 - RNA, 20 nt, Human
ugagacucugucucaaaaaa

SEQ ID NO: 1206275 - RNA, 22 nt, Human
ugagacagcccgggcucugccu

SEQ ID NO: 1206276 - RNA, 20 nt, Human
ugagacagcccgggcucugc

SEQ ID NO: 1206277 - RNA, 19 nt, Human
ugagacagcccgggcucug

SEQ ID NO: 1206278 - RNA, 18 nt, Human
ugagacagcccgggcucu

SEQ ID NO: 1206279 - RNA, 17 nt, Human
ugagacagcccgggcuc

SEQ ID NO: 1206280 - RNA, 12 nt, Human
ugagaauuaccc

SEQ ID NO: 1206281 - RNA, 13 nt, Human
ugagacagcccgg

SEQ ID NO: 1206282 - RNA, 21 nt, Human
ugagacagaguuuucacucuu

SEQ ID NO: 1206283 - RNA, 11 nt, Human
ugagacagagu

SEQ ID NO: 1206284 - RNA, 22 nt, Human
agcacaugccucucucaggcca

SEQ ID NO: 1206285 - RNA, 21 nt, Human
agcacaugccucucucaggcc

SEQ ID NO: 1206286 - RNA, 20 nt, Human
agcacaugccucucucaggc

SEQ ID NO: 1206287 - RNA, 19 nt, Human
agcacaugccucucucagg

SEQ ID NO: 1206288 - RNA, 18 nt, Human
agcacaugccucucucag

SEQ ID NO: 1206289 - RNA, 21 nt, Human
agcacagcuucauuuccugug

SEQ ID NO: 1206290 - RNA, 18 nt, Human
agcaagugagagcugggu

SEQ ID NO: 1206291 - RNA, 17 nt, Human
agcaagugagagcuggg

SEQ ID NO: 1206292 - RNA, 16 nt, Human
agcaccaucucuccuc

SEQ ID NO: 1206293 - RNA, 22 nt, Human
agcaccaaaagcuuaccaaggg

SEQ ID NO: 1206294 - RNA, 23 nt, Human
agcacaugccucucucaggccaa

SEQ ID NO: 1206295 - RNA, 16 nt, Human
agcaccuccugccucg

SEQ ID NO: 1206296 - RNA, 14 nt, Human
agcaccuccugccu

SEQ ID NO: 1206297 - RNA, 13 nt, Human
agcaccuccugcc

SEQ ID NO: 1206298 - RNA, 16 nt, Human
agcaagugagagcugg

SEQ ID NO: 1206299 - RNA, 15 nt, Human
agcaagugagagcug

SEQ ID NO: 1206300 - RNA, 16 nt, Human
agcaagugagacccug

SEQ ID NO: 1206301 - RNA, 19 nt, Human
agcaaggagauuuacaacu

SEQ ID NO: 1206302 - RNA, 17 nt, Human
agcaaggagauuuacaa

SEQ ID NO: 1206303 - RNA, 14 nt, Human
agcaaggagauuua

SEQ ID NO: 1206304 - RNA, 21 nt, Human
ugagccagauuucacucuccu

SEQ ID NO: 1206305 - RNA, 20 nt, Human
ugagccagauuucacucucc

SEQ ID NO: 1206306 - RNA, 19 nt, Human
ugagccagauuucacucuc

SEQ ID NO: 1206307 - RNA, 18 nt, Human
ugagccagauuucacucu

SEQ ID NO: 1206308 - RNA, 18 nt, Human
ugagccacugcaccgggc

SEQ ID NO: 1206309 - RNA, 14 nt, Human
ugagccacugcacc

SEQ ID NO: 1206310 - RNA, 13 nt, Human
ugagccacugcac

SEQ ID NO: 1206311 - RNA, 12 nt, Human
ugagccacugca

SEQ ID NO: 1206312 - RNA, 22 nt, Human
ugacagggcacaccgggcacuc

SEQ ID NO: 1206313 - RNA, 19 nt, Human
ugacaggcaaugcuggcug

SEQ ID NO: 1206314 - RNA, 17 nt, Human
ugacaggcaaugcuggc

SEQ ID NO: 1206315 - RNA, 19 nt, Human
ugacacgaauauugcugau

SEQ ID NO: 1206316 - RNA, 16 nt, Human
ugacacgaauauugcu

SEQ ID NO: 1206317 - RNA, 18 nt, Human
agaucucuaacuucacca

SEQ ID NO: 1206318 - RNA, 20 nt, Human
ugacuuacuguacaugaaaa

SEQ ID NO: 1206319 - RNA, 12 nt, Human
ugacuuacugua

SEQ ID NO: 1206320 - RNA, 16 nt, Human
agauucauauuuacuu

SEQ ID NO: 1206321 - RNA, 13 nt, Human
agauucauauuua

SEQ ID NO: 1206322 - RNA, 19 nt, Human
agauuucacucuccuuggu

SEQ ID NO: 1206323 - RNA, 19 nt, Human
agauucauauuuacuucuu

SEQ ID NO: 1206324 - RNA, 15 nt, Human
ugaccuuuaagagaa

SEQ ID NO: 1206325 - RNA, 13 nt, Human
ugaccuuucaaua

SEQ ID NO: 1206326 - RNA, 12 nt, Human
ugaccuuucaau

SEQ ID NO: 1206327 - RNA, 12 nt, Human
ucuuuccugagg

SEQ ID NO: 1206328 - RNA, 19 nt, Human
ucuuuaaugucacaggcag

SEQ ID NO: 1206329 - RNA, 18 nt, Human
ucuuuaaugucacaggca

SEQ ID NO: 1206330 - RNA, 15 nt, Human
ucuuuaaugucacag

SEQ ID NO: 1206331 - RNA, 22 nt, Human
agacaggcaagcaccuccugcc

SEQ ID NO: 1206332 - RNA, 20 nt, Human
agacaggcaagcaccuccug

SEQ ID NO: 1206333 - RNA, 13 nt, Human
agacucugucuca

SEQ ID NO: 1206334 - RNA, 14 nt, Human
agacuccugcaggc

SEQ ID NO: 1206335 - RNA, 13 nt, Human
agacuccugcagg

SEQ ID NO: 1206336 - RNA, 14 nt, Human
ucuuuguggcuucc

SEQ ID NO: 1206337 - RNA, 20 nt, Human
ucuuuguacagacaacaaac

SEQ ID NO: 1206338 - RNA, 15 nt, Human
ucuuuguacagacaa

SEQ ID NO: 1206339 - RNA, 14 nt, Human
ucuuuguacagaca

SEQ ID NO: 1206340 - RNA, 19 nt, Human
agagacacaagccuucggc

SEQ ID NO: 1206341 - RNA, 16 nt, Human
agagacacaagccuuc

SEQ ID NO: 1206342 - RNA, 19 nt, Human
agacuuuucuuucagccaa

SEQ ID NO: 1206343 - RNA, 15 nt, Human
agacuuuuccaaccc

SEQ ID NO: 1206344 - RNA, 19 nt, Human
agacuuuggaaagaguagg

SEQ ID NO: 1206345 - RNA, 15 nt, Human
agacuuuggaaagag

SEQ ID NO: 1206346 - RNA, 17 nt, Human
agacuuuggaaagacuu

SEQ ID NO: 1206347 - RNA, 14 nt, Human
agacuguacaaagu

SEQ ID NO: 1206348 - RNA, 20 nt, Human
agacugguuccauggccucu

SEQ ID NO: 1206349 - RNA, 16 nt, Human
ugaaaaucgugacaac

SEQ ID NO: 1206350 - RNA, 18 nt, Human
ugaaacuggauuaaacuu

SEQ ID NO: 1206351 - RNA, 17 nt, Human
ugaaacuggauuaaacu

SEQ ID NO: 1206352 - RNA, 20 nt, Human
ugaaaacacauuuuucuuag

SEQ ID NO: 1206353 - RNA, 19 nt, Human
ugaaaacacauuuuucuua

SEQ ID NO: 1206354 - RNA, 17 nt, Human
ugaaaacacauuuuucu

SEQ ID NO: 1206355 - RNA, 15 nt, Human
ugaaaacacauuuuu

SEQ ID NO: 1206356 - RNA, 14 nt, Human
ugaaaacacauuuu

SEQ ID NO: 1206357 - RNA, 13 nt, Human
ugaaaacacauuu

SEQ ID NO: 1206358 - RNA, 12 nt, Human
ugaaaacacauu

SEQ ID NO: 1206359 - RNA, 23 nt, Human
agagaccaucccugaaggccccg

SEQ ID NO: 1206360 - RNA, 22 nt, Human
agagaccaucccugaaggcccc

SEQ ID NO: 1206361 - RNA, 21 nt, Human
agagaccaucccugaaggccc

SEQ ID NO: 1206362 - RNA, 19 nt, Human
agagaccaucccugaaggc

SEQ ID NO: 1206363 - RNA, 22 nt, Human
ugaaagacuguacaaaguagaa

SEQ ID NO: 1206364 - RNA, 19 nt, Human
ugaaagacuguacaaagua

SEQ ID NO: 1206365 - RNA, 18 nt, Human
ugaaagacuguacaaagu

SEQ ID NO: 1206366 - RNA, 16 nt, Human
ugaaagacuguacaaa

SEQ ID NO: 1206367 - RNA, 22 nt, Human
ugaaagaaaauaccaaggaaca

SEQ ID NO: 1206368 - RNA, 15 nt, Human
agagacuccugcagg

SEQ ID NO: 1206369 - RNA, 14 nt, Human
agagacuccugcag

SEQ ID NO: 1206370 - RNA, 13 nt, Human
agagacuccugca

SEQ ID NO: 1206371 - RNA, 12 nt, Human
agagacuccugc

SEQ ID NO: 1206372 - RNA, 19 nt, Human
ugaaauuuuuauuaaauua

SEQ ID NO: 1206373 - RNA, 20 nt, Human
ugaaauuuuuauuaaauuau

SEQ ID NO: 1206374 - RNA, 16 nt, Human
ugaaauaacauggccu

SEQ ID NO: 1206375 - RNA, 17 nt, Human
ugaaauaacauggccuu

SEQ ID NO: 1206376 - RNA, 16 nt, Human
agagauugugguuuca

SEQ ID NO: 1206377 - RNA, 22 nt, Human
ugaaccgaugagaaauaaaguu

SEQ ID NO: 1206378 - RNA, 22 nt, Human
ugaaccaccacacccagcccac

SEQ ID NO: 1206379 - RNA, 13 nt, Human
ugaagacagagcu

SEQ ID NO: 1206380 - RNA, 23 nt, Human
ugaagacaaugacuuacuguaca

SEQ ID NO: 1206381 - RNA, 22 nt, Human
ugaagacaaugacuuacuguac

SEQ ID NO: 1206382 - RNA, 11 nt, Human
ugaacuccugg

SEQ ID NO: 1206383 - RNA, 22 nt, Human
agaggcugccucucccaucacu

SEQ ID NO: 1206384 - RNA, 20 nt, Human
agagggagugacagaggcag

SEQ ID NO: 1206385 - RNA, 15 nt, Human
agagggagugacaga

SEQ ID NO: 1206386 - RNA, 20 nt, Human
agagguucaaagauauuuug

SEQ ID NO: 1206387 - RNA, 19 nt, Human
agagguucaaagauauuuu

SEQ ID NO: 1206388 - RNA, 16 nt, Human
agagguucaaagauau

SEQ ID NO: 1206389 - RNA, 24 nt, Human
agaggcagccccauucugccugcc

SEQ ID NO: 1206390 - RNA, 23 nt, Human
agaggcagccccauucugccugc

SEQ ID NO: 1206391 - RNA, 22 nt, Human
agaggcagccccauucugccug

SEQ ID NO: 1206392 - RNA, 13 nt, Human
ugaauaauacagu

SEQ ID NO: 1206393 - RNA, 12 nt, Human
ugaauaauacag

SEQ ID NO: 1206394 - RNA, 13 nt, Human
ugaagucacacag

SEQ ID NO: 1206395 - RNA, 22 nt, Human
ugaaguaauaugcacacauuuu

SEQ ID NO: 1206396 - RNA, 21 nt, Human
ugaaguaauaugcacacauuu

SEQ ID NO: 1206397 - RNA, 20 nt, Human
ugaaguaauaugcacacauu

SEQ ID NO: 1206398 - RNA, 16 nt, Human
ugaaguaauaugcaca

SEQ ID NO: 1206399 - RNA, 15 nt, Human
ugaaguaauaugcac

SEQ ID NO: 1206400 - RNA, 23 nt, Human
agaaguuucugccgcagcccugc

SEQ ID NO: 1206401 - RNA, 22 nt, Human
agaaguuucugccgcagcccug

SEQ ID NO: 1206402 - RNA, 21 nt, Human
agaaguuucugccgcagcccu

SEQ ID NO: 1206403 - RNA, 18 nt, Human
ucuguuggccagugugac

SEQ ID NO: 1206404 - RNA, 13 nt, Human
ucuguuuagauaa

SEQ ID NO: 1206405 - RNA, 22 nt, Human
ucuguucuuuccaaaguacacu

SEQ ID NO: 1206406 - RNA, 13 nt, Human
ucuguucuuucca

SEQ ID NO: 1206407 - RNA, 17 nt, Human
ucuguuggccaguguga

SEQ ID NO: 1206408 - RNA, 12 nt, Human
ucuguuggccag

SEQ ID NO: 1206409 - RNA, 16 nt, Human
agacacaggcccggcu

SEQ ID NO: 1206410 - RNA, 13 nt, Human
agacacaggcccg

SEQ ID NO: 1206411 - RNA, 12 nt, Human
agacacaggccc

SEQ ID NO: 1206412 - RNA, 13 nt, Human
agacagagcuaca

SEQ ID NO: 1206413 - RNA, 19 nt, Human
agacaccuugacagggcac

SEQ ID NO: 1206414 - RNA, 18 nt, Human
agacaccuugacagggca

SEQ ID NO: 1206415 - RNA, 17 nt, Human
agacaccuugacagggc

SEQ ID NO: 1206416 - RNA, 20 nt, Human
agacacauguccaagaagcc

SEQ ID NO: 1206417 - RNA, 16 nt, Human
agacacauguccaaga

SEQ ID NO: 1206418 - RNA, 16 nt, Human
agaaauguacagcaag

SEQ ID NO: 1206419 - RNA, 18 nt, Human
agaagauuuugaaauuuu

SEQ ID NO: 1206420 - RNA, 17 nt, Human
ucugcccacucccugca

SEQ ID NO: 1206421 - RNA, 23 nt, Human
agaagcccaggaaaggcuccagg

SEQ ID NO: 1206422 - RNA, 22 nt, Human
agaagcccaggaaaggcuccag

SEQ ID NO: 1206423 - RNA, 21 nt, Human
agaagcccaggaaaggcucca

SEQ ID NO: 1206424 - RNA, 20 nt, Human
agaagcccaggaaaggcucc

SEQ ID NO: 1206425 - RNA, 18 nt, Human
agaagcccaggaaaggcu

SEQ ID NO: 1206426 - RNA, 16 nt, Human
agaagcccaggaaagg

SEQ ID NO: 1206427 - RNA, 12 nt, Human
agaagcccagga

SEQ ID NO: 1206428 - RNA, 15 nt, Human
ucugcuucagccucc

SEQ ID NO: 1206429 - RNA, 14 nt, Human
ucugcuucagccuc

SEQ ID NO: 1206430 - RNA, 20 nt, Human
ucugcucacauaucugucau

SEQ ID NO: 1206431 - RNA, 19 nt, Human
ucugcucacauaucuguca

SEQ ID NO: 1206432 - RNA, 22 nt, Human
ucugccugcccaggccccugcc

SEQ ID NO: 1206433 - RNA, 21 nt, Human
ucugccugcccaggccccugc

SEQ ID NO: 1206434 - RNA, 22 nt, Human
ucugccgcagcccugcagaggg

SEQ ID NO: 1206435 - RNA, 23 nt, Human
ucugccgcagcccugcagagggc

SEQ ID NO: 1206436 - RNA, 19 nt, Human
ucugcccuccaagaccuuc

SEQ ID NO: 1206437 - RNA, 23 nt, Human
ucugcccacucccugcaaccuga

SEQ ID NO: 1206438 - RNA, 21 nt, Human
ucugcccacucccugcaaccu

SEQ ID NO: 1206439 - RNA, 18 nt, Human
ucugcccacucccugcaa

SEQ ID NO: 1206440 - RNA, 15 nt, Human
ucugccgcagcccug

SEQ ID NO: 1206441 - RNA, 14 nt, Human
ucugccgcagcccu

SEQ ID NO: 1206442 - RNA, 15 nt, Human
agaaauguacagcaa

SEQ ID NO: 1206443 - RNA, 14 nt, Human
agaaauguacagca

SEQ ID NO: 1206444 - RNA, 17 nt, Human
ucugcagcaauaaagca

SEQ ID NO: 1206445 - RNA, 18 nt, Human
ucugcagcaauaaagcag

SEQ ID NO: 1206446 - RNA, 15 nt, Human
ucugcacuccccugc

SEQ ID NO: 1206447 - RNA, 14 nt, Human
ucugcacuccccug

SEQ ID NO: 1206448 - RNA, 16 nt, Human
ucugcacuccccugcu

SEQ ID NO: 1206449 - RNA, 17 nt, Human
ucugcacuccccugcug

SEQ ID NO: 1206450 - RNA, 22 nt, Human
ucugagacucgcgacaaugcaa

SEQ ID NO: 1206451 - RNA, 21 nt, Human
ucugagacucgcgacaaugca

SEQ ID NO: 1206452 - RNA, 21 nt, Human
ucugaucauccacugugccau

SEQ ID NO: 1206453 - RNA, 17 nt, Human
ucugaucauccacugug

SEQ ID NO: 1206454 - RNA, 15 nt, Human
ucugacacacagcuc

SEQ ID NO: 1206455 - RNA, 14 nt, Human
ucugacacacagcu

SEQ ID NO: 1206456 - RNA, 13 nt, Human
ucugacacacagc

SEQ ID NO: 1206457 - RNA, 22 nt, Human
ucugaaggacauugcggacagc

SEQ ID NO: 1206458 - RNA, 21 nt, Human
ucugaaggacauugcggacag

SEQ ID NO: 1206459 - RNA, 15 nt, Human
agaaaugccuuaccc

SEQ ID NO: 1206460 - RNA, 22 nt, Human
ucuaguuguuugauucagacag

SEQ ID NO: 1206461 - RNA, 12 nt, Human
ucuaggaagacu

SEQ ID NO: 1206462 - RNA, 13 nt, Human
ucuagccagagga

SEQ ID NO: 1206463 - RNA, 22 nt, Human
ucuaguuugauuaaauucuugc

SEQ ID NO: 1206464 - RNA, 21 nt, Human
ucuaguuugauuaaauucuug

SEQ ID NO: 1206465 - RNA, 23 nt, Human
ucuaguuguuugauucagacagc

SEQ ID NO: 1206466 - RNA, 18 nt, Human
ucuagcauggcugccaau

SEQ ID NO: 1206467 - RNA, 13 nt, Human
ucuagauacugua

SEQ ID NO: 1206468 - RNA, 16 nt, Human
acuucaucccucuggg

SEQ ID NO: 1206469 - RNA, 19 nt, Human
ucucacuauguugcccagg

SEQ ID NO: 1206470 - RNA, 17 nt, Human
ucucacuauguugccca

SEQ ID NO: 1206471 - RNA, 16 nt, Human
acuuacacuuuaugca

SEQ ID NO: 1206472 - RNA, 22 nt, Human
acuuaaucuaaauggaaccacu

SEQ ID NO: 1206473 - RNA, 19 nt, Human
acuuaaucuaaauggaacc

SEQ ID NO: 1206474 - RNA, 17 nt, Human
acuuaaucuaaauggaa

SEQ ID NO: 1206475 - RNA, 13 nt, Human
acuuaagcacacu

SEQ ID NO: 1206476 - RNA, 12 nt, Human
acuguugcccag

SEQ ID NO: 1206477 - RNA, 15 nt, Human
acuuagguguggggg

SEQ ID NO: 1206478 - RNA, 21 nt, Human
acuuacuguacaugaaaacac

SEQ ID NO: 1206479 - RNA, 17 nt, Human
acuuacacuuuaugcac

SEQ ID NO: 1206480 - RNA, 22 nt, Human
acuuacuguacaugaaaacaca

SEQ ID NO: 1206481 - RNA, 19 nt, Human
acuguucucugcccuccaa

SEQ ID NO: 1206482 - RNA, 18 nt, Human
acuguucucugcccucca

SEQ ID NO: 1206483 - RNA, 17 nt, Human
acuguucucugcccucc

SEQ ID NO: 1206484 - RNA, 16 nt, Human
acuguucucugcccuc

SEQ ID NO: 1206485 - RNA, 21 nt, Human
ucuacccuggcacuauaaugu

SEQ ID NO: 1206486 - RNA, 19 nt, Human
ucuacccuggcacuauaau

SEQ ID NO: 1206487 - RNA, 14 nt, Human
ucuacccaggugcu

SEQ ID NO: 1206488 - RNA, 20 nt, Human
ucuacccagcgagcccuggu

SEQ ID NO: 1206489 - RNA, 18 nt, Human
uccugggagugagcuggu

SEQ ID NO: 1206490 - RNA, 21 nt, Human
ucuacagaggccaugggccuc

SEQ ID NO: 1206491 - RNA, 19 nt, Human
ucuacccagcgagcccugg

SEQ ID NO: 1206492 - RNA, 21 nt, Human
ucuccuuguguuacuaaguuu

SEQ ID NO: 1206493 - RNA, 13 nt, Human
ucuccuuguguua

SEQ ID NO: 1206494 - RNA, 18 nt, Human
ucuccuucaccuuugucc

SEQ ID NO: 1206495 - RNA, 19 nt, Human
agaaaaaauauuuucccua

SEQ ID NO: 1206496 - RNA, 16 nt, Human
ucuccuucaccuuugu

SEQ ID NO: 1206497 - RNA, 15 nt, Human
ucuccuucaccuuug

SEQ ID NO: 1206498 - RNA, 14 nt, Human
ucuccuucaccuuu

SEQ ID NO: 1206499 - RNA, 17 nt, Human
agaaaaaauauuuuccc

SEQ ID NO: 1206500 - RNA, 23 nt, Human
acuuuuguucuugguuuguaaau

SEQ ID NO: 1206501 - RNA, 15 nt, Human
acuuuuguucuuggu

SEQ ID NO: 1206502 - RNA, 13 nt, Human
acuuuuguucuug

SEQ ID NO: 1206503 - RNA, 12 nt, Human
acuuuuguucuu

SEQ ID NO: 1206504 - RNA, 14 nt, Human
acuuuguucuggcu

SEQ ID NO: 1206505 - RNA, 21 nt, Human
acuuuguuaguuucuccaagc

SEQ ID NO: 1206506 - RNA, 20 nt, Human
acuuuguuaguuucuccaag

SEQ ID NO: 1206507 - RNA, 14 nt, Human
acuuugaccucugc

SEQ ID NO: 1206508 - RNA, 13 nt, Human
acuuugaccucug

SEQ ID NO: 1206509 - RNA, 12 nt, Human
acuuugaccucu

SEQ ID NO: 1206510 - RNA, 12 nt, Human
acuuuaccuuuu

SEQ ID NO: 1206511 - RNA, 20 nt, Human
acuuucugaaauaacauggc

SEQ ID NO: 1206512 - RNA, 20 nt, Human
ucuccucugcugcuggcugg

SEQ ID NO: 1206513 - RNA, 18 nt, Human
ucuccucugcugcuggcu

SEQ ID NO: 1206514 - RNA, 17 nt, Human
ucuccucugcugcuggc

SEQ ID NO: 1206515 - RNA, 16 nt, Human
ucuccucugcugcugg

SEQ ID NO: 1206516 - RNA, 15 nt, Human
ucuccuccagaguca

SEQ ID NO: 1206517 - RNA, 23 nt, Human
ucuccgaccagacaccuugacag

SEQ ID NO: 1206518 - RNA, 17 nt, Human
ucuccgaccagacaccu

SEQ ID NO: 1206519 - RNA, 23 nt, Human
ucuccccagcaagugagagcugg

SEQ ID NO: 1206520 - RNA, 12 nt, Human
ucuccacccugc

SEQ ID NO: 1206521 - RNA, 19 nt, Human
ucuccaagcaggacaugga

SEQ ID NO: 1206522 - RNA, 18 nt, Human
ucuccaagcaggacaugg

SEQ ID NO: 1206523 - RNA, 22 nt, Human
acuuguggacacagcucuucuc

SEQ ID NO: 1206524 - RNA, 19 nt, Human
acuuguggacacagcucuu

SEQ ID NO: 1206525 - RNA, 21 nt, Human
acuugucuuuggacccugagg

SEQ ID NO: 1206526 - RNA, 20 nt, Human
acuugucuuuggacccugag

SEQ ID NO: 1206527 - RNA, 23 nt, Human
acuugcagacucuacagaggcca

SEQ ID NO: 1206528 - RNA, 22 nt, Human
acuugcagacucuacagaggcc

SEQ ID NO: 1206529 - RNA, 19 nt, Human
acuugcagacucuacagag

SEQ ID NO: 1206530 - RNA, 23 nt, Human
ucucacuauguugcccaggcagg

SEQ ID NO: 1206531 - RNA, 22 nt, Human
ucucacuauguugcccaggcag

SEQ ID NO: 1206532 - RNA, 21 nt, Human
ucucacuauguugcccaggca

SEQ ID NO: 1206533 - RNA, 20 nt, Human
ucucacuauguugcccaggc

SEQ ID NO: 1206534 - RNA, 13 nt, Human
ucucaggccagcu

SEQ ID NO: 1206535 - RNA, 12 nt, Human
ucucaggccagc

SEQ ID NO: 1206536 - RNA, 12 nt, Human
ucucaggccaaa

SEQ ID NO: 1206537 - RNA, 10 nt, Human
ucucaggcca

SEQ ID NO: 1206538 - RNA, 16 nt, Human
ucuccaagcaggacau

SEQ ID NO: 1206539 - RNA, 13 nt, Human
ucuccaaaauaaa

SEQ ID NO: 1206540 - RNA, 16 nt, Human
ucucauuugucacaca

SEQ ID NO: 1206541 - RNA, 14 nt, Human
ucucauuugucaca

SEQ ID NO: 1206542 - RNA, 21 nt, Human
ucucaggccagcugcuugggc

SEQ ID NO: 1206543 - RNA, 18 nt, Human
ucucaggccagcugcuug

SEQ ID NO: 1206544 - RNA, 17 nt, Human
ucucaggccagcugcuu

SEQ ID NO: 1206545 - RNA, 21 nt, Human
uccugaugcuucuucagagac

SEQ ID NO: 1206546 - RNA, 20 nt, Human
uccugaugcuucuucagaga

SEQ ID NO: 1206547 - RNA, 19 nt, Human
uccugaugcuucuucagag

SEQ ID NO: 1206548 - RNA, 13 nt, Human
acugcacuguuuu

SEQ ID NO: 1206549 - RNA, 20 nt, Human
acugcacuccagccugggug

SEQ ID NO: 1206550 - RNA, 19 nt, Human
acugcacuccagccugggu

SEQ ID NO: 1206551 - RNA, 18 nt, Human
acugcacuccagccuggg

SEQ ID NO: 1206552 - RNA, 17 nt, Human
acugcacuccagccugg

SEQ ID NO: 1206553 - RNA, 14 nt, Human
acugcacuccagcc

SEQ ID NO: 1206554 - RNA, 21 nt, Human
acugcacuauagccuagguga

SEQ ID NO: 1206555 - RNA, 20 nt, Human
acugcacuauagccuaggug

SEQ ID NO: 1206556 - RNA, 16 nt, Human
acugcaccgggccaca

SEQ ID NO: 1206557 - RNA, 14 nt, Human
acugcaccgggcca

SEQ ID NO: 1206558 - RNA, 21 nt, Human
acugauaaagaugagugagca

SEQ ID NO: 1206559 - RNA, 13 nt, Human
acugauaaagaug

SEQ ID NO: 1206560 - RNA, 15 nt, Human
uccuggaaauauuaa

SEQ ID NO: 1206561 - RNA, 12 nt, Human
uccugggaguga

SEQ ID NO: 1206562 - RNA, 17 nt, Human
uccugggagugagcugg

SEQ ID NO: 1206563 - RNA, 14 nt, Human
uccugggagugagc

SEQ ID NO: 1206564 - RNA, 15 nt, Human
uccugcaggcagcca

SEQ ID NO: 1206565 - RNA, 14 nt, Human
uccugcaggcagcc

SEQ ID NO: 1206566 - RNA, 13 nt, Human
uccugcaggcagc

SEQ ID NO: 1206567 - RNA, 12 nt, Human
uccugcaggcag

SEQ ID NO: 1206568 - RNA, 21 nt, Human
acugagacagcccgggcucug

SEQ ID NO: 1206569 - RNA, 18 nt, Human
acugagacagcccgggcu

SEQ ID NO: 1206570 - RNA, 15 nt, Human
acugagacagcccgg

SEQ ID NO: 1206571 - RNA, 23 nt, Human
acugagacagcccgggcucugcc

SEQ ID NO: 1206572 - RNA, 22 nt, Human
acugagacagcccgggcucugc

SEQ ID NO: 1206573 - RNA, 19 nt, Human
acucuuucuauuguuucuu

SEQ ID NO: 1206574 - RNA, 21 nt, Human
uccucuuuggucuacacugug

SEQ ID NO: 1206575 - RNA, 19 nt, Human
uccucuuuggucuacacug

SEQ ID NO: 1206576 - RNA, 15 nt, Human
uccucccucccucuu

SEQ ID NO: 1206577 - RNA, 19 nt, Human
uccucuuuccaucuacccu

SEQ ID NO: 1206578 - RNA, 12 nt, Human
uccucuuuccau

SEQ ID NO: 1206579 - RNA, 11 nt, Human
uccucuuucca

SEQ ID NO: 1206580 - RNA, 14 nt, Human
uccucccucccucu

SEQ ID NO: 1206581 - RNA, 11 nt, Human
uccucccuccc

SEQ ID NO: 1206582 - RNA, 23 nt, Human
uccucuuuggucuacacugugcu

SEQ ID NO: 1206583 - RNA, 22 nt, Human
uccucuuuggucuacacugugc

SEQ ID NO: 1206584 - RNA, 11 nt, Human
acuccuggccu

SEQ ID NO: 1206585 - RNA, 17 nt, Human
ucccugguggcagcuca

SEQ ID NO: 1206586 - RNA, 16 nt, Human
ucccugguggcagcuc

SEQ ID NO: 1206587 - RNA, 21 nt, Human
ucccugguggcagcucaccuc

SEQ ID NO: 1206588 - RNA, 20 nt, Human
ucccugguggcagcucaccu

SEQ ID NO: 1206589 - RNA, 19 nt, Human
ucccugguggcagcucacc

SEQ ID NO: 1206590 - RNA, 18 nt, Human
ucccugguggcagcucac

SEQ ID NO: 1206591 - RNA, 17 nt, Human
acuccugcaggcagcca

SEQ ID NO: 1206592 - RNA, 22 nt, Human
acuccugcaggcagccaggcca

SEQ ID NO: 1206593 - RNA, 16 nt, Human
acuccugcaggcagcc

SEQ ID NO: 1206594 - RNA, 15 nt, Human
acuccugcaggcagc

SEQ ID NO: 1206595 - RNA, 14 nt, Human
acuccugcaggcag

SEQ ID NO: 1206596 - RNA, 13 nt, Human
acucaccccagcc

SEQ ID NO: 1206597 - RNA, 15 nt, Human
acucaccccagcccc

SEQ ID NO: 1206598 - RNA, 14 nt, Human
acucaccccagccc

SEQ ID NO: 1206599 - RNA, 16 nt, Human
acucaccccagcccca

SEQ ID NO: 1206600 - RNA, 23 nt, Human
ucccuuuuuuggcugcugaaggc

SEQ ID NO: 1206601 - RNA, 22 nt, Human
ucccuuuuuuggcugcugaagg

SEQ ID NO: 1206602 - RNA, 20 nt, Human
ucccuuuuuuggcugcugaa

SEQ ID NO: 1206603 - RNA, 19 nt, Human
ucccuuuuuuggcugcuga

SEQ ID NO: 1206604 - RNA, 17 nt, Human
ucccuuuuuuggcugcu

SEQ ID NO: 1206605 - RNA, 21 nt, Human
ucccuuugacgccaucccagc

SEQ ID NO: 1206606 - RNA, 19 nt, Human
ucccuuugacgccauccca

SEQ ID NO: 1206607 - RNA, 18 nt, Human
ucccuuugacgccauccc

SEQ ID NO: 1206608 - RNA, 16 nt, Human
ucccuuugacgccauc

SEQ ID NO: 1206609 - RNA, 12 nt, Human
acuccuggccuc

SEQ ID NO: 1206610 - RNA, 20 nt, Human
ucccuuggauuguccccgac

SEQ ID NO: 1206611 - RNA, 19 nt, Human
ucccuuggauuguccccga

SEQ ID NO: 1206612 - RNA, 23 nt, Human
ucccugguggcagcucaccucuc

SEQ ID NO: 1206613 - RNA, 22 nt, Human
ucccugguggcagcucaccucu

SEQ ID NO: 1206614 - RNA, 14 nt, Human
acuccuggccucaa

SEQ ID NO: 1206615 - RNA, 13 nt, Human
acuccuggccuca

SEQ ID NO: 1206616 - RNA, 13 nt, Human
uccuaggcauuug

SEQ ID NO: 1206617 - RNA, 15 nt, Human
uccuacucuguguca

SEQ ID NO: 1206618 - RNA, 14 nt, Human
uccuacucuguguc

SEQ ID NO: 1206619 - RNA, 13 nt, Human
uccuacucugugu

SEQ ID NO: 1206620 - RNA, 14 nt, Human
acucuugaccucag

SEQ ID NO: 1206621 - RNA, 16 nt, Human
acucuugaccucaggu

SEQ ID NO: 1206622 - RNA, 15 nt, Human
acucuugaccucagg

SEQ ID NO: 1206623 - RNA, 23 nt, Human
uccucauacccacccccacccaa

SEQ ID NO: 1206624 - RNA, 22 nt, Human
uccucauaguaugguggcuggg

SEQ ID NO: 1206625 - RNA, 15 nt, Human
acucuccuugguguc

SEQ ID NO: 1206626 - RNA, 18 nt, Human
acucuccuggaaauauua

SEQ ID NO: 1206627 - RNA, 16 nt, Human
acucuccucugcugcu

SEQ ID NO: 1206628 - RNA, 14 nt, Human
acucuccucugcug

SEQ ID NO: 1206629 - RNA, 13 nt, Human
acucuccucugcu

SEQ ID NO: 1206630 - RNA, 12 nt, Human
acucuccucugc

SEQ ID NO: 1206631 - RNA, 17 nt, Human
acucuccuccagaguca

SEQ ID NO: 1206632 - RNA, 14 nt, Human
acucuccuccagag

SEQ ID NO: 1206633 - RNA, 24 nt, Human
acuccuugaaaacacuguucucug

SEQ ID NO: 1206634 - RNA, 23 nt, Human
acuccuugaaaacacuguucucu

SEQ ID NO: 1206635 - RNA, 22 nt, Human
acucugagacucgcgacaaugc

SEQ ID NO: 1206636 - RNA, 11 nt, Human
acucugagacu

SEQ ID NO: 1206637 - RNA, 23 nt, Human
acucuccuuggugucgggcauga

SEQ ID NO: 1206638 - RNA, 16 nt, Human
acucuccuuggugucg

SEQ ID NO: 1206639 - RNA, 15 nt, Human
acucuggcagcucag

SEQ ID NO: 1206640 - RNA, 13 nt, Human
acucuggcagcuc

SEQ ID NO: 1206641 - RNA, 16 nt, Human
uccagaauuucccaaa

SEQ ID NO: 1206642 - RNA, 15 nt, Human
uccagaauuucccaa

SEQ ID NO: 1206643 - RNA, 14 nt, Human
uccagaauuuccca

SEQ ID NO: 1206644 - RNA, 11 nt, Human
uccagccuggg

SEQ ID NO: 1206645 - RNA, 18 nt, Human
acgaauauugcugauggu

SEQ ID NO: 1206646 - RNA, 15 nt, Human
acgaauauugcugau

SEQ ID NO: 1206647 - RNA, 14 nt, Human
uccaggcuguaucc

SEQ ID NO: 1206648 - RNA, 23 nt, Human
uccaggcugggagagccuuccag

SEQ ID NO: 1206649 - RNA, 21 nt, Human
uccaggcugggagagccuucc

SEQ ID NO: 1206650 - RNA, 20 nt, Human
uccaggcugggagagccuuc

SEQ ID NO: 1206651 - RNA, 22 nt, Human
uccaggcuccuuuagcgcccag

SEQ ID NO: 1206652 - RNA, 12 nt, Human
uccaggcuccuu

SEQ ID NO: 1206653 - RNA, 10 nt, Human
uccaggcucc

SEQ ID NO: 1206654 - RNA, 18 nt, Human
accuuuguccccaccgca

SEQ ID NO: 1206655 - RNA, 17 nt, Human
accuuuguccccaccgc

SEQ ID NO: 1206656 - RNA, 15 nt, Human
accuugaaugaugcc

SEQ ID NO: 1206657 - RNA, 20 nt, Human
accuugaacuggguacuugu

SEQ ID NO: 1206658 - RNA, 14 nt, Human
accuuuuuuauaca

SEQ ID NO: 1206659 - RNA, 13 nt, Human
accuuuuuuauac

SEQ ID NO: 1206660 - RNA, 21 nt, Human
uccacugugccaugugccagg

SEQ ID NO: 1206661 - RNA, 23 nt, Human
uccagugaggcucugcccuuggu

SEQ ID NO: 1206662 - RNA, 22 nt, Human
uccagugaggcucugcccuugg

SEQ ID NO: 1206663 - RNA, 17 nt, Human
uccagugaggcucugcc

SEQ ID NO: 1206664 - RNA, 16 nt, Human
uccagugaggcucugc

SEQ ID NO: 1206665 - RNA, 15 nt, Human
uccagugaggcucug

SEQ ID NO: 1206666 - RNA, 18 nt, Human
uccaguaucuugaagacu

SEQ ID NO: 1206667 - RNA, 16 nt, Human
uccaguaucuugaaga

SEQ ID NO: 1206668 - RNA, 15 nt, Human
uccaguaucuugaag

SEQ ID NO: 1206669 - RNA, 14 nt, Human
uccaguaucuugaa

SEQ ID NO: 1206670 - RNA, 18 nt, Human
acggcuuuuacuuaaacc

SEQ ID NO: 1206671 - RNA, 18 nt, Human
acggcucacugcagccuc

SEQ ID NO: 1206672 - RNA, 17 nt, Human
acggcucacugcagccu

SEQ ID NO: 1206673 - RNA, 16 nt, Human
acggcucacugcagcc

SEQ ID NO: 1206674 - RNA, 13 nt, Human
acggccaggccag

SEQ ID NO: 1206675 - RNA, 12 nt, Human
acggccaggcca

SEQ ID NO: 1206676 - RNA, 20 nt, Human
acgcgugcacacaccagagc

SEQ ID NO: 1206677 - RNA, 21 nt, Human
acgcuacccgggaagggggcu

SEQ ID NO: 1206678 - RNA, 21 nt, Human
acgaauauugcugauggugca

SEQ ID NO: 1206679 - RNA, 23 nt, Human
acggagucccaccuuggcugcag

SEQ ID NO: 1206680 - RNA, 18 nt, Human
acgcuggagugcagugag

SEQ ID NO: 1206681 - RNA, 17 nt, Human
acgcuggagugcaguga

SEQ ID NO: 1206682 - RNA, 16 nt, Human
acgcuggagugcagug

SEQ ID NO: 1206683 - RNA, 15 nt, Human
acgcuggagugcagu

SEQ ID NO: 1206684 - RNA, 23 nt, Human
acgcuggaccuugaacuggguac

SEQ ID NO: 1206685 - RNA, 20 nt, Human
acgcuggaccuugaacuggg

SEQ ID NO: 1206686 - RNA, 13 nt, Human
acgcuggaccuug

SEQ ID NO: 1206687 - RNA, 23 nt, Human
acguggcugcuucaaggauccug

SEQ ID NO: 1206688 - RNA, 21 nt, Human
acguggcugcuucaaggaucc

SEQ ID NO: 1206689 - RNA, 19 nt, Human
acguggcugcuucaaggau

SEQ ID NO: 1206690 - RNA, 18 nt, Human
acguggcugcuucaagga

SEQ ID NO: 1206691 - RNA, 16 nt, Human
acguuucuaaaggcua

SEQ ID NO: 1206692 - RNA, 15 nt, Human
acguugugcauuugg

SEQ ID NO: 1206693 - RNA, 14 nt, Human
acguugugcauuug

SEQ ID NO: 1206694 - RNA, 13 nt, Human
acguugugcauuu

SEQ ID NO: 1206695 - RNA, 18 nt, Human
ucccagauacuugggggg

SEQ ID NO: 1206696 - RNA, 16 nt, Human
ucccagauacuugggg

SEQ ID NO: 1206697 - RNA, 22 nt, Human
acguuucuaaaggcuaccuuug

SEQ ID NO: 1206698 - RNA, 16 nt, Human
acucaaugcacugaca

SEQ ID NO: 1206699 - RNA, 17 nt, Human
acuauguugcccaggca

SEQ ID NO: 1206700 - RNA, 16 nt, Human
acuauguugcccaggc

SEQ ID NO: 1206701 - RNA, 15 nt, Human
acuauguugcccagg

SEQ ID NO: 1206702 - RNA, 22 nt, Human
acuauggcccuggccuagcaua

SEQ ID NO: 1206703 - RNA, 14 nt, Human
acuauguugcccag

SEQ ID NO: 1206704 - RNA, 21 nt, Human
acuaucuaaauguugaaagau

SEQ ID NO: 1206705 - RNA, 22 nt, Human
acuauagccuaggugacagagu

SEQ ID NO: 1206706 - RNA, 20 nt, Human
acuauagccuaggugacaga

SEQ ID NO: 1206707 - RNA, 18 nt, Human
uccccaggaggccagccu

SEQ ID NO: 1206708 - RNA, 16 nt, Human
uccccaccgcagacag

SEQ ID NO: 1206709 - RNA, 15 nt, Human
uccccaccgcagaca

SEQ ID NO: 1206710 - RNA, 23 nt, Human
uccccacccugaaagcccugagc

SEQ ID NO: 1206711 - RNA, 23 nt, Human
uccccaggaggccagccuugacc

SEQ ID NO: 1206712 - RNA, 21 nt, Human
uccccaggaggccagccuuga

SEQ ID NO: 1206713 - RNA, 20 nt, Human
uccccaggaggccagccuug

SEQ ID NO: 1206714 - RNA, 16 nt, Human
ucccccagccccaucc

SEQ ID NO: 1206715 - RNA, 15 nt, Human
ucccccagccccauc

SEQ ID NO: 1206716 - RNA, 13 nt, Human
ucccccagcccca

SEQ ID NO: 1206717 - RNA, 20 nt, Human
ucacaguucucuccuucuuc

SEQ ID NO: 1206718 - RNA, 16 nt, Human
ucacaguucucuccuu

SEQ ID NO: 1206719 - RNA, 13 nt, Human
ucacagccucuga

SEQ ID NO: 1206720 - RNA, 20 nt, Human
ucacagaugggugcuuggag

SEQ ID NO: 1206721 - RNA, 17 nt, Human
ucacaaaggaugcccaa

SEQ ID NO: 1206722 - RNA, 20 nt, Human
accaccacacccagcccacu

SEQ ID NO: 1206723 - RNA, 15 nt, Human
accaccacacccagc

SEQ ID NO: 1206724 - RNA, 18 nt, Human
accacaugugcacaugca

SEQ ID NO: 1206725 - RNA, 19 nt, Human
accacaucuugcucugcug

SEQ ID NO: 1206726 - RNA, 18 nt, Human
accacaucuugcucugcu

SEQ ID NO: 1206727 - RNA, 17 nt, Human
accacaucuugcucugc

SEQ ID NO: 1206728 - RNA, 16 nt, Human
accacuacauucuguu

SEQ ID NO: 1206729 - RNA, 17 nt, Human
accacuacauucuguua

SEQ ID NO: 1206730 - RNA, 22 nt, Human
accagcgugugacuacuccccc

SEQ ID NO: 1206731 - RNA, 17 nt, Human
accaguguuguggauuu

SEQ ID NO: 1206732 - RNA, 15 nt, Human
accaguguuguggau

SEQ ID NO: 1206733 - RNA, 10 nt, Human
ucacuugagu

SEQ ID NO: 1206734 - RNA, 23 nt, Human
ucacuguugcccaggcuggcgug

SEQ ID NO: 1206735 - RNA, 15 nt, Human
ucacugcagccucaa

SEQ ID NO: 1206736 - RNA, 14 nt, Human
ucacugcagccuca

SEQ ID NO: 1206737 - RNA, 22 nt, Human
ucacugagacagcccgggcucu

SEQ ID NO: 1206738 - RNA, 21 nt, Human
ucacugagacagcccgggcuc

SEQ ID NO: 1206739 - RNA, 17 nt, Human
ucacugagacagcccgg

SEQ ID NO: 1206740 - RNA, 17 nt, Human
ucacuauguugcccagg

SEQ ID NO: 1206741 - RNA, 14 nt, Human
acauuccugaugcu

SEQ ID NO: 1206742 - RNA, 19 nt, Human
acauguccaagaagcccag

SEQ ID NO: 1206743 - RNA, 15 nt, Human
acauguccaagaagc

SEQ ID NO: 1206744 - RNA, 23 nt, Human
acauguaauuaaguacuauguau

SEQ ID NO: 1206745 - RNA, 13 nt, Human
ucaaauuucuaaa

SEQ ID NO: 1206746 - RNA, 14 nt, Human
ucaaauuucuaaau

SEQ ID NO: 1206747 - RNA, 20 nt, Human
ucaacugcaucaagauguga

SEQ ID NO: 1206748 - RNA, 14 nt, Human
ucaaccagcagaug

SEQ ID NO: 1206749 - RNA, 22 nt, Human
acauguaauuaaguacuaugua

SEQ ID NO: 1206750 - RNA, 21 nt, Human
acauguaauuaaguacuaugu

SEQ ID NO: 1206751 - RNA, 19 nt, Human
acauguaauuaaguacuau

SEQ ID NO: 1206752 - RNA, 17 nt, Human
acauguaauuaaguacu

SEQ ID NO: 1206753 - RNA, 15 nt, Human
acauguaauuaagua

SEQ ID NO: 1206754 - RNA, 14 nt, Human
acauggaaguacua

SEQ ID NO: 1206755 - RNA, 22 nt, Human
acaugcuacacacugcauguuu

SEQ ID NO: 1206756 - RNA, 21 nt, Human
acaugcuacacacugcauguu

SEQ ID NO: 1206757 - RNA, 15 nt, Human
acaugcuacacacug

SEQ ID NO: 1206758 - RNA, 12 nt, Human
acagucccugcc

SEQ ID NO: 1206759 - RNA, 21 nt, Human
acauuuuuuaaaugcaccugg

SEQ ID NO: 1206760 - RNA, 17 nt, Human
acauuuuuuaaaugcac

SEQ ID NO: 1206761 - RNA, 16 nt, Human
acauuuuuuaaaugca

SEQ ID NO: 1206762 - RNA, 14 nt, Human
acauuuuuuaaaug

SEQ ID NO: 1206763 - RNA, 23 nt, Human
acauuuuuaagugcugcauuuaa

SEQ ID NO: 1206764 - RNA, 22 nt, Human
acauuuuuaagugcugcauuua

SEQ ID NO: 1206765 - RNA, 21 nt, Human
acauuuuuaagugcugcauuu

SEQ ID NO: 1206766 - RNA, 20 nt, Human
acauuuuauuuuauuaugca

SEQ ID NO: 1206767 - RNA, 19 nt, Human
acauuuuauuuuauuaugc

SEQ ID NO: 1206768 - RNA, 18 nt, Human
acauuuuauuuuauuaug

SEQ ID NO: 1206769 - RNA, 15 nt, Human
ucagcaaaagaugcu

SEQ ID NO: 1206770 - RNA, 18 nt, Human
accaguguuguggauuua

SEQ ID NO: 1206771 - RNA, 12 nt, Human
ucagauuugaac

SEQ ID NO: 1206772 - RNA, 21 nt, Human
ucagauuugaacucuucaauc

SEQ ID NO: 1206773 - RNA, 22 nt, Human
accccagccccaaaacucuccu

SEQ ID NO: 1206774 - RNA, 13 nt, Human
accccagccccaa

SEQ ID NO: 1206775 - RNA, 17 nt, Human
accccacacacgccaga

SEQ ID NO: 1206776 - RNA, 23 nt, Human
acccaggagccccgaggccuucu

SEQ ID NO: 1206777 - RNA, 12 nt, Human
ucagcuccagcu

SEQ ID NO: 1206778 - RNA, 23 nt, Human
ucagcggggacagcuccuucugu

SEQ ID NO: 1206779 - RNA, 21 nt, Human
ucagcggggacagcuccuucu

SEQ ID NO: 1206780 - RNA, 20 nt, Human
ucagcggggacagcuccuuc

SEQ ID NO: 1206781 - RNA, 19 nt, Human
ucagcggggacagcuccuu

SEQ ID NO: 1206782 - RNA, 18 nt, Human
accccaucucuacaaaaa

SEQ ID NO: 1206783 - RNA, 16 nt, Human
ucaggguuggccccug

SEQ ID NO: 1206784 - RNA, 19 nt, Human
ucagggucccugguggcag

SEQ ID NO: 1206785 - RNA, 23 nt, Human
ucaggccaggcccucugcccacu

SEQ ID NO: 1206786 - RNA, 22 nt, Human
ucaggccaggcccucugcccac

SEQ ID NO: 1206787 - RNA, 21 nt, Human
ucaggccaggcccucugccca

SEQ ID NO: 1206788 - RNA, 22 nt, Human
ucagcuuguaaauagcucaggu

SEQ ID NO: 1206789 - RNA, 21 nt, Human
ucagcuuguaaauagcucagg

SEQ ID NO: 1206790 - RNA, 15 nt, Human
ucagcuccagcucac

SEQ ID NO: 1206791 - RNA, 14 nt, Human
ucagcuccagcuca

SEQ ID NO: 1206792 - RNA, 13 nt, Human
acccgggaagggg

SEQ ID NO: 1206793 - RNA, 12 nt, Human
acccgggaaggg

SEQ ID NO: 1206794 - RNA, 22 nt, Human
acccggccccugcugguucagg

SEQ ID NO: 1206795 - RNA, 20 nt, Human
acccggccccugcugguuca

SEQ ID NO: 1206796 - RNA, 17 nt, Human
acccggccccugcuggu

SEQ ID NO: 1206797 - RNA, 17 nt, Human
ucaggguuggccccugc

SEQ ID NO: 1206798 - RNA, 23 nt, Human
ucagguaacaggcagauacagga

SEQ ID NO: 1206799 - RNA, 22 nt, Human
ucagguaacaggcagauacagg

SEQ ID NO: 1206800 - RNA, 21 nt, Human
ucagguaacaggcagauacag

SEQ ID NO: 1206801 - RNA, 16 nt, Human
acccggccccugcugg

SEQ ID NO: 1206802 - RNA, 15 nt, Human
acccggccccugcug

SEQ ID NO: 1206803 - RNA, 14 nt, Human
acccggccccugcu

SEQ ID NO: 1206804 - RNA, 15 nt, Human
accgaaaacguggcu

SEQ ID NO: 1206805 - RNA, 23 nt, Human
acccuuguggucccaccccacac

SEQ ID NO: 1206806 - RNA, 17 nt, Human
acccuugccgucuaccu

SEQ ID NO: 1206807 - RNA, 22 nt, Human
acccugcccugugggcccccaa

SEQ ID NO: 1206808 - RNA, 17 nt, Human
acccugcccugugggcc

SEQ ID NO: 1206809 - RNA, 15 nt, Human
acccugcccuguggg

SEQ ID NO: 1206810 - RNA, 17 nt, Human
acccugaggcccagagg

SEQ ID NO: 1206811 - RNA, 16 nt, Human
acccugaggcccagag

SEQ ID NO: 1206812 - RNA, 15 nt, Human
acccugaggcccaga

SEQ ID NO: 1206813 - RNA, 14 nt, Human
acccugaggcccag

SEQ ID NO: 1206814 - RNA, 18 nt, Human
acccugaaagcccugagc

SEQ ID NO: 1206815 - RNA, 16 nt, Human
acccugaaagcccuga

SEQ ID NO: 1206816 - RNA, 17 nt, Human
accgcagacaggaccag

SEQ ID NO: 1206817 - RNA, 16 nt, Human
accgcagacaggacca

SEQ ID NO: 1206818 - RNA, 12 nt, Human
accgcagacagg

SEQ ID NO: 1206819 - RNA, 20 nt, Human
accucccacaaaggagagcu

SEQ ID NO: 1206820 - RNA, 12 nt, Human
accuccugccuc

SEQ ID NO: 1206821 - RNA, 12 nt, Human
ucagugccacua

SEQ ID NO: 1206822 - RNA, 20 nt, Human
accgaaaacguggcugcuuc

SEQ ID NO: 1206823 - RNA, 19 nt, Human
accgaaaacguggcugcuu

SEQ ID NO: 1206824 - RNA, 17 nt, Human
accgaaaacguggcugc

SEQ ID NO: 1206825 - RNA, 15 nt, Human
ucagugccuuaugga

SEQ ID NO: 1206826 - RNA, 14 nt, Human
ucagugccuuaugg

SEQ ID NO: 1206827 - RNA, 12 nt, Human
ucagugccuuau

SEQ ID NO: 1206828 - RNA, 11 nt, Human
ucagugccuua

SEQ ID NO: 1206829 - RNA, 10 nt, Human
ucagugccuu

SEQ ID NO: 1206830 - RNA, 9 nt, Human
ucagugccu

SEQ ID NO: 1206831 - RNA, 11 nt, Human
ucaguggcagc

SEQ ID NO: 1206832 - RNA, 18 nt, Human
ucagugccuuauggaaca

SEQ ID NO: 1206833 - RNA, 16 nt, Human
ucagugccuuauggaa

SEQ ID NO: 1206834 - RNA, 13 nt, Human
ucaguggcagcug

SEQ ID NO: 1206835 - RNA, 12 nt, Human
ucaguggcagcu

SEQ ID NO: 1206836 - RNA, 14 nt, Human
ucauaaccuagccu

SEQ ID NO: 1206837 - RNA, 19 nt, Human
ucauaguaugguggcuggg

SEQ ID NO: 1206838 - RNA, 18 nt, Human
ucauaguaugguggcugg

SEQ ID NO: 1206839 - RNA, 15 nt, Human
ucauaguaugguggc

SEQ ID NO: 1206840 - RNA, 21 nt, Human
ucauaguaugguggcuggguu

SEQ ID NO: 1206841 - RNA, 18 nt, Human
ucauauaagauucauauu

SEQ ID NO: 1206842 - RNA, 16 nt, Human
ucauauuuacuucuua

SEQ ID NO: 1206843 - RNA, 23 nt, Human
ucauauuuacuucuuauacauuu

SEQ ID NO: 1206844 - RNA, 15 nt, Human
ucauauuuacuucuu

SEQ ID NO: 1206845 - RNA, 17 nt, Human
uaacuuccaauuuacau

SEQ ID NO: 1206846 - RNA, 14 nt, Human
uaacuucaccauau

SEQ ID NO: 1206847 - RNA, 21 nt, Human
uaacuucacauauugauuucc

SEQ ID NO: 1206848 - RNA, 16 nt, Human
uaacuuucugaaauaa

SEQ ID NO: 1206849 - RNA, 17 nt, Human
uaacauguaauuaagua

SEQ ID NO: 1206850 - RNA, 23 nt, Human
uaacauggacaugaucuucuuua

SEQ ID NO: 1206851 - RNA, 18 nt, Human
uaacauggacaugaucuu

SEQ ID NO: 1206852 - RNA, 22 nt, Human
aauaguggugugauuuggggau

SEQ ID NO: 1206853 - RNA, 13 nt, Human
aauaguuggcuag

SEQ ID NO: 1206854 - RNA, 17 nt, Human
aauauugauaugcuuau

SEQ ID NO: 1206855 - RNA, 22 nt, Human
aauaugcacacauuuuuuaaau

SEQ ID NO: 1206856 - RNA, 17 nt, Human
aauaugcacacauuuuu

SEQ ID NO: 1206857 - RNA, 16 nt, Human
aauaugcacacauuuu

SEQ ID NO: 1206858 - RNA, 15 nt, Human
uaagagaaaugagcu

SEQ ID NO: 1206859 - RNA, 22 nt, Human
uaagcuguuacugucuucagua

SEQ ID NO: 1206860 - RNA, 18 nt, Human
uaagcacacuugacauca

SEQ ID NO: 1206861 - RNA, 17 nt, Human
aaugaaaccugugucuc

SEQ ID NO: 1206862 - RNA, 17 nt, Human
aaugaaagacuguacaa

SEQ ID NO: 1206863 - RNA, 16 nt, Human
aaugaaagacuguaca

SEQ ID NO: 1206864 - RNA, 17 nt, Human
aaugaaacauuuuguca

SEQ ID NO: 1206865 - RNA, 22 nt, Human
aaugaaugucagugugacugau

SEQ ID NO: 1206866 - RNA, 13 nt, Human
aaugaaugucagu

SEQ ID NO: 1206867 - RNA, 14 nt, Human
aaugaaugucagug

SEQ ID NO: 1206868 - RNA, 18 nt, Human
aaugaaagacuguacaaa

SEQ ID NO: 1206869 - RNA, 18 nt, Human
uaaugucacaggcagguc

SEQ ID NO: 1206870 - RNA, 13 nt, Human
uaauguacugcau

SEQ ID NO: 1206871 - RNA, 22 nt, Human
uaauagacaauuuauuauggca

SEQ ID NO: 1206872 - RNA, 18 nt, Human
uaauagacaauuuauuau

SEQ ID NO: 1206873 - RNA, 16 nt, Human
uaauagacaauuuauu

SEQ ID NO: 1206874 - RNA, 21 nt, Human
uaauacaccacuacauucugu

SEQ ID NO: 1206875 - RNA, 19 nt, Human
uaauacaccacuacauucu

SEQ ID NO: 1206876 - RNA, 18 nt, Human
uaauacaccacuacauuc

SEQ ID NO: 1206877 - RNA, 16 nt, Human
uaauacaccacuacau

SEQ ID NO: 1206878 - RNA, 17 nt, Human
uaaugaaugaaacauuu

SEQ ID NO: 1206879 - RNA, 21 nt, Human
uaaguauucuuauuuaaugaa

SEQ ID NO: 1206880 - RNA, 20 nt, Human
uaaguauucuuauuuaauga

SEQ ID NO: 1206881 - RNA, 19 nt, Human
uaaguauucuuauuuaaug

SEQ ID NO: 1206882 - RNA, 19 nt, Human
uaaguacuauguaucaaug

SEQ ID NO: 1206883 - RNA, 17 nt, Human
uaaguacuauguaucaa

SEQ ID NO: 1206884 - RNA, 16 nt, Human
uaaguacuauguauca

SEQ ID NO: 1206885 - RNA, 13 nt, Human
uaaguacuaugua

SEQ ID NO: 1206886 - RNA, 23 nt, Human
aaucauuaggugugacugaauuu

SEQ ID NO: 1206887 - RNA, 17 nt, Human
aaucauuaggugugacu

SEQ ID NO: 1206888 - RNA, 15 nt, Human
aaucauuagguguga

SEQ ID NO: 1206889 - RNA, 20 nt, Human
aauguauguguaaguauucu

SEQ ID NO: 1206890 - RNA, 22 nt, Human
aaugugaaacuggauuaaacuu

SEQ ID NO: 1206891 - RNA, 15 nt, Human
aaugugaaacuggau

SEQ ID NO: 1206892 - RNA, 14 nt, Human
aaugugaaacugga

SEQ ID NO: 1206893 - RNA, 19 nt, Human
aaugugaaaagaaaaauga

SEQ ID NO: 1206894 - RNA, 21 nt, Human
aaugugcugaaugguuuucaa

SEQ ID NO: 1206895 - RNA, 24 nt, Human
uacauaaugcgugcauaccacuuu

SEQ ID NO: 1206896 - RNA, 23 nt, Human
uacauaaugcgugcauaccacuu

SEQ ID NO: 1206897 - RNA, 16 nt, Human
uacaggugugagucac

SEQ ID NO: 1206898 - RNA, 13 nt, Human
uacauucuguuaa

SEQ ID NO: 1206899 - RNA, 11 nt, Human
aauuaacuuuu

SEQ ID NO: 1206900 - RNA, 15 nt, Human
uacacuaaaagguga

SEQ ID NO: 1206901 - RNA, 23 nt, Human
uacacauuuuauuuuauuaugca

SEQ ID NO: 1206902 - RNA, 22 nt, Human
uacacauuuuauuuuauuaugc

SEQ ID NO: 1206903 - RNA, 21 nt, Human
uacacauuuuauuuuauuaug

SEQ ID NO: 1206904 - RNA, 22 nt, Human
uacagacaacaaaccuguuucu

SEQ ID NO: 1206905 - RNA, 16 nt, Human
aauggcagccuuggca

SEQ ID NO: 1206906 - RNA, 12 nt, Human
aauggcagccuu

SEQ ID NO: 1206907 - RNA, 22 nt, Human
aaugcacuuuguucuggcucuu

SEQ ID NO: 1206908 - RNA, 21 nt, Human
aaugcacuuuguucuggcucu

SEQ ID NO: 1206909 - RNA, 20 nt, Human
aaugaccuuucaauaggaaa

SEQ ID NO: 1206910 - RNA, 21 nt, Human
uacaaugcugugcccuaaagu

SEQ ID NO: 1206911 - RNA, 18 nt, Human
aaugaccuuucaauagga

SEQ ID NO: 1206912 - RNA, 17 nt, Human
aaugaccuuucaauagg

SEQ ID NO: 1206913 - RNA, 16 nt, Human
aaugaccuuucaauag

SEQ ID NO: 1206914 - RNA, 20 nt, Human
aauggacuaacuugucuuug

SEQ ID NO: 1206915 - RNA, 23 nt, Human
aauggacguguuaugacuccaga

SEQ ID NO: 1206916 - RNA, 14 nt, Human
aauggaaccacucu

SEQ ID NO: 1206917 - RNA, 21 nt, Human
aauggaaaugggcagagcaga

SEQ ID NO: 1206918 - RNA, 20 nt, Human
aauggaaaugggcagagcag

SEQ ID NO: 1206919 - RNA, 13 nt, Human
aaugcccagcccc

SEQ ID NO: 1206920 - RNA, 12 nt, Human
aaugcccagccc

SEQ ID NO: 1206921 - RNA, 11 nt, Human
aaugcccagcc

SEQ ID NO: 1206922 - RNA, 17 nt, Human
uaccugucccccugaca

SEQ ID NO: 1206923 - RNA, 16 nt, Human
uaccugucccccugac

SEQ ID NO: 1206924 - RNA, 14 nt, Human
uaccugucccccug

SEQ ID NO: 1206925 - RNA, 13 nt, Human
uaccugucccccu

SEQ ID NO: 1206926 - RNA, 10 nt, Human
uaccuguccc

SEQ ID NO: 1206927 - RNA, 23 nt, Human
uaccugccaggaagccagcaggc

SEQ ID NO: 1206928 - RNA, 20 nt, Human
uaccugccaggaagccagca

SEQ ID NO: 1206929 - RNA, 18 nt, Human
uaccugccaggaagccag

SEQ ID NO: 1206930 - RNA, 11 nt, Human
aauuacaggaa

SEQ ID NO: 1206931 - RNA, 15 nt, Human
aauuagccaagugug

SEQ ID NO: 1206932 - RNA, 12 nt, Human
aauuccccagau

SEQ ID NO: 1206933 - RNA, 14 nt, Human
aauuccccacccug

SEQ ID NO: 1206934 - RNA, 22 nt, Human
uacuguacaugaaaacacauuu

SEQ ID NO: 1206935 - RNA, 21 nt, Human
uacuguacaugaaaacacauu

SEQ ID NO: 1206936 - RNA, 23 nt, Human
uacuguaauuugugauacaaugc

SEQ ID NO: 1206937 - RNA, 20 nt, Human
uacuguaauuugugauacaa

SEQ ID NO: 1206938 - RNA, 19 nt, Human
uacuguaauuugugauaca

SEQ ID NO: 1206939 - RNA, 18 nt, Human
uacuguaauuugugauac

SEQ ID NO: 1206940 - RNA, 16 nt, Human
uacuggagaaaaugga

SEQ ID NO: 1206941 - RNA, 21 nt, Human
uacucugugucagguggggca

SEQ ID NO: 1206942 - RNA, 12 nt, Human
uacucuguguca

SEQ ID NO: 1206943 - RNA, 23 nt, Human
uacucuccuggaaauauuaagaa

SEQ ID NO: 1206944 - RNA, 22 nt, Human
uacucuccuggaaauauuaaga

SEQ ID NO: 1206945 - RNA, 14 nt, Human
uacuauguaucaau

SEQ ID NO: 1206946 - RNA, 13 nt, Human
uacuauguaucaa

SEQ ID NO: 1206947 - RNA, 12 nt, Human
uacuauguauca

SEQ ID NO: 1206948 - RNA, 23 nt, Human
uacuauggcccuggccuagcaua

SEQ ID NO: 1206949 - RNA, 17 nt, Human
uacuacuccuguaggaa

SEQ ID NO: 1206950 - RNA, 22 nt, Human
uacgccaggggaaaaucagccu

SEQ ID NO: 1206951 - RNA, 16 nt, Human
uacguugugcauuugg

SEQ ID NO: 1206952 - RNA, 15 nt, Human
uacguugugcauuug

SEQ ID NO: 1206953 - RNA, 14 nt, Human
uacguacacauuuu

SEQ ID NO: 1206954 - RNA, 13 nt, Human
uacguacacauuu

SEQ ID NO: 1206955 - RNA, 12 nt, Human
uacguacacauu

SEQ ID NO: 1206956 - RNA, 23 nt, Human
uauggcuuuugugcauuaucuag

SEQ ID NO: 1206957 - RNA, 21 nt, Human
uauggcuuuugugcauuaucu

SEQ ID NO: 1206958 - RNA, 18 nt, Human
uauggcuuuugugcauua

SEQ ID NO: 1206959 - RNA, 17 nt, Human
uauggcuuuugugcauu

SEQ ID NO: 1206960 - RNA, 22 nt, Human
uaugcuuauacacuuacacuuu

SEQ ID NO: 1206961 - RNA, 15 nt, Human
uaugcuuauacacuu

SEQ ID NO: 1206962 - RNA, 17 nt, Human
uaugccugggcagaagg

SEQ ID NO: 1206963 - RNA, 24 nt, Human
uaugcauuugaaaauuuugauguu

SEQ ID NO: 1206964 - RNA, 23 nt, Human
uaugcauuugaaaauuuugaugu

SEQ ID NO: 1206965 - RNA, 11 nt, Human
uaugcauuuga

SEQ ID NO: 1206966 - RNA, 20 nt, Human
acagcccgggcucugccucc

SEQ ID NO: 1206967 - RNA, 19 nt, Human
acagcccgggcucugccuc

SEQ ID NO: 1206968 - RNA, 18 nt, Human
acagcccgggcucugccu

SEQ ID NO: 1206969 - RNA, 17 nt, Human
acagcccgggcucugcc

SEQ ID NO: 1206970 - RNA, 21 nt, Human
acagcaaggagauuuacaacu

SEQ ID NO: 1206971 - RNA, 17 nt, Human
acagcaaggagauuuac

SEQ ID NO: 1206972 - RNA, 19 nt, Human
acagagcccacgcccccac

SEQ ID NO: 1206973 - RNA, 18 nt, Human
acagagcccacgccccca

SEQ ID NO: 1206974 - RNA, 15 nt, Human
acagagcccacgccc

SEQ ID NO: 1206975 - RNA, 20 nt, Human
acagagcccacgcccccacu

SEQ ID NO: 1206976 - RNA, 16 nt, Human
uaucucccccagcccc

SEQ ID NO: 1206977 - RNA, 14 nt, Human
uaucucccccagcc

SEQ ID NO: 1206978 - RNA, 13 nt, Human
uaucucccccagc

SEQ ID NO: 1206979 - RNA, 18 nt, Human
acagagaaaguacuucuc

SEQ ID NO: 1206980 - RNA, 11 nt, Human
acagagaaagu

SEQ ID NO: 1206981 - RNA, 18 nt, Human
uaucaaguauuauaccuu

SEQ ID NO: 1206982 - RNA, 17 nt, Human
acagaaauguacagcaa

SEQ ID NO: 1206983 - RNA, 16 nt, Human
acagaaauguacagca

SEQ ID NO: 1206984 - RNA, 14 nt, Human
acagaaauguacag

SEQ ID NO: 1206985 - RNA, 18 nt, Human
acagaaaauucuucucca

SEQ ID NO: 1206986 - RNA, 17 nt, Human
acagaaaauucuucucc

SEQ ID NO: 1206987 - RNA, 20 nt, Human
acagaaaauggaagacagcu

SEQ ID NO: 1206988 - RNA, 16 nt, Human
acagacccugcccugu

SEQ ID NO: 1206989 - RNA, 15 nt, Human
acagacccugcccug

SEQ ID NO: 1206990 - RNA, 14 nt, Human
acagacccugcccu

SEQ ID NO: 1206991 - RNA, 13 nt, Human
acagacccugccc

SEQ ID NO: 1206992 - RNA, 20 nt, Human
uauguggaguucaucuugaa

SEQ ID NO: 1206993 - RNA, 22 nt, Human
acaggcauguucucugaggaca

SEQ ID NO: 1206994 - RNA, 20 nt, Human
acaggcauguucucugagga

SEQ ID NO: 1206995 - RNA, 19 nt, Human
acaggcauguucucugagg

SEQ ID NO: 1206996 - RNA, 18 nt, Human
acaggcauguucucugag

SEQ ID NO: 1206997 - RNA, 15 nt, Human
acaggcauguucucu

SEQ ID NO: 1206998 - RNA, 13 nt, Human
acagcuaacaugg

SEQ ID NO: 1206999 - RNA, 13 nt, Human
acaggaaguacug

SEQ ID NO: 1207000 - RNA, 18 nt, Human
acaggaaaagcugcugac

SEQ ID NO: 1207001 - RNA, 17 nt, Human
acaggaaaagcugcuga

SEQ ID NO: 1207002 - RNA, 16 nt, Human
acaggaaaagcugcug

SEQ ID NO: 1207003 - RNA, 15 nt, Human
acaggaaaagcugcu

SEQ ID NO: 1207004 - RNA, 14 nt, Human
acaggcauguucuc

SEQ ID NO: 1207005 - RNA, 16 nt, Human
acaggcagguccaggg

SEQ ID NO: 1207006 - RNA, 14 nt, Human
acaggcagguccag

SEQ ID NO: 1207007 - RNA, 15 nt, Human
acaggaucagucuga

SEQ ID NO: 1207008 - RNA, 14 nt, Human
acaggaucagucug

SEQ ID NO: 1207009 - RNA, 16 nt, Human
acaggagugagcacua

SEQ ID NO: 1207010 - RNA, 23 nt, Human
acaggaccagggauuuccaugau

SEQ ID NO: 1207011 - RNA, 20 nt, Human
acagggcacaccgggcacuc

SEQ ID NO: 1207012 - RNA, 12 nt, Human
acagggcacacc

SEQ ID NO: 1207013 - RNA, 22 nt, Human
acaggcugggcuucaguggcag

SEQ ID NO: 1207014 - RNA, 12 nt, Human
acaggcugggcu

SEQ ID NO: 1207015 - RNA, 23 nt, Human
acaggcugggcuucaguggcagc

SEQ ID NO: 1207016 - RNA, 20 nt, Human
uauucaguaauaacucuacc

SEQ ID NO: 1207017 - RNA, 16 nt, Human
uauucaggaagcucag

SEQ ID NO: 1207018 - RNA, 14 nt, Human
uauucaggaagcuc

SEQ ID NO: 1207019 - RNA, 14 nt, Human
uauuacuucugcua

SEQ ID NO: 1207020 - RNA, 13 nt, Human
uauuacuucugcu

SEQ ID NO: 1207021 - RNA, 21 nt, Human
acaccucugcacaagcugcac

SEQ ID NO: 1207022 - RNA, 16 nt, Human
acaccgggcacucaga

SEQ ID NO: 1207023 - RNA, 12 nt, Human
acacgaauauug

SEQ ID NO: 1207024 - RNA, 22 nt, Human
acacucacauuuauucugcuca

SEQ ID NO: 1207025 - RNA, 20 nt, Human
acacucacauuuauucugcu

SEQ ID NO: 1207026 - RNA, 15 nt, Human
acacucaaaagcugg

SEQ ID NO: 1207027 - RNA, 21 nt, Human
acacauuuuauuuuauuaugc

SEQ ID NO: 1207028 - RNA, 20 nt, Human
acacauuuuauuuuauuaug

SEQ ID NO: 1207029 - RNA, 19 nt, Human
acacauuuuauuuuauuau

SEQ ID NO: 1207030 - RNA, 14 nt, Human
acacauuuuauuuu

SEQ ID NO: 1207031 - RNA, 18 nt, Human
acacaugcaaggucauuu

SEQ ID NO: 1207032 - RNA, 21 nt, Human
acacaugagcaucaggccagg

SEQ ID NO: 1207033 - RNA, 20 nt, Human
uaguuccaccaucaagccac

SEQ ID NO: 1207034 - RNA, 21 nt, Human
acacacugcauguuugugauu

SEQ ID NO: 1207035 - RNA, 21 nt, Human
acacacgcgugcacacaccag

SEQ ID NO: 1207036 - RNA, 20 nt, Human
acacaccagagcccaccuug

SEQ ID NO: 1207037 - RNA, 15 nt, Human
acacaccagagccca

SEQ ID NO: 1207038 - RNA, 14 nt, Human
acacaccagagccc

SEQ ID NO: 1207039 - RNA, 19 nt, Human
acacacagcucuguccugg

SEQ ID NO: 1207040 - RNA, 17 nt, Human
acacacagcucuguccu

SEQ ID NO: 1207041 - RNA, 14 nt, Human
acacacagcucugu

SEQ ID NO: 1207042 - RNA, 13 nt, Human
acacacagcucug

SEQ ID NO: 1207043 - RNA, 22 nt, Human
acacacacgcgugcacacacca

SEQ ID NO: 1207044 - RNA, 19 nt, Human
acaaugugaaaagaaaaau

SEQ ID NO: 1207045 - RNA, 17 nt, Human
acaaugugaaaagaaaa

SEQ ID NO: 1207046 - RNA, 24 nt, Human
acaaugcugugcccuaaaguguau

SEQ ID NO: 1207047 - RNA, 23 nt, Human
acaaugcugugcccuaaagugua

SEQ ID NO: 1207048 - RNA, 22 nt, Human
acaaugcugugcccuaaagugu

SEQ ID NO: 1207049 - RNA, 21 nt, Human
acaaugcugugcccuaaagug

SEQ ID NO: 1207050 - RNA, 22 nt, Human
acacaguauuacuucugcuaca

SEQ ID NO: 1207051 - RNA, 19 nt, Human
acacaguauuacuucugcu

SEQ ID NO: 1207052 - RNA, 18 nt, Human
acacaguauuacuucugc

SEQ ID NO: 1207053 - RNA, 20 nt, Human
uaggcauuugcugaauacag

SEQ ID NO: 1207054 - RNA, 16 nt, Human
uaggcauuugcugaau

SEQ ID NO: 1207055 - RNA, 19 nt, Human
acaaugacuuacuguacau

SEQ ID NO: 1207056 - RNA, 18 nt, Human
acaaugacuuacuguaca

SEQ ID NO: 1207057 - RNA, 17 nt, Human
acaaugacuuacuguac

SEQ ID NO: 1207058 - RNA, 12 nt, Human
acaaugacuuac

SEQ ID NO: 1207059 - RNA, 19 nt, Human
uagauauaugcucugcaug

SEQ ID NO: 1207060 - RNA, 15 nt, Human
uagauauaugcucug

SEQ ID NO: 1207061 - RNA, 22 nt, Human
acaaaggaugcccaaagaugca

SEQ ID NO: 1207062 - RNA, 22 nt, Human
acaaaagcaugugagacugguu

SEQ ID NO: 1207063 - RNA, 11 nt, Human
acaaaagcaug

SEQ ID NO: 1207064 - RNA, 19 nt, Human
acaagacccuugugguccc

SEQ ID NO: 1207065 - RNA, 19 nt, Human
acaagaccacguuucuaaa

SEQ ID NO: 1207066 - RNA, 23 nt, Human
acaacacucauugaccugaggcc

SEQ ID NO: 1207067 - RNA, 15 nt, Human
uagccagaggagaga

SEQ ID NO: 1207068 - RNA, 11 nt, Human
uagccagagga

SEQ ID NO: 1207069 - RNA, 21 nt, Human
uagccaaggccaaaggaagca

SEQ ID NO: 1207070 - RNA, 22 nt, Human
uagcauuuugcuaaaugugaau

SEQ ID NO: 1207071 - RNA, 16 nt, Human
uagcauuuugcuaaau

SEQ ID NO: 1207072 - RNA, 19 nt, Human
uagcauggcugccaauggg

SEQ ID NO: 1207073 - RNA, 23 nt, Human
aagaucaaaagguuaauaaagua

SEQ ID NO: 1207074 - RNA, 20 nt, Human
aagaucaaaagguuaauaaa

SEQ ID NO: 1207075 - RNA, 23 nt, Human
gugugaaccaccacacccagccc

SEQ ID NO: 1207076 - RNA, 20 nt, Human
gugucagguggggcagcuug

SEQ ID NO: 1207077 - RNA, 19 nt, Human
gugucagguggggcagcuu

SEQ ID NO: 1207078 - RNA, 18 nt, Human
gugucagguggggcagcu

SEQ ID NO: 1207079 - RNA, 14 nt, Human
gugucagguggggc

SEQ ID NO: 1207080 - RNA, 22 nt, Human
gugucaccugaagacucauucu

SEQ ID NO: 1207081 - RNA, 14 nt, Human
gugucaccugaaga

SEQ ID NO: 1207082 - RNA, 15 nt, Human
gugguuucagaaaug

SEQ ID NO: 1207083 - RNA, 18 nt, Human
gugcugcccugcccaccu

SEQ ID NO: 1207084 - RNA, 23 nt, Human
gugcugcccugcccaccuggccu

SEQ ID NO: 1207085 - RNA, 22 nt, Human
aagagggagggagggcuccaga

SEQ ID NO: 1207086 - RNA, 21 nt, Human
aagagggagggagggcuccag

SEQ ID NO: 1207087 - RNA, 14 nt, Human
aagaggcagggucu

SEQ ID NO: 1207088 - RNA, 11 nt, Human
aagaggcaggg

SEQ ID NO: 1207089 - RNA, 16 nt, Human
aagcacacuugacauc

SEQ ID NO: 1207090 - RNA, 20 nt, Human
aagcacaugccucucucagg

SEQ ID NO: 1207091 - RNA, 19 nt, Human
aagcacaugccucucucag

SEQ ID NO: 1207092 - RNA, 16 nt, Human
aagcacaugccucucu

SEQ ID NO: 1207093 - RNA, 15 nt, Human
aagcacaugccucuc

SEQ ID NO: 1207094 - RNA, 14 nt, Human
aagcacaugccucu

SEQ ID NO: 1207095 - RNA, 16 nt, Human
aagcaccuccugccuc

SEQ ID NO: 1207096 - RNA, 15 nt, Human
aagcaccuccugccu

SEQ ID NO: 1207097 - RNA, 14 nt, Human
aagcaccuccugcc

SEQ ID NO: 1207098 - RNA, 13 nt, Human
aagcaccuccugc

SEQ ID NO: 1207099 - RNA, 21 nt, Human
aagcacaugccucucucaggc

SEQ ID NO: 1207100 - RNA, 17 nt, Human
aagcaccuccugccucg

SEQ ID NO: 1207101 - RNA, 20 nt, Human
aagccaaagcuaggccuggc

SEQ ID NO: 1207102 - RNA, 18 nt, Human
aagccaaagcuaggccug

SEQ ID NO: 1207103 - RNA, 17 nt, Human
aagccaaagcuaggccu

SEQ ID NO: 1207104 - RNA, 16 nt, Human
aagcauuuacuuugug

SEQ ID NO: 1207105 - RNA, 12 nt, Human
aagcaugugaga

SEQ ID NO: 1207106 - RNA, 23 nt, Human
guucagcuuguaaauagcucagg

SEQ ID NO: 1207107 - RNA, 22 nt, Human
guucaggguuggccccugcccg

SEQ ID NO: 1207108 - RNA, 21 nt, Human
guucaggguuggccccugccc

SEQ ID NO: 1207109 - RNA, 18 nt, Human
guucagguaacaggcaga

SEQ ID NO: 1207110 - RNA, 17 nt, Human
guucagguaacaggcag

SEQ ID NO: 1207111 - RNA, 21 nt, Human
aagccgugauuuucauugcug

SEQ ID NO: 1207112 - RNA, 19 nt, Human
aagccuccuccagccgcca

SEQ ID NO: 1207113 - RNA, 15 nt, Human
aagccuccuccagcc

SEQ ID NO: 1207114 - RNA, 16 nt, Human
aagccucccacgacug

SEQ ID NO: 1207115 - RNA, 19 nt, Human
guuagagguucccuuugac

SEQ ID NO: 1207116 - RNA, 18 nt, Human
guuaaucauuagguguga

SEQ ID NO: 1207117 - RNA, 22 nt, Human
guucccuuuuuuggcugcugaa

SEQ ID NO: 1207118 - RNA, 21 nt, Human
guucccuuuuuuggcugcuga

SEQ ID NO: 1207119 - RNA, 17 nt, Human
guucuuaauucuuagcu

SEQ ID NO: 1207120 - RNA, 14 nt, Human
guucuuaauucuua

SEQ ID NO: 1207121 - RNA, 13 nt, Human
guucuuaauucuu

SEQ ID NO: 1207122 - RNA, 18 nt, Human
guucucugcccuccaaga

SEQ ID NO: 1207123 - RNA, 17 nt, Human
guucucugcccuccaag

SEQ ID NO: 1207124 - RNA, 15 nt, Human
guucucugcccucca

SEQ ID NO: 1207125 - RNA, 14 nt, Human
guucucugaggaca

SEQ ID NO: 1207126 - RNA, 12 nt, Human
guucucugagga

SEQ ID NO: 1207127 - RNA, 15 nt, Human
guucucucuucucca

SEQ ID NO: 1207128 - RNA, 19 nt, Human
guucuagcauggcugccaa

SEQ ID NO: 1207129 - RNA, 22 nt, Human
guugauagcacagacccugccc

SEQ ID NO: 1207130 - RNA, 19 nt, Human
guugauagcacagacccug

SEQ ID NO: 1207131 - RNA, 14 nt, Human
guugauagcacaga

SEQ ID NO: 1207132 - RNA, 18 nt, Human
guucuugguuuguaaauu

SEQ ID NO: 1207133 - RNA, 15 nt, Human
guucuugguuuguaa

SEQ ID NO: 1207134 - RNA, 14 nt, Human
guucuugguuugua

SEQ ID NO: 1207135 - RNA, 23 nt, Human
aaguauucuuauuuaaugaaaga

SEQ ID NO: 1207136 - RNA, 21 nt, Human
aaguauucuuauuuaaugaaa

SEQ ID NO: 1207137 - RNA, 19 nt, Human
aaguauuauaccuuuuuua

SEQ ID NO: 1207138 - RNA, 16 nt, Human
aaguauuauaccuuuu

SEQ ID NO: 1207139 - RNA, 15 nt, Human
aaguauuauaccuuu

SEQ ID NO: 1207140 - RNA, 20 nt, Human
aaguacuucuccacccugcu

SEQ ID NO: 1207141 - RNA, 19 nt, Human
aaguacuucuccacccugc

SEQ ID NO: 1207142 - RNA, 18 nt, Human
aaguacuucuccacccug

SEQ ID NO: 1207143 - RNA, 15 nt, Human
aaguacuauguauca

SEQ ID NO: 1207144 - RNA, 13 nt, Human
aaguacuauguau

SEQ ID NO: 1207145 - RNA, 17 nt, Human
aaguacuauaauuuacc

SEQ ID NO: 1207146 - RNA, 14 nt, Human
aaguacuauaauuu

SEQ ID NO: 1207147 - RNA, 21 nt, Human
aaguaauaugcacacauuuuu

SEQ ID NO: 1207148 - RNA, 20 nt, Human
aaguaauaugcacacauuuu

SEQ ID NO: 1207149 - RNA, 18 nt, Human
aaguaauaugcacacauu

SEQ ID NO: 1207150 - RNA, 19 nt, Human
guuuucuguucuuucuggc

SEQ ID NO: 1207151 - RNA, 16 nt, Human
guuuucuguucuuucu

SEQ ID NO: 1207152 - RNA, 15 nt, Human
guuuucuguucuuuc

SEQ ID NO: 1207153 - RNA, 14 nt, Human
guuuucuguucuuu

SEQ ID NO: 1207154 - RNA, 22 nt, Human
guuuuaaggaugcuuguacaua

SEQ ID NO: 1207155 - RNA, 23 nt, Human
aagggggcugggacaugggaaag

SEQ ID NO: 1207156 - RNA, 12 nt, Human
aagggggcuggg

SEQ ID NO: 1207157 - RNA, 13 nt, Human
aaggggagaguaa

SEQ ID NO: 1207158 - RNA, 20 nt, Human
aaggcugucaauuacaggaa

SEQ ID NO: 1207159 - RNA, 22 nt, Human
aaggcugggggaagaagcucuc

SEQ ID NO: 1207160 - RNA, 19 nt, Human
aaggcugggggaagaagcu

SEQ ID NO: 1207161 - RNA, 16 nt, Human
aaggcugggggaagaa

SEQ ID NO: 1207162 - RNA, 14 nt, Human
guuucagaaaugug

SEQ ID NO: 1207163 - RNA, 13 nt, Human
guuucagaaaugu

SEQ ID NO: 1207164 - RNA, 11 nt, Human
guuucagaaau

SEQ ID NO: 1207165 - RNA, 21 nt, Human
guuuaagugacugauggcuaa

SEQ ID NO: 1207166 - RNA, 23 nt, Human
guuguuugauucagacagcugcc

SEQ ID NO: 1207167 - RNA, 22 nt, Human
aaggaaacccagcucuggucca

SEQ ID NO: 1207168 - RNA, 17 nt, Human
aaggaaacccagcucug

SEQ ID NO: 1207169 - RNA, 13 nt, Human
aagugugguagag

SEQ ID NO: 1207170 - RNA, 23 nt, Human
aaguguauuuuuuuacuaauaga

SEQ ID NO: 1207171 - RNA, 20 nt, Human
aaguuugagaucagccuggg

SEQ ID NO: 1207172 - RNA, 21 nt, Human
aaguuucugccgcagcccugc

SEQ ID NO: 1207173 - RNA, 19 nt, Human
aaguuucugccgcagcccu

SEQ ID NO: 1207174 - RNA, 13 nt, Human
uaaaagucuugug

SEQ ID NO: 1207175 - RNA, 20 nt, Human
aagugauccucccaccucag

SEQ ID NO: 1207176 - RNA, 19 nt, Human
aagugauccucccaccuca

SEQ ID NO: 1207177 - RNA, 13 nt, Human
aagugauccuccc

SEQ ID NO: 1207178 - RNA, 21 nt, Human
uaaaauaccagccaguaaaug

SEQ ID NO: 1207179 - RNA, 23 nt, Human
aagugauccucccaccucagccu

SEQ ID NO: 1207180 - RNA, 15 nt, Human
uaaaacuuuuuaaaa

SEQ ID NO: 1207181 - RNA, 12 nt, Human
uaaaacuuuuua

SEQ ID NO: 1207182 - RNA, 13 nt, Human
uaaaacccaagug

SEQ ID NO: 1207183 - RNA, 22 nt, Human
uaaaaaugagguacucuccugg

SEQ ID NO: 1207184 - RNA, 15 nt, Human
uaaaaaugagguacu

SEQ ID NO: 1207185 - RNA, 23 nt, Human
uaaaaaucucaaauuucuaaauc

SEQ ID NO: 1207186 - RNA, 23 nt, Human
gugccaaaaacaacaacaaaaug

SEQ ID NO: 1207187 - RNA, 21 nt, Human
gugcauuuggugguuucagaa

SEQ ID NO: 1207188 - RNA, 20 nt, Human
gugcauuugaggucuguucu

SEQ ID NO: 1207189 - RNA, 19 nt, Human
gugcauuugaggucuguuc

SEQ ID NO: 1207190 - RNA, 17 nt, Human
gugcauuugaggucugu

SEQ ID NO: 1207191 - RNA, 22 nt, Human
gugcaaugaccuuucaauagga

SEQ ID NO: 1207192 - RNA, 21 nt, Human
gugcacaugcacgugugugca

SEQ ID NO: 1207193 - RNA, 23 nt, Human
gugcacaagcuccaagcucccag

SEQ ID NO: 1207194 - RNA, 21 nt, Human
gugcacaagcuccaagcuccc

SEQ ID NO: 1207195 - RNA, 16 nt, Human
gugcacaagcuccaag

SEQ ID NO: 1207196 - RNA, 13 nt, Human
gugcacaagcucc

SEQ ID NO: 1207197 - RNA, 18 nt, Human
gugcaaugaccuuucaau

SEQ ID NO: 1207198 - RNA, 22 nt, Human
aacuucaccauauuaccacaga

SEQ ID NO: 1207199 - RNA, 22 nt, Human
aacuucacauauugauuuccgu

SEQ ID NO: 1207200 - RNA, 14 nt, Human
aacuucacauauug

SEQ ID NO: 1207201 - RNA, 16 nt, Human
gugcucugaucaucca

SEQ ID NO: 1207202 - RNA, 14 nt, Human
gugcucuggacagg

SEQ ID NO: 1207203 - RNA, 13 nt, Human
gugcucuggacag

SEQ ID NO: 1207204 - RNA, 15 nt, Human
gugcugcccugccca

SEQ ID NO: 1207205 - RNA, 14 nt, Human
gugcugcccugccc

SEQ ID NO: 1207206 - RNA, 13 nt, Human
gugcugcccugcc

SEQ ID NO: 1207207 - RNA, 19 nt, Human
gugcuaucucccccagccc

SEQ ID NO: 1207208 - RNA, 18 nt, Human
gugcuaucucccccagcc

SEQ ID NO: 1207209 - RNA, 15 nt, Human
gugcuaucuccccca

SEQ ID NO: 1207210 - RNA, 17 nt, Human
gugcuaggaacacuccu

SEQ ID NO: 1207211 - RNA, 22 nt, Human
aagaaaauaguggugugauuug

SEQ ID NO: 1207212 - RNA, 21 nt, Human
aagaaaauaguggugugauuu

SEQ ID NO: 1207213 - RNA, 15 nt, Human
aagaaaauaguggug

SEQ ID NO: 1207214 - RNA, 18 nt, Human
aagaaaaaugagccuggc

SEQ ID NO: 1207215 - RNA, 17 nt, Human
aagaaaaaugagccugg

SEQ ID NO: 1207216 - RNA, 18 nt, Human
aagaaaaagaaaaagaaa

SEQ ID NO: 1207217 - RNA, 13 nt, Human
aagaaaaagaaaa

SEQ ID NO: 1207218 - RNA, 19 nt, Human
aagaaaaaauauuuucccu

SEQ ID NO: 1207219 - RNA, 23 nt, Human
aacuuuaccuuuuuuauacauaa

SEQ ID NO: 1207220 - RNA, 22 nt, Human
aacuuuaccuuuuuuauacaua

SEQ ID NO: 1207221 - RNA, 21 nt, Human
aacuuuaccuuuuuuauacau

SEQ ID NO: 1207222 - RNA, 18 nt, Human
gucuggaaugcaguggua

SEQ ID NO: 1207223 - RNA, 16 nt, Human
gucuggaaugcagugg

SEQ ID NO: 1207224 - RNA, 15 nt, Human
gucuggaaugcagug

SEQ ID NO: 1207225 - RNA, 20 nt, Human
gucugacaggcaaugcuggc

SEQ ID NO: 1207226 - RNA, 18 nt, Human
gucugacaggcaaugcug

SEQ ID NO: 1207227 - RNA, 15 nt, Human
gucugacaggcaaug

SEQ ID NO: 1207228 - RNA, 14 nt, Human
gucugacaggcaau

SEQ ID NO: 1207229 - RNA, 13 nt, Human
gucugacaggcaa

SEQ ID NO: 1207230 - RNA, 12 nt, Human
gucugacaggca

SEQ ID NO: 1207231 - RNA, 14 nt, Human
gucugaaggcuggg

SEQ ID NO: 1207232 - RNA, 19 nt, Human
gucucaaaaaaagaaaaag

SEQ ID NO: 1207233 - RNA, 17 nt, Human
gucucaaaaaaagaaaa

SEQ ID NO: 1207234 - RNA, 14 nt, Human
gucucaaaaaaaca

SEQ ID NO: 1207235 - RNA, 15 nt, Human
aacguggcugcuuca

SEQ ID NO: 1207236 - RNA, 13 nt, Human
aacguggcugcuu

SEQ ID NO: 1207237 - RNA, 12 nt, Human
aacguggcugcu

SEQ ID NO: 1207238 - RNA, 17 nt, Human
aacuagggaagauaaua

SEQ ID NO: 1207239 - RNA, 21 nt, Human
aacucuccucugcugcuggcu

SEQ ID NO: 1207240 - RNA, 19 nt, Human
aacucuccucugcugcugg

SEQ ID NO: 1207241 - RNA, 19 nt, Human
gugagucaccaagcccagu

SEQ ID NO: 1207242 - RNA, 17 nt, Human
gugagucaccaagccca

SEQ ID NO: 1207243 - RNA, 23 nt, Human
gugaguacuacaguccucccauc

SEQ ID NO: 1207244 - RNA, 18 nt, Human
gugaggcucugcccuugg

SEQ ID NO: 1207245 - RNA, 17 nt, Human
gugaggcucugcccuug

SEQ ID NO: 1207246 - RNA, 16 nt, Human
gugaggcucugcccuu

SEQ ID NO: 1207247 - RNA, 15 nt, Human
gugaggcucugcccu

SEQ ID NO: 1207248 - RNA, 14 nt, Human
gugaggcucugccc

SEQ ID NO: 1207249 - RNA, 13 nt, Human
gugaggcucugcc

SEQ ID NO: 1207250 - RNA, 12 nt, Human
gugaggcucugc

SEQ ID NO: 1207251 - RNA, 18 nt, Human
gugagacucugucucaaa

SEQ ID NO: 1207252 - RNA, 16 nt, Human
aacugcauuggcuuug

SEQ ID NO: 1207253 - RNA, 23 nt, Human
aacugauuuuuuuuuccuucagu

SEQ ID NO: 1207254 - RNA, 22 nt, Human
aacugauuuuuuuuuccuucag

SEQ ID NO: 1207255 - RNA, 21 nt, Human
aacugauuuuuuuuuccuuca

SEQ ID NO: 1207256 - RNA, 23 nt, Human
aacucuccucugcugcuggcugg

SEQ ID NO: 1207257 - RNA, 22 nt, Human
aacucuccucugcugcuggcug

SEQ ID NO: 1207258 - RNA, 16 nt, Human
gugagacucugucuca

SEQ ID NO: 1207259 - RNA, 14 nt, Human
gugagacucugucu

SEQ ID NO: 1207260 - RNA, 22 nt, Human
gugagacccugucucaaaaaaa

SEQ ID NO: 1207261 - RNA, 19 nt, Human
gugacaugucuuuucuugc

SEQ ID NO: 1207262 - RNA, 22 nt, Human
gugacagagugagacucugucu

SEQ ID NO: 1207263 - RNA, 20 nt, Human
gugacagagugagacucugu

SEQ ID NO: 1207264 - RNA, 23 nt, Human
gugaauaauacaguaucucaggg

SEQ ID NO: 1207265 - RNA, 12 nt, Human
aacuccuggccu

SEQ ID NO: 1207266 - RNA, 19 nt, Human
gucauuugagcagggcuca

SEQ ID NO: 1207267 - RNA, 22 nt, Human
guccccaccgcagacaggacca

SEQ ID NO: 1207268 - RNA, 18 nt, Human
guccccaccgcagacagg

SEQ ID NO: 1207269 - RNA, 20 nt, Human
gucccaccccacacacgcca

SEQ ID NO: 1207270 - RNA, 15 nt, Human
gucccaccccacaca

SEQ ID NO: 1207271 - RNA, 22 nt, Human
guccccuguuuguuucugaaag

SEQ ID NO: 1207272 - RNA, 18 nt, Human
guccccuguuuguuucug

SEQ ID NO: 1207273 - RNA, 19 nt, Human
gucccuuacgugaguccug

SEQ ID NO: 1207274 - RNA, 18 nt, Human
gucccuuacgugaguccu

SEQ ID NO: 1207275 - RNA, 19 nt, Human
gucccugguggcagcucac

SEQ ID NO: 1207276 - RNA, 17 nt, Human
gucauuugagcagggcu

SEQ ID NO: 1207277 - RNA, 19 nt, Human
aacacuguucucugcccuc

SEQ ID NO: 1207278 - RNA, 18 nt, Human
aacacuguucucugcccu

SEQ ID NO: 1207279 - RNA, 17 nt, Human
aacacuguucucugccc

SEQ ID NO: 1207280 - RNA, 17 nt, Human
aacacucauugaccuga

SEQ ID NO: 1207281 - RNA, 21 nt, Human
aacacucacauuuauucugcu

SEQ ID NO: 1207282 - RNA, 19 nt, Human
aacacaaacgggcucagca

SEQ ID NO: 1207283 - RNA, 19 nt, Human
aaauuucuaaaucuccaaa

SEQ ID NO: 1207284 - RNA, 22 nt, Human
gucuaugggacucaaugcacug

SEQ ID NO: 1207285 - RNA, 20 nt, Human
gucuaccugaggggccucuu

SEQ ID NO: 1207286 - RNA, 16 nt, Human
gucuaccugaggggcc

SEQ ID NO: 1207287 - RNA, 15 nt, Human
gucuaccugaggggc

SEQ ID NO: 1207288 - RNA, 14 nt, Human
gucuaccugagggg

SEQ ID NO: 1207289 - RNA, 16 nt, Human
guccuggcaugggaau

SEQ ID NO: 1207290 - RNA, 19 nt, Human
guccugcugcaguugccag

SEQ ID NO: 1207291 - RNA, 14 nt, Human
guccucuuuucuga

SEQ ID NO: 1207292 - RNA, 12 nt, Human
gucgaggcagga

SEQ ID NO: 1207293 - RNA, 16 nt, Human
gucgaggacagggagg

SEQ ID NO: 1207294 - RNA, 17 nt, Human
guccuggcaugggaaug

SEQ ID NO: 1207295 - RNA, 18 nt, Human
aacaguccauugaaaggg

SEQ ID NO: 1207296 - RNA, 22 nt, Human
gucaccaaaucagcugcuacua

SEQ ID NO: 1207297 - RNA, 12 nt, Human
gucacaggcagg

SEQ ID NO: 1207298 - RNA, 22 nt, Human
gucaauuacaggaaguacugga

SEQ ID NO: 1207299 - RNA, 16 nt, Human
gucacugagacagccc

SEQ ID NO: 1207300 - RNA, 15 nt, Human
gucacugagacagcc

SEQ ID NO: 1207301 - RNA, 14 nt, Human
gucacugagacagc

SEQ ID NO: 1207302 - RNA, 23 nt, Human
gucacucuggcagcucagagagg

SEQ ID NO: 1207303 - RNA, 15 nt, Human
gucaccaagcccagu

SEQ ID NO: 1207304 - RNA, 12 nt, Human
gucaccaagccc

SEQ ID NO: 1207305 - RNA, 23 nt, Human
gucacugagacagcccgggcucu

SEQ ID NO: 1207306 - RNA, 21 nt, Human
gucacugagacagcccgggcu

SEQ ID NO: 1207307 - RNA, 18 nt, Human
gucacugagacagcccgg

SEQ ID NO: 1207308 - RNA, 17 nt, Human
gucacugagacagcccg

SEQ ID NO: 1207309 - RNA, 10 nt, Human
gucacugcuu

SEQ ID NO: 1207310 - RNA, 15 nt, Human
aaauuucuaaaucuc

SEQ ID NO: 1207311 - RNA, 13 nt, Human
aaauuucuaaauc

SEQ ID NO: 1207312 - RNA, 15 nt, Human
gucagugugacugau

SEQ ID NO: 1207313 - RNA, 22 nt, Human
gucagguggggcagcuugaggg

SEQ ID NO: 1207314 - RNA, 18 nt, Human
gucagguggggcagcuug

SEQ ID NO: 1207315 - RNA, 17 nt, Human
gucagguggggcagcuu

SEQ ID NO: 1207316 - RNA, 16 nt, Human
gucagguggggcagcu

SEQ ID NO: 1207317 - RNA, 21 nt, Human
gucacugcuuaacuucacaua

SEQ ID NO: 1207318 - RNA, 15 nt, Human
gucacugcuuaacuu

SEQ ID NO: 1207319 - RNA, 23 nt, Human
gucagaaguuucugccgcagccc

SEQ ID NO: 1207320 - RNA, 21 nt, Human
gucagaaguuucugccgcagc

SEQ ID NO: 1207321 - RNA, 16 nt, Human
aaauuccccacccuga

SEQ ID NO: 1207322 - RNA, 21 nt, Human
guauucucuccuguaccucuu

SEQ ID NO: 1207323 - RNA, 18 nt, Human
guauucucuccuguaccu

SEQ ID NO: 1207324 - RNA, 21 nt, Human
aaaugucucuuuaaugucaca

SEQ ID NO: 1207325 - RNA, 14 nt, Human
aaaaacacaaaagu

SEQ ID NO: 1207326 - RNA, 12 nt, Human
aaaacacauuuu

SEQ ID NO: 1207327 - RNA, 12 nt, Human
aaaaagaggcua

SEQ ID NO: 1207328 - RNA, 15 nt, Human
aaaaacugauuuuuu

SEQ ID NO: 1207329 - RNA, 13 nt, Human
aaaaacugauuuu

SEQ ID NO: 1207330 - RNA, 14 nt, Human
aaaaacauggccuu

SEQ ID NO: 1207331 - RNA, 18 nt, Human
aguuacagacaaagcgug

SEQ ID NO: 1207332 - RNA, 19 nt, Human
aguuguuacauuuuuaagu

SEQ ID NO: 1207333 - RNA, 16 nt, Human
aguuguuacauuuuua

SEQ ID NO: 1207334 - RNA, 15 nt, Human
aguuguuacauuuuu

SEQ ID NO: 1207335 - RNA, 13 nt, Human
aguuguuacauuu

SEQ ID NO: 1207336 - RNA, 23 nt, Human
agugugacaaggauugcuacugu

SEQ ID NO: 1207337 - RNA, 20 nt, Human
agucaagugaaaaaggagga

SEQ ID NO: 1207338 - RNA, 16 nt, Human
agucaagugaaaaagg

SEQ ID NO: 1207339 - RNA, 13 nt, Human
agugauccuccca

SEQ ID NO: 1207340 - RNA, 21 nt, Human
auaugcuuauacacuuacacu

SEQ ID NO: 1207341 - RNA, 19 nt, Human
auaugcuuauacacuuaca

SEQ ID NO: 1207342 - RNA, 16 nt, Human
auaugcuuauacacuu

SEQ ID NO: 1207343 - RNA, 14 nt, Human
auaugcuuauacac

SEQ ID NO: 1207344 - RNA, 22 nt, Human
auaugccugggcagaaggaaga

SEQ ID NO: 1207345 - RNA, 17 nt, Human
auauucaggaagcucag

SEQ ID NO: 1207346 - RNA, 16 nt, Human
auauucaggaagcuca

SEQ ID NO: 1207347 - RNA, 14 nt, Human
auauucaggaagcu

SEQ ID NO: 1207348 - RNA, 13 nt, Human
auauucaggaagc

SEQ ID NO: 1207349 - RNA, 16 nt, Human
auauaggaacuuaaau

SEQ ID NO: 1207350 - RNA, 16 nt, Human
auaguaugguggcugg

SEQ ID NO: 1207351 - RNA, 15 nt, Human
auaguaugguggcug

SEQ ID NO: 1207352 - RNA, 21 nt, Human
auaaugugaaacuggauuaaa

SEQ ID NO: 1207353 - RNA, 19 nt, Human
auaaugugaaacuggauua

SEQ ID NO: 1207354 - RNA, 18 nt, Human
auaaugugaaacuggauu

SEQ ID NO: 1207355 - RNA, 13 nt, Human
auaccuguccccc

SEQ ID NO: 1207356 - RNA, 12 nt, Human
auaccugucccc

SEQ ID NO: 1207357 - RNA, 20 nt, Human
auguucuuucacccuuuucu

SEQ ID NO: 1207358 - RNA, 20 nt, Human
auguucuuaguggauguucu

SEQ ID NO: 1207359 - RNA, 15 nt, Human
auguucuuaauucuu

SEQ ID NO: 1207360 - RNA, 22 nt, Human
auguucugacccugcuucaaau

SEQ ID NO: 1207361 - RNA, 18 nt, Human
auguucucugaggacacu

SEQ ID NO: 1207362 - RNA, 13 nt, Human
auuaaauucuugc

SEQ ID NO: 1207363 - RNA, 16 nt, Human
auuaaaugcccagccc

SEQ ID NO: 1207364 - RNA, 15 nt, Human
auuaaaugcccagcc

SEQ ID NO: 1207365 - RNA, 14 nt, Human
auuaaaugcccagc

SEQ ID NO: 1207366 - RNA, 18 nt, Human
auguuuuaagaggcaggg

SEQ ID NO: 1207367 - RNA, 16 nt, Human
auguuuuaagaggcag

SEQ ID NO: 1207368 - RNA, 14 nt, Human
auguuugccucugc

SEQ ID NO: 1207369 - RNA, 17 nt, Human
auguaagcucuacugag

SEQ ID NO: 1207370 - RNA, 17 nt, Human
augucacaggcaggucc

SEQ ID NO: 1207371 - RNA, 16 nt, Human
augucacaggcagguc

SEQ ID NO: 1207372 - RNA, 15 nt, Human
augucacaggcaggu

SEQ ID NO: 1207373 - RNA, 23 nt, Human
auggcugccaaugggagcucaug

SEQ ID NO: 1207374 - RNA, 15 nt, Human
augggaaugaauguc

SEQ ID NO: 1207375 - RNA, 21 nt, Human
augggaaugaaugucagugug

SEQ ID NO: 1207376 - RNA, 11 nt, Human
auggaacacuc

SEQ ID NO: 1207377 - RNA, 20 nt, Human
auggaaaugggcagagcaga

SEQ ID NO: 1207378 - RNA, 19 nt, Human
auggaaaugggcagagcag

SEQ ID NO: 1207379 - RNA, 18 nt, Human
augccugguggcagcugc

SEQ ID NO: 1207380 - RNA, 17 nt, Human
augccugguggcagcug

SEQ ID NO: 1207381 - RNA, 16 nt, Human
augccugguggcagcu

SEQ ID NO: 1207382 - RNA, 15 nt, Human
augccugguggcagc

SEQ ID NO: 1207383 - RNA, 11 nt, Human
augccuggugg

SEQ ID NO: 1207384 - RNA, 17 nt, Human
augccugggcagaagga

SEQ ID NO: 1207385 - RNA, 23 nt, Human
augccuggauggggcugcaccgg

SEQ ID NO: 1207386 - RNA, 21 nt, Human
augccuggauggggcugcacc

SEQ ID NO: 1207387 - RNA, 18 nt, Human
augcauuugaaaauuuug

SEQ ID NO: 1207388 - RNA, 12 nt, Human
augcauuugaaa

SEQ ID NO: 1207389 - RNA, 10 nt, Human
augcauuuga

SEQ ID NO: 1207390 - RNA, 23 nt, Human
augcaugaaguaauaugcacaca

SEQ ID NO: 1207391 - RNA, 21 nt, Human
augcacagcuaacauggaagu

SEQ ID NO: 1207392 - RNA, 14 nt, Human
augcacagcuaaca

SEQ ID NO: 1207393 - RNA, 23 nt, Human
augcacacauuuuuuaaaugcac

SEQ ID NO: 1207394 - RNA, 22 nt, Human
augcacacauuuuuuaaaugca

SEQ ID NO: 1207395 - RNA, 19 nt, Human
augcacacauuuuuuaaau

SEQ ID NO: 1207396 - RNA, 17 nt, Human
augcacacauuuuuuaa

SEQ ID NO: 1207397 - RNA, 17 nt, Human
augacuccagaauuucc

SEQ ID NO: 1207398 - RNA, 16 nt, Human
augacuccagaauuuc

SEQ ID NO: 1207399 - RNA, 12 nt, Human
augacuccagaa

SEQ ID NO: 1207400 - RNA, 12 nt, Human
augacccagugg

SEQ ID NO: 1207401 - RNA, 14 nt, Human
augagccuggcaag

SEQ ID NO: 1207402 - RNA, 13 nt, Human
augagccuggcaa

SEQ ID NO: 1207403 - RNA, 22 nt, Human
aucuucugaacuuggcgcugcc

SEQ ID NO: 1207404 - RNA, 17 nt, Human
aucuucuuuauaauucu

SEQ ID NO: 1207405 - RNA, 18 nt, Human
aucuugaagacuuuucuu

SEQ ID NO: 1207406 - RNA, 17 nt, Human
aucuugaagacuuuucu

SEQ ID NO: 1207407 - RNA, 22 nt, Human
aucucucgugauugauaagaac

SEQ ID NO: 1207408 - RNA, 19 nt, Human
aucuuccaacucaaacucu

SEQ ID NO: 1207409 - RNA, 23 nt, Human
aucagcugcuacuacuccuguag

SEQ ID NO: 1207410 - RNA, 13 nt, Human
aucagcugcuacu

SEQ ID NO: 1207411 - RNA, 17 nt, Human
aucagccugcuccagcu

SEQ ID NO: 1207412 - RNA, 21 nt, Human
aucagccugggcaaugugaua

SEQ ID NO: 1207413 - RNA, 20 nt, Human
aucagccugggcaaugugau

SEQ ID NO: 1207414 - RNA, 11 nt, Human
aucagccuggg

SEQ ID NO: 1207415 - RNA, 11 nt, Human
auccuccucag

SEQ ID NO: 1207416 - RNA, 23 nt, Human
auccucauacccacccccaccca

SEQ ID NO: 1207417 - RNA, 22 nt, Human
auccuccaggugcacaagcucc

SEQ ID NO: 1207418 - RNA, 19 nt, Human
auccuccaggugcacaagc

SEQ ID NO: 1207419 - RNA, 14 nt, Human
auccuccaggugca

SEQ ID NO: 1207420 - RNA, 13 nt, Human
aucgaugcagugc

SEQ ID NO: 1207421 - RNA, 14 nt, Human
auccuccucagauc

SEQ ID NO: 1207422 - RNA, 20 nt, Human
auccacccaccucagccucc

SEQ ID NO: 1207423 - RNA, 18 nt, Human
auccacccaccucagccu

SEQ ID NO: 1207424 - RNA, 22 nt, Human
auccucauacccacccccaccc

SEQ ID NO: 1207425 - RNA, 19 nt, Human
auccucauacccaccccca

SEQ ID NO: 1207426 - RNA, 18 nt, Human
auccucauacccaccccc

SEQ ID NO: 1207427 - RNA, 13 nt, Human
aucccucauccuc

SEQ ID NO: 1207428 - RNA, 20 nt, Human
aggaccccuccaugugggcu

SEQ ID NO: 1207429 - RNA, 18 nt, Human
aggagaggggcacagggu

SEQ ID NO: 1207430 - RNA, 16 nt, Human
aggagaggggcacagg

SEQ ID NO: 1207431 - RNA, 15 nt, Human
aggagaggagagggg

SEQ ID NO: 1207432 - RNA, 15 nt, Human
aggagagcuagcagc

SEQ ID NO: 1207433 - RNA, 20 nt, Human
aggaccucaggugagaagca

SEQ ID NO: 1207434 - RNA, 14 nt, Human
aggaccucagguga

SEQ ID NO: 1207435 - RNA, 20 nt, Human
aggauguucugggacacagu

SEQ ID NO: 1207436 - RNA, 17 nt, Human
aggaggggauagagaga

SEQ ID NO: 1207437 - RNA, 12 nt, Human
aggauucuuccu

SEQ ID NO: 1207438 - RNA, 16 nt, Human
aggauucuuccucccu

SEQ ID NO: 1207439 - RNA, 15 nt, Human
aggaaaaacugauuu

SEQ ID NO: 1207440 - RNA, 13 nt, Human
aggaaaaacugau

SEQ ID NO: 1207441 - RNA, 22 nt, Human
agcugggugucaagagggucug

SEQ ID NO: 1207442 - RNA, 17 nt, Human
agcugggugucaagagg

SEQ ID NO: 1207443 - RNA, 21 nt, Human
agcuggucccacucaguccau

SEQ ID NO: 1207444 - RNA, 23 nt, Human
aggcuagugugguguuuccuggc

SEQ ID NO: 1207445 - RNA, 18 nt, Human
aggcugccucucccauca

SEQ ID NO: 1207446 - RNA, 20 nt, Human
agggacagaggggguggccu

SEQ ID NO: 1207447 - RNA, 13 nt, Human
agggacagagggg

SEQ ID NO: 1207448 - RNA, 12 nt, Human
agggacagaggg

SEQ ID NO: 1207449 - RNA, 21 nt, Human
agggacgcuacccgggaaggg

SEQ ID NO: 1207450 - RNA, 15 nt, Human
aggggcacagggucu

SEQ ID NO: 1207451 - RNA, 21 nt, Human
aggggauagagagagaccacu

SEQ ID NO: 1207452 - RNA, 19 nt, Human
agggcgggaggauguucug

SEQ ID NO: 1207453 - RNA, 18 nt, Human
agggccuggccugagcug

SEQ ID NO: 1207454 - RNA, 17 nt, Human
agggccuggccugagcu

SEQ ID NO: 1207455 - RNA, 16 nt, Human
agggccuggccugagc

SEQ ID NO: 1207456 - RNA, 15 nt, Human
agggccuggccugag

SEQ ID NO: 1207457 - RNA, 22 nt, Human
agggcacagaaaauggaagaca

SEQ ID NO: 1207458 - RNA, 21 nt, Human
agggcacaccgggcacucaga

SEQ ID NO: 1207459 - RNA, 20 nt, Human
agggcacaccgggcacucag

SEQ ID NO: 1207460 - RNA, 17 nt, Human
agggcacaccgggcacu

SEQ ID NO: 1207461 - RNA, 17 nt, Human
aggugcugccauccagg

SEQ ID NO: 1207462 - RNA, 16 nt, Human
aggugcugccauccag

SEQ ID NO: 1207463 - RNA, 14 nt, Human
aggucgaggcagga

SEQ ID NO: 1207464 - RNA, 17 nt, Human
agguucaaagauauuuu

SEQ ID NO: 1207465 - RNA, 14 nt, Human
agguuaauguucau

SEQ ID NO: 1207466 - RNA, 13 nt, Human
agguucccuuuga

SEQ ID NO: 1207467 - RNA, 13 nt, Human
agguucagcuugu

SEQ ID NO: 1207468 - RNA, 22 nt, Human
agguacgaaaagaggggaagag

SEQ ID NO: 1207469 - RNA, 17 nt, Human
agguaaggaauaccugu

SEQ ID NO: 1207470 - RNA, 20 nt, Human
agccagaggagagaggaccc

SEQ ID NO: 1207471 - RNA, 23 nt, Human
agccaaggccaaaggaagcacau

SEQ ID NO: 1207472 - RNA, 22 nt, Human
agccaaggccaaaggaagcaca

SEQ ID NO: 1207473 - RNA, 23 nt, Human
agccaaagcuaggccuggccaga

SEQ ID NO: 1207474 - RNA, 20 nt, Human
agccaaagcuaggccuggcc

SEQ ID NO: 1207475 - RNA, 19 nt, Human
agccaaagcuaggccuggc

SEQ ID NO: 1207476 - RNA, 20 nt, Human
agcaugccuggauggggcug

SEQ ID NO: 1207477 - RNA, 12 nt, Human
agcaugccugga

SEQ ID NO: 1207478 - RNA, 21 nt, Human
agcagccacauuccugaugcu

SEQ ID NO: 1207479 - RNA, 20 nt, Human
agcacuaaggugugcucuga

SEQ ID NO: 1207480 - RNA, 19 nt, Human
agcacuaaggugugcucug

SEQ ID NO: 1207481 - RNA, 20 nt, Human
agccgagauugcaccacugc

SEQ ID NO: 1207482 - RNA, 19 nt, Human
agccgagauugcaccacug

SEQ ID NO: 1207483 - RNA, 21 nt, Human
agccgagaucacgccacugca

SEQ ID NO: 1207484 - RNA, 22 nt, Human
agccgcuggggccaguuggucc

SEQ ID NO: 1207485 - RNA, 14 nt, Human
agccgcuggggcca

SEQ ID NO: 1207486 - RNA, 19 nt, Human
agccucccaaagugcuggg

SEQ ID NO: 1207487 - RNA, 18 nt, Human
agccucccaaagugcugg

SEQ ID NO: 1207488 - RNA, 17 nt, Human
agccucccgaguagcug

SEQ ID NO: 1207489 - RNA, 22 nt, Human
agccucccgaauagcugggacu

SEQ ID NO: 1207490 - RNA, 20 nt, Human
agccucccgaauagcuggga

SEQ ID NO: 1207491 - RNA, 19 nt, Human
agccucccgaauagcuggg

SEQ ID NO: 1207492 - RNA, 18 nt, Human
agccucccgaauagcugg

SEQ ID NO: 1207493 - RNA, 20 nt, Human
agccucccaaagugcuggga

SEQ ID NO: 1207494 - RNA, 20 nt, Human
agccgagaucacgccacugc

SEQ ID NO: 1207495 - RNA, 19 nt, Human
agccgagaucacgccacug

SEQ ID NO: 1207496 - RNA, 15 nt, Human
agcccugagcuuucu

SEQ ID NO: 1207497 - RNA, 11 nt, Human
agccccauccu

SEQ ID NO: 1207498 - RNA, 20 nt, Human
agccccaucccaaacccuuc

SEQ ID NO: 1207499 - RNA, 16 nt, Human
agccccagugcccaca

SEQ ID NO: 1207500 - RNA, 18 nt, Human
agacgggggcagagaggg

SEQ ID NO: 1207501 - RNA, 19 nt, Human
agacggagucccaccuugg

SEQ ID NO: 1207502 - RNA, 21 nt, Human
agaccaucccugaaggccccg

SEQ ID NO: 1207503 - RNA, 18 nt, Human
agaccaucccugaaggcc

SEQ ID NO: 1207504 - RNA, 17 nt, Human
agaccaucccugaaggc

SEQ ID NO: 1207505 - RNA, 14 nt, Human
agaccaucccugaa

SEQ ID NO: 1207506 - RNA, 13 nt, Human
agaccaucccuga

SEQ ID NO: 1207507 - RNA, 21 nt, Human
agacagcccgggcucugccuc

SEQ ID NO: 1207508 - RNA, 20 nt, Human
agacagcccgggcucugccu

SEQ ID NO: 1207509 - RNA, 18 nt, Human
agacagcccgggcucugc

SEQ ID NO: 1207510 - RNA, 17 nt, Human
agacagcccgggcucug

SEQ ID NO: 1207511 - RNA, 21 nt, Human
agacaauuuauuauggcacau

SEQ ID NO: 1207512 - RNA, 15 nt, Human
agacaauuuauuaug

SEQ ID NO: 1207513 - RNA, 19 nt, Human
agacaaugacuuacuguac

SEQ ID NO: 1207514 - RNA, 17 nt, Human
agacaaugacuuacugu

SEQ ID NO: 1207515 - RNA, 13 nt, Human
agacaaugacuua

SEQ ID NO: 1207516 - RNA, 18 nt, Human
agagaaaguacuucucca

SEQ ID NO: 1207517 - RNA, 21 nt, Human
agagaagagauugugguuuca

SEQ ID NO: 1207518 - RNA, 10 nt, Human
agagaagaga

SEQ ID NO: 1207519 - RNA, 13 nt, Human
agauagccaaggc

SEQ ID NO: 1207520 - RNA, 22 nt, Human
agauacuuggggggcugaggug

SEQ ID NO: 1207521 - RNA, 22 nt, Human
agaggggaacagacuggaagca

SEQ ID NO: 1207522 - RNA, 16 nt, Human
agaggggaagagacuu

SEQ ID NO: 1207523 - RNA, 13 nt, Human
agaggagaggggc

SEQ ID NO: 1207524 - RNA, 20 nt, Human
agauagccaaggccaaagga

SEQ ID NO: 1207525 - RNA, 16 nt, Human
agauagccaaggccaa

SEQ ID NO: 1207526 - RNA, 15 nt, Human
agauagccaaggcca

SEQ ID NO: 1207527 - RNA, 14 nt, Human
agaucuucuguggg

SEQ ID NO: 1207528 - RNA, 13 nt, Human
aaugucaguguga

SEQ ID NO: 1207529 - RNA, 16 nt, Human
aaugucagugugacug

SEQ ID NO: 1207530 - RNA, 15 nt, Human
aaugucagugugacu

SEQ ID NO: 1207531 - RNA, 22 nt, Human
aaugucuaguuguaacaccaug

SEQ ID NO: 1207532 - RNA, 21 nt, Human
aaugucagugugacugaucuc

SEQ ID NO: 1207533 - RNA, 17 nt, Human
aaugucagugugacuga

SEQ ID NO: 1207534 - RNA, 20 nt, Human
aaugucucuuuaaugucaca

SEQ ID NO: 1207535 - RNA, 15 nt, Human
aaugggcagagcaga

SEQ ID NO: 1207536 - RNA, 18 nt, Human
aauuaaaacacaacaucu

SEQ ID NO: 1207537 - RNA, 19 nt, Human
aauguuugccucugccucu

SEQ ID NO: 1207538 - RNA, 18 nt, Human
aauguuugccucugccuc

SEQ ID NO: 1207539 - RNA, 18 nt, Human
aauuaguggcacuugcuu

SEQ ID NO: 1207540 - RNA, 21 nt, Human
aaugaugauccuaggcauuug

SEQ ID NO: 1207541 - RNA, 23 nt, Human
aaugaaccacaucuugcucugcu

SEQ ID NO: 1207542 - RNA, 17 nt, Human
aaugaaccacaucuugc

SEQ ID NO: 1207543 - RNA, 16 nt, Human
aaugaaccacaucuug

SEQ ID NO: 1207544 - RNA, 22 nt, Human
aaucugcuuuuuaaagaaugcu

SEQ ID NO: 1207545 - RNA, 18 nt, Human
aaucuccaaaauaaaacu

SEQ ID NO: 1207546 - RNA, 14 nt, Human
aaucuccaaaauaa

SEQ ID NO: 1207547 - RNA, 13 nt, Human
aaucuccaaaaua

SEQ ID NO: 1207548 - RNA, 19 nt, Human
aaugaugccaugaggaaca

SEQ ID NO: 1207549 - RNA, 18 nt, Human
aauauaggaacuuaaaua

SEQ ID NO: 1207550 - RNA, 21 nt, Human
aauauaggaacuuaaauaaug

SEQ ID NO: 1207551 - RNA, 20 nt, Human
aauauaggaacuuaaauaau

SEQ ID NO: 1207552 - RNA, 16 nt, Human
aauaaugugaaacugg

SEQ ID NO: 1207553 - RNA, 17 nt, Human
aaguaucccuacuguaa

SEQ ID NO: 1207554 - RNA, 16 nt, Human
aaguaucccuacugua

SEQ ID NO: 1207555 - RNA, 11 nt, Human
aaguacuucuu

SEQ ID NO: 1207556 - RNA, 20 nt, Human
aagguuaauguucaucaucc

SEQ ID NO: 1207557 - RNA, 16 nt, Human
aagguuaauaaaguaa

SEQ ID NO: 1207558 - RNA, 15 nt, Human
aagguuaauaaagua

SEQ ID NO: 1207559 - RNA, 11 nt, Human
aaggugggagg

SEQ ID NO: 1207560 - RNA, 16 nt, Human
aagucuuagauguaua

SEQ ID NO: 1207561 - RNA, 17 nt, Human
aagucuuagauguauau

SEQ ID NO: 1207562 - RNA, 18 nt, Human
aaggcaaggcugucaauu

SEQ ID NO: 1207563 - RNA, 17 nt, Human
aaggcaaggcugucaau

SEQ ID NO: 1207564 - RNA, 22 nt, Human
aagcugcacccucaggcaggug

SEQ ID NO: 1207565 - RNA, 21 nt, Human
aagcugcacccucaggcaggu

SEQ ID NO: 1207566 - RNA, 12 nt, Human
aagcguggugga

SEQ ID NO: 1207567 - RNA, 18 nt, Human
aaggacauugcggacagc

SEQ ID NO: 1207568 - RNA, 15 nt, Human
aagcugggcagguug

SEQ ID NO: 1207569 - RNA, 13 nt, Human
aagcugggcaggu

SEQ ID NO: 1207570 - RNA, 11 nt, Human
aagcugggcag

SEQ ID NO: 1207571 - RNA, 14 nt, Human
aagcagaggaagga

SEQ ID NO: 1207572 - RNA, 21 nt, Human
aagcagaggaaggagaggaga

SEQ ID NO: 1207573 - RNA, 14 nt, Human
aaagugcugggauu

SEQ ID NO: 1207574 - RNA, 11 nt, Human
aaagugcuggg

SEQ ID NO: 1207575 - RNA, 20 nt, Human
aaauggacguguuaugacuc

SEQ ID NO: 1207576 - RNA, 22 nt, Human
aaauggacguguuaugacucca

SEQ ID NO: 1207577 - RNA, 21 nt, Human
aaauggacguguuaugacucc

SEQ ID NO: 1207578 - RNA, 18 nt, Human
aaauggaagacagcucuu

SEQ ID NO: 1207579 - RNA, 16 nt, Human
aaauggaaaugggcag

SEQ ID NO: 1207580 - RNA, 14 nt, Human
aaauauaauugaca

SEQ ID NO: 1207581 - RNA, 19 nt, Human
aaauaguggugugauuugg

SEQ ID NO: 1207582 - RNA, 18 nt, Human
aaacacuguucucugccc

SEQ ID NO: 1207583 - RNA, 13 nt, Human
aaaauucagugga

SEQ ID NO: 1207584 - RNA, 15 nt, Human
aaaacacauuuuucu

SEQ ID NO: 1207585 - RNA, 13 nt, Human
aaaacacauuuuu

SEQ ID NO: 1207586 - RNA, 22 nt, Human
aaacacuguucucugcccucca

SEQ ID NO: 1207587 - RNA, 19 nt, Human
aaacacuguucucugcccu

SEQ ID NO: 1207588 - RNA, 14 nt, Human
aaagaguaggaaga

SEQ ID NO: 1207589 - RNA, 15 nt, Human
aacuuuuauaaacuu

SEQ ID NO: 1207590 - RNA, 12 nt, Human
aacuuuuauaaa

SEQ ID NO: 1207591 - RNA, 20 nt, Human
aacuuugaccucugcagcaa

SEQ ID NO: 1207592 - RNA, 19 nt, Human
aacuuugaccucugcagca

SEQ ID NO: 1207593 - RNA, 17 nt, Human
aacuuugaccucugcag

SEQ ID NO: 1207594 - RNA, 14 nt, Human
aacuuugaccucug

SEQ ID NO: 1207595 - RNA, 13 nt, Human
aacuuugaccucu

SEQ ID NO: 1207596 - RNA, 19 nt, Human
aacuuuuauaaacuuuacc

SEQ ID NO: 1207597 - RNA, 16 nt, Human
aacuuuuauaaacuuu

SEQ ID NO: 1207598 - RNA, 13 nt, Human
aacuucacauauu

SEQ ID NO: 1207599 - RNA, 17 nt, Human
aacuuaaauaaugugaa

SEQ ID NO: 1207600 - RNA, 19 nt, Human
aacuuaaauaaugugaaac

SEQ ID NO: 1207601 - RNA, 20 nt, Human
aacugauuuuuuuuuccuuc

SEQ ID NO: 1207602 - RNA, 19 nt, Human
aacugauuuuuuuuuccuu

SEQ ID NO: 1207603 - RNA, 17 nt, Human
aacugauuuuuuuuucc

SEQ ID NO: 1207604 - RNA, 16 nt, Human
aacucaccugccccuc

SEQ ID NO: 1207605 - RNA, 15 nt, Human
aacucaccugccccu

SEQ ID NO: 1207606 - RNA, 15 nt, Human
aacucaccccagccc

SEQ ID NO: 1207607 - RNA, 12 nt, Human
aacucaccccag

SEQ ID NO: 1207608 - RNA, 14 nt, Human
aacccuggugacca

SEQ ID NO: 1207609 - RNA, 17 nt, Human
aaccaguguuguggauu

SEQ ID NO: 1207610 - RNA, 22 nt, Human
aaccacucuaucaaguauuaua

SEQ ID NO: 1207611 - RNA, 23 nt, Human
aacauguaauuaaguacuaugua

SEQ ID NO: 1207612 - RNA, 21 nt, Human
aacauguaauuaaguacuaug

SEQ ID NO: 1207613 - RNA, 14 nt, Human
aacauguaauuaag

SEQ ID NO: 1207614 - RNA, 22 nt, Human
aacaugcuacacacugcauguu

SEQ ID NO: 1207615 - RNA, 19 nt, Human
aacacauuuuucuuaggga

SEQ ID NO: 1207616 - RNA, 17 nt, Human
acuccccugcugggugu

SEQ ID NO: 1207617 - RNA, 13 nt, Human
acuccccugcugg

SEQ ID NO: 1207618 - RNA, 14 nt, Human
acucccccaggugg

SEQ ID NO: 1207619 - RNA, 17 nt, Human
acucaaacucuuaaaac

SEQ ID NO: 1207620 - RNA, 16 nt, Human
acucaaacucuuaaaa

SEQ ID NO: 1207621 - RNA, 11 nt, Human
acuauaaugua

SEQ ID NO: 1207622 - RNA, 18 nt, Human
acucuuaaaacccaagug

SEQ ID NO: 1207623 - RNA, 11 nt, Human
acucuuaaaac

SEQ ID NO: 1207624 - RNA, 19 nt, Human
acucugugucagguggggc

SEQ ID NO: 1207625 - RNA, 16 nt, Human
acucugugucaggugg

SEQ ID NO: 1207626 - RNA, 21 nt, Human
acucuaucaaguauuauaccu

SEQ ID NO: 1207627 - RNA, 16 nt, Human
acucuaucaaguauua

SEQ ID NO: 1207628 - RNA, 14 nt, Human
acucuaucaaguau

SEQ ID NO: 1207629 - RNA, 21 nt, Human
acucuacccucuuagaaaaac

SEQ ID NO: 1207630 - RNA, 18 nt, Human
acucuacccucuuagaaa

SEQ ID NO: 1207631 - RNA, 17 nt, Human
acgccagauucuuuccu

SEQ ID NO: 1207632 - RNA, 17 nt, Human
acgcugugcugcccugc

SEQ ID NO: 1207633 - RNA, 16 nt, Human
acgcugugcugcccug

SEQ ID NO: 1207634 - RNA, 19 nt, Human
acgcugugcugcccugccc

SEQ ID NO: 1207635 - RNA, 18 nt, Human
acgcugugcugcccugcc

SEQ ID NO: 1207636 - RNA, 17 nt, Human
acguggcugcuucaagg

SEQ ID NO: 1207637 - RNA, 15 nt, Human
acguggcugcuucaa

SEQ ID NO: 1207638 - RNA, 14 nt, Human
acguggcugcuuca

SEQ ID NO: 1207639 - RNA, 13 nt, Human
acguggcugcuuc

SEQ ID NO: 1207640 - RNA, 22 nt, Human
acuaaguuuuuauggcuuuugu

SEQ ID NO: 1207641 - RNA, 19 nt, Human
acgauuucuguuuagauaa

SEQ ID NO: 1207642 - RNA, 18 nt, Human
acgccacugcacuauagc

SEQ ID NO: 1207643 - RNA, 17 nt, Human
acgauuucuguuuagau

SEQ ID NO: 1207644 - RNA, 14 nt, Human
acgauuucuguuua

SEQ ID NO: 1207645 - RNA, 13 nt, Human
acgauuucuguuu

SEQ ID NO: 1207646 - RNA, 12 nt, Human
acgauuucuguu

SEQ ID NO: 1207647 - RNA, 21 nt, Human
accucugcacaagcugcaccc

SEQ ID NO: 1207648 - RNA, 15 nt, Human
accucugcagcaaua

SEQ ID NO: 1207649 - RNA, 18 nt, Human
accucugcacaagcugca

SEQ ID NO: 1207650 - RNA, 16 nt, Human
accucugcacaagcug

SEQ ID NO: 1207651 - RNA, 23 nt, Human
accugccccucaacucuccucca

SEQ ID NO: 1207652 - RNA, 23 nt, Human
accuuucaauaggaaaaacugau

SEQ ID NO: 1207653 - RNA, 21 nt, Human
accuuucaauaggaaaaacug

SEQ ID NO: 1207654 - RNA, 17 nt, Human
accuuucaauaggaaaa

SEQ ID NO: 1207655 - RNA, 14 nt, Human
accuuggcugcagg

SEQ ID NO: 1207656 - RNA, 16 nt, Human
accuuucaauaggaaa

SEQ ID NO: 1207657 - RNA, 12 nt, Human
accuuggcugca

SEQ ID NO: 1207658 - RNA, 14 nt, Human
accuuggcucaagu

SEQ ID NO: 1207659 - RNA, 19 nt, Human
acuucacauauugauuucc

SEQ ID NO: 1207660 - RNA, 13 nt, Human
acuguuucaaacu

SEQ ID NO: 1207661 - RNA, 19 nt, Human
acuucugccauauucuguu

SEQ ID NO: 1207662 - RNA, 18 nt, Human
acuucugccauauucugu

SEQ ID NO: 1207663 - RNA, 23 nt, Human
acuucacauauugauuuccguua

SEQ ID NO: 1207664 - RNA, 14 nt, Human
acuggagaaaaugg

SEQ ID NO: 1207665 - RNA, 16 nt, Human
acuggaagcacagcuu

SEQ ID NO: 1207666 - RNA, 15 nt, Human
acuggaagcacagcu

SEQ ID NO: 1207667 - RNA, 14 nt, Human
acuggaagcacagc

SEQ ID NO: 1207668 - RNA, 12 nt, Human
acugucuucagu

SEQ ID NO: 1207669 - RNA, 16 nt, Human
acugugccaugugcca

SEQ ID NO: 1207670 - RNA, 22 nt, Human
acuuuuauaaacuuuaccuuuu

SEQ ID NO: 1207671 - RNA, 19 nt, Human
acuuuuauaaacuuuaccu

SEQ ID NO: 1207672 - RNA, 23 nt, Human
agaaaauggacguguuaugacuc

SEQ ID NO: 1207673 - RNA, 22 nt, Human
agaaaauggacguguuaugacu

SEQ ID NO: 1207674 - RNA, 20 nt, Human
agaaaauggacguguuauga

SEQ ID NO: 1207675 - RNA, 15 nt, Human
agaaaauggacgugu

SEQ ID NO: 1207676 - RNA, 23 nt, Human
agaaaauggaagacagcucuuau

SEQ ID NO: 1207677 - RNA, 23 nt, Human
acuuuguucuggcucuuccaggc

SEQ ID NO: 1207678 - RNA, 16 nt, Human
acuuucuagccagagg

SEQ ID NO: 1207679 - RNA, 23 nt, Human
acuuuccuucauucaacccaccu

SEQ ID NO: 1207680 - RNA, 18 nt, Human
agaaauaaaguuucuguu

SEQ ID NO: 1207681 - RNA, 15 nt, Human
agaaauaaaguuucu

SEQ ID NO: 1207682 - RNA, 23 nt, Human
agaaaggaggggauagagagaga

SEQ ID NO: 1207683 - RNA, 20 nt, Human
agaaaggaggggauagagag

SEQ ID NO: 1207684 - RNA, 15 nt, Human
accccggccaccugc

SEQ ID NO: 1207685 - RNA, 18 nt, Human
acccaagggccuggccug

SEQ ID NO: 1207686 - RNA, 16 nt, Human
acccaagggccuggcc

SEQ ID NO: 1207687 - RNA, 13 nt, Human
acccaagggccug

SEQ ID NO: 1207688 - RNA, 18 nt, Human
acccaugcugcccuguga

SEQ ID NO: 1207689 - RNA, 17 nt, Human
acccaugcugcccugug

SEQ ID NO: 1207690 - RNA, 19 nt, Human
acccaugcugcccugugag

SEQ ID NO: 1207691 - RNA, 18 nt, Human
accaucccugaaggcccc

SEQ ID NO: 1207692 - RNA, 12 nt, Human
accaucauugaa

SEQ ID NO: 1207693 - RNA, 17 nt, Human
accaucaugucuggcua

SEQ ID NO: 1207694 - RNA, 16 nt, Human
accaucaugucuggcu

SEQ ID NO: 1207695 - RNA, 22 nt, Human
accaucccugaaggccccgccc

SEQ ID NO: 1207696 - RNA, 21 nt, Human
accaucccugaaggccccgcc

SEQ ID NO: 1207697 - RNA, 14 nt, Human
accaucaugucugg

SEQ ID NO: 1207698 - RNA, 20 nt, Human
accccucaacaccucugcac

SEQ ID NO: 1207699 - RNA, 23 nt, Human
acauaaacaagaccacguuucua

SEQ ID NO: 1207700 - RNA, 22 nt, Human
acaucagcacgauuucuguuua

SEQ ID NO: 1207701 - RNA, 21 nt, Human
acaucagcacgauuucuguuu

SEQ ID NO: 1207702 - RNA, 20 nt, Human
acaucagcacgauuucuguu

SEQ ID NO: 1207703 - RNA, 21 nt, Human
acauguuuuucuucucccuca

SEQ ID NO: 1207704 - RNA, 23 nt, Human
acaugcacagcuaacauggaagu

SEQ ID NO: 1207705 - RNA, 20 nt, Human
acaugcacagcuaacaugga

SEQ ID NO: 1207706 - RNA, 19 nt, Human
acaugcaaggucauuuuuu

SEQ ID NO: 1207707 - RNA, 17 nt, Human
accagcagccuggaccc

SEQ ID NO: 1207708 - RNA, 14 nt, Human
accagcagccugga

SEQ ID NO: 1207709 - RNA, 15 nt, Human
accacuacauucugu

SEQ ID NO: 1207710 - RNA, 14 nt, Human
accacuacauucug

SEQ ID NO: 1207711 - RNA, 14 nt, Human
accacgcuggaccu

SEQ ID NO: 1207712 - RNA, 19 nt, Human
accacguuucuaaaggcua

SEQ ID NO: 1207713 - RNA, 15 nt, Human
accacguuucuaaag

SEQ ID NO: 1207714 - RNA, 20 nt, Human
acaaaauguaggguuauaau

SEQ ID NO: 1207715 - RNA, 15 nt, Human
acaaacgggcucagc

SEQ ID NO: 1207716 - RNA, 21 nt, Human
acaaaccuguuucugcagcca

SEQ ID NO: 1207717 - RNA, 13 nt, Human
acaaagacugagu

SEQ ID NO: 1207718 - RNA, 18 nt, Human
acacaaacgggcucagca

SEQ ID NO: 1207719 - RNA, 15 nt, Human
acaauuuauuauggc

SEQ ID NO: 1207720 - RNA, 16 nt, Human
acaauuuauuauggca

SEQ ID NO: 1207721 - RNA, 15 nt, Human
acacggacacucaaa

SEQ ID NO: 1207722 - RNA, 15 nt, Human
acacuaaccacgcug

SEQ ID NO: 1207723 - RNA, 14 nt, Human
acacuaaccacgcu

SEQ ID NO: 1207724 - RNA, 14 nt, Human
acacagcucugucc

SEQ ID NO: 1207725 - RNA, 12 nt, Human
acacagcucugu

SEQ ID NO: 1207726 - RNA, 11 nt, Human
acacagcucug

SEQ ID NO: 1207727 - RNA, 14 nt, Human
acaccacuacauuc

SEQ ID NO: 1207728 - RNA, 13 nt, Human
acaccagagccca

SEQ ID NO: 1207729 - RNA, 12 nt, Human
acaccagagccc

SEQ ID NO: 1207730 - RNA, 17 nt, Human
acacugugcugagucug

SEQ ID NO: 1207731 - RNA, 15 nt, Human
acagccaugauucuu

SEQ ID NO: 1207732 - RNA, 14 nt, Human
acagagucucacug

SEQ ID NO: 1207733 - RNA, 12 nt, Human
acagagucucac

SEQ ID NO: 1207734 - RNA, 22 nt, Human
acagaggggguggccucccaac

SEQ ID NO: 1207735 - RNA, 23 nt, Human
acagagucucacuguugcccagg

SEQ ID NO: 1207736 - RNA, 19 nt, Human
acagagucucacuguugcc

SEQ ID NO: 1207737 - RNA, 17 nt, Human
acagagucucacuguug

SEQ ID NO: 1207738 - RNA, 16 nt, Human
acaggcaagcaccucc

SEQ ID NO: 1207739 - RNA, 18 nt, Human
acaggcaagcaccuccug

SEQ ID NO: 1207740 - RNA, 19 nt, Human
acaggcaagcaccuccugc

SEQ ID NO: 1207741 - RNA, 23 nt, Human
acaggugugaaccaccacaccca

SEQ ID NO: 1207742 - RNA, 20 nt, Human
acaggugugaaccaccacac

SEQ ID NO: 1207743 - RNA, 22 nt, Human
acaggugugagucaccaagccc

SEQ ID NO: 1207744 - RNA, 23 nt, Human
acagcugccugggaucccucauc

SEQ ID NO: 1207745 - RNA, 14 nt, Human
acagcugccuggga

SEQ ID NO: 1207746 - RNA, 13 nt, Human
acagcucuguccu

SEQ ID NO: 1207747 - RNA, 15 nt, Human
acagcuccuucuguc

SEQ ID NO: 1207748 - RNA, 14 nt, Human
acagcuccuucugu

SEQ ID NO: 1207749 - RNA, 13 nt, Human
acagcuccuucug

SEQ ID NO: 1207750 - RNA, 12 nt, Human
acagcuccuucu

SEQ ID NO: 1207751 - RNA, 14 nt, Human
caaccuccugggcu

SEQ ID NO: 1207752 - RNA, 15 nt, Human
caaccuccugggcua

SEQ ID NO: 1207753 - RNA, 14 nt, Human
caacgucugugcca

SEQ ID NO: 1207754 - RNA, 13 nt, Human
caacgucugugcc

SEQ ID NO: 1207755 - RNA, 22 nt, Human
caacacucauugaccugaggcc

SEQ ID NO: 1207756 - RNA, 20 nt, Human
caacacucauugaccugagg

SEQ ID NO: 1207757 - RNA, 18 nt, Human
caacacucauugaccuga

SEQ ID NO: 1207758 - RNA, 17 nt, Human
caagagcccaggccucc

SEQ ID NO: 1207759 - RNA, 16 nt, Human
caagagcccaggccuc

SEQ ID NO: 1207760 - RNA, 17 nt, Human
caagcaccuccugccuc

SEQ ID NO: 1207761 - RNA, 16 nt, Human
caagcaccuccugccu

SEQ ID NO: 1207762 - RNA, 15 nt, Human
caagcaccuccugcc

SEQ ID NO: 1207763 - RNA, 15 nt, Human
caagagcccaggccu

SEQ ID NO: 1207764 - RNA, 14 nt, Human
caagagcccaggcc

SEQ ID NO: 1207765 - RNA, 18 nt, Human
caagacucuuuggacacu

SEQ ID NO: 1207766 - RNA, 19 nt, Human
caagacgcugugcugcccu

SEQ ID NO: 1207767 - RNA, 18 nt, Human
caagacgcugugcugccc

SEQ ID NO: 1207768 - RNA, 17 nt, Human
caagacgcugugcugcc

SEQ ID NO: 1207769 - RNA, 16 nt, Human
caagacgcugugcugc

SEQ ID NO: 1207770 - RNA, 18 nt, Human
caagaccuucuccuucac

SEQ ID NO: 1207771 - RNA, 17 nt, Human
caagaccuucuccuuca

SEQ ID NO: 1207772 - RNA, 16 nt, Human
caagaccuucuccuuc

SEQ ID NO: 1207773 - RNA, 20 nt, Human
caagaacuuuccaggaaggc

SEQ ID NO: 1207774 - RNA, 22 nt, Human
caagcgauucuucugcuucagc

SEQ ID NO: 1207775 - RNA, 20 nt, Human
caagcgauucuucugcuuca

SEQ ID NO: 1207776 - RNA, 18 nt, Human
caagcaggacauggacaa

SEQ ID NO: 1207777 - RNA, 14 nt, Human
caagcaggacaugg

SEQ ID NO: 1207778 - RNA, 18 nt, Human
caagcaccuccugccucg

SEQ ID NO: 1207779 - RNA, 19 nt, Human
caagcuggucccacucagu

SEQ ID NO: 1207780 - RNA, 17 nt, Human
caagcuggucccacuca

SEQ ID NO: 1207781 - RNA, 17 nt, Human
caagugagagcugggug

SEQ ID NO: 1207782 - RNA, 15 nt, Human
caagugagagcuggg

SEQ ID NO: 1207783 - RNA, 14 nt, Human
caagugagagcugg

SEQ ID NO: 1207784 - RNA, 21 nt, Human
caaguccucuuuucugagagg

SEQ ID NO: 1207785 - RNA, 18 nt, Human
caagugagagcugggugu

SEQ ID NO: 1207786 - RNA, 14 nt, Human
caaguuaaauaaau

SEQ ID NO: 1207787 - RNA, 18 nt, Human
caaggggcccaaauucuu

SEQ ID NO: 1207788 - RNA, 23 nt, Human
caaggcugucaauuacaggaagu

SEQ ID NO: 1207789 - RNA, 15 nt, Human
caaggcugcagugag

SEQ ID NO: 1207790 - RNA, 12 nt, Human
caaggcugcagu

SEQ ID NO: 1207791 - RNA, 14 nt, Human
caaguccucuuuuc

SEQ ID NO: 1207792 - RNA, 20 nt, Human
caaggucauuuuuuuuaaga

SEQ ID NO: 1207793 - RNA, 14 nt, Human
caaggucauuuuuu

SEQ ID NO: 1207794 - RNA, 22 nt, Human
caaugcacuuuguucuggcucu

SEQ ID NO: 1207795 - RNA, 21 nt, Human
caaugcacuuuguucuggcuc

SEQ ID NO: 1207796 - RNA, 20 nt, Human
caaugcacuuuguucuggcu

SEQ ID NO: 1207797 - RNA, 17 nt, Human
caaugcacuuuguucug

SEQ ID NO: 1207798 - RNA, 17 nt, Human
caaugugauaaaacccc

SEQ ID NO: 1207799 - RNA, 15 nt, Human
caaugugauaaaacc

SEQ ID NO: 1207800 - RNA, 16 nt, Human
caauuacaggaaguac

SEQ ID NO: 1207801 - RNA, 23 nt, Human
caauucucauuugucacacacuu

SEQ ID NO: 1207802 - RNA, 17 nt, Human
caauuacaggaaguacu

SEQ ID NO: 1207803 - RNA, 18 nt, Human
caaugacuuacuguacau

SEQ ID NO: 1207804 - RNA, 17 nt, Human
caaugacuuacuguaca

SEQ ID NO: 1207805 - RNA, 15 nt, Human
caaugacuuacugua

SEQ ID NO: 1207806 - RNA, 23 nt, Human
caaugaccuuucaauaggaaaaa

SEQ ID NO: 1207807 - RNA, 17 nt, Human
caauauucgcuguguca

SEQ ID NO: 1207808 - RNA, 13 nt, Human
caauaggaaaaac

SEQ ID NO: 1207809 - RNA, 12 nt, Human
caauaggaaaaa

SEQ ID NO: 1207810 - RNA, 14 nt, Human
caauguucucucuu

SEQ ID NO: 1207811 - RNA, 14 nt, Human
caauaggaaaaacu

SEQ ID NO: 1207812 - RNA, 23 nt, Human
caaagugcugggauuacaggugu

SEQ ID NO: 1207813 - RNA, 19 nt, Human
caaaggguaucaggugcug

SEQ ID NO: 1207814 - RNA, 19 nt, Human
caaagugcugggauuacag

SEQ ID NO: 1207815 - RNA, 14 nt, Human
caaauuucuaaauc

SEQ ID NO: 1207816 - RNA, 12 nt, Human
caaauuucuaaa

SEQ ID NO: 1207817 - RNA, 11 nt, Human
caaauuucuaa

SEQ ID NO: 1207818 - RNA, 18 nt, Human
caaagccuccuccagccg

SEQ ID NO: 1207819 - RNA, 17 nt, Human
caaagccuccuccagcc

SEQ ID NO: 1207820 - RNA, 17 nt, Human
caaacucaccugccccu

SEQ ID NO: 1207821 - RNA, 15 nt, Human
caaagcuaggccugg

SEQ ID NO: 1207822 - RNA, 19 nt, Human
caaagcuaggccuggccag

SEQ ID NO: 1207823 - RNA, 14 nt, Human
caaagcuaggccug

SEQ ID NO: 1207824 - RNA, 13 nt, Human
caaagcuaggccu

SEQ ID NO: 1207825 - RNA, 13 nt, Human
caaaggaagcaca

SEQ ID NO: 1207826 - RNA, 18 nt, Human
caaaggguaucaggugcu

SEQ ID NO: 1207827 - RNA, 16 nt, Human
caaaggguaucaggug

SEQ ID NO: 1207828 - RNA, 14 nt, Human
caaaggaagcacau

SEQ ID NO: 1207829 - RNA, 20 nt, Human
caaacccuucagugccaaaa

SEQ ID NO: 1207830 - RNA, 15 nt, Human
caaacacauacagga

SEQ ID NO: 1207831 - RNA, 15 nt, Human
caaaauguaggguua

SEQ ID NO: 1207832 - RNA, 14 nt, Human
caaaauaaaacuuu

SEQ ID NO: 1207833 - RNA, 12 nt, Human
caaaauaaaacu

SEQ ID NO: 1207834 - RNA, 23 nt, Human
caaaacucuccucugcugcuggc

SEQ ID NO: 1207835 - RNA, 22 nt, Human
caaaacucuccucugcugcugg

SEQ ID NO: 1207836 - RNA, 21 nt, Human
caaaacucuccucugcugcug

SEQ ID NO: 1207837 - RNA, 20 nt, Human
caaaacucuccucugcugcu

SEQ ID NO: 1207838 - RNA, 17 nt, Human
caaaauaaaaaugaggu

SEQ ID NO: 1207839 - RNA, 13 nt, Human
caaaaaggcagga

SEQ ID NO: 1207840 - RNA, 20 nt, Human
caaaaacauggccuuugcuu

SEQ ID NO: 1207841 - RNA, 23 nt, Human
auuuugggguacccacugcucug

SEQ ID NO: 1207842 - RNA, 22 nt, Human
auuuugggguacccacugcucu

SEQ ID NO: 1207843 - RNA, 21 nt, Human
auuuugggguacccacugcuc

SEQ ID NO: 1207844 - RNA, 19 nt, Human
cacaggcagguccaggguu

SEQ ID NO: 1207845 - RNA, 22 nt, Human
cacagugagucgaggacaggga

SEQ ID NO: 1207846 - RNA, 22 nt, Human
cacaguccuuaccagcagagca

SEQ ID NO: 1207847 - RNA, 21 nt, Human
cacaguccuuaccagcagagc

SEQ ID NO: 1207848 - RNA, 15 nt, Human
cacaguccuuaccag

SEQ ID NO: 1207849 - RNA, 13 nt, Human
cacaguccuuacc

SEQ ID NO: 1207850 - RNA, 15 nt, Human
cacaguucucuccuu

SEQ ID NO: 1207851 - RNA, 14 nt, Human
cacaguucucuccu

SEQ ID NO: 1207852 - RNA, 22 nt, Human
cacagcuucauuuccugugucu

SEQ ID NO: 1207853 - RNA, 21 nt, Human
cacagcuucauuuccuguguc

SEQ ID NO: 1207854 - RNA, 23 nt, Human
cacagcugggguggggaccucag

SEQ ID NO: 1207855 - RNA, 22 nt, Human
cacagcugggguggggaccuca

SEQ ID NO: 1207856 - RNA, 15 nt, Human
cacaggcagguccag

SEQ ID NO: 1207857 - RNA, 14 nt, Human
cacaggcaggucca

SEQ ID NO: 1207858 - RNA, 11 nt, Human
cacaggcaggu

SEQ ID NO: 1207859 - RNA, 18 nt, Human
uuuuauuuuuagacagag

SEQ ID NO: 1207860 - RNA, 17 nt, Human
uuuucaaaauaaaaaug

SEQ ID NO: 1207861 - RNA, 21 nt, Human
uuuuauacauaaacaagacca

SEQ ID NO: 1207862 - RNA, 13 nt, Human
uuuuauacauaaa

SEQ ID NO: 1207863 - RNA, 15 nt, Human
uuuuacuaauagaca

SEQ ID NO: 1207864 - RNA, 22 nt, Human
uuuucccuauuagagaagagau

SEQ ID NO: 1207865 - RNA, 18 nt, Human
uuuucccuauuagagaag

SEQ ID NO: 1207866 - RNA, 16 nt, Human
uuuucuuucagccaag

SEQ ID NO: 1207867 - RNA, 14 nt, Human
uuuucuucucccuc

SEQ ID NO: 1207868 - RNA, 22 nt, Human
uuuucuuguguguuuauuguca

SEQ ID NO: 1207869 - RNA, 13 nt, Human
uuuucuucucccu

SEQ ID NO: 1207870 - RNA, 23 nt, Human
uuuucuacucgaguuacagacaa

SEQ ID NO: 1207871 - RNA, 22 nt, Human
uuuucuacucgaguuacagaca

SEQ ID NO: 1207872 - RNA, 20 nt, Human
uuuucuacucgaguuacaga

SEQ ID NO: 1207873 - RNA, 13 nt, Human
uuuucuacucgag

SEQ ID NO: 1207874 - RNA, 13 nt, Human
uuuggacccugag

SEQ ID NO: 1207875 - RNA, 21 nt, Human
uuugagugccuuacacaaugg

SEQ ID NO: 1207876 - RNA, 17 nt, Human
uuuccguuaaaauacca

SEQ ID NO: 1207877 - RNA, 15 nt, Human
uuuccguuaaaauac

SEQ ID NO: 1207878 - RNA, 15 nt, Human
uuuguugucagcuga

SEQ ID NO: 1207879 - RNA, 22 nt, Human
uuuguuaguaugaggcauuugu

SEQ ID NO: 1207880 - RNA, 16 nt, Human
uuuguugucagcugaa

SEQ ID NO: 1207881 - RNA, 17 nt, Human
uuuggucuacacugugc

SEQ ID NO: 1207882 - RNA, 23 nt, Human
uuuuuaagugcugcauuuaaaag

SEQ ID NO: 1207883 - RNA, 22 nt, Human
uuuuuaagugcugcauuuaaaa

SEQ ID NO: 1207884 - RNA, 19 nt, Human
uuuuuaagugcugcauuua

SEQ ID NO: 1207885 - RNA, 18 nt, Human
uuuuuaagugcugcauuu

SEQ ID NO: 1207886 - RNA, 17 nt, Human
uuuuuaagugcugcauu

SEQ ID NO: 1207887 - RNA, 16 nt, Human
uuuuuaagugcugcau

SEQ ID NO: 1207888 - RNA, 23 nt, Human
uuuuuaagaaaaaggaugcacag

SEQ ID NO: 1207889 - RNA, 12 nt, Human
uuuuuaagaaaa

SEQ ID NO: 1207890 - RNA, 12 nt, Human
uuuuuuacuaau

SEQ ID NO: 1207891 - RNA, 12 nt, Human
uuuuuuuuaaga

SEQ ID NO: 1207892 - RNA, 11 nt, Human
uuuuuuuacua

SEQ ID NO: 1207893 - RNA, 17 nt, Human
uuuuuuccuucagugcc

SEQ ID NO: 1207894 - RNA, 13 nt, Human
uuuuuuuugacaa

SEQ ID NO: 1207895 - RNA, 20 nt, Human
uuccugaggcugggcucccu

SEQ ID NO: 1207896 - RNA, 15 nt, Human
uuccugaggcugggc

SEQ ID NO: 1207897 - RNA, 16 nt, Human
uuccauggccucuuca

SEQ ID NO: 1207898 - RNA, 12 nt, Human
uuccauggccuc

SEQ ID NO: 1207899 - RNA, 21 nt, Human
uuccuugaguugauucagcuc

SEQ ID NO: 1207900 - RNA, 22 nt, Human
uucuacucgaguuacagacaaa

SEQ ID NO: 1207901 - RNA, 14 nt, Human
uucuacccaggugc

SEQ ID NO: 1207902 - RNA, 21 nt, Human
uucuacccagcgagcccuggu

SEQ ID NO: 1207903 - RNA, 20 nt, Human
uucuacccagcgagcccugg

SEQ ID NO: 1207904 - RNA, 13 nt, Human
uucuacgccaggg

SEQ ID NO: 1207905 - RNA, 19 nt, Human
uucuacccagcgagcccug

SEQ ID NO: 1207906 - RNA, 12 nt, Human
uucuacccagcg

SEQ ID NO: 1207907 - RNA, 21 nt, Human
uucugacccugcuucaaauau

SEQ ID NO: 1207908 - RNA, 18 nt, Human
uucugacccugcuucaaa

SEQ ID NO: 1207909 - RNA, 23 nt, Human
uucugacccaugcugcccuguga

SEQ ID NO: 1207910 - RNA, 17 nt, Human
uucucugcccuccaaga

SEQ ID NO: 1207911 - RNA, 16 nt, Human
uucucugcccuccaag

SEQ ID NO: 1207912 - RNA, 19 nt, Human
uucugcucacauaucuguc

SEQ ID NO: 1207913 - RNA, 19 nt, Human
uucugauccuaguuccacc

SEQ ID NO: 1207914 - RNA, 12 nt, Human
uucucugcccuc

SEQ ID NO: 1207915 - RNA, 11 nt, Human
uucucugcccu

SEQ ID NO: 1207916 - RNA, 20 nt, Human
uucucugaggacacuaacca

SEQ ID NO: 1207917 - RNA, 14 nt, Human
uucucugaggacac

SEQ ID NO: 1207918 - RNA, 22 nt, Human
uucucuccuguaccucuugagc

SEQ ID NO: 1207919 - RNA, 19 nt, Human
uucucuccuguaccucuug

SEQ ID NO: 1207920 - RNA, 18 nt, Human
uucucuccuguaccucuu

SEQ ID NO: 1207921 - RNA, 14 nt, Human
uucucuccuguacc

SEQ ID NO: 1207922 - RNA, 16 nt, Human
uucucuccagccccug

SEQ ID NO: 1207923 - RNA, 15 nt, Human
uucucuccagccccu

SEQ ID NO: 1207924 - RNA, 14 nt, Human
uucucuccagcccc

SEQ ID NO: 1207925 - RNA, 13 nt, Human
uucucuccagccc

SEQ ID NO: 1207926 - RNA, 15 nt, Human
uucuccaccugccag

SEQ ID NO: 1207927 - RNA, 14 nt, Human
uucuccaccugcca

SEQ ID NO: 1207928 - RNA, 12 nt, Human
uucuccaccugc

SEQ ID NO: 1207929 - RNA, 21 nt, Human
uucuccaccucccacaaagga

SEQ ID NO: 1207930 - RNA, 18 nt, Human
uucuccaccugccaggga

SEQ ID NO: 1207931 - RNA, 16 nt, Human
uucuccaccugccagg

SEQ ID NO: 1207932 - RNA, 20 nt, Human
uucuccaccugccagggaca

SEQ ID NO: 1207933 - RNA, 16 nt, Human
uugaacuccuggccuc

SEQ ID NO: 1207934 - RNA, 15 nt, Human
uugaacuccuggccu

SEQ ID NO: 1207935 - RNA, 23 nt, Human
uugaaaacacuguucucugcccu

SEQ ID NO: 1207936 - RNA, 20 nt, Human
uugaaaaaccauuuugcugu

SEQ ID NO: 1207937 - RNA, 21 nt, Human
uucuuuccaaaguacacuguu

SEQ ID NO: 1207938 - RNA, 14 nt, Human
uucuuuccaaagua

SEQ ID NO: 1207939 - RNA, 12 nt, Human
uucuuucagcca

SEQ ID NO: 1207940 - RNA, 21 nt, Human
uucuuguguguuuauugucaa

SEQ ID NO: 1207941 - RNA, 23 nt, Human
uucuuccucccucccucuuuccc

SEQ ID NO: 1207942 - RNA, 13 nt, Human
uucuuccucccuc

SEQ ID NO: 1207943 - RNA, 21 nt, Human
uucuuccacaagagcccaggc

SEQ ID NO: 1207944 - RNA, 21 nt, Human
uucuuauacauuugauaaagu

SEQ ID NO: 1207945 - RNA, 18 nt, Human
uucuguauuuuguuuuug

SEQ ID NO: 1207946 - RNA, 19 nt, Human
uucugcuucagccucccga

SEQ ID NO: 1207947 - RNA, 16 nt, Human
uucugcuucagccucc

SEQ ID NO: 1207948 - RNA, 15 nt, Human
uucugcuucagccuc

SEQ ID NO: 1207949 - RNA, 14 nt, Human
uucugcuucagccu

SEQ ID NO: 1207950 - RNA, 13 nt, Human
uugaacuuugacc

SEQ ID NO: 1207951 - RNA, 18 nt, Human
uugaacuggguacuugug

SEQ ID NO: 1207952 - RNA, 20 nt, Human
uugacgccaucccagcccca

SEQ ID NO: 1207953 - RNA, 19 nt, Human
uugacgccaucccagcccc

SEQ ID NO: 1207954 - RNA, 18 nt, Human
uugacgccaucccagccc

SEQ ID NO: 1207955 - RNA, 17 nt, Human
uugacgccaucccagcc

SEQ ID NO: 1207956 - RNA, 16 nt, Human
uugaccucugcagcaa

SEQ ID NO: 1207957 - RNA, 15 nt, Human
uugaccucugcagca

SEQ ID NO: 1207958 - RNA, 14 nt, Human
uugaccucugcagc

SEQ ID NO: 1207959 - RNA, 17 nt, Human
uugaccgugaggccaga

SEQ ID NO: 1207960 - RNA, 23 nt, Human
uugauauccucuuugagugaagc

SEQ ID NO: 1207961 - RNA, 15 nt, Human
uugaggucuguucuu

SEQ ID NO: 1207962 - RNA, 16 nt, Human
uugaggguugggcugg

SEQ ID NO: 1207963 - RNA, 13 nt, Human
uugaggguugggc

SEQ ID NO: 1207964 - RNA, 14 nt, Human
uugagccugggagg

SEQ ID NO: 1207965 - RNA, 11 nt, Human
uugagccuggg

SEQ ID NO: 1207966 - RNA, 21 nt, Human
uugcaaaguaucccuacugua

SEQ ID NO: 1207967 - RNA, 16 nt, Human
uugaugaucuuugcag

SEQ ID NO: 1207968 - RNA, 13 nt, Human
uuauacauaaaca

SEQ ID NO: 1207969 - RNA, 11 nt, Human
uuauacauaaa

SEQ ID NO: 1207970 - RNA, 15 nt, Human
uuauaaugaaugaaa

SEQ ID NO: 1207971 - RNA, 18 nt, Human
uuauaauaauguuaacau

SEQ ID NO: 1207972 - RNA, 15 nt, Human
uuauaauaauguuaa

SEQ ID NO: 1207973 - RNA, 21 nt, Human
ugugaaaagaaaaaugagccu

SEQ ID NO: 1207974 - RNA, 21 nt, Human
ugucuuuucuugcaugaggcu

SEQ ID NO: 1207975 - RNA, 17 nt, Human
ugugaaaagaaaaauga

SEQ ID NO: 1207976 - RNA, 15 nt, Human
ugugaaaagaaaaau

SEQ ID NO: 1207977 - RNA, 13 nt, Human
ugugaaaagaaaa

SEQ ID NO: 1207978 - RNA, 21 nt, Human
uuauuaaaugcccagccccuu

SEQ ID NO: 1207979 - RNA, 19 nt, Human
uuauuaaaugcccagcccc

SEQ ID NO: 1207980 - RNA, 23 nt, Human
uuauuaaaaaucucaaauuucua

SEQ ID NO: 1207981 - RNA, 18 nt, Human
uuauggcuuuugugcauu

SEQ ID NO: 1207982 - RNA, 17 nt, Human
uuauggcuuuugugcau

SEQ ID NO: 1207983 - RNA, 16 nt, Human
uuauggcuuuugugca

SEQ ID NO: 1207984 - RNA, 14 nt, Human
uuauggcacaucag

SEQ ID NO: 1207985 - RNA, 21 nt, Human
uuauggacaaugacccagugg

SEQ ID NO: 1207986 - RNA, 20 nt, Human
uuauggaacacucugagacu

SEQ ID NO: 1207987 - RNA, 18 nt, Human
uuauggaacacucugaga

SEQ ID NO: 1207988 - RNA, 17 nt, Human
uuauggaacacucugag

SEQ ID NO: 1207989 - RNA, 14 nt, Human
uuaucuagauacug

SEQ ID NO: 1207990 - RNA, 22 nt, Human
uuauuuuggaaaauaaauuauu

SEQ ID NO: 1207991 - RNA, 18 nt, Human
uucaaaugcuguaacuuu

SEQ ID NO: 1207992 - RNA, 18 nt, Human
uuauuuuauuaugcauga

SEQ ID NO: 1207993 - RNA, 17 nt, Human
uuauuuuaauucaguug

SEQ ID NO: 1207994 - RNA, 21 nt, Human
uucagacagcugccugggauc

SEQ ID NO: 1207995 - RNA, 17 nt, Human
uucagacagcugccugg

SEQ ID NO: 1207996 - RNA, 16 nt, Human
uucagacagcugccug

SEQ ID NO: 1207997 - RNA, 15 nt, Human
uucagacagcugccu

SEQ ID NO: 1207998 - RNA, 18 nt, Human
uucacggaagagccuugc

SEQ ID NO: 1207999 - RNA, 17 nt, Human
uucacggaagagccuug

SEQ ID NO: 1208000 - RNA, 13 nt, Human
uucacggaagagc

SEQ ID NO: 1208001 - RNA, 22 nt, Human
uucaccuuuguccccaccgcag

SEQ ID NO: 1208002 - RNA, 22 nt, Human
uucaauaggaaaaacugauuuu

SEQ ID NO: 1208003 - RNA, 21 nt, Human
uucaauaggaaaaacugauuu

SEQ ID NO: 1208004 - RNA, 20 nt, Human
uucaccuuuguccccaccgc

SEQ ID NO: 1208005 - RNA, 19 nt, Human
uucaccuuuguccccaccg

SEQ ID NO: 1208006 - RNA, 14 nt, Human
uucaccuuuguccc

SEQ ID NO: 1208007 - RNA, 13 nt, Human
uucacccuuuucu

SEQ ID NO: 1208008 - RNA, 16 nt, Human
uuccaaaguacacugu

SEQ ID NO: 1208009 - RNA, 13 nt, Human
uuccaaaguacac

SEQ ID NO: 1208010 - RNA, 19 nt, Human
uuccaacccucaucaccaa

SEQ ID NO: 1208011 - RNA, 15 nt, Human
uuccauggacuuugu

SEQ ID NO: 1208012 - RNA, 14 nt, Human
uuccauggacuuug

SEQ ID NO: 1208013 - RNA, 14 nt, Human
uucaguggcagcug

SEQ ID NO: 1208014 - RNA, 22 nt, Human
uucagcuuguaaauagcucagg

SEQ ID NO: 1208015 - RNA, 22 nt, Human
uucagcuccagcucaccagccc

SEQ ID NO: 1208016 - RNA, 15 nt, Human
uucagcuccagcuca

SEQ ID NO: 1208017 - RNA, 12 nt, Human
uucagcuccagc

SEQ ID NO: 1208018 - RNA, 13 nt, Human
uucaguguacaug

SEQ ID NO: 1208019 - RNA, 12 nt, Human
uucaguguacau

SEQ ID NO: 1208020 - RNA, 17 nt, Human
uucaguggcagcugcuu

SEQ ID NO: 1208021 - RNA, 16 nt, Human
uucaguggcagcugcu

SEQ ID NO: 1208022 - RNA, 15 nt, Human
uucaguggcagcugc

SEQ ID NO: 1208023 - RNA, 19 nt, Human
uucauccuccucagaucuu

SEQ ID NO: 1208024 - RNA, 15 nt, Human
uucauccuccucaga

SEQ ID NO: 1208025 - RNA, 15 nt, Human
uucauaaccuagccu

SEQ ID NO: 1208026 - RNA, 18 nt, Human
uuucauuuaggugaggaa

SEQ ID NO: 1208027 - RNA, 14 nt, Human
uuucauuuagguga

SEQ ID NO: 1208028 - RNA, 14 nt, Human
uuucaguguacaug

SEQ ID NO: 1208029 - RNA, 13 nt, Human
uuucaguguacau

SEQ ID NO: 1208030 - RNA, 19 nt, Human
uuucaauaggaaaaacuga

SEQ ID NO: 1208031 - RNA, 17 nt, Human
uuucaauaggaaaaacu

SEQ ID NO: 1208032 - RNA, 14 nt, Human
uuucaauaggaaaa

SEQ ID NO: 1208033 - RNA, 12 nt, Human
uuucaauaggaa

SEQ ID NO: 1208034 - RNA, 20 nt, Human
uuuauggcuuuugugcauua

SEQ ID NO: 1208035 - RNA, 13 nt, Human
uuuauuauggcac

SEQ ID NO: 1208036 - RNA, 16 nt, Human
uuuauggcuuuugugc

SEQ ID NO: 1208037 - RNA, 14 nt, Human
uuuauggcuuuugu

SEQ ID NO: 1208038 - RNA, 19 nt, Human
uuuauuuaguuccuugagu

SEQ ID NO: 1208039 - RNA, 12 nt, Human
uuuagacagagu

SEQ ID NO: 1208040 - RNA, 14 nt, Human
uuuagaaauauaau

SEQ ID NO: 1208041 - RNA, 22 nt, Human
uuuacuucuuauacauuugaua

SEQ ID NO: 1208042 - RNA, 19 nt, Human
uuuacuucuuauacauuug

SEQ ID NO: 1208043 - RNA, 18 nt, Human
uuuaagaaaaaggaugca

SEQ ID NO: 1208044 - RNA, 22 nt, Human
uuuaagaaaaaggaugcacaga

SEQ ID NO: 1208045 - RNA, 21 nt, Human
uuguguuuauauauaagccaa

SEQ ID NO: 1208046 - RNA, 23 nt, Human
uuguggauuuaacagaaauguac

SEQ ID NO: 1208047 - RNA, 22 nt, Human
uuguggauuuaacagaaaugua

SEQ ID NO: 1208048 - RNA, 21 nt, Human
uuguggauuuaacagaaaugu

SEQ ID NO: 1208049 - RNA, 20 nt, Human
uuguggauuuaacagaaaug

SEQ ID NO: 1208050 - RNA, 17 nt, Human
uuguggacacagcucuu

SEQ ID NO: 1208051 - RNA, 16 nt, Human
uuguggacacagcucu

SEQ ID NO: 1208052 - RNA, 12 nt, Human
uugugcauuugg

SEQ ID NO: 1208053 - RNA, 23 nt, Human
uugugcauuaucuagauacugua

SEQ ID NO: 1208054 - RNA, 22 nt, Human
uugugcauuaucuagauacugu

SEQ ID NO: 1208055 - RNA, 17 nt, Human
uugugcauuaucuagau

SEQ ID NO: 1208056 - RNA, 21 nt, Human
uuguuaguaugaggcauuugu

SEQ ID NO: 1208057 - RNA, 19 nt, Human
uuguuaguaugaggcauuu

SEQ ID NO: 1208058 - RNA, 14 nt, Human
uuguuacauuuuua

SEQ ID NO: 1208059 - RNA, 20 nt, Human
uuguuagugugucuuagugu

SEQ ID NO: 1208060 - RNA, 22 nt, Human
uuguuaguaugaggcauuuguu

SEQ ID NO: 1208061 - RNA, 21 nt, Human
uuguauucucuccuguaccuc

SEQ ID NO: 1208062 - RNA, 19 nt, Human
uuguauucucuccuguacc

SEQ ID NO: 1208063 - RNA, 16 nt, Human
uuguauucucuccugu

SEQ ID NO: 1208064 - RNA, 15 nt, Human
uuguauucucuccug

SEQ ID NO: 1208065 - RNA, 20 nt, Human
uugugaaaggaaagaggcuc

SEQ ID NO: 1208066 - RNA, 22 nt, Human
uugucuuaaaaaguggaaaaau

SEQ ID NO: 1208067 - RNA, 17 nt, Human
uugugauuuuuguaauu

SEQ ID NO: 1208068 - RNA, 16 nt, Human
uugugauuuuuguaau

SEQ ID NO: 1208069 - RNA, 12 nt, Human
uugugauuuuug

SEQ ID NO: 1208070 - RNA, 15 nt, Human
uugucuuaaaaagug

SEQ ID NO: 1208071 - RNA, 13 nt, Human
uuggucuguguga

SEQ ID NO: 1208072 - RNA, 16 nt, Human
uuggucccccuuccau

SEQ ID NO: 1208073 - RNA, 22 nt, Human
uuggguucaagcgauucuucug

SEQ ID NO: 1208074 - RNA, 23 nt, Human
uuguaaauuaacuuuuauaaacu

SEQ ID NO: 1208075 - RNA, 18 nt, Human
uuguaaauuaacuuuuau

SEQ ID NO: 1208076 - RNA, 16 nt, Human
uuguaaauuaacuuuu

SEQ ID NO: 1208077 - RNA, 15 nt, Human
uuguaaauuaacuuu

SEQ ID NO: 1208078 - RNA, 18 nt, Human
uuguacauaaugcgugca

SEQ ID NO: 1208079 - RNA, 17 nt, Human
uuguaaauagcucaggu

SEQ ID NO: 1208080 - RNA, 14 nt, Human
uguaacaagccacc

SEQ ID NO: 1208081 - RNA, 17 nt, Human
uguaacaagccacccca

SEQ ID NO: 1208082 - RNA, 11 nt, Human
uguacagagcc

SEQ ID NO: 1208083 - RNA, 14 nt, Human
uguacagacaacaa

SEQ ID NO: 1208084 - RNA, 23 nt, Human
ugguuuuuaaaaaacugcugacu

SEQ ID NO: 1208085 - RNA, 21 nt, Human
ugguuuuuaaaaaacugcuga

SEQ ID NO: 1208086 - RNA, 19 nt, Human
ugguuuucuuguguguuua

SEQ ID NO: 1208087 - RNA, 16 nt, Human
ugguuuucuguucuuu

SEQ ID NO: 1208088 - RNA, 19 nt, Human
uggugucgggcaugacacg

SEQ ID NO: 1208089 - RNA, 18 nt, Human
uggugucgggcaugacac

SEQ ID NO: 1208090 - RNA, 15 nt, Human
uggugucgggcauga

SEQ ID NO: 1208091 - RNA, 16 nt, Human
uggugucaccugaaga

SEQ ID NO: 1208092 - RNA, 18 nt, Human
ugguugaugaucuuugca

SEQ ID NO: 1208093 - RNA, 19 nt, Human
uggugguuuucuguucuuu

SEQ ID NO: 1208094 - RNA, 18 nt, Human
uggugguuucagaaaugu

SEQ ID NO: 1208095 - RNA, 17 nt, Human
uggugguuucagaaaug

SEQ ID NO: 1208096 - RNA, 18 nt, Human
uggugggggccucggugu

SEQ ID NO: 1208097 - RNA, 16 nt, Human
uggugggggccucggu

SEQ ID NO: 1208098 - RNA, 13 nt, Human
ugguggcuggguu

SEQ ID NO: 1208099 - RNA, 14 nt, Human
uggugagaggcauc

SEQ ID NO: 1208100 - RNA, 23 nt, Human
uggguacuuguggacacagcucu

SEQ ID NO: 1208101 - RNA, 20 nt, Human
uggguacuuguggacacagc

SEQ ID NO: 1208102 - RNA, 20 nt, Human
uggugcaaugaccuuucaau

SEQ ID NO: 1208103 - RNA, 19 nt, Human
uggugcaaugaccuuucaa

SEQ ID NO: 1208104 - RNA, 14 nt, Human
uggugcaaugaccu

SEQ ID NO: 1208105 - RNA, 18 nt, Human
ugguggcagugggagcug

SEQ ID NO: 1208106 - RNA, 13 nt, Human
ugguggcaguggg

SEQ ID NO: 1208107 - RNA, 20 nt, Human
ugguggcagugggagcugcc

SEQ ID NO: 1208108 - RNA, 20 nt, Human
uguccugggagugagcuggu

SEQ ID NO: 1208109 - RNA, 19 nt, Human
uguccugggagugagcugg

SEQ ID NO: 1208110 - RNA, 12 nt, Human
uguccugggagu

SEQ ID NO: 1208111 - RNA, 14 nt, Human
ugucuaaugaaacc

SEQ ID NO: 1208112 - RNA, 19 nt, Human
uguccccgcacugggcuug

SEQ ID NO: 1208113 - RNA, 17 nt, Human
uguccccgcacugggcu

SEQ ID NO: 1208114 - RNA, 16 nt, Human
ugucuuuucuugcaug

SEQ ID NO: 1208115 - RNA, 23 nt, Human
ugucuuuggacccugaggcccag

SEQ ID NO: 1208116 - RNA, 16 nt, Human
ugucuaugggacucaa

SEQ ID NO: 1208117 - RNA, 15 nt, Human
ugucuaugggacuca

SEQ ID NO: 1208118 - RNA, 14 nt, Human
ugucuaugggacuc

SEQ ID NO: 1208119 - RNA, 23 nt, Human
ugucuaguuguuugauucagaca

SEQ ID NO: 1208120 - RNA, 15 nt, Human
ugucuaguuguuuga

SEQ ID NO: 1208121 - RNA, 21 nt, Human
ugucucaaaaaaagaaaaaga

SEQ ID NO: 1208122 - RNA, 14 nt, Human
ugucacaggcaggu

SEQ ID NO: 1208123 - RNA, 13 nt, Human
ugucacacacuuu

SEQ ID NO: 1208124 - RNA, 21 nt, Human
ugucaauuacaggaaguacug

SEQ ID NO: 1208125 - RNA, 19 nt, Human
uguauuuuacuaauaaaau

SEQ ID NO: 1208126 - RNA, 19 nt, Human
ugucagugugacugaucuc

SEQ ID NO: 1208127 - RNA, 16 nt, Human
ugucagugugacugau

SEQ ID NO: 1208128 - RNA, 15 nt, Human
ugucagugugacuga

SEQ ID NO: 1208129 - RNA, 21 nt, Human
ugucacaggcagguccagggu

SEQ ID NO: 1208130 - RNA, 17 nt, Human
ugucacaggcaggucca

SEQ ID NO: 1208131 - RNA, 16 nt, Human
ugucacaggcaggucc

SEQ ID NO: 1208132 - RNA, 15 nt, Human
ugucacaggcagguc

SEQ ID NO: 1208133 - RNA, 23 nt, Human
uguacagcaaggagauuuacaac

SEQ ID NO: 1208134 - RNA, 22 nt, Human
uguacagcaaggagauuuacaa

SEQ ID NO: 1208135 - RNA, 13 nt, Human
uguacagagccca

SEQ ID NO: 1208136 - RNA, 12 nt, Human
uguacagagccc

SEQ ID NO: 1208137 - RNA, 18 nt, Human
uguaggaagguuaauguu

SEQ ID NO: 1208138 - RNA, 13 nt, Human
uguaucugagcag

SEQ ID NO: 1208139 - RNA, 16 nt, Human
ugggaggaucucuuga

SEQ ID NO: 1208140 - RNA, 15 nt, Human
ugggacacccuguga

SEQ ID NO: 1208141 - RNA, 14 nt, Human
ugggacacccugug

SEQ ID NO: 1208142 - RNA, 21 nt, Human
ugggaaugaaugucaguguga

SEQ ID NO: 1208143 - RNA, 16 nt, Human
ugggaaugaaugucag

SEQ ID NO: 1208144 - RNA, 18 nt, Human
ugggaggaucucuugagc

SEQ ID NO: 1208145 - RNA, 18 nt, Human
ugggaugauuggaggggg

SEQ ID NO: 1208146 - RNA, 18 nt, Human
ugggcagagcagagacca

SEQ ID NO: 1208147 - RNA, 17 nt, Human
ugggcagagcagagacc

SEQ ID NO: 1208148 - RNA, 15 nt, Human
ugggcagagcagaga

SEQ ID NO: 1208149 - RNA, 14 nt, Human
ugggcagagcagag

SEQ ID NO: 1208150 - RNA, 19 nt, Human
uggggggcugaggugggag

SEQ ID NO: 1208151 - RNA, 16 nt, Human
ugggggccucagugcc

SEQ ID NO: 1208152 - RNA, 13 nt, Human
uggggcagcuuga

SEQ ID NO: 1208153 - RNA, 21 nt, Human
ugggcuugucuguagauuuua

SEQ ID NO: 1208154 - RNA, 17 nt, Human
ugggcuugucuguagau

SEQ ID NO: 1208155 - RNA, 23 nt, Human
ugggcuuggggaccagagcugcc

SEQ ID NO: 1208156 - RNA, 22 nt, Human
ugggcuucauccuccucagauc

SEQ ID NO: 1208157 - RNA, 15 nt, Human
ugggcuucauccucc

SEQ ID NO: 1208158 - RNA, 22 nt, Human
ugggcuucaguggcagcugcuu

SEQ ID NO: 1208159 - RNA, 14 nt, Human
ugggccuggcuccc

SEQ ID NO: 1208160 - RNA, 13 nt, Human
uggccucugcacu

SEQ ID NO: 1208161 - RNA, 16 nt, Human
uggcugcugaaggcuc

SEQ ID NO: 1208162 - RNA, 14 nt, Human
uggcugcugaaggc

SEQ ID NO: 1208163 - RNA, 13 nt, Human
uggcugcugaagg

SEQ ID NO: 1208164 - RNA, 22 nt, Human
uggcuuccuaaaauucagugga

SEQ ID NO: 1208165 - RNA, 20 nt, Human
uggccuagcauacguacaca

SEQ ID NO: 1208166 - RNA, 14 nt, Human
uggccccugcccgg

SEQ ID NO: 1208167 - RNA, 22 nt, Human
uggccccucagggucccuggug

SEQ ID NO: 1208168 - RNA, 21 nt, Human
uggccccucagggucccuggu

SEQ ID NO: 1208169 - RNA, 20 nt, Human
uggccccucagggucccugg

SEQ ID NO: 1208170 - RNA, 13 nt, Human
uggccccucaggg

SEQ ID NO: 1208171 - RNA, 19 nt, Human
uggcagcugcgguccaccc

SEQ ID NO: 1208172 - RNA, 17 nt, Human
uggcagcugcgguccac

SEQ ID NO: 1208173 - RNA, 23 nt, Human
uggccucccaacucaccccagcc

SEQ ID NO: 1208174 - RNA, 22 nt, Human
uggccucccaacucaccccagc

SEQ ID NO: 1208175 - RNA, 21 nt, Human
uggccucccaacucaccccag

SEQ ID NO: 1208176 - RNA, 20 nt, Human
uggccucccaacucacccca

SEQ ID NO: 1208177 - RNA, 19 nt, Human
uggccucccaacucacccc

SEQ ID NO: 1208178 - RNA, 14 nt, Human
uggccucccaacuc

SEQ ID NO: 1208179 - RNA, 11 nt, Human
uggccucccaa

SEQ ID NO: 1208180 - RNA, 23 nt, Human
uggccucaagugauucuccugcc

SEQ ID NO: 1208181 - RNA, 18 nt, Human
uggccucaagugauucuc

SEQ ID NO: 1208182 - RNA, 23 nt, Human
uggccuagcauacguacacauuu

SEQ ID NO: 1208183 - RNA, 18 nt, Human
ugcuugugaaaggaaaga

SEQ ID NO: 1208184 - RNA, 13 nt, Human
ugcuucuucagag

SEQ ID NO: 1208185 - RNA, 17 nt, Human
uggaacacucugagacu

SEQ ID NO: 1208186 - RNA, 15 nt, Human
uggaacacucugaga

SEQ ID NO: 1208187 - RNA, 23 nt, Human
ugcuuccagugaggcucugcccu

SEQ ID NO: 1208188 - RNA, 22 nt, Human
ugcuuccagugaggcucugccc

SEQ ID NO: 1208189 - RNA, 18 nt, Human
ugcuuaacuucacauauu

SEQ ID NO: 1208190 - RNA, 17 nt, Human
ugcuuaacuucacauau

SEQ ID NO: 1208191 - RNA, 14 nt, Human
ugcuuaacuucaca

SEQ ID NO: 1208192 - RNA, 13 nt, Human
ugcuuaacuucac

SEQ ID NO: 1208193 - RNA, 19 nt, Human
ugcuuaacuucacauauug

SEQ ID NO: 1208194 - RNA, 22 nt, Human
uggcacugcuuccagugaggcu

SEQ ID NO: 1208195 - RNA, 22 nt, Human
uggcacuauaauguaagcucua

SEQ ID NO: 1208196 - RNA, 19 nt, Human
uggcacugcuuccagugag

SEQ ID NO: 1208197 - RNA, 17 nt, Human
uggauuuaacagaaaug

SEQ ID NO: 1208198 - RNA, 15 nt, Human
uggauuuaacagaaa

SEQ ID NO: 1208199 - RNA, 21 nt, Human
uggcacuauaauguaagcucu

SEQ ID NO: 1208200 - RNA, 22 nt, Human
uggaugcagccucacaguccuu

SEQ ID NO: 1208201 - RNA, 21 nt, Human
uggaugcagccucacaguccu

SEQ ID NO: 1208202 - RNA, 13 nt, Human
uggaugcagccuc

SEQ ID NO: 1208203 - RNA, 23 nt, Human
uggaggggggaggugggauccuc

SEQ ID NO: 1208204 - RNA, 20 nt, Human
uggacuaacuugucuuugga

SEQ ID NO: 1208205 - RNA, 19 nt, Human
uggacuaacuugucuuugg

SEQ ID NO: 1208206 - RNA, 23 nt, Human
uggacguguuaugacuccagaau

SEQ ID NO: 1208207 - RNA, 19 nt, Human
uggacguguuaugacucca

SEQ ID NO: 1208208 - RNA, 23 nt, Human
uggacaggcauguucucugagga

SEQ ID NO: 1208209 - RNA, 22 nt, Human
uggacaggcauguucucugagg

SEQ ID NO: 1208210 - RNA, 18 nt, Human
uggacaggcauguucucu

SEQ ID NO: 1208211 - RNA, 18 nt, Human
ugagucgaggacagggag

SEQ ID NO: 1208212 - RNA, 19 nt, Human
ugaguugauucagcucugc

SEQ ID NO: 1208213 - RNA, 16 nt, Human
ugaguugauucagcuc

SEQ ID NO: 1208214 - RNA, 23 nt, Human
ugaguugauagcacagacccugc

SEQ ID NO: 1208215 - RNA, 16 nt, Human
ugagucgaggacaggg

SEQ ID NO: 1208216 - RNA, 15 nt, Human
ugagucgaggacagg

SEQ ID NO: 1208217 - RNA, 21 nt, Human
ugauagcacagacccugcccu

SEQ ID NO: 1208218 - RNA, 20 nt, Human
ugauagcacagacccugccc

SEQ ID NO: 1208219 - RNA, 18 nt, Human
ugauagcacagacccugc

SEQ ID NO: 1208220 - RNA, 17 nt, Human
ugauagcacagacccug

SEQ ID NO: 1208221 - RNA, 16 nt, Human
ugauagcacagacccu

SEQ ID NO: 1208222 - RNA, 15 nt, Human
ugauagcacagaccc

SEQ ID NO: 1208223 - RNA, 23 nt, Human
ugauagcacagacccugcccugu

SEQ ID NO: 1208224 - RNA, 22 nt, Human
ugauagcacagacccugcccug

SEQ ID NO: 1208225 - RNA, 11 nt, Human
ugaggcugggc

SEQ ID NO: 1208226 - RNA, 20 nt, Human
ugaggucuguucuuuccaaa

SEQ ID NO: 1208227 - RNA, 15 nt, Human
ugaggucuguucuuu

SEQ ID NO: 1208228 - RNA, 14 nt, Human
ugaggucuguucuu

SEQ ID NO: 1208229 - RNA, 16 nt, Human
ugaggugcuauguucu

SEQ ID NO: 1208230 - RNA, 21 nt, Human
ugaguccccuguuuguuucug

SEQ ID NO: 1208231 - RNA, 19 nt, Human
ugagguuucaaaccucccu

SEQ ID NO: 1208232 - RNA, 14 nt, Human
ugagucgaggacag

SEQ ID NO: 1208233 - RNA, 22 nt, Human
ugaguccuggcaugggaaugaa

SEQ ID NO: 1208234 - RNA, 19 nt, Human
ugaguccuggcaugggaau

SEQ ID NO: 1208235 - RNA, 18 nt, Human
ugaguccuggcaugggaa

SEQ ID NO: 1208236 - RNA, 11 nt, Human
ugaguccuggc

SEQ ID NO: 1208237 - RNA, 20 nt, Human
ugaugaugaaaugaggucag

SEQ ID NO: 1208238 - RNA, 23 nt, Human
ugaugaucuuugcagacaggcaa

SEQ ID NO: 1208239 - RNA, 14 nt, Human
ugaugccaugagga

SEQ ID NO: 1208240 - RNA, 23 nt, Human
ugaucuuugcagacaggcaagca

SEQ ID NO: 1208241 - RNA, 21 nt, Human
ugaucuuugcagacaggcaag

SEQ ID NO: 1208242 - RNA, 20 nt, Human
ugaucuuugcagacaggcaa

SEQ ID NO: 1208243 - RNA, 19 nt, Human
ugaucuuugcagacaggca

SEQ ID NO: 1208244 - RNA, 23 nt, Human
ugaugcuucuucagagacuccug

SEQ ID NO: 1208245 - RNA, 22 nt, Human
ugaugcuucuucagagacuccu

SEQ ID NO: 1208246 - RNA, 21 nt, Human
ugaugcuucuucagagacucc

SEQ ID NO: 1208247 - RNA, 19 nt, Human
ugaugcuucuucagagacu

SEQ ID NO: 1208248 - RNA, 22 nt, Human
ugaucacggcucacugcagccu

SEQ ID NO: 1208249 - RNA, 20 nt, Human
ugauccacccaccucagccu

SEQ ID NO: 1208250 - RNA, 16 nt, Human
ugauccacccaccuca

SEQ ID NO: 1208251 - RNA, 15 nt, Human
ugauccacccaccuc

SEQ ID NO: 1208252 - RNA, 21 nt, Human
ugauccaagcuggucccacuc

SEQ ID NO: 1208253 - RNA, 24 nt, Human
ugaucauccacugugccaugugcc

SEQ ID NO: 1208254 - RNA, 13 nt, Human
ugaucauccacug

SEQ ID NO: 1208255 - RNA, 21 nt, Human
ugaucuaggaagacuuuggaa

SEQ ID NO: 1208256 - RNA, 19 nt, Human
ugaucuaggaagacuuugg

SEQ ID NO: 1208257 - RNA, 22 nt, Human
ugauccacccaccucagccucc

SEQ ID NO: 1208258 - RNA, 21 nt, Human
ugauccacccaccucagccuc

SEQ ID NO: 1208259 - RNA, 15 nt, Human
ugagccucagcaucc

SEQ ID NO: 1208260 - RNA, 13 nt, Human
ugagccucagcau

SEQ ID NO: 1208261 - RNA, 16 nt, Human
ugagcaucaggccagg

SEQ ID NO: 1208262 - RNA, 15 nt, Human
ugagcaucaggccag

SEQ ID NO: 1208263 - RNA, 14 nt, Human
ugagcaucaggcca

SEQ ID NO: 1208264 - RNA, 13 nt, Human
ugagcaucaggcc

SEQ ID NO: 1208265 - RNA, 17 nt, Human
ugagaguagagucacug

SEQ ID NO: 1208266 - RNA, 23 nt, Human
ugagaggcauccaguaucuugaa

SEQ ID NO: 1208267 - RNA, 22 nt, Human
ugagaggcauccaguaucuuga

SEQ ID NO: 1208268 - RNA, 14 nt, Human
ugagacucugucuc

SEQ ID NO: 1208269 - RNA, 13 nt, Human
ugagacucugucu

SEQ ID NO: 1208270 - RNA, 12 nt, Human
ugagacucuguc

SEQ ID NO: 1208271 - RNA, 12 nt, Human
ugagacccuguc

SEQ ID NO: 1208272 - RNA, 15 nt, Human
ugacugaauuucuuu

SEQ ID NO: 1208273 - RNA, 14 nt, Human
ugacugaauuucuu

SEQ ID NO: 1208274 - RNA, 13 nt, Human
ugacugaauuucu

SEQ ID NO: 1208275 - RNA, 20 nt, Human
ugacgccaucccagccccaa

SEQ ID NO: 1208276 - RNA, 19 nt, Human
ugacgccaucccagcccca

SEQ ID NO: 1208277 - RNA, 18 nt, Human
ugacgccaucccagcccc

SEQ ID NO: 1208278 - RNA, 17 nt, Human
ugacgccaucccagccc

SEQ ID NO: 1208279 - RNA, 16 nt, Human
ugacgccaucccagcc

SEQ ID NO: 1208280 - RNA, 15 nt, Human
ugacgccaucccagc

SEQ ID NO: 1208281 - RNA, 14 nt, Human
ugacgccaucccag

SEQ ID NO: 1208282 - RNA, 13 nt, Human
ugacgccauccca

SEQ ID NO: 1208283 - RNA, 22 nt, Human
ugaccuuucaauaggaaaaacu

SEQ ID NO: 1208284 - RNA, 18 nt, Human
ugaccuuucaauaggaaa

SEQ ID NO: 1208285 - RNA, 22 nt, Human
ugaccauucuccaccugccagg

SEQ ID NO: 1208286 - RNA, 21 nt, Human
ugaccauucuccaccugccag

SEQ ID NO: 1208287 - RNA, 20 nt, Human
ugaccauucuccaccugcca

SEQ ID NO: 1208288 - RNA, 17 nt, Human
ucuugaauuguaaggaa

SEQ ID NO: 1208289 - RNA, 15 nt, Human
ucuugaacuccuggc

SEQ ID NO: 1208290 - RNA, 23 nt, Human
ugaccauucuccaccugccaggg

SEQ ID NO: 1208291 - RNA, 16 nt, Human
ugaccuuucaauagga

SEQ ID NO: 1208292 - RNA, 15 nt, Human
ugaccuuucaauagg

SEQ ID NO: 1208293 - RNA, 14 nt, Human
ugaccuuucaauag

SEQ ID NO: 1208294 - RNA, 12 nt, Human
ugaccucugccu

SEQ ID NO: 1208295 - RNA, 23 nt, Human
ugaccucugcagcaauaaagcag

SEQ ID NO: 1208296 - RNA, 21 nt, Human
ugaccucugcagcaauaaagc

SEQ ID NO: 1208297 - RNA, 18 nt, Human
ugaccucugcagcaauaa

SEQ ID NO: 1208298 - RNA, 16 nt, Human
ugaccucugcagcaau

SEQ ID NO: 1208299 - RNA, 13 nt, Human
ugaccucugcagc

SEQ ID NO: 1208300 - RNA, 22 nt, Human
ugaccucaggugauccacccac

SEQ ID NO: 1208301 - RNA, 18 nt, Human
ugcauuaucuagauacug

SEQ ID NO: 1208302 - RNA, 17 nt, Human
ugcauuaucuagauacu

SEQ ID NO: 1208303 - RNA, 12 nt, Human
ugcauuaucuag

SEQ ID NO: 1208304 - RNA, 15 nt, Human
ugcauguuugugauu

SEQ ID NO: 1208305 - RNA, 12 nt, Human
ugccauccaggu

SEQ ID NO: 1208306 - RNA, 20 nt, Human
ugccauccagguucagcuug

SEQ ID NO: 1208307 - RNA, 15 nt, Human
ugccauccagguuca

SEQ ID NO: 1208308 - RNA, 17 nt, Human
ugccagguuuuuggucu

SEQ ID NO: 1208309 - RNA, 19 nt, Human
ugccaggaagccagcaggc

SEQ ID NO: 1208310 - RNA, 18 nt, Human
ugccaggaagccagcagg

SEQ ID NO: 1208311 - RNA, 16 nt, Human
ugccaggaagccagca

SEQ ID NO: 1208312 - RNA, 12 nt, Human
ugccaggaagcc

SEQ ID NO: 1208313 - RNA, 13 nt, Human
ugcccacucccug

SEQ ID NO: 1208314 - RNA, 18 nt, Human
ugcccacgcuggagugca

SEQ ID NO: 1208315 - RNA, 20 nt, Human
ugcccaccuggccucugcac

SEQ ID NO: 1208316 - RNA, 16 nt, Human
ugccauguuggccagg

SEQ ID NO: 1208317 - RNA, 15 nt, Human
ugccauguuggccag

SEQ ID NO: 1208318 - RNA, 12 nt, Human
ugccauguuggc

SEQ ID NO: 1208319 - RNA, 15 nt, Human
ugccaugugccaggu

SEQ ID NO: 1208320 - RNA, 14 nt, Human
ugccaugugccagg

SEQ ID NO: 1208321 - RNA, 23 nt, Human
ugccaugaggaacaaggcaaggc

SEQ ID NO: 1208322 - RNA, 20 nt, Human
ugccaugaggaacaaggcaa

SEQ ID NO: 1208323 - RNA, 23 nt, Human
ugcccugcccaccuggccucugc

SEQ ID NO: 1208324 - RNA, 22 nt, Human
ugcccugcccaccuggccucug

SEQ ID NO: 1208325 - RNA, 19 nt, Human
ugcccuaaaguguauuuuu

SEQ ID NO: 1208326 - RNA, 17 nt, Human
ugcccuaaaguguauuu

SEQ ID NO: 1208327 - RNA, 19 nt, Human
ugccgucuaccugaggggc

SEQ ID NO: 1208328 - RNA, 17 nt, Human
ugccgucuaccugaggg

SEQ ID NO: 1208329 - RNA, 16 nt, Human
ugccgucuaccugagg

SEQ ID NO: 1208330 - RNA, 15 nt, Human
ugccgucuaccugag

SEQ ID NO: 1208331 - RNA, 19 nt, Human
ugccugguggcagcugcgg

SEQ ID NO: 1208332 - RNA, 18 nt, Human
ugccugguggcagcugcg

SEQ ID NO: 1208333 - RNA, 17 nt, Human
ugccugguggcagcugc

SEQ ID NO: 1208334 - RNA, 13 nt, Human
ugccugcccaggc

SEQ ID NO: 1208335 - RNA, 21 nt, Human
ugccucuucucuacucuaggg

SEQ ID NO: 1208336 - RNA, 22 nt, Human
ugccuccuuugugaggaagccg

SEQ ID NO: 1208337 - RNA, 21 nt, Human
ugccuccuuugugaggaagcc

SEQ ID NO: 1208338 - RNA, 14 nt, Human
ugccucugggacug

SEQ ID NO: 1208339 - RNA, 13 nt, Human
ugccucugggacu

SEQ ID NO: 1208340 - RNA, 20 nt, Human
ugauuuuuuuuuccuucagu

SEQ ID NO: 1208341 - RNA, 19 nt, Human
ugauuuuuuuuuccuucag

SEQ ID NO: 1208342 - RNA, 17 nt, Human
ugauuuuuuuuuccuuc

SEQ ID NO: 1208343 - RNA, 16 nt, Human
ugauuuuuuuuuccuu

SEQ ID NO: 1208344 - RNA, 23 nt, Human
ugauuuuuuuuuccuucagugcc

SEQ ID NO: 1208345 - RNA, 22 nt, Human
ugauuuuuuuuuccuucagugc

SEQ ID NO: 1208346 - RNA, 15 nt, Human
ugauuuucauugcug

SEQ ID NO: 1208347 - RNA, 13 nt, Human
ugauuuucauugc

SEQ ID NO: 1208348 - RNA, 22 nt, Human
ugcaaccugauugugucucuug

SEQ ID NO: 1208349 - RNA, 20 nt, Human
ugcaaccugauugugucucu

SEQ ID NO: 1208350 - RNA, 19 nt, Human
ugcaaccugauugugucuc

SEQ ID NO: 1208351 - RNA, 21 nt, Human
ugcaaccuccgccucuugggu

SEQ ID NO: 1208352 - RNA, 20 nt, Human
ugcaaccuccgccucuuggg

SEQ ID NO: 1208353 - RNA, 18 nt, Human
ugcaaccuccgccucuug

SEQ ID NO: 1208354 - RNA, 14 nt, Human
ugcaaccuccgccu

SEQ ID NO: 1208355 - RNA, 13 nt, Human
ugcaaccuccgcc

SEQ ID NO: 1208356 - RNA, 20 nt, Human
ugcaacaggcugggcuucag

SEQ ID NO: 1208357 - RNA, 19 nt, Human
ugcaacaggcugggcuuca

SEQ ID NO: 1208358 - RNA, 17 nt, Human
ugcaacaggcugggcuu

SEQ ID NO: 1208359 - RNA, 16 nt, Human
ugcaacaggcugggcu

SEQ ID NO: 1208360 - RNA, 15 nt, Human
ugcaacaggcugggc

SEQ ID NO: 1208361 - RNA, 14 nt, Human
ugcaacaggcuggg

SEQ ID NO: 1208362 - RNA, 16 nt, Human
ugcaauggcagccuug

SEQ ID NO: 1208363 - RNA, 15 nt, Human
ugcaauggcagccuu

SEQ ID NO: 1208364 - RNA, 14 nt, Human
ugcaauggcagccu

SEQ ID NO: 1208365 - RNA, 13 nt, Human
ugcaauggcagcc

SEQ ID NO: 1208366 - RNA, 23 nt, Human
ugcaaugaccuuucaauaggaaa

SEQ ID NO: 1208367 - RNA, 22 nt, Human
ugcaaugaccuuucaauaggaa

SEQ ID NO: 1208368 - RNA, 19 nt, Human
ugcaaugaccuuucaauag

SEQ ID NO: 1208369 - RNA, 17 nt, Human
ugcaaugaccuuucaau

SEQ ID NO: 1208370 - RNA, 16 nt, Human
ugcaaugaccuuucaa

SEQ ID NO: 1208371 - RNA, 13 nt, Human
ugcaaugaccuuu

SEQ ID NO: 1208372 - RNA, 16 nt, Human
ugcacaaacagaggcc

SEQ ID NO: 1208373 - RNA, 15 nt, Human
ugcacaaacagaggc

SEQ ID NO: 1208374 - RNA, 20 nt, Human
ugcacaaacagaggccgcca

SEQ ID NO: 1208375 - RNA, 19 nt, Human
ugcacaaacagaggccgcc

SEQ ID NO: 1208376 - RNA, 17 nt, Human
ugcacaaacagaggccg

SEQ ID NO: 1208377 - RNA, 19 nt, Human
ugcacagaguuguuacauu

SEQ ID NO: 1208378 - RNA, 18 nt, Human
ugcacagaguuguuacau

SEQ ID NO: 1208379 - RNA, 17 nt, Human
ugcacagaguuguuaca

SEQ ID NO: 1208380 - RNA, 21 nt, Human
ugcacugacauuguuggccaa

SEQ ID NO: 1208381 - RNA, 18 nt, Human
ugcacugacauuguuggc

SEQ ID NO: 1208382 - RNA, 16 nt, Human
ugcacuugcagacucu

SEQ ID NO: 1208383 - RNA, 22 nt, Human
ugcaccuggaauauauaaccag

SEQ ID NO: 1208384 - RNA, 20 nt, Human
ugcaccuggaauauauaacc

SEQ ID NO: 1208385 - RNA, 17 nt, Human
ugcaccuggaauauaua

SEQ ID NO: 1208386 - RNA, 21 nt, Human
ugcaccggcuggccuggcccc

SEQ ID NO: 1208387 - RNA, 20 nt, Human
ugcaccggcuggccuggccc

SEQ ID NO: 1208388 - RNA, 19 nt, Human
ugcaccggcuggccuggcc

SEQ ID NO: 1208389 - RNA, 20 nt, Human
ugcacagaguuguuacauuu

SEQ ID NO: 1208390 - RNA, 14 nt, Human
ucugccugcccagg

SEQ ID NO: 1208391 - RNA, 18 nt, Human
ucugccauauucuguugg

SEQ ID NO: 1208392 - RNA, 18 nt, Human
ucugcugacagacacagg

SEQ ID NO: 1208393 - RNA, 21 nt, Human
ucugcuccucuccccagcaag

SEQ ID NO: 1208394 - RNA, 18 nt, Human
ucugcuccucuccccagc

SEQ ID NO: 1208395 - RNA, 16 nt, Human
ucugccugcccaggcc

SEQ ID NO: 1208396 - RNA, 15 nt, Human
ucugccugcccaggc

SEQ ID NO: 1208397 - RNA, 21 nt, Human
ucuggacaggcauguucucug

SEQ ID NO: 1208398 - RNA, 14 nt, Human
ucuggacaggcaug

SEQ ID NO: 1208399 - RNA, 16 nt, Human
ucuggaaugcaguggu

SEQ ID NO: 1208400 - RNA, 15 nt, Human
ucuggaaugcagugg

SEQ ID NO: 1208401 - RNA, 22 nt, Human
ucugcugacagacacaggcccg

SEQ ID NO: 1208402 - RNA, 21 nt, Human
ucugcugacagacacaggccc

SEQ ID NO: 1208403 - RNA, 20 nt, Human
ucugcugacagacacaggcc

SEQ ID NO: 1208404 - RNA, 19 nt, Human
ucugcugacagacacaggc

SEQ ID NO: 1208405 - RNA, 14 nt, Human
ucugggacacaguu

SEQ ID NO: 1208406 - RNA, 23 nt, Human
ucuggugacuuuccucuuugguc

SEQ ID NO: 1208407 - RNA, 23 nt, Human
ucuggcucuuccaggcugggaga

SEQ ID NO: 1208408 - RNA, 22 nt, Human
ucuggcuaugcauuugaaaauu

SEQ ID NO: 1208409 - RNA, 19 nt, Human
ucuggcuaugcauuugaaa

SEQ ID NO: 1208410 - RNA, 16 nt, Human
ucugucgcccagucug

SEQ ID NO: 1208411 - RNA, 14 nt, Human
ucugucgcccaguc

SEQ ID NO: 1208412 - RNA, 20 nt, Human
ucuguccuacucugugucag

SEQ ID NO: 1208413 - RNA, 19 nt, Human
ucuguccuacucuguguca

SEQ ID NO: 1208414 - RNA, 15 nt, Human
ucuguccuacucugu

SEQ ID NO: 1208415 - RNA, 22 nt, Human
ucuuaaauauguggaguucauc

SEQ ID NO: 1208416 - RNA, 13 nt, Human
ucuuaaaaagugg

SEQ ID NO: 1208417 - RNA, 12 nt, Human
ucuugaacuccu

SEQ ID NO: 1208418 - RNA, 23 nt, Human
ucuucagaucucuaacuucacca

SEQ ID NO: 1208419 - RNA, 18 nt, Human
ucuucagaucucuaacuu

SEQ ID NO: 1208420 - RNA, 17 nt, Human
ucucugaggacacuaac

SEQ ID NO: 1208421 - RNA, 16 nt, Human
ucucuaguuugauuaa

SEQ ID NO: 1208422 - RNA, 15 nt, Human
ucucuaguuugauua

SEQ ID NO: 1208423 - RNA, 19 nt, Human
ucucuaacuucaccauauu

SEQ ID NO: 1208424 - RNA, 12 nt, Human
ucucuaacuuca

SEQ ID NO: 1208425 - RNA, 22 nt, Human
ucucgugauugauaagaaccuu

SEQ ID NO: 1208426 - RNA, 14 nt, Human
ucucgugauugaua

SEQ ID NO: 1208427 - RNA, 19 nt, Human
ucuccuguaccucuugagc

SEQ ID NO: 1208428 - RNA, 17 nt, Human
ucuccuguaccucuuga

SEQ ID NO: 1208429 - RNA, 16 nt, Human
ucuccuguaccucuug

SEQ ID NO: 1208430 - RNA, 15 nt, Human
ucuccuguaccucuu

SEQ ID NO: 1208431 - RNA, 21 nt, Human
ucuccuggaaauauuaagaaa

SEQ ID NO: 1208432 - RNA, 19 nt, Human
ucuccugccucagccuccc

SEQ ID NO: 1208433 - RNA, 15 nt, Human
ucuccugccucagcc

SEQ ID NO: 1208434 - RNA, 17 nt, Human
ucuccugccucagccuc

SEQ ID NO: 1208435 - RNA, 21 nt, Human
ucugcaagaauugaagcagga

SEQ ID NO: 1208436 - RNA, 20 nt, Human
ucugcaagaauugaagcagg

SEQ ID NO: 1208437 - RNA, 15 nt, Human
ucugacccacugcuu

SEQ ID NO: 1208438 - RNA, 14 nt, Human
ucugacccacugcu

SEQ ID NO: 1208439 - RNA, 19 nt, Human
ucugacacacagcucuguc

SEQ ID NO: 1208440 - RNA, 18 nt, Human
ucugacacacagcucugu

SEQ ID NO: 1208441 - RNA, 17 nt, Human
ucugacacacagcucug

SEQ ID NO: 1208442 - RNA, 16 nt, Human
ucugacacacagcucu

SEQ ID NO: 1208443 - RNA, 13 nt, Human
ucugacccacugc

SEQ ID NO: 1208444 - RNA, 22 nt, Human
ucugacaggcaaugcuggcugu

SEQ ID NO: 1208445 - RNA, 21 nt, Human
ucugacaggcaaugcuggcug

SEQ ID NO: 1208446 - RNA, 12 nt, Human
ucugacaggcaa

SEQ ID NO: 1208447 - RNA, 14 nt, Human
ucugaaaauguaug

SEQ ID NO: 1208448 - RNA, 13 nt, Human
ucugaaaauguau

SEQ ID NO: 1208449 - RNA, 21 nt, Human
ucuaaaucuccaaaauaaaac

SEQ ID NO: 1208450 - RNA, 22 nt, Human
ucuaaaucuccaaaauaaaacu

SEQ ID NO: 1208451 - RNA, 16 nt, Human
ucgugauugauaagaa

SEQ ID NO: 1208452 - RNA, 18 nt, Human
ucuaggaggucucuaaga

SEQ ID NO: 1208453 - RNA, 14 nt, Human
ucuaauauguaaca

SEQ ID NO: 1208454 - RNA, 17 nt, Human
ucucaaauaacuaaaag

SEQ ID NO: 1208455 - RNA, 22 nt, Human
ucuaucaaguauuauaccuuuu

SEQ ID NO: 1208456 - RNA, 21 nt, Human
ucuaucaaguauuauaccuuu

SEQ ID NO: 1208457 - RNA, 15 nt, Human
ucuaucaaguauuau

SEQ ID NO: 1208458 - RNA, 20 nt, Human
uccuucaccuuuguccccac

SEQ ID NO: 1208459 - RNA, 18 nt, Human
uccuucaccuuugucccc

SEQ ID NO: 1208460 - RNA, 20 nt, Human
uccuuaccagcagagcaccu

SEQ ID NO: 1208461 - RNA, 19 nt, Human
uccuucacagaugggugcu

SEQ ID NO: 1208462 - RNA, 18 nt, Human
uccuucacagaugggugc

SEQ ID NO: 1208463 - RNA, 18 nt, Human
uccuuaccagcagagcac

SEQ ID NO: 1208464 - RNA, 17 nt, Human
uccuuaccagcagagca

SEQ ID NO: 1208465 - RNA, 16 nt, Human
uccuuaccagcagagc

SEQ ID NO: 1208466 - RNA, 22 nt, Human
uccuucaccuuuguccccaccg

SEQ ID NO: 1208467 - RNA, 21 nt, Human
uccuucaccuuuguccccacc

SEQ ID NO: 1208468 - RNA, 18 nt, Human
uccuuuucgcaggauucu

SEQ ID NO: 1208469 - RNA, 13 nt, Human
ucgaacuggcugc

SEQ ID NO: 1208470 - RNA, 23 nt, Human
uccuuuucacaguucucuccuuc

SEQ ID NO: 1208471 - RNA, 22 nt, Human
uccuguaccucuugagccuuga

SEQ ID NO: 1208472 - RNA, 20 nt, Human
uccuguaccucuugagccuu

SEQ ID NO: 1208473 - RNA, 22 nt, Human
uccuggcacugcuuccagugag

SEQ ID NO: 1208474 - RNA, 18 nt, Human
uccuggcacugcuuccag

SEQ ID NO: 1208475 - RNA, 22 nt, Human
uccuggcacccggccccugcug

SEQ ID NO: 1208476 - RNA, 21 nt, Human
uccuggcacccggccccugcu

SEQ ID NO: 1208477 - RNA, 20 nt, Human
uccuggcacccggccccugc

SEQ ID NO: 1208478 - RNA, 19 nt, Human
uccuggcacccggccccug

SEQ ID NO: 1208479 - RNA, 16 nt, Human
uccuggcacccggccc

SEQ ID NO: 1208480 - RNA, 14 nt, Human
uccuggcacccggc

SEQ ID NO: 1208481 - RNA, 17 nt, Human
uccugccucagccuccc

SEQ ID NO: 1208482 - RNA, 16 nt, Human
uccugccucagccucc

SEQ ID NO: 1208483 - RNA, 15 nt, Human
uccugccucagccuc

SEQ ID NO: 1208484 - RNA, 13 nt, Human
uccugccucagcc

SEQ ID NO: 1208485 - RNA, 13 nt, Human
uccugagccagau

SEQ ID NO: 1208486 - RNA, 14 nt, Human
uccugagccagauu

SEQ ID NO: 1208487 - RNA, 14 nt, Human
uccugccucagccu

SEQ ID NO: 1208488 - RNA, 16 nt, Human
ucccuauuagagaaga

SEQ ID NO: 1208489 - RNA, 21 nt, Human
uccccuguuuguuucugaaag

SEQ ID NO: 1208490 - RNA, 20 nt, Human
uccccuguuuguuucugaaa

SEQ ID NO: 1208491 - RNA, 18 nt, Human
uccagguuuaagcuguua

SEQ ID NO: 1208492 - RNA, 17 nt, Human
uccagguuuaagcuguu

SEQ ID NO: 1208493 - RNA, 14 nt, Human
ucccuucccaccuc

SEQ ID NO: 1208494 - RNA, 13 nt, Human
ucccuucccaccu

SEQ ID NO: 1208495 - RNA, 20 nt, Human
ucccugcacuugcagacucu

SEQ ID NO: 1208496 - RNA, 14 nt, Human
ucccugcacuugca

SEQ ID NO: 1208497 - RNA, 13 nt, Human
ucccugcacuugc

SEQ ID NO: 1208498 - RNA, 16 nt, Human
uccuaaucuucugaac

SEQ ID NO: 1208499 - RNA, 17 nt, Human
uccgaccagacaccuug

SEQ ID NO: 1208500 - RNA, 13 nt, Human
uccgaccagacac

SEQ ID NO: 1208501 - RNA, 18 nt, Human
uccuacccacccuccuuu

SEQ ID NO: 1208502 - RNA, 17 nt, Human
uccucauuagcauuuug

SEQ ID NO: 1208503 - RNA, 21 nt, Human
uccuauauuguuuucagugua

SEQ ID NO: 1208504 - RNA, 18 nt, Human
uccuauauuguuuucagu

SEQ ID NO: 1208505 - RNA, 14 nt, Human
uccucuaggagguc

SEQ ID NO: 1208506 - RNA, 19 nt, Human
uccuccuuuucacaguucu

SEQ ID NO: 1208507 - RNA, 17 nt, Human
uccucugcugcuggcug

SEQ ID NO: 1208508 - RNA, 16 nt, Human
uccucugcugcuggcu

SEQ ID NO: 1208509 - RNA, 15 nt, Human
uccucugcugcuggc

SEQ ID NO: 1208510 - RNA, 14 nt, Human
uccucugcugcugg

SEQ ID NO: 1208511 - RNA, 17 nt, Human
uccucuaggaggucucu

SEQ ID NO: 1208512 - RNA, 19 nt, Human
uccucuguacagagcccac

SEQ ID NO: 1208513 - RNA, 18 nt, Human
uccucuguacagagccca

SEQ ID NO: 1208514 - RNA, 17 nt, Human
uccucuguacagagccc

SEQ ID NO: 1208515 - RNA, 16 nt, Human
uccucuguacagagcc

SEQ ID NO: 1208516 - RNA, 22 nt, Human
uauuguuuucaguguacaugga

SEQ ID NO: 1208517 - RNA, 20 nt, Human
uauuguuuucaguguacaug

SEQ ID NO: 1208518 - RNA, 18 nt, Human
uauuguuuucaguguaca

SEQ ID NO: 1208519 - RNA, 12 nt, Human
uauuguuuucag

SEQ ID NO: 1208520 - RNA, 18 nt, Human
uauucucuccuguaccuc

SEQ ID NO: 1208521 - RNA, 17 nt, Human
uauucucuccuguaccu

SEQ ID NO: 1208522 - RNA, 22 nt, Human
uauuggaaauuuguuauaauga

SEQ ID NO: 1208523 - RNA, 22 nt, Human
uauugcugauggugcaaugacc

SEQ ID NO: 1208524 - RNA, 17 nt, Human
uauugcugauggugcaa

SEQ ID NO: 1208525 - RNA, 15 nt, Human
gggaguggccacaga

SEQ ID NO: 1208526 - RNA, 13 nt, Human
gggaguggccaca

SEQ ID NO: 1208527 - RNA, 12 nt, Human
uauuaaauuaug

SEQ ID NO: 1208528 - RNA, 20 nt, Human
uauguugcccaggcaggucu

SEQ ID NO: 1208529 - RNA, 19 nt, Human
uauguugcccaggcagguc

SEQ ID NO: 1208530 - RNA, 16 nt, Human
uauguugcccaggcag

SEQ ID NO: 1208531 - RNA, 13 nt, Human
uauguugcccagg

SEQ ID NO: 1208532 - RNA, 23 nt, Human
ucaaccccuucgcuccugugucu

SEQ ID NO: 1208533 - RNA, 15 nt, Human
ucaaaaaaagaaaaa

SEQ ID NO: 1208534 - RNA, 14 nt, Human
ucaaaaaaagaaaa

SEQ ID NO: 1208535 - RNA, 17 nt, Human
uauuuuuuucuuuucuu

SEQ ID NO: 1208536 - RNA, 15 nt, Human
uauuuuuuuacuaau

SEQ ID NO: 1208537 - RNA, 14 nt, Human
uauuuuuuuacuaa

SEQ ID NO: 1208538 - RNA, 22 nt, Human
uauuuucccuauuagagaagag

SEQ ID NO: 1208539 - RNA, 17 nt, Human
uauuuuauuaugcauga

SEQ ID NO: 1208540 - RNA, 14 nt, Human
uauuuuauuaugca

SEQ ID NO: 1208541 - RNA, 23 nt, Human
ucaauuacaggaaguacuggaga

SEQ ID NO: 1208542 - RNA, 21 nt, Human
ucaauuacaggaaguacugga

SEQ ID NO: 1208543 - RNA, 21 nt, Human
ucaagugauucuccugccuca

SEQ ID NO: 1208544 - RNA, 20 nt, Human
ucaagugauucuccugccuc

SEQ ID NO: 1208545 - RNA, 16 nt, Human
ucaccacaugugcaca

SEQ ID NO: 1208546 - RNA, 21 nt, Human
ucaccaaaucagcugcuacua

SEQ ID NO: 1208547 - RNA, 20 nt, Human
ucaccaaaucagcugcuacu

SEQ ID NO: 1208548 - RNA, 19 nt, Human
ucaccaaaucagcugcuac

SEQ ID NO: 1208549 - RNA, 19 nt, Human
ucacauuuauucugcucac

SEQ ID NO: 1208550 - RNA, 18 nt, Human
ucacauuuauucugcuca

SEQ ID NO: 1208551 - RNA, 17 nt, Human
ucacauuuauucugcuc

SEQ ID NO: 1208552 - RNA, 23 nt, Human
ucacaguccuuaccagcagagca

SEQ ID NO: 1208553 - RNA, 22 nt, Human
ucacaguccuuaccagcagagc

SEQ ID NO: 1208554 - RNA, 19 nt, Human
ucacaguccuuaccagcag

SEQ ID NO: 1208555 - RNA, 19 nt, Human
ucacaggcagguccagggu

SEQ ID NO: 1208556 - RNA, 18 nt, Human
ucacaggcagguccaggg

SEQ ID NO: 1208557 - RNA, 17 nt, Human
ucacaggcagguccagg

SEQ ID NO: 1208558 - RNA, 21 nt, Human
ucauucaacccaccugcgucu

SEQ ID NO: 1208559 - RNA, 16 nt, Human
ucauuuccugugucuu

SEQ ID NO: 1208560 - RNA, 13 nt, Human
ucauuuccugugu

SEQ ID NO: 1208561 - RNA, 19 nt, Human
ucaucuugaauuguaagga

SEQ ID NO: 1208562 - RNA, 23 nt, Human
ucaucuuagguuggcaaaaaggc

SEQ ID NO: 1208563 - RNA, 15 nt, Human
ucaggugcugccauc

SEQ ID NO: 1208564 - RNA, 14 nt, Human
ucaggugcugccau

SEQ ID NO: 1208565 - RNA, 13 nt, Human
ucaggugcugcca

SEQ ID NO: 1208566 - RNA, 23 nt, Human
ucaggugagaagcagaggaagga

SEQ ID NO: 1208567 - RNA, 21 nt, Human
ucaggugagaagcagaggaag

SEQ ID NO: 1208568 - RNA, 21 nt, Human
ucaucaccaacgucugugcca

SEQ ID NO: 1208569 - RNA, 20 nt, Human
ucaucaccaacgucugugcc

SEQ ID NO: 1208570 - RNA, 19 nt, Human
ucaucaccaacgucugugc

SEQ ID NO: 1208571 - RNA, 15 nt, Human
ucauacucaccucac

SEQ ID NO: 1208572 - RNA, 16 nt, Human
uccagguucagcuugu

SEQ ID NO: 1208573 - RNA, 15 nt, Human
uccagguucagcuug

SEQ ID NO: 1208574 - RNA, 22 nt, Human
uccaggugcacaagcuccaagc

SEQ ID NO: 1208575 - RNA, 21 nt, Human
uccaggugcacaagcuccaag

SEQ ID NO: 1208576 - RNA, 20 nt, Human
uccaggugcacaagcuccaa

SEQ ID NO: 1208577 - RNA, 18 nt, Human
uccaggugcacaagcucc

SEQ ID NO: 1208578 - RNA, 15 nt, Human
uccaggugcacaagc

SEQ ID NO: 1208579 - RNA, 23 nt, Human
uccaggggugggacacccuguga

SEQ ID NO: 1208580 - RNA, 22 nt, Human
uccaggagcagccacauuccug

SEQ ID NO: 1208581 - RNA, 18 nt, Human
uccaggagcagccacauu

SEQ ID NO: 1208582 - RNA, 17 nt, Human
uccaggagcagccacau

SEQ ID NO: 1208583 - RNA, 16 nt, Human
uccaggagcagccaca

SEQ ID NO: 1208584 - RNA, 17 nt, Human
uccagcuguucagcugg

SEQ ID NO: 1208585 - RNA, 18 nt, Human
uccagcucaccagcccca

SEQ ID NO: 1208586 - RNA, 17 nt, Human
uccagcucaccagcccc

SEQ ID NO: 1208587 - RNA, 16 nt, Human
uccagcucaccagccc

SEQ ID NO: 1208588 - RNA, 21 nt, Human
uccaccugccagggacagagg

SEQ ID NO: 1208589 - RNA, 18 nt, Human
uccaccugccagggacag

SEQ ID NO: 1208590 - RNA, 17 nt, Human
uccaccugccagggaca

SEQ ID NO: 1208591 - RNA, 13 nt, Human
uccacccugcucu

SEQ ID NO: 1208592 - RNA, 12 nt, Human
uccacccugcuc

SEQ ID NO: 1208593 - RNA, 18 nt, Human
uccacaaguuaaauaaau

SEQ ID NO: 1208594 - RNA, 17 nt, Human
uccacaaguuaaauaaa

SEQ ID NO: 1208595 - RNA, 19 nt, Human
uccacaagagcccaggccu

SEQ ID NO: 1208596 - RNA, 18 nt, Human
uccacaagagcccaggcc

SEQ ID NO: 1208597 - RNA, 17 nt, Human
uccacaagagcccaggc

SEQ ID NO: 1208598 - RNA, 16 nt, Human
uccacaagagcccagg

SEQ ID NO: 1208599 - RNA, 20 nt, Human
uccaaaauaaaacuuuuuaa

SEQ ID NO: 1208600 - RNA, 18 nt, Human
uccaauuuacauacucug

SEQ ID NO: 1208601 - RNA, 17 nt, Human
uccaauuuacauacucu

SEQ ID NO: 1208602 - RNA, 14 nt, Human
ucagacagcugccu

SEQ ID NO: 1208603 - RNA, 13 nt, Human
ucagacagcugcc

SEQ ID NO: 1208604 - RNA, 10 nt, Human
ucagaaaugu

SEQ ID NO: 1208605 - RNA, 23 nt, Human
ucagaauucucuaguuugauuaa

SEQ ID NO: 1208606 - RNA, 15 nt, Human
ucagaaauguguuau

SEQ ID NO: 1208607 - RNA, 18 nt, Human
ucacugccaugccagcuu

SEQ ID NO: 1208608 - RNA, 20 nt, Human
ucacucuuauugcccacgcu

SEQ ID NO: 1208609 - RNA, 17 nt, Human
ucacucuuauugcccac

SEQ ID NO: 1208610 - RNA, 16 nt, Human
ucaccagccccagugc

SEQ ID NO: 1208611 - RNA, 13 nt, Human
ucaccagccccag

SEQ ID NO: 1208612 - RNA, 14 nt, Human
ucacugcuuaacuu

SEQ ID NO: 1208613 - RNA, 20 nt, Human
ucagccucccgaguagcugg

SEQ ID NO: 1208614 - RNA, 18 nt, Human
ucagccucccgaguagcu

SEQ ID NO: 1208615 - RNA, 22 nt, Human
ucagccucccgaauagcuggga

SEQ ID NO: 1208616 - RNA, 21 nt, Human
ucagccucccgaauagcuggg

SEQ ID NO: 1208617 - RNA, 21 nt, Human
ucagccucccaaagugcuggg

SEQ ID NO: 1208618 - RNA, 19 nt, Human
ucagccucccaaagugcug

SEQ ID NO: 1208619 - RNA, 14 nt, Human
ucagccucccaaag

SEQ ID NO: 1208620 - RNA, 16 nt, Human
ucagcugaaccugggu

SEQ ID NO: 1208621 - RNA, 15 nt, Human
ucagcugaaccuggg

SEQ ID NO: 1208622 - RNA, 19 nt, Human
ucagccugcuccagcuguu

SEQ ID NO: 1208623 - RNA, 18 nt, Human
ucagccugcuccagcugu

SEQ ID NO: 1208624 - RNA, 22 nt, Human
ucagccucccgaguagcuggga

SEQ ID NO: 1208625 - RNA, 21 nt, Human
ucagccucccgaguagcuggg

SEQ ID NO: 1208626 - RNA, 16 nt, Human
ucaggugagaagcaga

SEQ ID NO: 1208627 - RNA, 15 nt, Human
ucaggugagaagcag

SEQ ID NO: 1208628 - RNA, 16 nt, Human
ucagggccuggcucag

SEQ ID NO: 1208629 - RNA, 14 nt, Human
ucagggccuggcuc

SEQ ID NO: 1208630 - RNA, 23 nt, Human
gggaggaucucuugagccuggga

SEQ ID NO: 1208631 - RNA, 21 nt, Human
gggaggauugcuugagcucag

SEQ ID NO: 1208632 - RNA, 22 nt, Human
gggaggauguucugggacacag

SEQ ID NO: 1208633 - RNA, 21 nt, Human
gggagugaguugauagcacag

SEQ ID NO: 1208634 - RNA, 17 nt, Human
gggagugacagaggcag

SEQ ID NO: 1208635 - RNA, 23 nt, Human
gggaggauugcuugagcucagga

SEQ ID NO: 1208636 - RNA, 22 nt, Human
gggagcugccuguucagcucca

SEQ ID NO: 1208637 - RNA, 21 nt, Human
gggagcugccuguucagcucc

SEQ ID NO: 1208638 - RNA, 13 nt, Human
gggagcugccugu

SEQ ID NO: 1208639 - RNA, 14 nt, Human
gggacacccuguga

SEQ ID NO: 1208640 - RNA, 21 nt, Human
gggaauguuugccucugccuc

SEQ ID NO: 1208641 - RNA, 19 nt, Human
gggaauguuugccucugcc

SEQ ID NO: 1208642 - RNA, 23 nt, Human
gggacucaaugcacugacauugu

SEQ ID NO: 1208643 - RNA, 19 nt, Human
gggacucaaugcacugaca

SEQ ID NO: 1208644 - RNA, 17 nt, Human
gggacucaaugcacuga

SEQ ID NO: 1208645 - RNA, 15 nt, Human
ggcuuaaaacaacac

SEQ ID NO: 1208646 - RNA, 20 nt, Human
ggcuguuggcugggggccuc

SEQ ID NO: 1208647 - RNA, 16 nt, Human
ggcuguuggcuggggg

SEQ ID NO: 1208648 - RNA, 15 nt, Human
ggcuguuggcugggg

SEQ ID NO: 1208649 - RNA, 14 nt, Human
ggcuguuggcuggg

SEQ ID NO: 1208650 - RNA, 21 nt, Human
ggcuucacggaagagccuugc

SEQ ID NO: 1208651 - RNA, 20 nt, Human
ggcuucacggaagagccuug

SEQ ID NO: 1208652 - RNA, 15 nt, Human
ggcuuagucacugag

SEQ ID NO: 1208653 - RNA, 14 nt, Human
ggcuuagucacuga

SEQ ID NO: 1208654 - RNA, 19 nt, Human
ggcuuggggaccagagcug

SEQ ID NO: 1208655 - RNA, 18 nt, Human
ggcuuggggaccagagcu

SEQ ID NO: 1208656 - RNA, 17 nt, Human
ggcuuggggaccagagc

SEQ ID NO: 1208657 - RNA, 21 nt, Human
ggcugggcucccuucccaccu

SEQ ID NO: 1208658 - RNA, 20 nt, Human
ggcugggcucccuucccacc

SEQ ID NO: 1208659 - RNA, 14 nt, Human
ggcugggggccuca

SEQ ID NO: 1208660 - RNA, 16 nt, Human
ggcugggggaagaagc

SEQ ID NO: 1208661 - RNA, 22 nt, Human
ggcugggcuucaguggcagcug

SEQ ID NO: 1208662 - RNA, 21 nt, Human
ggcugggcuucaguggcagcu

SEQ ID NO: 1208663 - RNA, 11 nt, Human
ggcugggcuuc

SEQ ID NO: 1208664 - RNA, 21 nt, Human
ggcugcuucaaggauccugag

SEQ ID NO: 1208665 - RNA, 20 nt, Human
ggcugcuucaaggauccuga

SEQ ID NO: 1208666 - RNA, 19 nt, Human
ggcugcuucaaggauccug

SEQ ID NO: 1208667 - RNA, 15 nt, Human
ggcugcuucaaggau

SEQ ID NO: 1208668 - RNA, 17 nt, Human
ggcucugccucccauca

SEQ ID NO: 1208669 - RNA, 22 nt, Human
ggccucugcacuccccugcugg

SEQ ID NO: 1208670 - RNA, 19 nt, Human
ggccucugcacuccccugc

SEQ ID NO: 1208671 - RNA, 18 nt, Human
ggccucugcacuccccug

SEQ ID NO: 1208672 - RNA, 13 nt, Human
ggccuggccccuc

SEQ ID NO: 1208673 - RNA, 12 nt, Human
ggccugagcugg

SEQ ID NO: 1208674 - RNA, 14 nt, Human
ggccuggccugagc

SEQ ID NO: 1208675 - RNA, 13 nt, Human
ggccuggccugag

SEQ ID NO: 1208676 - RNA, 10 nt, Human
ggccuggccu

SEQ ID NO: 1208677 - RNA, 23 nt, Human
ggccuggccccucagggucccug

SEQ ID NO: 1208678 - RNA, 18 nt, Human
ggccuggccccucagggu

SEQ ID NO: 1208679 - RNA, 17 nt, Human
ggccuggccccucaggg

SEQ ID NO: 1208680 - RNA, 15 nt, Human
ggccuggccccucag

SEQ ID NO: 1208681 - RNA, 14 nt, Human
ggccuggccccuca

SEQ ID NO: 1208682 - RNA, 19 nt, Human
ggccuggccugagcuggga

SEQ ID NO: 1208683 - RNA, 16 nt, Human
ggccuggccugagcug

SEQ ID NO: 1208684 - RNA, 15 nt, Human
ggccuggccugagcu

SEQ ID NO: 1208685 - RNA, 23 nt, Human
ggccugggggcugggcagaggaa

SEQ ID NO: 1208686 - RNA, 24 nt, Human
ggcgcagcauauucaggaagcuca

SEQ ID NO: 1208687 - RNA, 23 nt, Human
ggcgcagcauauucaggaagcuc

SEQ ID NO: 1208688 - RNA, 14 nt, Human
ggccuccugugugu

SEQ ID NO: 1208689 - RNA, 23 nt, Human
ggccucaagugauucuccugccu

SEQ ID NO: 1208690 - RNA, 22 nt, Human
ggccucaagugauucuccugcc

SEQ ID NO: 1208691 - RNA, 14 nt, Human
ggccucaagugauu

SEQ ID NO: 1208692 - RNA, 23 nt, Human
ggccuagcauacguacacauuuu

SEQ ID NO: 1208693 - RNA, 22 nt, Human
ggccuagcauacguacacauuu

SEQ ID NO: 1208694 - RNA, 20 nt, Human
ggccuagcauacguacacau

SEQ ID NO: 1208695 - RNA, 20 nt, Human
ggcccagagggccugcaagg

SEQ ID NO: 1208696 - RNA, 19 nt, Human
ggcccagagggccugcaag

SEQ ID NO: 1208697 - RNA, 17 nt, Human
ggcccagagggccugca

SEQ ID NO: 1208698 - RNA, 14 nt, Human
ggcccagagggccu

SEQ ID NO: 1208699 - RNA, 16 nt, Human
ggcucugccucccauc

SEQ ID NO: 1208700 - RNA, 15 nt, Human
ggcucugccucccau

SEQ ID NO: 1208701 - RNA, 13 nt, Human
ggcucugccuccc

SEQ ID NO: 1208702 - RNA, 15 nt, Human
ggcucugcccuuggu

SEQ ID NO: 1208703 - RNA, 14 nt, Human
ggcucugcccuugg

SEQ ID NO: 1208704 - RNA, 12 nt, Human
ggcucugcccuu

SEQ ID NO: 1208705 - RNA, 20 nt, Human
ggcucucaggccagcugcuu

SEQ ID NO: 1208706 - RNA, 19 nt, Human
ggcucucaggccagcugcu

SEQ ID NO: 1208707 - RNA, 18 nt, Human
ggcucucaggccagcugc

SEQ ID NO: 1208708 - RNA, 17 nt, Human
ggcucucaggccagcug

SEQ ID NO: 1208709 - RNA, 16 nt, Human
ggcucucaggccagcu

SEQ ID NO: 1208710 - RNA, 15 nt, Human
ggcucucaggccagc

SEQ ID NO: 1208711 - RNA, 15 nt, Human
ggcuccaggcuccuu

SEQ ID NO: 1208712 - RNA, 14 nt, Human
ggcuccaggcuccu

SEQ ID NO: 1208713 - RNA, 13 nt, Human
ggcuccaggcucc

SEQ ID NO: 1208714 - RNA, 12 nt, Human
ggcuccaggcuc

SEQ ID NO: 1208715 - RNA, 18 nt, Human
ggcuccaggagcagccac

SEQ ID NO: 1208716 - RNA, 17 nt, Human
ggcuccaggagcagcca

SEQ ID NO: 1208717 - RNA, 16 nt, Human
ggcuccaggagcagcc

SEQ ID NO: 1208718 - RNA, 14 nt, Human
ggcuccaggagcag

SEQ ID NO: 1208719 - RNA, 10 nt, Human
ggcuccagac

SEQ ID NO: 1208720 - RNA, 9 nt, Human
ggcuccaga

SEQ ID NO: 1208721 - RNA, 14 nt, Human
ggcuaugcauuuga

SEQ ID NO: 1208722 - RNA, 13 nt, Human
ggcuaugcauuug

SEQ ID NO: 1208723 - RNA, 12 nt, Human
ggcuaugcauuu

SEQ ID NO: 1208724 - RNA, 18 nt, Human
ggcgcugccccuggcagc

SEQ ID NO: 1208725 - RNA, 17 nt, Human
ggcgcugccccuggcag

SEQ ID NO: 1208726 - RNA, 11 nt, Human
ggcgcugcccc

SEQ ID NO: 1208727 - RNA, 15 nt, Human
ggagccuccugcccu

SEQ ID NO: 1208728 - RNA, 14 nt, Human
ggagccuccugccc

SEQ ID NO: 1208729 - RNA, 21 nt, Human
ggagaccccuuggggagcagg

SEQ ID NO: 1208730 - RNA, 17 nt, Human
ggagggagggcuccaga

SEQ ID NO: 1208731 - RNA, 16 nt, Human
ggagggagggcuccag

SEQ ID NO: 1208732 - RNA, 13 nt, Human
ggagggagggcuc

SEQ ID NO: 1208733 - RNA, 21 nt, Human
ggaggauguucugggacacag

SEQ ID NO: 1208734 - RNA, 18 nt, Human
ggaggauguucugggaca

SEQ ID NO: 1208735 - RNA, 22 nt, Human
ggagucccaccuuggcugcagg

SEQ ID NO: 1208736 - RNA, 18 nt, Human
ggaccuugaacuggguac

SEQ ID NO: 1208737 - RNA, 19 nt, Human
ggaccagagcugccaccug

SEQ ID NO: 1208738 - RNA, 17 nt, Human
ggacagcuccuucuguc

SEQ ID NO: 1208739 - RNA, 16 nt, Human
ggacagcuccuucugu

SEQ ID NO: 1208740 - RNA, 15 nt, Human
ggacagcuccuucug

SEQ ID NO: 1208741 - RNA, 11 nt, Human
ggacagcuccu

SEQ ID NO: 1208742 - RNA, 20 nt, Human
ggacagaggggguggccucc

SEQ ID NO: 1208743 - RNA, 16 nt, Human
ggacagaggggguggc

SEQ ID NO: 1208744 - RNA, 21 nt, Human
ggaugccugguggcagcugcg

SEQ ID NO: 1208745 - RNA, 20 nt, Human
ggaugccugguggcagcugc

SEQ ID NO: 1208746 - RNA, 19 nt, Human
ggaugccugguggcagcug

SEQ ID NO: 1208747 - RNA, 18 nt, Human
ggaugccugguggcagcu

SEQ ID NO: 1208748 - RNA, 22 nt, Human
ggaugaucuaggaagacuuugg

SEQ ID NO: 1208749 - RNA, 18 nt, Human
ggaugaucuaggaagacu

SEQ ID NO: 1208750 - RNA, 16 nt, Human
ggaugaucuaggaaga

SEQ ID NO: 1208751 - RNA, 23 nt, Human
ggagucccaccuuggcugcaggg

SEQ ID NO: 1208752 - RNA, 18 nt, Human
ggaugcccaaagaugcag

SEQ ID NO: 1208753 - RNA, 17 nt, Human
ggaugccugguggcagc

SEQ ID NO: 1208754 - RNA, 13 nt, Human
ggaugccuggugg

SEQ ID NO: 1208755 - RNA, 19 nt, Human
ggaugcccaaagaugcagc

SEQ ID NO: 1208756 - RNA, 20 nt, Human
ggcacucagaagacacugau

SEQ ID NO: 1208757 - RNA, 19 nt, Human
ggcacucagaagacacuga

SEQ ID NO: 1208758 - RNA, 18 nt, Human
ggcacucagaagacacug

SEQ ID NO: 1208759 - RNA, 20 nt, Human
ggcacccggccccugcuggu

SEQ ID NO: 1208760 - RNA, 19 nt, Human
ggcacccggccccugcugg

SEQ ID NO: 1208761 - RNA, 18 nt, Human
ggcacccggccccugcug

SEQ ID NO: 1208762 - RNA, 20 nt, Human
ggcacccaccaucaugucug

SEQ ID NO: 1208763 - RNA, 17 nt, Human
ggcaccagcagccugga

SEQ ID NO: 1208764 - RNA, 15 nt, Human
ggcaaggcugucaau

SEQ ID NO: 1208765 - RNA, 19 nt, Human
ggcaagcaccuccugccuc

SEQ ID NO: 1208766 - RNA, 18 nt, Human
ggcaagcaccuccugccu

SEQ ID NO: 1208767 - RNA, 17 nt, Human
ggcaagcaccuccugcc

SEQ ID NO: 1208768 - RNA, 21 nt, Human
ggauucuuccucccucccucu

SEQ ID NO: 1208769 - RNA, 17 nt, Human
ggccaggcccucugccc

SEQ ID NO: 1208770 - RNA, 16 nt, Human
ggccaggcccucugcc

SEQ ID NO: 1208771 - RNA, 15 nt, Human
ggccaggcccucugc

SEQ ID NO: 1208772 - RNA, 13 nt, Human
ggccaggagccuc

SEQ ID NO: 1208773 - RNA, 11 nt, Human
ggccaggagcc

SEQ ID NO: 1208774 - RNA, 22 nt, Human
ggccacagaaaauucuucucca

SEQ ID NO: 1208775 - RNA, 20 nt, Human
ggcauguucucugaggacac

SEQ ID NO: 1208776 - RNA, 18 nt, Human
ggcagggucucacucugu

SEQ ID NO: 1208777 - RNA, 17 nt, Human
ggcagggucucacucug

SEQ ID NO: 1208778 - RNA, 12 nt, Human
ggcaggguccua

SEQ ID NO: 1208779 - RNA, 22 nt, Human
ggcagcugcuuuugucuauggg

SEQ ID NO: 1208780 - RNA, 24 nt, Human
ggcagcugcgguccacccaggagc

SEQ ID NO: 1208781 - RNA, 23 nt, Human
ggcagcugcgguccacccaggag

SEQ ID NO: 1208782 - RNA, 21 nt, Human
ggcagaguugaagacagagcu

SEQ ID NO: 1208783 - RNA, 19 nt, Human
ggcagaguugaagacagag

SEQ ID NO: 1208784 - RNA, 17 nt, Human
ggcagaguugaagacag

SEQ ID NO: 1208785 - RNA, 23 nt, Human
ggcaugugaugagaggaaaucac

SEQ ID NO: 1208786 - RNA, 18 nt, Human
ggcaugugaugagaggaa

SEQ ID NO: 1208787 - RNA, 23 nt, Human
gcugcaaaggguaucaggugcug

SEQ ID NO: 1208788 - RNA, 22 nt, Human
gcugcaaaggguaucaggugcu

SEQ ID NO: 1208789 - RNA, 19 nt, Human
gcugcauuuaaaagauaca

SEQ ID NO: 1208790 - RNA, 18 nt, Human
gcugcauuuaaaagauac

SEQ ID NO: 1208791 - RNA, 17 nt, Human
gcugcaguugccaguca

SEQ ID NO: 1208792 - RNA, 14 nt, Human
gcugcaguugccag

SEQ ID NO: 1208793 - RNA, 13 nt, Human
gcugcaguugcca

SEQ ID NO: 1208794 - RNA, 13 nt, Human
gcugccaccugcc

SEQ ID NO: 1208795 - RNA, 12 nt, Human
gcugccaccugc

SEQ ID NO: 1208796 - RNA, 21 nt, Human
gcucucaggccagcugcuugg

SEQ ID NO: 1208797 - RNA, 22 nt, Human
gcugacuguuuucucuugagag

SEQ ID NO: 1208798 - RNA, 20 nt, Human
gcugacagacacaggcccgg

SEQ ID NO: 1208799 - RNA, 19 nt, Human
gcugacagacacaggcccg

SEQ ID NO: 1208800 - RNA, 18 nt, Human
gcugacagacacaggccc

SEQ ID NO: 1208801 - RNA, 16 nt, Human
gcuggaccuugaacug

SEQ ID NO: 1208802 - RNA, 15 nt, Human
gcuggaccuugaacu

SEQ ID NO: 1208803 - RNA, 22 nt, Human
gcugcuuuugucuaugggacuc

SEQ ID NO: 1208804 - RNA, 24 nt, Human
gcugcccugcccaccuggccucug

SEQ ID NO: 1208805 - RNA, 23 nt, Human
gcugcccugcccaccuggccucu

SEQ ID NO: 1208806 - RNA, 22 nt, Human
gcugcccugcccaccuggccuc

SEQ ID NO: 1208807 - RNA, 21 nt, Human
gcugcccugcccaccuggccu

SEQ ID NO: 1208808 - RNA, 20 nt, Human
gcugcccugcccaccuggcc

SEQ ID NO: 1208809 - RNA, 18 nt, Human
gcugcccugcccaccugg

SEQ ID NO: 1208810 - RNA, 16 nt, Human
gcugcccugcccaccu

SEQ ID NO: 1208811 - RNA, 14 nt, Human
gcugcccugcccac

SEQ ID NO: 1208812 - RNA, 13 nt, Human
gcugcccugccca

SEQ ID NO: 1208813 - RNA, 12 nt, Human
gcugcccugccc

SEQ ID NO: 1208814 - RNA, 15 nt, Human
gcugcgguccaccca

SEQ ID NO: 1208815 - RNA, 14 nt, Human
gcugcgguccaccc

SEQ ID NO: 1208816 - RNA, 21 nt, Human
gcugcgguccacccaggagcc

SEQ ID NO: 1208817 - RNA, 16 nt, Human
gcugcgguccacccag

SEQ ID NO: 1208818 - RNA, 22 nt, Human
gcugcgguccacccaggagccc

SEQ ID NO: 1208819 - RNA, 22 nt, Human
gcugccuguucagcuccagcuc

SEQ ID NO: 1208820 - RNA, 20 nt, Human
gcugccuguucagcuccagc

SEQ ID NO: 1208821 - RNA, 19 nt, Human
gcugccuguucagcuccag

SEQ ID NO: 1208822 - RNA, 15 nt, Human
gcugugucucccuuc

SEQ ID NO: 1208823 - RNA, 16 nt, Human
gcugucccuuuuccuu

SEQ ID NO: 1208824 - RNA, 23 nt, Human
gcugucccuuacgugaguccugg

SEQ ID NO: 1208825 - RNA, 15 nt, Human
gcuggugucaccuga

SEQ ID NO: 1208826 - RNA, 14 nt, Human
gcuggugucaccug

SEQ ID NO: 1208827 - RNA, 16 nt, Human
gcuggugucaccugaa

SEQ ID NO: 1208828 - RNA, 17 nt, Human
gcugucagccauuccug

SEQ ID NO: 1208829 - RNA, 15 nt, Human
gcugggggccucagu

SEQ ID NO: 1208830 - RNA, 14 nt, Human
gcugggggccucag

SEQ ID NO: 1208831 - RNA, 18 nt, Human
gcugggggccucagugcc

SEQ ID NO: 1208832 - RNA, 14 nt, Human
gcuggucccacuca

SEQ ID NO: 1208833 - RNA, 22 nt, Human
gcugggcuucaguggcagcugc

SEQ ID NO: 1208834 - RNA, 21 nt, Human
gcugggcuucaguggcagcug

SEQ ID NO: 1208835 - RNA, 20 nt, Human
gcugggcuucaguggcagcu

SEQ ID NO: 1208836 - RNA, 21 nt, Human
gcugggaugauuggagggggg

SEQ ID NO: 1208837 - RNA, 16 nt, Human
gcuggccuggccccuc

SEQ ID NO: 1208838 - RNA, 19 nt, Human
gcugggaugauuggagggg

SEQ ID NO: 1208839 - RNA, 15 nt, Human
gcuggccuggccccu

SEQ ID NO: 1208840 - RNA, 14 nt, Human
gcuggccuggcccc

SEQ ID NO: 1208841 - RNA, 13 nt, Human
gcuggccuggccc

SEQ ID NO: 1208842 - RNA, 13 nt, Human
gcuuaucucaggg

SEQ ID NO: 1208843 - RNA, 20 nt, Human
gcuucaguggcagcugcuuu

SEQ ID NO: 1208844 - RNA, 19 nt, Human
gcuucaguggcagcugcuu

SEQ ID NO: 1208845 - RNA, 22 nt, Human
gcuucucacugccaugccagcu

SEQ ID NO: 1208846 - RNA, 13 nt, Human
gcuccugugucuu

SEQ ID NO: 1208847 - RNA, 12 nt, Human
gcuccugugucu

SEQ ID NO: 1208848 - RNA, 21 nt, Human
gcucgagcaugccuggauggg

SEQ ID NO: 1208849 - RNA, 19 nt, Human
gcucgagcaugccuggaug

SEQ ID NO: 1208850 - RNA, 17 nt, Human
gcuccuuuagcgcccag

SEQ ID NO: 1208851 - RNA, 15 nt, Human
gcuccuucuguccua

SEQ ID NO: 1208852 - RNA, 13 nt, Human
gcuccuucugucc

SEQ ID NO: 1208853 - RNA, 24 nt, Human
gcuccgcuuucuacccagcgagcc

SEQ ID NO: 1208854 - RNA, 13 nt, Human
gcuccaggcuccu

SEQ ID NO: 1208855 - RNA, 12 nt, Human
gcuccaggcucc

SEQ ID NO: 1208856 - RNA, 18 nt, Human
gcuccaggagcagccaca

SEQ ID NO: 1208857 - RNA, 17 nt, Human
gcuccaggagcagccac

SEQ ID NO: 1208858 - RNA, 16 nt, Human
gcuccaggagcagcca

SEQ ID NO: 1208859 - RNA, 15 nt, Human
gcuccaggagcagcc

SEQ ID NO: 1208860 - RNA, 14 nt, Human
gcuccaggagcagc

SEQ ID NO: 1208861 - RNA, 12 nt, Human
gcuccaggagca

SEQ ID NO: 1208862 - RNA, 11 nt, Human
gcuccaggagc

SEQ ID NO: 1208863 - RNA, 21 nt, Human
gcuccagcuguucagcugguu

SEQ ID NO: 1208864 - RNA, 23 nt, Human
gcuccgcuuucuacccagcgagc

SEQ ID NO: 1208865 - RNA, 22 nt, Human
gcuccgcuuucuacccagcgag

SEQ ID NO: 1208866 - RNA, 21 nt, Human
gcuccgcuuucuacccagcga

SEQ ID NO: 1208867 - RNA, 18 nt, Human
gcuccgcuuucuacccag

SEQ ID NO: 1208868 - RNA, 20 nt, Human
gcucccuucccaccucucuc

SEQ ID NO: 1208869 - RNA, 23 nt, Human
gcucagcggggacagcuccuucu

SEQ ID NO: 1208870 - RNA, 19 nt, Human
gcucagcggggacagcucc

SEQ ID NO: 1208871 - RNA, 18 nt, Human
gcucagcggggacagcuc

SEQ ID NO: 1208872 - RNA, 17 nt, Human
gcucagcggggacagcu

SEQ ID NO: 1208873 - RNA, 18 nt, Human
gcucaccucucccuugga

SEQ ID NO: 1208874 - RNA, 17 nt, Human
gcucaccucucccuugg

SEQ ID NO: 1208875 - RNA, 16 nt, Human
gcucaccucucccuug

SEQ ID NO: 1208876 - RNA, 18 nt, Human
gcucaccagccccagugc

SEQ ID NO: 1208877 - RNA, 15 nt, Human
gcucaccagccccag

SEQ ID NO: 1208878 - RNA, 14 nt, Human
gcucaccagcccca

SEQ ID NO: 1208879 - RNA, 13 nt, Human
gcucaccagcccc

SEQ ID NO: 1208880 - RNA, 12 nt, Human
gcucaccagccc

SEQ ID NO: 1208881 - RNA, 16 nt, Human
gcucacauaucuguca

SEQ ID NO: 1208882 - RNA, 22 nt, Human
gcucaaguccucuuuucugaga

SEQ ID NO: 1208883 - RNA, 19 nt, Human
gcucaaguccucuuuucug

SEQ ID NO: 1208884 - RNA, 18 nt, Human
gcucaaguccucuuuucu

SEQ ID NO: 1208885 - RNA, 15 nt, Human
gcuaucucccccagc

SEQ ID NO: 1208886 - RNA, 14 nt, Human
gcuaucucccccag

SEQ ID NO: 1208887 - RNA, 13 nt, Human
gcuaucuccccca

SEQ ID NO: 1208888 - RNA, 22 nt, Human
gcggugcuaucucccccagccc

SEQ ID NO: 1208889 - RNA, 19 nt, Human
gcggugcuaucucccccag

SEQ ID NO: 1208890 - RNA, 16 nt, Human
gccuuacacaaugguu

SEQ ID NO: 1208891 - RNA, 15 nt, Human
gccuuacacaauggu

SEQ ID NO: 1208892 - RNA, 21 nt, Human
gcgacaaugcaaaccaucauu

SEQ ID NO: 1208893 - RNA, 20 nt, Human
gcgacaaugcaaaccaucau

SEQ ID NO: 1208894 - RNA, 13 nt, Human
gcgacaaugcaaa

SEQ ID NO: 1208895 - RNA, 12 nt, Human
gcgacaaugcaa

SEQ ID NO: 1208896 - RNA, 19 nt, Human
gcggugagaggggaacaga

SEQ ID NO: 1208897 - RNA, 14 nt, Human
gcgguccacccagg

SEQ ID NO: 1208898 - RNA, 13 nt, Human
gcgguccacccag

SEQ ID NO: 1208899 - RNA, 18 nt, Human
gcggggacagcuccuucu

SEQ ID NO: 1208900 - RNA, 17 nt, Human
gcggggacagcuccuuc

SEQ ID NO: 1208901 - RNA, 15 nt, Human
gcggggacagcuccu

SEQ ID NO: 1208902 - RNA, 14 nt, Human
gcggggacagcucc

SEQ ID NO: 1208903 - RNA, 19 nt, Human
gcggagacggagucccacc

SEQ ID NO: 1208904 - RNA, 16 nt, Human
gcggagaaaggaaggg

SEQ ID NO: 1208905 - RNA, 21 nt, Human
gcgcugccccuggcagccccu

SEQ ID NO: 1208906 - RNA, 18 nt, Human
gcgcugccccuggcagcc

SEQ ID NO: 1208907 - RNA, 21 nt, Human
gcgccuuaaggauguucuagc

SEQ ID NO: 1208908 - RNA, 23 nt, Human
gcgcccaguuggguggaugccug

SEQ ID NO: 1208909 - RNA, 14 nt, Human
gccuggccccucag

SEQ ID NO: 1208910 - RNA, 13 nt, Human
gccuggccccuca

SEQ ID NO: 1208911 - RNA, 22 nt, Human
gccuggccagaugcaccagccc

SEQ ID NO: 1208912 - RNA, 21 nt, Human
gccuggccagaugcaccagcc

SEQ ID NO: 1208913 - RNA, 20 nt, Human
gccuggccagaugcaccagc

SEQ ID NO: 1208914 - RNA, 20 nt, Human
gccuguaauccuagcacuuu

SEQ ID NO: 1208915 - RNA, 15 nt, Human
gccuguaauccuagc

SEQ ID NO: 1208916 - RNA, 18 nt, Human
gccuggauggggcugcac

SEQ ID NO: 1208917 - RNA, 16 nt, Human
gccuggauggggcugc

SEQ ID NO: 1208918 - RNA, 14 nt, Human
gccuggacccugug

SEQ ID NO: 1208919 - RNA, 20 nt, Human
gccuggauggggcugcaccg

SEQ ID NO: 1208920 - RNA, 12 nt, Human
gccugagcuggg

SEQ ID NO: 1208921 - RNA, 18 nt, Human
gccugaagucacacagug

SEQ ID NO: 1208922 - RNA, 17 nt, Human
gccugaagucacacagu

SEQ ID NO: 1208923 - RNA, 16 nt, Human
gccugaagucacacag

SEQ ID NO: 1208924 - RNA, 22 nt, Human
gcccaguuggguggaugccugg

SEQ ID NO: 1208925 - RNA, 21 nt, Human
gcccaguuggguggaugccug

SEQ ID NO: 1208926 - RNA, 19 nt, Human
gcccaguuggguggaugcc

SEQ ID NO: 1208927 - RNA, 20 nt, Human
gccagagacacaagccuucg

SEQ ID NO: 1208928 - RNA, 10 nt, Human
gccagaggag

SEQ ID NO: 1208929 - RNA, 19 nt, Human
gccagagacacaagccuuc

SEQ ID NO: 1208930 - RNA, 17 nt, Human
gccagagacacaagccu

SEQ ID NO: 1208931 - RNA, 16 nt, Human
gccagagacacaagcc

SEQ ID NO: 1208932 - RNA, 20 nt, Human
gccacuauuguuagucucuu

SEQ ID NO: 1208933 - RNA, 18 nt, Human
gccagaugcaccagcccu

SEQ ID NO: 1208934 - RNA, 17 nt, Human
gccagaugcaccagccc

SEQ ID NO: 1208935 - RNA, 16 nt, Human
gccagaugcaccagcc

SEQ ID NO: 1208936 - RNA, 23 nt, Human
gccagagggagugacagaggcag

SEQ ID NO: 1208937 - RNA, 22 nt, Human
gccagagggagugacagaggca

SEQ ID NO: 1208938 - RNA, 21 nt, Human
gccagagggagugacagaggc

SEQ ID NO: 1208939 - RNA, 22 nt, Human
gccagaggagagaggacccccu

SEQ ID NO: 1208940 - RNA, 19 nt, Human
gccagaggagagaggaccc

SEQ ID NO: 1208941 - RNA, 17 nt, Human
gccagaggagagaggac

SEQ ID NO: 1208942 - RNA, 15 nt, Human
gccagaggagagagg

SEQ ID NO: 1208943 - RNA, 13 nt, Human
gccagaggagaga

SEQ ID NO: 1208944 - RNA, 12 nt, Human
gccagaggagag

SEQ ID NO: 1208945 - RNA, 22 nt, Human
gccaccugcggugcuaucuccc

SEQ ID NO: 1208946 - RNA, 20 nt, Human
gccaccugcggugcuaucuc

SEQ ID NO: 1208947 - RNA, 14 nt, Human
gccaccugcggugc

SEQ ID NO: 1208948 - RNA, 19 nt, Human
gccacggccaggccagagg

SEQ ID NO: 1208949 - RNA, 18 nt, Human
gccacggccaggccagag

SEQ ID NO: 1208950 - RNA, 17 nt, Human
gccaccugccuguuggg

SEQ ID NO: 1208951 - RNA, 22 nt, Human
gccacaagacccuugugguccc

SEQ ID NO: 1208952 - RNA, 16 nt, Human
gccacaagacccuugu

SEQ ID NO: 1208953 - RNA, 23 nt, Human
gccacagagaaaguacuucucca

SEQ ID NO: 1208954 - RNA, 20 nt, Human
gccacagagaaaguacuucu

SEQ ID NO: 1208955 - RNA, 14 nt, Human
gccacagagaaagu

SEQ ID NO: 1208956 - RNA, 13 nt, Human
gccacagagaaag

SEQ ID NO: 1208957 - RNA, 23 nt, Human
gccaaggugggaggauugcuuga

SEQ ID NO: 1208958 - RNA, 15 nt, Human
gccaaggugggagga

SEQ ID NO: 1208959 - RNA, 14 nt, Human
gccaaggugggagg

SEQ ID NO: 1208960 - RNA, 23 nt, Human
gcauuuggugguuucagaaaugu

SEQ ID NO: 1208961 - RNA, 22 nt, Human
gcauuuggugguuucagaaaug

SEQ ID NO: 1208962 - RNA, 20 nt, Human
gcauuugaggucuguucuuu

SEQ ID NO: 1208963 - RNA, 19 nt, Human
gcauuugaggucuguucuu

SEQ ID NO: 1208964 - RNA, 21 nt, Human
gcauuugaggucuguucuuuc

SEQ ID NO: 1208965 - RNA, 21 nt, Human
gccaaggcugggggaagaagc

SEQ ID NO: 1208966 - RNA, 15 nt, Human
gcccaaagaugcagc

SEQ ID NO: 1208967 - RNA, 19 nt, Human
gccaugccagcuuaucuca

SEQ ID NO: 1208968 - RNA, 18 nt, Human
gccaugccagcuuaucuc

SEQ ID NO: 1208969 - RNA, 13 nt, Human
gccaugccagcuu

SEQ ID NO: 1208970 - RNA, 20 nt, Human
gccaugaggaacaaggcaag

SEQ ID NO: 1208971 - RNA, 18 nt, Human
gccaugaggaacaaggca

SEQ ID NO: 1208972 - RNA, 21 nt, Human
gccagucaccccggccaccug

SEQ ID NO: 1208973 - RNA, 20 nt, Human
gccagucaccccggccaccu

SEQ ID NO: 1208974 - RNA, 18 nt, Human
gccagucaccccggccac

SEQ ID NO: 1208975 - RNA, 17 nt, Human
gccagucaccccggcca

SEQ ID NO: 1208976 - RNA, 12 nt, Human
gccaguaaaugg

SEQ ID NO: 1208977 - RNA, 17 nt, Human
gccagguuuuuggucug

SEQ ID NO: 1208978 - RNA, 23 nt, Human
gccagggacagaggggguggccu

SEQ ID NO: 1208979 - RNA, 18 nt, Human
gccagggacagagggggu

SEQ ID NO: 1208980 - RNA, 16 nt, Human
gccagggacagagggg

SEQ ID NO: 1208981 - RNA, 13 nt, Human
gccagggacagag

SEQ ID NO: 1208982 - RNA, 21 nt, Human
gccagauuucacucuccuugg

SEQ ID NO: 1208983 - RNA, 18 nt, Human
gccagauuucacucuccu

SEQ ID NO: 1208984 - RNA, 12 nt, Human
gcccagccccuu

SEQ ID NO: 1208985 - RNA, 11 nt, Human
gcccagccccu

SEQ ID NO: 1208986 - RNA, 9 nt, Human
gcccagccc

SEQ ID NO: 1208987 - RNA, 22 nt, Human
gcccagagggccugcaagggag

SEQ ID NO: 1208988 - RNA, 21 nt, Human
gcccagagggccugcaaggga

SEQ ID NO: 1208989 - RNA, 20 nt, Human
gcccagagggccugcaaggg

SEQ ID NO: 1208990 - RNA, 19 nt, Human
gcccagagggccugcaagg

SEQ ID NO: 1208991 - RNA, 18 nt, Human
gcccagagggccugcaag

SEQ ID NO: 1208992 - RNA, 15 nt, Human
gcccagagggccugc

SEQ ID NO: 1208993 - RNA, 14 nt, Human
gcccagagggccug

SEQ ID NO: 1208994 - RNA, 12 nt, Human
gcccagagggcc

SEQ ID NO: 1208995 - RNA, 15 nt, Human
gcccagagagggugg

SEQ ID NO: 1208996 - RNA, 21 nt, Human
gcccaaugcacuuuguucugg

SEQ ID NO: 1208997 - RNA, 20 nt, Human
gcccagucuggaaugcagug

SEQ ID NO: 1208998 - RNA, 19 nt, Human
gcccagucuggaaugcagu

SEQ ID NO: 1208999 - RNA, 23 nt, Human
gcccaggcuuagucacugagaca

SEQ ID NO: 1209000 - RNA, 21 nt, Human
gcccaggcuuagucacugaga

SEQ ID NO: 1209001 - RNA, 19 nt, Human
gcccaggcuuagucacuga

SEQ ID NO: 1209002 - RNA, 22 nt, Human
gcccaggcuggcgugcaguggu

SEQ ID NO: 1209003 - RNA, 20 nt, Human
gcccaggcuggcgugcagug

SEQ ID NO: 1209004 - RNA, 19 nt, Human
gcccaggcuggcgugcagu

SEQ ID NO: 1209005 - RNA, 21 nt, Human
gcccaggaaaggcuccaggag

SEQ ID NO: 1209006 - RNA, 20 nt, Human
gcccaggaaaggcuccagga

SEQ ID NO: 1209007 - RNA, 19 nt, Human
gcccaggaaaggcuccagg

SEQ ID NO: 1209008 - RNA, 18 nt, Human
gcccaggaaaggcuccag

SEQ ID NO: 1209009 - RNA, 24 nt, Human
gcccagccccuucugacccaugcu

SEQ ID NO: 1209010 - RNA, 20 nt, Human
gcccagccccuucugaccca

SEQ ID NO: 1209011 - RNA, 17 nt, Human
gcccagccccuucugac

SEQ ID NO: 1209012 - RNA, 16 nt, Human
gcccagccccuucuga

SEQ ID NO: 1209013 - RNA, 14 nt, Human
gcccagccccuucu

SEQ ID NO: 1209014 - RNA, 13 nt, Human
gcccagccccuuc

SEQ ID NO: 1209015 - RNA, 18 nt, Human
gcaggcagccaggccaca

SEQ ID NO: 1209016 - RNA, 16 nt, Human
gcagggucucacucug

SEQ ID NO: 1209017 - RNA, 19 nt, Human
gcaggguccuagaaauucc

SEQ ID NO: 1209018 - RNA, 22 nt, Human
gcaggggaggguagagcggaga

SEQ ID NO: 1209019 - RNA, 12 nt, Human
gcagugggagcu

SEQ ID NO: 1209020 - RNA, 11 nt, Human
gcagugggagc

SEQ ID NO: 1209021 - RNA, 19 nt, Human
gcaguggugcgaucugggu

SEQ ID NO: 1209022 - RNA, 18 nt, Human
gcaguggugcgaucuggg

SEQ ID NO: 1209023 - RNA, 17 nt, Human
gcagggucucacucugu

SEQ ID NO: 1209024 - RNA, 19 nt, Human
gcauacguacacauuuuau

SEQ ID NO: 1209025 - RNA, 22 nt, Human
gcaguggugguuuucuguucuu

SEQ ID NO: 1209026 - RNA, 21 nt, Human
gcaguggugguuuucuguucu

SEQ ID NO: 1209027 - RNA, 20 nt, Human
gcaguggugguuuucuguuc

SEQ ID NO: 1209028 - RNA, 19 nt, Human
gcaguggugguuuucuguu

SEQ ID NO: 1209029 - RNA, 22 nt, Human
gcaguggugcgaucuggguuca

SEQ ID NO: 1209030 - RNA, 21 nt, Human
gcaguggugcgaucuggguuc

SEQ ID NO: 1209031 - RNA, 20 nt, Human
gcaguggugcgaucuggguu

SEQ ID NO: 1209032 - RNA, 18 nt, Human
gcauuugaggucuguucu

SEQ ID NO: 1209033 - RNA, 22 nt, Human
gcauuccccaggaggccagccu

SEQ ID NO: 1209034 - RNA, 21 nt, Human
gcauuccccaggaggccagcc

SEQ ID NO: 1209035 - RNA, 20 nt, Human
gcauuccccaggaggccagc

SEQ ID NO: 1209036 - RNA, 19 nt, Human
gcauuccccaggaggccag

SEQ ID NO: 1209037 - RNA, 18 nt, Human
gcauuccccaggaggcca

SEQ ID NO: 1209038 - RNA, 17 nt, Human
gcauuccccaggaggcc

SEQ ID NO: 1209039 - RNA, 16 nt, Human
gcauuccccaggaggc

SEQ ID NO: 1209040 - RNA, 15 nt, Human
gcauuccccaggagg

SEQ ID NO: 1209041 - RNA, 14 nt, Human
gcauuccccaggag

SEQ ID NO: 1209042 - RNA, 24 nt, Human
gcauuaucuagauacuguaucaug

SEQ ID NO: 1209043 - RNA, 22 nt, Human
gcauuaucuagauacuguauca

SEQ ID NO: 1209044 - RNA, 14 nt, Human
gcauguucucugag

SEQ ID NO: 1209045 - RNA, 13 nt, Human
gcauguuacauaa

SEQ ID NO: 1209046 - RNA, 15 nt, Human
gcaugccuggauggg

SEQ ID NO: 1209047 - RNA, 14 nt, Human
gcaugccuggaugg

SEQ ID NO: 1209048 - RNA, 22 nt, Human
gcaugacacgaauauugcugau

SEQ ID NO: 1209049 - RNA, 21 nt, Human
gcaugacacgaauauugcuga

SEQ ID NO: 1209050 - RNA, 23 nt, Human
gcaugaaguaauaugcacacauu

SEQ ID NO: 1209051 - RNA, 22 nt, Human
gcaugaaguaauaugcacacau

SEQ ID NO: 1209052 - RNA, 21 nt, Human
gcaugaaguaauaugcacaca

SEQ ID NO: 1209053 - RNA, 20 nt, Human
gcaugaaguaauaugcacac

SEQ ID NO: 1209054 - RNA, 12 nt, Human
gcaucaggccag

SEQ ID NO: 1209055 - RNA, 13 nt, Human
gcaucaggccagg

SEQ ID NO: 1209056 - RNA, 23 nt, Human
gcaucaggccaggcccucugccc

SEQ ID NO: 1209057 - RNA, 17 nt, Human
gcaccaucucuccuccu

SEQ ID NO: 1209058 - RNA, 15 nt, Human
gcaccaucucuccuc

SEQ ID NO: 1209059 - RNA, 14 nt, Human
gcaccaucucuccu

SEQ ID NO: 1209060 - RNA, 14 nt, Human
gcaccagcagccug

SEQ ID NO: 1209061 - RNA, 13 nt, Human
gcaccagcagccu

SEQ ID NO: 1209062 - RNA, 20 nt, Human
gauugugucucuugguccug

SEQ ID NO: 1209063 - RNA, 23 nt, Human
gcacagcuucauuuccugugucu

SEQ ID NO: 1209064 - RNA, 20 nt, Human
gcacuaaggugugcucugau

SEQ ID NO: 1209065 - RNA, 14 nt, Human
gcacgugugugcac

SEQ ID NO: 1209066 - RNA, 19 nt, Human
gcacccucaggcagguggg

SEQ ID NO: 1209067 - RNA, 14 nt, Human
gcacccggccccug

SEQ ID NO: 1209068 - RNA, 16 nt, Human
gcacccucaggcaggu

SEQ ID NO: 1209069 - RNA, 15 nt, Human
gcacugcuuccagug

SEQ ID NO: 1209070 - RNA, 14 nt, Human
gcacugcuuccagu

SEQ ID NO: 1209071 - RNA, 13 nt, Human
gcacugcuuccag

SEQ ID NO: 1209072 - RNA, 12 nt, Human
gcacugcuucca

SEQ ID NO: 1209073 - RNA, 22 nt, Human
gcacuauaauguaagcucuacu

SEQ ID NO: 1209074 - RNA, 20 nt, Human
gcacuauaauguaagcucua

SEQ ID NO: 1209075 - RNA, 15 nt, Human
gcacuauaauguaag

SEQ ID NO: 1209076 - RNA, 14 nt, Human
gcacuauaauguaa

SEQ ID NO: 1209077 - RNA, 12 nt, Human
gcacugggcuug

SEQ ID NO: 1209078 - RNA, 14 nt, Human
gcacugggcuuggg

SEQ ID NO: 1209079 - RNA, 19 nt, Human
gcacuguuuuauuuuaauu

SEQ ID NO: 1209080 - RNA, 19 nt, Human
gcagcucagagaggguggg

SEQ ID NO: 1209081 - RNA, 18 nt, Human
gcagcucagagagggugg

SEQ ID NO: 1209082 - RNA, 14 nt, Human
gcagcucagagagg

SEQ ID NO: 1209083 - RNA, 21 nt, Human
gcagcucaccucucccuugga

SEQ ID NO: 1209084 - RNA, 20 nt, Human
gcagcucaccucucccuugg

SEQ ID NO: 1209085 - RNA, 17 nt, Human
gcagcucaccucucccu

SEQ ID NO: 1209086 - RNA, 16 nt, Human
gcagcucaccucuccc

SEQ ID NO: 1209087 - RNA, 19 nt, Human
gcagccucacaguccuuac

SEQ ID NO: 1209088 - RNA, 17 nt, Human
gcagccucacaguccuu

SEQ ID NO: 1209089 - RNA, 19 nt, Human
gcagcagggagggcuucug

SEQ ID NO: 1209090 - RNA, 18 nt, Human
gcagcagggagggcuucu

SEQ ID NO: 1209091 - RNA, 20 nt, Human
gcagcagggagggcuucugc

SEQ ID NO: 1209092 - RNA, 22 nt, Human
gcagagaccaucccugaaggcc

SEQ ID NO: 1209093 - RNA, 21 nt, Human
gcagagaccaucccugaaggc

SEQ ID NO: 1209094 - RNA, 20 nt, Human
gcagagaccaucccugaagg

SEQ ID NO: 1209095 - RNA, 22 nt, Human
gcagacucuacagaggccaugg

SEQ ID NO: 1209096 - RNA, 19 nt, Human
gcagacucuacagaggcca

SEQ ID NO: 1209097 - RNA, 18 nt, Human
gcagacucuacagaggcc

SEQ ID NO: 1209098 - RNA, 16 nt, Human
gcacuugcagacucua

SEQ ID NO: 1209099 - RNA, 14 nt, Human
gcacuugcagacuc

SEQ ID NO: 1209100 - RNA, 22 nt, Human
gcacuucgggaggucgaggcag

SEQ ID NO: 1209101 - RNA, 18 nt, Human
gcagauggagaccccuug

SEQ ID NO: 1209102 - RNA, 16 nt, Human
gauguucugggacaca

SEQ ID NO: 1209103 - RNA, 20 nt, Human
gauggugcaaugaccuuuca

SEQ ID NO: 1209104 - RNA, 23 nt, Human
gauggugcaaugaccuuucaaua

SEQ ID NO: 1209105 - RNA, 19 nt, Human
gauucaacagguuuuccug

SEQ ID NO: 1209106 - RNA, 21 nt, Human
gauuaaccacuucagcugacu

SEQ ID NO: 1209107 - RNA, 19 nt, Human
gauuaaccacuucagcuga

SEQ ID NO: 1209108 - RNA, 18 nt, Human
gauuaaccacuucagcug

SEQ ID NO: 1209109 - RNA, 19 nt, Human
gauuaaauucuugcaaagu

SEQ ID NO: 1209110 - RNA, 12 nt, Human
gauuaaauucuu

SEQ ID NO: 1209111 - RNA, 23 nt, Human
gauguuuuccaugaguccccugu

SEQ ID NO: 1209112 - RNA, 15 nt, Human
gauguuuuccaugag

SEQ ID NO: 1209113 - RNA, 14 nt, Human
gauguuuuccauga

SEQ ID NO: 1209114 - RNA, 21 nt, Human
gauguucuuucacccuuuucu

SEQ ID NO: 1209115 - RNA, 22 nt, Human
gauucccaagcucugcuccucu

SEQ ID NO: 1209116 - RNA, 12 nt, Human
gauucagacagc

SEQ ID NO: 1209117 - RNA, 20 nt, Human
gauuguccccgacccuugcc

SEQ ID NO: 1209118 - RNA, 15 nt, Human
gauuguccccgaccc

SEQ ID NO: 1209119 - RNA, 23 nt, Human
gauugacgggacuguugguauug

SEQ ID NO: 1209120 - RNA, 21 nt, Human
gaugcacagaguuguuacauu

SEQ ID NO: 1209121 - RNA, 23 nt, Human
gaugagaaauaaaguuucuguug

SEQ ID NO: 1209122 - RNA, 22 nt, Human
gaugagaaagguugaagcacca

SEQ ID NO: 1209123 - RNA, 11 nt, Human
gaugagaaagg

SEQ ID NO: 1209124 - RNA, 14 nt, Human
gaugccugguggca

SEQ ID NO: 1209125 - RNA, 19 nt, Human
gauccugagccagauuuca

SEQ ID NO: 1209126 - RNA, 15 nt, Human
gauccugagccagau

SEQ ID NO: 1209127 - RNA, 14 nt, Human
gauccugagccaga

SEQ ID NO: 1209128 - RNA, 21 nt, Human
gauccucccaccucagccucc

SEQ ID NO: 1209129 - RNA, 20 nt, Human
gauccucccaccucagccuc

SEQ ID NO: 1209130 - RNA, 19 nt, Human
gauccucccaccucagccu

SEQ ID NO: 1209131 - RNA, 12 nt, Human
gauccuccaggu

SEQ ID NO: 1209132 - RNA, 11 nt, Human
gauccuccagg

SEQ ID NO: 1209133 - RNA, 16 nt, Human
gaucacgccacugcac

SEQ ID NO: 1209134 - RNA, 18 nt, Human
gauccuaguuccaccauc

SEQ ID NO: 1209135 - RNA, 15 nt, Human
gaucacgccacugca

SEQ ID NO: 1209136 - RNA, 14 nt, Human
gaucacgccacugc

SEQ ID NO: 1209137 - RNA, 13 nt, Human
gaucacgccacug

SEQ ID NO: 1209138 - RNA, 23 nt, Human
gaucaaccccuucgcuccugugu

SEQ ID NO: 1209139 - RNA, 15 nt, Human
gaugaaaaaauaaca

SEQ ID NO: 1209140 - RNA, 17 nt, Human
gaucuuugcagacaggc

SEQ ID NO: 1209141 - RNA, 16 nt, Human
gaucuuugcagacagg

SEQ ID NO: 1209142 - RNA, 21 nt, Human
gauccugagccagauuucacu

SEQ ID NO: 1209143 - RNA, 14 nt, Human
gagguucccuuuga

SEQ ID NO: 1209144 - RNA, 19 nt, Human
gagguucaaagauauuuug

SEQ ID NO: 1209145 - RNA, 16 nt, Human
gaguacguugugcauu

SEQ ID NO: 1209146 - RNA, 19 nt, Human
gagguuuuaaaaaaauccc

SEQ ID NO: 1209147 - RNA, 19 nt, Human
gaguacuacaguccuccca

SEQ ID NO: 1209148 - RNA, 18 nt, Human
gaguacuacaguccuccc

SEQ ID NO: 1209149 - RNA, 15 nt, Human
gaguacuacaguccu

SEQ ID NO: 1209150 - RNA, 20 nt, Human
gaguacguugugcauuuggu

SEQ ID NO: 1209151 - RNA, 18 nt, Human
gaguacguugugcauuug

SEQ ID NO: 1209152 - RNA, 17 nt, Human
gaguacguugugcauuu

SEQ ID NO: 1209153 - RNA, 22 nt, Human
gaggugggauccuccaggugca

SEQ ID NO: 1209154 - RNA, 21 nt, Human
gaggugggauccuccaggugc

SEQ ID NO: 1209155 - RNA, 15 nt, Human
gaggggggagguggg

SEQ ID NO: 1209156 - RNA, 22 nt, Human
gaggggggaggugggauccucc

SEQ ID NO: 1209157 - RNA, 15 nt, Human
gaggggguggccucc

SEQ ID NO: 1209158 - RNA, 17 nt, Human
gagucgaggacagggag

SEQ ID NO: 1209159 - RNA, 21 nt, Human
gagucucacuguugcccaggc

SEQ ID NO: 1209160 - RNA, 20 nt, Human
gagucucacuguugcccagg

SEQ ID NO: 1209161 - RNA, 21 nt, Human
gagucugaaggcuggguucug

SEQ ID NO: 1209162 - RNA, 23 nt, Human
gagucucacuguugcccaggcug

SEQ ID NO: 1209163 - RNA, 22 nt, Human
gagucucacuguugcccaggcu

SEQ ID NO: 1209164 - RNA, 23 nt, Human
gaguccccuguuuguuucugaaa

SEQ ID NO: 1209165 - RNA, 14 nt, Human
gaguccccuguuug

SEQ ID NO: 1209166 - RNA, 12 nt, Human
gaguccccuguu

SEQ ID NO: 1209167 - RNA, 19 nt, Human
gaguagcugggacuacagg

SEQ ID NO: 1209168 - RNA, 14 nt, Human
gaguagcugggacu

SEQ ID NO: 1209169 - RNA, 12 nt, Human
gaguagcuggga

SEQ ID NO: 1209170 - RNA, 14 nt, Human
gaguugaagacaga

SEQ ID NO: 1209171 - RNA, 23 nt, Human
gaguucaucuugaauuguaagga

SEQ ID NO: 1209172 - RNA, 17 nt, Human
gagugugccugaagucc

SEQ ID NO: 1209173 - RNA, 23 nt, Human
gagugggggaucacagccucuga

SEQ ID NO: 1209174 - RNA, 12 nt, Human
gagugggcccaa

SEQ ID NO: 1209175 - RNA, 18 nt, Human
gauagcacagacccugcc

SEQ ID NO: 1209176 - RNA, 17 nt, Human
gauagcacagacccugc

SEQ ID NO: 1209177 - RNA, 18 nt, Human
gauacaaugcugugcccu

SEQ ID NO: 1209178 - RNA, 13 nt, Human
gauacaaugcugu

SEQ ID NO: 1209179 - RNA, 22 nt, Human
gaucaaccccuucgcuccugug

SEQ ID NO: 1209180 - RNA, 23 nt, Human
gauauaugcucugcauguuacau

SEQ ID NO: 1209181 - RNA, 14 nt, Human
gauagccaaggcca

SEQ ID NO: 1209182 - RNA, 13 nt, Human
gauagccaaggcc

SEQ ID NO: 1209183 - RNA, 20 nt, Human
gauagcacagacccugcccu

SEQ ID NO: 1209184 - RNA, 19 nt, Human
gauagcacagacccugccc

SEQ ID NO: 1209185 - RNA, 12 nt, Human
gauagccaaggc

SEQ ID NO: 1209186 - RNA, 12 nt, Human
gaggauguucug

SEQ ID NO: 1209187 - RNA, 16 nt, Human
gaggauugcuugagcu

SEQ ID NO: 1209188 - RNA, 20 nt, Human
gaggauguucugggacacag

SEQ ID NO: 1209189 - RNA, 17 nt, Human
gaggauguucugggaca

SEQ ID NO: 1209190 - RNA, 23 nt, Human
gaggaguuugggguaugggagag

SEQ ID NO: 1209191 - RNA, 13 nt, Human
gaggccagccuug

SEQ ID NO: 1209192 - RNA, 12 nt, Human
gaggccagccuu

SEQ ID NO: 1209193 - RNA, 23 nt, Human
gaggcagccccauucugccugcc

SEQ ID NO: 1209194 - RNA, 22 nt, Human
gaggcagccccauucugccugc

SEQ ID NO: 1209195 - RNA, 18 nt, Human
gaggcagccccauucugc

SEQ ID NO: 1209196 - RNA, 13 nt, Human
gaggcagccccau

SEQ ID NO: 1209197 - RNA, 23 nt, Human
gaggacagggaggugaccccagg

SEQ ID NO: 1209198 - RNA, 22 nt, Human
gaggacagggaggugaccccag

SEQ ID NO: 1209199 - RNA, 13 nt, Human
gaggacagggagg

SEQ ID NO: 1209200 - RNA, 15 nt, Human
gaggaauccagaccc

SEQ ID NO: 1209201 - RNA, 14 nt, Human
gaggaauccagacc

SEQ ID NO: 1209202 - RNA, 22 nt, Human
gaggaaggaaacccagcucugg

SEQ ID NO: 1209203 - RNA, 15 nt, Human
gagggagggcuccag

SEQ ID NO: 1209204 - RNA, 15 nt, Human
gagggagggagggcu

SEQ ID NO: 1209205 - RNA, 14 nt, Human
gagggagggagggc

SEQ ID NO: 1209206 - RNA, 22 nt, Human
gaggggccucuuaugggcuggg

SEQ ID NO: 1209207 - RNA, 16 nt, Human
gagggagugacagagg

SEQ ID NO: 1209208 - RNA, 16 nt, Human
gagggagggcuccaga

SEQ ID NO: 1209209 - RNA, 14 nt, Human
gagggagugacaga

SEQ ID NO: 1209210 - RNA, 13 nt, Human
gagggagugacag

SEQ ID NO: 1209211 - RNA, 22 nt, Human
gagggcacagaaaauggaagac

SEQ ID NO: 1209212 - RNA, 23 nt, Human
gagggcacagaaaauggaagaca

SEQ ID NO: 1209213 - RNA, 24 nt, Human
gaggcccuucucuccagccccugg

SEQ ID NO: 1209214 - RNA, 23 nt, Human
gaggcccuucucuccagccccug

SEQ ID NO: 1209215 - RNA, 14 nt, Human
gaggcccuucucuc

SEQ ID NO: 1209216 - RNA, 16 nt, Human
gaggcugggcucccuu

SEQ ID NO: 1209217 - RNA, 15 nt, Human
gaggcugggcucccu

SEQ ID NO: 1209218 - RNA, 14 nt, Human
gaggcugggcuccc

SEQ ID NO: 1209219 - RNA, 13 nt, Human
gaggcugggcucc

SEQ ID NO: 1209220 - RNA, 14 nt, Human
gaggccuucucuga

SEQ ID NO: 1209221 - RNA, 23 nt, Human
gagcuacacaggggaaaagagga

SEQ ID NO: 1209222 - RNA, 16 nt, Human
gagcugccaccugccu

SEQ ID NO: 1209223 - RNA, 15 nt, Human
gagcugccaccugcc

SEQ ID NO: 1209224 - RNA, 13 nt, Human
gagcugccaccug

SEQ ID NO: 1209225 - RNA, 22 nt, Human
gagccuccugcccuuaccugcc

SEQ ID NO: 1209226 - RNA, 20 nt, Human
gagccuccugcccuuaccug

SEQ ID NO: 1209227 - RNA, 17 nt, Human
gagcccugguggcagug

SEQ ID NO: 1209228 - RNA, 19 nt, Human
gagccucagcauccuggca

SEQ ID NO: 1209229 - RNA, 16 nt, Human
gagcccugguggcagu

SEQ ID NO: 1209230 - RNA, 15 nt, Human
gagcccugguggcag

SEQ ID NO: 1209231 - RNA, 21 nt, Human
gagccucagcauccuggcacc

SEQ ID NO: 1209232 - RNA, 20 nt, Human
gagccucagcauccuggcac

SEQ ID NO: 1209233 - RNA, 14 nt, Human
gagccuccugcccu

SEQ ID NO: 1209234 - RNA, 18 nt, Human
gagcccugguggcagugg

SEQ ID NO: 1209235 - RNA, 21 nt, Human
gagccugggaggucaaggcug

SEQ ID NO: 1209236 - RNA, 13 nt, Human
gagccugggaggu

SEQ ID NO: 1209237 - RNA, 15 nt, Human
gagccuggcaagaau

SEQ ID NO: 1209238 - RNA, 10 nt, Human
gagccuggca

SEQ ID NO: 1209239 - RNA, 19 nt, Human
gagcaccuuagacaguccc

SEQ ID NO: 1209240 - RNA, 17 nt, Human
gagcaccuuagacaguc

SEQ ID NO: 1209241 - RNA, 23 nt, Human
gagcaagacgcugugcugcccug

SEQ ID NO: 1209242 - RNA, 22 nt, Human
gagcaagacgcugugcugcccu

SEQ ID NO: 1209243 - RNA, 21 nt, Human
gagcaagacgcugugcugccc

SEQ ID NO: 1209244 - RNA, 19 nt, Human
gagcaaaaucgaugcagug

SEQ ID NO: 1209245 - RNA, 16 nt, Human
gagaucagccugggca

SEQ ID NO: 1209246 - RNA, 14 nt, Human
gagaucagccuggg

SEQ ID NO: 1209247 - RNA, 13 nt, Human
gagaucagccugg

SEQ ID NO: 1209248 - RNA, 23 nt, Human
gagaucaaccccuucgcuccugu

SEQ ID NO: 1209249 - RNA, 20 nt, Human
gagaucaaccccuucgcucc

SEQ ID NO: 1209250 - RNA, 18 nt, Human
gagcccacgcccccacug

SEQ ID NO: 1209251 - RNA, 14 nt, Human
gagcccaggccucc

SEQ ID NO: 1209252 - RNA, 13 nt, Human
gagcccaggccuc

SEQ ID NO: 1209253 - RNA, 12 nt, Human
gagcccaggccu

SEQ ID NO: 1209254 - RNA, 16 nt, Human
gagcccacgcccccac

SEQ ID NO: 1209255 - RNA, 15 nt, Human
gagcccacgccccca

SEQ ID NO: 1209256 - RNA, 12 nt, Human
gagcccacgccc

SEQ ID NO: 1209257 - RNA, 13 nt, Human
gagccagauuuca

SEQ ID NO: 1209258 - RNA, 22 nt, Human
gagccacugcaccgggccacag

SEQ ID NO: 1209259 - RNA, 18 nt, Human
gagcagccacauuccuga

SEQ ID NO: 1209260 - RNA, 21 nt, Human
gagcagccacauuccugaugc

SEQ ID NO: 1209261 - RNA, 13 nt, Human
gagccacugcacc

SEQ ID NO: 1209262 - RNA, 21 nt, Human
gaaccacaucuugcucugcug

SEQ ID NO: 1209263 - RNA, 19 nt, Human
gaacagacuggaagcacag

SEQ ID NO: 1209264 - RNA, 16 nt, Human
gaacagacuggaagca

SEQ ID NO: 1209265 - RNA, 15 nt, Human
gaacagacuggaagc

SEQ ID NO: 1209266 - RNA, 17 nt, Human
gaaccaccacacccagc

SEQ ID NO: 1209267 - RNA, 16 nt, Human
gaaccaccacacccag

SEQ ID NO: 1209268 - RNA, 22 nt, Human
gaacuggguacuuguggacaca

SEQ ID NO: 1209269 - RNA, 16 nt, Human
gaacuuggcgcugccc

SEQ ID NO: 1209270 - RNA, 15 nt, Human
gaacuuggcgcugcc

SEQ ID NO: 1209271 - RNA, 13 nt, Human
gaacuuggcgcug

SEQ ID NO: 1209272 - RNA, 23 nt, Human
gaacuugguucccauuugcuccu

SEQ ID NO: 1209273 - RNA, 17 nt, Human
gaacuuggcgcugcccc

SEQ ID NO: 1209274 - RNA, 15 nt, Human
gaaaugggcagagca

SEQ ID NO: 1209275 - RNA, 20 nt, Human
gaaaugggcagagcagagac

SEQ ID NO: 1209276 - RNA, 14 nt, Human
gaaaugggcagagc

SEQ ID NO: 1209277 - RNA, 17 nt, Human
gaaauuuguuauaauga

SEQ ID NO: 1209278 - RNA, 21 nt, Human
gaaauaucugaaaauguaugu

SEQ ID NO: 1209279 - RNA, 17 nt, Human
gaaauauaggaacuuaa

SEQ ID NO: 1209280 - RNA, 13 nt, Human
gaaauauaauuga

SEQ ID NO: 1209281 - RNA, 21 nt, Human
gaaugaaagggcccagagagg

SEQ ID NO: 1209282 - RNA, 19 nt, Human
gaaugaaagggcccagaga

SEQ ID NO: 1209283 - RNA, 14 nt, Human
gaaugaaagggccc

SEQ ID NO: 1209284 - RNA, 16 nt, Human
gaaucucaaauaacua

SEQ ID NO: 1209285 - RNA, 18 nt, Human
gaauccagacccggcugc

SEQ ID NO: 1209286 - RNA, 15 nt, Human
gaauagcugggacua

SEQ ID NO: 1209287 - RNA, 14 nt, Human
gaauagcugggacu

SEQ ID NO: 1209288 - RNA, 14 nt, Human
gaauaacauguaau

SEQ ID NO: 1209289 - RNA, 20 nt, Human
gaaguuucugccgcagcccu

SEQ ID NO: 1209290 - RNA, 12 nt, Human
gaaguuucugcc

SEQ ID NO: 1209291 - RNA, 21 nt, Human
gaaggauacaaaagcauguga

SEQ ID NO: 1209292 - RNA, 19 nt, Human
gaaggauacaaaagcaugu

SEQ ID NO: 1209293 - RNA, 12 nt, Human
gaaggauacaaa

SEQ ID NO: 1209294 - RNA, 19 nt, Human
gaaggaaacccagcucugg

SEQ ID NO: 1209295 - RNA, 18 nt, Human
gaaggaaacccagcucug

SEQ ID NO: 1209296 - RNA, 17 nt, Human
gaaggaaacccagcucu

SEQ ID NO: 1209297 - RNA, 14 nt, Human
gaaggaaacccagc

SEQ ID NO: 1209298 - RNA, 17 nt, Human
gaaggccccgcccaggc

SEQ ID NO: 1209299 - RNA, 16 nt, Human
gaaggccccgcccagg

SEQ ID NO: 1209300 - RNA, 15 nt, Human
gaaggccccgcccag

SEQ ID NO: 1209301 - RNA, 14 nt, Human
gaaggccccgccca

SEQ ID NO: 1209302 - RNA, 19 nt, Human
gaagccagcaggcucucag

SEQ ID NO: 1209303 - RNA, 16 nt, Human
gaagccagcaggcucu

SEQ ID NO: 1209304 - RNA, 15 nt, Human
gaagccagcaggcuc

SEQ ID NO: 1209305 - RNA, 14 nt, Human
gaagaagcucucuc

SEQ ID NO: 1209306 - RNA, 21 nt, Human
gaagacucauucuucuguacg

SEQ ID NO: 1209307 - RNA, 19 nt, Human
gaagacucauucuucugua

SEQ ID NO: 1209308 - RNA, 23 nt, Human
gaagcccaggaaaggcuccagga

SEQ ID NO: 1209309 - RNA, 22 nt, Human
gaagcccaggaaaggcuccagg

SEQ ID NO: 1209310 - RNA, 21 nt, Human
gaagcccaggaaaggcuccag

SEQ ID NO: 1209311 - RNA, 20 nt, Human
gaagcccaggaaaggcucca

SEQ ID NO: 1209312 - RNA, 14 nt, Human
gaagcggcuggcag

SEQ ID NO: 1209313 - RNA, 22 nt, Human
cuuuccaaaugcccagcuuaaa

SEQ ID NO: 1209314 - RNA, 19 nt, Human
cuuuccaaaugcccagcuu

SEQ ID NO: 1209315 - RNA, 18 nt, Human
cuuuccaaaugcccagcu

SEQ ID NO: 1209316 - RNA, 13 nt, Human
cuuuauaauucua

SEQ ID NO: 1209317 - RNA, 21 nt, Human
cuuguguguuuauugucaaag

SEQ ID NO: 1209318 - RNA, 16 nt, Human
cuuguaaauagcucag

SEQ ID NO: 1209319 - RNA, 22 nt, Human
cuugggcuucauccuccucaga

SEQ ID NO: 1209320 - RNA, 21 nt, Human
cuuggggaccagagcugccac

SEQ ID NO: 1209321 - RNA, 13 nt, Human
cuugggcuucauc

SEQ ID NO: 1209322 - RNA, 18 nt, Human
cuugggccacugugaaga

SEQ ID NO: 1209323 - RNA, 14 nt, Human
cuugggccacugug

SEQ ID NO: 1209324 - RNA, 15 nt, Human
cuuggggggcugagg

SEQ ID NO: 1209325 - RNA, 16 nt, Human
cuuggggaccagagcu

SEQ ID NO: 1209326 - RNA, 22 nt, Human
cuuggggaccagagcugccacc

SEQ ID NO: 1209327 - RNA, 22 nt, Human
cuuggggggcugaggugggagg

SEQ ID NO: 1209328 - RNA, 16 nt, Human
cuuggggggcugaggu

SEQ ID NO: 1209329 - RNA, 16 nt, Human
cuuggcugcagggagu

SEQ ID NO: 1209330 - RNA, 22 nt, Human
cuuggaggaaggaaacccagcu

SEQ ID NO: 1209331 - RNA, 12 nt, Human
cuuggagggcau

SEQ ID NO: 1209332 - RNA, 23 nt, Human
cuuggagggcaugaagacagaua

SEQ ID NO: 1209333 - RNA, 17 nt, Human
cuuggcugcagggaguc

SEQ ID NO: 1209334 - RNA, 13 nt, Human
cuuggaggaagga

SEQ ID NO: 1209335 - RNA, 14 nt, Human
cuuggaagcuccgc

SEQ ID NO: 1209336 - RNA, 13 nt, Human
cuuggaagcuccg

SEQ ID NO: 1209337 - RNA, 16 nt, Human
cuuggaaaugggagac

SEQ ID NO: 1209338 - RNA, 20 nt, Human
cuugcuucaaccccaugaga

SEQ ID NO: 1209339 - RNA, 17 nt, Human
cuugcucugcugacaga

SEQ ID NO: 1209340 - RNA, 16 nt, Human
cuugcucugcugacag

SEQ ID NO: 1209341 - RNA, 14 nt, Human
cuugcucugcugac

SEQ ID NO: 1209342 - RNA, 21 nt, Human
cuucuccacccugcucuccga

SEQ ID NO: 1209343 - RNA, 18 nt, Human
cuucuccacccugcucuc

SEQ ID NO: 1209344 - RNA, 17 nt, Human
cuucuccacccugcucu

SEQ ID NO: 1209345 - RNA, 21 nt, Human
cuuuugagugccuuacacaau

SEQ ID NO: 1209346 - RNA, 16 nt, Human
cuuuugagcauuuaga

SEQ ID NO: 1209347 - RNA, 15 nt, Human
cuuuuuuggcugcug

SEQ ID NO: 1209348 - RNA, 14 nt, Human
cuuuuuuggcugcu

SEQ ID NO: 1209349 - RNA, 16 nt, Human
cuuuuuuggcugcuga

SEQ ID NO: 1209350 - RNA, 23 nt, Human
gaaaaaggaugcacagaguuguu

SEQ ID NO: 1209351 - RNA, 15 nt, Human
gaaaacaugcuacac

SEQ ID NO: 1209352 - RNA, 14 nt, Human
gaaaacaugcuaca

SEQ ID NO: 1209353 - RNA, 12 nt, Human
gaaaacaugcua

SEQ ID NO: 1209354 - RNA, 14 nt, Human
gaaaacacauuuuu

SEQ ID NO: 1209355 - RNA, 13 nt, Human
gaaaacacauuuu

SEQ ID NO: 1209356 - RNA, 19 nt, Human
gaaaacguggcugcuucaa

SEQ ID NO: 1209357 - RNA, 18 nt, Human
gaaaacguggcugcuuca

SEQ ID NO: 1209358 - RNA, 16 nt, Human
gaaaacguggcugcuu

SEQ ID NO: 1209359 - RNA, 15 nt, Human
gaaaacguggcugcu

SEQ ID NO: 1209360 - RNA, 16 nt, Human
gaaaacaugcuacaca

SEQ ID NO: 1209361 - RNA, 19 nt, Human
gaaaagcugcugacagugu

SEQ ID NO: 1209362 - RNA, 17 nt, Human
gaaaagcugcugacagu

SEQ ID NO: 1209363 - RNA, 13 nt, Human
gaaaagcugcuga

SEQ ID NO: 1209364 - RNA, 14 nt, Human
gaaaaucagccugc

SEQ ID NO: 1209365 - RNA, 18 nt, Human
gaaaaucagccugcucca

SEQ ID NO: 1209366 - RNA, 16 nt, Human
gaaaaucagccugcuc

SEQ ID NO: 1209367 - RNA, 18 nt, Human
gaaacagcuaaugggaca

SEQ ID NO: 1209368 - RNA, 16 nt, Human
cuuuucuuucagccaa

SEQ ID NO: 1209369 - RNA, 23 nt, Human
cuuuucuugcaugaggcuagugu

SEQ ID NO: 1209370 - RNA, 23 nt, Human
cuuuucuguccgagcuuugaaaa

SEQ ID NO: 1209371 - RNA, 18 nt, Human
cuuuucuguccgagcuuu

SEQ ID NO: 1209372 - RNA, 20 nt, Human
cuuuguuuguugucagcuga

SEQ ID NO: 1209373 - RNA, 18 nt, Human
cuuuguuuguugucagcu

SEQ ID NO: 1209374 - RNA, 22 nt, Human
cuuuucauaaccuagccuuaga

SEQ ID NO: 1209375 - RNA, 20 nt, Human
cuuuucauaaccuagccuua

SEQ ID NO: 1209376 - RNA, 15 nt, Human
cuuuguucuggcucu

SEQ ID NO: 1209377 - RNA, 14 nt, Human
cuuuguucuggcuc

SEQ ID NO: 1209378 - RNA, 19 nt, Human
cuuugugauuuuuguaauu

SEQ ID NO: 1209379 - RNA, 18 nt, Human
cuuugugauuuuuguaau

SEQ ID NO: 1209380 - RNA, 17 nt, Human
cuuugugauuuuuguaa

SEQ ID NO: 1209381 - RNA, 14 nt, Human
cuuugugauuuuug

SEQ ID NO: 1209382 - RNA, 23 nt, Human
cuuugggaggccaaggugggagg

SEQ ID NO: 1209383 - RNA, 22 nt, Human
cuuuguccccaccgcagacagg

SEQ ID NO: 1209384 - RNA, 18 nt, Human
cuuuguccccaccgcaga

SEQ ID NO: 1209385 - RNA, 13 nt, Human
cuuugggaggcca

SEQ ID NO: 1209386 - RNA, 16 nt, Human
cuuucccaucuuccaa

SEQ ID NO: 1209387 - RNA, 19 nt, Human
cuuuggacccugaggccca

SEQ ID NO: 1209388 - RNA, 18 nt, Human
cuuuggacccugaggccc

SEQ ID NO: 1209389 - RNA, 17 nt, Human
cuuuggacccugaggcc

SEQ ID NO: 1209390 - RNA, 16 nt, Human
cuuuggacccugaggc

SEQ ID NO: 1209391 - RNA, 15 nt, Human
cuuuggacccugagg

SEQ ID NO: 1209392 - RNA, 20 nt, Human
cuucauucaacccaccugcg

SEQ ID NO: 1209393 - RNA, 15 nt, Human
cuuccacaagagccc

SEQ ID NO: 1209394 - RNA, 14 nt, Human
cuuccacaagagcc

SEQ ID NO: 1209395 - RNA, 13 nt, Human
cuuccacaagagc

SEQ ID NO: 1209396 - RNA, 14 nt, Human
cuucagugccaaaa

SEQ ID NO: 1209397 - RNA, 15 nt, Human
cuucaguaagccgug

SEQ ID NO: 1209398 - RNA, 14 nt, Human
cuucaguaagccgu

SEQ ID NO: 1209399 - RNA, 19 nt, Human
cuucagcugacuuuucugu

SEQ ID NO: 1209400 - RNA, 15 nt, Human
cuucagcugacuuuu

SEQ ID NO: 1209401 - RNA, 20 nt, Human
cuucagccucccgaguagcu

SEQ ID NO: 1209402 - RNA, 16 nt, Human
cuucagccucccgagu

SEQ ID NO: 1209403 - RNA, 14 nt, Human
cuucagccucccga

SEQ ID NO: 1209404 - RNA, 23 nt, Human
cuucacauauugauuuccguuaa

SEQ ID NO: 1209405 - RNA, 14 nt, Human
cuucacauauugau

SEQ ID NO: 1209406 - RNA, 22 nt, Human
cuucaaggauccugagccagau

SEQ ID NO: 1209407 - RNA, 21 nt, Human
cuucaaggauccugagccaga

SEQ ID NO: 1209408 - RNA, 23 nt, Human
cuucaaggauccugagccagauu

SEQ ID NO: 1209409 - RNA, 21 nt, Human
cuuagucacugagacagcccg

SEQ ID NO: 1209410 - RNA, 22 nt, Human
cuuagucacugagacagcccgg

SEQ ID NO: 1209411 - RNA, 20 nt, Human
cuucaaggauccugagccag

SEQ ID NO: 1209412 - RNA, 19 nt, Human
cuucaaggauccugagcca

SEQ ID NO: 1209413 - RNA, 18 nt, Human
cuucaaggauccugagcc

SEQ ID NO: 1209414 - RNA, 17 nt, Human
cuucaaggauccugagc

SEQ ID NO: 1209415 - RNA, 21 nt, Human
cuucucacugccaugccagcu

SEQ ID NO: 1209416 - RNA, 16 nt, Human
cuucucacugccaugc

SEQ ID NO: 1209417 - RNA, 19 nt, Human
cuucgggaggucgaggcag

SEQ ID NO: 1209418 - RNA, 17 nt, Human
cuucgcuccugugucuu

SEQ ID NO: 1209419 - RNA, 16 nt, Human
cuuccacaagagccca

SEQ ID NO: 1209420 - RNA, 20 nt, Human
cuuaauucuuagcucauucu

SEQ ID NO: 1209421 - RNA, 14 nt, Human
cuuagucacugaga

SEQ ID NO: 1209422 - RNA, 23 nt, Human
cuuagguuggcaaaaaggcagga

SEQ ID NO: 1209423 - RNA, 11 nt, Human
cuuagacaguc

SEQ ID NO: 1209424 - RNA, 19 nt, Human
cuuagaauuaguggcacuu

SEQ ID NO: 1209425 - RNA, 20 nt, Human
cuuaccugccaggaagccag

SEQ ID NO: 1209426 - RNA, 13 nt, Human
cuuacuguacaug

SEQ ID NO: 1209427 - RNA, 20 nt, Human
cuuagaaaaaccaccaccau

SEQ ID NO: 1209428 - RNA, 20 nt, Human
cuuagaagucacacaguauu

SEQ ID NO: 1209429 - RNA, 17 nt, Human
cuuagaagucacacagu

SEQ ID NO: 1209430 - RNA, 16 nt, Human
cuguugcccaggcugg

SEQ ID NO: 1209431 - RNA, 15 nt, Human
cuguugcccaggcug

SEQ ID NO: 1209432 - RNA, 14 nt, Human
cuguugcccaggcu

SEQ ID NO: 1209433 - RNA, 13 nt, Human
cuguugcccaggc

SEQ ID NO: 1209434 - RNA, 12 nt, Human
cuguugcccagg

SEQ ID NO: 1209435 - RNA, 23 nt, Human
cuguucuuucuggcuaugcauuu

SEQ ID NO: 1209436 - RNA, 21 nt, Human
cuguucuuucuggcuaugcau

SEQ ID NO: 1209437 - RNA, 14 nt, Human
cuguucuuucuggc

SEQ ID NO: 1209438 - RNA, 13 nt, Human
cuguucuuucugg

SEQ ID NO: 1209439 - RNA, 21 nt, Human
cuguucuuuccaaaguacacu

SEQ ID NO: 1209440 - RNA, 19 nt, Human
cuguucuuuccaaaguaca

SEQ ID NO: 1209441 - RNA, 16 nt, Human
cuguucuuuccaaagu

SEQ ID NO: 1209442 - RNA, 15 nt, Human
cuguucuuuccaaag

SEQ ID NO: 1209443 - RNA, 16 nt, Human
cuguuaauaguucagg

SEQ ID NO: 1209444 - RNA, 17 nt, Human
cuguuucaaacuuuacu

SEQ ID NO: 1209445 - RNA, 15 nt, Human
cuguuucaaacuuua

SEQ ID NO: 1209446 - RNA, 18 nt, Human
cuguuuagauaauacacc

SEQ ID NO: 1209447 - RNA, 17 nt, Human
cuguuuagauaauacac

SEQ ID NO: 1209448 - RNA, 18 nt, Human
cuguugcccaggcuggcg

SEQ ID NO: 1209449 - RNA, 17 nt, Human
cuguugcccaggcuggc

SEQ ID NO: 1209450 - RNA, 19 nt, Human
cuguuugcuaagugaggau

SEQ ID NO: 1209451 - RNA, 17 nt, Human
cuguuugcuaagugagg

SEQ ID NO: 1209452 - RNA, 17 nt, Human
cuuaaaaaguggaaaaa

SEQ ID NO: 1209453 - RNA, 16 nt, Human
cuuaaaaaguggaaaa

SEQ ID NO: 1209454 - RNA, 13 nt, Human
cuguuuucucuug

SEQ ID NO: 1209455 - RNA, 18 nt, Human
cugugugugcgccuacag

SEQ ID NO: 1209456 - RNA, 20 nt, Human
cugugucuuuuuucacuaca

SEQ ID NO: 1209457 - RNA, 22 nt, Human
cuguggguuucuaaagcugcca

SEQ ID NO: 1209458 - RNA, 21 nt, Human
cuguggguuucuaaagcugcc

SEQ ID NO: 1209459 - RNA, 15 nt, Human
cugugccaugugcca

SEQ ID NO: 1209460 - RNA, 19 nt, Human
cugugcccuaaaguguauu

SEQ ID NO: 1209461 - RNA, 14 nt, Human
cugugccaugugcc

SEQ ID NO: 1209462 - RNA, 17 nt, Human
cugugauggggcccugc

SEQ ID NO: 1209463 - RNA, 23 nt, Human
cugugauggggcccugccuccuu

SEQ ID NO: 1209464 - RNA, 21 nt, Human
cugugauggggcccugccucc

SEQ ID NO: 1209465 - RNA, 16 nt, Human
cugugauggggcccug

SEQ ID NO: 1209466 - RNA, 15 nt, Human
cugugauggggcccu

SEQ ID NO: 1209467 - RNA, 22 nt, Human
cugugaaaggaaagagggaggu

SEQ ID NO: 1209468 - RNA, 16 nt, Human
cugugaaaggaaagag

SEQ ID NO: 1209469 - RNA, 15 nt, Human
cugugaaaggaaaga

SEQ ID NO: 1209470 - RNA, 18 nt, Human
cugucuucaguaagccgu

SEQ ID NO: 1209471 - RNA, 23 nt, Human
cugucauuugagcagggcucagc

SEQ ID NO: 1209472 - RNA, 22 nt, Human
cugucauuugagcagggcucag

SEQ ID NO: 1209473 - RNA, 21 nt, Human
cugucauuugagcagggcuca

SEQ ID NO: 1209474 - RNA, 19 nt, Human
cugucaauuacaggaagua

SEQ ID NO: 1209475 - RNA, 18 nt, Human
cugucaauuacaggaagu

SEQ ID NO: 1209476 - RNA, 19 nt, Human
cugguggcagugggagcug

SEQ ID NO: 1209477 - RNA, 21 nt, Human
cugguggcagcucaccucucc

SEQ ID NO: 1209478 - RNA, 18 nt, Human
cugguggcagugggagcu

SEQ ID NO: 1209479 - RNA, 14 nt, Human
cugguggcaguggg

SEQ ID NO: 1209480 - RNA, 15 nt, Human
cugguggcagcugcg

SEQ ID NO: 1209481 - RNA, 20 nt, Human
cugguggcagcucaccucuc

SEQ ID NO: 1209482 - RNA, 18 nt, Human
cugguggcagcucaccuc

SEQ ID NO: 1209483 - RNA, 17 nt, Human
cugguggcagcucaccu

SEQ ID NO: 1209484 - RNA, 22 nt, Human
cuguacagagcccacgccccca

SEQ ID NO: 1209485 - RNA, 18 nt, Human
cuguacagagcccacgcc

SEQ ID NO: 1209486 - RNA, 15 nt, Human
cuguacagagcccac

SEQ ID NO: 1209487 - RNA, 17 nt, Human
cuguaauuugugauaca

SEQ ID NO: 1209488 - RNA, 15 nt, Human
cuguaauuugugaua

SEQ ID NO: 1209489 - RNA, 14 nt, Human
cuguaauuugugau

SEQ ID NO: 1209490 - RNA, 19 nt, Human
cuguaauccuagcacuuug

SEQ ID NO: 1209491 - RNA, 22 nt, Human
cugguuagagguucccuuugac

SEQ ID NO: 1209492 - RNA, 21 nt, Human
cugguuagagguucccuuuga

SEQ ID NO: 1209493 - RNA, 16 nt, Human
cugucaauuacaggaa

SEQ ID NO: 1209494 - RNA, 15 nt, Human
cugucaauuacagga

SEQ ID NO: 1209495 - RNA, 20 nt, Human
cuguauuuuguuuuugucuu

SEQ ID NO: 1209496 - RNA, 20 nt, Human
cuguaucccaugagccucag

SEQ ID NO: 1209497 - RNA, 22 nt, Human
cuguaucccaugagccucagca

SEQ ID NO: 1209498 - RNA, 21 nt, Human
cuguaucccaugagccucagc

SEQ ID NO: 1209499 - RNA, 18 nt, Human
cuguacgucugacaggca

SEQ ID NO: 1209500 - RNA, 16 nt, Human
cuguacgucugacagg

SEQ ID NO: 1209501 - RNA, 15 nt, Human
cuguacgucugacag

SEQ ID NO: 1209502 - RNA, 14 nt, Human
cuguacgucugaca

SEQ ID NO: 1209503 - RNA, 21 nt, Human
cuguacaugaaaacacauuuu

SEQ ID NO: 1209504 - RNA, 20 nt, Human
cuguacaugaaaacacauuu

SEQ ID NO: 1209505 - RNA, 17 nt, Human
cuguacaugaaaacaca

SEQ ID NO: 1209506 - RNA, 20 nt, Human
cuguacgucugacaggcaau

SEQ ID NO: 1209507 - RNA, 19 nt, Human
cuguacgucugacaggcaa

SEQ ID NO: 1209508 - RNA, 18 nt, Human
cugggggcugggcagagg

SEQ ID NO: 1209509 - RNA, 14 nt, Human
cugggggcugggca

SEQ ID NO: 1209510 - RNA, 18 nt, Human
cugggcuugucuguagau

SEQ ID NO: 1209511 - RNA, 22 nt, Human
cugggcuuggggaccagagcug

SEQ ID NO: 1209512 - RNA, 17 nt, Human
cugggcuucaguggcag

SEQ ID NO: 1209513 - RNA, 15 nt, Human
cugggcuucaguggc

SEQ ID NO: 1209514 - RNA, 20 nt, Human
cuggguaacuagggaagaua

SEQ ID NO: 1209515 - RNA, 21 nt, Human
cugggauuacaagcgugagcc

SEQ ID NO: 1209516 - RNA, 17 nt, Human
cugauugugucucuugg

SEQ ID NO: 1209517 - RNA, 21 nt, Human
cugauggugcaaugaccuuuc

SEQ ID NO: 1209518 - RNA, 20 nt, Human
cugauggugcaaugaccuuu

SEQ ID NO: 1209519 - RNA, 19 nt, Human
cugauggugcaaugaccuu

SEQ ID NO: 1209520 - RNA, 17 nt, Human
cugauggugcaaugacc

SEQ ID NO: 1209521 - RNA, 21 nt, Human
cugauugugucucuugguccu

SEQ ID NO: 1209522 - RNA, 20 nt, Human
cugauuuuuuuuuccuucag

SEQ ID NO: 1209523 - RNA, 19 nt, Human
cugauuuuuuuuuccuuca

SEQ ID NO: 1209524 - RNA, 18 nt, Human
cugauuuuuuuuuccuuc

SEQ ID NO: 1209525 - RNA, 16 nt, Human
cugauuuuuuuuuccu

SEQ ID NO: 1209526 - RNA, 23 nt, Human
cugauuuuuuuuuccuucagugc

SEQ ID NO: 1209527 - RNA, 22 nt, Human
cugauuuuuuuuuccuucagug

SEQ ID NO: 1209528 - RNA, 21 nt, Human
cugauuuuuuuuuccuucagu

SEQ ID NO: 1209529 - RNA, 18 nt, Human
cugcacuugcagacucua

SEQ ID NO: 1209530 - RNA, 18 nt, Human
cugcacuccccugcuggg

SEQ ID NO: 1209531 - RNA, 17 nt, Human
cugcacuccccugcugg

SEQ ID NO: 1209532 - RNA, 16 nt, Human
cugcacuccccugcug

SEQ ID NO: 1209533 - RNA, 15 nt, Human
cugcacuccccugcu

SEQ ID NO: 1209534 - RNA, 14 nt, Human
cugcaccgggccac

SEQ ID NO: 1209535 - RNA, 12 nt, Human
cugcaccgggcc

SEQ ID NO: 1209536 - RNA, 23 nt, Human
cugcaccggcuggccuggccccu

SEQ ID NO: 1209537 - RNA, 22 nt, Human
cugcaccggcuggccuggcccc

SEQ ID NO: 1209538 - RNA, 16 nt, Human
cugcacccucaggcag

SEQ ID NO: 1209539 - RNA, 14 nt, Human
cugcacccucaggc

SEQ ID NO: 1209540 - RNA, 13 nt, Human
cugcacccucagg

SEQ ID NO: 1209541 - RNA, 22 nt, Human
cugcacaagcugcacccucagg

SEQ ID NO: 1209542 - RNA, 18 nt, Human
cugcaauaaggggagagu

SEQ ID NO: 1209543 - RNA, 19 nt, Human
cugagucugaaggcugggu

SEQ ID NO: 1209544 - RNA, 18 nt, Human
cugagucugaaggcuggg

SEQ ID NO: 1209545 - RNA, 16 nt, Human
cugauggugcaaugac

SEQ ID NO: 1209546 - RNA, 15 nt, Human
cugauggugcaauga

SEQ ID NO: 1209547 - RNA, 14 nt, Human
cugauggugcaaug

SEQ ID NO: 1209548 - RNA, 21 nt, Human
cugauccuaguuccaccauca

SEQ ID NO: 1209549 - RNA, 20 nt, Human
cugauccuaguuccaccauc

SEQ ID NO: 1209550 - RNA, 22 nt, Human
cugaggcugggcucccuuccca

SEQ ID NO: 1209551 - RNA, 17 nt, Human
cugaggcugggcucccu

SEQ ID NO: 1209552 - RNA, 16 nt, Human
cugaggcugggcuccc

SEQ ID NO: 1209553 - RNA, 15 nt, Human
cugaggcugggcucc

SEQ ID NO: 1209554 - RNA, 13 nt, Human
cugaggcugggcu

SEQ ID NO: 1209555 - RNA, 22 nt, Human
cugccugcccaggccccugcca

SEQ ID NO: 1209556 - RNA, 21 nt, Human
cugccugcccaggccccugcc

SEQ ID NO: 1209557 - RNA, 21 nt, Human
cugccucugacacacagcucu

SEQ ID NO: 1209558 - RNA, 18 nt, Human
cugccucugacacacagc

SEQ ID NO: 1209559 - RNA, 17 nt, Human
cugccucugacacacag

SEQ ID NO: 1209560 - RNA, 18 nt, Human
cugcgguccacccaggag

SEQ ID NO: 1209561 - RNA, 20 nt, Human
cugcgguccacccaggagcc

SEQ ID NO: 1209562 - RNA, 19 nt, Human
cugcgguccacccaggagc

SEQ ID NO: 1209563 - RNA, 15 nt, Human
cugccucagccuccc

SEQ ID NO: 1209564 - RNA, 19 nt, Human
cugccucagccucccaaag

SEQ ID NO: 1209565 - RNA, 14 nt, Human
cugccgcagcccug

SEQ ID NO: 1209566 - RNA, 23 nt, Human
cugccgcagcccugcagagggca

SEQ ID NO: 1209567 - RNA, 22 nt, Human
cugccgcagcccugcagagggc

SEQ ID NO: 1209568 - RNA, 21 nt, Human
cugccgcagcccugcagaggg

SEQ ID NO: 1209569 - RNA, 20 nt, Human
cugccgcagcccugcagagg

SEQ ID NO: 1209570 - RNA, 13 nt, Human
cugccgcagcccu

SEQ ID NO: 1209571 - RNA, 12 nt, Human
cugccgcagccc

SEQ ID NO: 1209572 - RNA, 13 nt, Human
cugccaggcaugg

SEQ ID NO: 1209573 - RNA, 11 nt, Human
cugccaggcau

SEQ ID NO: 1209574 - RNA, 15 nt, Human
cugcccaccuggccu

SEQ ID NO: 1209575 - RNA, 14 nt, Human
cugcccaccuggcc

SEQ ID NO: 1209576 - RNA, 15 nt, Human
cugccaugccagcuu

SEQ ID NO: 1209577 - RNA, 14 nt, Human
cugccaugccagcu

SEQ ID NO: 1209578 - RNA, 16 nt, Human
cugcccacucccugca

SEQ ID NO: 1209579 - RNA, 15 nt, Human
cugcccacucccugc

SEQ ID NO: 1209580 - RNA, 14 nt, Human
cugcccacucccug

SEQ ID NO: 1209581 - RNA, 22 nt, Human
cugcccaccuggccucugcacu

SEQ ID NO: 1209582 - RNA, 20 nt, Human
cugcccaccuggccucugca

SEQ ID NO: 1209583 - RNA, 19 nt, Human
cugcccaccuggccucugc

SEQ ID NO: 1209584 - RNA, 18 nt, Human
cugcccaccuggccucug

SEQ ID NO: 1209585 - RNA, 17 nt, Human
cugcccaccuggccucu

SEQ ID NO: 1209586 - RNA, 18 nt, Human
cugcccacucccugcaac

SEQ ID NO: 1209587 - RNA, 19 nt, Human
cugccaaugggagcucaug

SEQ ID NO: 1209588 - RNA, 18 nt, Human
cugccaaugggagcucau

SEQ ID NO: 1209589 - RNA, 22 nt, Human
cugcaugcgggcuuccuccugg

SEQ ID NO: 1209590 - RNA, 18 nt, Human
cugcaugcgggcuuccuc

SEQ ID NO: 1209591 - RNA, 22 nt, Human
cugcaguugccagucaccccgg

SEQ ID NO: 1209592 - RNA, 21 nt, Human
cugcaguugccagucaccccg

SEQ ID NO: 1209593 - RNA, 19 nt, Human
cugcaguugccagucaccc

SEQ ID NO: 1209594 - RNA, 23 nt, Human
cugcacuugcagacucuacagag

SEQ ID NO: 1209595 - RNA, 22 nt, Human
cugcaucguuucaucuuccaac

SEQ ID NO: 1209596 - RNA, 16 nt, Human
cugcaucguuucaucu

SEQ ID NO: 1209597 - RNA, 15 nt, Human
cugagccagauuuca

SEQ ID NO: 1209598 - RNA, 14 nt, Human
cugagccagauuuc

SEQ ID NO: 1209599 - RNA, 13 nt, Human
cugagccagauuu

SEQ ID NO: 1209600 - RNA, 22 nt, Human
cugagacagcccgggcucugcc

SEQ ID NO: 1209601 - RNA, 21 nt, Human
cugagacagcccgggcucugc

SEQ ID NO: 1209602 - RNA, 20 nt, Human
cugagacagcccgggcucug

SEQ ID NO: 1209603 - RNA, 14 nt, Human
cugaauuucuuuug

SEQ ID NO: 1209604 - RNA, 16 nt, Human
cugacagacacaggcc

SEQ ID NO: 1209605 - RNA, 18 nt, Human
cugacagacacaggcccg

SEQ ID NO: 1209606 - RNA, 17 nt, Human
cugacagacacaggccc

SEQ ID NO: 1209607 - RNA, 19 nt, Human
cugacagacacaggcccgg

SEQ ID NO: 1209608 - RNA, 12 nt, Human
cugaauuucuuu

SEQ ID NO: 1209609 - RNA, 20 nt, Human
cugaaugguuuucaaaauaa

SEQ ID NO: 1209610 - RNA, 19 nt, Human
cugaaugguuuucaaaaua

SEQ ID NO: 1209611 - RNA, 24 nt, Human
cugaagucuuuguacagacaacaa

SEQ ID NO: 1209612 - RNA, 17 nt, Human
cugaaguucagcugcau

SEQ ID NO: 1209613 - RNA, 20 nt, Human
cugaagucuuuguacagaca

SEQ ID NO: 1209614 - RNA, 17 nt, Human
cugaagucuuuguacag

SEQ ID NO: 1209615 - RNA, 22 nt, Human
cugaagucccagauacuugggg

SEQ ID NO: 1209616 - RNA, 19 nt, Human
cugaagucacacagugagu

SEQ ID NO: 1209617 - RNA, 18 nt, Human
cugaagucacacagugag

SEQ ID NO: 1209618 - RNA, 17 nt, Human
cugaagucacacaguga

SEQ ID NO: 1209619 - RNA, 21 nt, Human
cugaagucacacagugagucg

SEQ ID NO: 1209620 - RNA, 23 nt, Human
cugaaagggacgcuacccgggaa

SEQ ID NO: 1209621 - RNA, 14 nt, Human
cucuuuucaaaaca

SEQ ID NO: 1209622 - RNA, 23 nt, Human
cucuuuggucuacacugugcuga

SEQ ID NO: 1209623 - RNA, 22 nt, Human
cucuuuggucuacacugugcug

SEQ ID NO: 1209624 - RNA, 16 nt, Human
cucuucuccaggcugu

SEQ ID NO: 1209625 - RNA, 20 nt, Human
cucugcccacucccugcaac

SEQ ID NO: 1209626 - RNA, 18 nt, Human
cucugcccacucccugca

SEQ ID NO: 1209627 - RNA, 17 nt, Human
cucugcccacucccugc

SEQ ID NO: 1209628 - RNA, 16 nt, Human
cucugcccacucccug

SEQ ID NO: 1209629 - RNA, 15 nt, Human
cucugcccacucccu

SEQ ID NO: 1209630 - RNA, 13 nt, Human
cucugcccacucc

SEQ ID NO: 1209631 - RNA, 17 nt, Human
cucugccucccaucacc

SEQ ID NO: 1209632 - RNA, 16 nt, Human
cucugccucccaucac

SEQ ID NO: 1209633 - RNA, 14 nt, Human
cucugccucccauc

SEQ ID NO: 1209634 - RNA, 13 nt, Human
cucugccucccau

SEQ ID NO: 1209635 - RNA, 13 nt, Human
cucugcacaagcu

SEQ ID NO: 1209636 - RNA, 15 nt, Human
cucugcacaagcugc

SEQ ID NO: 1209637 - RNA, 14 nt, Human
cucugcacaagcug

SEQ ID NO: 1209638 - RNA, 16 nt, Human
cucugcacaagcugca

SEQ ID NO: 1209639 - RNA, 23 nt, Human
cucugacagaagaaccccagggu

SEQ ID NO: 1209640 - RNA, 19 nt, Human
cucugacacacagcucugu

SEQ ID NO: 1209641 - RNA, 18 nt, Human
cucugacacacagcucug

SEQ ID NO: 1209642 - RNA, 17 nt, Human
cucugacacacagcucu

SEQ ID NO: 1209643 - RNA, 16 nt, Human
cucugacacacagcuc

SEQ ID NO: 1209644 - RNA, 15 nt, Human
cucugacacacagcu

SEQ ID NO: 1209645 - RNA, 14 nt, Human
cucugacacacagc

SEQ ID NO: 1209646 - RNA, 16 nt, Human
cucugaggacacuaac

SEQ ID NO: 1209647 - RNA, 14 nt, Human
cucugaggacacua

SEQ ID NO: 1209648 - RNA, 12 nt, Human
cucugaggacac

SEQ ID NO: 1209649 - RNA, 23 nt, Human
cucugagacucgcgacaaugcaa

SEQ ID NO: 1209650 - RNA, 21 nt, Human
cucugagacucgcgacaaugc

SEQ ID NO: 1209651 - RNA, 13 nt, Human
cucuuaaaaccca

SEQ ID NO: 1209652 - RNA, 23 nt, Human
cucugugucagguggggcagcuu

SEQ ID NO: 1209653 - RNA, 22 nt, Human
cucugugucagguggggcagcu

SEQ ID NO: 1209654 - RNA, 21 nt, Human
cucugugucagguggggcagc

SEQ ID NO: 1209655 - RNA, 20 nt, Human
cucugugucagguggggcag

SEQ ID NO: 1209656 - RNA, 15 nt, Human
cucuucuccaggcug

SEQ ID NO: 1209657 - RNA, 23 nt, Human
cucuggcagcucagagagggugg

SEQ ID NO: 1209658 - RNA, 10 nt, Human
cucugccuga

SEQ ID NO: 1209659 - RNA, 20 nt, Human
cucugccucugacacacagc

SEQ ID NO: 1209660 - RNA, 19 nt, Human
cucugccucugacacacag

SEQ ID NO: 1209661 - RNA, 21 nt, Human
cucugccucccaucacccgcu

SEQ ID NO: 1209662 - RNA, 22 nt, Human
cucuguccugggagugagcugg

SEQ ID NO: 1209663 - RNA, 15 nt, Human
cucuguccugggagu

SEQ ID NO: 1209664 - RNA, 14 nt, Human
cucuguccugggag

SEQ ID NO: 1209665 - RNA, 19 nt, Human
cucugucgcccagucugga

SEQ ID NO: 1209666 - RNA, 18 nt, Human
cucugucgcccagucugg

SEQ ID NO: 1209667 - RNA, 17 nt, Human
cucugucgcccagucug

SEQ ID NO: 1209668 - RNA, 13 nt, Human
cucugucgcccag

SEQ ID NO: 1209669 - RNA, 18 nt, Human
cuauuguuagucucuuga

SEQ ID NO: 1209670 - RNA, 17 nt, Human
cucaaccuccugggcua

SEQ ID NO: 1209671 - RNA, 15 nt, Human
cucaaccuccugggc

SEQ ID NO: 1209672 - RNA, 13 nt, Human
cucaaccuccugg

SEQ ID NO: 1209673 - RNA, 21 nt, Human
cucaacaccucugcacaagcu

SEQ ID NO: 1209674 - RNA, 19 nt, Human
cucaccagccccagugccc

SEQ ID NO: 1209675 - RNA, 18 nt, Human
cucaccagccccagugcc

SEQ ID NO: 1209676 - RNA, 17 nt, Human
cucaccagccccagugc

SEQ ID NO: 1209677 - RNA, 15 nt, Human
cucaccagccccagu

SEQ ID NO: 1209678 - RNA, 14 nt, Human
cucaccagccccag

SEQ ID NO: 1209679 - RNA, 13 nt, Human
cucaccagcccca

SEQ ID NO: 1209680 - RNA, 22 nt, Human
cucacauuuauucugcucacau

SEQ ID NO: 1209681 - RNA, 19 nt, Human
cucacauuuauucugcuca

SEQ ID NO: 1209682 - RNA, 15 nt, Human
cucacauuuauucug

SEQ ID NO: 1209683 - RNA, 23 nt, Human
cucacaguccuuaccagcagagc

SEQ ID NO: 1209684 - RNA, 22 nt, Human
cucacaguccuuaccagcagag

SEQ ID NO: 1209685 - RNA, 19 nt, Human
cucacaguccuuaccagca

SEQ ID NO: 1209686 - RNA, 17 nt, Human
cucacaguccuuaccag

SEQ ID NO: 1209687 - RNA, 15 nt, Human
cucacaguccuuacc

SEQ ID NO: 1209688 - RNA, 24 nt, Human
cucacacaugagcaucaggccagg

SEQ ID NO: 1209689 - RNA, 22 nt, Human
cucacacaugagcaucaggcca

SEQ ID NO: 1209690 - RNA, 17 nt, Human
cucaagugauucuccug

SEQ ID NO: 1209691 - RNA, 21 nt, Human
cucaaguccucuuuucugaga

SEQ ID NO: 1209692 - RNA, 17 nt, Human
cucagcauccuggcacc

SEQ ID NO: 1209693 - RNA, 16 nt, Human
cucagcauccuggcac

SEQ ID NO: 1209694 - RNA, 15 nt, Human
cucagaucuucugug

SEQ ID NO: 1209695 - RNA, 18 nt, Human
cucagagagggugggagu

SEQ ID NO: 1209696 - RNA, 14 nt, Human
cucagagagggugg

SEQ ID NO: 1209697 - RNA, 22 nt, Human
cucacuguugcccaggcuggcg

SEQ ID NO: 1209698 - RNA, 21 nt, Human
cucacuguugcccaggcuggc

SEQ ID NO: 1209699 - RNA, 20 nt, Human
cucacuguugcccaggcugg

SEQ ID NO: 1209700 - RNA, 22 nt, Human
cucacugccaugccagcuuauc

SEQ ID NO: 1209701 - RNA, 19 nt, Human
cucacugccaugccagcuu

SEQ ID NO: 1209702 - RNA, 22 nt, Human
cucacucugucgcccagucugg

SEQ ID NO: 1209703 - RNA, 21 nt, Human
cucacucugucgcccagucug

SEQ ID NO: 1209704 - RNA, 13 nt, Human
cucacucugucgc

SEQ ID NO: 1209705 - RNA, 12 nt, Human
cucacugcagcc

SEQ ID NO: 1209706 - RNA, 13 nt, Human
cucacugcagccu

SEQ ID NO: 1209707 - RNA, 14 nt, Human
cucacugcagccuc

SEQ ID NO: 1209708 - RNA, 12 nt, Human
cucacucugucg

SEQ ID NO: 1209709 - RNA, 11 nt, Human
cucacucuguc

SEQ ID NO: 1209710 - RNA, 13 nt, Human
cucacuccuugaa

SEQ ID NO: 1209711 - RNA, 20 nt, Human
cucacuauguugcccaggca

SEQ ID NO: 1209712 - RNA, 19 nt, Human
cucacuauguugcccaggc

SEQ ID NO: 1209713 - RNA, 15 nt, Human
cucaccccagcccca

SEQ ID NO: 1209714 - RNA, 23 nt, Human
cucacuauguugcccaggcaggu

SEQ ID NO: 1209715 - RNA, 22 nt, Human
cucacuauguugcccaggcagg

SEQ ID NO: 1209716 - RNA, 21 nt, Human
cucacuauguugcccaggcag

SEQ ID NO: 1209717 - RNA, 15 nt, Human
cuauuagagaagaga

SEQ ID NO: 1209718 - RNA, 23 nt, Human
cuaugggacucaaugcacugaca

SEQ ID NO: 1209719 - RNA, 22 nt, Human
cuaugggacucaaugcacugac

SEQ ID NO: 1209720 - RNA, 18 nt, Human
cuaugggacucaaugcac

SEQ ID NO: 1209721 - RNA, 18 nt, Human
cuauagccuaggugacag

SEQ ID NO: 1209722 - RNA, 17 nt, Human
cuauagccuaggugaca

SEQ ID NO: 1209723 - RNA, 22 nt, Human
cuauaauuuaccugaagucuuu

SEQ ID NO: 1209724 - RNA, 21 nt, Human
cuauaauguaagcucuacuga

SEQ ID NO: 1209725 - RNA, 16 nt, Human
cuauaauguaagcucu

SEQ ID NO: 1209726 - RNA, 24 nt, Human
cuaggugacagagugagacucugu

SEQ ID NO: 1209727 - RNA, 18 nt, Human
cuaggugacagagugaga

SEQ ID NO: 1209728 - RNA, 14 nt, Human
cuaggugacagagu

SEQ ID NO: 1209729 - RNA, 23 nt, Human
cgcccaguuggguggaugccugg

SEQ ID NO: 1209730 - RNA, 22 nt, Human
cgcccaguuggguggaugccug

SEQ ID NO: 1209731 - RNA, 15 nt, Human
cgccaugcuccuggc

SEQ ID NO: 1209732 - RNA, 20 nt, Human
cgccaucccagccccaauga

SEQ ID NO: 1209733 - RNA, 19 nt, Human
cucgagcaugccuggaugg

SEQ ID NO: 1209734 - RNA, 16 nt, Human
cucgagcaugccugga

SEQ ID NO: 1209735 - RNA, 15 nt, Human
cucgagcaugccugg

SEQ ID NO: 1209736 - RNA, 13 nt, Human
cucgagcaugccu

SEQ ID NO: 1209737 - RNA, 23 nt, Human
cuccuuggugucgggcaugacac

SEQ ID NO: 1209738 - RNA, 22 nt, Human
cucgagcaugccuggauggggc

SEQ ID NO: 1209739 - RNA, 13 nt, Human
cucgcgacaaugc

SEQ ID NO: 1209740 - RNA, 14 nt, Human
cuccuggaaauauu

SEQ ID NO: 1209741 - RNA, 24 nt, Human
cuccugugugugcgccuacaggag

SEQ ID NO: 1209742 - RNA, 23 nt, Human
cuccugugugugcgccuacagga

SEQ ID NO: 1209743 - RNA, 21 nt, Human
cuccugugugugcgccuacag

SEQ ID NO: 1209744 - RNA, 22 nt, Human
cuccugccucgaacuggcugca

SEQ ID NO: 1209745 - RNA, 21 nt, Human
cuccugccucgaacuggcugc

SEQ ID NO: 1209746 - RNA, 20 nt, Human
cuccugccucgaacuggcug

SEQ ID NO: 1209747 - RNA, 18 nt, Human
cuccugccucgaacuggc

SEQ ID NO: 1209748 - RNA, 22 nt, Human
cuccucuccccagcaagugaga

SEQ ID NO: 1209749 - RNA, 15 nt, Human
cuccucuccccagca

SEQ ID NO: 1209750 - RNA, 13 nt, Human
cuccucuccccag

SEQ ID NO: 1209751 - RNA, 17 nt, Human
cuccugccucagccucc

SEQ ID NO: 1209752 - RNA, 12 nt, Human
cuccugccucag

SEQ ID NO: 1209753 - RNA, 11 nt, Human
cuccugccuca

SEQ ID NO: 1209754 - RNA, 22 nt, Human
cuccuccagccgccaugcuccu

SEQ ID NO: 1209755 - RNA, 15 nt, Human
cuccuccagccgcca

SEQ ID NO: 1209756 - RNA, 15 nt, Human
cuccuccagagucag

SEQ ID NO: 1209757 - RNA, 13 nt, Human
cuccuccagaguc

SEQ ID NO: 1209758 - RNA, 18 nt, Human
cuccucagaucuucugug

SEQ ID NO: 1209759 - RNA, 20 nt, Human
cucccgaguagcugggacua

SEQ ID NO: 1209760 - RNA, 19 nt, Human
cucccgaguagcugggacu

SEQ ID NO: 1209761 - RNA, 16 nt, Human
cucccgaauagcuggg

SEQ ID NO: 1209762 - RNA, 23 nt, Human
cuccccagcaagugagagcuggg

SEQ ID NO: 1209763 - RNA, 22 nt, Human
cuccccagcaagugagagcugg

SEQ ID NO: 1209764 - RNA, 13 nt, Human
cuccacccugcuc

SEQ ID NO: 1209765 - RNA, 15 nt, Human
cuccacccugcucuc

SEQ ID NO: 1209766 - RNA, 17 nt, Human
cucauuugucacacacu

SEQ ID NO: 1209767 - RNA, 16 nt, Human
cuccaaaauaaaacuu

SEQ ID NO: 1209768 - RNA, 15 nt, Human
cuccaaaauaaaacu

SEQ ID NO: 1209769 - RNA, 18 nt, Human
cucauuugucacacacuu

SEQ ID NO: 1209770 - RNA, 18 nt, Human
cuccaaaauaaaacuuuu

SEQ ID NO: 1209771 - RNA, 15 nt, Human
cuccaccugccaggg

SEQ ID NO: 1209772 - RNA, 14 nt, Human
cuccaccugccagg

SEQ ID NO: 1209773 - RNA, 13 nt, Human
cuccaccugccag

SEQ ID NO: 1209774 - RNA, 12 nt, Human
cuccaccugcca

SEQ ID NO: 1209775 - RNA, 14 nt, Human
cuccagcucaccag

SEQ ID NO: 1209776 - RNA, 12 nt, Human
cuccagccuggg

SEQ ID NO: 1209777 - RNA, 20 nt, Human
cuccagccccuggaugcagc

SEQ ID NO: 1209778 - RNA, 17 nt, Human
cuccagccccuggaugc

SEQ ID NO: 1209779 - RNA, 16 nt, Human
cuccagccccuggaug

SEQ ID NO: 1209780 - RNA, 23 nt, Human
cuccaggagcagccacauuccug

SEQ ID NO: 1209781 - RNA, 18 nt, Human
cuccaggagcagccacau

SEQ ID NO: 1209782 - RNA, 17 nt, Human
cuccaggagcagccaca

SEQ ID NO: 1209783 - RNA, 16 nt, Human
cuccaggagcagccac

SEQ ID NO: 1209784 - RNA, 15 nt, Human
cuccaggagcagcca

SEQ ID NO: 1209785 - RNA, 14 nt, Human
cuccaggagcagcc

SEQ ID NO: 1209786 - RNA, 13 nt, Human
cuccaggagcagc

SEQ ID NO: 1209787 - RNA, 11 nt, Human
cuccaggagca

SEQ ID NO: 1209788 - RNA, 15 nt, Human
cucauccucauaccc

SEQ ID NO: 1209789 - RNA, 22 nt, Human
cucaucaccaacgucugugcca

SEQ ID NO: 1209790 - RNA, 21 nt, Human
cucaucaccaacgucugugcc

SEQ ID NO: 1209791 - RNA, 23 nt, Human
cucauaguaugguggcuggguug

SEQ ID NO: 1209792 - RNA, 21 nt, Human
cucauacccacccccacccaa

SEQ ID NO: 1209793 - RNA, 19 nt, Human
cucauacccacccccaccc

SEQ ID NO: 1209794 - RNA, 18 nt, Human
cucauacccacccccacc

SEQ ID NO: 1209795 - RNA, 16 nt, Human
cucauacccaccccca

SEQ ID NO: 1209796 - RNA, 22 nt, Human
cucaggugauccacccaccuca

SEQ ID NO: 1209797 - RNA, 20 nt, Human
cucaggugauccacccaccu

SEQ ID NO: 1209798 - RNA, 19 nt, Human
cucaggugauccacccacc

SEQ ID NO: 1209799 - RNA, 18 nt, Human
cucaggugauccacccac

SEQ ID NO: 1209800 - RNA, 22 nt, Human
cucauacucaccucaccccacu

SEQ ID NO: 1209801 - RNA, 14 nt, Human
cucauacucaccuc

SEQ ID NO: 1209802 - RNA, 21 nt, Human
cucauaguaugguggcugggu

SEQ ID NO: 1209803 - RNA, 20 nt, Human
cucaggugagaagcagagga

SEQ ID NO: 1209804 - RNA, 19 nt, Human
cucaggugagaagcagagg

SEQ ID NO: 1209805 - RNA, 16 nt, Human
cucaggugagaagcag

SEQ ID NO: 1209806 - RNA, 18 nt, Human
cucagggucccugguggc

SEQ ID NO: 1209807 - RNA, 17 nt, Human
cucagggucccuggugg

SEQ ID NO: 1209808 - RNA, 16 nt, Human
cucagggucccuggug

SEQ ID NO: 1209809 - RNA, 15 nt, Human
cucagggucccuggu

SEQ ID NO: 1209810 - RNA, 18 nt, Human
cucagggccuggcucagg

SEQ ID NO: 1209811 - RNA, 15 nt, Human
cucagggccuggucg

SEQ ID NO: 1209812 - RNA, 16 nt, Human
cucagggccuggcuca

SEQ ID NO: 1209813 - RNA, 15 nt, Human
cucagggccuggcuc

SEQ ID NO: 1209814 - RNA, 14 nt, Human
cucagggccuggcu

SEQ ID NO: 1209815 - RNA, 18 nt, Human
cucagcauccuggcaccc

SEQ ID NO: 1209816 - RNA, 23 nt, Human
cucaggaguuugagaccaaccug

SEQ ID NO: 1209817 - RNA, 18 nt, Human
cucaggaguuugagacca

SEQ ID NO: 1209818 - RNA, 20 nt, Human
cgagauugcaccacugcacu

SEQ ID NO: 1209819 - RNA, 20 nt, Human
cgagaucacgccacugcacu

SEQ ID NO: 1209820 - RNA, 18 nt, Human
cgagaucacgccacugca

SEQ ID NO: 1209821 - RNA, 17 nt, Human
cgagcaugccuggaugg

SEQ ID NO: 1209822 - RNA, 16 nt, Human
cgagcaugccuggaug

SEQ ID NO: 1209823 - RNA, 13 nt, Human
cgagcaugccugg

SEQ ID NO: 1209824 - RNA, 20 nt, Human
cgagcaggcuucuucccccc

SEQ ID NO: 1209825 - RNA, 17 nt, Human
cgagaucacgccacugc

SEQ ID NO: 1209826 - RNA, 18 nt, Human
cgagauagccaaggccaa

SEQ ID NO: 1209827 - RNA, 14 nt, Human
cgaauagcugggac

SEQ ID NO: 1209828 - RNA, 13 nt, Human
cgaauagcuggga

SEQ ID NO: 1209829 - RNA, 15 nt, Human
cgaauagcugggacu

SEQ ID NO: 1209830 - RNA, 20 nt, Human
cgaaaacguggcugcuucaa

SEQ ID NO: 1209831 - RNA, 19 nt, Human
cgaaaacguggcugcuuca

SEQ ID NO: 1209832 - RNA, 18 nt, Human
cgaaaacguggcugcuuc

SEQ ID NO: 1209833 - RNA, 15 nt, Human
cgaaaacguggcugc

SEQ ID NO: 1209834 - RNA, 23 nt, Human
ccuuugacgccaucccagcccca

SEQ ID NO: 1209835 - RNA, 22 nt, Human
ccuuugacgccaucccagcccc

SEQ ID NO: 1209836 - RNA, 21 nt, Human
ccuuugacgccaucccagccc

SEQ ID NO: 1209837 - RNA, 20 nt, Human
ccuuugacgccaucccagcc

SEQ ID NO: 1209838 - RNA, 22 nt, Human
cgaaagggacuuggaagcuccg

SEQ ID NO: 1209839 - RNA, 19 nt, Human
cgaaagggacuuggaagcu

SEQ ID NO: 1209840 - RNA, 20 nt, Human
cgaaaggaugaaagugacca

SEQ ID NO: 1209841 - RNA, 12 nt, Human
cgaaagaacagu

SEQ ID NO: 1209842 - RNA, 21 nt, Human
cgaaagaacaguccauugaaa

SEQ ID NO: 1209843 - RNA, 14 nt, Human
cgaacuggcugcaa

SEQ ID NO: 1209844 - RNA, 12 nt, Human
cgaacuggcugc

SEQ ID NO: 1209845 - RNA, 17 nt, Human
cgccaugcuccuggccc

SEQ ID NO: 1209846 - RNA, 18 nt, Human
cgagcccugguggcagug

SEQ ID NO: 1209847 - RNA, 16 nt, Human
cgagcccugguggcag

SEQ ID NO: 1209848 - RNA, 15 nt, Human
cgagcccugguggca

SEQ ID NO: 1209849 - RNA, 18 nt, Human
cgagcaugccuggauggg

SEQ ID NO: 1209850 - RNA, 22 nt, Human
cgccaggggaaaaucagccugc

SEQ ID NO: 1209851 - RNA, 22 nt, Human
cgccagauucuuuccugaggcu

SEQ ID NO: 1209852 - RNA, 21 nt, Human
cgccagauucuuuccugaggc

SEQ ID NO: 1209853 - RNA, 20 nt, Human
cgccagauucuuuccugagg

SEQ ID NO: 1209854 - RNA, 19 nt, Human
cgccagauucuuuccugag

SEQ ID NO: 1209855 - RNA, 15 nt, Human
cgcagcccugcagag

SEQ ID NO: 1209856 - RNA, 16 nt, Human
cgcagacaggaccagg

SEQ ID NO: 1209857 - RNA, 15 nt, Human
cgcagacaggaccag

SEQ ID NO: 1209858 - RNA, 14 nt, Human
cgcagcccugcaga

SEQ ID NO: 1209859 - RNA, 14 nt, Human
cgagcaugccugga

SEQ ID NO: 1209860 - RNA, 18 nt, Human
ccuuugacgccaucccag

SEQ ID NO: 1209861 - RNA, 17 nt, Human
ccuuugacgccauccca

SEQ ID NO: 1209862 - RNA, 16 nt, Human
ccuuugacgccauccc

SEQ ID NO: 1209863 - RNA, 22 nt, Human
ccuugguuaggcauugugggaa

SEQ ID NO: 1209864 - RNA, 21 nt, Human
ccuugguuaggcauuguggga

SEQ ID NO: 1209865 - RNA, 22 nt, Human
ccuuggugucgggcaugacacg

SEQ ID NO: 1209866 - RNA, 20 nt, Human
ccuugaguugauucagcucu

SEQ ID NO: 1209867 - RNA, 13 nt, Human
ccuugacucuuuc

SEQ ID NO: 1209868 - RNA, 23 nt, Human
ccuugaccauucuccaccugcca

SEQ ID NO: 1209869 - RNA, 19 nt, Human
ccuucuccuucaccuuugu

SEQ ID NO: 1209870 - RNA, 15 nt, Human
ccuucuccuucaccu

SEQ ID NO: 1209871 - RNA, 15 nt, Human
ccuucggcgccuuaa

SEQ ID NO: 1209872 - RNA, 22 nt, Human
ccuucauuuggcauuccccacu

SEQ ID NO: 1209873 - RNA, 14 nt, Human
ccuucagugccaaa

SEQ ID NO: 1209874 - RNA, 11 nt, Human
ccuucagugcc

SEQ ID NO: 1209875 - RNA, 20 nt, Human
ccuucaccuuuguccccacc

SEQ ID NO: 1209876 - RNA, 19 nt, Human
ccuucaccuuuguccccac

SEQ ID NO: 1209877 - RNA, 14 nt, Human
ccuuagacaguccc

SEQ ID NO: 1209878 - RNA, 17 nt, Human
ccuucacagaugggugc

SEQ ID NO: 1209879 - RNA, 21 nt, Human
ccuucaccuuuguccccaccg

SEQ ID NO: 1209880 - RNA, 17 nt, Human
ccuugaaugaugccaug

SEQ ID NO: 1209881 - RNA, 20 nt, Human
ccuuacacaaugguuuucuu

SEQ ID NO: 1209882 - RNA, 14 nt, Human
ccuuacacaauggu

SEQ ID NO: 1209883 - RNA, 18 nt, Human
ccuuagaagucacacagu

SEQ ID NO: 1209884 - RNA, 17 nt, Human
ccuuagaagucacacag

SEQ ID NO: 1209885 - RNA, 19 nt, Human
ccuuaccugccaggaagcc

SEQ ID NO: 1209886 - RNA, 19 nt, Human
ccuuacccucauguucuua

SEQ ID NO: 1209887 - RNA, 15 nt, Human
ccuuacccucauguu

SEQ ID NO: 1209888 - RNA, 20 nt, Human
ccuuaccagcagagcaccuu

SEQ ID NO: 1209889 - RNA, 13 nt, Human
ccuuaccagcaga

SEQ ID NO: 1209890 - RNA, 21 nt, Human
ccugugugugcgccuacagga

SEQ ID NO: 1209891 - RNA, 20 nt, Human
ccugugugugcgccuacagg

SEQ ID NO: 1209892 - RNA, 22 nt, Human
ccugugucuugcaauggcagcc

SEQ ID NO: 1209893 - RNA, 21 nt, Human
ccugugucuugcaauggcagc

SEQ ID NO: 1209894 - RNA, 19 nt, Human
ccugugucuugcaauggca

SEQ ID NO: 1209895 - RNA, 17 nt, Human
ccugugucuugcaaugg

SEQ ID NO: 1209896 - RNA, 18 nt, Human
ccuguuuguuucugaaag

SEQ ID NO: 1209897 - RNA, 14 nt, Human
ccuguuuguuucug

SEQ ID NO: 1209898 - RNA, 16 nt, Human
ccuguuucugcagcca

SEQ ID NO: 1209899 - RNA, 12 nt, Human
ccuucagugccu

SEQ ID NO: 1209900 - RNA, 16 nt, Human
ccugagcuuucugcua

SEQ ID NO: 1209901 - RNA, 21 nt, Human
ccugaggcccagagggccugc

SEQ ID NO: 1209902 - RNA, 14 nt, Human
ccugagcuuucugc

SEQ ID NO: 1209903 - RNA, 12 nt, Human
ccugagccagau

SEQ ID NO: 1209904 - RNA, 17 nt, Human
ccugccaggaagccagc

SEQ ID NO: 1209905 - RNA, 15 nt, Human
ccugccaggaagcca

SEQ ID NO: 1209906 - RNA, 14 nt, Human
ccugccaggaagcc

SEQ ID NO: 1209907 - RNA, 13 nt, Human
ccugccaggaagc

SEQ ID NO: 1209908 - RNA, 22 nt, Human
ccugccagggacagagggggug

SEQ ID NO: 1209909 - RNA, 16 nt, Human
ccugccagggacagag

SEQ ID NO: 1209910 - RNA, 15 nt, Human
ccugccagggacaga

SEQ ID NO: 1209911 - RNA, 14 nt, Human
ccugccagggacag

SEQ ID NO: 1209912 - RNA, 13 nt, Human
ccugccagggaca

SEQ ID NO: 1209913 - RNA, 12 nt, Human
ccugccagggac

SEQ ID NO: 1209914 - RNA, 11 nt, Human
ccugccaggga

SEQ ID NO: 1209915 - RNA, 16 nt, Human
ccugccaggcauggug

SEQ ID NO: 1209916 - RNA, 23 nt, Human
ccugccaggaagccagcaggcuc

SEQ ID NO: 1209917 - RNA, 22 nt, Human
ccugccaggaagccagcaggcu

SEQ ID NO: 1209918 - RNA, 21 nt, Human
ccugccaggaagccagcaggc

SEQ ID NO: 1209919 - RNA, 19 nt, Human
ccugccaggaagccagcag

SEQ ID NO: 1209920 - RNA, 18 nt, Human
ccugccaggaagccagca

SEQ ID NO: 1209921 - RNA, 22 nt, Human
ccugcaaccugauugugucucu

SEQ ID NO: 1209922 - RNA, 19 nt, Human
ccugauugugucucuuggu

SEQ ID NO: 1209923 - RNA, 17 nt, Human
ccugauugugucucuug

SEQ ID NO: 1209924 - RNA, 15 nt, Human
ccugauugugucucu

SEQ ID NO: 1209925 - RNA, 14 nt, Human
ccugaggcccuucu

SEQ ID NO: 1209926 - RNA, 22 nt, Human
ccugaugcuucuucagagacuc

SEQ ID NO: 1209927 - RNA, 21 nt, Human
ccugaugcuucuucagagacu

SEQ ID NO: 1209928 - RNA, 20 nt, Human
ccugaugcuucuucagagac

SEQ ID NO: 1209929 - RNA, 12 nt, Human
ccugaggcccuu

SEQ ID NO: 1209930 - RNA, 11 nt, Human
ccugaggcccu

SEQ ID NO: 1209931 - RNA, 14 nt, Human
ccugcaagaacaag

SEQ ID NO: 1209932 - RNA, 20 nt, Human
ccuggccagaugcaccagcc

SEQ ID NO: 1209933 - RNA, 15 nt, Human
ccuggccagaugcac

SEQ ID NO: 1209934 - RNA, 14 nt, Human
ccuggcagccccug

SEQ ID NO: 1209935 - RNA, 13 nt, Human
ccuggcagccccu

SEQ ID NO: 1209936 - RNA, 12 nt, Human
ccuggcagcccc

SEQ ID NO: 1209937 - RNA, 22 nt, Human
ccuggcacuauaauguaagcuc

SEQ ID NO: 1209938 - RNA, 23 nt, Human
ccuggcacccggccccugcuggu

SEQ ID NO: 1209939 - RNA, 22 nt, Human
ccuggcacccggccccugcugg

SEQ ID NO: 1209940 - RNA, 18 nt, Human
ccuggaauauauaaccag

SEQ ID NO: 1209941 - RNA, 23 nt, Human
ccugccuguugggccaggagccu

SEQ ID NO: 1209942 - RNA, 11 nt, Human
ccugccucagc

SEQ ID NO: 1209943 - RNA, 22 nt, Human
ccugccccucaacucuccucca

SEQ ID NO: 1209944 - RNA, 17 nt, Human
ccugcggugcuaucucc

SEQ ID NO: 1209945 - RNA, 16 nt, Human
ccugcggugcuaucuc

SEQ ID NO: 1209946 - RNA, 14 nt, Human
ccugcuucaaauau

SEQ ID NO: 1209947 - RNA, 21 nt, Human
ccugcucuccgaccagacacc

SEQ ID NO: 1209948 - RNA, 22 nt, Human
ccugcggugcuaucucccccag

SEQ ID NO: 1209949 - RNA, 22 nt, Human
ccugcucuccgaccagacaccu

SEQ ID NO: 1209950 - RNA, 16 nt, Human
ccucuaggaggucucu

SEQ ID NO: 1209951 - RNA, 18 nt, Human
ccucgguguggagaagcg

SEQ ID NO: 1209952 - RNA, 14 nt, Human
ccucgguguggaga

SEQ ID NO: 1209953 - RNA, 16 nt, Human
ccucggugccuuccuc

SEQ ID NO: 1209954 - RNA, 14 nt, Human
ccuccugggcuaag

SEQ ID NO: 1209955 - RNA, 23 nt, Human
ccuccugccucgaacuggcugca

SEQ ID NO: 1209956 - RNA, 21 nt, Human
ccucccgaguagcugggacua

SEQ ID NO: 1209957 - RNA, 20 nt, Human
ccucccgaguagcugggacu

SEQ ID NO: 1209958 - RNA, 10 nt, Human
ccucccuccc

SEQ ID NO: 1209959 - RNA, 17 nt, Human
ccucccgaauagcuggg

SEQ ID NO: 1209960 - RNA, 16 nt, Human
ccucccaaagugcugg

SEQ ID NO: 1209961 - RNA, 15 nt, Human
ccucccaaagugcug

SEQ ID NO: 1209962 - RNA, 23 nt, Human
ccuccaugugggcuaguugggcu

SEQ ID NO: 1209963 - RNA, 21 nt, Human
ccuccaggugcacaagcucca

SEQ ID NO: 1209964 - RNA, 19 nt, Human
ccuccaggugcacaagcuc

SEQ ID NO: 1209965 - RNA, 22 nt, Human
ccuccaggugcacaagcuccaa

SEQ ID NO: 1209966 - RNA, 20 nt, Human
ccucauccucauacccaccc

SEQ ID NO: 1209967 - RNA, 13 nt, Human
ccucauccucaua

SEQ ID NO: 1209968 - RNA, 14 nt, Human
ccucaucaccaacg

SEQ ID NO: 1209969 - RNA, 13 nt, Human
ccucaucaccaac

SEQ ID NO: 1209970 - RNA, 22 nt, Human
ccucauaguaugguggcugggu

SEQ ID NO: 1209971 - RNA, 21 nt, Human
ccucauaguaugguggcuggg

SEQ ID NO: 1209972 - RNA, 20 nt, Human
ccucauaguaugguggcugg

SEQ ID NO: 1209973 - RNA, 13 nt, Human
ccucauacccacc

SEQ ID NO: 1209974 - RNA, 11 nt, Human
ccucagugcca

SEQ ID NO: 1209975 - RNA, 20 nt, Human
ccucagucuggcccuuccuu

SEQ ID NO: 1209976 - RNA, 18 nt, Human
ccggcuggccuggccccu

SEQ ID NO: 1209977 - RNA, 17 nt, Human
ccggcuggccuggcccc

SEQ ID NO: 1209978 - RNA, 23 nt, Human
ccgcuuucuacccagcgagcccu

SEQ ID NO: 1209979 - RNA, 19 nt, Human
ccgcuuucuacccagcgag

SEQ ID NO: 1209980 - RNA, 12 nt, Human
ccgcuuucuacc

SEQ ID NO: 1209981 - RNA, 13 nt, Human
ccgggcucugccu

SEQ ID NO: 1209982 - RNA, 20 nt, Human
ccgggcgcgguggcucacgc

SEQ ID NO: 1209983 - RNA, 14 nt, Human
ccgaggccuucucu

SEQ ID NO: 1209984 - RNA, 20 nt, Human
cccugguggcagcucaccuc

SEQ ID NO: 1209985 - RNA, 20 nt, Human
ccgaguagcugggacuacag

SEQ ID NO: 1209986 - RNA, 17 nt, Human
ccgaguagcugggacua

SEQ ID NO: 1209987 - RNA, 17 nt, Human
ccgaggccuucucugaa

SEQ ID NO: 1209988 - RNA, 19 nt, Human
ccgcacugggcuuggggac

SEQ ID NO: 1209989 - RNA, 14 nt, Human
ccgcacugggcuug

SEQ ID NO: 1209990 - RNA, 21 nt, Human
ccgcuaagagggagggagggc

SEQ ID NO: 1209991 - RNA, 23 nt, Human
ccgcuaagagggagggagggcuc

SEQ ID NO: 1209992 - RNA, 23 nt, Human
ccuaguuccaccaucaagccacc

SEQ ID NO: 1209993 - RNA, 21 nt, Human
ccuaguuccaccaucaagcca

SEQ ID NO: 1209994 - RNA, 13 nt, Human
ccuaguuccacca

SEQ ID NO: 1209995 - RNA, 18 nt, Human
ccuauauuguuuucagug

SEQ ID NO: 1209996 - RNA, 22 nt, Human
ccuauauuguuuucaguguaca

SEQ ID NO: 1209997 - RNA, 15 nt, Human
ccuaaaauucagugg

SEQ ID NO: 1209998 - RNA, 13 nt, Human
cccacaggaucag

SEQ ID NO: 1209999 - RNA, 23 nt, Human
cccaaugcacuuuguucuggcuc

SEQ ID NO: 1210000 - RNA, 20 nt, Human
cccaaugcacuuuguucugg

SEQ ID NO: 1210001 - RNA, 16 nt, Human
cccaaugcacuuuguu

SEQ ID NO: 1210002 - RNA, 20 nt, Human
cccaccgcagacaggaccag

SEQ ID NO: 1210003 - RNA, 18 nt, Human
cccaccaucaugucuggc

SEQ ID NO: 1210004 - RNA, 19 nt, Human
cccaccgcagacaggacca

SEQ ID NO: 1210005 - RNA, 22 nt, Human
cccaccucucucacuccuugaa

SEQ ID NO: 1210006 - RNA, 23 nt, Human
cccacuugagaauuacccuuuug

SEQ ID NO: 1210007 - RNA, 21 nt, Human
cccacgcuggagugcagugag

SEQ ID NO: 1210008 - RNA, 20 nt, Human
cccacgcuggagugcaguga

SEQ ID NO: 1210009 - RNA, 19 nt, Human
cccacgcuggagugcagug

SEQ ID NO: 1210010 - RNA, 21 nt, Human
cccacgacugcccggcagggu

SEQ ID NO: 1210011 - RNA, 20 nt, Human
cccacgacugcccggcaggg

SEQ ID NO: 1210012 - RNA, 21 nt, Human
cccaccuggccucugcacucc

SEQ ID NO: 1210013 - RNA, 19 nt, Human
cccaccuggccucugcacu

SEQ ID NO: 1210014 - RNA, 17 nt, Human
cccaccuggccucugca

SEQ ID NO: 1210015 - RNA, 23 nt, Human
cccugaggcccagagggccugca

SEQ ID NO: 1210016 - RNA, 20 nt, Human
cccugaggcccagagggccu

SEQ ID NO: 1210017 - RNA, 19 nt, Human
cccugaggcccagagggcc

SEQ ID NO: 1210018 - RNA, 18 nt, Human
cccugaggcccagagggc

SEQ ID NO: 1210019 - RNA, 17 nt, Human
cccugaggcccagaggg

SEQ ID NO: 1210020 - RNA, 16 nt, Human
cccugaggcccagagg

SEQ ID NO: 1210021 - RNA, 15 nt, Human
cccugaggcccagag

SEQ ID NO: 1210022 - RNA, 14 nt, Human
cccugaggcccaga

SEQ ID NO: 1210023 - RNA, 16 nt, Human
cccugaaagcccugag

SEQ ID NO: 1210024 - RNA, 15 nt, Human
cccugaaagcccuga

SEQ ID NO: 1210025 - RNA, 16 nt, Human
cccucuggggcuguuc

SEQ ID NO: 1210026 - RNA, 22 nt, Human
cccugcacuugcagacucuaca

SEQ ID NO: 1210027 - RNA, 19 nt, Human
cccugcacuugcagacucu

SEQ ID NO: 1210028 - RNA, 12 nt, Human
cccugcacuugc

SEQ ID NO: 1210029 - RNA, 16 nt, Human
cccugcaaccugauug

SEQ ID NO: 1210030 - RNA, 17 nt, Human
cccugcccaccuggccu

SEQ ID NO: 1210031 - RNA, 14 nt, Human
cccugcccaccugg

SEQ ID NO: 1210032 - RNA, 21 nt, Human
cccugcuggguguggcgcagc

SEQ ID NO: 1210033 - RNA, 16 nt, Human
cccugcuggguguggc

SEQ ID NO: 1210034 - RNA, 20 nt, Human
cccugcccaccuggccucug

SEQ ID NO: 1210035 - RNA, 18 nt, Human
cccugcccaccuggccuc

SEQ ID NO: 1210036 - RNA, 22 nt, Human
cccugcuggguguggcgcagca

SEQ ID NO: 1210037 - RNA, 17 nt, Human
cccugguggcagcucac

SEQ ID NO: 1210038 - RNA, 16 nt, Human
cccugguggcagcuca

SEQ ID NO: 1210039 - RNA, 15 nt, Human
cccugguggcagcuc

SEQ ID NO: 1210040 - RNA, 21 nt, Human
cccuggugaccagcaccaucu

SEQ ID NO: 1210041 - RNA, 15 nt, Human
cccgggcucugccuc

SEQ ID NO: 1210042 - RNA, 14 nt, Human
cccgggcucugccu

SEQ ID NO: 1210043 - RNA, 12 nt, Human
cccgggcucugc

SEQ ID NO: 1210044 - RNA, 20 nt, Human
cccgcugucagccauuccug

SEQ ID NO: 1210045 - RNA, 19 nt, Human
cccgcugucagccauuccu

SEQ ID NO: 1210046 - RNA, 22 nt, Human
cccgaguagcugggacuacagg

SEQ ID NO: 1210047 - RNA, 21 nt, Human
cccgaguagcugggacuacag

SEQ ID NO: 1210048 - RNA, 18 nt, Human
cccgaguagcugggacua

SEQ ID NO: 1210049 - RNA, 17 nt, Human
cccgaguagcugggacu

SEQ ID NO: 1210050 - RNA, 16 nt, Human
cccgaguagcugggac

SEQ ID NO: 1210051 - RNA, 15 nt, Human
cccgaguagcuggga

SEQ ID NO: 1210052 - RNA, 14 nt, Human
cccgaguagcuggg

SEQ ID NO: 1210053 - RNA, 13 nt, Human
cccgaguagcugg

SEQ ID NO: 1210054 - RNA, 18 nt, Human
cccagagggccugcaagg

SEQ ID NO: 1210055 - RNA, 15 nt, Human
cccagagggccugca

SEQ ID NO: 1210056 - RNA, 14 nt, Human
cccagagggccugc

SEQ ID NO: 1210057 - RNA, 20 nt, Human
cccuacaguugaaaaacagc

SEQ ID NO: 1210058 - RNA, 16 nt, Human
cccgggcucugccucc

SEQ ID NO: 1210059 - RNA, 17 nt, Human
ccauguuggccaggcug

SEQ ID NO: 1210060 - RNA, 18 nt, Human
ccauguuggccaggcugg

SEQ ID NO: 1210061 - RNA, 20 nt, Human
cccaaaacucuccucugcug

SEQ ID NO: 1210062 - RNA, 18 nt, Human
cccaaaacucuccucugc

SEQ ID NO: 1210063 - RNA, 16 nt, Human
cccaaaacucuccucu

SEQ ID NO: 1210064 - RNA, 15 nt, Human
cccaaagugcuggga

SEQ ID NO: 1210065 - RNA, 13 nt, Human
cccaaagugcugg

SEQ ID NO: 1210066 - RNA, 20 nt, Human
ccauucuccaccugccaggg

SEQ ID NO: 1210067 - RNA, 19 nt, Human
ccauucuccaccugccagg

SEQ ID NO: 1210068 - RNA, 14 nt, Human
ccauuuguguuuau

SEQ ID NO: 1210069 - RNA, 23 nt, Human
cccaaauggaaaugggcagagca

SEQ ID NO: 1210070 - RNA, 22 nt, Human
cccaaauggaaaugggcagagc

SEQ ID NO: 1210071 - RNA, 18 nt, Human
cccaaauggaaaugggca

SEQ ID NO: 1210072 - RNA, 16 nt, Human
cccaaagugcugggau

SEQ ID NO: 1210073 - RNA, 18 nt, Human
ccauguuuuguuuacggu

SEQ ID NO: 1210074 - RNA, 19 nt, Human
ccaggagccccgaggccuu

SEQ ID NO: 1210075 - RNA, 12 nt, Human
ccaggagccucc

SEQ ID NO: 1210076 - RNA, 20 nt, Human
ccaggagccccgaggccuuc

SEQ ID NO: 1210077 - RNA, 22 nt, Human
ccaggcauuccccaggaggcca

SEQ ID NO: 1210078 - RNA, 21 nt, Human
ccaggcauuccccaggaggcc

SEQ ID NO: 1210079 - RNA, 19 nt, Human
ccaggcauuccccaggagg

SEQ ID NO: 1210080 - RNA, 18 nt, Human
ccaggcauuccccaggag

SEQ ID NO: 1210081 - RNA, 21 nt, Human
ccaggcccucugcccacuccc

SEQ ID NO: 1210082 - RNA, 23 nt, Human
ccaggcccucugcccacucccug

SEQ ID NO: 1210083 - RNA, 22 nt, Human
ccaggcccucugcccacucccu

SEQ ID NO: 1210084 - RNA, 17 nt, Human
ccaggcuuagucacuga

SEQ ID NO: 1210085 - RNA, 21 nt, Human
ccagggacagaggggguggcc

SEQ ID NO: 1210086 - RNA, 15 nt, Human
ccagggacagagggg

SEQ ID NO: 1210087 - RNA, 20 nt, Human
ccaggcuuagucacugagac

SEQ ID NO: 1210088 - RNA, 22 nt, Human
ccagggacagaggggguggccu

SEQ ID NO: 1210089 - RNA, 20 nt, Human
ccagucuggaaugcaguggu

SEQ ID NO: 1210090 - RNA, 19 nt, Human
ccagucuggaaugcagugg

SEQ ID NO: 1210091 - RNA, 18 nt, Human
ccagucuggaaugcagug

SEQ ID NO: 1210092 - RNA, 17 nt, Human
ccagguuuuuggucuga

SEQ ID NO: 1210093 - RNA, 24 nt, Human
ccaggugcacaagcuccaagcucc

SEQ ID NO: 1210094 - RNA, 20 nt, Human
ccaggugcacaagcuccaag

SEQ ID NO: 1210095 - RNA, 19 nt, Human
ccaggugcacaagcuccaa

SEQ ID NO: 1210096 - RNA, 13 nt, Human
ccaucuacccucc

SEQ ID NO: 1210097 - RNA, 20 nt, Human
ccagugccgagaaggaagcc

SEQ ID NO: 1210098 - RNA, 16 nt, Human
ccagugaggcucugcc

SEQ ID NO: 1210099 - RNA, 15 nt, Human
ccagugaggcucugc

SEQ ID NO: 1210100 - RNA, 14 nt, Human
ccagugaggcucug

SEQ ID NO: 1210101 - RNA, 17 nt, Human
ccagugaggcucugccc

SEQ ID NO: 1210102 - RNA, 22 nt, Human
ccaguguuguggauuuaacaga

SEQ ID NO: 1210103 - RNA, 23 nt, Human
ccauauucuguuggccaguguga

SEQ ID NO: 1210104 - RNA, 15 nt, Human
ccagccaaagccucc

SEQ ID NO: 1210105 - RNA, 19 nt, Human
ccagccaaagccuccucca

SEQ ID NO: 1210106 - RNA, 18 nt, Human
ccagccaaagccuccucc

SEQ ID NO: 1210107 - RNA, 19 nt, Human
ccagccgccaugcuccugg

SEQ ID NO: 1210108 - RNA, 18 nt, Human
ccagccgccaugcuccug

SEQ ID NO: 1210109 - RNA, 14 nt, Human
ccagccgccaugcu

SEQ ID NO: 1210110 - RNA, 15 nt, Human
ccagccccagugccc

SEQ ID NO: 1210111 - RNA, 13 nt, Human
ccagccccagugc

SEQ ID NO: 1210112 - RNA, 23 nt, Human
ccagccccaaaacucuccucugc

SEQ ID NO: 1210113 - RNA, 16 nt, Human
ccagccccagugccca

SEQ ID NO: 1210114 - RNA, 17 nt, Human
ccagcccuuagcaggga

SEQ ID NO: 1210115 - RNA, 16 nt, Human
ccagcccuuagcaggg

SEQ ID NO: 1210116 - RNA, 15 nt, Human
ccagcaagugagagc

SEQ ID NO: 1210117 - RNA, 14 nt, Human
ccagauuucacucu

SEQ ID NO: 1210118 - RNA, 15 nt, Human
ccagauuucacucuc

SEQ ID NO: 1210119 - RNA, 22 nt, Human
ccagcaagugagagcugggugu

SEQ ID NO: 1210120 - RNA, 21 nt, Human
ccagcaagugagagcugggug

SEQ ID NO: 1210121 - RNA, 16 nt, Human
ccagcaagugagagcu

SEQ ID NO: 1210122 - RNA, 20 nt, Human
ccagacaccuugacagggca

SEQ ID NO: 1210123 - RNA, 14 nt, Human
ccagagaggguggu

SEQ ID NO: 1210124 - RNA, 23 nt, Human
ccagagaggguggugaccucugc

SEQ ID NO: 1210125 - RNA, 21 nt, Human
ccagagaggguggugaccucu

SEQ ID NO: 1210126 - RNA, 19 nt, Human
ccagacaccuugacagggc

SEQ ID NO: 1210127 - RNA, 17 nt, Human
ccagacaccuugacagg

SEQ ID NO: 1210128 - RNA, 21 nt, Human
ccagagggagugacagaggca

SEQ ID NO: 1210129 - RNA, 20 nt, Human
ccagagggagugacagaggc

SEQ ID NO: 1210130 - RNA, 19 nt, Human
ccagagggagugacagagg

SEQ ID NO: 1210131 - RNA, 18 nt, Human
ccagagggagugacagag

SEQ ID NO: 1210132 - RNA, 17 nt, Human
ccagagggagugacaga

SEQ ID NO: 1210133 - RNA, 16 nt, Human
ccagagggagugacag

SEQ ID NO: 1210134 - RNA, 22 nt, Human
ccagaggagagaggacccccug

SEQ ID NO: 1210135 - RNA, 21 nt, Human
ccagaggagagaggacccccu

SEQ ID NO: 1210136 - RNA, 19 nt, Human
ccagagcugccaccugccu

SEQ ID NO: 1210137 - RNA, 16 nt, Human
ccagagcugccaccug

SEQ ID NO: 1210138 - RNA, 15 nt, Human
ccagagcugccaccu

SEQ ID NO: 1210139 - RNA, 14 nt, Human
ccagagcugccacc

SEQ ID NO: 1210140 - RNA, 13 nt, Human
ccagagcugccac

SEQ ID NO: 1210141 - RNA, 12 nt, Human
ccagagcugcca

SEQ ID NO: 1210142 - RNA, 11 nt, Human
ccagagcugcc

SEQ ID NO: 1210143 - RNA, 12 nt, Human
ccagauuucacu

SEQ ID NO: 1210144 - RNA, 21 nt, Human
ccagauugcaacaggcugggc

SEQ ID NO: 1210145 - RNA, 20 nt, Human
ccagauugcaacaggcuggg

SEQ ID NO: 1210146 - RNA, 19 nt, Human
ccagauugcaacaggcugg

SEQ ID NO: 1210147 - RNA, 23 nt, Human
ccagauucuuuccugaggcuggg

SEQ ID NO: 1210148 - RNA, 22 nt, Human
ccagauucuuuccugaggcugg

SEQ ID NO: 1210149 - RNA, 21 nt, Human
ccagauucuuuccugaggcug

SEQ ID NO: 1210150 - RNA, 20 nt, Human
ccagauucuuuccugaggcu

SEQ ID NO: 1210151 - RNA, 19 nt, Human
ccagauucuuuccugaggc

SEQ ID NO: 1210152 - RNA, 18 nt, Human
ccagauucuuuccugagg

SEQ ID NO: 1210153 - RNA, 16 nt, Human
ccagagggccugcaag

SEQ ID NO: 1210154 - RNA, 15 nt, Human
ccagagggccugcaa

SEQ ID NO: 1210155 - RNA, 13 nt, Human
ccagagggccugc

SEQ ID NO: 1210156 - RNA, 23 nt, Human
ccagagggagugacagaggcagc

SEQ ID NO: 1210157 - RNA, 22 nt, Human
ccagagggagugacagaggcag

SEQ ID NO: 1210158 - RNA, 13 nt, Human
ccacucccugcaa

SEQ ID NO: 1210159 - RNA, 12 nt, Human
ccacucccugca

SEQ ID NO: 1210160 - RNA, 23 nt, Human
ccacuacggaauaguuggcuagg

SEQ ID NO: 1210161 - RNA, 22 nt, Human
ccacuacggaauaguuggcuag

SEQ ID NO: 1210162 - RNA, 18 nt, Human
ccacuacauucuguuaau

SEQ ID NO: 1210163 - RNA, 23 nt, Human
ccacugcacuccagccuggguga

SEQ ID NO: 1210164 - RNA, 20 nt, Human
ccacugcacuccagccuggg

SEQ ID NO: 1210165 - RNA, 19 nt, Human
ccacugcacuccagccugg

SEQ ID NO: 1210166 - RNA, 17 nt, Human
ccacucccugcaaccug

SEQ ID NO: 1210167 - RNA, 15 nt, Human
ccacucccugcaacc

SEQ ID NO: 1210168 - RNA, 11 nt, Human
ccacugcucug

SEQ ID NO: 1210169 - RNA, 16 nt, Human
ccacugcgaccacaag

SEQ ID NO: 1210170 - RNA, 13 nt, Human
ccacguuucuaaa

SEQ ID NO: 1210171 - RNA, 17 nt, Human
ccaccucccacaaagga

SEQ ID NO: 1210172 - RNA, 20 nt, Human
ccaccugccuguugggccag

SEQ ID NO: 1210173 - RNA, 17 nt, Human
ccaccugccuguugggc

SEQ ID NO: 1210174 - RNA, 12 nt, Human
ccaccugccagg

SEQ ID NO: 1210175 - RNA, 15 nt, Human
ccacggccaggccag

SEQ ID NO: 1210176 - RNA, 14 nt, Human
ccacggccaggcca

SEQ ID NO: 1210177 - RNA, 13 nt, Human
ccacggccaggcc

SEQ ID NO: 1210178 - RNA, 12 nt, Human
ccacggccaggc

SEQ ID NO: 1210179 - RNA, 18 nt, Human
ccaccuggccucugcacu

SEQ ID NO: 1210180 - RNA, 17 nt, Human
ccaccuggccucugcac

SEQ ID NO: 1210181 - RNA, 16 nt, Human
ccaccuggccucugca

SEQ ID NO: 1210182 - RNA, 15 nt, Human
ccaccuggccucugc

SEQ ID NO: 1210183 - RNA, 22 nt, Human
ccaccugcggugcuaucucccc

SEQ ID NO: 1210184 - RNA, 19 nt, Human
ccaccccucaacaccucug

SEQ ID NO: 1210185 - RNA, 15 nt, Human
ccaccucagccuccc

SEQ ID NO: 1210186 - RNA, 14 nt, Human
ccaccucagccucc

SEQ ID NO: 1210187 - RNA, 13 nt, Human
ccaccucagccuc

SEQ ID NO: 1210188 - RNA, 12 nt, Human
ccaccucagccu

SEQ ID NO: 1210189 - RNA, 18 nt, Human
ccacccugaaagcccuga

SEQ ID NO: 1210190 - RNA, 17 nt, Human
ccacccugaaagcccug

SEQ ID NO: 1210191 - RNA, 16 nt, Human
ccacccugaaagcccu

SEQ ID NO: 1210192 - RNA, 14 nt, Human
ccacccaggagccc

SEQ ID NO: 1210193 - RNA, 12 nt, Human
ccacccaggagc

SEQ ID NO: 1210194 - RNA, 12 nt, Human
ccacacccagcc

SEQ ID NO: 1210195 - RNA, 15 nt, Human
ccacacccagcccac

SEQ ID NO: 1210196 - RNA, 14 nt, Human
ccacacccagccca

SEQ ID NO: 1210197 - RNA, 13 nt, Human
ccacacccagccc

SEQ ID NO: 1210198 - RNA, 14 nt, Human
ccacaucuugcucu

SEQ ID NO: 1210199 - RNA, 18 nt, Human
ccaccaacauacucccau

SEQ ID NO: 1210200 - RNA, 14 nt, Human
ccaccaacauacuc

SEQ ID NO: 1210201 - RNA, 23 nt, Human
ccacaucuugcucugcugacaga

SEQ ID NO: 1210202 - RNA, 22 nt, Human
ccacaucuugcucugcugacag

SEQ ID NO: 1210203 - RNA, 17 nt, Human
ccacaucuugcucugcu

SEQ ID NO: 1210204 - RNA, 16 nt, Human
ccacaucuugcucugc

SEQ ID NO: 1210205 - RNA, 20 nt, Human
ccaccaacauacucccaucu

SEQ ID NO: 1210206 - RNA, 16 nt, Human
ccaccacacccagccc

SEQ ID NO: 1210207 - RNA, 14 nt, Human
ccaccacacccagc

SEQ ID NO: 1210208 - RNA, 19 nt, Human
ccacccaagggccuggccu

SEQ ID NO: 1210209 - RNA, 17 nt, Human
ccacccaagggccuggc

SEQ ID NO: 1210210 - RNA, 16 nt, Human
ccacccaagggccugg

SEQ ID NO: 1210211 - RNA, 17 nt, Human
ccaccacacccagccca

SEQ ID NO: 1210212 - RNA, 16 nt, Human
ccacccaccucagccu

SEQ ID NO: 1210213 - RNA, 15 nt, Human
ccacccaccucagcc

SEQ ID NO: 1210214 - RNA, 14 nt, Human
ccacccaccucagc

SEQ ID NO: 1210215 - RNA, 13 nt, Human
ccacccaccucag

SEQ ID NO: 1210216 - RNA, 22 nt, Human
ccacccaagggccuggccugag

SEQ ID NO: 1210217 - RNA, 21 nt, Human
ccacccaagggccuggccuga

SEQ ID NO: 1210218 - RNA, 20 nt, Human
ccacccaagggccuggccug

SEQ ID NO: 1210219 - RNA, 21 nt, Human
ccacccaggagccccgaggcc

SEQ ID NO: 1210220 - RNA, 17 nt, Human
cauuccccaggaggcca

SEQ ID NO: 1210221 - RNA, 15 nt, Human
cauuccccaggaggc

SEQ ID NO: 1210222 - RNA, 13 nt, Human
cauuccccaggag

SEQ ID NO: 1210223 - RNA, 19 nt, Human
cauuccccaggaggccagc

SEQ ID NO: 1210224 - RNA, 18 nt, Human
cauuccccaggaggccag

SEQ ID NO: 1210225 - RNA, 20 nt, Human
cauuccccaggaggccagcc

SEQ ID NO: 1210226 - RNA, 23 nt, Human
cauucuucuguacgucugacagg

SEQ ID NO: 1210227 - RNA, 22 nt, Human
cauuccugaugcuucuucagag

SEQ ID NO: 1210228 - RNA, 19 nt, Human
cauuccugaugcuucuuca

SEQ ID NO: 1210229 - RNA, 16 nt, Human
cauuccugaugcuucu

SEQ ID NO: 1210230 - RNA, 14 nt, Human
cauuccugaugcuu

SEQ ID NO: 1210231 - RNA, 23 nt, Human
cauuccugaugcuucuucagaga

SEQ ID NO: 1210232 - RNA, 20 nt, Human
cauucugccugcccaggccc

SEQ ID NO: 1210233 - RNA, 19 nt, Human
cauucugccugcccaggcc

SEQ ID NO: 1210234 - RNA, 18 nt, Human
cauucugccugcccaggc

SEQ ID NO: 1210235 - RNA, 17 nt, Human
cauucugccugcccagg

SEQ ID NO: 1210236 - RNA, 16 nt, Human
cauucugccugcccag

SEQ ID NO: 1210237 - RNA, 15 nt, Human
cauucugccugccca

SEQ ID NO: 1210238 - RNA, 13 nt, Human
cauucugccugcc

SEQ ID NO: 1210239 - RNA, 12 nt, Human
cauucugccugc

SEQ ID NO: 1210240 - RNA, 17 nt, Human
cauucuguuaaucauua

SEQ ID NO: 1210241 - RNA, 18 nt, Human
cauuuuuaguagagacag

SEQ ID NO: 1210242 - RNA, 17 nt, Human
cauuuuuaguagagaca

SEQ ID NO: 1210243 - RNA, 16 nt, Human
ccaaacccuucagugc

SEQ ID NO: 1210244 - RNA, 23 nt, Human
cauuuuauuuuauuaugcaugaa

SEQ ID NO: 1210245 - RNA, 20 nt, Human
cauuugaaaauuuugauguu

SEQ ID NO: 1210246 - RNA, 19 nt, Human
cauuugaaaauuuugaugu

SEQ ID NO: 1210247 - RNA, 17 nt, Human
cauuugaaaauuuugau

SEQ ID NO: 1210248 - RNA, 15 nt, Human
cauuuaaaaaaaauc

SEQ ID NO: 1210249 - RNA, 15 nt, Human
cauugugggaagggg

SEQ ID NO: 1210250 - RNA, 18 nt, Human
cauugaccugaggcccuu

SEQ ID NO: 1210251 - RNA, 17 nt, Human
cauugaccugaggcccu

SEQ ID NO: 1210252 - RNA, 15 nt, Human
cauugaccugaggcc

SEQ ID NO: 1210253 - RNA, 12 nt, Human
caugucuggcua

SEQ ID NO: 1210254 - RNA, 21 nt, Human
caugugaugagaggaaaucac

SEQ ID NO: 1210255 - RNA, 20 nt, Human
caugugaugagaggaaauca

SEQ ID NO: 1210256 - RNA, 18 nt, Human
caugugaugagaggaaau

SEQ ID NO: 1210257 - RNA, 17 nt, Human
caugugaugagaggaaa

SEQ ID NO: 1210258 - RNA, 16 nt, Human
caugugaugagaggaa

SEQ ID NO: 1210259 - RNA, 15 nt, Human
caugugaugagagga

SEQ ID NO: 1210260 - RNA, 14 nt, Human
caugugcacaugca

SEQ ID NO: 1210261 - RNA, 19 nt, Human
cauggucggaaaacaugcu

SEQ ID NO: 1210262 - RNA, 23 nt, Human
cauggucggaaaacaugcuacac

SEQ ID NO: 1210263 - RNA, 15 nt, Human
cauguuugugauuga

SEQ ID NO: 1210264 - RNA, 20 nt, Human
cauguuuuucuucucccuca

SEQ ID NO: 1210265 - RNA, 19 nt, Human
cauguuuuucuucucccuc

SEQ ID NO: 1210266 - RNA, 14 nt, Human
cauguuugugauug

SEQ ID NO: 1210267 - RNA, 12 nt, Human
cauguuugugau

SEQ ID NO: 1210268 - RNA, 17 nt, Human
caugcugucccuuacgu

SEQ ID NO: 1210269 - RNA, 15 nt, Human
caugcugucccuuac

SEQ ID NO: 1210270 - RNA, 13 nt, Human
caugcugucccuu

SEQ ID NO: 1210271 - RNA, 17 nt, Human
caugcgggcuuccuccu

SEQ ID NO: 1210272 - RNA, 15 nt, Human
cauggacuuccacug

SEQ ID NO: 1210273 - RNA, 18 nt, Human
caugggccuccugugugu

SEQ ID NO: 1210274 - RNA, 23 nt, Human
caugaguccccuguuuguuucug

SEQ ID NO: 1210275 - RNA, 15 nt, Human
caugaguccccuguu

SEQ ID NO: 1210276 - RNA, 14 nt, Human
caugaguccccugu

SEQ ID NO: 1210277 - RNA, 13 nt, Human
caugaguccccug

SEQ ID NO: 1210278 - RNA, 23 nt, Human
caugaggaacaaggcaaggcugu

SEQ ID NO: 1210279 - RNA, 21 nt, Human
caugaggaacaaggcaaggcu

SEQ ID NO: 1210280 - RNA, 20 nt, Human
caugaggaacaaggcaaggc

SEQ ID NO: 1210281 - RNA, 17 nt, Human
caugaggaacaaggcaa

SEQ ID NO: 1210282 - RNA, 16 nt, Human
caugaggaacaaggca

SEQ ID NO: 1210283 - RNA, 23 nt, Human
caugagccucagcauccuggcac

SEQ ID NO: 1210284 - RNA, 22 nt, Human
caugagccucagcauccuggca

SEQ ID NO: 1210285 - RNA, 13 nt, Human
caugagcaucagg

SEQ ID NO: 1210286 - RNA, 21 nt, Human
caugagccucagcauccuggc

SEQ ID NO: 1210287 - RNA, 20 nt, Human
caugagccucagcauccugg

SEQ ID NO: 1210288 - RNA, 19 nt, Human
caugagccucagcauccug

SEQ ID NO: 1210289 - RNA, 18 nt, Human
caugagccucagcauccu

SEQ ID NO: 1210290 - RNA, 17 nt, Human
caugagccucagcaucc

SEQ ID NO: 1210291 - RNA, 15 nt, Human
caugagccucagcau

SEQ ID NO: 1210292 - RNA, 12 nt, Human
caugagccucag

SEQ ID NO: 1210293 - RNA, 23 nt, Human
caugagcaucaggccaggcccuc

SEQ ID NO: 1210294 - RNA, 22 nt, Human
caugagcaucaggccaggcccu

SEQ ID NO: 1210295 - RNA, 21 nt, Human
caugagcaucaggccaggccc

SEQ ID NO: 1210296 - RNA, 20 nt, Human
caugagcaucaggccaggcc

SEQ ID NO: 1210297 - RNA, 18 nt, Human
caugagcaucaggccagg

SEQ ID NO: 1210298 - RNA, 17 nt, Human
caugagcaucaggccag

SEQ ID NO: 1210299 - RNA, 16 nt, Human
caugagcaucaggcca

SEQ ID NO: 1210300 - RNA, 15 nt, Human
caugagcaucaggcc

SEQ ID NO: 1210301 - RNA, 21 nt, Human
caugaaaacacauuuuucuua

SEQ ID NO: 1210302 - RNA, 19 nt, Human
caugaaaacacauuuuucu

SEQ ID NO: 1210303 - RNA, 12 nt, Human
caugaagacaga

SEQ ID NO: 1210304 - RNA, 17 nt, Human
caugaaaacacauuuuu

SEQ ID NO: 1210305 - RNA, 16 nt, Human
caugaaaacacauuuu

SEQ ID NO: 1210306 - RNA, 15 nt, Human
caugaaaacacauuu

SEQ ID NO: 1210307 - RNA, 14 nt, Human
caugaaaacacauu

SEQ ID NO: 1210308 - RNA, 13 nt, Human
caugaaaacacau

SEQ ID NO: 1210309 - RNA, 16 nt, Human
caucucuacaaaaagc

SEQ ID NO: 1210310 - RNA, 15 nt, Human
caucucuccuccuuu

SEQ ID NO: 1210311 - RNA, 19 nt, Human
caucuugcucugcugacag

SEQ ID NO: 1210312 - RNA, 17 nt, Human
caucuugcucugcugac

SEQ ID NO: 1210313 - RNA, 16 nt, Human
caucuugcucugcuga

SEQ ID NO: 1210314 - RNA, 21 nt, Human
caucuugaauuguaaggaaug

SEQ ID NO: 1210315 - RNA, 16 nt, Human
caucuugaauuguaag

SEQ ID NO: 1210316 - RNA, 15 nt, Human
caucaugucuggcua

SEQ ID NO: 1210317 - RNA, 14 nt, Human
caucaugucuggcu

SEQ ID NO: 1210318 - RNA, 13 nt, Human
caucaugucuggc

SEQ ID NO: 1210319 - RNA, 16 nt, Human
caucauccuaagcuau

SEQ ID NO: 1210320 - RNA, 12 nt, Human
caucacccgcua

SEQ ID NO: 1210321 - RNA, 23 nt, Human
cauccacugugccaugugccagg

SEQ ID NO: 1210322 - RNA, 17 nt, Human
cauccacugugccaugu

SEQ ID NO: 1210323 - RNA, 14 nt, Human
cauccacugugcca

SEQ ID NO: 1210324 - RNA, 15 nt, Human
caucccucuggggcu

SEQ ID NO: 1210325 - RNA, 14 nt, Human
caucaacaucuugg

SEQ ID NO: 1210326 - RNA, 21 nt, Human
cauauugauuuccguuaaaau

SEQ ID NO: 1210327 - RNA, 17 nt, Human
cauauugauuuccguua

SEQ ID NO: 1210328 - RNA, 22 nt, Human
cauauucuguuggccaguguga

SEQ ID NO: 1210329 - RNA, 17 nt, Human
cauaguaugguggcugg

SEQ ID NO: 1210330 - RNA, 16 nt, Human
cauaguaugguggcug

SEQ ID NO: 1210331 - RNA, 15 nt, Human
cauaguaugguggcu

SEQ ID NO: 1210332 - RNA, 23 nt, Human
cauauaagauucauauuuacuuc

SEQ ID NO: 1210333 - RNA, 23 nt, Human
caggugugagucaccaagcccag

SEQ ID NO: 1210334 - RNA, 22 nt, Human
caggugugagucaccaagccca

SEQ ID NO: 1210335 - RNA, 23 nt, Human
caggugugaaccaccacacccag

SEQ ID NO: 1210336 - RNA, 22 nt, Human
caggugugaaccaccacaccca

SEQ ID NO: 1210337 - RNA, 19 nt, Human
caggugugaaccaccacac

SEQ ID NO: 1210338 - RNA, 16 nt, Human
caggugugaaccacca

SEQ ID NO: 1210339 - RNA, 21 nt, Human
caggugugagucaccaagccc

SEQ ID NO: 1210340 - RNA, 20 nt, Human
caggugugagucaccaagcc

SEQ ID NO: 1210341 - RNA, 16 nt, Human
caggugugagucacca

SEQ ID NO: 1210342 - RNA, 12 nt, Human
caggugugaacc

SEQ ID NO: 1210343 - RNA, 19 nt, Human
caggugucccugcacuugc

SEQ ID NO: 1210344 - RNA, 18 nt, Human
caggugucccugcacuug

SEQ ID NO: 1210345 - RNA, 15 nt, Human
caggugucccugcac

SEQ ID NO: 1210346 - RNA, 16 nt, Human
caggugucccugcacu

SEQ ID NO: 1210347 - RNA, 22 nt, Human
caguaaaugggggugcauuuga

SEQ ID NO: 1210348 - RNA, 21 nt, Human
caguaaaugggggugcauuug

SEQ ID NO: 1210349 - RNA, 13 nt, Human
cagguucagcuug

SEQ ID NO: 1210350 - RNA, 12 nt, Human
cagguucagcuu

SEQ ID NO: 1210351 - RNA, 13 nt, Human
caguaauaacucu

SEQ ID NO: 1210352 - RNA, 12 nt, Human
caguaauaacuc

SEQ ID NO: 1210353 - RNA, 14 nt, Human
caggugucccugca

SEQ ID NO: 1210354 - RNA, 11 nt, Human
caggugucccu

SEQ ID NO: 1210355 - RNA, 20 nt, Human
caggugguuauggagagggu

SEQ ID NO: 1210356 - RNA, 18 nt, Human
caggugguuauggagagg

SEQ ID NO: 1210357 - RNA, 23 nt, Human
cagguggggucacucuggcagcu

SEQ ID NO: 1210358 - RNA, 22 nt, Human
cagguggggucacucuggcagc

SEQ ID NO: 1210359 - RNA, 21 nt, Human
cagguggggucacucuggcag

SEQ ID NO: 1210360 - RNA, 20 nt, Human
cagguggggucacucuggca

SEQ ID NO: 1210361 - RNA, 19 nt, Human
cagguggggucacucuggc

SEQ ID NO: 1210362 - RNA, 18 nt, Human
cagguggggucacucugg

SEQ ID NO: 1210363 - RNA, 17 nt, Human
cagguggggcagcuuga

SEQ ID NO: 1210364 - RNA, 16 nt, Human
cagguggggcagcuug

SEQ ID NO: 1210365 - RNA, 15 nt, Human
cagguggggcagcuu

SEQ ID NO: 1210366 - RNA, 14 nt, Human
cagguggggcagcu

SEQ ID NO: 1210367 - RNA, 13 nt, Human
cagguggggcagc

SEQ ID NO: 1210368 - RNA, 21 nt, Human
cagguaacaggcagauacagg

SEQ ID NO: 1210369 - RNA, 20 nt, Human
cagguaacaggcagauacag

SEQ ID NO: 1210370 - RNA, 23 nt, Human
caggucuugaacuccuggccuca

SEQ ID NO: 1210371 - RNA, 22 nt, Human
caggucuugaacuccuggccuc

SEQ ID NO: 1210372 - RNA, 21 nt, Human
caggucuugaacuccuggccu

SEQ ID NO: 1210373 - RNA, 20 nt, Human
caggucuugaacuccuggcc

SEQ ID NO: 1210374 - RNA, 19 nt, Human
caggucuugaacuccuggc

SEQ ID NO: 1210375 - RNA, 18 nt, Human
caggucuugaacuccugg

SEQ ID NO: 1210376 - RNA, 21 nt, Human
caggugagaagcagaggaagg

SEQ ID NO: 1210377 - RNA, 20 nt, Human
caggugagaagcagaggaag

SEQ ID NO: 1210378 - RNA, 13 nt, Human
caggugagaagca

SEQ ID NO: 1210379 - RNA, 21 nt, Human
caggggugggacacccuguga

SEQ ID NO: 1210380 - RNA, 20 nt, Human
caggggugggacacccugug

SEQ ID NO: 1210381 - RNA, 15 nt, Human
caggggugggacacc

SEQ ID NO: 1210382 - RNA, 14 nt, Human
caggggugggacac

SEQ ID NO: 1210383 - RNA, 17 nt, Human
cagguaacaggcagaua

SEQ ID NO: 1210384 - RNA, 16 nt, Human
cagguaacaggcagau

SEQ ID NO: 1210385 - RNA, 15 nt, Human
cagguaacaggcaga

SEQ ID NO: 1210386 - RNA, 14 nt, Human
cagguaacaggcag

SEQ ID NO: 1210387 - RNA, 16 nt, Human
caggguuuugccaugu

SEQ ID NO: 1210388 - RNA, 17 nt, Human
cagggucucacucuguc

SEQ ID NO: 1210389 - RNA, 16 nt, Human
cagggucucacucugu

SEQ ID NO: 1210390 - RNA, 15 nt, Human
cagggucucacucug

SEQ ID NO: 1210391 - RNA, 23 nt, Human
cagggucucacuauguugcccag

SEQ ID NO: 1210392 - RNA, 22 nt, Human
cagggucucacuauguugccca

SEQ ID NO: 1210393 - RNA, 21 nt, Human
cagggucucacuauguugccc

SEQ ID NO: 1210394 - RNA, 18 nt, Human
caggguccuguagcccua

SEQ ID NO: 1210395 - RNA, 23 nt, Human
cagggucccugguggcagcucac

SEQ ID NO: 1210396 - RNA, 22 nt, Human
cagggucccugguggcagcuca

SEQ ID NO: 1210397 - RNA, 19 nt, Human
cagggucccugguggcagc

SEQ ID NO: 1210398 - RNA, 18 nt, Human
cagggucccugguggcag

SEQ ID NO: 1210399 - RNA, 15 nt, Human
cagggucccuggugg

SEQ ID NO: 1210400 - RNA, 14 nt, Human
cagggucccuggug

SEQ ID NO: 1210401 - RNA, 12 nt, Human
cagggucccugg

SEQ ID NO: 1210402 - RNA, 21 nt, Human
caggguauuccagagugggga

SEQ ID NO: 1210403 - RNA, 20 nt, Human
caggguauuccagagugggg

SEQ ID NO: 1210404 - RNA, 16 nt, Human
caguauuacuucugcu

SEQ ID NO: 1210405 - RNA, 19 nt, Human
caguauuacuucugcuaca

SEQ ID NO: 1210406 - RNA, 18 nt, Human
caguauuacuucugcuac

SEQ ID NO: 1210407 - RNA, 14 nt, Human
caguccauugaaag

SEQ ID NO: 1210408 - RNA, 16 nt, Human
caguccauagcagaga

SEQ ID NO: 1210409 - RNA, 21 nt, Human
caguaucuugaagacuuuucu

SEQ ID NO: 1210410 - RNA, 18 nt, Human
caguaucuugaagacuuu

SEQ ID NO: 1210411 - RNA, 12 nt, Human
caguaucuugaa

SEQ ID NO: 1210412 - RNA, 15 nt, Human
caguaucucagggcc

SEQ ID NO: 1210413 - RNA, 13 nt, Human
caguaucucaggg

SEQ ID NO: 1210414 - RNA, 12 nt, Human
cagucccugcca

SEQ ID NO: 1210415 - RNA, 16 nt, Human
cagucccugccaaugg

SEQ ID NO: 1210416 - RNA, 15 nt, Human
cagucccugccaaug

SEQ ID NO: 1210417 - RNA, 14 nt, Human
cagucccugccaau

SEQ ID NO: 1210418 - RNA, 13 nt, Human
cagucccugccaa

SEQ ID NO: 1210419 - RNA, 15 nt, Human
caguccucccaucuc

SEQ ID NO: 1210420 - RNA, 14 nt, Human
caguccucccaucu

SEQ ID NO: 1210421 - RNA, 13 nt, Human
caguccucccauc

SEQ ID NO: 1210422 - RNA, 12 nt, Human
caguccucccau

SEQ ID NO: 1210423 - RNA, 17 nt, Human
cagucccugccaaugga

SEQ ID NO: 1210424 - RNA, 19 nt, Human
cagucuggaaugcaguggu

SEQ ID NO: 1210425 - RNA, 21 nt, Human
caguccuuaccagcagagcac

SEQ ID NO: 1210426 - RNA, 20 nt, Human
caguccuuaccagcagagca

SEQ ID NO: 1210427 - RNA, 19 nt, Human
caguccuuaccagcagagc

SEQ ID NO: 1210428 - RNA, 18 nt, Human
caguccuuaccagcagag

SEQ ID NO: 1210429 - RNA, 15 nt, Human
caguccuuaccagca

SEQ ID NO: 1210430 - RNA, 17 nt, Human
caguccucccaucucac

SEQ ID NO: 1210431 - RNA, 16 nt, Human
caguccucccaucuca

SEQ ID NO: 1210432 - RNA, 18 nt, Human
cagugagucgaggacagg

SEQ ID NO: 1210433 - RNA, 17 nt, Human
cagugagucgaggacag

SEQ ID NO: 1210434 - RNA, 21 nt, Human
cagugaggcucugcccuuggu

SEQ ID NO: 1210435 - RNA, 20 nt, Human
cagugaggcucugcccuugg

SEQ ID NO: 1210436 - RNA, 19 nt, Human
cagugaggcucugcccuug

SEQ ID NO: 1210437 - RNA, 18 nt, Human
cagugaggcucugcccuu

SEQ ID NO: 1210438 - RNA, 17 nt, Human
cagugaggcucugcccu

SEQ ID NO: 1210439 - RNA, 16 nt, Human
cagugaggcucugccc

SEQ ID NO: 1210440 - RNA, 15 nt, Human
cagugaggcucugcc

SEQ ID NO: 1210441 - RNA, 14 nt, Human
cagugaggcucugc

SEQ ID NO: 1210442 - RNA, 13 nt, Human
cagugaggcucug

SEQ ID NO: 1210443 - RNA, 12 nt, Human
cagugaggcucu

SEQ ID NO: 1210444 - RNA, 24 nt, Human
cagugagccgagauugcaccacug

SEQ ID NO: 1210445 - RNA, 22 nt, Human
cagugccuuauggaacacucug

SEQ ID NO: 1210446 - RNA, 21 nt, Human
cagugccuuauggaacacucu

SEQ ID NO: 1210447 - RNA, 20 nt, Human
cagugccuuauggaacacuc

SEQ ID NO: 1210448 - RNA, 19 nt, Human
cagugccuuauggaacacu

SEQ ID NO: 1210449 - RNA, 18 nt, Human
cagugccuuauggaacac

SEQ ID NO: 1210450 - RNA, 17 nt, Human
cagugccuuauggaaca

SEQ ID NO: 1210451 - RNA, 16 nt, Human
cagugccuuauggaac

SEQ ID NO: 1210452 - RNA, 15 nt, Human
cagugccuuauggaa

SEQ ID NO: 1210453 - RNA, 13 nt, Human
cagugccuuaugg

SEQ ID NO: 1210454 - RNA, 11 nt, Human
cagugccuuau

SEQ ID NO: 1210455 - RNA, 18 nt, Human
cagugccgagaaggaagc

SEQ ID NO: 1210456 - RNA, 15 nt, Human
cagugccgagaagga

SEQ ID NO: 1210457 - RNA, 23 nt, Human
cagugagucgaggacagggaggu

SEQ ID NO: 1210458 - RNA, 22 nt, Human
cagugagucgaggacagggagg

SEQ ID NO: 1210459 - RNA, 20 nt, Human
cagugagucgaggacaggga

SEQ ID NO: 1210460 - RNA, 19 nt, Human
cagugagucgaggacaggg

SEQ ID NO: 1210461 - RNA, 23 nt, Human
cagugccuuauggaacacucuga

SEQ ID NO: 1210462 - RNA, 20 nt, Human
cagggacagaggggguggcc

SEQ ID NO: 1210463 - RNA, 14 nt, Human
cagggacagagggg

SEQ ID NO: 1210464 - RNA, 13 nt, Human
cagggacagaggg

SEQ ID NO: 1210465 - RNA, 22 nt, Human
cagggaaacagcuaaugggaca

SEQ ID NO: 1210466 - RNA, 19 nt, Human
caggggaggguagagcgga

SEQ ID NO: 1210467 - RNA, 19 nt, Human
cagggccuggcucaggugg

SEQ ID NO: 1210468 - RNA, 16 nt, Human
cagggccuggcucagg

SEQ ID NO: 1210469 - RNA, 15 nt, Human
cagggccuggcucag

SEQ ID NO: 1210470 - RNA, 14 nt, Human
cagggccuggcuca

SEQ ID NO: 1210471 - RNA, 13 nt, Human
cagggccuggcuc

SEQ ID NO: 1210472 - RNA, 23 nt, Human
cagggcacaccgggcacucagaa

SEQ ID NO: 1210473 - RNA, 22 nt, Human
cagggcacaccgggcacucaga

SEQ ID NO: 1210474 - RNA, 21 nt, Human
cagggcacaccgggcacucag

SEQ ID NO: 1210475 - RNA, 19 nt, Human
cagggcacaccgggcacuc

SEQ ID NO: 1210476 - RNA, 17 nt, Human
cagggcacaccgggcac

SEQ ID NO: 1210477 - RNA, 15 nt, Human
cagggcacaccgggc

SEQ ID NO: 1210478 - RNA, 14 nt, Human
cagggcacaccggg

SEQ ID NO: 1210479 - RNA, 23 nt, Human
cagggacagaggggguggccucc

SEQ ID NO: 1210480 - RNA, 20 nt, Human
caggcuccuuuagcgcccag

SEQ ID NO: 1210481 - RNA, 19 nt, Human
caggcuccuuuagcgccca

SEQ ID NO: 1210482 - RNA, 14 nt, Human
caggcuccuuuagc

SEQ ID NO: 1210483 - RNA, 23 nt, Human
caggcucucaggccagcugcuug

SEQ ID NO: 1210484 - RNA, 21 nt, Human
caggcucucaggccagcugcu

SEQ ID NO: 1210485 - RNA, 20 nt, Human
caggcucucaggccagcugc

SEQ ID NO: 1210486 - RNA, 19 nt, Human
caggcucucaggccagcug

SEQ ID NO: 1210487 - RNA, 18 nt, Human
caggcucucaggccagcu

SEQ ID NO: 1210488 - RNA, 17 nt, Human
caggcucucaggccagc

SEQ ID NO: 1210489 - RNA, 16 nt, Human
caggcucucaggccag

SEQ ID NO: 1210490 - RNA, 15 nt, Human
caggcucucaggcca

SEQ ID NO: 1210491 - RNA, 14 nt, Human
caggcucucaggcc

SEQ ID NO: 1210492 - RNA, 13 nt, Human
caggcucucaggc

SEQ ID NO: 1210493 - RNA, 12 nt, Human
caggcucucagg

SEQ ID NO: 1210494 - RNA, 20 nt, Human
caggcucgggcuccccagcc

SEQ ID NO: 1210495 - RNA, 21 nt, Human
caggcuccuuuagcgcccagu

SEQ ID NO: 1210496 - RNA, 15 nt, Human
caggcccucugccca

SEQ ID NO: 1210497 - RNA, 14 nt, Human
caggcccucugccc

SEQ ID NO: 1210498 - RNA, 13 nt, Human
caggcccucugcc

SEQ ID NO: 1210499 - RNA, 22 nt, Human
caggcccggcuccaggcuccuu

SEQ ID NO: 1210500 - RNA, 21 nt, Human
caggcccggcuccaggcuccu

SEQ ID NO: 1210501 - RNA, 20 nt, Human
caggcccggcuccaggcucc

SEQ ID NO: 1210502 - RNA, 19 nt, Human
caggcccggcuccaggcuc

SEQ ID NO: 1210503 - RNA, 18 nt, Human
caggcccggcuccaggcu

SEQ ID NO: 1210504 - RNA, 17 nt, Human
caggcccggcuccaggc

SEQ ID NO: 1210505 - RNA, 22 nt, Human
caggcccucugcccacucccug

SEQ ID NO: 1210506 - RNA, 21 nt, Human
caggcccucugcccacucccu

SEQ ID NO: 1210507 - RNA, 20 nt, Human
caggcccucugcccacuccc

SEQ ID NO: 1210508 - RNA, 19 nt, Human
caggcccucugcccacucc

SEQ ID NO: 1210509 - RNA, 17 nt, Human
caggcccucugcccacu

SEQ ID NO: 1210510 - RNA, 16 nt, Human
caggcccucugcccac

SEQ ID NO: 1210511 - RNA, 16 nt, Human
cagggaaacagcuaau

SEQ ID NO: 1210512 - RNA, 23 nt, Human
caggcuuagucacugagacagcc

SEQ ID NO: 1210513 - RNA, 22 nt, Human
caggcuuagucacugagacagc

SEQ ID NO: 1210514 - RNA, 21 nt, Human
caggcuuagucacugagacag

SEQ ID NO: 1210515 - RNA, 20 nt, Human
caggcuuagucacugagaca

SEQ ID NO: 1210516 - RNA, 17 nt, Human
caggcuuagucacugag

SEQ ID NO: 1210517 - RNA, 16 nt, Human
caggcuuagucacuga

SEQ ID NO: 1210518 - RNA, 23 nt, Human
caggcuguaucccaugagccuca

SEQ ID NO: 1210519 - RNA, 22 nt, Human
caggcuguaucccaugagccuc

SEQ ID NO: 1210520 - RNA, 21 nt, Human
caggcuguaucccaugagccu

SEQ ID NO: 1210521 - RNA, 20 nt, Human
caggcuguaucccaugagcc

SEQ ID NO: 1210522 - RNA, 14 nt, Human
caggcuguauccca

SEQ ID NO: 1210523 - RNA, 12 nt, Human
caggcuggucuc

SEQ ID NO: 1210524 - RNA, 19 nt, Human
caggcuggucucaaacucu

SEQ ID NO: 1210525 - RNA, 17 nt, Human
caggcaugguggcccac

SEQ ID NO: 1210526 - RNA, 15 nt, Human
caggcaggugggaug

SEQ ID NO: 1210527 - RNA, 23 nt, Human
caggcaggucuugaacuccuggc

SEQ ID NO: 1210528 - RNA, 22 nt, Human
caggcaggucuugaacuccugg

SEQ ID NO: 1210529 - RNA, 13 nt, Human
caggcaggucuug

SEQ ID NO: 1210530 - RNA, 12 nt, Human
caggcaggucuu

SEQ ID NO: 1210531 - RNA, 19 nt, Human
caggcagguccaggguuug

SEQ ID NO: 1210532 - RNA, 15 nt, Human
caggcagguccaggg

SEQ ID NO: 1210533 - RNA, 14 nt, Human
caggcagguccagg

SEQ ID NO: 1210534 - RNA, 24 nt, Human
caggcauuccccaggaggccagcc

SEQ ID NO: 1210535 - RNA, 23 nt, Human
caggcauuccccaggaggccagc

SEQ ID NO: 1210536 - RNA, 22 nt, Human
caggcauuccccaggaggccag

SEQ ID NO: 1210537 - RNA, 21 nt, Human
caggcauuccccaggaggcca

SEQ ID NO: 1210538 - RNA, 20 nt, Human
caggcauuccccaggaggcc

SEQ ID NO: 1210539 - RNA, 19 nt, Human
caggcauuccccaggaggc

SEQ ID NO: 1210540 - RNA, 18 nt, Human
caggcauuccccaggagg

SEQ ID NO: 1210541 - RNA, 17 nt, Human
caggcauuccccaggag

SEQ ID NO: 1210542 - RNA, 16 nt, Human
caggcauuccccagga

SEQ ID NO: 1210543 - RNA, 15 nt, Human
caggcauuccccagg

SEQ ID NO: 1210544 - RNA, 13 nt, Human
caggcauucccca

SEQ ID NO: 1210545 - RNA, 20 nt, Human
caggcauguucucugaggac

SEQ ID NO: 1210546 - RNA, 19 nt, Human
caggcauguucucugagga

SEQ ID NO: 1210547 - RNA, 18 nt, Human
caggcauguucucugagg

SEQ ID NO: 1210548 - RNA, 15 nt, Human
caggcauguucucug

SEQ ID NO: 1210549 - RNA, 15 nt, Human
caggcagccaggcca

SEQ ID NO: 1210550 - RNA, 14 nt, Human
caggcagccaggcc

SEQ ID NO: 1210551 - RNA, 14 nt, Human
caggcaaugcuggc

SEQ ID NO: 1210552 - RNA, 21 nt, Human
caggcaagcaccuccugccuc

SEQ ID NO: 1210553 - RNA, 16 nt, Human
caggcaagcaccuccu

SEQ ID NO: 1210554 - RNA, 15 nt, Human
caggcaagcaccucc

SEQ ID NO: 1210555 - RNA, 14 nt, Human
caggcaagcaccuc

SEQ ID NO: 1210556 - RNA, 20 nt, Human
caggauucuuccucccuccc

SEQ ID NO: 1210557 - RNA, 13 nt, Human
caggcagguccag

SEQ ID NO: 1210558 - RNA, 17 nt, Human
caggcagccaggccaca

SEQ ID NO: 1210559 - RNA, 16 nt, Human
caggcagccaggccac

SEQ ID NO: 1210560 - RNA, 13 nt, Human
caggaucagucug

SEQ ID NO: 1210561 - RNA, 14 nt, Human
caggaucagucuga

SEQ ID NO: 1210562 - RNA, 23 nt, Human
caggauggccgggcgcgguggcu

SEQ ID NO: 1210563 - RNA, 18 nt, Human
caggauucuuccucccuc

SEQ ID NO: 1210564 - RNA, 17 nt, Human
caggauucuuccucccu

SEQ ID NO: 1210565 - RNA, 22 nt, Human
caggccaggcccucugcccacu

SEQ ID NO: 1210566 - RNA, 21 nt, Human
caggccaggcccucugcccac

SEQ ID NO: 1210567 - RNA, 20 nt, Human
caggccacaagacccuugug

SEQ ID NO: 1210568 - RNA, 18 nt, Human
caggccacaagacccuug

SEQ ID NO: 1210569 - RNA, 17 nt, Human
caggccacaagacccuu

SEQ ID NO: 1210570 - RNA, 13 nt, Human
caggccacaagac

SEQ ID NO: 1210571 - RNA, 23 nt, Human
caggccaaacucaccugccccuc

SEQ ID NO: 1210572 - RNA, 18 nt, Human
caggccaaacucaccugc

SEQ ID NO: 1210573 - RNA, 13 nt, Human
caggccccugcca

SEQ ID NO: 1210574 - RNA, 16 nt, Human
caggcccggcuccagg

SEQ ID NO: 1210575 - RNA, 15 nt, Human
caggcccggcuccag

SEQ ID NO: 1210576 - RNA, 14 nt, Human
caggcccggcucca

SEQ ID NO: 1210577 - RNA, 13 nt, Human
caggcccggcucc

SEQ ID NO: 1210578 - RNA, 20 nt, Human
caggccccugccacccuggg

SEQ ID NO: 1210579 - RNA, 19 nt, Human
caggccccugccacccugg

SEQ ID NO: 1210580 - RNA, 17 nt, Human
caggccccugccacccu

SEQ ID NO: 1210581 - RNA, 15 nt, Human
caggccccugccacc

SEQ ID NO: 1210582 - RNA, 12 nt, Human
caggagugagca

SEQ ID NO: 1210583 - RNA, 20 nt, Human
caggagccuccugcccuuac

SEQ ID NO: 1210584 - RNA, 17 nt, Human
caggagccuccugcccu

SEQ ID NO: 1210585 - RNA, 14 nt, Human
caggagccuccugc

SEQ ID NO: 1210586 - RNA, 23 nt, Human
caggagccccgaggccuucucug

SEQ ID NO: 1210587 - RNA, 22 nt, Human
caggagccccgaggccuucucu

SEQ ID NO: 1210588 - RNA, 20 nt, Human
caggagccccgaggccuucu

SEQ ID NO: 1210589 - RNA, 18 nt, Human
caggagccccgaggccuu

SEQ ID NO: 1210590 - RNA, 16 nt, Human
caggagccccgaggcc

SEQ ID NO: 1210591 - RNA, 15 nt, Human
caggagccccgaggc

SEQ ID NO: 1210592 - RNA, 19 nt, Human
caggagcagccacauuccu

SEQ ID NO: 1210593 - RNA, 14 nt, Human
caggagcagccaca

SEQ ID NO: 1210594 - RNA, 13 nt, Human
caggagcagccac

SEQ ID NO: 1210595 - RNA, 12 nt, Human
caggagcagcca

SEQ ID NO: 1210596 - RNA, 23 nt, Human
caggaguuugagaccaaccuggg

SEQ ID NO: 1210597 - RNA, 22 nt, Human
caggaguuugagaccaaccugg

SEQ ID NO: 1210598 - RNA, 21 nt, Human
caggaguuugagaccaaccug

SEQ ID NO: 1210599 - RNA, 22 nt, Human
caggaagccagcaggcucucag

SEQ ID NO: 1210600 - RNA, 21 nt, Human
caggaagccagcaggcucuca

SEQ ID NO: 1210601 - RNA, 19 nt, Human
caggaagccagcaggcucu

SEQ ID NO: 1210602 - RNA, 18 nt, Human
caggaagccagcaggcuc

SEQ ID NO: 1210603 - RNA, 17 nt, Human
caggaagccagcaggcu

SEQ ID NO: 1210604 - RNA, 16 nt, Human
caggaagccagcaggc

SEQ ID NO: 1210605 - RNA, 14 nt, Human
caggaagccagcag

SEQ ID NO: 1210606 - RNA, 23 nt, Human
caggaagcucagggccuggcuca

SEQ ID NO: 1210607 - RNA, 21 nt, Human
caggaagcucagggccuggcu

SEQ ID NO: 1210608 - RNA, 20 nt, Human
caggaagcucagggccuggc

SEQ ID NO: 1210609 - RNA, 19 nt, Human
caggaagcucagggccugg

SEQ ID NO: 1210610 - RNA, 18 nt, Human
caggaagcucagggccug

SEQ ID NO: 1210611 - RNA, 17 nt, Human
caggaagcucagggccu

SEQ ID NO: 1210612 - RNA, 16 nt, Human
caggaagcucagggcc

SEQ ID NO: 1210613 - RNA, 15 nt, Human
caggaagcucagggc

SEQ ID NO: 1210614 - RNA, 14 nt, Human
caggaagcucaggg

SEQ ID NO: 1210615 - RNA, 13 nt, Human
caggaagcucagg

SEQ ID NO: 1210616 - RNA, 20 nt, Human
caggaaguacuggagaaaau

SEQ ID NO: 1210617 - RNA, 18 nt, Human
caggaaguacuggagaaa

SEQ ID NO: 1210618 - RNA, 17 nt, Human
caggaaguacuggagaa

SEQ ID NO: 1210619 - RNA, 16 nt, Human
caggaaguacuggaga

SEQ ID NO: 1210620 - RNA, 14 nt, Human
caggaaguacugga

SEQ ID NO: 1210621 - RNA, 12 nt, Human
caggaaguacug

SEQ ID NO: 1210622 - RNA, 15 nt, Human
caggaaggcuaaagg

SEQ ID NO: 1210623 - RNA, 21 nt, Human
cagcuugaggguugggcuggu

SEQ ID NO: 1210624 - RNA, 20 nt, Human
cagcuugaggguugggcugg

SEQ ID NO: 1210625 - RNA, 19 nt, Human
cagcuugaggguugggcug

SEQ ID NO: 1210626 - RNA, 18 nt, Human
cagcuugaggguugggcu

SEQ ID NO: 1210627 - RNA, 15 nt, Human
cagcuugaggguugg

SEQ ID NO: 1210628 - RNA, 14 nt, Human
cagcuugaggguug

SEQ ID NO: 1210629 - RNA, 21 nt, Human
cagcuugaccgugaggccaga

SEQ ID NO: 1210630 - RNA, 20 nt, Human
cagcuugaccgugaggccag

SEQ ID NO: 1210631 - RNA, 19 nt, Human
cagcuugaccgugaggcca

SEQ ID NO: 1210632 - RNA, 18 nt, Human
cagcuugaccgugaggcc

SEQ ID NO: 1210633 - RNA, 21 nt, Human
cagcuucauuuccugugucuu

SEQ ID NO: 1210634 - RNA, 20 nt, Human
cagcuucauuuccugugucu

SEQ ID NO: 1210635 - RNA, 23 nt, Human
cagcuuuguuuguugucagcuga

SEQ ID NO: 1210636 - RNA, 22 nt, Human
cagcuuuguuuguugucagcug

SEQ ID NO: 1210637 - RNA, 21 nt, Human
cagcuuuguuuguugucagcu

SEQ ID NO: 1210638 - RNA, 12 nt, Human
cagcuuuguuug

SEQ ID NO: 1210639 - RNA, 22 nt, Human
cagcuuguaaauagcucaggug

SEQ ID NO: 1210640 - RNA, 21 nt, Human
cagcuuguaaauagcucaggu

SEQ ID NO: 1210641 - RNA, 20 nt, Human
cagcuuguaaauagcucagg

SEQ ID NO: 1210642 - RNA, 19 nt, Human
cagcuuguaaauagcucag

SEQ ID NO: 1210643 - RNA, 18 nt, Human
cagcuuguaaauagcuca

SEQ ID NO: 1210644 - RNA, 23 nt, Human
cagcucuucuccaggcuguaucc

SEQ ID NO: 1210645 - RNA, 19 nt, Human
cagcucuucuccaggcugu

SEQ ID NO: 1210646 - RNA, 18 nt, Human
cagcucuucuccaggcug

SEQ ID NO: 1210647 - RNA, 17 nt, Human
cagcucuucuccaggcu

SEQ ID NO: 1210648 - RNA, 16 nt, Human
cagcucuucuccaggc

SEQ ID NO: 1210649 - RNA, 15 nt, Human
cagcucuucuccagg

SEQ ID NO: 1210650 - RNA, 14 nt, Human
cagcucuucuccag

SEQ ID NO: 1210651 - RNA, 13 nt, Human
cagcucuucucca

SEQ ID NO: 1210652 - RNA, 21 nt, Human
cagcucuuauauugccauuuc

SEQ ID NO: 1210653 - RNA, 10 nt, Human
cagcucuuau

SEQ ID NO: 1210654 - RNA, 23 nt, Human
cagcucuguccugggagugagcu

SEQ ID NO: 1210655 - RNA, 18 nt, Human
cagcucuguccugggagu

SEQ ID NO: 1210656 - RNA, 17 nt, Human
cagcucuguccugggag

SEQ ID NO: 1210657 - RNA, 16 nt, Human
cagcucuguccuggga

SEQ ID NO: 1210658 - RNA, 14 nt, Human
cagcucuguccugg

SEQ ID NO: 1210659 - RNA, 13 nt, Human
cagcucuguccug

SEQ ID NO: 1210660 - RNA, 12 nt, Human
cagcucuguccu

SEQ ID NO: 1210661 - RNA, 23 nt, Human
cagcucugguccauagagagcaa

SEQ ID NO: 1210662 - RNA, 22 nt, Human
cagcucugguccauagagagca

SEQ ID NO: 1210663 - RNA, 21 nt, Human
cagcucugguccauagagagc

SEQ ID NO: 1210664 - RNA, 18 nt, Human
cagcucugguccauagag

SEQ ID NO: 1210665 - RNA, 17 nt, Human
cagcucugguccauaga

SEQ ID NO: 1210666 - RNA, 16 nt, Human
cagcucugguccauag

SEQ ID NO: 1210667 - RNA, 13 nt, Human
cagcucuggucca

SEQ ID NO: 1210668 - RNA, 10 nt, Human
cagcucuggu

SEQ ID NO: 1210669 - RNA, 21 nt, Human
cagcucugcaagaauugaagc

SEQ ID NO: 1210670 - RNA, 16 nt, Human
cagcucugcaagaauu

SEQ ID NO: 1210671 - RNA, 15 nt, Human
cagcucugcaagaau

SEQ ID NO: 1210672 - RNA, 23 nt, Human
cagcuccuucuguccuacucugu

SEQ ID NO: 1210673 - RNA, 21 nt, Human
cagcuccuucuguccuacucu

SEQ ID NO: 1210674 - RNA, 17 nt, Human
cagcuccuucuguccua

SEQ ID NO: 1210675 - RNA, 16 nt, Human
cagcuccuucuguccu

SEQ ID NO: 1210676 - RNA, 20 nt, Human
cagcucagagagggugggag

SEQ ID NO: 1210677 - RNA, 19 nt, Human
cagcucagagaggguggga

SEQ ID NO: 1210678 - RNA, 17 nt, Human
cagcucagagagggugg

SEQ ID NO: 1210679 - RNA, 13 nt, Human
cagcucagagagg

SEQ ID NO: 1210680 - RNA, 23 nt, Human
cagcugggguggggaccucaggc

SEQ ID NO: 1210681 - RNA, 22 nt, Human
cagcugggguggggaccucagg

SEQ ID NO: 1210682 - RNA, 21 nt, Human
cagcugggguggggaccucag

SEQ ID NO: 1210683 - RNA, 18 nt, Human
cagcugguugagguuuca

SEQ ID NO: 1210684 - RNA, 22 nt, Human
cagcugcuuuugucuaugggac

SEQ ID NO: 1210685 - RNA, 24 nt, Human
cagcugcgguccacccaggagccc

SEQ ID NO: 1210686 - RNA, 23 nt, Human
cagcugcgguccacccaggagcc

SEQ ID NO: 1210687 - RNA, 22 nt, Human
cagcugcgguccacccaggagc

SEQ ID NO: 1210688 - RNA, 21 nt, Human
cagcugcgguccacccaggag

SEQ ID NO: 1210689 - RNA, 20 nt, Human
cagcugcgguccacccagga

SEQ ID NO: 1210690 - RNA, 19 nt, Human
cagcugcgguccacccagg

SEQ ID NO: 1210691 - RNA, 18 nt, Human
cagcugcgguccacccag

SEQ ID NO: 1210692 - RNA, 23 nt, Human
cagcugccugggaucccucaucc

SEQ ID NO: 1210693 - RNA, 18 nt, Human
cagcugccugggaucccu

SEQ ID NO: 1210694 - RNA, 22 nt, Human
cagcugcuugggcuucauccuc

SEQ ID NO: 1210695 - RNA, 21 nt, Human
cagcugcuugggcuucauccu

SEQ ID NO: 1210696 - RNA, 19 nt, Human
cagcugcuugggcuucauc

SEQ ID NO: 1210697 - RNA, 18 nt, Human
cagcugcuugggcuucau

SEQ ID NO: 1210698 - RNA, 16 nt, Human
cagcugcuugggcuuc

SEQ ID NO: 1210699 - RNA, 15 nt, Human
cagcugcuugggcuu

SEQ ID NO: 1210700 - RNA, 14 nt, Human
cagcugcuugggcu

SEQ ID NO: 1210701 - RNA, 13 nt, Human
cagcugcuugggc

SEQ ID NO: 1210702 - RNA, 17 nt, Human
cagcugcuacuacuccu

SEQ ID NO: 1210703 - RNA, 22 nt, Human
caggaagcucagggccuggcuc

SEQ ID NO: 1210704 - RNA, 19 nt, Human
cagccuggacccuguggau

SEQ ID NO: 1210705 - RNA, 15 nt, Human
cagccuggacccugu

SEQ ID NO: 1210706 - RNA, 23 nt, Human
cagccucccgaguagcugggacu

SEQ ID NO: 1210707 - RNA, 22 nt, Human
cagccucccgaguagcugggac

SEQ ID NO: 1210708 - RNA, 21 nt, Human
cagccucccgaguagcuggga

SEQ ID NO: 1210709 - RNA, 20 nt, Human
cagccucccgaguagcuggg

SEQ ID NO: 1210710 - RNA, 19 nt, Human
cagccucccgaguagcugg

SEQ ID NO: 1210711 - RNA, 23 nt, Human
cagccucccgaauagcugggacu

SEQ ID NO: 1210712 - RNA, 20 nt, Human
cagccugcuccagcuguuca

SEQ ID NO: 1210713 - RNA, 24 nt, Human
cagccuugaccauucuccaccugc

SEQ ID NO: 1210714 - RNA, 23 nt, Human
cagccuugaccauucuccaccug

SEQ ID NO: 1210715 - RNA, 22 nt, Human
cagccuugaccauucuccaccu

SEQ ID NO: 1210716 - RNA, 21 nt, Human
cagccuugaccauucuccacc

SEQ ID NO: 1210717 - RNA, 20 nt, Human
cagccuugaccauucuccac

SEQ ID NO: 1210718 - RNA, 17 nt, Human
cagccuugaccauucuc

SEQ ID NO: 1210719 - RNA, 19 nt, Human
cagccugggcaaugugaua

SEQ ID NO: 1210720 - RNA, 16 nt, Human
cagccugggcaaugug

SEQ ID NO: 1210721 - RNA, 19 nt, Human
cagcucaccagccccagug

SEQ ID NO: 1210722 - RNA, 17 nt, Human
cagcucaccagccccag

SEQ ID NO: 1210723 - RNA, 16 nt, Human
cagcucaccagcccca

SEQ ID NO: 1210724 - RNA, 15 nt, Human
cagcucaccagcccc

SEQ ID NO: 1210725 - RNA, 13 nt, Human
cagcucaccagcc

SEQ ID NO: 1210726 - RNA, 17 nt, Human
cagcucaccucucccuu

SEQ ID NO: 1210727 - RNA, 16 nt, Human
cagcucaccucucccu

SEQ ID NO: 1210728 - RNA, 15 nt, Human
cagcucaccucuccc

SEQ ID NO: 1210729 - RNA, 13 nt, Human
cagcucaccucuc

SEQ ID NO: 1210730 - RNA, 22 nt, Human
cagcucaccagccccagugccc

SEQ ID NO: 1210731 - RNA, 21 nt, Human
cagcucaccagccccagugcc

SEQ ID NO: 1210732 - RNA, 20 nt, Human
cagcucaccagccccagugc

SEQ ID NO: 1210733 - RNA, 12 nt, Human
cagcucagagag

SEQ ID NO: 1210734 - RNA, 20 nt, Human
cagcucaccucucccuugga

SEQ ID NO: 1210735 - RNA, 19 nt, Human
cagcucaccucucccuugg

SEQ ID NO: 1210736 - RNA, 19 nt, Human
cagcuaacauggaaguacu

SEQ ID NO: 1210737 - RNA, 21 nt, Human
cagcgagcccugguggcagug

SEQ ID NO: 1210738 - RNA, 20 nt, Human
cagcgagcccugguggcagu

SEQ ID NO: 1210739 - RNA, 19 nt, Human
cagcgagcccugguggcag

SEQ ID NO: 1210740 - RNA, 17 nt, Human
cagcgagcccugguggc

SEQ ID NO: 1210741 - RNA, 16 nt, Human
cagcgagcccuggugg

SEQ ID NO: 1210742 - RNA, 13 nt, Human
cagcgagcccugg

SEQ ID NO: 1210743 - RNA, 20 nt, Human
cagcuaacauggaaguacua

SEQ ID NO: 1210744 - RNA, 16 nt, Human
cagcuaaugggacacu

SEQ ID NO: 1210745 - RNA, 15 nt, Human
cagcuaaugggacac

SEQ ID NO: 1210746 - RNA, 23 nt, Human
cagccucccaaagugcugggauu

SEQ ID NO: 1210747 - RNA, 21 nt, Human
cagccucccaaagugcuggga

SEQ ID NO: 1210748 - RNA, 20 nt, Human
cagccucccaaagugcuggg

SEQ ID NO: 1210749 - RNA, 19 nt, Human
cagccucccaaagugcugg

SEQ ID NO: 1210750 - RNA, 22 nt, Human
cagccucccgaauagcugggac

SEQ ID NO: 1210751 - RNA, 21 nt, Human
cagccucccgaauagcuggga

SEQ ID NO: 1210752 - RNA, 20 nt, Human
cagccucccgaauagcuggg

SEQ ID NO: 1210753 - RNA, 21 nt, Human
cagccucaaccuccugggcua

SEQ ID NO: 1210754 - RNA, 20 nt, Human
cagccucaaccuccugggcu

SEQ ID NO: 1210755 - RNA, 19 nt, Human
cagccucaaccuccugggc

SEQ ID NO: 1210756 - RNA, 18 nt, Human
cagccucaaccuccuggg

SEQ ID NO: 1210757 - RNA, 17 nt, Human
cagccucaaccuccugg

SEQ ID NO: 1210758 - RNA, 20 nt, Human
cagccucacaguccuuacca

SEQ ID NO: 1210759 - RNA, 15 nt, Human
cagccucacaguccu

SEQ ID NO: 1210760 - RNA, 14 nt, Human
cagccucacagucc

SEQ ID NO: 1210761 - RNA, 20 nt, Human
cagcccugcagagggcacag

SEQ ID NO: 1210762 - RNA, 18 nt, Human
cagcccugcagagggcac

SEQ ID NO: 1210763 - RNA, 16 nt, Human
cagcccugcagagggc

SEQ ID NO: 1210764 - RNA, 15 nt, Human
cagcccugcagaggg

SEQ ID NO: 1210765 - RNA, 14 nt, Human
cagcccugcagagg

SEQ ID NO: 1210766 - RNA, 13 nt, Human
cagcccugcagag

SEQ ID NO: 1210767 - RNA, 21 nt, Human
cagccguguaaccauggaccc

SEQ ID NO: 1210768 - RNA, 22 nt, Human
cagcccgggcucugccucccau

SEQ ID NO: 1210769 - RNA, 21 nt, Human
cagcccgggcucugccuccca

SEQ ID NO: 1210770 - RNA, 20 nt, Human
cagcccgggcucugccuccc

SEQ ID NO: 1210771 - RNA, 19 nt, Human
cagcccgggcucugccucc

SEQ ID NO: 1210772 - RNA, 18 nt, Human
cagcccgggcucugccuc

SEQ ID NO: 1210773 - RNA, 17 nt, Human
cagcccgggcucugccu

SEQ ID NO: 1210774 - RNA, 16 nt, Human
cagcccgggcucugcc

SEQ ID NO: 1210775 - RNA, 15 nt, Human
cagcccgggcucugc

SEQ ID NO: 1210776 - RNA, 14 nt, Human
cagcccgggcucug

SEQ ID NO: 1210777 - RNA, 13 nt, Human
cagcccgggcucu

SEQ ID NO: 1210778 - RNA, 24 nt, Human
cagccccuucugacccaugcugcc

SEQ ID NO: 1210779 - RNA, 23 nt, Human
cagccccuucugacccaugcugc

SEQ ID NO: 1210780 - RNA, 22 nt, Human
cagccccuucugacccaugcug

SEQ ID NO: 1210781 - RNA, 21 nt, Human
cagccccuucugacccaugcu

SEQ ID NO: 1210782 - RNA, 19 nt, Human
cagccccuucugacccaug

SEQ ID NO: 1210783 - RNA, 17 nt, Human
cagccccuucugaccca

SEQ ID NO: 1210784 - RNA, 16 nt, Human
cagccccuucugaccc

SEQ ID NO: 1210785 - RNA, 21 nt, Human
cagccccuguucuggcagagu

SEQ ID NO: 1210786 - RNA, 20 nt, Human
cagccccuguucuggcagag

SEQ ID NO: 1210787 - RNA, 23 nt, Human
cagccccuggaugcagccucaca

SEQ ID NO: 1210788 - RNA, 18 nt, Human
cagccccauucugccugc

SEQ ID NO: 1210789 - RNA, 17 nt, Human
cagccccauucugccug

SEQ ID NO: 1210790 - RNA, 16 nt, Human
cagccccauucugccu

SEQ ID NO: 1210791 - RNA, 14 nt, Human
cagccccauucugc

SEQ ID NO: 1210792 - RNA, 13 nt, Human
cagccccauucug

SEQ ID NO: 1210793 - RNA, 22 nt, Human
cagccccauccucuguacagag

SEQ ID NO: 1210794 - RNA, 16 nt, Human
cagccccauccucugu

SEQ ID NO: 1210795 - RNA, 14 nt, Human
cagccccauccucu

SEQ ID NO: 1210796 - RNA, 13 nt, Human
cagccccauccuc

SEQ ID NO: 1210797 - RNA, 12 nt, Human
cagccccauccu

SEQ ID NO: 1210798 - RNA, 22 nt, Human
cagccccaucccaaacccuuca

SEQ ID NO: 1210799 - RNA, 21 nt, Human
cagccccaucccaaacccuuc

SEQ ID NO: 1210800 - RNA, 11 nt, Human
cagccccaucc

SEQ ID NO: 1210801 - RNA, 18 nt, Human
cagccccagugcccacag

SEQ ID NO: 1210802 - RNA, 17 nt, Human
cagccccagugcccaca

SEQ ID NO: 1210803 - RNA, 16 nt, Human
cagccccagugcccac

SEQ ID NO: 1210804 - RNA, 15 nt, Human
cagccccagugccca

SEQ ID NO: 1210805 - RNA, 14 nt, Human
cagccccagugccc

SEQ ID NO: 1210806 - RNA, 13 nt, Human
cagccccagugcc

SEQ ID NO: 1210807 - RNA, 23 nt, Human
cagcugcuuuugucuaugggacu

SEQ ID NO: 1210808 - RNA, 16 nt, Human
cagccaaagccuccuc

SEQ ID NO: 1210809 - RNA, 15 nt, Human
cagccaaagccuccu

SEQ ID NO: 1210810 - RNA, 21 nt, Human
cagccaaagccuccuccagcc

SEQ ID NO: 1210811 - RNA, 18 nt, Human
cagccaaagccuccucca

SEQ ID NO: 1210812 - RNA, 21 nt, Human
cagcauccuggcacccggccc

SEQ ID NO: 1210813 - RNA, 20 nt, Human
cagcauccuggcacccggcc

SEQ ID NO: 1210814 - RNA, 19 nt, Human
cagcauccuggcacccggc

SEQ ID NO: 1210815 - RNA, 17 nt, Human
cagcauccuggcacccg

SEQ ID NO: 1210816 - RNA, 16 nt, Human
cagcauccuggcaccc

SEQ ID NO: 1210817 - RNA, 15 nt, Human
cagcauccuggcacc

SEQ ID NO: 1210818 - RNA, 14 nt, Human
cagcauccuggcac

SEQ ID NO: 1210819 - RNA, 20 nt, Human
cagcagggagggcuucugcc

SEQ ID NO: 1210820 - RNA, 18 nt, Human
cagcagggagggcuucug

SEQ ID NO: 1210821 - RNA, 22 nt, Human
cagcaggcucucaggccagcug

SEQ ID NO: 1210822 - RNA, 20 nt, Human
cagcaggcucucaggccagc

SEQ ID NO: 1210823 - RNA, 19 nt, Human
cagcaggcucucaggccag

SEQ ID NO: 1210824 - RNA, 18 nt, Human
cagcaggcucucaggcca

SEQ ID NO: 1210825 - RNA, 17 nt, Human
cagcaggcucucaggcc

SEQ ID NO: 1210826 - RNA, 16 nt, Human
cagcaggcucucaggc

SEQ ID NO: 1210827 - RNA, 15 nt, Human
cagcaggcucucagg

SEQ ID NO: 1210828 - RNA, 14 nt, Human
cagcaggcucucag

SEQ ID NO: 1210829 - RNA, 12 nt, Human
cagcaggcucuc

SEQ ID NO: 1210830 - RNA, 22 nt, Human
cagcagccuggacccuguggau

SEQ ID NO: 1210831 - RNA, 19 nt, Human
cagcagccuggacccugug

SEQ ID NO: 1210832 - RNA, 18 nt, Human
cagcagccuggacccugu

SEQ ID NO: 1210833 - RNA, 15 nt, Human
cagcagccuggaccc

SEQ ID NO: 1210834 - RNA, 14 nt, Human
cagcagccuggacc

SEQ ID NO: 1210835 - RNA, 12 nt, Human
cagcagccugga

SEQ ID NO: 1210836 - RNA, 15 nt, Human
cagcccacuucugcc

SEQ ID NO: 1210837 - RNA, 15 nt, Human
cagcccaccccucaa

SEQ ID NO: 1210838 - RNA, 22 nt, Human
cagccccaaaacucuccucugc

SEQ ID NO: 1210839 - RNA, 21 nt, Human
cagccccaaaacucuccucug

SEQ ID NO: 1210840 - RNA, 20 nt, Human
cagccccaaaacucuccucu

SEQ ID NO: 1210841 - RNA, 18 nt, Human
cagcccacuucugccaua

SEQ ID NO: 1210842 - RNA, 22 nt, Human
cagccaguaaaugggggugcau

SEQ ID NO: 1210843 - RNA, 23 nt, Human
cagccacggccaggccagaggga

SEQ ID NO: 1210844 - RNA, 22 nt, Human
cagccacggccaggccagaggg

SEQ ID NO: 1210845 - RNA, 21 nt, Human
cagccacggccaggccagagg

SEQ ID NO: 1210846 - RNA, 19 nt, Human
cagccacggccaggccaga

SEQ ID NO: 1210847 - RNA, 18 nt, Human
cagccacggccaggccag

SEQ ID NO: 1210848 - RNA, 17 nt, Human
cagccacggccaggcca

SEQ ID NO: 1210849 - RNA, 16 nt, Human
cagccacggccaggcc

SEQ ID NO: 1210850 - RNA, 15 nt, Human
cagccacggccaggc

SEQ ID NO: 1210851 - RNA, 14 nt, Human
cagccacggccagg

SEQ ID NO: 1210852 - RNA, 19 nt, Human
cagccacauuccugaugcu

SEQ ID NO: 1210853 - RNA, 17 nt, Human
cagccacauuccugaug

SEQ ID NO: 1210854 - RNA, 15 nt, Human
cagccacauuccuga

SEQ ID NO: 1210855 - RNA, 14 nt, Human
cagccacauuccug

SEQ ID NO: 1210856 - RNA, 13 nt, Human
cagcagagcaccu

SEQ ID NO: 1210857 - RNA, 11 nt, Human
cagcagagcac

SEQ ID NO: 1210858 - RNA, 22 nt, Human
cagcagaaaugccuuacccuca

SEQ ID NO: 1210859 - RNA, 19 nt, Human
cagcagaaaugccuuaccc

SEQ ID NO: 1210860 - RNA, 17 nt, Human
cagcagaaaugccuuac

SEQ ID NO: 1210861 - RNA, 15 nt, Human
cagcagaaaugccuu

SEQ ID NO: 1210862 - RNA, 17 nt, Human
cagcaagugagagcugg

SEQ ID NO: 1210863 - RNA, 16 nt, Human
cagcaagugagagcug

SEQ ID NO: 1210864 - RNA, 15 nt, Human
cagcaagugagagcu

SEQ ID NO: 1210865 - RNA, 14 nt, Human
cagcaagugagagc

SEQ ID NO: 1210866 - RNA, 12 nt, Human
cagcaagugaga

SEQ ID NO: 1210867 - RNA, 18 nt, Human
cagcaaggagauuuacaa

SEQ ID NO: 1210868 - RNA, 17 nt, Human
cagcaaggagauuuaca

SEQ ID NO: 1210869 - RNA, 22 nt, Human
cagcaauaaagcagcguuucua

SEQ ID NO: 1210870 - RNA, 21 nt, Human
cagcaauaaagcagcguuucu

SEQ ID NO: 1210871 - RNA, 13 nt, Human
cagcaauaaagca

SEQ ID NO: 1210872 - RNA, 21 nt, Human
cagcaagugagagcugggugu

SEQ ID NO: 1210873 - RNA, 19 nt, Human
cagcaagugagagcugggu

SEQ ID NO: 1210874 - RNA, 18 nt, Human
cagcaaaagaugcuucuc

SEQ ID NO: 1210875 - RNA, 15 nt, Human
cagauucuuuccuga

SEQ ID NO: 1210876 - RNA, 14 nt, Human
cagauucuuuccug

SEQ ID NO: 1210877 - RNA, 23 nt, Human
cagaugggugcuuggaggaagga

SEQ ID NO: 1210878 - RNA, 18 nt, Human
cagaugggugcuuggagg

SEQ ID NO: 1210879 - RNA, 14 nt, Human
cagcucaccagccc

SEQ ID NO: 1210880 - RNA, 19 nt, Human
cagaggagagaggaccccc

SEQ ID NO: 1210881 - RNA, 15 nt, Human
cagaggagagaggac

SEQ ID NO: 1210882 - RNA, 13 nt, Human
cagaggagagagg

SEQ ID NO: 1210883 - RNA, 11 nt, Human
cagaggcagcc

SEQ ID NO: 1210884 - RNA, 20 nt, Human
cagaggagagaggacccccu

SEQ ID NO: 1210885 - RNA, 13 nt, Human
cagaggaaggaga

SEQ ID NO: 1210886 - RNA, 13 nt, Human
cagagccugcagu

SEQ ID NO: 1210887 - RNA, 12 nt, Human
cagagccugcag

SEQ ID NO: 1210888 - RNA, 23 nt, Human
cagagcccacgcccccacuggug

SEQ ID NO: 1210889 - RNA, 21 nt, Human
cagagcccacgcccccacugg

SEQ ID NO: 1210890 - RNA, 20 nt, Human
cagagcccacgcccccacug

SEQ ID NO: 1210891 - RNA, 19 nt, Human
cagagcccacgcccccacu

SEQ ID NO: 1210892 - RNA, 17 nt, Human
cagagcccacgccccca

SEQ ID NO: 1210893 - RNA, 16 nt, Human
cagagcccacgccccc

SEQ ID NO: 1210894 - RNA, 20 nt, Human
cagagcccaccuuggcucaa

SEQ ID NO: 1210895 - RNA, 19 nt, Human
cagagcccaccuuggcuca

SEQ ID NO: 1210896 - RNA, 17 nt, Human
cagagcccaccuuggcu

SEQ ID NO: 1210897 - RNA, 15 nt, Human
cagagcccaccuugg

SEQ ID NO: 1210898 - RNA, 21 nt, Human
cagagcagagaccaucccuga

SEQ ID NO: 1210899 - RNA, 19 nt, Human
cagagcagagaccaucccu

SEQ ID NO: 1210900 - RNA, 18 nt, Human
cagagcagagaccauccc

SEQ ID NO: 1210901 - RNA, 17 nt, Human
cagagcagagaccaucc

SEQ ID NO: 1210902 - RNA, 15 nt, Human
cagagcagagaccau

SEQ ID NO: 1210903 - RNA, 14 nt, Human
cagagcagagacca

SEQ ID NO: 1210904 - RNA, 13 nt, Human
cagagcagagacc

SEQ ID NO: 1210905 - RNA, 12 nt, Human
cagagcagagac

SEQ ID NO: 1210906 - RNA, 11 nt, Human
cagagcagaga

SEQ ID NO: 1210907 - RNA, 23 nt, Human
cagagcaccuuagacagucccug

SEQ ID NO: 1210908 - RNA, 22 nt, Human
cagagcaccuuagacagucccu

SEQ ID NO: 1210909 - RNA, 21 nt, Human
cagagcaccuuagacaguccc

SEQ ID NO: 1210910 - RNA, 19 nt, Human
cagagcaccuuagacaguc

SEQ ID NO: 1210911 - RNA, 18 nt, Human
cagagcaccuuagacagu

SEQ ID NO: 1210912 - RNA, 16 nt, Human
cagagaccaucccuga

SEQ ID NO: 1210913 - RNA, 14 nt, Human
cagagaccaucccu

SEQ ID NO: 1210914 - RNA, 13 nt, Human
cagagaccauccc

SEQ ID NO: 1210915 - RNA, 17 nt, Human
cagagacacaagccuuc

SEQ ID NO: 1210916 - RNA, 16 nt, Human
cagagacacaagccuu

SEQ ID NO: 1210917 - RNA, 15 nt, Human
cagagacacaagccu

SEQ ID NO: 1210918 - RNA, 14 nt, Human
cagagacacaagcc

SEQ ID NO: 1210919 - RNA, 15 nt, Human
cagagaauucucuua

SEQ ID NO: 1210920 - RNA, 21 nt, Human
cagagaaugaaagggcccaga

SEQ ID NO: 1210921 - RNA, 20 nt, Human
cagagaaugaaagggcccag

SEQ ID NO: 1210922 - RNA, 19 nt, Human
cagagaaugaaagggccca

SEQ ID NO: 1210923 - RNA, 19 nt, Human
cagagacuccugcaggcag

SEQ ID NO: 1210924 - RNA, 18 nt, Human
cagagacuccugcaggca

SEQ ID NO: 1210925 - RNA, 17 nt, Human
cagagacuccugcaggc

SEQ ID NO: 1210926 - RNA, 16 nt, Human
cagagacuccugcagg

SEQ ID NO: 1210927 - RNA, 15 nt, Human
cagagacuccugcag

SEQ ID NO: 1210928 - RNA, 14 nt, Human
cagagacuccugca

SEQ ID NO: 1210929 - RNA, 13 nt, Human
cagagacuccugc

SEQ ID NO: 1210930 - RNA, 21 nt, Human
cagagaccaucccugaaggcc

SEQ ID NO: 1210931 - RNA, 20 nt, Human
cagagaccaucccugaaggc

SEQ ID NO: 1210932 - RNA, 19 nt, Human
cagagaccaucccugaagg

SEQ ID NO: 1210933 - RNA, 18 nt, Human
cagagaccaucccugaag

SEQ ID NO: 1210934 - RNA, 17 nt, Human
cagagaccaucccugaa

SEQ ID NO: 1210935 - RNA, 20 nt, Human
cagagcaagugagacccugu

SEQ ID NO: 1210936 - RNA, 14 nt, Human
cagagcaagugaga

SEQ ID NO: 1210937 - RNA, 16 nt, Human
cagagcaccuuagaca

SEQ ID NO: 1210938 - RNA, 13 nt, Human
cagagucucacug

SEQ ID NO: 1210939 - RNA, 21 nt, Human
cagagucucacuguugcccag

SEQ ID NO: 1210940 - RNA, 20 nt, Human
cagagucucacuguugccca

SEQ ID NO: 1210941 - RNA, 19 nt, Human
cagagucucacuguugccc

SEQ ID NO: 1210942 - RNA, 17 nt, Human
cagagucucacuguugc

SEQ ID NO: 1210943 - RNA, 19 nt, Human
cagagggccugcaagggag

SEQ ID NO: 1210944 - RNA, 15 nt, Human
cagagggccugcaag

SEQ ID NO: 1210945 - RNA, 23 nt, Human
cagagggagugacagaggcagcc

SEQ ID NO: 1210946 - RNA, 22 nt, Human
cagagggagugacagaggcagc

SEQ ID NO: 1210947 - RNA, 21 nt, Human
cagagggagugacagaggcag

SEQ ID NO: 1210948 - RNA, 20 nt, Human
cagagggagugacagaggca

SEQ ID NO: 1210949 - RNA, 20 nt, Human
cagagugagacucugucuca

SEQ ID NO: 1210950 - RNA, 19 nt, Human
cagagugagacucugucuc

SEQ ID NO: 1210951 - RNA, 18 nt, Human
cagagugagacucugucu

SEQ ID NO: 1210952 - RNA, 17 nt, Human
cagagugagacucuguc

SEQ ID NO: 1210953 - RNA, 16 nt, Human
cagagugagacucugu

SEQ ID NO: 1210954 - RNA, 23 nt, Human
cagagucucacuguugcccaggc

SEQ ID NO: 1210955 - RNA, 22 nt, Human
cagagucucacuguugcccagg

SEQ ID NO: 1210956 - RNA, 19 nt, Human
cagagggagugacagaggc

SEQ ID NO: 1210957 - RNA, 18 nt, Human
cagagggagugacagagg

SEQ ID NO: 1210958 - RNA, 16 nt, Human
cagagggagugacaga

SEQ ID NO: 1210959 - RNA, 14 nt, Human
cagagggagugaca

SEQ ID NO: 1210960 - RNA, 23 nt, Human
cagaggcugccucucccaucacu

SEQ ID NO: 1210961 - RNA, 13 nt, Human
cagaggcugccuc

SEQ ID NO: 1210962 - RNA, 21 nt, Human
cagaggccaugggccuccugu

SEQ ID NO: 1210963 - RNA, 20 nt, Human
cagaggccaugggccuccug

SEQ ID NO: 1210964 - RNA, 19 nt, Human
cagaggccaugggccuccu

SEQ ID NO: 1210965 - RNA, 23 nt, Human
cagaggcagccccauucugccug

SEQ ID NO: 1210966 - RNA, 22 nt, Human
cagaggcagccccauucugccu

SEQ ID NO: 1210967 - RNA, 20 nt, Human
cagaggcagccccauucugc

SEQ ID NO: 1210968 - RNA, 19 nt, Human
cagaggcagccccauucug

SEQ ID NO: 1210969 - RNA, 18 nt, Human
cagaggcagccccauucu

SEQ ID NO: 1210970 - RNA, 15 nt, Human
cagaggcagccccau

SEQ ID NO: 1210971 - RNA, 14 nt, Human
cagaggcagcccca

SEQ ID NO: 1210972 - RNA, 13 nt, Human
cagaggcagcccc

SEQ ID NO: 1210973 - RNA, 12 nt, Human
cagaggcagccc

SEQ ID NO: 1210974 - RNA, 19 nt, Human
cagaguuguuacauuuuua

SEQ ID NO: 1210975 - RNA, 18 nt, Human
cagaguuguuacauuuuu

SEQ ID NO: 1210976 - RNA, 15 nt, Human
cagaguuguuacauu

SEQ ID NO: 1210977 - RNA, 14 nt, Human
cagaguuguuacau

SEQ ID NO: 1210978 - RNA, 22 nt, Human
cagaguugaagacagagcuaca

SEQ ID NO: 1210979 - RNA, 20 nt, Human
cagaguugaagacagagcua

SEQ ID NO: 1210980 - RNA, 19 nt, Human
cagaguugaagacagagcu

SEQ ID NO: 1210981 - RNA, 18 nt, Human
cagaguugaagacagagc

SEQ ID NO: 1210982 - RNA, 17 nt, Human
cagaguugaagacagag

SEQ ID NO: 1210983 - RNA, 16 nt, Human
cagaguugaagacaga

SEQ ID NO: 1210984 - RNA, 15 nt, Human
cagaguugaagacag

SEQ ID NO: 1210985 - RNA, 14 nt, Human
cagaguugaagaca

SEQ ID NO: 1210986 - RNA, 20 nt, Human
cagaucucuaacuucaccau

SEQ ID NO: 1210987 - RNA, 23 nt, Human
cagauacaggaaaagcugcugac

SEQ ID NO: 1210988 - RNA, 22 nt, Human
cagauacaggaaaagcugcuga

SEQ ID NO: 1210989 - RNA, 21 nt, Human
cagauacaggaaaagcugcug

SEQ ID NO: 1210990 - RNA, 20 nt, Human
cagauacaggaaaagcugcu

SEQ ID NO: 1210991 - RNA, 22 nt, Human
cagaugcaccagcccuuagcag

SEQ ID NO: 1210992 - RNA, 17 nt, Human
cagaugcaccagcccuu

SEQ ID NO: 1210993 - RNA, 16 nt, Human
cagaugcaccagcccu

SEQ ID NO: 1210994 - RNA, 14 nt, Human
cagaugcaccagcc

SEQ ID NO: 1210995 - RNA, 13 nt, Human
cagaugcaccagc

SEQ ID NO: 1210996 - RNA, 16 nt, Human
cagaggccaugggccu

SEQ ID NO: 1210997 - RNA, 23 nt, Human
cagagaaaguacuucuccacccu

SEQ ID NO: 1210998 - RNA, 19 nt, Human
cagagaaaguacuucucca

SEQ ID NO: 1210999 - RNA, 20 nt, Human
cagaccacaaaacuuuucua

SEQ ID NO: 1211000 - RNA, 14 nt, Human
cagaccacaaaacu

SEQ ID NO: 1211001 - RNA, 22 nt, Human
cagacccugcccugugggcccc

SEQ ID NO: 1211002 - RNA, 21 nt, Human
cagacccugcccugugggccc

SEQ ID NO: 1211003 - RNA, 17 nt, Human
cagacccugcccugugg

SEQ ID NO: 1211004 - RNA, 16 nt, Human
cagacccugcccugug

SEQ ID NO: 1211005 - RNA, 15 nt, Human
cagacccugcccugu

SEQ ID NO: 1211006 - RNA, 14 nt, Human
cagacccugcccug

SEQ ID NO: 1211007 - RNA, 13 nt, Human
cagacccugcccu

SEQ ID NO: 1211008 - RNA, 12 nt, Human
cagacccugccc

SEQ ID NO: 1211009 - RNA, 16 nt, Human
cagacccggcugcgug

SEQ ID NO: 1211010 - RNA, 14 nt, Human
cagacccggcugcg

SEQ ID NO: 1211011 - RNA, 12 nt, Human
cagacccggcug

SEQ ID NO: 1211012 - RNA, 14 nt, Human
cagaauuucccaaa

SEQ ID NO: 1211013 - RNA, 18 nt, Human
cagaauucucuaguuuga

SEQ ID NO: 1211014 - RNA, 15 nt, Human
cagaauucucuaguu

SEQ ID NO: 1211015 - RNA, 11 nt, Human
cagaauucuca

SEQ ID NO: 1211016 - RNA, 20 nt, Human
cagacaacaaaccuguuucu

SEQ ID NO: 1211017 - RNA, 22 nt, Human
cagacaaagcgugguggacaug

SEQ ID NO: 1211018 - RNA, 12 nt, Human
cagacaaagcgu

SEQ ID NO: 1211019 - RNA, 24 nt, Human
cagaauuucccaaagcagugcaug

SEQ ID NO: 1211020 - RNA, 20 nt, Human
cagaauuucccaaagcagug

SEQ ID NO: 1211021 - RNA, 19 nt, Human
cagaauuucccaaagcagu

SEQ ID NO: 1211022 - RNA, 18 nt, Human
cagaauuucccaaagcag

SEQ ID NO: 1211023 - RNA, 17 nt, Human
cagaauuucccaaagca

SEQ ID NO: 1211024 - RNA, 19 nt, Human
cagacauacuaaccagcag

SEQ ID NO: 1211025 - RNA, 20 nt, Human
cagacaguuaagagaaauga

SEQ ID NO: 1211026 - RNA, 22 nt, Human
cagacaccuugacagggcacac

SEQ ID NO: 1211027 - RNA, 20 nt, Human
cagacaccuugacagggcac

SEQ ID NO: 1211028 - RNA, 19 nt, Human
cagacaccuugacagggca

SEQ ID NO: 1211029 - RNA, 23 nt, Human
cagacacauguccaagaagccca

SEQ ID NO: 1211030 - RNA, 22 nt, Human
cagacacauguccaagaagccc

SEQ ID NO: 1211031 - RNA, 21 nt, Human
cagacacauguccaagaagcc

SEQ ID NO: 1211032 - RNA, 17 nt, Human
cagacacauguccaaga

SEQ ID NO: 1211033 - RNA, 14 nt, Human
cagacacaugucca

SEQ ID NO: 1211034 - RNA, 23 nt, Human
cagacacaggcccggcuccaggc

SEQ ID NO: 1211035 - RNA, 22 nt, Human
cagacacaggcccggcuccagg

SEQ ID NO: 1211036 - RNA, 21 nt, Human
cagacacaggcccggcuccag

SEQ ID NO: 1211037 - RNA, 18 nt, Human
cagacacaggcccggcuc

SEQ ID NO: 1211038 - RNA, 17 nt, Human
cagacacaggcccggcu

SEQ ID NO: 1211039 - RNA, 15 nt, Human
cagacacaggcccgg

SEQ ID NO: 1211040 - RNA, 14 nt, Human
cagacacaggcccg

SEQ ID NO: 1211041 - RNA, 13 nt, Human
cagacacaggccc

SEQ ID NO: 1211042 - RNA, 23 nt, Human
cagaaaauggaagacagcucuua

SEQ ID NO: 1211043 - RNA, 22 nt, Human
cagaaaauggaagacagcucuu

SEQ ID NO: 1211044 - RNA, 21 nt, Human
cagaaaauggaagacagcucu

SEQ ID NO: 1211045 - RNA, 20 nt, Human
cagaaaauggaagacagcuc

SEQ ID NO: 1211046 - RNA, 16 nt, Human
cagaaaauggaagaca

SEQ ID NO: 1211047 - RNA, 23 nt, Human
cacuuuguucuggcucuuccagg

SEQ ID NO: 1211048 - RNA, 16 nt, Human
cacuuuguucuggcuc

SEQ ID NO: 1211049 - RNA, 14 nt, Human
cacuuuguucuggc

SEQ ID NO: 1211050 - RNA, 13 nt, Human
cacuuuguucugg

SEQ ID NO: 1211051 - RNA, 16 nt, Human
cacuuugggaggccaa

SEQ ID NO: 1211052 - RNA, 13 nt, Human
cacuuugggaggc

SEQ ID NO: 1211053 - RNA, 12 nt, Human
cacuuugggagg

SEQ ID NO: 1211054 - RNA, 22 nt, Human
cacuuucuagccagaggagaga

SEQ ID NO: 1211055 - RNA, 22 nt, Human
cacuuuuguucuugguuuguaa

SEQ ID NO: 1211056 - RNA, 14 nt, Human
cacuuuuguucuug

SEQ ID NO: 1211057 - RNA, 21 nt, Human
cagaagacacugaugggcaac

SEQ ID NO: 1211058 - RNA, 18 nt, Human
cagaaucucaaauaacua

SEQ ID NO: 1211059 - RNA, 17 nt, Human
cagaaucucaaauaacu

SEQ ID NO: 1211060 - RNA, 19 nt, Human
cagaaggaagacuucaucc

SEQ ID NO: 1211061 - RNA, 18 nt, Human
cagaaggaagacuucauc

SEQ ID NO: 1211062 - RNA, 17 nt, Human
cagaaggaagacuucau

SEQ ID NO: 1211063 - RNA, 16 nt, Human
cagaaggaagacuuca

SEQ ID NO: 1211064 - RNA, 16 nt, Human
cagacaacaaaccugu

SEQ ID NO: 1211065 - RNA, 15 nt, Human
cacucauugaccuga

SEQ ID NO: 1211066 - RNA, 16 nt, Human
cacucaguccauagca

SEQ ID NO: 1211067 - RNA, 16 nt, Human
cacucccugcaaccug

SEQ ID NO: 1211068 - RNA, 13 nt, Human
cacucccugcaac

SEQ ID NO: 1211069 - RNA, 12 nt, Human
cacucccugcaa

SEQ ID NO: 1211070 - RNA, 22 nt, Human
cacucauugaccugaggcccuu

SEQ ID NO: 1211071 - RNA, 20 nt, Human
cacucauugaccugaggccc

SEQ ID NO: 1211072 - RNA, 19 nt, Human
cacucauugaccugaggcc

SEQ ID NO: 1211073 - RNA, 18 nt, Human
cacucauugaccugaggc

SEQ ID NO: 1211074 - RNA, 21 nt, Human
cacuccuucacagaugggugc

SEQ ID NO: 1211075 - RNA, 14 nt, Human
cacuccuucacaga

SEQ ID NO: 1211076 - RNA, 17 nt, Human
cacucccugcaaccuga

SEQ ID NO: 1211077 - RNA, 14 nt, Human
cacucuggcagcuc

SEQ ID NO: 1211078 - RNA, 13 nt, Human
cacucuggcagcu

SEQ ID NO: 1211079 - RNA, 12 nt, Human
cacucuggcagc

SEQ ID NO: 1211080 - RNA, 23 nt, Human
cacucugagacucgcgacaaugc

SEQ ID NO: 1211081 - RNA, 12 nt, Human
cacucugagacu

SEQ ID NO: 1211082 - RNA, 12 nt, Human
cacucuccuugg

SEQ ID NO: 1211083 - RNA, 22 nt, Human
cacucagaagacacugaugggc

SEQ ID NO: 1211084 - RNA, 19 nt, Human
cacucagaagacacugaug

SEQ ID NO: 1211085 - RNA, 18 nt, Human
cacucagaagacacugau

SEQ ID NO: 1211086 - RNA, 17 nt, Human
cacucagaagacacuga

SEQ ID NO: 1211087 - RNA, 16 nt, Human
cacucagaagacacug

SEQ ID NO: 1211088 - RNA, 12 nt, Human
cacucagaagac

SEQ ID NO: 1211089 - RNA, 20 nt, Human
cacucacauuuauucugcuc

SEQ ID NO: 1211090 - RNA, 19 nt, Human
cacucacauuuauucugcu

SEQ ID NO: 1211091 - RNA, 20 nt, Human
cacucaaaagcugggcaggu

SEQ ID NO: 1211092 - RNA, 19 nt, Human
cacucaaaagcugggcagg

SEQ ID NO: 1211093 - RNA, 18 nt, Human
cacucaaaagcugggcag

SEQ ID NO: 1211094 - RNA, 17 nt, Human
cacucaaaagcugggca

SEQ ID NO: 1211095 - RNA, 15 nt, Human
cacucaaaagcuggg

SEQ ID NO: 1211096 - RNA, 21 nt, Human
cacuauguugcccaggcaggu

SEQ ID NO: 1211097 - RNA, 20 nt, Human
cacuauguugcccaggcagg

SEQ ID NO: 1211098 - RNA, 18 nt, Human
cacuaaggugugcucuga

SEQ ID NO: 1211099 - RNA, 17 nt, Human
cacuaaggugugcucug

SEQ ID NO: 1211100 - RNA, 18 nt, Human
cacuaaccacgcuggacc

SEQ ID NO: 1211101 - RNA, 16 nt, Human
cacuaaccacgcugga

SEQ ID NO: 1211102 - RNA, 15 nt, Human
cacuaaccacgcugg

SEQ ID NO: 1211103 - RNA, 14 nt, Human
cacuaaccacgcug

SEQ ID NO: 1211104 - RNA, 21 nt, Human
cacuauagccuaggugacaga

SEQ ID NO: 1211105 - RNA, 14 nt, Human
cacuauagccuagg

SEQ ID NO: 1211106 - RNA, 18 nt, Human
cacuauaauguaagcucu

SEQ ID NO: 1211107 - RNA, 14 nt, Human
cacuauaauguaag

SEQ ID NO: 1211108 - RNA, 19 nt, Human
cacuauguugcccaggcag

SEQ ID NO: 1211109 - RNA, 18 nt, Human
cacuauguugcccaggca

SEQ ID NO: 1211110 - RNA, 17 nt, Human
cacuauguugcccaggc

SEQ ID NO: 1211111 - RNA, 16 nt, Human
cacuauguugcccagg

SEQ ID NO: 1211112 - RNA, 15 nt, Human
cacuauguugcccag

SEQ ID NO: 1211113 - RNA, 19 nt, Human
cacgugguccuaaucuucu

SEQ ID NO: 1211114 - RNA, 16 nt, Human
cacgugguccuaaucu

SEQ ID NO: 1211115 - RNA, 23 nt, Human
cacguuucuaaaggcuaccuuug

SEQ ID NO: 1211116 - RNA, 14 nt, Human
cacguuucuaaagg

SEQ ID NO: 1211117 - RNA, 12 nt, Human
cacguuucuaaa

SEQ ID NO: 1211118 - RNA, 14 nt, Human
cacguacacacaca

SEQ ID NO: 1211119 - RNA, 19 nt, Human
cacguacacacacauacac

SEQ ID NO: 1211120 - RNA, 18 nt, Human
cacguacacacacauaca

SEQ ID NO: 1211121 - RNA, 20 nt, Human
cacggcucacugcagccuca

SEQ ID NO: 1211122 - RNA, 19 nt, Human
cacggcucacugcagccuc

SEQ ID NO: 1211123 - RNA, 17 nt, Human
cacggcucacugcagcc

SEQ ID NO: 1211124 - RNA, 16 nt, Human
cacggcucacugcagc

SEQ ID NO: 1211125 - RNA, 15 nt, Human
cacgcuggagugcag

SEQ ID NO: 1211126 - RNA, 20 nt, Human
cacgcuggaccuugaacugg

SEQ ID NO: 1211127 - RNA, 17 nt, Human
cacgcuggaccuugaac

SEQ ID NO: 1211128 - RNA, 23 nt, Human
cacgcgugcacacaccagagccc

SEQ ID NO: 1211129 - RNA, 21 nt, Human
cacgcgugcacacaccagagc

SEQ ID NO: 1211130 - RNA, 16 nt, Human
cacgcgugcacacacc

SEQ ID NO: 1211131 - RNA, 15 nt, Human
cacgcgugcacacac

SEQ ID NO: 1211132 - RNA, 20 nt, Human
cacgccuguaauccuagcac

SEQ ID NO: 1211133 - RNA, 19 nt, Human
cacgccuguaauccuagca

SEQ ID NO: 1211134 - RNA, 18 nt, Human
cacgcccccacuggugac

SEQ ID NO: 1211135 - RNA, 17 nt, Human
cacgcccccacugguga

SEQ ID NO: 1211136 - RNA, 15 nt, Human
cacgcccccacuggu

SEQ ID NO: 1211137 - RNA, 13 nt, Human
cacgcccccacug

SEQ ID NO: 1211138 - RNA, 23 nt, Human
cacgccagauucuuuccugaggc

SEQ ID NO: 1211139 - RNA, 22 nt, Human
cacgccagauucuuuccugagg

SEQ ID NO: 1211140 - RNA, 20 nt, Human
cacgccagauucuuuccuga

SEQ ID NO: 1211141 - RNA, 19 nt, Human
cacgccagauucuuuccug

SEQ ID NO: 1211142 - RNA, 15 nt, Human
cacgccacugcacua

SEQ ID NO: 1211143 - RNA, 13 nt, Human
cacgccacugcac

SEQ ID NO: 1211144 - RNA, 17 nt, Human
cacgcacuucgggaggu

SEQ ID NO: 1211145 - RNA, 16 nt, Human
cacgauuucuguuuag

SEQ ID NO: 1211146 - RNA, 14 nt, Human
cacgauuucuguuu

SEQ ID NO: 1211147 - RNA, 12 nt, Human
cacgauuucugu

SEQ ID NO: 1211148 - RNA, 17 nt, Human
cacgacugcccggcagg

SEQ ID NO: 1211149 - RNA, 16 nt, Human
cacgacugcccggcag

SEQ ID NO: 1211150 - RNA, 22 nt, Human
cacgaauauugcugauggugca

SEQ ID NO: 1211151 - RNA, 19 nt, Human
cacgaauauugcugauggu

SEQ ID NO: 1211152 - RNA, 16 nt, Human
cacgaauauugcugau

SEQ ID NO: 1211153 - RNA, 18 nt, Human
caccuugacagggcacac

SEQ ID NO: 1211154 - RNA, 16 nt, Human
caccuugacagggcac

SEQ ID NO: 1211155 - RNA, 15 nt, Human
caccuugacagggca

SEQ ID NO: 1211156 - RNA, 13 nt, Human
caccuugacaggg

SEQ ID NO: 1211157 - RNA, 19 nt, Human
caccuuagacagucccugc

SEQ ID NO: 1211158 - RNA, 18 nt, Human
caccuuagacagucccug

SEQ ID NO: 1211159 - RNA, 16 nt, Human
caccuuagacaguccc

SEQ ID NO: 1211160 - RNA, 14 nt, Human
caccuuagacaguc

SEQ ID NO: 1211161 - RNA, 23 nt, Human
caccuuagacagucccugccaau

SEQ ID NO: 1211162 - RNA, 21 nt, Human
caccuuagacagucccugcca

SEQ ID NO: 1211163 - RNA, 24 nt, Human
cacugaugggcaacccccagccug

SEQ ID NO: 1211164 - RNA, 18 nt, Human
cacugaugggcaaccccc

SEQ ID NO: 1211165 - RNA, 14 nt, Human
cacugaugggcaac

SEQ ID NO: 1211166 - RNA, 23 nt, Human
cacugagacagcccgggcucugc

SEQ ID NO: 1211167 - RNA, 23 nt, Human
cacugcaaccuccgccucuuggg

SEQ ID NO: 1211168 - RNA, 16 nt, Human
cacugcaaccuccgcc

SEQ ID NO: 1211169 - RNA, 14 nt, Human
cacugcaaccuccg

SEQ ID NO: 1211170 - RNA, 13 nt, Human
cacugcaaccucc

SEQ ID NO: 1211171 - RNA, 22 nt, Human
cacugagacagcccgggcucug

SEQ ID NO: 1211172 - RNA, 19 nt, Human
cacugagacagcccgggcu

SEQ ID NO: 1211173 - RNA, 17 nt, Human
cacugagacagcccggg

SEQ ID NO: 1211174 - RNA, 14 nt, Human
cacugagacagccc

SEQ ID NO: 1211175 - RNA, 13 nt, Human
cacugagacagcc

SEQ ID NO: 1211176 - RNA, 12 nt, Human
cacugagacagc

SEQ ID NO: 1211177 - RNA, 23 nt, Human
cacugacauuguuggccaaagcc

SEQ ID NO: 1211178 - RNA, 20 nt, Human
cacucugucgcccagucugg

SEQ ID NO: 1211179 - RNA, 19 nt, Human
cacucugucgcccagucug

SEQ ID NO: 1211180 - RNA, 16 nt, Human
cacucugucgcccagu

SEQ ID NO: 1211181 - RNA, 15 nt, Human
cacucugucgcccag

SEQ ID NO: 1211182 - RNA, 23 nt, Human
cacucuggcagcucagagagggu

SEQ ID NO: 1211183 - RNA, 21 nt, Human
cacucuggcagcucagagagg

SEQ ID NO: 1211184 - RNA, 20 nt, Human
cacucuggcagcucagagag

SEQ ID NO: 1211185 - RNA, 19 nt, Human
cacucuggcagcucagaga

SEQ ID NO: 1211186 - RNA, 17 nt, Human
cacucuggcagcucaga

SEQ ID NO: 1211187 - RNA, 16 nt, Human
cacucuggcagcucag

SEQ ID NO: 1211188 - RNA, 15 nt, Human
cacucuggcagcuca

SEQ ID NO: 1211189 - RNA, 12 nt, Human
cacugcucuggu

SEQ ID NO: 1211190 - RNA, 19 nt, Human
cacugcacuauagccuagg

SEQ ID NO: 1211191 - RNA, 18 nt, Human
cacugcacuauagccuag

SEQ ID NO: 1211192 - RNA, 19 nt, Human
cacugcaccgggccacaga

SEQ ID NO: 1211193 - RNA, 18 nt, Human
cacugcaccgggccacag

SEQ ID NO: 1211194 - RNA, 16 nt, Human
cacugcaccgggccac

SEQ ID NO: 1211195 - RNA, 15 nt, Human
cacugcaccgggcca

SEQ ID NO: 1211196 - RNA, 14 nt, Human
cacugcaccgggcc

SEQ ID NO: 1211197 - RNA, 17 nt, Human
cacuggaacacuaauga

SEQ ID NO: 1211198 - RNA, 21 nt, Human
cacugcuuuuggucuguguga

SEQ ID NO: 1211199 - RNA, 20 nt, Human
cacugcuuuuggucugugug

SEQ ID NO: 1211200 - RNA, 22 nt, Human
cacugcuuccagugaggcucug

SEQ ID NO: 1211201 - RNA, 21 nt, Human
cacugcuuccagugaggcucu

SEQ ID NO: 1211202 - RNA, 20 nt, Human
cacugcuuccagugaggcuc

SEQ ID NO: 1211203 - RNA, 19 nt, Human
cacugcuuccagugaggcu

SEQ ID NO: 1211204 - RNA, 18 nt, Human
cacugcuuccagugaggc

SEQ ID NO: 1211205 - RNA, 16 nt, Human
cacugcuuccagugag

SEQ ID NO: 1211206 - RNA, 15 nt, Human
cacugcuuccaguga

SEQ ID NO: 1211207 - RNA, 14 nt, Human
cacugcuuccagug

SEQ ID NO: 1211208 - RNA, 13 nt, Human
cacugcuuaacuu

SEQ ID NO: 1211209 - RNA, 14 nt, Human
cacugugccaugug

SEQ ID NO: 1211210 - RNA, 13 nt, Human
cacugugaagaga

SEQ ID NO: 1211211 - RNA, 22 nt, Human
cacuguucucugcccuccaaga

SEQ ID NO: 1211212 - RNA, 21 nt, Human
cacuguucucugcccuccaag

SEQ ID NO: 1211213 - RNA, 19 nt, Human
cacuguucucugcccucca

SEQ ID NO: 1211214 - RNA, 17 nt, Human
cacuguucucugcccuc

SEQ ID NO: 1211215 - RNA, 16 nt, Human
cacuguucucugcccu

SEQ ID NO: 1211216 - RNA, 15 nt, Human
cacuguucucugccc

SEQ ID NO: 1211217 - RNA, 14 nt, Human
cacuguucucugcc

SEQ ID NO: 1211218 - RNA, 13 nt, Human
cacuguucucugc

SEQ ID NO: 1211219 - RNA, 15 nt, Human
cacugugcugagucu

SEQ ID NO: 1211220 - RNA, 13 nt, Human
cacugugcugagu

SEQ ID NO: 1211221 - RNA, 18 nt, Human
cacugugccaugugccag

SEQ ID NO: 1211222 - RNA, 16 nt, Human
cacugugccaugugcc

SEQ ID NO: 1211223 - RNA, 15 nt, Human
cacugugccaugugc

SEQ ID NO: 1211224 - RNA, 22 nt, Human
cacugugcugagucugaaggcu

SEQ ID NO: 1211225 - RNA, 21 nt, Human
cacugugcugagucugaaggc

SEQ ID NO: 1211226 - RNA, 20 nt, Human
cacugugcugagucugaagg

SEQ ID NO: 1211227 - RNA, 17 nt, Human
cacugugcugagucuga

SEQ ID NO: 1211228 - RNA, 20 nt, Human
cacuuucuagccagaggaga

SEQ ID NO: 1211229 - RNA, 19 nt, Human
cacuuucuagccagaggag

SEQ ID NO: 1211230 - RNA, 24 nt, Human
cacuugcagacucuacagaggcca

SEQ ID NO: 1211231 - RNA, 22 nt, Human
cacuugcagacucuacagaggc

SEQ ID NO: 1211232 - RNA, 19 nt, Human
cacuugcagacucuacaga

SEQ ID NO: 1211233 - RNA, 18 nt, Human
cacuugcagacucuacag

SEQ ID NO: 1211234 - RNA, 14 nt, Human
cacuugcagacucu

SEQ ID NO: 1211235 - RNA, 16 nt, Human
cacuugacaucaacug

SEQ ID NO: 1211236 - RNA, 20 nt, Human
cacuugagaauuacccuuuu

SEQ ID NO: 1211237 - RNA, 17 nt, Human
cacuugagaauuacccu

SEQ ID NO: 1211238 - RNA, 19 nt, Human
cacuugacaucaacugcau

SEQ ID NO: 1211239 - RNA, 13 nt, Human
cacuugcagacuc

SEQ ID NO: 1211240 - RNA, 13 nt, Human
cacuugaguccag

SEQ ID NO: 1211241 - RNA, 22 nt, Human
cacuucugccauauucuguugg

SEQ ID NO: 1211242 - RNA, 23 nt, Human
cacuucgggaggucgaggcagga

SEQ ID NO: 1211243 - RNA, 21 nt, Human
cacuucgggaggucgaggcag

SEQ ID NO: 1211244 - RNA, 16 nt, Human
cacuucccuacaugga

SEQ ID NO: 1211245 - RNA, 14 nt, Human
cacuguugcccagg

SEQ ID NO: 1211246 - RNA, 21 nt, Human
cacuucagcugacuuuucugu

SEQ ID NO: 1211247 - RNA, 12 nt, Human
cacuucagcuga

SEQ ID NO: 1211248 - RNA, 18 nt, Human
caccgggccacagagaaa

SEQ ID NO: 1211249 - RNA, 15 nt, Human
caccgggccacagag

SEQ ID NO: 1211250 - RNA, 22 nt, Human
caccgggcacucagaagacacu

SEQ ID NO: 1211251 - RNA, 15 nt, Human
caccgggcacucaga

SEQ ID NO: 1211252 - RNA, 21 nt, Human
caccgcagacaggaccaggga

SEQ ID NO: 1211253 - RNA, 14 nt, Human
caccgggcacucag

SEQ ID NO: 1211254 - RNA, 20 nt, Human
caccggcuggccuggccccu

SEQ ID NO: 1211255 - RNA, 18 nt, Human
caccggcuggccuggccc

SEQ ID NO: 1211256 - RNA, 17 nt, Human
caccggcuggccuggcc

SEQ ID NO: 1211257 - RNA, 16 nt, Human
caccggcuggccuggc

SEQ ID NO: 1211258 - RNA, 15 nt, Human
caccggcuggccugg

SEQ ID NO: 1211259 - RNA, 14 nt, Human
caccggcuggccug

SEQ ID NO: 1211260 - RNA, 17 nt, Human
caccucucccuuggauu

SEQ ID NO: 1211261 - RNA, 14 nt, Human
caccucucccuugg

SEQ ID NO: 1211262 - RNA, 13 nt, Human
caccucucccuug

SEQ ID NO: 1211263 - RNA, 14 nt, Human
caccuccugccucg

SEQ ID NO: 1211264 - RNA, 13 nt, Human
caccuccugccuc

SEQ ID NO: 1211265 - RNA, 11 nt, Human
caccuccugcc

SEQ ID NO: 1211266 - RNA, 23 nt, Human
caccuggccucugcacuccccug

SEQ ID NO: 1211267 - RNA, 20 nt, Human
caccuggccucugcacuccc

SEQ ID NO: 1211268 - RNA, 19 nt, Human
caccuggccucugcacucc

SEQ ID NO: 1211269 - RNA, 18 nt, Human
caccuggccucugcacuc

SEQ ID NO: 1211270 - RNA, 17 nt, Human
caccuggccucugcacu

SEQ ID NO: 1211271 - RNA, 15 nt, Human
caccuggccucugca

SEQ ID NO: 1211272 - RNA, 14 nt, Human
caccuggccucugc

SEQ ID NO: 1211273 - RNA, 13 nt, Human
caccuggccucug

SEQ ID NO: 1211274 - RNA, 12 nt, Human
caccuggccucu

SEQ ID NO: 1211275 - RNA, 20 nt, Human
caccuggaauauauaaccag

SEQ ID NO: 1211276 - RNA, 23 nt, Human
caccugcggugcuaucuccccca

SEQ ID NO: 1211277 - RNA, 23 nt, Human
caccugaagacucauucuucugu

SEQ ID NO: 1211278 - RNA, 15 nt, Human
caccugaagacucau

SEQ ID NO: 1211279 - RNA, 14 nt, Human
caccugaagacuca

SEQ ID NO: 1211280 - RNA, 19 nt, Human
caccucugcacaagcugca

SEQ ID NO: 1211281 - RNA, 18 nt, Human
caccucugcacaagcugc

SEQ ID NO: 1211282 - RNA, 19 nt, Human
caccucucucacuccuuga

SEQ ID NO: 1211283 - RNA, 18 nt, Human
caccucucucacuccuug

SEQ ID NO: 1211284 - RNA, 17 nt, Human
caccucucucacuccuu

SEQ ID NO: 1211285 - RNA, 15 nt, Human
caccucucucacucc

SEQ ID NO: 1211286 - RNA, 18 nt, Human
caccgcagacaggaccag

SEQ ID NO: 1211287 - RNA, 17 nt, Human
caccgcagacaggacca

SEQ ID NO: 1211288 - RNA, 15 nt, Human
caccgcagacaggac

SEQ ID NO: 1211289 - RNA, 14 nt, Human
caccgcagacagga

SEQ ID NO: 1211290 - RNA, 13 nt, Human
caccgcagacagg

SEQ ID NO: 1211291 - RNA, 12 nt, Human
caccgcagacag

SEQ ID NO: 1211292 - RNA, 22 nt, Human
caccgaaaacguggcugcuuca

SEQ ID NO: 1211293 - RNA, 21 nt, Human
caccgaaaacguggcugcuuc

SEQ ID NO: 1211294 - RNA, 19 nt, Human
caccgaaaacguggcugcu

SEQ ID NO: 1211295 - RNA, 18 nt, Human
caccgaaaacguggcugc

SEQ ID NO: 1211296 - RNA, 15 nt, Human
caccgaaaacguggc

SEQ ID NO: 1211297 - RNA, 23 nt, Human
cacccugugauggggcccugccu

SEQ ID NO: 1211298 - RNA, 22 nt, Human
cacccugugauggggcccugcc

SEQ ID NO: 1211299 - RNA, 21 nt, Human
cacccugugauggggcccugc

SEQ ID NO: 1211300 - RNA, 20 nt, Human
cacccugugauggggcccug

SEQ ID NO: 1211301 - RNA, 18 nt, Human
cacccugugauggggccc

SEQ ID NO: 1211302 - RNA, 15 nt, Human
cacccugugaugggg

SEQ ID NO: 1211303 - RNA, 12 nt, Human
cacccugugaug

SEQ ID NO: 1211304 - RNA, 11 nt, Human
cacccugugau

SEQ ID NO: 1211305 - RNA, 21 nt, Human
cacccggccccugcugguuca

SEQ ID NO: 1211306 - RNA, 18 nt, Human
cacccggccccugcuggu

SEQ ID NO: 1211307 - RNA, 17 nt, Human
cacccggccccugcugg

SEQ ID NO: 1211308 - RNA, 16 nt, Human
cacccggccccugcug

SEQ ID NO: 1211309 - RNA, 14 nt, Human
cacccggccccugc

SEQ ID NO: 1211310 - RNA, 13 nt, Human
cacccggccccug

SEQ ID NO: 1211311 - RNA, 12 nt, Human
cacccggccccu

SEQ ID NO: 1211312 - RNA, 19 nt, Human
cacccgcuaagagggaggg

SEQ ID NO: 1211313 - RNA, 20 nt, Human
caccccucaacaccucugca

SEQ ID NO: 1211314 - RNA, 13 nt, Human
cacauauugauuu

SEQ ID NO: 1211315 - RNA, 20 nt, Human
cacauauugauuuccguuaa

SEQ ID NO: 1211316 - RNA, 16 nt, Human
cacgccagauucuuuc

SEQ ID NO: 1211317 - RNA, 22 nt, Human
aggauguucuagcauggcugcc

SEQ ID NO: 1211318 - RNA, 14 nt, Human
aggaggucucuaag

SEQ ID NO: 1211319 - RNA, 19 nt, Human
aggaaguacuggagaaaau

SEQ ID NO: 1211320 - RNA, 14 nt, Human
aggagugagcacua

SEQ ID NO: 1211321 - RNA, 12 nt, Human
aggagugagcac

SEQ ID NO: 1211322 - RNA, 15 nt, Human
aggaggucucuaaga

SEQ ID NO: 1211323 - RNA, 18 nt, Human
aggcagccaggccacaag

SEQ ID NO: 1211324 - RNA, 12 nt, Human
aggcauguucuc

SEQ ID NO: 1211325 - RNA, 24 nt, Human
aggcaugugaugagaggaaaucac

SEQ ID NO: 1211326 - RNA, 23 nt, Human
aggcaugugaugagaggaaauca

SEQ ID NO: 1211327 - RNA, 17 nt, Human
aggcauuccccaggagg

SEQ ID NO: 1211328 - RNA, 23 nt, Human
aggcauuccccaggaggccagcc

SEQ ID NO: 1211329 - RNA, 22 nt, Human
aggcauuccccaggaggccagc

SEQ ID NO: 1211330 - RNA, 22 nt, Human
aggcauguucucugaggacacu

SEQ ID NO: 1211331 - RNA, 20 nt, Human
aggcauguucucugaggaca

SEQ ID NO: 1211332 - RNA, 21 nt, Human
aggcauuccccaggaggccag

SEQ ID NO: 1211333 - RNA, 23 nt, Human
aggccagcugcuugggcuucauc

SEQ ID NO: 1211334 - RNA, 17 nt, Human
aggcccucugcccacuc

SEQ ID NO: 1211335 - RNA, 17 nt, Human
aggccaugggccuccug

SEQ ID NO: 1211336 - RNA, 16 nt, Human
aggccaugggccuccu

SEQ ID NO: 1211337 - RNA, 14 nt, Human
aggccaugggccuc

SEQ ID NO: 1211338 - RNA, 23 nt, Human
aggccaggcccucugcccacucc

SEQ ID NO: 1211339 - RNA, 19 nt, Human
aggccaggcccucugccca

SEQ ID NO: 1211340 - RNA, 18 nt, Human
aggccaggcccucugccc

SEQ ID NO: 1211341 - RNA, 17 nt, Human
aggccaggcccucugcc

SEQ ID NO: 1211342 - RNA, 16 nt, Human
aggccagcugcuuggg

SEQ ID NO: 1211343 - RNA, 14 nt, Human
aggccagcugcuug

SEQ ID NO: 1211344 - RNA, 13 nt, Human
aggccagcugcuu

SEQ ID NO: 1211345 - RNA, 16 nt, Human
aggcagccaggccaca

SEQ ID NO: 1211346 - RNA, 15 nt, Human
aggcagccaggccac

SEQ ID NO: 1211347 - RNA, 14 nt, Human
aggcagccaggcca

SEQ ID NO: 1211348 - RNA, 13 nt, Human
aggcagauacagg

SEQ ID NO: 1211349 - RNA, 14 nt, Human
agggccuggcucag

SEQ ID NO: 1211350 - RNA, 13 nt, Human
agggccuggcuca

SEQ ID NO: 1211351 - RNA, 18 nt, Human
agggccuggcucaggugg

SEQ ID NO: 1211352 - RNA, 19 nt, Human
aggcugcagugagccgaga

SEQ ID NO: 1211353 - RNA, 17 nt, Human
aggcugcagugagccga

SEQ ID NO: 1211354 - RNA, 19 nt, Human
aggcugucaauuacaggaa

SEQ ID NO: 1211355 - RNA, 12 nt, Human
aggcugucaauu

SEQ ID NO: 1211356 - RNA, 24 nt, Human
aggcuguaucccaugagccucagc

SEQ ID NO: 1211357 - RNA, 20 nt, Human
aggcccucugcccacucccu

SEQ ID NO: 1211358 - RNA, 19 nt, Human
aggcccucugcccacuccc

SEQ ID NO: 1211359 - RNA, 21 nt, Human
aggcccucugcccacucccug

SEQ ID NO: 1211360 - RNA, 22 nt, Human
agcuuuguuuguugucagcuga

SEQ ID NO: 1211361 - RNA, 21 nt, Human
agcuuuguuuguugucagcug

SEQ ID NO: 1211362 - RNA, 15 nt, Human
aggaaguacuggaga

SEQ ID NO: 1211363 - RNA, 11 nt, Human
aggaaguacug

SEQ ID NO: 1211364 - RNA, 14 nt, Human
aggaagguagaaau

SEQ ID NO: 1211365 - RNA, 15 nt, Human
aggaacacuccuuca

SEQ ID NO: 1211366 - RNA, 12 nt, Human
aggaacacuccu

SEQ ID NO: 1211367 - RNA, 16 nt, Human
agcuggucccacucag

SEQ ID NO: 1211368 - RNA, 15 nt, Human
agcuggucccacuca

SEQ ID NO: 1211369 - RNA, 16 nt, Human
agcugguugagguuuc

SEQ ID NO: 1211370 - RNA, 21 nt, Human
agcugacuuuucuguccgagc

SEQ ID NO: 1211371 - RNA, 15 nt, Human
agcugacuuuucugu

SEQ ID NO: 1211372 - RNA, 23 nt, Human
agcucaccagccccagugcccac

SEQ ID NO: 1211373 - RNA, 22 nt, Human
agcucaccagccccagugccca

SEQ ID NO: 1211374 - RNA, 19 nt, Human
agcgauucuucugcuucag

SEQ ID NO: 1211375 - RNA, 17 nt, Human
agcgauucuucugcuuc

SEQ ID NO: 1211376 - RNA, 15 nt, Human
agcgauucuucugcu

SEQ ID NO: 1211377 - RNA, 20 nt, Human
agcuaacauggaaguacuau

SEQ ID NO: 1211378 - RNA, 19 nt, Human
agcuaacauggaaguacua

SEQ ID NO: 1211379 - RNA, 15 nt, Human
agcuaaugggacacu

SEQ ID NO: 1211380 - RNA, 14 nt, Human
agcuaaugggacac

SEQ ID NO: 1211381 - RNA, 13 nt, Human
agcuaaugggaca

SEQ ID NO: 1211382 - RNA, 21 nt, Human
agcucaccagccccagugccc

SEQ ID NO: 1211383 - RNA, 15 nt, Human
agcucaccagcccca

SEQ ID NO: 1211384 - RNA, 14 nt, Human
agcucaccagcccc

SEQ ID NO: 1211385 - RNA, 13 nt, Human
agcucaccagccc

SEQ ID NO: 1211386 - RNA, 18 nt, Human
agccugggcaaugugaua

SEQ ID NO: 1211387 - RNA, 14 nt, Human
agccuggacccugu

SEQ ID NO: 1211388 - RNA, 19 nt, Human
agaggguggugaccucugc

SEQ ID NO: 1211389 - RNA, 20 nt, Human
agagggucugaggaauccag

SEQ ID NO: 1211390 - RNA, 15 nt, Human
agaguugaagacaga

SEQ ID NO: 1211391 - RNA, 14 nt, Human
agaguugaagacag

SEQ ID NO: 1211392 - RNA, 13 nt, Human
agaguugaagaca

SEQ ID NO: 1211393 - RNA, 16 nt, Human
agauugcaccacugca

SEQ ID NO: 1211394 - RNA, 19 nt, Human
agauugcaacaggcugggc

SEQ ID NO: 1211395 - RNA, 17 nt, Human
agauugcaacaggcugg

SEQ ID NO: 1211396 - RNA, 16 nt, Human
agauugcaacaggcug

SEQ ID NO: 1211397 - RNA, 18 nt, Human
agauucuuuccugaggcu

SEQ ID NO: 1211398 - RNA, 16 nt, Human
agauucuuuccugagg

SEQ ID NO: 1211399 - RNA, 15 nt, Human
agauucuuuccugag

SEQ ID NO: 1211400 - RNA, 19 nt, Human
agcaaauucuguuuuucua

SEQ ID NO: 1211401 - RNA, 14 nt, Human
agauucuuuccuga

SEQ ID NO: 1211402 - RNA, 22 nt, Human
agaugggugcuuggaggaagga

SEQ ID NO: 1211403 - RNA, 20 nt, Human
agaugggugcuuggaggaag

SEQ ID NO: 1211404 - RNA, 18 nt, Human
agaugacaucugucuagg

SEQ ID NO: 1211405 - RNA, 22 nt, Human
agccagauuucacucuccuugg

SEQ ID NO: 1211406 - RNA, 20 nt, Human
agccagauuucacucuccuu

SEQ ID NO: 1211407 - RNA, 17 nt, Human
agccagauuucacucuc

SEQ ID NO: 1211408 - RNA, 14 nt, Human
agccagauuucacu

SEQ ID NO: 1211409 - RNA, 23 nt, Human
agccagcaggcucucaggccagc

SEQ ID NO: 1211410 - RNA, 22 nt, Human
agccagcaggcucucaggccag

SEQ ID NO: 1211411 - RNA, 20 nt, Human
agcccacgcccccacuggug

SEQ ID NO: 1211412 - RNA, 14 nt, Human
agcccaccuuggcu

SEQ ID NO: 1211413 - RNA, 19 nt, Human
agcccacgcccccacuggu

SEQ ID NO: 1211414 - RNA, 18 nt, Human
agcccacgcccccacugg

SEQ ID NO: 1211415 - RNA, 17 nt, Human
agcccacgcccccacug

SEQ ID NO: 1211416 - RNA, 13 nt, Human
agcccaccuuggc

SEQ ID NO: 1211417 - RNA, 23 nt, Human
agcccaccccucaacaccucugc

SEQ ID NO: 1211418 - RNA, 16 nt, Human
agcaucuaugugagac

SEQ ID NO: 1211419 - RNA, 18 nt, Human
agcagugcaugcuguccc

SEQ ID NO: 1211420 - RNA, 17 nt, Human
agcagugcaugcugucc

SEQ ID NO: 1211421 - RNA, 16 nt, Human
agcagugcaugcuguc

SEQ ID NO: 1211422 - RNA, 13 nt, Human
agcagugcaugcu

SEQ ID NO: 1211423 - RNA, 19 nt, Human
agcagcguuucuaugacac

SEQ ID NO: 1211424 - RNA, 20 nt, Human
agcagccuggacccugugga

SEQ ID NO: 1211425 - RNA, 16 nt, Human
agcagccuggacccug

SEQ ID NO: 1211426 - RNA, 21 nt, Human
agcacagacccugcccugugg

SEQ ID NO: 1211427 - RNA, 18 nt, Human
agagcccacgcccccacu

SEQ ID NO: 1211428 - RNA, 23 nt, Human
agagagcaagacgcugugcugcc

SEQ ID NO: 1211429 - RNA, 19 nt, Human
agagagcaagacgcugugc

SEQ ID NO: 1211430 - RNA, 11 nt, Human
agagagcaaga

SEQ ID NO: 1211431 - RNA, 16 nt, Human
agacucuuuggacacu

SEQ ID NO: 1211432 - RNA, 20 nt, Human
agacgcugugcugcccugcc

SEQ ID NO: 1211433 - RNA, 19 nt, Human
agacgcugugcugcccugc

SEQ ID NO: 1211434 - RNA, 18 nt, Human
agacgcugugcugcccug

SEQ ID NO: 1211435 - RNA, 17 nt, Human
agacgcugugcugcccu

SEQ ID NO: 1211436 - RNA, 15 nt, Human
agacuaucuaaaugu

SEQ ID NO: 1211437 - RNA, 15 nt, Human
agaccacguuucuaa

SEQ ID NO: 1211438 - RNA, 23 nt, Human
agaccaucccugaaggccccgcc

SEQ ID NO: 1211439 - RNA, 14 nt, Human
agaccacguuucua

SEQ ID NO: 1211440 - RNA, 23 nt, Human
agacagcccgggcucugccuccc

SEQ ID NO: 1211441 - RNA, 22 nt, Human
agacagcccgggcucugccucc

SEQ ID NO: 1211442 - RNA, 14 nt, Human
agacaauuuauuau

SEQ ID NO: 1211443 - RNA, 20 nt, Human
agacaaugugaaaagaaaaa

SEQ ID NO: 1211444 - RNA, 14 nt, Human
agaagucacacagu

SEQ ID NO: 1211445 - RNA, 19 nt, Human
agaagucuuagauguauau

SEQ ID NO: 1211446 - RNA, 17 nt, Human
agaagucuuagauguau

SEQ ID NO: 1211447 - RNA, 23 nt, Human
agaagagaaugcacaaacagagg

SEQ ID NO: 1211448 - RNA, 15 nt, Human
agaagagaaugcaca

SEQ ID NO: 1211449 - RNA, 21 nt, Human
agaaccaaaaagaggcuaugu

SEQ ID NO: 1211450 - RNA, 23 nt, Human
agaaugcacaaacagaggccgcc

SEQ ID NO: 1211451 - RNA, 18 nt, Human
agaaugcucuuuacuuca

SEQ ID NO: 1211452 - RNA, 16 nt, Human
agaaugaaagggccca

SEQ ID NO: 1211453 - RNA, 17 nt, Human
agaaucucaaauaacua

SEQ ID NO: 1211454 - RNA, 18 nt, Human
agaaccaaaaagaggcua

SEQ ID NO: 1211455 - RNA, 17 nt, Human
agaaccaaaaagaggcu

SEQ ID NO: 1211456 - RNA, 21 nt, Human
auccacugugccaugugccag

SEQ ID NO: 1211457 - RNA, 20 nt, Human
aucaugacaaagacugagua

SEQ ID NO: 1211458 - RNA, 15 nt, Human
aucauccuaagcuau

SEQ ID NO: 1211459 - RNA, 19 nt, Human
aucauggagguuugaagau

SEQ ID NO: 1211460 - RNA, 18 nt, Human
auauuuuuuucuuuucuu

SEQ ID NO: 1211461 - RNA, 24 nt, Human
aucaaaagguuaauaaaguaauua

SEQ ID NO: 1211462 - RNA, 20 nt, Human
aucaaaagguuaauaaagua

SEQ ID NO: 1211463 - RNA, 19 nt, Human
aucaaagagguuuuaaaaa

SEQ ID NO: 1211464 - RNA, 14 nt, Human
auagcacagacccu

SEQ ID NO: 1211465 - RNA, 15 nt, Human
auagcacagacccug

SEQ ID NO: 1211466 - RNA, 12 nt, Human
augaaagacugu

SEQ ID NO: 1211467 - RNA, 23 nt, Human
augaagcauuuacuuuguguuca

SEQ ID NO: 1211468 - RNA, 23 nt, Human
augaaguaauaugcacacauuuu

SEQ ID NO: 1211469 - RNA, 21 nt, Human
augaaguaauaugcacacauu

SEQ ID NO: 1211470 - RNA, 14 nt, Human
augaaguaauaugc

SEQ ID NO: 1211471 - RNA, 12 nt, Human
augagccuggca

SEQ ID NO: 1211472 - RNA, 11 nt, Human
augagccuggc

SEQ ID NO: 1211473 - RNA, 21 nt, Human
augagccucagcauccuggca

SEQ ID NO: 1211474 - RNA, 18 nt, Human
augaccuuucaauaggaa

SEQ ID NO: 1211475 - RNA, 15 nt, Human
augaccuuucaauag

SEQ ID NO: 1211476 - RNA, 13 nt, Human
augaccuuucaau

SEQ ID NO: 1211477 - RNA, 23 nt, Human
aucuaggaagacuuuggaaagag

SEQ ID NO: 1211478 - RNA, 16 nt, Human
augcuuugaucccuuc

SEQ ID NO: 1211479 - RNA, 22 nt, Human
augcuucuucagagacuccugc

SEQ ID NO: 1211480 - RNA, 20 nt, Human
augcuucuucagagacuccu

SEQ ID NO: 1211481 - RNA, 17 nt, Human
augcuucuucagagacu

SEQ ID NO: 1211482 - RNA, 14 nt, Human
augcuucuucagag

SEQ ID NO: 1211483 - RNA, 19 nt, Human
augcucugcauguuacaua

SEQ ID NO: 1211484 - RNA, 18 nt, Human
augcucugcauguuacau

SEQ ID NO: 1211485 - RNA, 19 nt, Human
augccugguggcagcugcg

SEQ ID NO: 1211486 - RNA, 14 nt, Human
augccugguggcag

SEQ ID NO: 1211487 - RNA, 13 nt, Human
augccugguggca

SEQ ID NO: 1211488 - RNA, 12 nt, Human
augccugguggc

SEQ ID NO: 1211489 - RNA, 21 nt, Human
augccugguggcagcugcggu

SEQ ID NO: 1211490 - RNA, 18 nt, Human
agucuggcccuuccuuuu

SEQ ID NO: 1211491 - RNA, 16 nt, Human
agucgaggacagggag

SEQ ID NO: 1211492 - RNA, 19 nt, Human
aguccuuaccagcagagca

SEQ ID NO: 1211493 - RNA, 22 nt, Human
agucugauucccaagcucugcu

SEQ ID NO: 1211494 - RNA, 21 nt, Human
agucugauucccaagcucugc

SEQ ID NO: 1211495 - RNA, 18 nt, Human
aguccuuaccagcagagc

SEQ ID NO: 1211496 - RNA, 16 nt, Human
aguccuuaccagcaga

SEQ ID NO: 1211497 - RNA, 14 nt, Human
aguccucuuuucug

SEQ ID NO: 1211498 - RNA, 19 nt, Human
agugacagaggcagcccca

SEQ ID NO: 1211499 - RNA, 16 nt, Human
agugacagaggcagcc

SEQ ID NO: 1211500 - RNA, 14 nt, Human
agugacagaggcag

SEQ ID NO: 1211501 - RNA, 23 nt, Human
agugauccucccaccucagccuc

SEQ ID NO: 1211502 - RNA, 22 nt, Human
agugauccucccaccucagccu

SEQ ID NO: 1211503 - RNA, 20 nt, Human
agugauccucccaccucagc

SEQ ID NO: 1211504 - RNA, 22 nt, Human
agugccuuauggaacacucuga

SEQ ID NO: 1211505 - RNA, 21 nt, Human
agugccuuauggaacacucug

SEQ ID NO: 1211506 - RNA, 20 nt, Human
agugccuuauggaacacucu

SEQ ID NO: 1211507 - RNA, 19 nt, Human
agugccuuauggaacacuc

SEQ ID NO: 1211508 - RNA, 20 nt, Human
agugauucuccugccucagc

SEQ ID NO: 1211509 - RNA, 19 nt, Human
agugauucuccugccucag

SEQ ID NO: 1211510 - RNA, 18 nt, Human
agugauucuccugccuca

SEQ ID NO: 1211511 - RNA, 22 nt, Human
aguacuucuccacccugcucuc

SEQ ID NO: 1211512 - RNA, 21 nt, Human
aguacuucuccacccugcucu

SEQ ID NO: 1211513 - RNA, 20 nt, Human
aguacuucuccacccugcuc

SEQ ID NO: 1211514 - RNA, 15 nt, Human
aguacuggagaaaau

SEQ ID NO: 1211515 - RNA, 14 nt, Human
aguacguugugcau

SEQ ID NO: 1211516 - RNA, 17 nt, Human
aguaacuuacuuaggug

SEQ ID NO: 1211517 - RNA, 21 nt, Human
aguaaaugggggugcauuuga

SEQ ID NO: 1211518 - RNA, 20 nt, Human
aguaaaugggggugcauuug

SEQ ID NO: 1211519 - RNA, 19 nt, Human
aguaaaugggggugcauuu

SEQ ID NO: 1211520 - RNA, 11 nt, Human
aguuugcaguu

SEQ ID NO: 1211521 - RNA, 16 nt, Human
aguuugauuaaauucu

SEQ ID NO: 1211522 - RNA, 14 nt, Human
aguuugauuaaauu

SEQ ID NO: 1211523 - RNA, 22 nt, Human
aguuguuagugugucuuagugu

SEQ ID NO: 1211524 - RNA, 17 nt, Human
aguuguuagugugucuu

SEQ ID NO: 1211525 - RNA, 17 nt, Human
aguugaagacagagcua

SEQ ID NO: 1211526 - RNA, 16 nt, Human
aguugaagacagagcu

SEQ ID NO: 1211527 - RNA, 18 nt, Human
aguugaaaaacagcugag

SEQ ID NO: 1211528 - RNA, 17 nt, Human
aguugaaaaacagcuga

SEQ ID NO: 1211529 - RNA, 21 nt, Human
aguuccaccaucaagccacca

SEQ ID NO: 1211530 - RNA, 18 nt, Human
aguuccaccaucaagcca

SEQ ID NO: 1211531 - RNA, 18 nt, Human
aguuacacuaaaagguga

SEQ ID NO: 1211532 - RNA, 14 nt, Human
aguucauacccugu

SEQ ID NO: 1211533 - RNA, 21 nt, Human
auaaagaugagugagcaugcc

SEQ ID NO: 1211534 - RNA, 15 nt, Human
auacaccacuacauu

SEQ ID NO: 1211535 - RNA, 23 nt, Human
auacaaugcugugcccuaaagug

SEQ ID NO: 1211536 - RNA, 12 nt, Human
auaauguuaaca

SEQ ID NO: 1211537 - RNA, 18 nt, Human
auacaccacuacauucug

SEQ ID NO: 1211538 - RNA, 17 nt, Human
auacaccacuacauucu

SEQ ID NO: 1211539 - RNA, 23 nt, Human
acccucaucaccaacgucugugc

SEQ ID NO: 1211540 - RNA, 23 nt, Human
acccuggcacuauaauguaagcu

SEQ ID NO: 1211541 - RNA, 13 nt, Human
acccucaucacca

SEQ ID NO: 1211542 - RNA, 16 nt, Human
acccucaggcaggugg

SEQ ID NO: 1211543 - RNA, 15 nt, Human
acccucaggcaggug

SEQ ID NO: 1211544 - RNA, 14 nt, Human
acccucaggcaggu

SEQ ID NO: 1211545 - RNA, 13 nt, Human
acccucaggcagg

SEQ ID NO: 1211546 - RNA, 16 nt, Human
acccugugauggggcc

SEQ ID NO: 1211547 - RNA, 16 nt, Human
acccuggggagaaagu

SEQ ID NO: 1211548 - RNA, 13 nt, Human
acccuauugcugc

SEQ ID NO: 1211549 - RNA, 19 nt, Human
acccuauugcugcuugagg

SEQ ID NO: 1211550 - RNA, 14 nt, Human
acccuauugcugcu

SEQ ID NO: 1211551 - RNA, 23 nt, Human
accgugaggccagagacacaagc

SEQ ID NO: 1211552 - RNA, 12 nt, Human
accucagccucc

SEQ ID NO: 1211553 - RNA, 18 nt, Human
accgugaggccagagaca

SEQ ID NO: 1211554 - RNA, 20 nt, Human
accgggcacucagaagacac

SEQ ID NO: 1211555 - RNA, 16 nt, Human
accgggcacucagaag

SEQ ID NO: 1211556 - RNA, 14 nt, Human
accgggcacucaga

SEQ ID NO: 1211557 - RNA, 12 nt, Human
accgggcacuca

SEQ ID NO: 1211558 - RNA, 21 nt, Human
acccugugauggggcccugcc

SEQ ID NO: 1211559 - RNA, 20 nt, Human
acccugugauggggcccugc

SEQ ID NO: 1211560 - RNA, 19 nt, Human
acccugugauggggcccug

SEQ ID NO: 1211561 - RNA, 17 nt, Human
acccugugauggggccc

SEQ ID NO: 1211562 - RNA, 21 nt, Human
accucaggugauccacccacc

SEQ ID NO: 1211563 - RNA, 20 nt, Human
accucaggugauccacccac

SEQ ID NO: 1211564 - RNA, 11 nt, Human
accucaggccu

SEQ ID NO: 1211565 - RNA, 13 nt, Human
acgucugugccau

SEQ ID NO: 1211566 - RNA, 19 nt, Human
acggacacucaaaagcugg

SEQ ID NO: 1211567 - RNA, 17 nt, Human
acggacacucaaaagcu

SEQ ID NO: 1211568 - RNA, 19 nt, Human
acggaauaguuggcuagga

SEQ ID NO: 1211569 - RNA, 22 nt, Human
acgcugugcugcccugcccacc

SEQ ID NO: 1211570 - RNA, 23 nt, Human
acgauuucuguuuagauaauaca

SEQ ID NO: 1211571 - RNA, 20 nt, Human
acgauuucuguuuagauaau

SEQ ID NO: 1211572 - RNA, 18 nt, Human
acuaauggggcggugaga

SEQ ID NO: 1211573 - RNA, 12 nt, Human
accuuggcucaa

SEQ ID NO: 1211574 - RNA, 20 nt, Human
accugccccucaacucuccu

SEQ ID NO: 1211575 - RNA, 15 nt, Human
accugccccucaacu

SEQ ID NO: 1211576 - RNA, 12 nt, Human
accugccccuca

SEQ ID NO: 1211577 - RNA, 23 nt, Human
accugccaggaagccagcaggcu

SEQ ID NO: 1211578 - RNA, 22 nt, Human
accugccaggaagccagcaggc

SEQ ID NO: 1211579 - RNA, 21 nt, Human
accugccaggaagccagcagg

SEQ ID NO: 1211580 - RNA, 23 nt, Human
accucugccugaagucacacagu

SEQ ID NO: 1211581 - RNA, 20 nt, Human
accucugccugaagucacac

SEQ ID NO: 1211582 - RNA, 12 nt, Human
accucugccuga

SEQ ID NO: 1211583 - RNA, 12 nt, Human
acugaauuucuu

SEQ ID NO: 1211584 - RNA, 13 nt, Human
acucuacccucuu

SEQ ID NO: 1211585 - RNA, 18 nt, Human
acugacauuguuggccaa

SEQ ID NO: 1211586 - RNA, 17 nt, Human
acugacauuguuggcca

SEQ ID NO: 1211587 - RNA, 23 nt, Human
acugaauuucuuuugccguuauu

SEQ ID NO: 1211588 - RNA, 22 nt, Human
acugacauuguuggccaaagcc

SEQ ID NO: 1211589 - RNA, 20 nt, Human
acugauuuuuuuuuccuuca

SEQ ID NO: 1211590 - RNA, 19 nt, Human
acugauuuuuuuuuccuuc

SEQ ID NO: 1211591 - RNA, 18 nt, Human
acugauuuuuuuuuccuu

SEQ ID NO: 1211592 - RNA, 17 nt, Human
acugauuuuuuuuuccu

SEQ ID NO: 1211593 - RNA, 16 nt, Human
acugauuuuuuuuucc

SEQ ID NO: 1211594 - RNA, 15 nt, Human
acucuacagaggcca

SEQ ID NO: 1211595 - RNA, 22 nt, Human
acucccaucugugaaaggaaag

SEQ ID NO: 1211596 - RNA, 23 nt, Human
acuuggggggcugaggugggagg

SEQ ID NO: 1211597 - RNA, 18 nt, Human
acuguuucaaacuuuacu

SEQ ID NO: 1211598 - RNA, 15 nt, Human
acuguuucaaacuuu

SEQ ID NO: 1211599 - RNA, 19 nt, Human
acuguuucaaacuuuacua

SEQ ID NO: 1211600 - RNA, 16 nt, Human
acugugaagagaacca

SEQ ID NO: 1211601 - RNA, 18 nt, Human
acugugccaugugccagg

SEQ ID NO: 1211602 - RNA, 17 nt, Human
acugugccaugugccag

SEQ ID NO: 1211603 - RNA, 15 nt, Human
acaggcagauacagg

SEQ ID NO: 1211604 - RNA, 18 nt, Human
acaggcaaugcuggcugu

SEQ ID NO: 1211605 - RNA, 23 nt, Human
acaggcacccaccaucaugucug

SEQ ID NO: 1211606 - RNA, 17 nt, Human
acaggcaaugcuggcug

SEQ ID NO: 1211607 - RNA, 16 nt, Human
acaggcaaugcuggcu

SEQ ID NO: 1211608 - RNA, 15 nt, Human
acaggcaaugcuggc

SEQ ID NO: 1211609 - RNA, 14 nt, Human
acaggauuauugga

SEQ ID NO: 1211610 - RNA, 20 nt, Human
acagcucuucuccaggcugu

SEQ ID NO: 1211611 - RNA, 19 nt, Human
acagcucuucuccaggcug

SEQ ID NO: 1211612 - RNA, 21 nt, Human
accaacgucugugccauuuug

SEQ ID NO: 1211613 - RNA, 14 nt, Human
accacguuucuaaa

SEQ ID NO: 1211614 - RNA, 13 nt, Human
accacguuucuaa

SEQ ID NO: 1211615 - RNA, 18 nt, Human
accacgcuggaccuugaa

SEQ ID NO: 1211616 - RNA, 16 nt, Human
accacgcuggaccuug

SEQ ID NO: 1211617 - RNA, 17 nt, Human
accaacgucugugccau

SEQ ID NO: 1211618 - RNA, 14 nt, Human
accaacgucugugc

SEQ ID NO: 1211619 - RNA, 16 nt, Human
accagagcugccaccu

SEQ ID NO: 1211620 - RNA, 14 nt, Human
accagagcugccac

SEQ ID NO: 1211621 - RNA, 13 nt, Human
accagagcugcca

SEQ ID NO: 1211622 - RNA, 19 nt, Human
accagagcugccaccugcc

SEQ ID NO: 1211623 - RNA, 13 nt, Human
acaugcacgugug

SEQ ID NO: 1211624 - RNA, 20 nt, Human
acauacaggaagguagaaau

SEQ ID NO: 1211625 - RNA, 21 nt, Human
acauaaugcgugcauaccacu

SEQ ID NO: 1211626 - RNA, 16 nt, Human
acauacaauuccaaac

SEQ ID NO: 1211627 - RNA, 15 nt, Human
acauaagauaaaugu

SEQ ID NO: 1211628 - RNA, 19 nt, Human
acauguuuuucuucucccu

SEQ ID NO: 1211629 - RNA, 19 nt, Human
aauuaugaguuauuuuuau

SEQ ID NO: 1211630 - RNA, 22 nt, Human
aauuguaaggaaugauuaauua

SEQ ID NO: 1211631 - RNA, 13 nt, Human
aauucuuaaauau

SEQ ID NO: 1211632 - RNA, 18 nt, Human
aauucuguuuuucuaggc

SEQ ID NO: 1211633 - RNA, 14 nt, Human
aauucuguuuuucu

SEQ ID NO: 1211634 - RNA, 15 nt, Human
aauucucuuauccaa

SEQ ID NO: 1211635 - RNA, 17 nt, Human
aauucucuaguuugauu

SEQ ID NO: 1211636 - RNA, 15 nt, Human
aauucucuaguuuga

SEQ ID NO: 1211637 - RNA, 21 nt, Human
aauucucauuugucacacacu

SEQ ID NO: 1211638 - RNA, 19 nt, Human
aauucucagaaucucaaau

SEQ ID NO: 1211639 - RNA, 14 nt, Human
aauucuacuuugag

SEQ ID NO: 1211640 - RNA, 17 nt, Human
aauuucccaaagcagug

SEQ ID NO: 1211641 - RNA, 15 nt, Human
aauuucccaaagcag

SEQ ID NO: 1211642 - RNA, 23 nt, Human
acaccagagcccaccuuggcuca

SEQ ID NO: 1211643 - RNA, 18 nt, Human
acaccagagcccaccuug

SEQ ID NO: 1211644 - RNA, 19 nt, Human
acacagcucuucuccaggc

SEQ ID NO: 1211645 - RNA, 18 nt, Human
acacagcucuucuccagg

SEQ ID NO: 1211646 - RNA, 16 nt, Human
acacagcucuucucca

SEQ ID NO: 1211647 - RNA, 14 nt, Human
acacagcucuucuc

SEQ ID NO: 1211648 - RNA, 20 nt, Human
acaaggcaaggcugucaauu

SEQ ID NO: 1211649 - RNA, 19 nt, Human
acaaggcaaggcugucaau

SEQ ID NO: 1211650 - RNA, 17 nt, Human
acaaggcaaggcuguca

SEQ ID NO: 1211651 - RNA, 16 nt, Human
acaaggcaaggcuguc

SEQ ID NO: 1211652 - RNA, 15 nt, Human
acaaguuaaauaaau

SEQ ID NO: 1211653 - RNA, 13 nt, Human
aacaggcugggcu

SEQ ID NO: 1211654 - RNA, 22 nt, Human
aacauggccuuugcuugaaaga

SEQ ID NO: 1211655 - RNA, 11 nt, Human
aacaggcagau

SEQ ID NO: 1211656 - RNA, 15 nt, Human
aaauucuugcaaagu

SEQ ID NO: 1211657 - RNA, 23 nt, Human
aaauucuucuccacuuucuagcc

SEQ ID NO: 1211658 - RNA, 18 nt, Human
aaauucuugcaaaguauc

SEQ ID NO: 1211659 - RNA, 16 nt, Human
aaccuuuugagugccu

SEQ ID NO: 1211660 - RNA, 23 nt, Human
aaccuuuugagugccuuacacaa

SEQ ID NO: 1211661 - RNA, 23 nt, Human
aacauggccuuugcuugaaagaa

SEQ ID NO: 1211662 - RNA, 19 nt, Human
aaaugcuguaacuuucuga

SEQ ID NO: 1211663 - RNA, 14 nt, Human
aaaucuuuuugcuu

SEQ ID NO: 1211664 - RNA, 13 nt, Human
aaaucuuuuugcu

SEQ ID NO: 1211665 - RNA, 19 nt, Human
aaaucuccaaaauaaaacu

SEQ ID NO: 1211666 - RNA, 20 nt, Human
aaaggaugcccaaagaugca

SEQ ID NO: 1211667 - RNA, 11 nt, Human
aaaagaaaaag

SEQ ID NO: 1211668 - RNA, 19 nt, Human
aaaacacuguucucugccc

SEQ ID NO: 1211669 - RNA, 17 nt, Human
aaaacacauuuuucuua

SEQ ID NO: 1211670 - RNA, 14 nt, Human
aaaauaaaacuuuu

SEQ ID NO: 1211671 - RNA, 21 nt, Human
aaaaucagccugcuccagcug

SEQ ID NO: 1211672 - RNA, 17 nt, Human
aaaaucagccugcucca

SEQ ID NO: 1211673 - RNA, 13 nt, Human
aaaaucagccugc

SEQ ID NO: 1211674 - RNA, 16 nt, Human
aaaauaaaacuuuuua

SEQ ID NO: 1211675 - RNA, 18 nt, Human
aaacccagcucuggucca

SEQ ID NO: 1211676 - RNA, 16 nt, Human
aaacccagcucugguc

SEQ ID NO: 1211677 - RNA, 12 nt, Human
aaacccagcucu

SEQ ID NO: 1211678 - RNA, 16 nt, Human
aaaccgccaaggcugg

SEQ ID NO: 1211679 - RNA, 15 nt, Human
aaaccgccaaggcug

SEQ ID NO: 1211680 - RNA, 23 nt, Human
aaacugauuuuuuuuuccuucag

SEQ ID NO: 1211681 - RNA, 23 nt, Human
aaacucuuaaaacccaagugccu

SEQ ID NO: 1211682 - RNA, 12 nt, Human
aaacucuuaaaa

SEQ ID NO: 1211683 - RNA, 16 nt, Human
aaaaucucaaauuucu

SEQ ID NO: 1211684 - RNA, 15 nt, Human
aaaaucucaaauuuc

SEQ ID NO: 1211685 - RNA, 18 nt, Human
aaaaucucaaauuucuaa

SEQ ID NO: 1211686 - RNA, 16 nt, Human
aagcgugagccacugc

SEQ ID NO: 1211687 - RNA, 15 nt, Human
aagcgugagccacug

SEQ ID NO: 1211688 - RNA, 14 nt, Human
aagcgauucuucug

SEQ ID NO: 1211689 - RNA, 14 nt, Human
aagcggcuggcagc

SEQ ID NO: 1211690 - RNA, 23 nt, Human
aagauacaguuacucagaauucu

SEQ ID NO: 1211691 - RNA, 17 nt, Human
aagauacaguuacucag

SEQ ID NO: 1211692 - RNA, 21 nt, Human
aagauaauauuaaggaagaca

SEQ ID NO: 1211693 - RNA, 19 nt, Human
aagauaauauuaaggaaga

SEQ ID NO: 1211694 - RNA, 18 nt, Human
aagccauaauuguucuua

SEQ ID NO: 1211695 - RNA, 20 nt, Human
aagcugcacccucaggcagg

SEQ ID NO: 1211696 - RNA, 19 nt, Human
aagcugcacccucaggcag

SEQ ID NO: 1211697 - RNA, 13 nt, Human
aagcugcacccuc

SEQ ID NO: 1211698 - RNA, 22 nt, Human
aagcuagacgagcaggcuucuu

SEQ ID NO: 1211699 - RNA, 13 nt, Human
aaggcaaggcugu

SEQ ID NO: 1211700 - RNA, 16 nt, Human
aaggcaaggcugucaa

SEQ ID NO: 1211701 - RNA, 15 nt, Human
aaggcaaggcuguca

SEQ ID NO: 1211702 - RNA, 13 nt, Human
aagagaaaaaaua

SEQ ID NO: 1211703 - RNA, 19 nt, Human
aagacuuuucuuucagcca

SEQ ID NO: 1211704 - RNA, 12 nt, Human
aagacuuuucuu

SEQ ID NO: 1211705 - RNA, 21 nt, Human
aagacuuuuccaacccucauc

SEQ ID NO: 1211706 - RNA, 17 nt, Human
aagaccacguuucuaaa

SEQ ID NO: 1211707 - RNA, 15 nt, Human
aagaccacguuucua

SEQ ID NO: 1211708 - RNA, 23 nt, Human
aagacagauacuccuccaagguu

SEQ ID NO: 1211709 - RNA, 20 nt, Human
aagacaaugugaaaagaaaa

SEQ ID NO: 1211710 - RNA, 19 nt, Human
aagacaaugugaaaagaaa

SEQ ID NO: 1211711 - RNA, 22 nt, Human
aagacaaugacuuacuguacau

SEQ ID NO: 1211712 - RNA, 22 nt, Human
aaguuguaggcauaaagucagg

SEQ ID NO: 1211713 - RNA, 22 nt, Human
aagugcugggauuacaggugug

SEQ ID NO: 1211714 - RNA, 12 nt, Human
aagugcugggau

SEQ ID NO: 1211715 - RNA, 22 nt, Human
aagugcugcauuuaaaagauac

SEQ ID NO: 1211716 - RNA, 22 nt, Human
aauaaugugaaacuggauuaaa

SEQ ID NO: 1211717 - RNA, 17 nt, Human
aauaaugugaaacugga

SEQ ID NO: 1211718 - RNA, 14 nt, Human
aauaaagcagcguu

SEQ ID NO: 1211719 - RNA, 19 nt, Human
aauaauguuaacauggaca

SEQ ID NO: 1211720 - RNA, 21 nt, Human
aaugaaagacuguacaaagua

SEQ ID NO: 1211721 - RNA, 20 nt, Human
aaugaaagacuguacaaagu

SEQ ID NO: 1211722 - RNA, 20 nt, Human
aaugaugccaugaggaacaa

SEQ ID NO: 1211723 - RNA, 13 nt, Human
aauauuaagaaag

SEQ ID NO: 1211724 - RNA, 23 nt, Human
aauauguggaguucaucuugaau

SEQ ID NO: 1211725 - RNA, 23 nt, Human
aaucaccgaaaacguggcugcuu

SEQ ID NO: 1211726 - RNA, 21 nt, Human
aaucaccgaaaacguggcugc

SEQ ID NO: 1211727 - RNA, 16 nt, Human
cucugcacuccccugc

SEQ ID NO: 1211728 - RNA, 15 nt, Human
cucugcacuccccug

SEQ ID NO: 1211729 - RNA, 21 nt, Human
cucugcacaagcugcacccuc

SEQ ID NO: 1211730 - RNA, 20 nt, Human
cucugcacaagcugcacccu

SEQ ID NO: 1211731 - RNA, 18 nt, Human
cucugcacuccccugcug

SEQ ID NO: 1211732 - RNA, 17 nt, Human
cucugcacuccccugcu

SEQ ID NO: 1211733 - RNA, 21 nt, Human
cucugcuccucuccccagcaa

SEQ ID NO: 1211734 - RNA, 13 nt, Human
cucugcugcuggc

SEQ ID NO: 1211735 - RNA, 23 nt, Human
cucugcugacagacacaggcccg

SEQ ID NO: 1211736 - RNA, 22 nt, Human
cucugcugacagacacaggccc

SEQ ID NO: 1211737 - RNA, 21 nt, Human
cucugcugacagacacaggcc

SEQ ID NO: 1211738 - RNA, 13 nt, Human
cucuguccuggga

SEQ ID NO: 1211739 - RNA, 16 nt, Human
cucuguacagagccca

SEQ ID NO: 1211740 - RNA, 15 nt, Human
cucuguacagagccc

SEQ ID NO: 1211741 - RNA, 14 nt, Human
cucuguacagagcc

SEQ ID NO: 1211742 - RNA, 16 nt, Human
cucugcugcuggcugg

SEQ ID NO: 1211743 - RNA, 15 nt, Human
cucugcugcuggcug

SEQ ID NO: 1211744 - RNA, 14 nt, Human
cucugcugcuggcu

SEQ ID NO: 1211745 - RNA, 16 nt, Human
cucuccuccagaguca

SEQ ID NO: 1211746 - RNA, 15 nt, Human
cucuccuccagaguc

SEQ ID NO: 1211747 - RNA, 13 nt, Human
cucuccuccagag

SEQ ID NO: 1211748 - RNA, 23 nt, Human
cucgguguggagaagcggcuggc

SEQ ID NO: 1211749 - RNA, 17 nt, Human
cucgguguggagaagcg

SEQ ID NO: 1211750 - RNA, 16 nt, Human
cucgguguggagaagc

SEQ ID NO: 1211751 - RNA, 23 nt, Human
cuccuuugugaggaagccgcugg

SEQ ID NO: 1211752 - RNA, 18 nt, Human
cuccuuugugaggaagcc

SEQ ID NO: 1211753 - RNA, 17 nt, Human
cuccuuugugaggaagc

SEQ ID NO: 1211754 - RNA, 14 nt, Human
cuccuuguguuacu

SEQ ID NO: 1211755 - RNA, 15 nt, Human
cuccuuucaccacau

SEQ ID NO: 1211756 - RNA, 16 nt, Human
cuccuguaccucuuga

SEQ ID NO: 1211757 - RNA, 18 nt, Human
cuccugggcuaagugauc

SEQ ID NO: 1211758 - RNA, 19 nt, Human
cuccuggccucaagugauu

SEQ ID NO: 1211759 - RNA, 19 nt, Human
cuccuggcccacugcaucg

SEQ ID NO: 1211760 - RNA, 15 nt, Human
cuccucugcugcugg

SEQ ID NO: 1211761 - RNA, 14 nt, Human
cuccucugcugcug

SEQ ID NO: 1211762 - RNA, 13 nt, Human
cuccucugcugcu

SEQ ID NO: 1211763 - RNA, 22 nt, Human
cuccaggcuguaucccaugagc

SEQ ID NO: 1211764 - RNA, 20 nt, Human
cuccaggcuguaucccauga

SEQ ID NO: 1211765 - RNA, 23 nt, Human
cuccaggcuccuuuagcgcccag

SEQ ID NO: 1211766 - RNA, 23 nt, Human
cuccaggugcacaagcuccaagc

SEQ ID NO: 1211767 - RNA, 20 nt, Human
cucccucuuucccucccuuc

SEQ ID NO: 1211768 - RNA, 15 nt, Human
cucccaggcauuccc

SEQ ID NO: 1211769 - RNA, 22 nt, Human
cucagucuggcccuuccuuuuc

SEQ ID NO: 1211770 - RNA, 17 nt, Human
cucaguccauagcagag

SEQ ID NO: 1211771 - RNA, 15 nt, Human
cucaguccauagcag

SEQ ID NO: 1211772 - RNA, 23 nt, Human
cucaggugucccugcacuugcag

SEQ ID NO: 1211773 - RNA, 20 nt, Human
cucaggccagcugcuugggc

SEQ ID NO: 1211774 - RNA, 18 nt, Human
cucaggccagcugcuugg

SEQ ID NO: 1211775 - RNA, 17 nt, Human
cucaggccagcugcuug

SEQ ID NO: 1211776 - RNA, 16 nt, Human
cucaggccagcugcuu

SEQ ID NO: 1211777 - RNA, 11 nt, Human
cucaggccugg

SEQ ID NO: 1211778 - RNA, 21 nt, Human
cucaggccaaacucaccugcc

SEQ ID NO: 1211779 - RNA, 20 nt, Human
cucaggccaaacucaccugc

SEQ ID NO: 1211780 - RNA, 19 nt, Human
cucaggccaaacucaccug

SEQ ID NO: 1211781 - RNA, 13 nt, Human
cucaggccugggg

SEQ ID NO: 1211782 - RNA, 23 nt, Human
cucagccucccgaauagcuggga

SEQ ID NO: 1211783 - RNA, 22 nt, Human
cucagccucccgaauagcuggg

SEQ ID NO: 1211784 - RNA, 21 nt, Human
cucagccucccgaauagcugg

SEQ ID NO: 1211785 - RNA, 19 nt, Human
cucagccucccgaauagcu

SEQ ID NO: 1211786 - RNA, 23 nt, Human
cucagaagacacugaugggcaac

SEQ ID NO: 1211787 - RNA, 22 nt, Human
cucagaagacacugaugggcaa

SEQ ID NO: 1211788 - RNA, 20 nt, Human
cucagaagacacugaugggc

SEQ ID NO: 1211789 - RNA, 17 nt, Human
cucagaagacacugaug

SEQ ID NO: 1211790 - RNA, 15 nt, Human
cucagaagacacuga

SEQ ID NO: 1211791 - RNA, 13 nt, Human
cucagaagacacu

SEQ ID NO: 1211792 - RNA, 17 nt, Human
cucaccuuucccaucuu

SEQ ID NO: 1211793 - RNA, 23 nt, Human
cucaauuauuuugcauuuuuucu

SEQ ID NO: 1211794 - RNA, 22 nt, Human
cuauguugcccaggcaggucuu

SEQ ID NO: 1211795 - RNA, 21 nt, Human
cuauguugcccaggcaggucu

SEQ ID NO: 1211796 - RNA, 19 nt, Human
cuauguugcccaggcaggu

SEQ ID NO: 1211797 - RNA, 18 nt, Human
cuauguugcccaggcagg

SEQ ID NO: 1211798 - RNA, 14 nt, Human
cuauguugcccagg

SEQ ID NO: 1211799 - RNA, 17 nt, Human
cuaugugagcacaaagg

SEQ ID NO: 1211800 - RNA, 14 nt, Human
cuaugugagaccau

SEQ ID NO: 1211801 - RNA, 14 nt, Human
cuaucucccccagc

SEQ ID NO: 1211802 - RNA, 13 nt, Human
cuaucucccccag

SEQ ID NO: 1211803 - RNA, 14 nt, Human
cgugaggccagaga

SEQ ID NO: 1211804 - RNA, 22 nt, Human
cgugagccacugcaccgggcca

SEQ ID NO: 1211805 - RNA, 20 nt, Human
cgugagccacugcaccgggc

SEQ ID NO: 1211806 - RNA, 15 nt, Human
cgugagccacugcac

SEQ ID NO: 1211807 - RNA, 14 nt, Human
cgugagccacugca

SEQ ID NO: 1211808 - RNA, 15 nt, Human
cgugacaacacuugu

SEQ ID NO: 1211809 - RNA, 14 nt, Human
cgugacaacacuug

SEQ ID NO: 1211810 - RNA, 11 nt, Human
cuaaagcugcc

SEQ ID NO: 1211811 - RNA, 19 nt, Human
cguguuaugacuccagaau

SEQ ID NO: 1211812 - RNA, 15 nt, Human
cguguuaugacucca

SEQ ID NO: 1211813 - RNA, 16 nt, Human
cgugaggccagagaca

SEQ ID NO: 1211814 - RNA, 19 nt, Human
cgugaguccuggcauggga

SEQ ID NO: 1211815 - RNA, 19 nt, Human
cuaaaguguauuuuuuuac

SEQ ID NO: 1211816 - RNA, 16 nt, Human
cuaacuuuccuucauu

SEQ ID NO: 1211817 - RNA, 22 nt, Human
cuaacuugucuuuggacccuga

SEQ ID NO: 1211818 - RNA, 14 nt, Human
cuaacuugucuuug

SEQ ID NO: 1211819 - RNA, 19 nt, Human
cuacaaaaagcauaaaaau

SEQ ID NO: 1211820 - RNA, 20 nt, Human
cuaauaaaauuuaaaagucu

SEQ ID NO: 1211821 - RNA, 20 nt, Human
cuaaguuuuuauggcuuuug

SEQ ID NO: 1211822 - RNA, 14 nt, Human
cuaaguuuuuaugg

SEQ ID NO: 1211823 - RNA, 20 nt, Human
cggagacggagucccaccuu

SEQ ID NO: 1211824 - RNA, 17 nt, Human
cggagacggagucccac

SEQ ID NO: 1211825 - RNA, 23 nt, Human
cggagucccaccuuggcugcagg

SEQ ID NO: 1211826 - RNA, 22 nt, Human
cggagucccaccuuggcugcag

SEQ ID NO: 1211827 - RNA, 20 nt, Human
cgguggcucacgccuguaau

SEQ ID NO: 1211828 - RNA, 22 nt, Human
cguacacauuuuauuuuauuau

SEQ ID NO: 1211829 - RNA, 14 nt, Human
cggcucacugcagc

SEQ ID NO: 1211830 - RNA, 13 nt, Human
cgggcucugccuc

SEQ ID NO: 1211831 - RNA, 12 nt, Human
cgggcucugccu

SEQ ID NO: 1211832 - RNA, 18 nt, Human
cgcuggagugcagugagc

SEQ ID NO: 1211833 - RNA, 17 nt, Human
cgcuggagugcagugag

SEQ ID NO: 1211834 - RNA, 20 nt, Human
cgcugccccuggcagccccu

SEQ ID NO: 1211835 - RNA, 19 nt, Human
cgcugccccuggcagcccc

SEQ ID NO: 1211836 - RNA, 20 nt, Human
ccuuuucgcaggauucuucc

SEQ ID NO: 1211837 - RNA, 18 nt, Human
ccuuucaauaggaaaaac

SEQ ID NO: 1211838 - RNA, 17 nt, Human
ccuuucaauaggaaaaa

SEQ ID NO: 1211839 - RNA, 15 nt, Human
ccuuucaauaggaaa

SEQ ID NO: 1211840 - RNA, 21 nt, Human
ccuucuguccuacucuguguc

SEQ ID NO: 1211841 - RNA, 20 nt, Human
ccuucuguccuacucugugu

SEQ ID NO: 1211842 - RNA, 22 nt, Human
ccuucuguccuacucuguguca

SEQ ID NO: 1211843 - RNA, 16 nt, Human
ccuucucugaaggaca

SEQ ID NO: 1211844 - RNA, 14 nt, Human
ccuucucugaagga

SEQ ID NO: 1211845 - RNA, 23 nt, Human
ccuucucuccagccccuggaugc

SEQ ID NO: 1211846 - RNA, 21 nt, Human
ccuucucuccagccccuggau

SEQ ID NO: 1211847 - RNA, 20 nt, Human
ccuucucuccagccccugga

SEQ ID NO: 1211848 - RNA, 22 nt, Human
ccuuauggaacacucugagacu

SEQ ID NO: 1211849 - RNA, 20 nt, Human
ccuuauggaacacucugaga

SEQ ID NO: 1211850 - RNA, 19 nt, Human
ccuuauggaacacucugag

SEQ ID NO: 1211851 - RNA, 18 nt, Human
ccuuauggaacacucuga

SEQ ID NO: 1211852 - RNA, 17 nt, Human
ccuuauggaacacucug

SEQ ID NO: 1211853 - RNA, 16 nt, Human
ccuuauggaacacucu

SEQ ID NO: 1211854 - RNA, 14 nt, Human
ccuuauggaacacu

SEQ ID NO: 1211855 - RNA, 19 nt, Human
ccuucccaccucucucacu

SEQ ID NO: 1211856 - RNA, 14 nt, Human
ccuucccaccucuc

SEQ ID NO: 1211857 - RNA, 12 nt, Human
ccuucccaccuc

SEQ ID NO: 1211858 - RNA, 12 nt, Human
ccuuauggaaca

SEQ ID NO: 1211859 - RNA, 20 nt, Human
ccuuagcagggaaacagcua

SEQ ID NO: 1211860 - RNA, 19 nt, Human
ccuuagcagggaaacagcu

SEQ ID NO: 1211861 - RNA, 16 nt, Human
ccuuagcaaauucugu

SEQ ID NO: 1211862 - RNA, 23 nt, Human
ccuguugggccaggagccuccug

SEQ ID NO: 1211863 - RNA, 20 nt, Human
ccuguugggccaggagccuc

SEQ ID NO: 1211864 - RNA, 19 nt, Human
ccuguugggccaggagccu

SEQ ID NO: 1211865 - RNA, 18 nt, Human
ccuguugggccaggagcc

SEQ ID NO: 1211866 - RNA, 17 nt, Human
ccuguugggccaggagc

SEQ ID NO: 1211867 - RNA, 16 nt, Human
ccuguugggccaggag

SEQ ID NO: 1211868 - RNA, 23 nt, Human
ccuguucagcuccagcucaccag

SEQ ID NO: 1211869 - RNA, 21 nt, Human
ccuguucagcuccagcucacc

SEQ ID NO: 1211870 - RNA, 20 nt, Human
ccuguucagcuccagcucac

SEQ ID NO: 1211871 - RNA, 19 nt, Human
ccuguucagcuccagcuca

SEQ ID NO: 1211872 - RNA, 16 nt, Human
ccuguucagcuccagc

SEQ ID NO: 1211873 - RNA, 15 nt, Human
ccuguucagcuccag

SEQ ID NO: 1211874 - RNA, 14 nt, Human
ccuguucagcucca

SEQ ID NO: 1211875 - RNA, 17 nt, Human
ccuguucuggcagaguu

SEQ ID NO: 1211876 - RNA, 12 nt, Human
ccuguucuggca

SEQ ID NO: 1211877 - RNA, 18 nt, Human
ccuguucccaugagauga

SEQ ID NO: 1211878 - RNA, 13 nt, Human
ccuguucagcucc

SEQ ID NO: 1211879 - RNA, 18 nt, Human
ccagagacacaagccuuc

SEQ ID NO: 1211880 - RNA, 16 nt, Human
ccagagacacaagccu

SEQ ID NO: 1211881 - RNA, 13 nt, Human
ccagagagggugg

SEQ ID NO: 1211882 - RNA, 13 nt, Human
ccagaugcaccag

SEQ ID NO: 1211883 - RNA, 14 nt, Human
ccagaugcaccagc

SEQ ID NO: 1211884 - RNA, 15 nt, Human
ccagaugcaccagcc

SEQ ID NO: 1211885 - RNA, 17 nt, Human
ccagacccggcugcgug

SEQ ID NO: 1211886 - RNA, 22 nt, Human
ccacuuuuguucuugguuugua

SEQ ID NO: 1211887 - RNA, 21 nt, Human
ccacuuuuguucuugguuugu

SEQ ID NO: 1211888 - RNA, 15 nt, Human
ccacuuuuguucuug

SEQ ID NO: 1211889 - RNA, 14 nt, Human
ccacuuuuguucuu

SEQ ID NO: 1211890 - RNA, 20 nt, Human
ccacuuucuagccagaggag

SEQ ID NO: 1211891 - RNA, 19 nt, Human
ccacuuucuagccagagga

SEQ ID NO: 1211892 - RNA, 18 nt, Human
ccacuuucuagccagagg

SEQ ID NO: 1211893 - RNA, 13 nt, Human
ccacuuucuagcc

SEQ ID NO: 1211894 - RNA, 19 nt, Human
ccacugcaccgggccacag

SEQ ID NO: 1211895 - RNA, 17 nt, Human
ccacugcaccgggccac

SEQ ID NO: 1211896 - RNA, 14 nt, Human
ccacugcaccgggc

SEQ ID NO: 1211897 - RNA, 13 nt, Human
ccacugcaccggg

SEQ ID NO: 1211898 - RNA, 20 nt, Human
ccacugcacuauagccuagg

SEQ ID NO: 1211899 - RNA, 19 nt, Human
ccacugcacuauagccuag

SEQ ID NO: 1211900 - RNA, 18 nt, Human
ccacugcacuccagccug

SEQ ID NO: 1211901 - RNA, 19 nt, Human
ccaggaaaggcuccaggag

SEQ ID NO: 1211902 - RNA, 18 nt, Human
ccaggaaaggcuccagga

SEQ ID NO: 1211903 - RNA, 20 nt, Human
ccaggaaaggcuccaggagc

SEQ ID NO: 1211904 - RNA, 18 nt, Human
ccagccccuucugaccca

SEQ ID NO: 1211905 - RNA, 17 nt, Human
ccagccccuucugaccc

SEQ ID NO: 1211906 - RNA, 16 nt, Human
ccagccccuucugacc

SEQ ID NO: 1211907 - RNA, 15 nt, Human
ccagccccuucugac

SEQ ID NO: 1211908 - RNA, 18 nt, Human
ccagccccuggaugcagc

SEQ ID NO: 1211909 - RNA, 15 nt, Human
ccagccccuggaugc

SEQ ID NO: 1211910 - RNA, 14 nt, Human
ccagccccuggaug

SEQ ID NO: 1211911 - RNA, 13 nt, Human
ccagccccuggau

SEQ ID NO: 1211912 - RNA, 14 nt, Human
ccagcagccuggac

SEQ ID NO: 1211913 - RNA, 23 nt, Human
ccagccccauccucuguacagag

SEQ ID NO: 1211914 - RNA, 13 nt, Human
ccagcagccugga

SEQ ID NO: 1211915 - RNA, 22 nt, Human
ccagcagaaaugccuuacccuc

SEQ ID NO: 1211916 - RNA, 17 nt, Human
ccagcagaaaugccuua

SEQ ID NO: 1211917 - RNA, 16 nt, Human
ccagcagaaaugccuu

SEQ ID NO: 1211918 - RNA, 12 nt, Human
ccagcagccugg

SEQ ID NO: 1211919 - RNA, 11 nt, Human
ccagcagccug

SEQ ID NO: 1211920 - RNA, 19 nt, Human
ccagucaccccggccaccu

SEQ ID NO: 1211921 - RNA, 18 nt, Human
ccagucaccccggccacc

SEQ ID NO: 1211922 - RNA, 17 nt, Human
ccagucaccccggccac

SEQ ID NO: 1211923 - RNA, 16 nt, Human
ccagucaccccggcca

SEQ ID NO: 1211924 - RNA, 22 nt, Human
ccaguaucuugaagacuuuucu

SEQ ID NO: 1211925 - RNA, 19 nt, Human
ccaguaucuugaagacuuu

SEQ ID NO: 1211926 - RNA, 23 nt, Human
ccaggggugggacacccugugau

SEQ ID NO: 1211927 - RNA, 22 nt, Human
ccaggggugggacacccuguga

SEQ ID NO: 1211928 - RNA, 21 nt, Human
ccaggggugggacacccugug

SEQ ID NO: 1211929 - RNA, 20 nt, Human
ccaggggugggacacccugu

SEQ ID NO: 1211930 - RNA, 18 nt, Human
ccccggccaccugcggug

SEQ ID NO: 1211931 - RNA, 14 nt, Human
ccccggccaccugc

SEQ ID NO: 1211932 - RNA, 14 nt, Human
ccccgcccaggcuu

SEQ ID NO: 1211933 - RNA, 12 nt, Human
ccccgcccaggc

SEQ ID NO: 1211934 - RNA, 14 nt, Human
cccccuuccaugga

SEQ ID NO: 1211935 - RNA, 21 nt, Human
ccccaaaacucuccucugcug

SEQ ID NO: 1211936 - RNA, 20 nt, Human
ccccaaaacucuccucugcu

SEQ ID NO: 1211937 - RNA, 18 nt, Human
ccccaaaacucuccucug

SEQ ID NO: 1211938 - RNA, 12 nt, Human
ccccagccccaa

SEQ ID NO: 1211939 - RNA, 16 nt, Human
ccccagccccauccca

SEQ ID NO: 1211940 - RNA, 21 nt, Human
ccccauucugccugcccaggc

SEQ ID NO: 1211941 - RNA, 14 nt, Human
ccccagccccaaaa

SEQ ID NO: 1211942 - RNA, 14 nt, Human
ccccagccccaucc

SEQ ID NO: 1211943 - RNA, 14 nt, Human
cccauccucuguac

SEQ ID NO: 1211944 - RNA, 18 nt, Human
cccaggcuggcgugcagu

SEQ ID NO: 1211945 - RNA, 20 nt, Human
cccaggcuggcgugcagugg

SEQ ID NO: 1211946 - RNA, 19 nt, Human
cccaggcuggcgugcagug

SEQ ID NO: 1211947 - RNA, 21 nt, Human
cccaggcuggcgugcaguggu

SEQ ID NO: 1211948 - RNA, 19 nt, Human
cccauccucuguacagagc

SEQ ID NO: 1211949 - RNA, 15 nt, Human
cccauccucuguaca

SEQ ID NO: 1211950 - RNA, 20 nt, Human
cccauccucuguacagagcc

SEQ ID NO: 1211951 - RNA, 13 nt, Human
cccagccccaaug

SEQ ID NO: 1211952 - RNA, 23 nt, Human
cccagccccaaaacucuccucug

SEQ ID NO: 1211953 - RNA, 21 nt, Human
cccagccccaaaacucuccuc

SEQ ID NO: 1211954 - RNA, 19 nt, Human
cccagcccacuucugccau

SEQ ID NO: 1211955 - RNA, 18 nt, Human
cccacccaagggccuggc

SEQ ID NO: 1211956 - RNA, 15 nt, Human
cccacccaagggccu

SEQ ID NO: 1211957 - RNA, 12 nt, Human
cccaagcucugc

SEQ ID NO: 1211958 - RNA, 17 nt, Human
cccaagcucugcuccuc

SEQ ID NO: 1211959 - RNA, 18 nt, Human
cccaccgcagacaggacc

SEQ ID NO: 1211960 - RNA, 15 nt, Human
cccaccgcagacagg

SEQ ID NO: 1211961 - RNA, 18 nt, Human
ccaugaggaacaaggcaa

SEQ ID NO: 1211962 - RNA, 17 nt, Human
ccaugaggaacaaggca

SEQ ID NO: 1211963 - RNA, 16 nt, Human
ccaugaggaacaaggc

SEQ ID NO: 1211964 - RNA, 13 nt, Human
ccaugagccucag

SEQ ID NO: 1211965 - RNA, 15 nt, Human
ccugccucuucucua

SEQ ID NO: 1211966 - RNA, 22 nt, Human
ccugcugcaguugccagucacc

SEQ ID NO: 1211967 - RNA, 16 nt, Human
ccugcugcaguugcca

SEQ ID NO: 1211968 - RNA, 12 nt, Human
ccugcugcaguu

SEQ ID NO: 1211969 - RNA, 11 nt, Human
ccugcugcagu

SEQ ID NO: 1211970 - RNA, 23 nt, Human
ccugccuccuuugugaggaagcc

SEQ ID NO: 1211971 - RNA, 22 nt, Human
ccugccuccuuugugaggaagc

SEQ ID NO: 1211972 - RNA, 21 nt, Human
ccugccuccuuugugaggaag

SEQ ID NO: 1211973 - RNA, 20 nt, Human
ccugccuccuuugugaggaa

SEQ ID NO: 1211974 - RNA, 19 nt, Human
ccugccuccuuugugagga

SEQ ID NO: 1211975 - RNA, 15 nt, Human
ccugccuccuuugug

SEQ ID NO: 1211976 - RNA, 13 nt, Human
ccugccuccuuug

SEQ ID NO: 1211977 - RNA, 13 nt, Human
ccucuuggguuca

SEQ ID NO: 1211978 - RNA, 19 nt, Human
ccucuuuggucuacacugu

SEQ ID NO: 1211979 - RNA, 21 nt, Human
ccucugccugaagucacacag

SEQ ID NO: 1211980 - RNA, 17 nt, Human
ccugcaggcagccaggc

SEQ ID NO: 1211981 - RNA, 16 nt, Human
ccugcaggcagccagg

SEQ ID NO: 1211982 - RNA, 12 nt, Human
ccugcagagggc

SEQ ID NO: 1211983 - RNA, 21 nt, Human
ccugcaggcagccaggccaca

SEQ ID NO: 1211984 - RNA, 20 nt, Human
ccugcaggcagccaggccac

SEQ ID NO: 1211985 - RNA, 19 nt, Human
ccugcaggcagccaggcca

SEQ ID NO: 1211986 - RNA, 18 nt, Human
ccugcaggcagccaggcc

SEQ ID NO: 1211987 - RNA, 23 nt, Human
ccugcaggcagccaggccacaag

SEQ ID NO: 1211988 - RNA, 14 nt, Human
ccugcagagggcac

SEQ ID NO: 1211989 - RNA, 16 nt, Human
ccugaggggccucuua

SEQ ID NO: 1211990 - RNA, 12 nt, Human
ccugaggggccu

SEQ ID NO: 1211991 - RNA, 21 nt, Human
ccugaggcugggcucccuucc

SEQ ID NO: 1211992 - RNA, 19 nt, Human
ccugaggcugggcucccuu

SEQ ID NO: 1211993 - RNA, 17 nt, Human
ccugaggcugggcuccc

SEQ ID NO: 1211994 - RNA, 12 nt, Human
ccucucucacuc

SEQ ID NO: 1211995 - RNA, 20 nt, Human
ccucugccugaagucacaca

SEQ ID NO: 1211996 - RNA, 11 nt, Human
ccucugccuga

SEQ ID NO: 1211997 - RNA, 23 nt, Human
ccucugccucugacacacagcuc

SEQ ID NO: 1211998 - RNA, 21 nt, Human
ccucugccucugacacacagc

SEQ ID NO: 1211999 - RNA, 20 nt, Human
ccucugccucugacacacag

SEQ ID NO: 1212000 - RNA, 16 nt, Human
ccucgaacuggcugca

SEQ ID NO: 1212001 - RNA, 20 nt, Human
ccuccuuugugaggaagccg

SEQ ID NO: 1212002 - RNA, 19 nt, Human
ccuccuuugugaggaagcc

SEQ ID NO: 1212003 - RNA, 18 nt, Human
ccuccuuugugaggaagc

SEQ ID NO: 1212004 - RNA, 13 nt, Human
ccuccgccucuug

SEQ ID NO: 1212005 - RNA, 23 nt, Human
ccucccaacucaccccagcccca

SEQ ID NO: 1212006 - RNA, 21 nt, Human
ccucccaacucaccccagccc

SEQ ID NO: 1212007 - RNA, 20 nt, Human
ccucccaacucaccccagcc

SEQ ID NO: 1212008 - RNA, 17 nt, Human
ccucccaacucacccca

SEQ ID NO: 1212009 - RNA, 11 nt, Human
ccucaggcagg

SEQ ID NO: 1212010 - RNA, 16 nt, Human
cccugagcuuucugcu

SEQ ID NO: 1212011 - RNA, 17 nt, Human
cccugcccggcugcgga

SEQ ID NO: 1212012 - RNA, 14 nt, Human
cccugcccggcugc

SEQ ID NO: 1212013 - RNA, 22 nt, Human
cccugcccaccuggccucugca

SEQ ID NO: 1212014 - RNA, 21 nt, Human
cccuggaugcagccucacagu

SEQ ID NO: 1212015 - RNA, 17 nt, Human
cccuggaugcagccuca

SEQ ID NO: 1212016 - RNA, 13 nt, Human
cccuggaugcagc

SEQ ID NO: 1212017 - RNA, 11 nt, Human
cccugcccugu

SEQ ID NO: 1212018 - RNA, 12 nt, Human
cccugaaggccc

SEQ ID NO: 1212019 - RNA, 19 nt, Human
cccugaaggccccgcccag

SEQ ID NO: 1212020 - RNA, 16 nt, Human
cccugaaggccccgcc

SEQ ID NO: 1212021 - RNA, 14 nt, Human
cccugaaggccccg

SEQ ID NO: 1212022 - RNA, 13 nt, Human
cccugaaggcccc

SEQ ID NO: 1212023 - RNA, 22 nt, Human
cccugacaacacucauugaccu

SEQ ID NO: 1212024 - RNA, 16 nt, Human
cccugacaacacucau

SEQ ID NO: 1212025 - RNA, 14 nt, Human
cccugacaacacuc

SEQ ID NO: 1212026 - RNA, 22 nt, Human
cccugaaggccccgcccaggcu

SEQ ID NO: 1212027 - RNA, 20 nt, Human
cccugaaggccccgcccagg

SEQ ID NO: 1212028 - RNA, 18 nt, Human
cccugaaagcccugagcu

SEQ ID NO: 1212029 - RNA, 16 nt, Human
ccggccaccugcggug

SEQ ID NO: 1212030 - RNA, 16 nt, Human
ccgugaggccagagac

SEQ ID NO: 1212031 - RNA, 14 nt, Human
ccgugaggccagag

SEQ ID NO: 1212032 - RNA, 13 nt, Human
ccgugaggccaga

SEQ ID NO: 1212033 - RNA, 12 nt, Human
ccgugaggccag

SEQ ID NO: 1212034 - RNA, 17 nt, Human
ccgucuaccugaggggc

SEQ ID NO: 1212035 - RNA, 14 nt, Human
ccggcuccaggcuc

SEQ ID NO: 1212036 - RNA, 13 nt, Human
ccggcuccaggcu

SEQ ID NO: 1212037 - RNA, 15 nt, Human
ccgucuaccugaggg

SEQ ID NO: 1212038 - RNA, 14 nt, Human
ccgucuaccugagg

SEQ ID NO: 1212039 - RNA, 15 nt, Human
ccggcuccaggcucc

SEQ ID NO: 1212040 - RNA, 14 nt, Human
ccuaaucuucugaa

SEQ ID NO: 1212041 - RNA, 20 nt, Human
ccuagccugugccucuggga

SEQ ID NO: 1212042 - RNA, 21 nt, Human
ccuagcauacguacacauuuu

SEQ ID NO: 1212043 - RNA, 19 nt, Human
ccuagcauacguacacauu

SEQ ID NO: 1212044 - RNA, 23 nt, Human
cccugugauggggcccugccucc

SEQ ID NO: 1212045 - RNA, 22 nt, Human
cccugugauggggcccugccuc

SEQ ID NO: 1212046 - RNA, 21 nt, Human
cccugugauggggcccugccu

SEQ ID NO: 1212047 - RNA, 13 nt, Human
cccugucuaauga

SEQ ID NO: 1212048 - RNA, 17 nt, Human
ccgcagacaggaccagg

SEQ ID NO: 1212049 - RNA, 16 nt, Human
ccgcagacaggaccag

SEQ ID NO: 1212050 - RNA, 12 nt, Human
ccgcccaggcuu

SEQ ID NO: 1212051 - RNA, 19 nt, Human
ccgaaagggacuuggaagc

SEQ ID NO: 1212052 - RNA, 17 nt, Human
ccgaaaacguggcugcu

SEQ ID NO: 1212053 - RNA, 16 nt, Human
ccgaaaacguggcugc

SEQ ID NO: 1212054 - RNA, 15 nt, Human
cccuuccucuuucca

SEQ ID NO: 1212055 - RNA, 17 nt, Human
ccgaauagcugggacua

SEQ ID NO: 1212056 - RNA, 16 nt, Human
ccgaauagcugggacu

SEQ ID NO: 1212057 - RNA, 17 nt, Human
ccgaccagacaccuuga

SEQ ID NO: 1212058 - RNA, 13 nt, Human
ccgaccagacacc

SEQ ID NO: 1212059 - RNA, 18 nt, Human
ccgaccagacaccuugac

SEQ ID NO: 1212060 - RNA, 21 nt, Human
caucagcacgauuucuguuua

SEQ ID NO: 1212061 - RNA, 19 nt, Human
caucccaaacccuucagug

SEQ ID NO: 1212062 - RNA, 11 nt, Human
caucccagccc

SEQ ID NO: 1212063 - RNA, 20 nt, Human
caucccaaacccuucagugc

SEQ ID NO: 1212064 - RNA, 22 nt, Human
cauccucuguacagagcccacg

SEQ ID NO: 1212065 - RNA, 12 nt, Human
caucccagcccc

SEQ ID NO: 1212066 - RNA, 16 nt, Human
cauacaguuugcacuu

SEQ ID NO: 1212067 - RNA, 23 nt, Human
cauacaggaagguagaaauaucu

SEQ ID NO: 1212068 - RNA, 23 nt, Human
caguuuguuaguaugaggcauuu

SEQ ID NO: 1212069 - RNA, 22 nt, Human
caguuguuagugugucuuagug

SEQ ID NO: 1212070 - RNA, 22 nt, Human
cagucugauucccaagcucugc

SEQ ID NO: 1212071 - RNA, 21 nt, Human
cagucugauucccaagcucug

SEQ ID NO: 1212072 - RNA, 20 nt, Human
cagugguaugaucacggcuc

SEQ ID NO: 1212073 - RNA, 18 nt, Human
cagugggagcugccuguu

SEQ ID NO: 1212074 - RNA, 17 nt, Human
cagugggagcugccugu

SEQ ID NO: 1212075 - RNA, 16 nt, Human
cagugggagcugccug

SEQ ID NO: 1212076 - RNA, 22 nt, Human
cagugcccacaggaucagucug

SEQ ID NO: 1212077 - RNA, 21 nt, Human
cagugcccacaggaucagucu

SEQ ID NO: 1212078 - RNA, 23 nt, Human
cagucugauucccaagcucugcu

SEQ ID NO: 1212079 - RNA, 20 nt, Human
caguuacucagaauucucua

SEQ ID NO: 1212080 - RNA, 20 nt, Human
caguggugcgaucuggguuc

SEQ ID NO: 1212081 - RNA, 19 nt, Human
caguggugcgaucuggguu

SEQ ID NO: 1212082 - RNA, 21 nt, Human
cagugguaugaucacggcuca

SEQ ID NO: 1212083 - RNA, 14 nt, Human
ccaaugggagcuca

SEQ ID NO: 1212084 - RNA, 23 nt, Human
ccaauggacuaacuugucuuugg

SEQ ID NO: 1212085 - RNA, 17 nt, Human
ccaagcucugcuccucu

SEQ ID NO: 1212086 - RNA, 16 nt, Human
ccaagcucugcuccuc

SEQ ID NO: 1212087 - RNA, 15 nt, Human
ccaagcucugcuccu

SEQ ID NO: 1212088 - RNA, 14 nt, Human
ccaagcucugcucc

SEQ ID NO: 1212089 - RNA, 14 nt, Human
ccaacucaccccag

SEQ ID NO: 1212090 - RNA, 21 nt, Human
ccaacucaccccagccccaaa

SEQ ID NO: 1212091 - RNA, 13 nt, Human
ccaacucacccca

SEQ ID NO: 1212092 - RNA, 16 nt, Human
ccaaaucauaguggcu

SEQ ID NO: 1212093 - RNA, 23 nt, Human
ccaaaucagcugcuacuacuccu

SEQ ID NO: 1212094 - RNA, 15 nt, Human
ccaaaucagcugcua

SEQ ID NO: 1212095 - RNA, 14 nt, Human
ccaaagugcuggga

SEQ ID NO: 1212096 - RNA, 22 nt, Human
ccaaaguacacuguuucaaacu

SEQ ID NO: 1212097 - RNA, 18 nt, Human
cauuuaggugaggaagca

SEQ ID NO: 1212098 - RNA, 16 nt, Human
cauuuaggugaggaag

SEQ ID NO: 1212099 - RNA, 17 nt, Human
ccaaaaaaugcuugcuu

SEQ ID NO: 1212100 - RNA, 21 nt, Human
cauuuggugguuucagaaaug

SEQ ID NO: 1212101 - RNA, 17 nt, Human
cauuuguuugaacugau

SEQ ID NO: 1212102 - RNA, 23 nt, Human
cauuuuuuuuaagaaaaaggaug

SEQ ID NO: 1212103 - RNA, 15 nt, Human
caugcaaggucauuu

SEQ ID NO: 1212104 - RNA, 12 nt, Human
caugcaagguca

SEQ ID NO: 1212105 - RNA, 13 nt, Human
caugacaaagacu

SEQ ID NO: 1212106 - RNA, 16 nt, Human
caugcuccuggcccac

SEQ ID NO: 1212107 - RNA, 14 nt, Human
caugcuccuggccc

SEQ ID NO: 1212108 - RNA, 17 nt, Human
caugcuccuggcccacu

SEQ ID NO: 1212109 - RNA, 20 nt, Human
caugcuccuggcccacugca

SEQ ID NO: 1212110 - RNA, 22 nt, Human
cauggccucuucagaucucuaa

SEQ ID NO: 1212111 - RNA, 21 nt, Human
cauggccucuucagaucucua

SEQ ID NO: 1212112 - RNA, 18 nt, Human
caugggaaaggggaaguu

SEQ ID NO: 1212113 - RNA, 21 nt, Human
cauucuccaccugccagggac

SEQ ID NO: 1212114 - RNA, 19 nt, Human
cauucuccaccugccaggg

SEQ ID NO: 1212115 - RNA, 18 nt, Human
cauucuccaccugccagg

SEQ ID NO: 1212116 - RNA, 17 nt, Human
cauucuccaccugccag

SEQ ID NO: 1212117 - RNA, 12 nt, Human
cauuaucuagau

SEQ ID NO: 1212118 - RNA, 16 nt, Human
cauguucuuaauucuu

SEQ ID NO: 1212119 - RNA, 13 nt, Human
cauguucuuaauu

SEQ ID NO: 1212120 - RNA, 21 nt, Human
cauguuacauaagauaaaugu

SEQ ID NO: 1212121 - RNA, 17 nt, Human
cauguuacauaagauaa

SEQ ID NO: 1212122 - RNA, 16 nt, Human
cauguuacauaagaua

SEQ ID NO: 1212123 - RNA, 16 nt, Human
cauguccaagaagccc

SEQ ID NO: 1212124 - RNA, 15 nt, Human
cauguccaagaagcc

SEQ ID NO: 1212125 - RNA, 19 nt, Human
cauguuggccaggcugguc

SEQ ID NO: 1212126 - RNA, 18 nt, Human
cauguucuuaauucuuag

SEQ ID NO: 1212127 - RNA, 17 nt, Human
cauguuggccaggcugg

SEQ ID NO: 1212128 - RNA, 18 nt, Human
cauguuggccaggcuggu

SEQ ID NO: 1212129 - RNA, 15 nt, Human
cagcacgauuucugu

SEQ ID NO: 1212130 - RNA, 14 nt, Human
cagcacgauuucug

SEQ ID NO: 1212131 - RNA, 19 nt, Human
cagcaccaucucuccuccu

SEQ ID NO: 1212132 - RNA, 17 nt, Human
cagcaccaucucuccuc

SEQ ID NO: 1212133 - RNA, 19 nt, Human
cagauuugaacucuucaau

SEQ ID NO: 1212134 - RNA, 20 nt, Human
cagauuucacucuccuuggu

SEQ ID NO: 1212135 - RNA, 13 nt, Human
cagauuucacucu

SEQ ID NO: 1212136 - RNA, 20 nt, Human
cagauugcaacaggcugggc

SEQ ID NO: 1212137 - RNA, 19 nt, Human
cagauugcaacaggcuggg

SEQ ID NO: 1212138 - RNA, 21 nt, Human
cagauugcaacaggcugggcu

SEQ ID NO: 1212139 - RNA, 18 nt, Human
cagauugcaacaggcugg

SEQ ID NO: 1212140 - RNA, 19 nt, Human
cagauagauauaugcucug

SEQ ID NO: 1212141 - RNA, 19 nt, Human
cagauacuuggggggcuga

SEQ ID NO: 1212142 - RNA, 17 nt, Human
cagaggggguggccucc

SEQ ID NO: 1212143 - RNA, 16 nt, Human
cagaggggguggccuc

SEQ ID NO: 1212144 - RNA, 14 nt, Human
cagaggggguggcc

SEQ ID NO: 1212145 - RNA, 13 nt, Human
cagaggggguggc

SEQ ID NO: 1212146 - RNA, 20 nt, Human
cagaggaaagcaaaggagau

SEQ ID NO: 1212147 - RNA, 19 nt, Human
cagaggaaagcaaaggaga

SEQ ID NO: 1212148 - RNA, 17 nt, Human
cagaggaaagcaaagga

SEQ ID NO: 1212149 - RNA, 16 nt, Human
cagagcugccaccugc

SEQ ID NO: 1212150 - RNA, 13 nt, Human
cagagcugccacc

SEQ ID NO: 1212151 - RNA, 20 nt, Human
cagagagguuaaggugggua

SEQ ID NO: 1212152 - RNA, 23 nt, Human
cagagaggguggugaccucugcc

SEQ ID NO: 1212153 - RNA, 22 nt, Human
cagagaggguggugaccucugc

SEQ ID NO: 1212154 - RNA, 20 nt, Human
cagagaggguggugaccucu

SEQ ID NO: 1212155 - RNA, 17 nt, Human
cagagaggguggugacc

SEQ ID NO: 1212156 - RNA, 13 nt, Human
cagagaggguggg

SEQ ID NO: 1212157 - RNA, 12 nt, Human
cagagagggugg

SEQ ID NO: 1212158 - RNA, 21 nt, Human
cagacuggaagcacagcuuca

SEQ ID NO: 1212159 - RNA, 20 nt, Human
cagacuggaagcacagcuuc

SEQ ID NO: 1212160 - RNA, 18 nt, Human
cagacuggaagcacagcu

SEQ ID NO: 1212161 - RNA, 17 nt, Human
cagacuggaagcacagc

SEQ ID NO: 1212162 - RNA, 16 nt, Human
cagacuggaagcacag

SEQ ID NO: 1212163 - RNA, 14 nt, Human
cagacuggaagcac

SEQ ID NO: 1212164 - RNA, 13 nt, Human
cagacuggaagca

SEQ ID NO: 1212165 - RNA, 23 nt, Human
cagacucuacagaggccaugggc

SEQ ID NO: 1212166 - RNA, 21 nt, Human
cagacucuacagaggccaugg

SEQ ID NO: 1212167 - RNA, 20 nt, Human
cagacucuacagaggccaug

SEQ ID NO: 1212168 - RNA, 19 nt, Human
cagacucuacagaggccau

SEQ ID NO: 1212169 - RNA, 18 nt, Human
cagacucuacagaggcca

SEQ ID NO: 1212170 - RNA, 17 nt, Human
cagacucuacagaggcc

SEQ ID NO: 1212171 - RNA, 23 nt, Human
cagacaggcaagcaccuccugcc

SEQ ID NO: 1212172 - RNA, 22 nt, Human
cagacaggcaagcaccuccugc

SEQ ID NO: 1212173 - RNA, 21 nt, Human
cagacaggcaagcaccuccug

SEQ ID NO: 1212174 - RNA, 20 nt, Human
cagacaggcaagcaccuccu

SEQ ID NO: 1212175 - RNA, 18 nt, Human
cagacaggcaagcaccuc

SEQ ID NO: 1212176 - RNA, 13 nt, Human
cagacaggcaagc

SEQ ID NO: 1212177 - RNA, 11 nt, Human
cagacaggcaa

SEQ ID NO: 1212178 - RNA, 24 nt, Human
cagacaggaccagggauuuccaug

SEQ ID NO: 1212179 - RNA, 17 nt, Human
cagacaggaccagggau

SEQ ID NO: 1212180 - RNA, 16 nt, Human
cagacaggaccaggga

SEQ ID NO: 1212181 - RNA, 15 nt, Human
cagacaggaccaggg

SEQ ID NO: 1212182 - RNA, 13 nt, Human
cagacaggaccag

SEQ ID NO: 1212183 - RNA, 18 nt, Human
cagacagcugccugggau

SEQ ID NO: 1212184 - RNA, 17 nt, Human
cagacagcugccuggga

SEQ ID NO: 1212185 - RNA, 16 nt, Human
cagacagcugccuggg

SEQ ID NO: 1212186 - RNA, 15 nt, Human
cagacagcugccugg

SEQ ID NO: 1212187 - RNA, 14 nt, Human
cagacagcugccug

SEQ ID NO: 1212188 - RNA, 13 nt, Human
cagacagcugccu

SEQ ID NO: 1212189 - RNA, 17 nt, Human
caggcaaugcuggcugu

SEQ ID NO: 1212190 - RNA, 16 nt, Human
caggcaaugcuggcug

SEQ ID NO: 1212191 - RNA, 15 nt, Human
caggcaaugcuggcu

SEQ ID NO: 1212192 - RNA, 22 nt, Human
caggaggccagccuugaccauu

SEQ ID NO: 1212193 - RNA, 19 nt, Human
caggaggccagccuugacc

SEQ ID NO: 1212194 - RNA, 19 nt, Human
caggaggaucacuugaguc

SEQ ID NO: 1212195 - RNA, 23 nt, Human
caggaccucaggugagaagcaga

SEQ ID NO: 1212196 - RNA, 16 nt, Human
caggaccucaggugag

SEQ ID NO: 1212197 - RNA, 12 nt, Human
caggccaggccc

SEQ ID NO: 1212198 - RNA, 11 nt, Human
caggccaggcc

SEQ ID NO: 1212199 - RNA, 23 nt, Human
caggcugggagagccuuccaggg

SEQ ID NO: 1212200 - RNA, 22 nt, Human
caggcugggagagccuuccagg

SEQ ID NO: 1212201 - RNA, 16 nt, Human
caggggaaaagaggag

SEQ ID NO: 1212202 - RNA, 14 nt, Human
caggggaaaagagg

SEQ ID NO: 1212203 - RNA, 17 nt, Human
caggggaaaaucagccu

SEQ ID NO: 1212204 - RNA, 14 nt, Human
caggccuccuacag

SEQ ID NO: 1212205 - RNA, 21 nt, Human
caggcugggagagccuuccag

SEQ ID NO: 1212206 - RNA, 17 nt, Human
caggaaaggcuccagga

SEQ ID NO: 1212207 - RNA, 16 nt, Human
caggaaaggcuccagg

SEQ ID NO: 1212208 - RNA, 20 nt, Human
caggaaaggcuccaggagca

SEQ ID NO: 1212209 - RNA, 19 nt, Human
caggaaaggcuccaggagc

SEQ ID NO: 1212210 - RNA, 19 nt, Human
cagcugagggugagugggu

SEQ ID NO: 1212211 - RNA, 21 nt, Human
cagcugacuuuucuguccgag

SEQ ID NO: 1212212 - RNA, 19 nt, Human
cagccugcuccagcuguuc

SEQ ID NO: 1212213 - RNA, 17 nt, Human
cagccugcuccagcugu

SEQ ID NO: 1212214 - RNA, 16 nt, Human
cagccugcuccagcug

SEQ ID NO: 1212215 - RNA, 15 nt, Human
cagcuaacauggaag

SEQ ID NO: 1212216 - RNA, 18 nt, Human
cagcuaacauggaaguac

SEQ ID NO: 1212217 - RNA, 13 nt, Human
caccugccaggga

SEQ ID NO: 1212218 - RNA, 21 nt, Human
caccugccccucaacucuccu

SEQ ID NO: 1212219 - RNA, 18 nt, Human
caccugccccucaacucu

SEQ ID NO: 1212220 - RNA, 12 nt, Human
caccugccaggg

SEQ ID NO: 1212221 - RNA, 11 nt, Human
caccugccagg

SEQ ID NO: 1212222 - RNA, 12 nt, Human
cacccuccuuuc

SEQ ID NO: 1212223 - RNA, 12 nt, Human
cacccugcucuc

SEQ ID NO: 1212224 - RNA, 19 nt, Human
caccugcggugcuaucucc

SEQ ID NO: 1212225 - RNA, 17 nt, Human
caccugcggugcuaucu

SEQ ID NO: 1212226 - RNA, 16 nt, Human
caccugcggugcuauc

SEQ ID NO: 1212227 - RNA, 20 nt, Human
caccugcggugcuaucuccc

SEQ ID NO: 1212228 - RNA, 20 nt, Human
cacgcuggagugcagugagc

SEQ ID NO: 1212229 - RNA, 18 nt, Human
cacgcuggagugcaguga

SEQ ID NO: 1212230 - RNA, 17 nt, Human
cacgcuggagugcagug

SEQ ID NO: 1212231 - RNA, 16 nt, Human
cacgcuggagugcagu

SEQ ID NO: 1212232 - RNA, 21 nt, Human
cacgcuggagugcagugagcc

SEQ ID NO: 1212233 - RNA, 14 nt, Human
cacuacauucuguu

SEQ ID NO: 1212234 - RNA, 13 nt, Human
cacuacauucugu

SEQ ID NO: 1212235 - RNA, 22 nt, Human
cacggaagagccuugcggaagg

SEQ ID NO: 1212236 - RNA, 16 nt, Human
cacggaagagccuugc

SEQ ID NO: 1212237 - RNA, 15 nt, Human
cacuacauucuguua

SEQ ID NO: 1212238 - RNA, 21 nt, Human
caccagcccuuagcagggaaa

SEQ ID NO: 1212239 - RNA, 19 nt, Human
caccagcccuuagcaggga

SEQ ID NO: 1212240 - RNA, 22 nt, Human
caccagccccagugcccacagg

SEQ ID NO: 1212241 - RNA, 21 nt, Human
caccagccccagugcccacag

SEQ ID NO: 1212242 - RNA, 18 nt, Human
caccagccccagugccca

SEQ ID NO: 1212243 - RNA, 17 nt, Human
caccagccccagugccc

SEQ ID NO: 1212244 - RNA, 18 nt, Human
cacauuuauucugcucac

SEQ ID NO: 1212245 - RNA, 17 nt, Human
cacauuuauucugcuca

SEQ ID NO: 1212246 - RNA, 16 nt, Human
cacaucuugcucugcu

SEQ ID NO: 1212247 - RNA, 23 nt, Human
cacaucuugcucugcugacagac

SEQ ID NO: 1212248 - RNA, 16 nt, Human
cacccagcccacuucu

SEQ ID NO: 1212249 - RNA, 12 nt, Human
cacccagcccac

SEQ ID NO: 1212250 - RNA, 22 nt, Human
cacaucuugcucugcugacaga

SEQ ID NO: 1212251 - RNA, 21 nt, Human
cacaucuugcucugcugacag

SEQ ID NO: 1212252 - RNA, 20 nt, Human
cacaucuugcucugcugaca

SEQ ID NO: 1212253 - RNA, 15 nt, Human
cacaucuugcucugc

SEQ ID NO: 1212254 - RNA, 14 nt, Human
cacaucuugcucug

SEQ ID NO: 1212255 - RNA, 13 nt, Human
cacaucuugcucu

SEQ ID NO: 1212256 - RNA, 22 nt, Human
caaguauuauaccuuuuuuaga

SEQ ID NO: 1212257 - RNA, 17 nt, Human
caaguauuauaccuuuu

SEQ ID NO: 1212258 - RNA, 16 nt, Human
caaggcaaggcuguca

SEQ ID NO: 1212259 - RNA, 14 nt, Human
caaggcaaggcugu

SEQ ID NO: 1212260 - RNA, 20 nt, Human
caaggauugcuacuguccua

SEQ ID NO: 1212261 - RNA, 13 nt, Human
caagcugcacccu

SEQ ID NO: 1212262 - RNA, 16 nt, Human
caagcucugcuccucu

SEQ ID NO: 1212263 - RNA, 17 nt, Human
caagcucccaggcauuc

SEQ ID NO: 1212264 - RNA, 15 nt, Human
caagcucccaggcau

SEQ ID NO: 1212265 - RNA, 14 nt, Human
caagcucccaggca

SEQ ID NO: 1212266 - RNA, 12 nt, Human
caagcucccagg

SEQ ID NO: 1212267 - RNA, 18 nt, Human
caagcuccaagcucccag

SEQ ID NO: 1212268 - RNA, 21 nt, Human
caagcuccaagcucccaggca

SEQ ID NO: 1212269 - RNA, 19 nt, Human
caagcuccaagcucccagg

SEQ ID NO: 1212270 - RNA, 20 nt, Human
caauuuauuauggcacauca

SEQ ID NO: 1212271 - RNA, 16 nt, Human
caauggcagccuuggc

SEQ ID NO: 1212272 - RNA, 12 nt, Human
caaugcuggcug

SEQ ID NO: 1212273 - RNA, 15 nt, Human
caauggcagccuugg

SEQ ID NO: 1212274 - RNA, 14 nt, Human
caauggcagccuug

SEQ ID NO: 1212275 - RNA, 13 nt, Human
caauggcagccuu

SEQ ID NO: 1212276 - RNA, 14 nt, Human
caaucaaaucugcu

SEQ ID NO: 1212277 - RNA, 17 nt, Human
caaccccuucgcuccug

SEQ ID NO: 1212278 - RNA, 16 nt, Human
caaccccuucgcuccu

SEQ ID NO: 1212279 - RNA, 14 nt, Human
caaccccuucgcuc

SEQ ID NO: 1212280 - RNA, 14 nt, Human
caacccccagccug

SEQ ID NO: 1212281 - RNA, 17 nt, Human
caagaaggaugauucaa

SEQ ID NO: 1212282 - RNA, 18 nt, Human
caagaagcccaggaaagg

SEQ ID NO: 1212283 - RNA, 15 nt, Human
caagaagcccaggaa

SEQ ID NO: 1212284 - RNA, 16 nt, Human
caagaccacguuucua

SEQ ID NO: 1212285 - RNA, 14 nt, Human
caagaccacguuuc

SEQ ID NO: 1212286 - RNA, 13 nt, Human
caagcaccuccug

SEQ ID NO: 1212287 - RNA, 14 nt, Human
caagcaccuccugc

SEQ ID NO: 1212288 - RNA, 22 nt, Human
auuuuguuuuugucuuaaaaag

SEQ ID NO: 1212289 - RNA, 16 nt, Human
auuuuuauuaaauuau

SEQ ID NO: 1212290 - RNA, 12 nt, Human
auuuuuuuuucc

SEQ ID NO: 1212291 - RNA, 13 nt, Human
caaaagcauguga

SEQ ID NO: 1212292 - RNA, 19 nt, Human
caaaagcaucuaugugaga

SEQ ID NO: 1212293 - RNA, 20 nt, Human
caaaagguuaauaaaguaau

SEQ ID NO: 1212294 - RNA, 16 nt, Human
caaaccaucauugaaa

SEQ ID NO: 1212295 - RNA, 14 nt, Human
caaaccaucauuga

SEQ ID NO: 1212296 - RNA, 17 nt, Human
caaaccaucauugaaau

SEQ ID NO: 1212297 - RNA, 19 nt, Human
caaaccaucauugaaaucu

SEQ ID NO: 1212298 - RNA, 14 nt, Human
auuuguuauaauga

SEQ ID NO: 1212299 - RNA, 14 nt, Human
auuucacucuccuu

SEQ ID NO: 1212300 - RNA, 12 nt, Human
auuucacucucc

SEQ ID NO: 1212301 - RNA, 20 nt, Human
auuucuguuuagauaauaca

SEQ ID NO: 1212302 - RNA, 21 nt, Human
auuucuguuuagauaauacac

SEQ ID NO: 1212303 - RNA, 16 nt, Human
auucucuccuguaccu

SEQ ID NO: 1212304 - RNA, 15 nt, Human
auucucuuauccaac

SEQ ID NO: 1212305 - RNA, 14 nt, Human
auucucuuauccaa

SEQ ID NO: 1212306 - RNA, 12 nt, Human
auucucuuaucc

SEQ ID NO: 1212307 - RNA, 23 nt, Human
auucucuaguuugauuaaauucu

SEQ ID NO: 1212308 - RNA, 20 nt, Human
auucucuaguuugauuaaau

SEQ ID NO: 1212309 - RNA, 14 nt, Human
auucauauuuacuu

SEQ ID NO: 1212310 - RNA, 16 nt, Human
auuacaggugugaacc

SEQ ID NO: 1212311 - RNA, 17 nt, Human
ggccucccaacucaccc

SEQ ID NO: 1212312 - RNA, 14 nt, Human
ggccucccaacuca

SEQ ID NO: 1212313 - RNA, 13 nt, Human
ggccucccaacuc

SEQ ID NO: 1212314 - RNA, 14 nt, Human
ggcccuuccuuuuc

SEQ ID NO: 1212315 - RNA, 13 nt, Human
ggccaaaggaagc

SEQ ID NO: 1212316 - RNA, 12 nt, Human
ggccaaaggaag

SEQ ID NO: 1212317 - RNA, 15 nt, Human
ggccaaagccaaagc

SEQ ID NO: 1212318 - RNA, 12 nt, Human
ggcauuguggga

SEQ ID NO: 1212319 - RNA, 20 nt, Human
ggccagaugcaccagcccuu

SEQ ID NO: 1212320 - RNA, 19 nt, Human
ggccagaugcaccagcccu

SEQ ID NO: 1212321 - RNA, 23 nt, Human
ggccagagggagugacagaggca

SEQ ID NO: 1212322 - RNA, 13 nt, Human
ggccaagguggga

SEQ ID NO: 1212323 - RNA, 21 nt, Human
ggauuuugauccaagcugguc

SEQ ID NO: 1212324 - RNA, 23 nt, Human
ggauuaaacuuaaucuaaaugga

SEQ ID NO: 1212325 - RNA, 13 nt, Human
ggauguucuggga

SEQ ID NO: 1212326 - RNA, 22 nt, Human
ggaugagaaagguugaagcacc

SEQ ID NO: 1212327 - RNA, 12 nt, Human
ggaugagaaagg

SEQ ID NO: 1212328 - RNA, 21 nt, Human
ggaugaauuccaaauucugcu

SEQ ID NO: 1212329 - RNA, 17 nt, Human
ggcagccaggccacaag

SEQ ID NO: 1212330 - RNA, 15 nt, Human
ggcagccaggccaca

SEQ ID NO: 1212331 - RNA, 12 nt, Human
ggcagagcagag

SEQ ID NO: 1212332 - RNA, 10 nt, Human
ggcagagcag

SEQ ID NO: 1212333 - RNA, 12 nt, Human
ggcagaaggaag

SEQ ID NO: 1212334 - RNA, 16 nt, Human
ggaggucgaggcagga

SEQ ID NO: 1212335 - RNA, 15 nt, Human
ggaggucgaggcagg

SEQ ID NO: 1212336 - RNA, 18 nt, Human
ggaggucgaggcaggagg

SEQ ID NO: 1212337 - RNA, 16 nt, Human
ggagcugaguggggga

SEQ ID NO: 1212338 - RNA, 13 nt, Human
ggaggccagccuu

SEQ ID NO: 1212339 - RNA, 20 nt, Human
ggaggccaaggugggaggau

SEQ ID NO: 1212340 - RNA, 18 nt, Human
ggaggccaaggugggagg

SEQ ID NO: 1212341 - RNA, 21 nt, Human
ggaggcaugugaugagaggaa

SEQ ID NO: 1212342 - RNA, 19 nt, Human
ggaggaaggaaacccagcu

SEQ ID NO: 1212343 - RNA, 12 nt, Human
ggaggaagagaa

SEQ ID NO: 1212344 - RNA, 21 nt, Human
ggagcagccacauuccugaug

SEQ ID NO: 1212345 - RNA, 13 nt, Human
ggagcagccacau

SEQ ID NO: 1212346 - RNA, 19 nt, Human
gcuuguacauaaugcgugc

SEQ ID NO: 1212347 - RNA, 19 nt, Human
ggacccugaggcccagagg

SEQ ID NO: 1212348 - RNA, 18 nt, Human
ggacccugaggcccagag

SEQ ID NO: 1212349 - RNA, 15 nt, Human
ggacccugaggccca

SEQ ID NO: 1212350 - RNA, 14 nt, Human
ggacccugaggccc

SEQ ID NO: 1212351 - RNA, 17 nt, Human
ggagagcuagcagcagg

SEQ ID NO: 1212352 - RNA, 15 nt, Human
ggagagcuagcagca

SEQ ID NO: 1212353 - RNA, 22 nt, Human
ggagagccuuccagggguggga

SEQ ID NO: 1212354 - RNA, 18 nt, Human
ggagagccuuccaggggu

SEQ ID NO: 1212355 - RNA, 17 nt, Human
ggagagccuuccagggg

SEQ ID NO: 1212356 - RNA, 16 nt, Human
ggagagccuuccaggg

SEQ ID NO: 1212357 - RNA, 13 nt, Human
ggagagccuucca

SEQ ID NO: 1212358 - RNA, 17 nt, Human
ggacuuggaagcuccgc

SEQ ID NO: 1212359 - RNA, 19 nt, Human
ggagaaaauggacguguua

SEQ ID NO: 1212360 - RNA, 22 nt, Human
ggagaaccaaaaagaggcuaug

SEQ ID NO: 1212361 - RNA, 12 nt, Human
ggaccucaggcc

SEQ ID NO: 1212362 - RNA, 20 nt, Human
ggacuacaggugugagucac

SEQ ID NO: 1212363 - RNA, 22 nt, Human
ggacucaaugcacugacauugu

SEQ ID NO: 1212364 - RNA, 13 nt, Human
aaaaaaacacaaa

SEQ ID NO: 1212365 - RNA, 15 nt, Human
ggcuucaguggcagc

SEQ ID NO: 1212366 - RNA, 15 nt, Human
ggcugucaauuacag

SEQ ID NO: 1212367 - RNA, 23 nt, Human
ggcuguaucccaugagccucagc

SEQ ID NO: 1212368 - RNA, 22 nt, Human
ggcuguaucccaugagccucag

SEQ ID NO: 1212369 - RNA, 20 nt, Human
ggcuguaucccaugagccuc

SEQ ID NO: 1212370 - RNA, 16 nt, Human
ggcuggugucaccuga

SEQ ID NO: 1212371 - RNA, 19 nt, Human
ggcuguaucccaugagccu

SEQ ID NO: 1212372 - RNA, 23 nt, Human
gggaaaaucagccugcuccagcu

SEQ ID NO: 1212373 - RNA, 13 nt, Human
gggaaaaucagcc

SEQ ID NO: 1212374 - RNA, 17 nt, Human
ggcuucaguggcagcug

SEQ ID NO: 1212375 - RNA, 16 nt, Human
ggcuucaguggcagcu

SEQ ID NO: 1212376 - RNA, 20 nt, Human
ggcuggcgugcaguggugcg

SEQ ID NO: 1212377 - RNA, 16 nt, Human
ggcuggcgugcagugg

SEQ ID NO: 1212378 - RNA, 14 nt, Human
ggcuggcgugcagu

SEQ ID NO: 1212379 - RNA, 22 nt, Human
ggcuggccuggccccucagggu

SEQ ID NO: 1212380 - RNA, 17 nt, Human
ggcuggccuggccccuc

SEQ ID NO: 1212381 - RNA, 13 nt, Human
ggcugggagagcc

SEQ ID NO: 1212382 - RNA, 22 nt, Human
ggcucccuucccaccucucuca

SEQ ID NO: 1212383 - RNA, 20 nt, Human
ggcucccuucccaccucucu

SEQ ID NO: 1212384 - RNA, 18 nt, Human
ggcucccuucccaccucu

SEQ ID NO: 1212385 - RNA, 17 nt, Human
ggcucccuucccaccuc

SEQ ID NO: 1212386 - RNA, 16 nt, Human
ggcucccuucccaccu

SEQ ID NO: 1212387 - RNA, 22 nt, Human
ggcugcaugcgggcuuccuccu

SEQ ID NO: 1212388 - RNA, 20 nt, Human
ggcugcaugcgggcuuccuc

SEQ ID NO: 1212389 - RNA, 24 nt, Human
ggcucuuccaggcugggagagccu

SEQ ID NO: 1212390 - RNA, 23 nt, Human
ggcucuuccaggcugggagagcc

SEQ ID NO: 1212391 - RNA, 18 nt, Human
ggcucgagcaugccugga

SEQ ID NO: 1212392 - RNA, 14 nt, Human
gggcagaggaaagc

SEQ ID NO: 1212393 - RNA, 15 nt, Human
gggauuuccaugaug

SEQ ID NO: 1212394 - RNA, 18 nt, Human
aaaauaguggugugauuu

SEQ ID NO: 1212395 - RNA, 12 nt, Human
aaaauagccugc

SEQ ID NO: 1212396 - RNA, 15 nt, Human
aaaauaccagccagu

SEQ ID NO: 1212397 - RNA, 14 nt, Human
aaaauaccagccag

SEQ ID NO: 1212398 - RNA, 12 nt, Human
aaaauaaauuau

SEQ ID NO: 1212399 - RNA, 14 nt, Human
aaaagcugggcagg

SEQ ID NO: 1212400 - RNA, 19 nt, Human
gggaggccaaggugggagg

SEQ ID NO: 1212401 - RNA, 13 nt, Human
gggagggcuccag

SEQ ID NO: 1212402 - RNA, 11 nt, Human
gggagggcucc

SEQ ID NO: 1212403 - RNA, 20 nt, Human
aaaaaucucaaauuucuaaa

SEQ ID NO: 1212404 - RNA, 19 nt, Human
aaaaaucucaaauuucuaa

SEQ ID NO: 1212405 - RNA, 22 nt, Human
gggaacagacuggaagcacagc

SEQ ID NO: 1212406 - RNA, 14 nt, Human
gggaacagacugga

SEQ ID NO: 1212407 - RNA, 18 nt, Human
aaaacguggcugcuucaa

SEQ ID NO: 1212408 - RNA, 17 nt, Human
aaaacguggcugcuuca

SEQ ID NO: 1212409 - RNA, 16 nt, Human
aaaacguggcugcuuc

SEQ ID NO: 1212410 - RNA, 21 nt, Human
aaaaccaauguucucucuucu

SEQ ID NO: 1212411 - RNA, 15 nt, Human
aaaaccaauguucuc

SEQ ID NO: 1212412 - RNA, 20 nt, Human
aaaacugcugacuguuuucu

SEQ ID NO: 1212413 - RNA, 22 nt, Human
aaaacugauuuuuuuuuccuuc

SEQ ID NO: 1212414 - RNA, 18 nt, Human
aaaacugauuuuuuuuuc

SEQ ID NO: 1212415 - RNA, 21 nt, Human
aaaacguggcugcuucaagga

SEQ ID NO: 1212416 - RNA, 18 nt, Human
aaacaagaccacguuucu

SEQ ID NO: 1212417 - RNA, 21 nt, Human
aaaauggacguguuaugacuc

SEQ ID NO: 1212418 - RNA, 21 nt, Human
aaaauguaggguuauaauaau

SEQ ID NO: 1212419 - RNA, 22 nt, Human
aaacaugcuacacacugcaugu

SEQ ID NO: 1212420 - RNA, 23 nt, Human
ggggcccugccuccuuugugagg

SEQ ID NO: 1212421 - RNA, 19 nt, Human
ggggcccugccuccuuugu

SEQ ID NO: 1212422 - RNA, 16 nt, Human
ggggcccugccuccuu

SEQ ID NO: 1212423 - RNA, 19 nt, Human
ggggccaguuggucccccu

SEQ ID NO: 1212424 - RNA, 17 nt, Human
ggggccaguuggucccc

SEQ ID NO: 1212425 - RNA, 17 nt, Human
ggggaccucaggccugg

SEQ ID NO: 1212426 - RNA, 16 nt, Human
ggggaccucaggccug

SEQ ID NO: 1212427 - RNA, 15 nt, Human
ggggaccucaggccu

SEQ ID NO: 1212428 - RNA, 20 nt, Human
ggguaucaggugcugccauc

SEQ ID NO: 1212429 - RNA, 12 nt, Human
gggucucacucu

SEQ ID NO: 1212430 - RNA, 23 nt, Human
gggucucacuauguugcccaggc

SEQ ID NO: 1212431 - RNA, 22 nt, Human
gggucucacuauguugcccagg

SEQ ID NO: 1212432 - RNA, 20 nt, Human
aaacguggcugcuucaagga

SEQ ID NO: 1212433 - RNA, 17 nt, Human
aaacguggcugcuucaa

SEQ ID NO: 1212434 - RNA, 16 nt, Human
aaacguggcugcuuca

SEQ ID NO: 1212435 - RNA, 16 nt, Human
aaacuggauuaaacuu

SEQ ID NO: 1212436 - RNA, 14 nt, Human
aaagaugcuucuca

SEQ ID NO: 1212437 - RNA, 15 nt, Human
aaagaugagugagca

SEQ ID NO: 1212438 - RNA, 18 nt, Human
aaagaggcuaugugagca

SEQ ID NO: 1212439 - RNA, 13 nt, Human
aaagaggcuaugu

SEQ ID NO: 1212440 - RNA, 19 nt, Human
aaagacuuuuccaacccuc

SEQ ID NO: 1212441 - RNA, 15 nt, Human
aaagacuguacaaag

SEQ ID NO: 1212442 - RNA, 17 nt, Human
aaacuuuaccuuuuuua

SEQ ID NO: 1212443 - RNA, 14 nt, Human
aaacuuuaccuuuu

SEQ ID NO: 1212444 - RNA, 14 nt, Human
ggucccaccccaca

SEQ ID NO: 1212445 - RNA, 12 nt, Human
ggucccacccca

SEQ ID NO: 1212446 - RNA, 22 nt, Human
gguccacccaggagccccgagg

SEQ ID NO: 1212447 - RNA, 20 nt, Human
gguccacccaggagccccga

SEQ ID NO: 1212448 - RNA, 23 nt, Human
gguauuggcuagagguucaaaga

SEQ ID NO: 1212449 - RNA, 22 nt, Human
ggugcacaagcuccaagcuccc

SEQ ID NO: 1212450 - RNA, 22 nt, Human
ggucuugaacuccuggccucaa

SEQ ID NO: 1212451 - RNA, 19 nt, Human
ggucuguucuuuccaaagu

SEQ ID NO: 1212452 - RNA, 17 nt, Human
ggucuguucuuuccaaa

SEQ ID NO: 1212453 - RNA, 12 nt, Human
ggucuguucuuu

SEQ ID NO: 1212454 - RNA, 17 nt, Human
aaagcagugcaugcugu

SEQ ID NO: 1212455 - RNA, 18 nt, Human
aaagcuaggccuggccag

SEQ ID NO: 1212456 - RNA, 22 nt, Human
aaagcagugcaugcugucccuu

SEQ ID NO: 1212457 - RNA, 21 nt, Human
aaagcagugcaugcugucccu

SEQ ID NO: 1212458 - RNA, 15 nt, Human
aaagcuuguuaagau

SEQ ID NO: 1212459 - RNA, 22 nt, Human
aaaggaaagagggagguaagga

SEQ ID NO: 1212460 - RNA, 11 nt, Human
aaaggaaagag

SEQ ID NO: 1212461 - RNA, 13 nt, Human
gccuccuccagcc

SEQ ID NO: 1212462 - RNA, 14 nt, Human
gccucugggacugg

SEQ ID NO: 1212463 - RNA, 12 nt, Human
gccucugggacu

SEQ ID NO: 1212464 - RNA, 13 nt, Human
gccuccugugugu

SEQ ID NO: 1212465 - RNA, 20 nt, Human
gccugcccaggccccugcca

SEQ ID NO: 1212466 - RNA, 19 nt, Human
gccugcccaggccccugcc

SEQ ID NO: 1212467 - RNA, 18 nt, Human
gccugcccaggccccugc

SEQ ID NO: 1212468 - RNA, 23 nt, Human
gccucuucucuacucuagggaaa

SEQ ID NO: 1212469 - RNA, 12 nt, Human
gccucuucucua

SEQ ID NO: 1212470 - RNA, 17 nt, Human
gccuggccccucagggu

SEQ ID NO: 1212471 - RNA, 16 nt, Human
gccuggccccucaggg

SEQ ID NO: 1212472 - RNA, 15 nt, Human
gccuggccccucagg

SEQ ID NO: 1212473 - RNA, 21 nt, Human
gccugggaucccucauccuca

SEQ ID NO: 1212474 - RNA, 18 nt, Human
gccugggaucccucaucc

SEQ ID NO: 1212475 - RNA, 14 nt, Human
gccugggaucccuc

SEQ ID NO: 1212476 - RNA, 22 nt, Human
gccugggaggucaaggcugcag

SEQ ID NO: 1212477 - RNA, 21 nt, Human
gccugggaggucaaggcugca

SEQ ID NO: 1212478 - RNA, 10 nt, Human
gccuggccug

SEQ ID NO: 1212479 - RNA, 22 nt, Human
gccuggccccucagggucccug

SEQ ID NO: 1212480 - RNA, 20 nt, Human
gccuggccccucaggguccc

SEQ ID NO: 1212481 - RNA, 16 nt, Human
gccugccucuucucua

SEQ ID NO: 1212482 - RNA, 19 nt, Human
gcccacucccugcaaccug

SEQ ID NO: 1212483 - RNA, 15 nt, Human
gcccacucccugcaa

SEQ ID NO: 1212484 - RNA, 14 nt, Human
gcccacucccugca

SEQ ID NO: 1212485 - RNA, 13 nt, Human
gcccacucccugc

SEQ ID NO: 1212486 - RNA, 22 nt, Human
gcccuaaaguguauuuuuuuac

SEQ ID NO: 1212487 - RNA, 22 nt, Human
gccccuggaugcagccucacag

SEQ ID NO: 1212488 - RNA, 18 nt, Human
gccccuggaugcagccuc

SEQ ID NO: 1212489 - RNA, 16 nt, Human
gccccuggaugcagcc

SEQ ID NO: 1212490 - RNA, 15 nt, Human
gccccugcccggcug

SEQ ID NO: 1212491 - RNA, 19 nt, Human
gccccaaaacucuccucug

SEQ ID NO: 1212492 - RNA, 18 nt, Human
gccccaaaacucuccucu

SEQ ID NO: 1212493 - RNA, 14 nt, Human
gccccugcccggcu

SEQ ID NO: 1212494 - RNA, 13 nt, Human
gccccugcccggc

SEQ ID NO: 1212495 - RNA, 16 nt, Human
gccgccaugcuccugg

SEQ ID NO: 1212496 - RNA, 15 nt, Human
gccgccaugcuccug

SEQ ID NO: 1212497 - RNA, 21 nt, Human
gcccuuaccugccaggaagcc

SEQ ID NO: 1212498 - RNA, 20 nt, Human
gcccuuaccugccaggaagc

SEQ ID NO: 1212499 - RNA, 16 nt, Human
gcccuuaccugccagg

SEQ ID NO: 1212500 - RNA, 22 nt, Human
gcccugccuccuuugugaggaa

SEQ ID NO: 1212501 - RNA, 16 nt, Human
gcccugccuccuuugu

SEQ ID NO: 1212502 - RNA, 20 nt, Human
gccacauuccugaugcuucu

SEQ ID NO: 1212503 - RNA, 16 nt, Human
gccacauuccugaugc

SEQ ID NO: 1212504 - RNA, 21 nt, Human
gccaccaacauacucccaucu

SEQ ID NO: 1212505 - RNA, 20 nt, Human
gccaccaacauacucccauc

SEQ ID NO: 1212506 - RNA, 19 nt, Human
gccaccaacauacucccau

SEQ ID NO: 1212507 - RNA, 22 nt, Human
gccaccaacauacucccaucug

SEQ ID NO: 1212508 - RNA, 23 nt, Human
gccacugcaccgggccacagaga

SEQ ID NO: 1212509 - RNA, 19 nt, Human
gccacccuggggagaaagu

SEQ ID NO: 1212510 - RNA, 13 nt, Human
gccacccugggga

SEQ ID NO: 1212511 - RNA, 21 nt, Human
gccacugcacuauagccuagg

SEQ ID NO: 1212512 - RNA, 19 nt, Human
gccacugugaagagaacca

SEQ ID NO: 1212513 - RNA, 18 nt, Human
gccacugugaagagaacc

SEQ ID NO: 1212514 - RNA, 13 nt, Human
gccaggccagagg

SEQ ID NO: 1212515 - RNA, 17 nt, Human
gccaggcccucugccca

SEQ ID NO: 1212516 - RNA, 16 nt, Human
gccaggcccucugccc

SEQ ID NO: 1212517 - RNA, 21 nt, Human
gccaggcccucugcccacucc

SEQ ID NO: 1212518 - RNA, 20 nt, Human
gccaggcccucugcccacuc

SEQ ID NO: 1212519 - RNA, 19 nt, Human
gccaggcccucugcccacu

SEQ ID NO: 1212520 - RNA, 12 nt, Human
gccaggccagag

SEQ ID NO: 1212521 - RNA, 23 nt, Human
gccagcaggcucucaggccagcu

SEQ ID NO: 1212522 - RNA, 21 nt, Human
gccagcaggcucucaggccag

SEQ ID NO: 1212523 - RNA, 20 nt, Human
gccagcaggcucucaggcca

SEQ ID NO: 1212524 - RNA, 19 nt, Human
gccagcaggcucucaggcc

SEQ ID NO: 1212525 - RNA, 18 nt, Human
gccagcaggcucucaggc

SEQ ID NO: 1212526 - RNA, 17 nt, Human
gccagcaggcucucagg

SEQ ID NO: 1212527 - RNA, 16 nt, Human
gccagcaggcucucag

SEQ ID NO: 1212528 - RNA, 13 nt, Human
gccagcaggcucu

SEQ ID NO: 1212529 - RNA, 20 nt, Human
gccauauucuguuggccagu

SEQ ID NO: 1212530 - RNA, 19 nt, Human
gccauauucuguuggccag

SEQ ID NO: 1212531 - RNA, 18 nt, Human
gccauguuggccaggcug

SEQ ID NO: 1212532 - RNA, 17 nt, Human
gccauguuggccaggcu

SEQ ID NO: 1212533 - RNA, 16 nt, Human
gccauguuggccaggc

SEQ ID NO: 1212534 - RNA, 15 nt, Human
gccauguuggccagg

SEQ ID NO: 1212535 - RNA, 14 nt, Human
gccauguuggccag

SEQ ID NO: 1212536 - RNA, 18 nt, Human
gcccaccuuggcucaagu

SEQ ID NO: 1212537 - RNA, 14 nt, Human
gcccacgcccccac

SEQ ID NO: 1212538 - RNA, 13 nt, Human
gcccacgccccca

SEQ ID NO: 1212539 - RNA, 17 nt, Human
gcccacgcuggagugca

SEQ ID NO: 1212540 - RNA, 16 nt, Human
gcccacgcuggagugc

SEQ ID NO: 1212541 - RNA, 15 nt, Human
gcccacgcuggagug

SEQ ID NO: 1212542 - RNA, 15 nt, Human
gcccacgcccccacu

SEQ ID NO: 1212543 - RNA, 24 nt, Human
gccauguuggccaggcuggucuca

SEQ ID NO: 1212544 - RNA, 22 nt, Human
gccauguuggccaggcuggucu

SEQ ID NO: 1212545 - RNA, 20 nt, Human
gccauguuggccaggcuggu

SEQ ID NO: 1212546 - RNA, 19 nt, Human
gccauguuggccaggcugg

SEQ ID NO: 1212547 - RNA, 19 nt, Human
gcugccugggaucccucau

SEQ ID NO: 1212548 - RNA, 18 nt, Human
gcugccugggaucccuca

SEQ ID NO: 1212549 - RNA, 16 nt, Human
gcugccugggaucccu

SEQ ID NO: 1212550 - RNA, 13 nt, Human
gcugccugggauc

SEQ ID NO: 1212551 - RNA, 18 nt, Human
gcugagggugagugggug

SEQ ID NO: 1212552 - RNA, 23 nt, Human
gcugccauccagguucagcuugu

SEQ ID NO: 1212553 - RNA, 21 nt, Human
gcugccauccagguucagcuu

SEQ ID NO: 1212554 - RNA, 21 nt, Human
gcugccagccgagauagccaa

SEQ ID NO: 1212555 - RNA, 19 nt, Human
gcugccagccgagauagcc

SEQ ID NO: 1212556 - RNA, 22 nt, Human
gcugcaccggcuggccuggccc

SEQ ID NO: 1212557 - RNA, 19 nt, Human
gcugcaccggcuggccugg

SEQ ID NO: 1212558 - RNA, 18 nt, Human
gcugcaccggcuggccug

SEQ ID NO: 1212559 - RNA, 17 nt, Human
gcugcaccggcuggccu

SEQ ID NO: 1212560 - RNA, 16 nt, Human
gcugcaccggcuggcc

SEQ ID NO: 1212561 - RNA, 12 nt, Human
gcuggagugcag

SEQ ID NO: 1212562 - RNA, 15 nt, Human
gcuggguguggcgca

SEQ ID NO: 1212563 - RNA, 21 nt, Human
gcugggcucccuucccaccuc

SEQ ID NO: 1212564 - RNA, 14 nt, Human
gcugggcagguugg

SEQ ID NO: 1212565 - RNA, 20 nt, Human
gcugggcucccuucccaccu

SEQ ID NO: 1212566 - RNA, 17 nt, Human
gcugggcucccuuccca

SEQ ID NO: 1212567 - RNA, 16 nt, Human
gcugggcucccuuccc

SEQ ID NO: 1212568 - RNA, 19 nt, Human
gcugggcagaggaaagcaa

SEQ ID NO: 1212569 - RNA, 17 nt, Human
gcugggcagaggaaagc

SEQ ID NO: 1212570 - RNA, 16 nt, Human
gcugggcagaggaaag

SEQ ID NO: 1212571 - RNA, 15 nt, Human
gcugggcagaggaaa

SEQ ID NO: 1212572 - RNA, 14 nt, Human
gcugggcagaggaa

SEQ ID NO: 1212573 - RNA, 13 nt, Human
gcugggcagagga

SEQ ID NO: 1212574 - RNA, 19 nt, Human
gcugggauuacagguguga

SEQ ID NO: 1212575 - RNA, 18 nt, Human
gcugggauuacaggugug

SEQ ID NO: 1212576 - RNA, 17 nt, Human
gcuggccuggccccuca

SEQ ID NO: 1212577 - RNA, 17 nt, Human
gcuggagugcagugagc

SEQ ID NO: 1212578 - RNA, 15 nt, Human
gcuggagugcaguga

SEQ ID NO: 1212579 - RNA, 14 nt, Human
gcuggagugcagug

SEQ ID NO: 1212580 - RNA, 19 nt, Human
gcuggccuggccccucagg

SEQ ID NO: 1212581 - RNA, 18 nt, Human
gcuggccuggccccucag

SEQ ID NO: 1212582 - RNA, 16 nt, Human
gcugggauuacaggug

SEQ ID NO: 1212583 - RNA, 16 nt, Human
gcuuguacauaaugcg

SEQ ID NO: 1212584 - RNA, 14 nt, Human
gcuuguacauaaug

SEQ ID NO: 1212585 - RNA, 19 nt, Human
gcuugggcuucauccuccu

SEQ ID NO: 1212586 - RNA, 17 nt, Human
gcuggguucuacccagg

SEQ ID NO: 1212587 - RNA, 21 nt, Human
gcuggguuggaggguguccca

SEQ ID NO: 1212588 - RNA, 14 nt, Human
gcuggguuggaggg

SEQ ID NO: 1212589 - RNA, 15 nt, Human
gcuggguucugaucc

SEQ ID NO: 1212590 - RNA, 15 nt, Human
gcuggguucuaccca

SEQ ID NO: 1212591 - RNA, 23 nt, Human
gcuguaucccaugagccucagca

SEQ ID NO: 1212592 - RNA, 20 nt, Human
gcuguaucccaugagccuca

SEQ ID NO: 1212593 - RNA, 20 nt, Human
gcuucacggaagagccuugc

SEQ ID NO: 1212594 - RNA, 15 nt, Human
gcuucacggaagagc

SEQ ID NO: 1212595 - RNA, 14 nt, Human
gcuuaacuucacau

SEQ ID NO: 1212596 - RNA, 22 nt, Human
gcuucaaggauccugagccaga

SEQ ID NO: 1212597 - RNA, 22 nt, Human
gcuguuggcugggggccucagu

SEQ ID NO: 1212598 - RNA, 21 nt, Human
gcuguuggcugggggccucag

SEQ ID NO: 1212599 - RNA, 22 nt, Human
gcugugcugcccugcccaccug

SEQ ID NO: 1212600 - RNA, 19 nt, Human
gcugugcugcccugcccac

SEQ ID NO: 1212601 - RNA, 14 nt, Human
gcugugcugcccug

SEQ ID NO: 1212602 - RNA, 13 nt, Human
gcugugcugcccu

SEQ ID NO: 1212603 - RNA, 12 nt, Human
gcugugcugccc

SEQ ID NO: 1212604 - RNA, 21 nt, Human
gcugugcucuggacaggcaug

SEQ ID NO: 1212605 - RNA, 16 nt, Human
gcucucaggccagcug

SEQ ID NO: 1212606 - RNA, 15 nt, Human
gcucucaggccagcu

SEQ ID NO: 1212607 - RNA, 14 nt, Human
gcucucaggccagc

SEQ ID NO: 1212608 - RNA, 13 nt, Human
gcucucaggccag

SEQ ID NO: 1212609 - RNA, 14 nt, Human
gcuccccagcccca

SEQ ID NO: 1212610 - RNA, 23 nt, Human
gcucccaggcauuccccaggagg

SEQ ID NO: 1212611 - RNA, 22 nt, Human
gcucccaggcauuccccaggag

SEQ ID NO: 1212612 - RNA, 21 nt, Human
gcucccaggcauuccccagga

SEQ ID NO: 1212613 - RNA, 20 nt, Human
gcucccaggcauuccccagg

SEQ ID NO: 1212614 - RNA, 17 nt, Human
gcugacagacacaggcc

SEQ ID NO: 1212615 - RNA, 16 nt, Human
gcugacagacacaggc

SEQ ID NO: 1212616 - RNA, 15 nt, Human
gcugacagacacagg

SEQ ID NO: 1212617 - RNA, 14 nt, Human
gcugacagacacag

SEQ ID NO: 1212618 - RNA, 17 nt, Human
gcugaaugguuuucaaa

SEQ ID NO: 1212619 - RNA, 23 nt, Human
gcugaaggcucgagcaugccugg

SEQ ID NO: 1212620 - RNA, 20 nt, Human
gcugaaggcucgagcaugcc

SEQ ID NO: 1212621 - RNA, 12 nt, Human
gcugaaggcucg

SEQ ID NO: 1212622 - RNA, 18 nt, Human
gcucuuccaggcugggag

SEQ ID NO: 1212623 - RNA, 16 nt, Human
gcucuuccaggcuggg

SEQ ID NO: 1212624 - RNA, 15 nt, Human
gcucuuccaggcugg

SEQ ID NO: 1212625 - RNA, 12 nt, Human
gcucuuccaggc

SEQ ID NO: 1212626 - RNA, 15 nt, Human
gcucuguccugggag

SEQ ID NO: 1212627 - RNA, 16 nt, Human
gcucuguccugggagu

SEQ ID NO: 1212628 - RNA, 22 nt, Human
gcucagguggggucacucuggc

SEQ ID NO: 1212629 - RNA, 21 nt, Human
gcucagguggggucacucugg

SEQ ID NO: 1212630 - RNA, 23 nt, Human
gcucagguggggucacucuggca

SEQ ID NO: 1212631 - RNA, 17 nt, Human
gcucagggccuggcuca

SEQ ID NO: 1212632 - RNA, 16 nt, Human
gcucagggccuggcuc

SEQ ID NO: 1212633 - RNA, 13 nt, Human
gcucagggccugg

SEQ ID NO: 1212634 - RNA, 12 nt, Human
gcucagggccug

SEQ ID NO: 1212635 - RNA, 22 nt, Human
gcucagagagggugggaguggg

SEQ ID NO: 1212636 - RNA, 20 nt, Human
gcucagagagggugggagug

SEQ ID NO: 1212637 - RNA, 18 nt, Human
gcucagagagggugggag

SEQ ID NO: 1212638 - RNA, 15 nt, Human
gcucagagagggugg

SEQ ID NO: 1212639 - RNA, 14 nt, Human
gccuguucagcucc

SEQ ID NO: 1212640 - RNA, 20 nt, Human
gccuguucagcuccagcuca

SEQ ID NO: 1212641 - RNA, 19 nt, Human
gccuguucagcuccagcuc

SEQ ID NO: 1212642 - RNA, 21 nt, Human
gcuaggaacacuccuucacag

SEQ ID NO: 1212643 - RNA, 19 nt, Human
gcuaggaacacuccuucac

SEQ ID NO: 1212644 - RNA, 18 nt, Human
gcuaggaacacuccuuca

SEQ ID NO: 1212645 - RNA, 15 nt, Human
gcuaggccuggccag

SEQ ID NO: 1212646 - RNA, 14 nt, Human
gcuaggccuggcca

SEQ ID NO: 1212647 - RNA, 18 nt, Human
gauucuccugccucagcc

SEQ ID NO: 1212648 - RNA, 17 nt, Human
gauucuccugccucagc

SEQ ID NO: 1212649 - RNA, 15 nt, Human
gauucuccugccuca

SEQ ID NO: 1212650 - RNA, 12 nt, Human
gauucuucugcu

SEQ ID NO: 1212651 - RNA, 18 nt, Human
gauucuuccucccucccu

SEQ ID NO: 1212652 - RNA, 17 nt, Human
gauucuuccucccuccc

SEQ ID NO: 1212653 - RNA, 12 nt, Human
gauuauuggaaa

SEQ ID NO: 1212654 - RNA, 21 nt, Human
gaugaucuaggaagacuuugg

SEQ ID NO: 1212655 - RNA, 15 nt, Human
gaugaucuaggaaga

SEQ ID NO: 1212656 - RNA, 16 nt, Human
gaugagugagcaugcc

SEQ ID NO: 1212657 - RNA, 14 nt, Human
gaugaucuuugcag

SEQ ID NO: 1212658 - RNA, 14 nt, Human
gcacaccgggcacu

SEQ ID NO: 1212659 - RNA, 20 nt, Human
gcacaccgggcacucagaag

SEQ ID NO: 1212660 - RNA, 16 nt, Human
gauuuuuuuuuccuuc

SEQ ID NO: 1212661 - RNA, 22 nt, Human
gcacuccccugcuggguguggc

SEQ ID NO: 1212662 - RNA, 17 nt, Human
gcacuccccugcugggu

SEQ ID NO: 1212663 - RNA, 17 nt, Human
gcacucagaagacacug

SEQ ID NO: 1212664 - RNA, 16 nt, Human
gcacucagaagacacu

SEQ ID NO: 1212665 - RNA, 13 nt, Human
gcacucagaagac

SEQ ID NO: 1212666 - RNA, 23 nt, Human
gcaccgggccacagagaaaguac

SEQ ID NO: 1212667 - RNA, 23 nt, Human
gcacaucagcacgauuucuguuu

SEQ ID NO: 1212668 - RNA, 22 nt, Human
gcacaucagcacgauuucuguu

SEQ ID NO: 1212669 - RNA, 14 nt, Human
gcaccgggccacag

SEQ ID NO: 1212670 - RNA, 23 nt, Human
gaggugaccccagguuucuaugu

SEQ ID NO: 1212671 - RNA, 15 nt, Human
gaggucgaggcagga

SEQ ID NO: 1212672 - RNA, 22 nt, Human
gagucagaaguuucugccgcag

SEQ ID NO: 1212673 - RNA, 18 nt, Human
gagugacagaggcagccc

SEQ ID NO: 1212674 - RNA, 13 nt, Human
gagucccaccuug

SEQ ID NO: 1212675 - RNA, 12 nt, Human
gagucccaccuu

SEQ ID NO: 1212676 - RNA, 16 nt, Human
gagucaccaagcccag

SEQ ID NO: 1212677 - RNA, 17 nt, Human
gagucaccaagcccagu

SEQ ID NO: 1212678 - RNA, 17 nt, Human
gaguugauucagcucug

SEQ ID NO: 1212679 - RNA, 16 nt, Human
gaguugauucagcucu

SEQ ID NO: 1212680 - RNA, 15 nt, Human
gaguugauucagcuc

SEQ ID NO: 1212681 - RNA, 20 nt, Human
gagugacagaggcagcccca

SEQ ID NO: 1212682 - RNA, 18 nt, Human
gaguugauucagcucugc

SEQ ID NO: 1212683 - RNA, 20 nt, Human
gagccuuccaggggugggac

SEQ ID NO: 1212684 - RNA, 19 nt, Human
gagccuugaacuuugaccu

SEQ ID NO: 1212685 - RNA, 13 nt, Human
gagccuugaacuu

SEQ ID NO: 1212686 - RNA, 23 nt, Human
gagccuuccaggggugggacacc

SEQ ID NO: 1212687 - RNA, 14 nt, Human
gaggcagggucuca

SEQ ID NO: 1212688 - RNA, 18 nt, Human
gaggcagggucucacucu

SEQ ID NO: 1212689 - RNA, 15 nt, Human
gaggcagggucucac

SEQ ID NO: 1212690 - RNA, 22 nt, Human
gaggccaaggugggaggauugc

SEQ ID NO: 1212691 - RNA, 22 nt, Human
gaggcuagugugguguuuccug

SEQ ID NO: 1212692 - RNA, 19 nt, Human
gaggccagagacacaagcc

SEQ ID NO: 1212693 - RNA, 14 nt, Human
gaggccagagacac

SEQ ID NO: 1212694 - RNA, 13 nt, Human
gaggccagagaca

SEQ ID NO: 1212695 - RNA, 12 nt, Human
gaggggccucuu

SEQ ID NO: 1212696 - RNA, 19 nt, Human
gacgcuacccgggaagggg

SEQ ID NO: 1212697 - RNA, 18 nt, Human
gacgcuacccgggaaggg

SEQ ID NO: 1212698 - RNA, 16 nt, Human
gacgcuacccgggaag

SEQ ID NO: 1212699 - RNA, 19 nt, Human
gacgccaucccagccccaa

SEQ ID NO: 1212700 - RNA, 18 nt, Human
gacgccaucccagcccca

SEQ ID NO: 1212701 - RNA, 17 nt, Human
gacgccaucccagcccc

SEQ ID NO: 1212702 - RNA, 16 nt, Human
gacgccaucccagccc

SEQ ID NO: 1212703 - RNA, 14 nt, Human
gaccugaggcccuu

SEQ ID NO: 1212704 - RNA, 13 nt, Human
gaccugaggcccu

SEQ ID NO: 1212705 - RNA, 11 nt, Human
gaccugaggcc

SEQ ID NO: 1212706 - RNA, 14 nt, Human
gaccucugcagcaa

SEQ ID NO: 1212707 - RNA, 14 nt, Human
gaccaucccugaag

SEQ ID NO: 1212708 - RNA, 20 nt, Human
gaccaucccugaaggccccg

SEQ ID NO: 1212709 - RNA, 16 nt, Human
gacugaauuucuuuug

SEQ ID NO: 1212710 - RNA, 14 nt, Human
gacugaauuucuuu

SEQ ID NO: 1212711 - RNA, 16 nt, Human
gacacagcucuucucc

SEQ ID NO: 1212712 - RNA, 14 nt, Human
gacacagcucuucu

SEQ ID NO: 1212713 - RNA, 12 nt, Human
gacacaggcccg

SEQ ID NO: 1212714 - RNA, 23 nt, Human
gacacagcucuucuccaggcugu

SEQ ID NO: 1212715 - RNA, 22 nt, Human
gacacagcucuucuccaggcug

SEQ ID NO: 1212716 - RNA, 17 nt, Human
gacacagcucuucucca

SEQ ID NO: 1212717 - RNA, 17 nt, Human
gacagcccgggcucugc

SEQ ID NO: 1212718 - RNA, 18 nt, Human
gaccagggauuuccauga

SEQ ID NO: 1212719 - RNA, 19 nt, Human
gaccaucccugaaggcccc

SEQ ID NO: 1212720 - RNA, 13 nt, Human
gaccaucccugaa

SEQ ID NO: 1212721 - RNA, 12 nt, Human
gaccaucccuga

SEQ ID NO: 1212722 - RNA, 20 nt, Human
gaccagggauuuccaugaug

SEQ ID NO: 1212723 - RNA, 19 nt, Human
gacauuguuggccaaagcc

SEQ ID NO: 1212724 - RNA, 17 nt, Human
gacauugcggacagcca

SEQ ID NO: 1212725 - RNA, 15 nt, Human
gacauugcggacagc

SEQ ID NO: 1212726 - RNA, 14 nt, Human
gacauugcggacag

SEQ ID NO: 1212727 - RNA, 19 nt, Human
gacagcccgggcucugccu

SEQ ID NO: 1212728 - RNA, 18 nt, Human
gacagcccgggcucugcc

SEQ ID NO: 1212729 - RNA, 20 nt, Human
gacagcccgggcucugccuc

SEQ ID NO: 1212730 - RNA, 22 nt, Human
gaaggcuggguucugauccuag

SEQ ID NO: 1212731 - RNA, 20 nt, Human
gaaggcuggguucugauccu

SEQ ID NO: 1212732 - RNA, 19 nt, Human
gaaggcuggguucugaucc

SEQ ID NO: 1212733 - RNA, 15 nt, Human
gaaggcuggguucug

SEQ ID NO: 1212734 - RNA, 21 nt, Human
gaaggcucgagcaugccugga

SEQ ID NO: 1212735 - RNA, 19 nt, Human
gaaggccccgcccaggcuu

SEQ ID NO: 1212736 - RNA, 18 nt, Human
gaaggccccgcccaggcu

SEQ ID NO: 1212737 - RNA, 22 nt, Human
gaagcuccgcuuucuacccagc

SEQ ID NO: 1212738 - RNA, 22 nt, Human
gaaggggagauaaggguaucug

SEQ ID NO: 1212739 - RNA, 20 nt, Human
gaauauugcugauggugcaa

SEQ ID NO: 1212740 - RNA, 19 nt, Human
gaauauugcugauggugca

SEQ ID NO: 1212741 - RNA, 15 nt, Human
gaauauugcugaugg

SEQ ID NO: 1212742 - RNA, 14 nt, Human
gaauauugcugaug

SEQ ID NO: 1212743 - RNA, 15 nt, Human
gaagcagaggaagga

SEQ ID NO: 1212744 - RNA, 21 nt, Human
gaagcacaugccucucucagg

SEQ ID NO: 1212745 - RNA, 20 nt, Human
gaagcacaugccucucucag

SEQ ID NO: 1212746 - RNA, 17 nt, Human
gaagcacaugccucucu

SEQ ID NO: 1212747 - RNA, 15 nt, Human
gaagcacaugccucu

SEQ ID NO: 1212748 - RNA, 23 nt, Human
gaagacaaugugaaaagaaaaau

SEQ ID NO: 1212749 - RNA, 22 nt, Human
gaagacaaugacuuacuguaca

SEQ ID NO: 1212750 - RNA, 16 nt, Human
gaagacaaugacuuac

SEQ ID NO: 1212751 - RNA, 12 nt, Human
gaacuggcugca

SEQ ID NO: 1212752 - RNA, 11 nt, Human
gaacuggcugc

SEQ ID NO: 1212753 - RNA, 21 nt, Human
cuucuucagagacuccugcag

SEQ ID NO: 1212754 - RNA, 20 nt, Human
cuucuucagagacuccugca

SEQ ID NO: 1212755 - RNA, 23 nt, Human
cuucuucagagacuccugcaggc

SEQ ID NO: 1212756 - RNA, 22 nt, Human
cuucuucagagacuccugcagg

SEQ ID NO: 1212757 - RNA, 20 nt, Human
cuugaaugaugccaugagga

SEQ ID NO: 1212758 - RNA, 13 nt, Human
cuugcucugcuga

SEQ ID NO: 1212759 - RNA, 12 nt, Human
cuugcucugcug

SEQ ID NO: 1212760 - RNA, 23 nt, Human
cuugccgucuaccugaggggccu

SEQ ID NO: 1212761 - RNA, 20 nt, Human
cuugccgucuaccugagggg

SEQ ID NO: 1212762 - RNA, 12 nt, Human
cuugacagggca

SEQ ID NO: 1212763 - RNA, 23 nt, Human
cuugaaugaugccaugaggaaca

SEQ ID NO: 1212764 - RNA, 23 nt, Human
cuuucaauaggaaaaacugauuu

SEQ ID NO: 1212765 - RNA, 22 nt, Human
cuuucaauaggaaaaacugauu

SEQ ID NO: 1212766 - RNA, 21 nt, Human
cuuucaauaggaaaaacugau

SEQ ID NO: 1212767 - RNA, 20 nt, Human
cuuucaauaggaaaaacuga

SEQ ID NO: 1212768 - RNA, 16 nt, Human
cuuguggacacagcuc

SEQ ID NO: 1212769 - RNA, 15 nt, Human
cuuguggacacagcu

SEQ ID NO: 1212770 - RNA, 14 nt, Human
cuuguggacacagc

SEQ ID NO: 1212771 - RNA, 15 nt, Human
cuuuucaaaacauuu

SEQ ID NO: 1212772 - RNA, 20 nt, Human
cuuuggucuacacugugcug

SEQ ID NO: 1212773 - RNA, 16 nt, Human
cuuuggucuacacugu

SEQ ID NO: 1212774 - RNA, 15 nt, Human
cuuuuauaaacuuua

SEQ ID NO: 1212775 - RNA, 18 nt, Human
cuuuuauaaacuuuaccu

SEQ ID NO: 1212776 - RNA, 16 nt, Human
cuuuuauaaacuuuac

SEQ ID NO: 1212777 - RNA, 19 nt, Human
cuuuuauaaacuuuaccuu

SEQ ID NO: 1212778 - RNA, 22 nt, Human
cuuugacgccaucccagcccca

SEQ ID NO: 1212779 - RNA, 21 nt, Human
cuuugacgccaucccagcccc

SEQ ID NO: 1212780 - RNA, 19 nt, Human
cuuugacgccaucccagcc

SEQ ID NO: 1212781 - RNA, 14 nt, Human
cuguucagcuccag

SEQ ID NO: 1212782 - RNA, 13 nt, Human
cuguucagcucca

SEQ ID NO: 1212783 - RNA, 19 nt, Human
cugugucuugcaauggcag

SEQ ID NO: 1212784 - RNA, 16 nt, Human
cugugucuugcaaugg

SEQ ID NO: 1212785 - RNA, 20 nt, Human
cugugucuugcaauggcagc

SEQ ID NO: 1212786 - RNA, 14 nt, Human
cugugucuugcaau

SEQ ID NO: 1212787 - RNA, 19 nt, Human
cugugucucccuucauccu

SEQ ID NO: 1212788 - RNA, 14 nt, Human
cugugucucccuuc

SEQ ID NO: 1212789 - RNA, 22 nt, Human
cugugucagguggggcagcuug

SEQ ID NO: 1212790 - RNA, 21 nt, Human
cugugucagguggggcagcuu

SEQ ID NO: 1212791 - RNA, 19 nt, Human
cugugucagguggggcagc

SEQ ID NO: 1212792 - RNA, 20 nt, Human
cugugucagcauagaaguaa

SEQ ID NO: 1212793 - RNA, 11 nt, Human
cugugcugccc

SEQ ID NO: 1212794 - RNA, 22 nt, Human
cugugcugagucugaaggcugg

SEQ ID NO: 1212795 - RNA, 20 nt, Human
cugugcugagucugaaggcu

SEQ ID NO: 1212796 - RNA, 13 nt, Human
cuuaccugccagg

SEQ ID NO: 1212797 - RNA, 21 nt, Human
cuuaccucggugccuuccucu

SEQ ID NO: 1212798 - RNA, 19 nt, Human
cuuaccucggugccuuccu

SEQ ID NO: 1212799 - RNA, 19 nt, Human
cuuacccucauguucuuaa

SEQ ID NO: 1212800 - RNA, 18 nt, Human
cuuacccucauguucuua

SEQ ID NO: 1212801 - RNA, 17 nt, Human
cuuacccucauguucuu

SEQ ID NO: 1212802 - RNA, 13 nt, Human
cuuaccucggugc

SEQ ID NO: 1212803 - RNA, 20 nt, Human
cuguugggccaggagccucc

SEQ ID NO: 1212804 - RNA, 17 nt, Human
cuguugggccaggagcc

SEQ ID NO: 1212805 - RNA, 16 nt, Human
cuguugggccaggagc

SEQ ID NO: 1212806 - RNA, 20 nt, Human
cuuccagugaggcucugccc

SEQ ID NO: 1212807 - RNA, 19 nt, Human
cuuccagugaggcucugcc

SEQ ID NO: 1212808 - RNA, 18 nt, Human
cuuccagugaggcucugc

SEQ ID NO: 1212809 - RNA, 17 nt, Human
cuuccauggacuuuguu

SEQ ID NO: 1212810 - RNA, 16 nt, Human
cuuccauggacuuugu

SEQ ID NO: 1212811 - RNA, 22 nt, Human
cuucagagacuccugcaggcag

SEQ ID NO: 1212812 - RNA, 21 nt, Human
cuucagagacuccugcaggca

SEQ ID NO: 1212813 - RNA, 17 nt, Human
cuucagagacuccugca

SEQ ID NO: 1212814 - RNA, 16 nt, Human
cuucagagacuccugc

SEQ ID NO: 1212815 - RNA, 14 nt, Human
cuucaccuuugucc

SEQ ID NO: 1212816 - RNA, 18 nt, Human
cuuauugcccacgcugga

SEQ ID NO: 1212817 - RNA, 20 nt, Human
cuucaccuuuguccccaccg

SEQ ID NO: 1212818 - RNA, 17 nt, Human
cuucaccuuugucccca

SEQ ID NO: 1212819 - RNA, 16 nt, Human
cuucauccuccucaga

SEQ ID NO: 1212820 - RNA, 15 nt, Human
cuucauccuccucag

SEQ ID NO: 1212821 - RNA, 13 nt, Human
cuucaucccucug

SEQ ID NO: 1212822 - RNA, 24 nt, Human
cuucagagacuccugcaggcagcc

SEQ ID NO: 1212823 - RNA, 23 nt, Human
cuucagagacuccugcaggcagc

SEQ ID NO: 1212824 - RNA, 18 nt, Human
cuucaguggcagcugcuu

SEQ ID NO: 1212825 - RNA, 13 nt, Human
cuuauugcccacg

SEQ ID NO: 1212826 - RNA, 23 nt, Human
cuuaugggcuggguucuacccag

SEQ ID NO: 1212827 - RNA, 22 nt, Human
cuuaugggcuggguucuaccca

SEQ ID NO: 1212828 - RNA, 21 nt, Human
cuuaugggcuggguucuaccc

SEQ ID NO: 1212829 - RNA, 14 nt, Human
cuuaugggcugggu

SEQ ID NO: 1212830 - RNA, 21 nt, Human
cuuagcagggaaacagcuaau

SEQ ID NO: 1212831 - RNA, 18 nt, Human
cuuagcagggaaacagcu

SEQ ID NO: 1212832 - RNA, 17 nt, Human
cugcccuuaccugccag

SEQ ID NO: 1212833 - RNA, 16 nt, Human
cugcccuuaccugcca

SEQ ID NO: 1212834 - RNA, 12 nt, Human
cugcccuuaccu

SEQ ID NO: 1212835 - RNA, 19 nt, Human
cugccauccagguucagcu

SEQ ID NO: 1212836 - RNA, 18 nt, Human
cugccauccagguucagc

SEQ ID NO: 1212837 - RNA, 16 nt, Human
cugccauccagguuca

SEQ ID NO: 1212838 - RNA, 16 nt, Human
cugccauauucuguug

SEQ ID NO: 1212839 - RNA, 23 nt, Human
cugccagggacagaggggguggc

SEQ ID NO: 1212840 - RNA, 22 nt, Human
cugccagggacagagggggugg

SEQ ID NO: 1212841 - RNA, 20 nt, Human
cugccagggacagagggggu

SEQ ID NO: 1212842 - RNA, 18 nt, Human
cugcauuuaaaagauaca

SEQ ID NO: 1212843 - RNA, 17 nt, Human
cugcauuuaaaagauac

SEQ ID NO: 1212844 - RNA, 14 nt, Human
cugcauuuaaaaga

SEQ ID NO: 1212845 - RNA, 23 nt, Human
cugcaccgggccacagagaaagu

SEQ ID NO: 1212846 - RNA, 12 nt, Human
cugcaagggagu

SEQ ID NO: 1212847 - RNA, 20 nt, Human
cugcaagaauugaagcagga

SEQ ID NO: 1212848 - RNA, 20 nt, Human
cugcaaccuccgccucuugg

SEQ ID NO: 1212849 - RNA, 21 nt, Human
cugcaaccugauugugucucu

SEQ ID NO: 1212850 - RNA, 19 nt, Human
cugcaaccugauugugucu

SEQ ID NO: 1212851 - RNA, 14 nt, Human
cugcaaccugauug

SEQ ID NO: 1212852 - RNA, 22 nt, Human
cugcaaccuccgccucuugggu

SEQ ID NO: 1212853 - RNA, 18 nt, Human
cugcaagaauugaagcag

SEQ ID NO: 1212854 - RNA, 22 nt, Human
cugcaaccugauugugucucuu

SEQ ID NO: 1212855 - RNA, 14 nt, Human
cucuuaugggcugg

SEQ ID NO: 1212856 - RNA, 13 nt, Human
cucuuauugccca

SEQ ID NO: 1212857 - RNA, 15 nt, Human
cucuuaugggcuggg

SEQ ID NO: 1212858 - RNA, 17 nt, Human
cugaugcuucuucagag

SEQ ID NO: 1212859 - RNA, 16 nt, Human
cugaugcuucuucaga

SEQ ID NO: 1212860 - RNA, 21 nt, Human
cugaugggcaacccccagccu

SEQ ID NO: 1212861 - RNA, 18 nt, Human
cugaugggcaacccccag

SEQ ID NO: 1212862 - RNA, 20 nt, Human
cugaugcuucuucagagacu

SEQ ID NO: 1212863 - RNA, 19 nt, Human
cugaugcuucuucagagac

SEQ ID NO: 1212864 - RNA, 18 nt, Human
cugaugcuucuucagaga

SEQ ID NO: 1212865 - RNA, 24 nt, Human
cugaugggcaacccccagccugcu

SEQ ID NO: 1212866 - RNA, 23 nt, Human
cugaugggcaacccccagccugc

SEQ ID NO: 1212867 - RNA, 22 nt, Human
cugaugggcaacccccagccug

SEQ ID NO: 1212868 - RNA, 22 nt, Human
cugcaaaggguaucaggugcug

SEQ ID NO: 1212869 - RNA, 21 nt, Human
cugcaaaggguaucaggugcu

SEQ ID NO: 1212870 - RNA, 12 nt, Human
cugcagcuuugu

SEQ ID NO: 1212871 - RNA, 20 nt, Human
cugcaggcagccaggccaca

SEQ ID NO: 1212872 - RNA, 19 nt, Human
cugcaggcagccaggccac

SEQ ID NO: 1212873 - RNA, 18 nt, Human
cugcaggcagccaggcca

SEQ ID NO: 1212874 - RNA, 17 nt, Human
cugcaggcagccaggcc

SEQ ID NO: 1212875 - RNA, 16 nt, Human
cugcaggcagccaggc

SEQ ID NO: 1212876 - RNA, 15 nt, Human
cugcaggcagccagg

SEQ ID NO: 1212877 - RNA, 14 nt, Human
cugcaggcagccag

SEQ ID NO: 1212878 - RNA, 13 nt, Human
cugcaggcagcca

SEQ ID NO: 1212879 - RNA, 24 nt, Human
cugcagccucaaccuccugggcua

SEQ ID NO: 1212880 - RNA, 19 nt, Human
cugcacuccagccugggug

SEQ ID NO: 1212881 - RNA, 18 nt, Human
cugcacuccagccugggu

SEQ ID NO: 1212882 - RNA, 17 nt, Human
cugcacuccagccuggg

SEQ ID NO: 1212883 - RNA, 16 nt, Human
cugcacuccagccugg

SEQ ID NO: 1212884 - RNA, 20 nt, Human
cugcacuauagccuagguga

SEQ ID NO: 1212885 - RNA, 18 nt, Human
cugcacuauagccuaggu

SEQ ID NO: 1212886 - RNA, 17 nt, Human
cugcacuauagccuagg

SEQ ID NO: 1212887 - RNA, 16 nt, Human
cugcacuauagccuag

SEQ ID NO: 1212888 - RNA, 15 nt, Human
cugcacuccagccug

SEQ ID NO: 1212889 - RNA, 23 nt, Human
cugcacuauagccuaggugacag

SEQ ID NO: 1212890 - RNA, 22 nt, Human
cugcacuauagccuaggugaca

SEQ ID NO: 1212891 - RNA, 13 nt, Human
cugcacuccagcc

SEQ ID NO: 1212892 - RNA, 19 nt, Human
cugcucacauaucugucau

SEQ ID NO: 1212893 - RNA, 16 nt, Human
cugcucacauaucugu

SEQ ID NO: 1212894 - RNA, 12 nt, Human
cugcugacagug

SEQ ID NO: 1212895 - RNA, 15 nt, Human
cugcugaaggcucga

SEQ ID NO: 1212896 - RNA, 14 nt, Human
cugcugaaggcucg

SEQ ID NO: 1212897 - RNA, 13 nt, Human
cugcugaaggcuc

SEQ ID NO: 1212898 - RNA, 15 nt, Human
cugcugacaguguug

SEQ ID NO: 1212899 - RNA, 13 nt, Human
cugcugacagugu

SEQ ID NO: 1212900 - RNA, 18 nt, Human
cugcugaaggcucgagca

SEQ ID NO: 1212901 - RNA, 17 nt, Human
cuggaguucugguuccu

SEQ ID NO: 1212902 - RNA, 16 nt, Human
cuggaguucugguucc

SEQ ID NO: 1212903 - RNA, 15 nt, Human
cuggaguucugguuc

SEQ ID NO: 1212904 - RNA, 15 nt, Human
cuggaugcagccuca

SEQ ID NO: 1212905 - RNA, 15 nt, Human
cuggguguggcgcag

SEQ ID NO: 1212906 - RNA, 14 nt, Human
cuggguguggcgca

SEQ ID NO: 1212907 - RNA, 22 nt, Human
cuggguggcaccagcagccugg

SEQ ID NO: 1212908 - RNA, 21 nt, Human
cuggguggcaccagcagccug

SEQ ID NO: 1212909 - RNA, 20 nt, Human
cugggcagguuggugggggc

SEQ ID NO: 1212910 - RNA, 20 nt, Human
cugggcagaggaaagcaaag

SEQ ID NO: 1212911 - RNA, 16 nt, Human
cugggcagaggaaagc

SEQ ID NO: 1212912 - RNA, 13 nt, Human
cugggcagaggaa

SEQ ID NO: 1212913 - RNA, 20 nt, Human
cuggguggcaccagcagccu

SEQ ID NO: 1212914 - RNA, 18 nt, Human
cuggguggcaccagcagc

SEQ ID NO: 1212915 - RNA, 14 nt, Human
cuggggagaaagua

SEQ ID NO: 1212916 - RNA, 13 nt, Human
cuggggagaaagu

SEQ ID NO: 1212917 - RNA, 12 nt, Human
cuggcccuuccu

SEQ ID NO: 1212918 - RNA, 22 nt, Human
cuggcuaugcauuugaaaauuu

SEQ ID NO: 1212919 - RNA, 16 nt, Human
cuggcuaugcauuuga

SEQ ID NO: 1212920 - RNA, 15 nt, Human
cuggcuaugcauuug

SEQ ID NO: 1212921 - RNA, 14 nt, Human
cuggcuaugcauuu

SEQ ID NO: 1212922 - RNA, 13 nt, Human
cuggcuaugcauu

SEQ ID NO: 1212923 - RNA, 22 nt, Human
cugggagaaccaaaaagaggcu

SEQ ID NO: 1212924 - RNA, 16 nt, Human
cugggacuacaggcac

SEQ ID NO: 1212925 - RNA, 15 nt, Human
cugggacuacaggca

SEQ ID NO: 1212926 - RNA, 13 nt, Human
cugggacuacagg

SEQ ID NO: 1212927 - RNA, 22 nt, Human
cugggacaugggaaaggggaag

SEQ ID NO: 1212928 - RNA, 18 nt, Human
cugggacaugggaaaggg

SEQ ID NO: 1212929 - RNA, 14 nt, Human
cugggacaugggaa

SEQ ID NO: 1212930 - RNA, 17 nt, Human
auuguuuucaguguaca

SEQ ID NO: 1212931 - RNA, 14 nt, Human
auuuaaaaaaaauc

SEQ ID NO: 1212932 - RNA, 19 nt, Human
auuguuuucaguguacaug

SEQ ID NO: 1212933 - RNA, 18 nt, Human
auuguuuucaguguacau

SEQ ID NO: 1212934 - RNA, 20 nt, Human
auuuacuucuuauacauuug

SEQ ID NO: 1212935 - RNA, 19 nt, Human
auuuacuucuuauacauuu

SEQ ID NO: 1212936 - RNA, 16 nt, Human
auuucccaaagcagug

SEQ ID NO: 1212937 - RNA, 14 nt, Human
auuucccaaagcag

SEQ ID NO: 1212938 - RNA, 22 nt, Human
auuugaggucuguucuuuccaa

SEQ ID NO: 1212939 - RNA, 21 nt, Human
auuugaggucuguucuuucca

SEQ ID NO: 1212940 - RNA, 16 nt, Human
auuucuuccacaagag

SEQ ID NO: 1212941 - RNA, 18 nt, Human
auuugaggucuguucuuu

SEQ ID NO: 1212942 - RNA, 17 nt, Human
auuugaggucuguucuu

SEQ ID NO: 1212943 - RNA, 16 nt, Human
auuugagcagggcuca

SEQ ID NO: 1212944 - RNA, 15 nt, Human
auuugagcagggcuc

SEQ ID NO: 1212945 - RNA, 23 nt, Human
auuggcuagagguucaaagauau

SEQ ID NO: 1212946 - RNA, 22 nt, Human
auuggcuagagguucaaagaua

SEQ ID NO: 1212947 - RNA, 20 nt, Human
auuggcuagagguucaaaga

SEQ ID NO: 1212948 - RNA, 19 nt, Human
auuggcuagagguucaaag

SEQ ID NO: 1212949 - RNA, 12 nt, Human
auugcaccacug

SEQ ID NO: 1212950 - RNA, 19 nt, Human
auugcaacaggcugggcuu

SEQ ID NO: 1212951 - RNA, 18 nt, Human
auugcaacaggcugggcu

SEQ ID NO: 1212952 - RNA, 17 nt, Human
auugcaacaggcugggc

SEQ ID NO: 1212953 - RNA, 21 nt, Human
augugccagguuuuuggucug

SEQ ID NO: 1212954 - RNA, 21 nt, Human
uuuuaaaaaacugcugacugu

SEQ ID NO: 1212955 - RNA, 18 nt, Human
uuuuaaaaaacugcugac

SEQ ID NO: 1212956 - RNA, 19 nt, Human
auguuacauaagauaaaug

SEQ ID NO: 1212957 - RNA, 20 nt, Human
auguuacauaagauaaaugu

SEQ ID NO: 1212958 - RNA, 15 nt, Human
auguugcccaggcag

SEQ ID NO: 1212959 - RNA, 14 nt, Human
auguugcccaggca

SEQ ID NO: 1212960 - RNA, 13 nt, Human
auguugcccaggc

SEQ ID NO: 1212961 - RNA, 18 nt, Human
auguugaaagaucaaaag

SEQ ID NO: 1212962 - RNA, 12 nt, Human
auguugaaagau

SEQ ID NO: 1212963 - RNA, 17 nt, Human
uuuuagaguugauacua

SEQ ID NO: 1212964 - RNA, 21 nt, Human
uuuuagacccuauugcugcuu

SEQ ID NO: 1212965 - RNA, 13 nt, Human
auguuggccaggc

SEQ ID NO: 1212966 - RNA, 16 nt, Human
auguugcccaggcagg

SEQ ID NO: 1212967 - RNA, 14 nt, Human
uuuucaguguacau

SEQ ID NO: 1212968 - RNA, 12 nt, Human
uuuuauuaaauu

SEQ ID NO: 1212969 - RNA, 21 nt, Human
uuuuauggcuuuugugcauua

SEQ ID NO: 1212970 - RNA, 15 nt, Human
uuuuaguagagacag

SEQ ID NO: 1212971 - RNA, 23 nt, Human
uuuuagaguugauacuacaguuu

SEQ ID NO: 1212972 - RNA, 19 nt, Human
uuuuauggcuuuugugcau

SEQ ID NO: 1212973 - RNA, 18 nt, Human
uuuuauggcuuuugugca

SEQ ID NO: 1212974 - RNA, 19 nt, Human
auuaaaacacaacaucuuu

SEQ ID NO: 1212975 - RNA, 23 nt, Human
auuaaaaaucucaaauuucuaaa

SEQ ID NO: 1212976 - RNA, 17 nt, Human
auguuuuucuucucccu

SEQ ID NO: 1212977 - RNA, 13 nt, Human
uuuucuguucuuu

SEQ ID NO: 1212978 - RNA, 17 nt, Human
auguuggccaggcuggu

SEQ ID NO: 1212979 - RNA, 14 nt, Human
uuuguacagacaac

SEQ ID NO: 1212980 - RNA, 16 nt, Human
uuuguaauuuuuuuau

SEQ ID NO: 1212981 - RNA, 15 nt, Human
augugaugagaggaa

SEQ ID NO: 1212982 - RNA, 16 nt, Human
uuuguuucugaaaggg

SEQ ID NO: 1212983 - RNA, 14 nt, Human
uuuguuucugaaag

SEQ ID NO: 1212984 - RNA, 22 nt, Human
uuugugcauuaucuagauacug

SEQ ID NO: 1212985 - RNA, 19 nt, Human
uuugugcauuaucuagaua

SEQ ID NO: 1212986 - RNA, 22 nt, Human
uuugugauacaaugcugugccc

SEQ ID NO: 1212987 - RNA, 16 nt, Human
uuugugauacaaugcu

SEQ ID NO: 1212988 - RNA, 23 nt, Human
uuugucuuaaaaaguggaaaaau

SEQ ID NO: 1212989 - RNA, 14 nt, Human
uuugucuuaaaaag

SEQ ID NO: 1212990 - RNA, 13 nt, Human
uuugucuuaaaaa

SEQ ID NO: 1212991 - RNA, 18 nt, Human
auguccaagaagcccagg

SEQ ID NO: 1212992 - RNA, 17 nt, Human
auguccaagaagcccag

SEQ ID NO: 1212993 - RNA, 16 nt, Human
auguccaagaagccca

SEQ ID NO: 1212994 - RNA, 15 nt, Human
auguaucaaugagua

SEQ ID NO: 1212995 - RNA, 12 nt, Human
auguaucaauga

SEQ ID NO: 1212996 - RNA, 14 nt, Human
augugagacugguu

SEQ ID NO: 1212997 - RNA, 13 nt, Human
augugagaccauu

SEQ ID NO: 1212998 - RNA, 22 nt, Human
uuugggguacccacugcucugg

SEQ ID NO: 1212999 - RNA, 21 nt, Human
uuugggguacccacugcucug

SEQ ID NO: 1213000 - RNA, 13 nt, Human
uuuggggaagaac

SEQ ID NO: 1213001 - RNA, 13 nt, Human
uuuggcugcugaa

SEQ ID NO: 1213002 - RNA, 12 nt, Human
uuuggcugcuga

SEQ ID NO: 1213003 - RNA, 18 nt, Human
uuugauucagacagcugc

SEQ ID NO: 1213004 - RNA, 19 nt, Human
uuugcuggggccgaaagaa

SEQ ID NO: 1213005 - RNA, 22 nt, Human
uuugcuggggccgaaagaacag

SEQ ID NO: 1213006 - RNA, 22 nt, Human
uuuggauuggaugaauuccaaa

SEQ ID NO: 1213007 - RNA, 13 nt, Human
uuugagacagagu

SEQ ID NO: 1213008 - RNA, 15 nt, Human
uuugauucagacagc

SEQ ID NO: 1213009 - RNA, 15 nt, Human
uuugauccaagcugg

SEQ ID NO: 1213010 - RNA, 23 nt, Human
uuucccucccuuccucuuuccau

SEQ ID NO: 1213011 - RNA, 21 nt, Human
uuugaccucugcagcaauaaa

SEQ ID NO: 1213012 - RNA, 19 nt, Human
uuugaccucugcagcaaua

SEQ ID NO: 1213013 - RNA, 14 nt, Human
uuugacaaggggca

SEQ ID NO: 1213014 - RNA, 16 nt, Human
auucaguuguuagugu

SEQ ID NO: 1213015 - RNA, 22 nt, Human
auuccccaggaggccagccuug

SEQ ID NO: 1213016 - RNA, 20 nt, Human
auuccccaggaggccagccu

SEQ ID NO: 1213017 - RNA, 19 nt, Human
auucccaagcucugcuccu

SEQ ID NO: 1213018 - RNA, 18 nt, Human
auucccaagcucugcucc

SEQ ID NO: 1213019 - RNA, 13 nt, Human
auuagagaagaga

SEQ ID NO: 1213020 - RNA, 14 nt, Human
auuacuucugcuac

SEQ ID NO: 1213021 - RNA, 13 nt, Human
auuacuucugcua

SEQ ID NO: 1213022 - RNA, 16 nt, Human
uuuuguuuuugucuua

SEQ ID NO: 1213023 - RNA, 23 nt, Human
auuaaaacacaacaucuuuuucu

SEQ ID NO: 1213024 - RNA, 19 nt, Human
auuaaguacuauguaucaa

SEQ ID NO: 1213025 - RNA, 18 nt, Human
auuaaguacuauguauca

SEQ ID NO: 1213026 - RNA, 13 nt, Human
auuaaggaagaca

SEQ ID NO: 1213027 - RNA, 23 nt, Human
augaguccccuguuuguuucuga

SEQ ID NO: 1213028 - RNA, 13 nt, Human
augaguccccugu

SEQ ID NO: 1213029 - RNA, 21 nt, Human
uugucauauaagauucauauu

SEQ ID NO: 1213030 - RNA, 18 nt, Human
uugucacacacuuuggcu

SEQ ID NO: 1213031 - RNA, 17 nt, Human
uugucacacacuuuggc

SEQ ID NO: 1213032 - RNA, 22 nt, Human
augaggucagagccugcaguua

SEQ ID NO: 1213033 - RNA, 20 nt, Human
augaggucagagccugcagu

SEQ ID NO: 1213034 - RNA, 19 nt, Human
augaggucagagccugcag

SEQ ID NO: 1213035 - RNA, 18 nt, Human
augaggucagagccugca

SEQ ID NO: 1213036 - RNA, 16 nt, Human
augaggucagagccug

SEQ ID NO: 1213037 - RNA, 15 nt, Human
augaggucagagccu

SEQ ID NO: 1213038 - RNA, 21 nt, Human
uugugaggaagccgcuggggc

SEQ ID NO: 1213039 - RNA, 20 nt, Human
uugugauacaaugcugugcc

SEQ ID NO: 1213040 - RNA, 18 nt, Human
uugugaggaagccgcugg

SEQ ID NO: 1213041 - RNA, 17 nt, Human
uugugaggaagccgcug

SEQ ID NO: 1213042 - RNA, 13 nt, Human
uugugaggaagcc

SEQ ID NO: 1213043 - RNA, 16 nt, Human
uuguccccgacccuug

SEQ ID NO: 1213044 - RNA, 15 nt, Human
uuguccccgacccuu

SEQ ID NO: 1213045 - RNA, 20 nt, Human
uuguccccaccgcagacagg

SEQ ID NO: 1213046 - RNA, 18 nt, Human
uuguccccaccgcagaca

SEQ ID NO: 1213047 - RNA, 23 nt, Human
uuuaaaaauacagauagauauau

SEQ ID NO: 1213048 - RNA, 11 nt, Human
uuuaaaugcac

SEQ ID NO: 1213049 - RNA, 19 nt, Human
uuuaaggaugcuuguacau

SEQ ID NO: 1213050 - RNA, 21 nt, Human
uuuaagcuguuacugucuuca

SEQ ID NO: 1213051 - RNA, 14 nt, Human
uuuaagaggcaggg

SEQ ID NO: 1213052 - RNA, 12 nt, Human
uuuaagagaaau

SEQ ID NO: 1213053 - RNA, 22 nt, Human
uuuaaggaugcuuguacauaau

SEQ ID NO: 1213054 - RNA, 21 nt, Human
uuuaaggaugcuuguacauaa

SEQ ID NO: 1213055 - RNA, 20 nt, Human
uuuaaggaugcuuguacaua

SEQ ID NO: 1213056 - RNA, 16 nt, Human
uuuaaugaaagacugu

SEQ ID NO: 1213057 - RNA, 20 nt, Human
uuguucuugguuuguaaauu

SEQ ID NO: 1213058 - RNA, 19 nt, Human
uuguucuugguuuguaaau

SEQ ID NO: 1213059 - RNA, 17 nt, Human
uuguucuugguuuguaa

SEQ ID NO: 1213060 - RNA, 23 nt, Human
augcacuuuguucuggcucuucc

SEQ ID NO: 1213061 - RNA, 17 nt, Human
augcccagccccuucug

SEQ ID NO: 1213062 - RNA, 16 nt, Human
augcccagccccuucu

SEQ ID NO: 1213063 - RNA, 21 nt, Human
augccaugaggaacaaggcaa

SEQ ID NO: 1213064 - RNA, 23 nt, Human
uuuaaugaaagacuguacaaagu

SEQ ID NO: 1213065 - RNA, 21 nt, Human
uuuaaugaaagacuguacaaa

SEQ ID NO: 1213066 - RNA, 15 nt, Human
augccucucucaggc

SEQ ID NO: 1213067 - RNA, 14 nt, Human
augccucucucagg

SEQ ID NO: 1213068 - RNA, 13 nt, Human
augccucucucag

SEQ ID NO: 1213069 - RNA, 22 nt, Human
augcgugcauaccacuuuuguu

SEQ ID NO: 1213070 - RNA, 17 nt, Human
augccucucucaggcca

SEQ ID NO: 1213071 - RNA, 15 nt, Human
uuuacuucuuauaca

SEQ ID NO: 1213072 - RNA, 14 nt, Human
uuuacuucuuauac

SEQ ID NO: 1213073 - RNA, 13 nt, Human
uuuacuucuuaua

SEQ ID NO: 1213074 - RNA, 11 nt, Human
uuuacuuaaac

SEQ ID NO: 1213075 - RNA, 16 nt, Human
uuuacugcagcuuugu

SEQ ID NO: 1213076 - RNA, 22 nt, Human
uuuaccugaagucuuuguacag

SEQ ID NO: 1213077 - RNA, 18 nt, Human
uuuaccugaagucuuugu

SEQ ID NO: 1213078 - RNA, 15 nt, Human
uuucaaacuuuacua

SEQ ID NO: 1213079 - RNA, 12 nt, Human
uuucaaacuuua

SEQ ID NO: 1213080 - RNA, 13 nt, Human
uuucagaaaugug

SEQ ID NO: 1213081 - RNA, 12 nt, Human
uuucagaaaugu

SEQ ID NO: 1213082 - RNA, 11 nt, Human
uuucagaaaug

SEQ ID NO: 1213083 - RNA, 16 nt, Human
uuucccuauuagagaa

SEQ ID NO: 1213084 - RNA, 18 nt, Human
augcuggcuguuggcugg

SEQ ID NO: 1213085 - RNA, 19 nt, Human
augcuccuggcccacugca

SEQ ID NO: 1213086 - RNA, 14 nt, Human
augcuccuggccca

SEQ ID NO: 1213087 - RNA, 14 nt, Human
uuuaucagaauucu

SEQ ID NO: 1213088 - RNA, 22 nt, Human
augcuggcuguuggcugggggc

SEQ ID NO: 1213089 - RNA, 20 nt, Human
augcuggcuguuggcugggg

SEQ ID NO: 1213090 - RNA, 19 nt, Human
augcuggcuguuggcuggg

SEQ ID NO: 1213091 - RNA, 20 nt, Human
augcuucucacugccaugcc

SEQ ID NO: 1213092 - RNA, 16 nt, Human
augcuucucacugcca

SEQ ID NO: 1213093 - RNA, 18 nt, Human
auggaagacagcucuuau

SEQ ID NO: 1213094 - RNA, 17 nt, Human
auggaagacagcucuua

SEQ ID NO: 1213095 - RNA, 14 nt, Human
uugguuuguaaauu

SEQ ID NO: 1213096 - RNA, 19 nt, Human
uuggugucgggcaugacac

SEQ ID NO: 1213097 - RNA, 18 nt, Human
uuggugucgggcaugaca

SEQ ID NO: 1213098 - RNA, 17 nt, Human
uuggugucgggcaugac

SEQ ID NO: 1213099 - RNA, 19 nt, Human
uuggugguuucagaaaugu

SEQ ID NO: 1213100 - RNA, 18 nt, Human
uuggugguuucagaaaug

SEQ ID NO: 1213101 - RNA, 20 nt, Human
augaaugucagugugacuga

SEQ ID NO: 1213102 - RNA, 18 nt, Human
augaaugucagugugacu

SEQ ID NO: 1213103 - RNA, 16 nt, Human
augaaugucaguguga

SEQ ID NO: 1213104 - RNA, 23 nt, Human
augaaccacaucuugcucugcug

SEQ ID NO: 1213105 - RNA, 17 nt, Human
augaaugaaacauuuug

SEQ ID NO: 1213106 - RNA, 22 nt, Human
aucugucauuugagcagggcuc

SEQ ID NO: 1213107 - RNA, 17 nt, Human
aucugucauuugagcag

SEQ ID NO: 1213108 - RNA, 12 nt, Human
aucugucauuug

SEQ ID NO: 1213109 - RNA, 17 nt, Human
aucuugcucugcugaca

SEQ ID NO: 1213110 - RNA, 16 nt, Human
aucuugcucugcugac

SEQ ID NO: 1213111 - RNA, 15 nt, Human
aucuugcucugcuga

SEQ ID NO: 1213112 - RNA, 14 nt, Human
aucuugcucugcug

SEQ ID NO: 1213113 - RNA, 17 nt, Human
uuggaaaauaaauuauu

SEQ ID NO: 1213114 - RNA, 20 nt, Human
uugcuuugugauuuuuguaa

SEQ ID NO: 1213115 - RNA, 15 nt, Human
uugcuuugugauuuu

SEQ ID NO: 1213116 - RNA, 23 nt, Human
uugauguucuuucacccuuuucu

SEQ ID NO: 1213117 - RNA, 21 nt, Human
uugauuaaauucuugcaaagu

SEQ ID NO: 1213118 - RNA, 20 nt, Human
uugauuaaauucuugcaaag

SEQ ID NO: 1213119 - RNA, 16 nt, Human
uugauuaaauucuugc

SEQ ID NO: 1213120 - RNA, 15 nt, Human
uugauuaaauucuug

SEQ ID NO: 1213121 - RNA, 12 nt, Human
aucugaaaaugu

SEQ ID NO: 1213122 - RNA, 23 nt, Human
aucucacacaugagcaucaggcc

SEQ ID NO: 1213123 - RNA, 17 nt, Human
aucucaaauuucuaaau

SEQ ID NO: 1213124 - RNA, 16 nt, Human
aucucaaauuucuaaa

SEQ ID NO: 1213125 - RNA, 23 nt, Human
uugcccaggcuggcgugcagugg

SEQ ID NO: 1213126 - RNA, 14 nt, Human
uugcccaggcuggc

SEQ ID NO: 1213127 - RNA, 12 nt, Human
uugcccaggcug

SEQ ID NO: 1213128 - RNA, 11 nt, Human
uugcccaggcu

SEQ ID NO: 1213129 - RNA, 18 nt, Human
uugcccaggcaggucuug

SEQ ID NO: 1213130 - RNA, 16 nt, Human
uugcccaggcaggucu

SEQ ID NO: 1213131 - RNA, 14 nt, Human
uugcccaggcaggu

SEQ ID NO: 1213132 - RNA, 13 nt, Human
uugcccaggcagg

SEQ ID NO: 1213133 - RNA, 14 nt, Human
uugcaugaggcuag

SEQ ID NO: 1213134 - RNA, 21 nt, Human
uugcaccacugcacuccagcc

SEQ ID NO: 1213135 - RNA, 14 nt, Human
uugcaauggcagcc

SEQ ID NO: 1213136 - RNA, 14 nt, Human
aucucaaauuucua

SEQ ID NO: 1213137 - RNA, 23 nt, Human
aucucaaauaacuaaaagguaug

SEQ ID NO: 1213138 - RNA, 21 nt, Human
aucucaaauaacuaaaaggua

SEQ ID NO: 1213139 - RNA, 14 nt, Human
aucucaaauaacua

SEQ ID NO: 1213140 - RNA, 22 nt, Human
aucuaggaagacuuuggaaaga

SEQ ID NO: 1213141 - RNA, 19 nt, Human
aucuaggaagacuuuggaa

SEQ ID NO: 1213142 - RNA, 18 nt, Human
aucuaggaagacuuugga

SEQ ID NO: 1213143 - RNA, 17 nt, Human
aucuaggaagacuuugg

SEQ ID NO: 1213144 - RNA, 19 nt, Human
aucuagauacuguaucaug

SEQ ID NO: 1213145 - RNA, 18 nt, Human
aucuagauacuguaucau

SEQ ID NO: 1213146 - RNA, 23 nt, Human
aucuaauauguaacaagccaccc

SEQ ID NO: 1213147 - RNA, 18 nt, Human
uugauagcacagacccug

SEQ ID NO: 1213148 - RNA, 17 nt, Human
uugauacuacaguuugu

SEQ ID NO: 1213149 - RNA, 21 nt, Human
uugagugcugucuccauguuu

SEQ ID NO: 1213150 - RNA, 16 nt, Human
uugacaucaacugcau

SEQ ID NO: 1213151 - RNA, 19 nt, Human
uugacagggcacaccgggc

SEQ ID NO: 1213152 - RNA, 12 nt, Human
uugacagggcac

SEQ ID NO: 1213153 - RNA, 10 nt, Human
uugacagggc

SEQ ID NO: 1213154 - RNA, 19 nt, Human
uugacaggauuauuggaaa

SEQ ID NO: 1213155 - RNA, 17 nt, Human
uugaccauucuccaccu

SEQ ID NO: 1213156 - RNA, 16 nt, Human
uugagcagggcucagc

SEQ ID NO: 1213157 - RNA, 12 nt, Human
uugagcagggcu

SEQ ID NO: 1213158 - RNA, 12 nt, Human
uugagacagagu

SEQ ID NO: 1213159 - RNA, 11 nt, Human
uugagacagag

SEQ ID NO: 1213160 - RNA, 20 nt, Human
auauuguuuucaguguacau

SEQ ID NO: 1213161 - RNA, 21 nt, Human
auauugcugauggugcaauga

SEQ ID NO: 1213162 - RNA, 17 nt, Human
auauugcugauggugca

SEQ ID NO: 1213163 - RNA, 16 nt, Human
auauucuguuggccag

SEQ ID NO: 1213164 - RNA, 22 nt, Human
auauugauuuccguuaaaauac

SEQ ID NO: 1213165 - RNA, 21 nt, Human
auauugauuuccguuaaaaua

SEQ ID NO: 1213166 - RNA, 19 nt, Human
auauugauuuccguuaaaa

SEQ ID NO: 1213167 - RNA, 20 nt, Human
auauguuuuaagaggcaggg

SEQ ID NO: 1213168 - RNA, 18 nt, Human
auauguuuuaagaggcag

SEQ ID NO: 1213169 - RNA, 22 nt, Human
auauuaaggaagacaaugugaa

SEQ ID NO: 1213170 - RNA, 24 nt, Human
auauuaagaaagacuaucuaaaug

SEQ ID NO: 1213171 - RNA, 15 nt, Human
auauuaagaaagacu

SEQ ID NO: 1213172 - RNA, 15 nt, Human
uuccuucagugccuu

SEQ ID NO: 1213173 - RNA, 14 nt, Human
uuccuucagugccu

SEQ ID NO: 1213174 - RNA, 11 nt, Human
uuccuucagug

SEQ ID NO: 1213175 - RNA, 11 nt, Human
uuccucuuucc

SEQ ID NO: 1213176 - RNA, 17 nt, Human
uuccuguucccaugaga

SEQ ID NO: 1213177 - RNA, 17 nt, Human
uuccuaauccucuagga

SEQ ID NO: 1213178 - RNA, 15 nt, Human
uuccuaauccucuag

SEQ ID NO: 1213179 - RNA, 13 nt, Human
uuccuaauccucu

SEQ ID NO: 1213180 - RNA, 18 nt, Human
aucaaguauuauaccuuu

SEQ ID NO: 1213181 - RNA, 14 nt, Human
aucaaguauuauac

SEQ ID NO: 1213182 - RNA, 13 nt, Human
aucaaguauuaua

SEQ ID NO: 1213183 - RNA, 21 nt, Human
aucaagaugugacauguuuua

SEQ ID NO: 1213184 - RNA, 22 nt, Human
aucacggcucacugcagccuca

SEQ ID NO: 1213185 - RNA, 23 nt, Human
aucauaguggcuuaaaacaacac

SEQ ID NO: 1213186 - RNA, 15 nt, Human
aucauugaaaucuuu

SEQ ID NO: 1213187 - RNA, 14 nt, Human
aucauugaaaucuu

SEQ ID NO: 1213188 - RNA, 22 nt, Human
aucauuaaagccugaguuugcu

SEQ ID NO: 1213189 - RNA, 18 nt, Human
aucagcacgauuucuguu

SEQ ID NO: 1213190 - RNA, 17 nt, Human
aucagcacgauuucugu

SEQ ID NO: 1213191 - RNA, 16 nt, Human
aucagcacgauuucug

SEQ ID NO: 1213192 - RNA, 13 nt, Human
uucuaggccuggg

SEQ ID NO: 1213193 - RNA, 22 nt, Human
uucucagaaucucaaauaacua

SEQ ID NO: 1213194 - RNA, 19 nt, Human
uucucagaaucucaaauaa

SEQ ID NO: 1213195 - RNA, 23 nt, Human
uucucagaaucucaaauaacuaa

SEQ ID NO: 1213196 - RNA, 23 nt, Human
uucugccgcagcccugcagaggg

SEQ ID NO: 1213197 - RNA, 22 nt, Human
uucugggacacaguucaauucu

SEQ ID NO: 1213198 - RNA, 11 nt, Human
uucugggacac

SEQ ID NO: 1213199 - RNA, 10 nt, Human
uucugggaca

SEQ ID NO: 1213200 - RNA, 15 nt, Human
uucugaaagggacgc

SEQ ID NO: 1213201 - RNA, 20 nt, Human
aucauugaaaucuuuuugcu

SEQ ID NO: 1213202 - RNA, 19 nt, Human
aucauugaaaucuuuuugc

SEQ ID NO: 1213203 - RNA, 16 nt, Human
auccagguucagcuug

SEQ ID NO: 1213204 - RNA, 15 nt, Human
auccagguucagcuu

SEQ ID NO: 1213205 - RNA, 17 nt, Human
aucccauaugccugggc

SEQ ID NO: 1213206 - RNA, 16 nt, Human
aucccauaugccuggg

SEQ ID NO: 1213207 - RNA, 21 nt, Human
uucaaggauccugagccagau

SEQ ID NO: 1213208 - RNA, 19 nt, Human
uucaaggauccugagccag

SEQ ID NO: 1213209 - RNA, 18 nt, Human
uucaaggauccugagcca

SEQ ID NO: 1213210 - RNA, 16 nt, Human
uucaaggauccugagc

SEQ ID NO: 1213211 - RNA, 15 nt, Human
uucaaggauccugag

SEQ ID NO: 1213212 - RNA, 22 nt, Human
uucaccacaugugcacaugcac

SEQ ID NO: 1213213 - RNA, 17 nt, Human
uucacauauugauuucc

SEQ ID NO: 1213214 - RNA, 13 nt, Human
uucacaguucucu

SEQ ID NO: 1213215 - RNA, 18 nt, Human
auagccugccucuucucu

SEQ ID NO: 1213216 - RNA, 17 nt, Human
auaagauaaaugugcug

SEQ ID NO: 1213217 - RNA, 13 nt, Human
auaagauaaaugu

SEQ ID NO: 1213218 - RNA, 19 nt, Human
auagcucaggugucccugc

SEQ ID NO: 1213219 - RNA, 22 nt, Human
auagcucaggugucccugcacu

SEQ ID NO: 1213220 - RNA, 21 nt, Human
auagcucaggugucccugcac

SEQ ID NO: 1213221 - RNA, 20 nt, Human
auagcucaggugucccugca

SEQ ID NO: 1213222 - RNA, 12 nt, Human
auagcugggacu

SEQ ID NO: 1213223 - RNA, 22 nt, Human
uuauuuaaugaaagacuguaca

SEQ ID NO: 1213224 - RNA, 18 nt, Human
uuauuuaaugaaagacug

SEQ ID NO: 1213225 - RNA, 14 nt, Human
uuauuuaaauuuua

SEQ ID NO: 1213226 - RNA, 17 nt, Human
auagcugggacuacagg

SEQ ID NO: 1213227 - RNA, 22 nt, Human
auagcuggucuuauuuguaaag

SEQ ID NO: 1213228 - RNA, 23 nt, Human
auagcuggucuuauuuguaaagc

SEQ ID NO: 1213229 - RNA, 16 nt, Human
uuauuuaguuccuuga

SEQ ID NO: 1213230 - RNA, 21 nt, Human
uucaucauccuaagcuauuca

SEQ ID NO: 1213231 - RNA, 21 nt, Human
uucauauuuacuucuuauaca

SEQ ID NO: 1213232 - RNA, 16 nt, Human
uucauauuuacuucuu

SEQ ID NO: 1213233 - RNA, 14 nt, Human
uucaguaauaacuc

SEQ ID NO: 1213234 - RNA, 20 nt, Human
auaugauuuaaaucagccgu

SEQ ID NO: 1213235 - RNA, 14 nt, Human
auaugucaagccau

SEQ ID NO: 1213236 - RNA, 13 nt, Human
auaugcacacauu

SEQ ID NO: 1213237 - RNA, 19 nt, Human
uucagccaagaauucuuaa

SEQ ID NO: 1213238 - RNA, 14 nt, Human
uucagacagcugcc

SEQ ID NO: 1213239 - RNA, 17 nt, Human
uucagaucucuaacuuc

SEQ ID NO: 1213240 - RNA, 13 nt, Human
uuagacagagucu

SEQ ID NO: 1213241 - RNA, 11 nt, Human
uuagacagagu

SEQ ID NO: 1213242 - RNA, 14 nt, Human
uuagaaauauaauu

SEQ ID NO: 1213243 - RNA, 12 nt, Human
uuagaaauauaa

SEQ ID NO: 1213244 - RNA, 11 nt, Human
uuagaaauaua

SEQ ID NO: 1213245 - RNA, 23 nt, Human
uuacucagaauucucuaguuuga

SEQ ID NO: 1213246 - RNA, 18 nt, Human
uuacucagaauucucuag

SEQ ID NO: 1213247 - RNA, 15 nt, Human
uuacaggaaguacug

SEQ ID NO: 1213248 - RNA, 14 nt, Human
uuacaggaaguacu

SEQ ID NO: 1213249 - RNA, 14 nt, Human
uuaagugcugcauu

SEQ ID NO: 1213250 - RNA, 17 nt, Human
uuaaguacuauguauca

SEQ ID NO: 1213251 - RNA, 16 nt, Human
uuaagaggcagggucu

SEQ ID NO: 1213252 - RNA, 15 nt, Human
uuaagaggcaggguc

SEQ ID NO: 1213253 - RNA, 13 nt, Human
uuaagaggcaggg

SEQ ID NO: 1213254 - RNA, 15 nt, Human
uuaauucuuagcuca

SEQ ID NO: 1213255 - RNA, 23 nt, Human
uuaaugaaagacuguacaaagua

SEQ ID NO: 1213256 - RNA, 23 nt, Human
auaaacaagaccacguuucuaaa

SEQ ID NO: 1213257 - RNA, 22 nt, Human
auaaacaagaccacguuucuaa

SEQ ID NO: 1213258 - RNA, 15 nt, Human
auaaacaagaccacg

SEQ ID NO: 1213259 - RNA, 19 nt, Human
uuaauuuuuuugagacaga

SEQ ID NO: 1213260 - RNA, 13 nt, Human
uuaaauaauguga

SEQ ID NO: 1213261 - RNA, 23 nt, Human
aguuguuugauucagacagcugc

SEQ ID NO: 1213262 - RNA, 21 nt, Human
aguuguuugauucagacagcu

SEQ ID NO: 1213263 - RNA, 18 nt, Human
aguuggucccccuuccau

SEQ ID NO: 1213264 - RNA, 16 nt, Human
aguuggcuaggacccc

SEQ ID NO: 1213265 - RNA, 21 nt, Human
aguuggguggaugccuggugg

SEQ ID NO: 1213266 - RNA, 13 nt, Human
aguugggcuuccu

SEQ ID NO: 1213267 - RNA, 19 nt, Human
uguuuauugucaaaguggu

SEQ ID NO: 1213268 - RNA, 19 nt, Human
uguugcccaggcaggucuu

SEQ ID NO: 1213269 - RNA, 22 nt, Human
uguuugauucagacagcugccu

SEQ ID NO: 1213270 - RNA, 17 nt, Human
uguuugauucagacagc

SEQ ID NO: 1213271 - RNA, 14 nt, Human
aguucugguuccua

SEQ ID NO: 1213272 - RNA, 21 nt, Human
uguuuuauuuuaauucaguug

SEQ ID NO: 1213273 - RNA, 20 nt, Human
uguuuuccaugaguccccug

SEQ ID NO: 1213274 - RNA, 23 nt, Human
uguguguuuauugucaaaguggu

SEQ ID NO: 1213275 - RNA, 19 nt, Human
uguguguuuauugucaaag

SEQ ID NO: 1213276 - RNA, 21 nt, Human
ugugucuugcaauggcagccu

SEQ ID NO: 1213277 - RNA, 22 nt, Human
ugugucucuugguccugcugca

SEQ ID NO: 1213278 - RNA, 21 nt, Human
ugugucucuugguccugcugc

SEQ ID NO: 1213279 - RNA, 20 nt, Human
ugugucucuugguccugcug

SEQ ID NO: 1213280 - RNA, 17 nt, Human
ugugucucuugguccug

SEQ ID NO: 1213281 - RNA, 20 nt, Human
ugugguguuuccuggcacug

SEQ ID NO: 1213282 - RNA, 16 nt, Human
ugugguguuuccuggc

SEQ ID NO: 1213283 - RNA, 14 nt, Human
ugugguguuuccug

SEQ ID NO: 1213284 - RNA, 15 nt, Human
uguggucccacccca

SEQ ID NO: 1213285 - RNA, 13 nt, Human
uguggucccaccc

SEQ ID NO: 1213286 - RNA, 16 nt, Human
uguggucccaccccac

SEQ ID NO: 1213287 - RNA, 23 nt, Human
uguggguuucuaaagcugccagc

SEQ ID NO: 1213288 - RNA, 21 nt, Human
uguggguuucuaaagcugcca

SEQ ID NO: 1213289 - RNA, 21 nt, Human
agugcugggauuacaggugug

SEQ ID NO: 1213290 - RNA, 19 nt, Human
agugcugcauuuaaaagau

SEQ ID NO: 1213291 - RNA, 17 nt, Human
agugcugcauuuaaaag

SEQ ID NO: 1213292 - RNA, 16 nt, Human
agugcugcauuuaaaa

SEQ ID NO: 1213293 - RNA, 13 nt, Human
agugcugcauuua

SEQ ID NO: 1213294 - RNA, 12 nt, Human
agugcugcauuu

SEQ ID NO: 1213295 - RNA, 23 nt, Human
agugaguugauagcacagacccu

SEQ ID NO: 1213296 - RNA, 22 nt, Human
agugaguugauagcacagaccc

SEQ ID NO: 1213297 - RNA, 16 nt, Human
uguucugggacacagu

SEQ ID NO: 1213298 - RNA, 20 nt, Human
uguuccacaaguuaaauaaa

SEQ ID NO: 1213299 - RNA, 20 nt, Human
agugugucuuagugugugca

SEQ ID NO: 1213300 - RNA, 18 nt, Human
uguugcccaggcaggucu

SEQ ID NO: 1213301 - RNA, 17 nt, Human
uguugcccaggcagguc

SEQ ID NO: 1213302 - RNA, 16 nt, Human
uguugcccaggcaggu

SEQ ID NO: 1213303 - RNA, 15 nt, Human
uguugcccaggcagg

SEQ ID NO: 1213304 - RNA, 13 nt, Human
uguugcccaggca

SEQ ID NO: 1213305 - RNA, 20 nt, Human
agugugguguuuccuggcac

SEQ ID NO: 1213306 - RNA, 19 nt, Human
agugugguguuuccuggca

SEQ ID NO: 1213307 - RNA, 17 nt, Human
agugugguguuuccugg

SEQ ID NO: 1213308 - RNA, 20 nt, Human
agugugccugaagucccaga

SEQ ID NO: 1213309 - RNA, 16 nt, Human
agugugguguuuccug

SEQ ID NO: 1213310 - RNA, 23 nt, Human
aguggugguuuucuguucuuucu

SEQ ID NO: 1213311 - RNA, 21 nt, Human
aguggugguuuucuguucuuu

SEQ ID NO: 1213312 - RNA, 20 nt, Human
aguggugguuuucuguucuu

SEQ ID NO: 1213313 - RNA, 19 nt, Human
aguggugguuuucuguucu

SEQ ID NO: 1213314 - RNA, 18 nt, Human
aguggugguuuucuguuc

SEQ ID NO: 1213315 - RNA, 17 nt, Human
aguggugguuuucuguu

SEQ ID NO: 1213316 - RNA, 21 nt, Human
agugguggugaacagaacaaa

SEQ ID NO: 1213317 - RNA, 17 nt, Human
aguggugcgaucugggu

SEQ ID NO: 1213318 - RNA, 21 nt, Human
uguggaguucaucuugaauug

SEQ ID NO: 1213319 - RNA, 17 nt, Human
uguggaguucaucuuga

SEQ ID NO: 1213320 - RNA, 21 nt, Human
ugugcccccauguaagcaccc

SEQ ID NO: 1213321 - RNA, 17 nt, Human
agugaggcucugcccuu

SEQ ID NO: 1213322 - RNA, 16 nt, Human
agugaggcucugcccu

SEQ ID NO: 1213323 - RNA, 15 nt, Human
agugaggcucugccc

SEQ ID NO: 1213324 - RNA, 15 nt, Human
agugagucgaggaca

SEQ ID NO: 1213325 - RNA, 20 nt, Human
agugaggcucugcccuuggu

SEQ ID NO: 1213326 - RNA, 19 nt, Human
agugaggcucugcccuugg

SEQ ID NO: 1213327 - RNA, 21 nt, Human
agugaggcucugcccuugguu

SEQ ID NO: 1213328 - RNA, 16 nt, Human
ugugccaugugccagg

SEQ ID NO: 1213329 - RNA, 12 nt, Human
ugugccaugugc

SEQ ID NO: 1213330 - RNA, 20 nt, Human
ugugccagguuuuuggucug

SEQ ID NO: 1213331 - RNA, 20 nt, Human
ugugauggggcccugccucc

SEQ ID NO: 1213332 - RNA, 19 nt, Human
ugugauggggcccugccuc

SEQ ID NO: 1213333 - RNA, 18 nt, Human
ugugaugagaggaaauca

SEQ ID NO: 1213334 - RNA, 14 nt, Human
ugugaagagaacca

SEQ ID NO: 1213335 - RNA, 19 nt, Human
ugugaaccaccacacccag

SEQ ID NO: 1213336 - RNA, 21 nt, Human
ugugaaccaccacacccagcc

SEQ ID NO: 1213337 - RNA, 20 nt, Human
ugugaaccaccacacccagc

SEQ ID NO: 1213338 - RNA, 21 nt, Human
ugugaaaggaaagagggaggu

SEQ ID NO: 1213339 - RNA, 18 nt, Human
ugugaaaggaaagaggcu

SEQ ID NO: 1213340 - RNA, 15 nt, Human
ugugaaaggaaagag

SEQ ID NO: 1213341 - RNA, 15 nt, Human
ugugacugaauuucu

SEQ ID NO: 1213342 - RNA, 16 nt, Human
ugugacugaucucucg

SEQ ID NO: 1213343 - RNA, 16 nt, Human
ugugacugaauuucuu

SEQ ID NO: 1213344 - RNA, 14 nt, Human
agucuuuguacaga

SEQ ID NO: 1213345 - RNA, 17 nt, Human
uguaucaaugaguaaca

SEQ ID NO: 1213346 - RNA, 20 nt, Human
uguauucucuccuguaccuc

SEQ ID NO: 1213347 - RNA, 19 nt, Human
uguauucucuccuguaccu

SEQ ID NO: 1213348 - RNA, 18 nt, Human
aguauuacuucugcuaca

SEQ ID NO: 1213349 - RNA, 17 nt, Human
aguaugguggcuggguu

SEQ ID NO: 1213350 - RNA, 16 nt, Human
aguaugguggcugggu

SEQ ID NO: 1213351 - RNA, 15 nt, Human
aguaugguggcuggg

SEQ ID NO: 1213352 - RNA, 19 nt, Human
ugucaauuacaggaaguac

SEQ ID NO: 1213353 - RNA, 17 nt, Human
ugucaauuacaggaagu

SEQ ID NO: 1213354 - RNA, 15 nt, Human
ugucaauuacaggaa

SEQ ID NO: 1213355 - RNA, 14 nt, Human
ugucaauuacagga

SEQ ID NO: 1213356 - RNA, 23 nt, Human
agucacacagugagucgaggaca

SEQ ID NO: 1213357 - RNA, 15 nt, Human
agucacacagugagu

SEQ ID NO: 1213358 - RNA, 19 nt, Human
agucaccccggccaccugc

SEQ ID NO: 1213359 - RNA, 18 nt, Human
uguagagccagggucuca

SEQ ID NO: 1213360 - RNA, 16 nt, Human
uguagagccagggucu

SEQ ID NO: 1213361 - RNA, 17 nt, Human
aguaauaugcacacauu

SEQ ID NO: 1213362 - RNA, 15 nt, Human
aguaauaugcacaca

SEQ ID NO: 1213363 - RNA, 14 nt, Human
aguaauaugcacac

SEQ ID NO: 1213364 - RNA, 21 nt, Human
aguagaagucuuagauguaua

SEQ ID NO: 1213365 - RNA, 20 nt, Human
aguagaagucuuagauguau

SEQ ID NO: 1213366 - RNA, 19 nt, Human
aguagaagucuuagaugua

SEQ ID NO: 1213367 - RNA, 20 nt, Human
uguaggcauaaagucagggg

SEQ ID NO: 1213368 - RNA, 17 nt, Human
uguaggcauaaagucag

SEQ ID NO: 1213369 - RNA, 11 nt, Human
aguagagacag

SEQ ID NO: 1213370 - RNA, 16 nt, Human
uguaaauagcucaggu

SEQ ID NO: 1213371 - RNA, 15 nt, Human
uguaaauagcucagg

SEQ ID NO: 1213372 - RNA, 21 nt, Human
ugguuuguaaauuaacuuuua

SEQ ID NO: 1213373 - RNA, 17 nt, Human
ugguuuucaaaauaaaa

SEQ ID NO: 1213374 - RNA, 15 nt, Human
ugguuuucaaaauaa

SEQ ID NO: 1213375 - RNA, 14 nt, Human
ugguuuucaaaaua

SEQ ID NO: 1213376 - RNA, 15 nt, Human
ugguuuguaaauuaa

SEQ ID NO: 1213377 - RNA, 14 nt, Human
ugguuauggagagg

SEQ ID NO: 1213378 - RNA, 21 nt, Human
aggugauccacccaccucagc

SEQ ID NO: 1213379 - RNA, 20 nt, Human
aggugauccacccaccucag

SEQ ID NO: 1213380 - RNA, 14 nt, Human
aggugauccaccca

SEQ ID NO: 1213381 - RNA, 23 nt, Human
agguggggcagcuugaggguugg

SEQ ID NO: 1213382 - RNA, 18 nt, Human
aggugggauccuccaggu

SEQ ID NO: 1213383 - RNA, 17 nt, Human
aggugggauccuccagg

SEQ ID NO: 1213384 - RNA, 16 nt, Human
aggugggauccuccag

SEQ ID NO: 1213385 - RNA, 15 nt, Human
aggugggauccucca

SEQ ID NO: 1213386 - RNA, 18 nt, Human
aggugccucaagagaagg

SEQ ID NO: 1213387 - RNA, 14 nt, Human
agguuuaagcuguu

SEQ ID NO: 1213388 - RNA, 20 nt, Human
aggugugcucugaucaucca

SEQ ID NO: 1213389 - RNA, 15 nt, Human
aggugugcucugauc

SEQ ID NO: 1213390 - RNA, 17 nt, Human
aggugugaaccaccaca

SEQ ID NO: 1213391 - RNA, 23 nt, Human
agguggggucacucuggcagcuc

SEQ ID NO: 1213392 - RNA, 19 nt, Human
agguggggucacucuggca

SEQ ID NO: 1213393 - RNA, 23 nt, Human
aggugagaagcagaggaaggaga

SEQ ID NO: 1213394 - RNA, 21 nt, Human
aggugagaagcagaggaagga

SEQ ID NO: 1213395 - RNA, 16 nt, Human
aggugagaagcagagg

SEQ ID NO: 1213396 - RNA, 13 nt, Human
aggugaccccagg

SEQ ID NO: 1213397 - RNA, 22 nt, Human
aggugacagagugagacucugu

SEQ ID NO: 1213398 - RNA, 15 nt, Human
aggugacagagugag

SEQ ID NO: 1213399 - RNA, 13 nt, Human
aggugacagagug

SEQ ID NO: 1213400 - RNA, 18 nt, Human
aggucuugaacuccuggc

SEQ ID NO: 1213401 - RNA, 17 nt, Human
aggucuugaacuccugg

SEQ ID NO: 1213402 - RNA, 16 nt, Human
aggucuugaacuccug

SEQ ID NO: 1213403 - RNA, 18 nt, Human
aggucagagccugcaguu

SEQ ID NO: 1213404 - RNA, 17 nt, Human
aggucagagccugcagu

SEQ ID NO: 1213405 - RNA, 15 nt, Human
aggucagagccugca

SEQ ID NO: 1213406 - RNA, 14 nt, Human
aggucagagccugc

SEQ ID NO: 1213407 - RNA, 22 nt, Human
uggucagauuugaacucuucaa

SEQ ID NO: 1213408 - RNA, 16 nt, Human
uggucagauuugaacu

SEQ ID NO: 1213409 - RNA, 15 nt, Human
uggucagauuugaac

SEQ ID NO: 1213410 - RNA, 20 nt, Human
ugguuaggcauugugggaag

SEQ ID NO: 1213411 - RNA, 18 nt, Human
ugguuaggcauuguggga

SEQ ID NO: 1213412 - RNA, 12 nt, Human
ugguggcagugg

SEQ ID NO: 1213413 - RNA, 15 nt, Human
ugguggcagcugcgg

SEQ ID NO: 1213414 - RNA, 14 nt, Human
ugguggcagcugcg

SEQ ID NO: 1213415 - RNA, 17 nt, Human
uggugcgaucuggguuc

SEQ ID NO: 1213416 - RNA, 16 nt, Human
uggugcgaucuggguu

SEQ ID NO: 1213417 - RNA, 16 nt, Human
aggguggugaccucug

SEQ ID NO: 1213418 - RNA, 17 nt, Human
aggguggugaccucugc

SEQ ID NO: 1213419 - RNA, 22 nt, Human
uggguggcaccagcagccugga

SEQ ID NO: 1213420 - RNA, 21 nt, Human
uggguggcaccagcagccugg

SEQ ID NO: 1213421 - RNA, 20 nt, Human
uggguggcaccagcagccug

SEQ ID NO: 1213422 - RNA, 17 nt, Human
uggguggcaccagcagc

SEQ ID NO: 1213423 - RNA, 20 nt, Human
ugguagagugugccugaagu

SEQ ID NO: 1213424 - RNA, 21 nt, Human
aggggaauguuugccucugcc

SEQ ID NO: 1213425 - RNA, 20 nt, Human
aggggaauguuugccucugc

SEQ ID NO: 1213426 - RNA, 19 nt, Human
aggggaauguuugccucug

SEQ ID NO: 1213427 - RNA, 18 nt, Human
aggggugggacacccugu

SEQ ID NO: 1213428 - RNA, 13 nt, Human
agggggcugggac

SEQ ID NO: 1213429 - RNA, 20 nt, Human
aggggguggccucccaacuc

SEQ ID NO: 1213430 - RNA, 15 nt, Human
aggguaaggcugugg

SEQ ID NO: 1213431 - RNA, 15 nt, Human
agggucucacucugu

SEQ ID NO: 1213432 - RNA, 14 nt, Human
agggucucacucug

SEQ ID NO: 1213433 - RNA, 16 nt, Human
agggucucacucuguc

SEQ ID NO: 1213434 - RNA, 21 nt, Human
agggucucacucugucgccca

SEQ ID NO: 1213435 - RNA, 12 nt, Human
uggggcccugcc

SEQ ID NO: 1213436 - RNA, 23 nt, Human
uggggcugcaccggcuggccugg

SEQ ID NO: 1213437 - RNA, 17 nt, Human
uggggaccucaggccug

SEQ ID NO: 1213438 - RNA, 16 nt, Human
uggggaccucaggccu

SEQ ID NO: 1213439 - RNA, 15 nt, Human
uggggaccucaggcc

SEQ ID NO: 1213440 - RNA, 14 nt, Human
uggggaccucaggc

SEQ ID NO: 1213441 - RNA, 15 nt, Human
agggcuccagacaca

SEQ ID NO: 1213442 - RNA, 12 nt, Human
agggcuccagac

SEQ ID NO: 1213443 - RNA, 22 nt, Human
uggggucacucuggcagcucag

SEQ ID NO: 1213444 - RNA, 16 nt, Human
uggggucacucuggca

SEQ ID NO: 1213445 - RNA, 14 nt, Human
uggggucacucugg

SEQ ID NO: 1213446 - RNA, 13 nt, Human
uggggucacucug

SEQ ID NO: 1213447 - RNA, 20 nt, Human
ugggguacccacugcucugg

SEQ ID NO: 1213448 - RNA, 19 nt, Human
ugggguacccacugcucug

SEQ ID NO: 1213449 - RNA, 18 nt, Human
ugggguacccacugcucu

SEQ ID NO: 1213450 - RNA, 17 nt, Human
ugggguacccacugcuc

SEQ ID NO: 1213451 - RNA, 13 nt, Human
aggggaaaagagg

SEQ ID NO: 1213452 - RNA, 14 nt, Human
aggggaacagacug

SEQ ID NO: 1213453 - RNA, 22 nt, Human
aggggaaaaucagccugcucca

SEQ ID NO: 1213454 - RNA, 18 nt, Human
aggggaaaaucagccugc

SEQ ID NO: 1213455 - RNA, 13 nt, Human
aggggaauguuug

SEQ ID NO: 1213456 - RNA, 20 nt, Human
ugggacucaaugcacugaca

SEQ ID NO: 1213457 - RNA, 21 nt, Human
ugggagagaagagaaugcaca

SEQ ID NO: 1213458 - RNA, 19 nt, Human
ugggagagaagagaaugca

SEQ ID NO: 1213459 - RNA, 16 nt, Human
ugggagagccuuccag

SEQ ID NO: 1213460 - RNA, 16 nt, Human
ugggacuacaggcacc

SEQ ID NO: 1213461 - RNA, 15 nt, Human
ugggacuacaggcac

SEQ ID NO: 1213462 - RNA, 14 nt, Human
ugggacuacaggca

SEQ ID NO: 1213463 - RNA, 22 nt, Human
agggaaggauacaaaagcaugu

SEQ ID NO: 1213464 - RNA, 21 nt, Human
aggcccggcuccaggcuccuu

SEQ ID NO: 1213465 - RNA, 20 nt, Human
aggcccggcuccaggcuccu

SEQ ID NO: 1213466 - RNA, 18 nt, Human
aggcccggcuccaggcuc

SEQ ID NO: 1213467 - RNA, 17 nt, Human
agggagggagggcucca

SEQ ID NO: 1213468 - RNA, 15 nt, Human
agggagggagggcuc

SEQ ID NO: 1213469 - RNA, 21 nt, Human
ugggcccccaaauggaaaugg

SEQ ID NO: 1213470 - RNA, 16 nt, Human
ugggcccccaaaugga

SEQ ID NO: 1213471 - RNA, 13 nt, Human
ugggcagagcaga

SEQ ID NO: 1213472 - RNA, 18 nt, Human
ugggccaggagccuccug

SEQ ID NO: 1213473 - RNA, 12 nt, Human
ugggcagagcag

SEQ ID NO: 1213474 - RNA, 11 nt, Human
ugggcagagca

SEQ ID NO: 1213475 - RNA, 12 nt, Human
ugggcagaagga

SEQ ID NO: 1213476 - RNA, 20 nt, Human
ugggaggccaaggugggagg

SEQ ID NO: 1213477 - RNA, 19 nt, Human
ugggaggccaaggugggag

SEQ ID NO: 1213478 - RNA, 22 nt, Human
ugggaggaucucuugagccugg

SEQ ID NO: 1213479 - RNA, 21 nt, Human
ugggaggaucucuugagccug

SEQ ID NO: 1213480 - RNA, 20 nt, Human
ugggaggaucucuugagccu

SEQ ID NO: 1213481 - RNA, 23 nt, Human
agggcucagcggggacagcuccu

SEQ ID NO: 1213482 - RNA, 22 nt, Human
agggcucagcggggacagcucc

SEQ ID NO: 1213483 - RNA, 20 nt, Human
agggcucagcggggacagcu

SEQ ID NO: 1213484 - RNA, 19 nt, Human
agggcucagcggggacagc

SEQ ID NO: 1213485 - RNA, 17 nt, Human
agggagggcuccagaca

SEQ ID NO: 1213486 - RNA, 16 nt, Human
agggagggcuccagac

SEQ ID NO: 1213487 - RNA, 15 nt, Human
agggagggcuccaga

SEQ ID NO: 1213488 - RNA, 14 nt, Human
agggagggcuccag

SEQ ID NO: 1213489 - RNA, 18 nt, Human
ugcuaucucccccagccc

SEQ ID NO: 1213490 - RNA, 17 nt, Human
ugcuaucucccccagcc

SEQ ID NO: 1213491 - RNA, 14 nt, Human
ugcuaucuccccca

SEQ ID NO: 1213492 - RNA, 13 nt, Human
ugcuaucuccccc

SEQ ID NO: 1213493 - RNA, 16 nt, Human
aggaaaagcugcugac

SEQ ID NO: 1213494 - RNA, 19 nt, Human
ugcucugaucauccacugu

SEQ ID NO: 1213495 - RNA, 21 nt, Human
ugcuccagcuguucagcuggu

SEQ ID NO: 1213496 - RNA, 15 nt, Human
ugcucugcugacaga

SEQ ID NO: 1213497 - RNA, 14 nt, Human
ugcucugcugacag

SEQ ID NO: 1213498 - RNA, 16 nt, Human
ugcucugcugacagac

SEQ ID NO: 1213499 - RNA, 16 nt, Human
aggaagcucagggccu

SEQ ID NO: 1213500 - RNA, 15 nt, Human
aggaagcucagggcc

SEQ ID NO: 1213501 - RNA, 14 nt, Human
aggaagcucagggc

SEQ ID NO: 1213502 - RNA, 13 nt, Human
aggaagcucaggg

SEQ ID NO: 1213503 - RNA, 13 nt, Human
aggaagccagcag

SEQ ID NO: 1213504 - RNA, 15 nt, Human
ugcgguccacccagg

SEQ ID NO: 1213505 - RNA, 14 nt, Human
ugcgguccacccag

SEQ ID NO: 1213506 - RNA, 17 nt, Human
ugcgguccacccaggag

SEQ ID NO: 1213507 - RNA, 14 nt, Human
aggaaaagcugcug

SEQ ID NO: 1213508 - RNA, 23 nt, Human
agcuugaccgugaggccagagac

SEQ ID NO: 1213509 - RNA, 22 nt, Human
agcuugaccgugaggccagaga

SEQ ID NO: 1213510 - RNA, 20 nt, Human
agcuugaccgugaggccaga

SEQ ID NO: 1213511 - RNA, 15 nt, Human
agcuccuucuguccu

SEQ ID NO: 1213512 - RNA, 23 nt, Human
agcucccaggcauuccccaggag

SEQ ID NO: 1213513 - RNA, 13 nt, Human
agcucccaggcau

SEQ ID NO: 1213514 - RNA, 20 nt, Human
agcucugguccauagagagc

SEQ ID NO: 1213515 - RNA, 17 nt, Human
agcucugguccauagag

SEQ ID NO: 1213516 - RNA, 12 nt, Human
agcucuggucca

SEQ ID NO: 1213517 - RNA, 22 nt, Human
agcuccuucuguccuacucugu

SEQ ID NO: 1213518 - RNA, 21 nt, Human
agcuccuucuguccuacucug

SEQ ID NO: 1213519 - RNA, 16 nt, Human
agcuccuucuguccua

SEQ ID NO: 1213520 - RNA, 13 nt, Human
ugccucagccucc

SEQ ID NO: 1213521 - RNA, 12 nt, Human
ugccucagccuc

SEQ ID NO: 1213522 - RNA, 14 nt, Human
ugccgcagcccugc

SEQ ID NO: 1213523 - RNA, 12 nt, Human
ugccgcagcccu

SEQ ID NO: 1213524 - RNA, 19 nt, Human
ugcccuuaccugccaggaa

SEQ ID NO: 1213525 - RNA, 18 nt, Human
ugcccuuaccugccagga

SEQ ID NO: 1213526 - RNA, 20 nt, Human
agcugccagccgagauagcc

SEQ ID NO: 1213527 - RNA, 18 nt, Human
agcugcauacaguuugca

SEQ ID NO: 1213528 - RNA, 23 nt, Human
agcucuguccugggagugagcug

SEQ ID NO: 1213529 - RNA, 21 nt, Human
agcucuguccugggagugagc

SEQ ID NO: 1213530 - RNA, 16 nt, Human
agcucuguccugggag

SEQ ID NO: 1213531 - RNA, 18 nt, Human
agcuguuacugucuucag

SEQ ID NO: 1213532 - RNA, 19 nt, Human
agcugugcucuggacaggc

SEQ ID NO: 1213533 - RNA, 18 nt, Human
agcugugcucuggacagg

SEQ ID NO: 1213534 - RNA, 17 nt, Human
agcugugcucuggacag

SEQ ID NO: 1213535 - RNA, 17 nt, Human
agcugggacuacaggug

SEQ ID NO: 1213536 - RNA, 23 nt, Human
agcugggguggggaccucaggcc

SEQ ID NO: 1213537 - RNA, 22 nt, Human
agcugggguggggaccucaggc

SEQ ID NO: 1213538 - RNA, 20 nt, Human
agcugggguggggaccucag

SEQ ID NO: 1213539 - RNA, 16 nt, Human
agcugggacuacaggu

SEQ ID NO: 1213540 - RNA, 23 nt, Human
agcugggacuacaggcacccacc

SEQ ID NO: 1213541 - RNA, 20 nt, Human
agcugggacuacaggcaccc

SEQ ID NO: 1213542 - RNA, 16 nt, Human
ugccuuggggacaaga

SEQ ID NO: 1213543 - RNA, 21 nt, Human
ugccuuacccucauguucuua

SEQ ID NO: 1213544 - RNA, 20 nt, Human
ugccuuacccucauguucuu

SEQ ID NO: 1213545 - RNA, 19 nt, Human
ugccuguugggccaggagc

SEQ ID NO: 1213546 - RNA, 17 nt, Human
ugccuguugggccagga

SEQ ID NO: 1213547 - RNA, 16 nt, Human
ugccuguugggccagg

SEQ ID NO: 1213548 - RNA, 19 nt, Human
agcuguuacugucuucagu

SEQ ID NO: 1213549 - RNA, 19 nt, Human
agcugccuguucagcucca

SEQ ID NO: 1213550 - RNA, 18 nt, Human
agcugccuguucagcucc

SEQ ID NO: 1213551 - RNA, 16 nt, Human
agcugccuguucagcu

SEQ ID NO: 1213552 - RNA, 14 nt, Human
agcugccuguucag

SEQ ID NO: 1213553 - RNA, 21 nt, Human
ugccuggauggggcugcaccg

SEQ ID NO: 1213554 - RNA, 20 nt, Human
ugccuggauggggcugcacc

SEQ ID NO: 1213555 - RNA, 17 nt, Human
ugccuggauggggcugc

SEQ ID NO: 1213556 - RNA, 16 nt, Human
ugccuggauggggcug

SEQ ID NO: 1213557 - RNA, 20 nt, Human
agcugcuugggcuucauccu

SEQ ID NO: 1213558 - RNA, 16 nt, Human
agcugcuugggcuuca

SEQ ID NO: 1213559 - RNA, 20 nt, Human
ugccucugccucugacacac

SEQ ID NO: 1213560 - RNA, 18 nt, Human
ugccucugccucugacac

SEQ ID NO: 1213561 - RNA, 14 nt, Human
ugccucagccuccc

SEQ ID NO: 1213562 - RNA, 24 nt, Human
ugccugcccaggccccugccaccc

SEQ ID NO: 1213563 - RNA, 23 nt, Human
ugccugcccaggccccugccacc

SEQ ID NO: 1213564 - RNA, 22 nt, Human
ugccugcccaggccccugccac

SEQ ID NO: 1213565 - RNA, 22 nt, Human
aggauugcuacuguccuaccca

SEQ ID NO: 1213566 - RNA, 18 nt, Human
aggauugcuacuguccua

SEQ ID NO: 1213567 - RNA, 17 nt, Human
aggauugcuacuguccu

SEQ ID NO: 1213568 - RNA, 15 nt, Human
aggauugcuacuguc

SEQ ID NO: 1213569 - RNA, 17 nt, Human
aggcaaggcugucaauu

SEQ ID NO: 1213570 - RNA, 16 nt, Human
aggcaaggcugucaau

SEQ ID NO: 1213571 - RNA, 20 nt, Human
aggcaagcaccuccugccuc

SEQ ID NO: 1213572 - RNA, 19 nt, Human
aggcaagcaccuccugccu

SEQ ID NO: 1213573 - RNA, 18 nt, Human
aggcaagcaccuccugcc

SEQ ID NO: 1213574 - RNA, 18 nt, Human
aggcauugugggaagggg

SEQ ID NO: 1213575 - RNA, 22 nt, Human
aggcauaaagucagggguuccc

SEQ ID NO: 1213576 - RNA, 15 nt, Human
aggcauaaagucagg

SEQ ID NO: 1213577 - RNA, 17 nt, Human
aggcaggugggauggau

SEQ ID NO: 1213578 - RNA, 18 nt, Human
aggcagggucucacucug

SEQ ID NO: 1213579 - RNA, 12 nt, Human
aggcagggucuc

SEQ ID NO: 1213580 - RNA, 23 nt, Human
uggcacaucagcacgauuucugu

SEQ ID NO: 1213581 - RNA, 23 nt, Human
uggaugccugguggcagcugcgg

SEQ ID NO: 1213582 - RNA, 21 nt, Human
uggaugccugguggcagcugc

SEQ ID NO: 1213583 - RNA, 14 nt, Human
uggagugcagugag

SEQ ID NO: 1213584 - RNA, 20 nt, Human
aggcauuugcugaauacaga

SEQ ID NO: 1213585 - RNA, 16 nt, Human
aggcauuugcugaaua

SEQ ID NO: 1213586 - RNA, 12 nt, Human
aggccagcugcu

SEQ ID NO: 1213587 - RNA, 15 nt, Human
aggccagccuugacc

SEQ ID NO: 1213588 - RNA, 13 nt, Human
aggccagccuuga

SEQ ID NO: 1213589 - RNA, 13 nt, Human
uggcagcucagag

SEQ ID NO: 1213590 - RNA, 23 nt, Human
uggcagcucaccucucccuugga

SEQ ID NO: 1213591 - RNA, 22 nt, Human
uggcagcucaccucucccuugg

SEQ ID NO: 1213592 - RNA, 21 nt, Human
uggcagcucaccucucccuug

SEQ ID NO: 1213593 - RNA, 20 nt, Human
uggcacccggccccugcugg

SEQ ID NO: 1213594 - RNA, 19 nt, Human
uggcacccggccccugcug

SEQ ID NO: 1213595 - RNA, 18 nt, Human
uggcacccggccccugcu

SEQ ID NO: 1213596 - RNA, 15 nt, Human
aggcccagagggccu

SEQ ID NO: 1213597 - RNA, 13 nt, Human
aggcccagagggc

SEQ ID NO: 1213598 - RNA, 14 nt, Human
aggccccgcccagg

SEQ ID NO: 1213599 - RNA, 13 nt, Human
aggcccggcucca

SEQ ID NO: 1213600 - RNA, 14 nt, Human
aggcccggcuccag

SEQ ID NO: 1213601 - RNA, 16 nt, Human
uggaagacagcucuua

SEQ ID NO: 1213602 - RNA, 23 nt, Human
uggaaauuuguuauaaugaauga

SEQ ID NO: 1213603 - RNA, 21 nt, Human
uggaaauuuguuauaaugaau

SEQ ID NO: 1213604 - RNA, 23 nt, Human
ugcuuuuuaauauugauaugcuu

SEQ ID NO: 1213605 - RNA, 20 nt, Human
ugcuuuugucuaugggacuc

SEQ ID NO: 1213606 - RNA, 18 nt, Human
ugcuuuuggucuguguga

SEQ ID NO: 1213607 - RNA, 22 nt, Human
ugcuuugugauuuuuguaauuu

SEQ ID NO: 1213608 - RNA, 15 nt, Human
ugcuugagcucagga

SEQ ID NO: 1213609 - RNA, 17 nt, Human
aggagccuccugcccuu

SEQ ID NO: 1213610 - RNA, 13 nt, Human
aggaucagucuga

SEQ ID NO: 1213611 - RNA, 19 nt, Human
aggauucuuccucccuccc

SEQ ID NO: 1213612 - RNA, 17 nt, Human
aggauucuuccucccuc

SEQ ID NO: 1213613 - RNA, 22 nt, Human
aggaugcacagaguuguuacau

SEQ ID NO: 1213614 - RNA, 23 nt, Human
aggaugaucuaggaagacuuugg

SEQ ID NO: 1213615 - RNA, 22 nt, Human
aggaugaucuaggaagacuuug

SEQ ID NO: 1213616 - RNA, 16 nt, Human
aggagccuccugcccu

SEQ ID NO: 1213617 - RNA, 17 nt, Human
aggagccccgaggccuu

SEQ ID NO: 1213618 - RNA, 14 nt, Human
aggagcagccacau

SEQ ID NO: 1213619 - RNA, 13 nt, Human
aggagcagccaca

SEQ ID NO: 1213620 - RNA, 12 nt, Human
aggagcagccac

SEQ ID NO: 1213621 - RNA, 23 nt, Human
aggacuuuucuuuguggcuuccu

SEQ ID NO: 1213622 - RNA, 22 nt, Human
aggacuuuucuuuguggcuucc

SEQ ID NO: 1213623 - RNA, 19 nt, Human
aggacuuuucuuuguggcu

SEQ ID NO: 1213624 - RNA, 17 nt, Human
aggacuuuucuuugugg

SEQ ID NO: 1213625 - RNA, 22 nt, Human
ugauggggcccugccuccuuug

SEQ ID NO: 1213626 - RNA, 14 nt, Human
ugauggggcccugc

SEQ ID NO: 1213627 - RNA, 23 nt, Human
ugauguuuuccaugaguccccug

SEQ ID NO: 1213628 - RNA, 19 nt, Human
ugauguuuuccaugagucc

SEQ ID NO: 1213629 - RNA, 17 nt, Human
ugauguuuuccaugagu

SEQ ID NO: 1213630 - RNA, 21 nt, Human
ugauguuuuaaggaugcuugu

SEQ ID NO: 1213631 - RNA, 17 nt, Human
ugauuaaauucuugcaa

SEQ ID NO: 1213632 - RNA, 16 nt, Human
ugauuaaauucuugca

SEQ ID NO: 1213633 - RNA, 13 nt, Human
ugauuaaauucuu

SEQ ID NO: 1213634 - RNA, 22 nt, Human
ugaugaaaugaggucagagccu

SEQ ID NO: 1213635 - RNA, 15 nt, Human
ugaucuaggaagacu

SEQ ID NO: 1213636 - RNA, 14 nt, Human
ugaucuaggaagac

SEQ ID NO: 1213637 - RNA, 20 nt, Human
ugaugaucuuugcagacagg

SEQ ID NO: 1213638 - RNA, 19 nt, Human
ugaugaucuuugcagacag

SEQ ID NO: 1213639 - RNA, 23 nt, Human
ugaugaaaugaggucagagccug

SEQ ID NO: 1213640 - RNA, 13 nt, Human
ugauggggcccug

SEQ ID NO: 1213641 - RNA, 22 nt, Human
ugaugggcaacccccagccugc

SEQ ID NO: 1213642 - RNA, 22 nt, Human
ugaugaucuuugcagacaggca

SEQ ID NO: 1213643 - RNA, 21 nt, Human
ugaugaucuuugcagacaggc

SEQ ID NO: 1213644 - RNA, 18 nt, Human
ugauccucccaccucagc

SEQ ID NO: 1213645 - RNA, 20 nt, Human
ugauccucccaccucagccu

SEQ ID NO: 1213646 - RNA, 19 nt, Human
ugauccucccaccucagcc

SEQ ID NO: 1213647 - RNA, 13 nt, Human
ugaucuaggaaga

SEQ ID NO: 1213648 - RNA, 23 nt, Human
agcaucaggccaggcccucugcc

SEQ ID NO: 1213649 - RNA, 22 nt, Human
agcaucaggccaggcccucugc

SEQ ID NO: 1213650 - RNA, 12 nt, Human
agcaucaggcca

SEQ ID NO: 1213651 - RNA, 18 nt, Human
ugauacaaugcugugccc

SEQ ID NO: 1213652 - RNA, 21 nt, Human
agcauauucaggaagcucagg

SEQ ID NO: 1213653 - RNA, 19 nt, Human
agcauauucaggaagcuca

SEQ ID NO: 1213654 - RNA, 17 nt, Human
agcauauucaggaagcu

SEQ ID NO: 1213655 - RNA, 14 nt, Human
ugaucacggcucac

SEQ ID NO: 1213656 - RNA, 13 nt, Human
ugaucacggcuca

SEQ ID NO: 1213657 - RNA, 15 nt, Human
ugaucacggcucacu

SEQ ID NO: 1213658 - RNA, 18 nt, Human
ugaucacggcucacugca

SEQ ID NO: 1213659 - RNA, 15 nt, Human
agcauuuugcuaaau

SEQ ID NO: 1213660 - RNA, 22 nt, Human
agcauuuugcuaaaugugaaug

SEQ ID NO: 1213661 - RNA, 19 nt, Human
agcauggcugccaauggga

SEQ ID NO: 1213662 - RNA, 22 nt, Human
agcagggcucagcggggacagc

SEQ ID NO: 1213663 - RNA, 15 nt, Human
agcagggcucagcgg

SEQ ID NO: 1213664 - RNA, 14 nt, Human
agcagggcucagcg

SEQ ID NO: 1213665 - RNA, 13 nt, Human
agcagggcucagc

SEQ ID NO: 1213666 - RNA, 20 nt, Human
agcagggagggcuucugcca

SEQ ID NO: 1213667 - RNA, 19 nt, Human
agcaggcucucaggccagc

SEQ ID NO: 1213668 - RNA, 18 nt, Human
agcaggcucucaggccag

SEQ ID NO: 1213669 - RNA, 17 nt, Human
agcaggcucucaggcca

SEQ ID NO: 1213670 - RNA, 16 nt, Human
agcaggcucucaggcc

SEQ ID NO: 1213671 - RNA, 15 nt, Human
agcaggcucucaggc

SEQ ID NO: 1213672 - RNA, 14 nt, Human
agcaggcucucagg

SEQ ID NO: 1213673 - RNA, 13 nt, Human
agcaggcucucag

SEQ ID NO: 1213674 - RNA, 17 nt, Human
agcaggcucgggcuccc

SEQ ID NO: 1213675 - RNA, 23 nt, Human
agcaggcucucaggccagcugcu

SEQ ID NO: 1213676 - RNA, 22 nt, Human
agcaggcucucaggccagcugc

SEQ ID NO: 1213677 - RNA, 21 nt, Human
agcaggcucucaggccagcug

SEQ ID NO: 1213678 - RNA, 15 nt, Human
agcagggaaacagcu

SEQ ID NO: 1213679 - RNA, 14 nt, Human
agcagggaaacagc

SEQ ID NO: 1213680 - RNA, 13 nt, Human
agcagggaaacag

SEQ ID NO: 1213681 - RNA, 13 nt, Human
agcaggacaugga

SEQ ID NO: 1213682 - RNA, 15 nt, Human
agcagccacauuccu

SEQ ID NO: 1213683 - RNA, 11 nt, Human
agcagccacau

SEQ ID NO: 1213684 - RNA, 16 nt, Human
agcagcagggagggcu

SEQ ID NO: 1213685 - RNA, 20 nt, Human
ugacccaugcugcccuguga

SEQ ID NO: 1213686 - RNA, 19 nt, Human
ugacccaugcugcccugug

SEQ ID NO: 1213687 - RNA, 18 nt, Human
ugacccaugcugcccugu

SEQ ID NO: 1213688 - RNA, 23 nt, Human
ugagugggggaucacagccucug

SEQ ID NO: 1213689 - RNA, 21 nt, Human
ugagugggggaucacagccuc

SEQ ID NO: 1213690 - RNA, 15 nt, Human
ugauacaaugcugug

SEQ ID NO: 1213691 - RNA, 14 nt, Human
ugauacaaugcugu

SEQ ID NO: 1213692 - RNA, 16 nt, Human
ugagugccuuacacaa

SEQ ID NO: 1213693 - RNA, 14 nt, Human
ugagugccuuacac

SEQ ID NO: 1213694 - RNA, 13 nt, Human
ugagugccuuaca

SEQ ID NO: 1213695 - RNA, 17 nt, Human
ugagugcagcucuggag

SEQ ID NO: 1213696 - RNA, 13 nt, Human
ugaguccagaagu

SEQ ID NO: 1213697 - RNA, 14 nt, Human
ugaguacuacaguc

SEQ ID NO: 1213698 - RNA, 20 nt, Human
ugaguacguugugcauuugg

SEQ ID NO: 1213699 - RNA, 18 nt, Human
ugagucaccaagcccagu

SEQ ID NO: 1213700 - RNA, 19 nt, Human
ugaguacguugugcauuug

SEQ ID NO: 1213701 - RNA, 18 nt, Human
ugaguacguugugcauuu

SEQ ID NO: 1213702 - RNA, 17 nt, Human
ugaguacguugugcauu

SEQ ID NO: 1213703 - RNA, 16 nt, Human
ugaguacguugugcau

SEQ ID NO: 1213704 - RNA, 23 nt, Human
agcauaaaaauuagccaagugug

SEQ ID NO: 1213705 - RNA, 19 nt, Human
agcauaaaaauuagccaag

SEQ ID NO: 1213706 - RNA, 18 nt, Human
agccuccugcccuuaccu

SEQ ID NO: 1213707 - RNA, 14 nt, Human
agccuccugcccuu

SEQ ID NO: 1213708 - RNA, 13 nt, Human
agccuccugcccu

SEQ ID NO: 1213709 - RNA, 21 nt, Human
ugcagacaggcaagcaccucc

SEQ ID NO: 1213710 - RNA, 13 nt, Human
ugcagacaggcaa

SEQ ID NO: 1213711 - RNA, 12 nt, Human
ugcagacaggca

SEQ ID NO: 1213712 - RNA, 21 nt, Human
ugcagccucacaguccuuacc

SEQ ID NO: 1213713 - RNA, 18 nt, Human
ugcagccucacaguccuu

SEQ ID NO: 1213714 - RNA, 21 nt, Human
ugcauaccacuuuuguucuug

SEQ ID NO: 1213715 - RNA, 20 nt, Human
ugcauaccacuuuuguucuu

SEQ ID NO: 1213716 - RNA, 18 nt, Human
ugcauaccacuuuuguuc

SEQ ID NO: 1213717 - RNA, 16 nt, Human
ugcauaccacuuuugu

SEQ ID NO: 1213718 - RNA, 21 nt, Human
ugcaugcugucccuuacguga

SEQ ID NO: 1213719 - RNA, 19 nt, Human
ugcaugcugucccuuacgu

SEQ ID NO: 1213720 - RNA, 18 nt, Human
ugcaugcugucccuuacg

SEQ ID NO: 1213721 - RNA, 20 nt, Human
ugcaugaaguaauaugcaca

SEQ ID NO: 1213722 - RNA, 22 nt, Human
ugccagccgagauagccaaggc

SEQ ID NO: 1213723 - RNA, 17 nt, Human
ugccagccgagauagcc

SEQ ID NO: 1213724 - RNA, 18 nt, Human
ugccaaugggagcucaug

SEQ ID NO: 1213725 - RNA, 14 nt, Human
ugccaaugggagcu

SEQ ID NO: 1213726 - RNA, 13 nt, Human
ugccaauggacua

SEQ ID NO: 1213727 - RNA, 16 nt, Human
ugcauuuaaaagauac

SEQ ID NO: 1213728 - RNA, 19 nt, Human
agccugugccucugggacu

SEQ ID NO: 1213729 - RNA, 18 nt, Human
agccugugccucugggac

SEQ ID NO: 1213730 - RNA, 17 nt, Human
agccugugccucuggga

SEQ ID NO: 1213731 - RNA, 13 nt, Human
agccuugaacuuu

SEQ ID NO: 1213732 - RNA, 22 nt, Human
agccuuagaagucacacaguau

SEQ ID NO: 1213733 - RNA, 20 nt, Human
agccuuagaagucacacagu

SEQ ID NO: 1213734 - RNA, 19 nt, Human
agccuugcggaagguucua

SEQ ID NO: 1213735 - RNA, 21 nt, Human
agccuugaccauucuccaccu

SEQ ID NO: 1213736 - RNA, 19 nt, Human
agccuugaccauucuccac

SEQ ID NO: 1213737 - RNA, 18 nt, Human
agccuugaccauucucca

SEQ ID NO: 1213738 - RNA, 22 nt, Human
agccuugaccauucuccaccug

SEQ ID NO: 1213739 - RNA, 16 nt, Human
agccccgaggccuucu

SEQ ID NO: 1213740 - RNA, 14 nt, Human
agccccgaggccuu

SEQ ID NO: 1213741 - RNA, 21 nt, Human
agcccaggccuccuacagcuu

SEQ ID NO: 1213742 - RNA, 19 nt, Human
agcccaggccuccuacagc

SEQ ID NO: 1213743 - RNA, 14 nt, Human
agcccaggccuccu

SEQ ID NO: 1213744 - RNA, 16 nt, Human
agcccgggcucugccu

SEQ ID NO: 1213745 - RNA, 19 nt, Human
agcccugcagagggcacag

SEQ ID NO: 1213746 - RNA, 16 nt, Human
agcccugcagagggca

SEQ ID NO: 1213747 - RNA, 15 nt, Human
agcccugcagagggc

SEQ ID NO: 1213748 - RNA, 14 nt, Human
agcccugcagaggg

SEQ ID NO: 1213749 - RNA, 15 nt, Human
agcccgggcucugcc

SEQ ID NO: 1213750 - RNA, 14 nt, Human
agcccgggcucugc

SEQ ID NO: 1213751 - RNA, 19 nt, Human
agccccuucugacccaugc

SEQ ID NO: 1213752 - RNA, 16 nt, Human
agccccuucugaccca

SEQ ID NO: 1213753 - RNA, 15 nt, Human
agccccuucugaccc

SEQ ID NO: 1213754 - RNA, 14 nt, Human
agccccuucugacc

SEQ ID NO: 1213755 - RNA, 16 nt, Human
ugcacuccagccuggg

SEQ ID NO: 1213756 - RNA, 15 nt, Human
ugcacuccagccugg

SEQ ID NO: 1213757 - RNA, 14 nt, Human
ugcacuccagccug

SEQ ID NO: 1213758 - RNA, 18 nt, Human
ugcaccggcuggccuggc

SEQ ID NO: 1213759 - RNA, 16 nt, Human
ugcaccggcuggccug

SEQ ID NO: 1213760 - RNA, 15 nt, Human
ugcaccggcuggccu

SEQ ID NO: 1213761 - RNA, 14 nt, Human
ugcaccggcuggcc

SEQ ID NO: 1213762 - RNA, 13 nt, Human
ugcaccagcccuu

SEQ ID NO: 1213763 - RNA, 21 nt, Human
ugcaccacugcacuccagccu

SEQ ID NO: 1213764 - RNA, 12 nt, Human
agcccaggccuc

SEQ ID NO: 1213765 - RNA, 15 nt, Human
ugcaaggucauuuuu

SEQ ID NO: 1213766 - RNA, 13 nt, Human
ugcaacaggcugg

SEQ ID NO: 1213767 - RNA, 20 nt, Human
ugcaaaccaucauugaaauc

SEQ ID NO: 1213768 - RNA, 18 nt, Human
ugcaaaccaucauugaaa

SEQ ID NO: 1213769 - RNA, 20 nt, Human
ugcaaaguaucccuacugua

SEQ ID NO: 1213770 - RNA, 21 nt, Human
ugcaaaggguaucaggugcug

SEQ ID NO: 1213771 - RNA, 18 nt, Human
agccacggccaggccaga

SEQ ID NO: 1213772 - RNA, 17 nt, Human
agccacggccaggccag

SEQ ID NO: 1213773 - RNA, 18 nt, Human
ugauuuccguuaaaauac

SEQ ID NO: 1213774 - RNA, 13 nt, Human
ugcaaaccaucau

SEQ ID NO: 1213775 - RNA, 12 nt, Human
ugcaaaccauca

SEQ ID NO: 1213776 - RNA, 15 nt, Human
agaugcaccagcccu

SEQ ID NO: 1213777 - RNA, 14 nt, Human
agaugcaccagccc

SEQ ID NO: 1213778 - RNA, 16 nt, Human
agaugcuucucacugc

SEQ ID NO: 1213779 - RNA, 15 nt, Human
agaugcuucucacug

SEQ ID NO: 1213780 - RNA, 13 nt, Human
ugacccacugcuu

SEQ ID NO: 1213781 - RNA, 12 nt, Human
ugacccacugcu

SEQ ID NO: 1213782 - RNA, 15 nt, Human
agaucagccugggca

SEQ ID NO: 1213783 - RNA, 13 nt, Human
agaucagccuggg

SEQ ID NO: 1213784 - RNA, 18 nt, Human
ugaccaaugauggucacc

SEQ ID NO: 1213785 - RNA, 21 nt, Human
ugacauuguuggccaaagcca

SEQ ID NO: 1213786 - RNA, 20 nt, Human
ugacauuguuggccaaagcc

SEQ ID NO: 1213787 - RNA, 21 nt, Human
ugacagggcacaccgggcacu

SEQ ID NO: 1213788 - RNA, 20 nt, Human
ugacagggcacaccgggcac

SEQ ID NO: 1213789 - RNA, 16 nt, Human
ugacagggcacaccgg

SEQ ID NO: 1213790 - RNA, 11 nt, Human
ugacagggcac

SEQ ID NO: 1213791 - RNA, 20 nt, Human
ugacaggcaaugcuggcugu

SEQ ID NO: 1213792 - RNA, 21 nt, Human
ugacacacagcucuguccugg

SEQ ID NO: 1213793 - RNA, 19 nt, Human
ugaaugucagugugacuga

SEQ ID NO: 1213794 - RNA, 20 nt, Human
ugaaugguuuucaaaauaaa

SEQ ID NO: 1213795 - RNA, 16 nt, Human
agaguuguuacauuuu

SEQ ID NO: 1213796 - RNA, 12 nt, Human
agaguuguuaca

SEQ ID NO: 1213797 - RNA, 22 nt, Human
agaguugauacuacaguuuguu

SEQ ID NO: 1213798 - RNA, 20 nt, Human
agaguugauacuacaguuug

SEQ ID NO: 1213799 - RNA, 17 nt, Human
agaguugauacuacagu

SEQ ID NO: 1213800 - RNA, 12 nt, Human
agauaaaugugc

SEQ ID NO: 1213801 - RNA, 16 nt, Human
agaucacgccacugca

SEQ ID NO: 1213802 - RNA, 15 nt, Human
agaucacgccacugc

SEQ ID NO: 1213803 - RNA, 14 nt, Human
agaucacgccacug

SEQ ID NO: 1213804 - RNA, 15 nt, Human
ugaauuucuuuugcc

SEQ ID NO: 1213805 - RNA, 18 nt, Human
agaucacgccacugcacu

SEQ ID NO: 1213806 - RNA, 17 nt, Human
agaucacgccacugcac

SEQ ID NO: 1213807 - RNA, 19 nt, Human
agaggccaugggccuccug

SEQ ID NO: 1213808 - RNA, 21 nt, Human
agaggcagggucucacucugu

SEQ ID NO: 1213809 - RNA, 13 nt, Human
agaggcagggucu

SEQ ID NO: 1213810 - RNA, 10 nt, Human
agaggcaggg

SEQ ID NO: 1213811 - RNA, 21 nt, Human
agaggcagccccauucugccu

SEQ ID NO: 1213812 - RNA, 19 nt, Human
agaggcagccccauucugc

SEQ ID NO: 1213813 - RNA, 13 nt, Human
agaggcagcccca

SEQ ID NO: 1213814 - RNA, 16 nt, Human
ugaacuccuggccuca

SEQ ID NO: 1213815 - RNA, 22 nt, Human
ugaacuuugaccucugcagcaa

SEQ ID NO: 1213816 - RNA, 20 nt, Human
ugaacuuugaccucugcagc

SEQ ID NO: 1213817 - RNA, 19 nt, Human
ugaacuuugaccucugcag

SEQ ID NO: 1213818 - RNA, 15 nt, Human
ugaacuccuggccuc

SEQ ID NO: 1213819 - RNA, 14 nt, Human
ugaacuccuggccu

SEQ ID NO: 1213820 - RNA, 12 nt, Human
ugaacuccuggc

SEQ ID NO: 1213821 - RNA, 15 nt, Human
ugaaauuuuuauuaa

SEQ ID NO: 1213822 - RNA, 21 nt, Human
agagccuugcggaagguucua

SEQ ID NO: 1213823 - RNA, 11 nt, Human
agagccuugcg

SEQ ID NO: 1213824 - RNA, 20 nt, Human
agagcagagaccaucccuga

SEQ ID NO: 1213825 - RNA, 18 nt, Human
agagcagagaccaucccu

SEQ ID NO: 1213826 - RNA, 17 nt, Human
agagcagagaccauccc

SEQ ID NO: 1213827 - RNA, 12 nt, Human
agagcagagacc

SEQ ID NO: 1213828 - RNA, 21 nt, Human
agagcaccuuagacagucccu

SEQ ID NO: 1213829 - RNA, 21 nt, Human
ucuuuggacccugaggcccag

SEQ ID NO: 1213830 - RNA, 17 nt, Human
ucuuuggacccugaggc

SEQ ID NO: 1213831 - RNA, 18 nt, Human
agagcugccaccugccug

SEQ ID NO: 1213832 - RNA, 23 nt, Human
agaaccccaggguccuguagccc

SEQ ID NO: 1213833 - RNA, 21 nt, Human
agaauguguuuaaacuugguu

SEQ ID NO: 1213834 - RNA, 19 nt, Human
agaauuaguggcacuugcu

SEQ ID NO: 1213835 - RNA, 18 nt, Human
agaauucucuaguuugau

SEQ ID NO: 1213836 - RNA, 14 nt, Human
agaauucucuaguu

SEQ ID NO: 1213837 - RNA, 20 nt, Human
agaauucucagaaucucaaa

SEQ ID NO: 1213838 - RNA, 20 nt, Human
agaauuauaauuaguuccuc

SEQ ID NO: 1213839 - RNA, 23 nt, Human
ucuguuuagauaauacaccacua

SEQ ID NO: 1213840 - RNA, 19 nt, Human
ucuguuuagauaauacacc

SEQ ID NO: 1213841 - RNA, 16 nt, Human
ucuguuuagauaauac

SEQ ID NO: 1213842 - RNA, 14 nt, Human
agacagcugccugg

SEQ ID NO: 1213843 - RNA, 13 nt, Human
agacagcugccug

SEQ ID NO: 1213844 - RNA, 22 nt, Human
agacaccuugacagggcacacc

SEQ ID NO: 1213845 - RNA, 24 nt, Human
agacacauguccaagaagcccagg

SEQ ID NO: 1213846 - RNA, 22 nt, Human
agacacauguccaagaagccca

SEQ ID NO: 1213847 - RNA, 21 nt, Human
agacacauguccaagaagccc

SEQ ID NO: 1213848 - RNA, 23 nt, Human
agacacaggcccggcuccaggcu

SEQ ID NO: 1213849 - RNA, 22 nt, Human
agacacaggcccggcuccaggc

SEQ ID NO: 1213850 - RNA, 21 nt, Human
agacacaggcccggcuccagg

SEQ ID NO: 1213851 - RNA, 20 nt, Human
agacacaggcccggcuccag

SEQ ID NO: 1213852 - RNA, 19 nt, Human
agacacaggcccggcucca

SEQ ID NO: 1213853 - RNA, 17 nt, Human
agacacaggcccggcuc

SEQ ID NO: 1213854 - RNA, 14 nt, Human
agacacaagccuuc

SEQ ID NO: 1213855 - RNA, 13 nt, Human
agacacaagccuu

SEQ ID NO: 1213856 - RNA, 17 nt, Human
agaauucucuuauccaa

SEQ ID NO: 1213857 - RNA, 19 nt, Human
agaauucucuaguuugauu

SEQ ID NO: 1213858 - RNA, 14 nt, Human
ucuuagauguauau

SEQ ID NO: 1213859 - RNA, 12 nt, Human
ucuuagauguau

SEQ ID NO: 1213860 - RNA, 14 nt, Human
agacagucccugcc

SEQ ID NO: 1213861 - RNA, 13 nt, Human
agacagucccugc

SEQ ID NO: 1213862 - RNA, 12 nt, Human
agacagucccug

SEQ ID NO: 1213863 - RNA, 16 nt, Human
agacagcugccuggga

SEQ ID NO: 1213864 - RNA, 15 nt, Human
agacagcugccuggg

SEQ ID NO: 1213865 - RNA, 23 nt, Human
ucuucuguacgucugacaggcaa

SEQ ID NO: 1213866 - RNA, 22 nt, Human
ucuucuguacgucugacaggca

SEQ ID NO: 1213867 - RNA, 21 nt, Human
ucuucuguacgucugacaggc

SEQ ID NO: 1213868 - RNA, 22 nt, Human
ucuucugcuucagccucccgag

SEQ ID NO: 1213869 - RNA, 19 nt, Human
ucuugagccuugaacuuug

SEQ ID NO: 1213870 - RNA, 18 nt, Human
ucuugagccuugaacuuu

SEQ ID NO: 1213871 - RNA, 20 nt, Human
ucuugagccuugaacuuuga

SEQ ID NO: 1213872 - RNA, 17 nt, Human
ucuugagccuugaacuu

SEQ ID NO: 1213873 - RNA, 15 nt, Human
agacucauucuucug

SEQ ID NO: 1213874 - RNA, 14 nt, Human
agacccggcugcgu

SEQ ID NO: 1213875 - RNA, 16 nt, Human
agacuguacaaaguag

SEQ ID NO: 1213876 - RNA, 15 nt, Human
agacuguacaaagua

SEQ ID NO: 1213877 - RNA, 21 nt, Human
agacucgcgacaaugcaaacc

SEQ ID NO: 1213878 - RNA, 20 nt, Human
agacucgcgacaaugcaaac

SEQ ID NO: 1213879 - RNA, 15 nt, Human
agagacacaagccuu

SEQ ID NO: 1213880 - RNA, 22 nt, Human
agagaaaaaauauuuuccugcc

SEQ ID NO: 1213881 - RNA, 19 nt, Human
ucuuucuggcuaugcauuu

SEQ ID NO: 1213882 - RNA, 18 nt, Human
ucuuucuggcuaugcauu

SEQ ID NO: 1213883 - RNA, 13 nt, Human
ucuuucugcuuug

SEQ ID NO: 1213884 - RNA, 20 nt, Human
ucuuuauaauucuacuuuga

SEQ ID NO: 1213885 - RNA, 19 nt, Human
agacucgcgacaaugcaaa

SEQ ID NO: 1213886 - RNA, 18 nt, Human
agacucgcgacaaugcaa

SEQ ID NO: 1213887 - RNA, 17 nt, Human
agacucgcgacaaugca

SEQ ID NO: 1213888 - RNA, 15 nt, Human
agacucgcgacaaug

SEQ ID NO: 1213889 - RNA, 14 nt, Human
ucuugguuuguaaa

SEQ ID NO: 1213890 - RNA, 22 nt, Human
ucuuuaaugucacaggcagguc

SEQ ID NO: 1213891 - RNA, 20 nt, Human
ucuuuaaugucacaggcagg

SEQ ID NO: 1213892 - RNA, 16 nt, Human
ucuugguuuguaaauu

SEQ ID NO: 1213893 - RNA, 23 nt, Human
ucugagacucgcgacaaugcaaa

SEQ ID NO: 1213894 - RNA, 19 nt, Human
ucugcacuccccugcuggg

SEQ ID NO: 1213895 - RNA, 18 nt, Human
ucugcacuccccugcugg

SEQ ID NO: 1213896 - RNA, 18 nt, Human
ucugauucccaagcucug

SEQ ID NO: 1213897 - RNA, 22 nt, Human
ucugcacuccccugcugggugu

SEQ ID NO: 1213898 - RNA, 20 nt, Human
ucugcacuccccugcugggu

SEQ ID NO: 1213899 - RNA, 20 nt, Human
agaaauaucugaaaauguau

SEQ ID NO: 1213900 - RNA, 19 nt, Human
agaaauaucugaaaaugua

SEQ ID NO: 1213901 - RNA, 14 nt, Human
agaaauauaauuga

SEQ ID NO: 1213902 - RNA, 12 nt, Human
ucugacacacag

SEQ ID NO: 1213903 - RNA, 15 nt, Human
ucucucacuccuuga

SEQ ID NO: 1213904 - RNA, 13 nt, Human
ucucucacuccuu

SEQ ID NO: 1213905 - RNA, 18 nt, Human
acuuugaccucugcagca

SEQ ID NO: 1213906 - RNA, 14 nt, Human
acuuucugaaauaa

SEQ ID NO: 1213907 - RNA, 16 nt, Human
acuuugaccucugcag

SEQ ID NO: 1213908 - RNA, 15 nt, Human
acuuugaccucugca

SEQ ID NO: 1213909 - RNA, 19 nt, Human
ucucuccagccccuggaug

SEQ ID NO: 1213910 - RNA, 18 nt, Human
ucucuccagccccuggau

SEQ ID NO: 1213911 - RNA, 17 nt, Human
ucucuccagccccugga

SEQ ID NO: 1213912 - RNA, 17 nt, Human
ucucugcccuccaagac

SEQ ID NO: 1213913 - RNA, 16 nt, Human
ucucugcccuccaaga

SEQ ID NO: 1213914 - RNA, 15 nt, Human
ucucugcccuccaag

SEQ ID NO: 1213915 - RNA, 17 nt, Human
ucucuccuguaccucuu

SEQ ID NO: 1213916 - RNA, 16 nt, Human
ucucuccuguaccucu

SEQ ID NO: 1213917 - RNA, 14 nt, Human
ucucuccuguaccu

SEQ ID NO: 1213918 - RNA, 18 nt, Human
agaaaaaggaugcacaga

SEQ ID NO: 1213919 - RNA, 17 nt, Human
agaaaaaggaugcacag

SEQ ID NO: 1213920 - RNA, 13 nt, Human
agaaaaagaaaaa

SEQ ID NO: 1213921 - RNA, 21 nt, Human
ucucuuuaaugucacaggcag

SEQ ID NO: 1213922 - RNA, 20 nt, Human
ucucuuuaaugucacaggca

SEQ ID NO: 1213923 - RNA, 16 nt, Human
ucucuugguccugcug

SEQ ID NO: 1213924 - RNA, 16 nt, Human
ucucuugauucauaau

SEQ ID NO: 1213925 - RNA, 14 nt, Human
ucucuugauucaua

SEQ ID NO: 1213926 - RNA, 18 nt, Human
ucucuugagccugggagg

SEQ ID NO: 1213927 - RNA, 19 nt, Human
ucucagggccuggucguuu

SEQ ID NO: 1213928 - RNA, 15 nt, Human
ucucagggccugguc

SEQ ID NO: 1213929 - RNA, 14 nt, Human
ucucagggccuggu

SEQ ID NO: 1213930 - RNA, 13 nt, Human
ucucagggccugg

SEQ ID NO: 1213931 - RNA, 12 nt, Human
ucucagggccug

SEQ ID NO: 1213932 - RNA, 16 nt, Human
ucuccaggcuguaucc

SEQ ID NO: 1213933 - RNA, 15 nt, Human
ucuccaagcaggaca

SEQ ID NO: 1213934 - RNA, 22 nt, Human
ucuccaaaauaaaacuuuuuaa

SEQ ID NO: 1213935 - RNA, 19 nt, Human
ucuccaaaauaaaacuuuu

SEQ ID NO: 1213936 - RNA, 17 nt, Human
ucuccaaaauaaaacuu

SEQ ID NO: 1213937 - RNA, 17 nt, Human
acuuucuagccagagga

SEQ ID NO: 1213938 - RNA, 21 nt, Human
ucuccuccuuuucacaguucu

SEQ ID NO: 1213939 - RNA, 16 nt, Human
ucuccauguuugaugu

SEQ ID NO: 1213940 - RNA, 16 nt, Human
acuuguggacacagcu

SEQ ID NO: 1213941 - RNA, 18 nt, Human
acuuguggacacagcucu

SEQ ID NO: 1213942 - RNA, 17 nt, Human
acuuguggacacagcuc

SEQ ID NO: 1213943 - RNA, 19 nt, Human
acuugagcccagagugaac

SEQ ID NO: 1213944 - RNA, 18 nt, Human
acuucuccacccugcucu

SEQ ID NO: 1213945 - RNA, 16 nt, Human
acuucuccacccugcu

SEQ ID NO: 1213946 - RNA, 15 nt, Human
acuucuccacccugc

SEQ ID NO: 1213947 - RNA, 11 nt, Human
ucucacuccuu

SEQ ID NO: 1213948 - RNA, 16 nt, Human
acuucagcugacuuuu

SEQ ID NO: 1213949 - RNA, 11 nt, Human
acuucagcuga

SEQ ID NO: 1213950 - RNA, 14 nt, Human
acuucuccacccug

SEQ ID NO: 1213951 - RNA, 16 nt, Human
ucucacucugucgccc

SEQ ID NO: 1213952 - RNA, 12 nt, Human
ucucacucuguc

SEQ ID NO: 1213953 - RNA, 16 nt, Human
ucucacuauguugccc

SEQ ID NO: 1213954 - RNA, 13 nt, Human
ucucacuccuuga

SEQ ID NO: 1213955 - RNA, 15 nt, Human
uccuucagugccuua

SEQ ID NO: 1213956 - RNA, 20 nt, Human
uccuucagugccuuauggaa

SEQ ID NO: 1213957 - RNA, 17 nt, Human
uccuucagugccuuaug

SEQ ID NO: 1213958 - RNA, 16 nt, Human
uccuucagugccuuau

SEQ ID NO: 1213959 - RNA, 19 nt, Human
uccuuuagcgcccaguugg

SEQ ID NO: 1213960 - RNA, 15 nt, Human
uccuuuagcgcccag

SEQ ID NO: 1213961 - RNA, 23 nt, Human
uccuuguguuacuaaguuuuuau

SEQ ID NO: 1213962 - RNA, 14 nt, Human
uccuuguguuacua

SEQ ID NO: 1213963 - RNA, 23 nt, Human
uccuuuagcgcccaguugggugg

SEQ ID NO: 1213964 - RNA, 22 nt, Human
uccuuuagcgcccaguugggug

SEQ ID NO: 1213965 - RNA, 16 nt, Human
ucgagcaugccuggau

SEQ ID NO: 1213966 - RNA, 18 nt, Human
ucgagcaugccuggaugg

SEQ ID NO: 1213967 - RNA, 19 nt, Human
ucgcgacaaugcaaaccau

SEQ ID NO: 1213968 - RNA, 16 nt, Human
ucgcgacaaugcaaac

SEQ ID NO: 1213969 - RNA, 13 nt, Human
ucgaggacaggga

SEQ ID NO: 1213970 - RNA, 18 nt, Human
acugcuuaacuucacaua

SEQ ID NO: 1213971 - RNA, 22 nt, Human
acuggauuaaacuuaaucuaaa

SEQ ID NO: 1213972 - RNA, 15 nt, Human
acuggauuaaacuua

SEQ ID NO: 1213973 - RNA, 14 nt, Human
acugcuuuuggucu

SEQ ID NO: 1213974 - RNA, 17 nt, Human
acugcuuccagugaggc

SEQ ID NO: 1213975 - RNA, 20 nt, Human
acugcuuaacuucacauauu

SEQ ID NO: 1213976 - RNA, 16 nt, Human
acugcauaugaaagga

SEQ ID NO: 1213977 - RNA, 22 nt, Human
uccuagaaauuccccacccuga

SEQ ID NO: 1213978 - RNA, 21 nt, Human
uccuagaaauuccccacccug

SEQ ID NO: 1213979 - RNA, 16 nt, Human
acugcauguuugugau

SEQ ID NO: 1213980 - RNA, 15 nt, Human
acugcauguuuguga

SEQ ID NO: 1213981 - RNA, 22 nt, Human
acugcaucaagaugugacaugu

SEQ ID NO: 1213982 - RNA, 20 nt, Human
acugcaucaagaugugacau

SEQ ID NO: 1213983 - RNA, 14 nt, Human
acuguucucugccc

SEQ ID NO: 1213984 - RNA, 21 nt, Human
acuguucucugcccuccaaga

SEQ ID NO: 1213985 - RNA, 20 nt, Human
acuguucucugcccuccaag

SEQ ID NO: 1213986 - RNA, 15 nt, Human
acuguucucugcccu

SEQ ID NO: 1213987 - RNA, 16 nt, Human
ucuaaagcugccagcc

SEQ ID NO: 1213988 - RNA, 15 nt, Human
ucuaaagcugccagc

SEQ ID NO: 1213989 - RNA, 14 nt, Human
ucuaaagcugccag

SEQ ID NO: 1213990 - RNA, 13 nt, Human
ucuaaagcugcca

SEQ ID NO: 1213991 - RNA, 20 nt, Human
acuuaaauaaugugaaacug

SEQ ID NO: 1213992 - RNA, 18 nt, Human
acuuaaauaaugugaaac

SEQ ID NO: 1213993 - RNA, 17 nt, Human
acuuaaauaaugugaaa

SEQ ID NO: 1213994 - RNA, 16 nt, Human
acuuaaauaaugugaa

SEQ ID NO: 1213995 - RNA, 18 nt, Human
acuguugcccaggcuggc

SEQ ID NO: 1213996 - RNA, 17 nt, Human
acuguugcccaggcugg

SEQ ID NO: 1213997 - RNA, 14 nt, Human
acuguugcccaggc

SEQ ID NO: 1213998 - RNA, 13 nt, Human
acuguugcccagg

SEQ ID NO: 1213999 - RNA, 16 nt, Human
acuuaaucuaaaugga

SEQ ID NO: 1214000 - RNA, 15 nt, Human
acuuaaucuaaaugg

SEQ ID NO: 1214001 - RNA, 13 nt, Human
acuuaaucuaaau

SEQ ID NO: 1214002 - RNA, 23 nt, Human
acuguccuacccacccuccuuuc

SEQ ID NO: 1214003 - RNA, 18 nt, Human
acuguccuacccacccuc

SEQ ID NO: 1214004 - RNA, 17 nt, Human
acuguccuacccacccu

SEQ ID NO: 1214005 - RNA, 12 nt, Human
ucgggcaugaca

SEQ ID NO: 1214006 - RNA, 11 nt, Human
ucgggcaugac

SEQ ID NO: 1214007 - RNA, 21 nt, Human
ucgggaggucgaggcaggagg

SEQ ID NO: 1214008 - RNA, 19 nt, Human
ucgggaggucgaggcagga

SEQ ID NO: 1214009 - RNA, 14 nt, Human
acucauugaccuga

SEQ ID NO: 1214010 - RNA, 15 nt, Human
acucauucuucugua

SEQ ID NO: 1214011 - RNA, 17 nt, Human
acuccagaauuucccaa

SEQ ID NO: 1214012 - RNA, 15 nt, Human
acuccagaauuuccc

SEQ ID NO: 1214013 - RNA, 15 nt, Human
acucauugaccugag

SEQ ID NO: 1214014 - RNA, 13 nt, Human
acuccagccuggg

SEQ ID NO: 1214015 - RNA, 12 nt, Human
acuccagccugg

SEQ ID NO: 1214016 - RNA, 23 nt, Human
acuccagaauuucccaaagcagu

SEQ ID NO: 1214017 - RNA, 19 nt, Human
acuccugcaggcagccagg

SEQ ID NO: 1214018 - RNA, 18 nt, Human
acuccugcaggcagccag

SEQ ID NO: 1214019 - RNA, 17 nt, Human
ucccuuacgugaguccu

SEQ ID NO: 1214020 - RNA, 12 nt, Human
ucccugucccag

SEQ ID NO: 1214021 - RNA, 15 nt, Human
ucccugguggcagcu

SEQ ID NO: 1214022 - RNA, 21 nt, Human
acuccugcaggcagccaggcc

SEQ ID NO: 1214023 - RNA, 12 nt, Human
ucccuuuuccuu

SEQ ID NO: 1214024 - RNA, 17 nt, Human
uccggucccugucccag

SEQ ID NO: 1214025 - RNA, 16 nt, Human
uccuagaaauucccca

SEQ ID NO: 1214026 - RNA, 21 nt, Human
ucccucuuucccucccuuccu

SEQ ID NO: 1214027 - RNA, 15 nt, Human
ucccugaaggccccg

SEQ ID NO: 1214028 - RNA, 11 nt, Human
ucccugaaggc

SEQ ID NO: 1214029 - RNA, 20 nt, Human
ucccucuuucccucccuucc

SEQ ID NO: 1214030 - RNA, 18 nt, Human
ucccucuuucccucccuu

SEQ ID NO: 1214031 - RNA, 17 nt, Human
ucccugaaggccccgcc

SEQ ID NO: 1214032 - RNA, 16 nt, Human
ucccugaaggccccgc

SEQ ID NO: 1214033 - RNA, 17 nt, Human
acuacucccccaggugg

SEQ ID NO: 1214034 - RNA, 12 nt, Human
acucaccccagc

SEQ ID NO: 1214035 - RNA, 15 nt, Human
ucccgaguagcuggg

SEQ ID NO: 1214036 - RNA, 20 nt, Human
ucccgaauagcugggacuac

SEQ ID NO: 1214037 - RNA, 17 nt, Human
ucccgaguagcugggac

SEQ ID NO: 1214038 - RNA, 16 nt, Human
ucccgaguagcuggga

SEQ ID NO: 1214039 - RNA, 18 nt, Human
ucccgaguagcugggacu

SEQ ID NO: 1214040 - RNA, 20 nt, Human
ucccgaguagcugggacuac

SEQ ID NO: 1214041 - RNA, 17 nt, Human
acgguuuuacugcagcu

SEQ ID NO: 1214042 - RNA, 15 nt, Human
acgguuuuacugcag

SEQ ID NO: 1214043 - RNA, 20 nt, Human
ucccaccccacacacgccag

SEQ ID NO: 1214044 - RNA, 15 nt, Human
ucccaccccacacac

SEQ ID NO: 1214045 - RNA, 16 nt, Human
ucccacaaaggagagc

SEQ ID NO: 1214046 - RNA, 20 nt, Human
acgggaggguaaggcugugg

SEQ ID NO: 1214047 - RNA, 14 nt, Human
ucccaaagugcugg

SEQ ID NO: 1214048 - RNA, 13 nt, Human
ucccaaagugcug

SEQ ID NO: 1214049 - RNA, 21 nt, Human
ucccaaagcagugcaugcugu

SEQ ID NO: 1214050 - RNA, 18 nt, Human
ucccaaagcagugcaugc

SEQ ID NO: 1214051 - RNA, 17 nt, Human
ucccaaagcagugcaug

SEQ ID NO: 1214052 - RNA, 16 nt, Human
ucccaaagcagugcau

SEQ ID NO: 1214053 - RNA, 18 nt, Human
ucccaaacccuucagugc

SEQ ID NO: 1214054 - RNA, 23 nt, Human
acgccagauucuuuccugaggcu

SEQ ID NO: 1214055 - RNA, 22 nt, Human
acgccagauucuuuccugaggc

SEQ ID NO: 1214056 - RNA, 17 nt, Human
ucccagcugugcucugg

SEQ ID NO: 1214057 - RNA, 12 nt, Human
ucccagccccaa

SEQ ID NO: 1214058 - RNA, 15 nt, Human
acuacauucuguuaa

SEQ ID NO: 1214059 - RNA, 14 nt, Human
acuacauucuguua

SEQ ID NO: 1214060 - RNA, 13 nt, Human
acuacauucuguu

SEQ ID NO: 1214061 - RNA, 12 nt, Human
acuacauucugu

SEQ ID NO: 1214062 - RNA, 15 nt, Human
acuacaguuuguuag

SEQ ID NO: 1214063 - RNA, 14 nt, Human
acuacaguuuguua

SEQ ID NO: 1214064 - RNA, 13 nt, Human
acuacaguuuguu

SEQ ID NO: 1214065 - RNA, 23 nt, Human
acuacaggugugagucaccaagc

SEQ ID NO: 1214066 - RNA, 15 nt, Human
acuacaggcacccac

SEQ ID NO: 1214067 - RNA, 11 nt, Human
acuacaggcac

SEQ ID NO: 1214068 - RNA, 12 nt, Human
acuaaccacgcu

SEQ ID NO: 1214069 - RNA, 15 nt, Human
ucccaucacccgcua

SEQ ID NO: 1214070 - RNA, 22 nt, Human
ucccauaugccugggcagaagg

SEQ ID NO: 1214071 - RNA, 20 nt, Human
ucccagcugugcucuggaca

SEQ ID NO: 1214072 - RNA, 21 nt, Human
uccccaccgcagacaggacca

SEQ ID NO: 1214073 - RNA, 18 nt, Human
uccccaccgcagacagga

SEQ ID NO: 1214074 - RNA, 17 nt, Human
uccccaccgcagacagg

SEQ ID NO: 1214075 - RNA, 12 nt, Human
uccccacccuga

SEQ ID NO: 1214076 - RNA, 22 nt, Human
uccccaccgcagacaggaccag

SEQ ID NO: 1214077 - RNA, 20 nt, Human
accuuuugagugccuuacac

SEQ ID NO: 1214078 - RNA, 17 nt, Human
accuuuugagugccuua

SEQ ID NO: 1214079 - RNA, 14 nt, Human
accuuuugagugcc

SEQ ID NO: 1214080 - RNA, 13 nt, Human
uccagacacaugu

SEQ ID NO: 1214081 - RNA, 22 nt, Human
uccagaauuucccaaagcagug

SEQ ID NO: 1214082 - RNA, 20 nt, Human
uccagaauuucccaaagcag

SEQ ID NO: 1214083 - RNA, 19 nt, Human
uccagacccggcugcgugg

SEQ ID NO: 1214084 - RNA, 18 nt, Human
uccagacccggcugcgug

SEQ ID NO: 1214085 - RNA, 15 nt, Human
uccagacccggcugc

SEQ ID NO: 1214086 - RNA, 14 nt, Human
uccagccccuggau

SEQ ID NO: 1214087 - RNA, 13 nt, Human
uccagccccugga

SEQ ID NO: 1214088 - RNA, 12 nt, Human
uccagccccugg

SEQ ID NO: 1214089 - RNA, 22 nt, Human
accuuuuuuauacauaaacaag

SEQ ID NO: 1214090 - RNA, 21 nt, Human
accuuuuuuauacauaaacaa

SEQ ID NO: 1214091 - RNA, 20 nt, Human
accuuuuuuauacauaaaca

SEQ ID NO: 1214092 - RNA, 19 nt, Human
accuuuuuuauacauaaac

SEQ ID NO: 1214093 - RNA, 21 nt, Human
uccaggcuguaucccaugagc

SEQ ID NO: 1214094 - RNA, 19 nt, Human
acgccagauucuuuccuga

SEQ ID NO: 1214095 - RNA, 16 nt, Human
acgagcaggcuucuuc

SEQ ID NO: 1214096 - RNA, 23 nt, Human
uccaacccucaucaccaacgucu

SEQ ID NO: 1214097 - RNA, 17 nt, Human
uccaacccucaucacca

SEQ ID NO: 1214098 - RNA, 16 nt, Human
uccaacccucaucacc

SEQ ID NO: 1214099 - RNA, 14 nt, Human
uccaacccucauca

SEQ ID NO: 1214100 - RNA, 15 nt, Human
accugccaggaagcc

SEQ ID NO: 1214101 - RNA, 14 nt, Human
accugccaggaagc

SEQ ID NO: 1214102 - RNA, 12 nt, Human
accugccaggaa

SEQ ID NO: 1214103 - RNA, 20 nt, Human
uccaagcuggucccacucag

SEQ ID NO: 1214104 - RNA, 12 nt, Human
uccaagaagccc

SEQ ID NO: 1214105 - RNA, 21 nt, Human
uccaagcuggucccacucagu

SEQ ID NO: 1214106 - RNA, 17 nt, Human
accuggccucugcacuc

SEQ ID NO: 1214107 - RNA, 16 nt, Human
accuggccucugcacu

SEQ ID NO: 1214108 - RNA, 14 nt, Human
accuggccucugca

SEQ ID NO: 1214109 - RNA, 17 nt, Human
uccacccaggagccccg

SEQ ID NO: 1214110 - RNA, 15 nt, Human
uccacccaggagccc

SEQ ID NO: 1214111 - RNA, 14 nt, Human
uccacccaggagcc

SEQ ID NO: 1214112 - RNA, 12 nt, Human
uccacccaggag

SEQ ID NO: 1214113 - RNA, 19 nt, Human
uccacccaccucagccucc

SEQ ID NO: 1214114 - RNA, 18 nt, Human
uccacccaccucagccuc

SEQ ID NO: 1214115 - RNA, 23 nt, Human
accuggccucugcacuccccugc

SEQ ID NO: 1214116 - RNA, 20 nt, Human
accuggccucugcacucccc

SEQ ID NO: 1214117 - RNA, 18 nt, Human
accuggccucugcacucc

SEQ ID NO: 1214118 - RNA, 20 nt, Human
accuuagacagucccugcca

SEQ ID NO: 1214119 - RNA, 19 nt, Human
accuuagacagucccugcc

SEQ ID NO: 1214120 - RNA, 18 nt, Human
accuuagacagucccugc

SEQ ID NO: 1214121 - RNA, 19 nt, Human
accuguuucugcagccacu

SEQ ID NO: 1214122 - RNA, 16 nt, Human
ucaggaagcucagggc

SEQ ID NO: 1214123 - RNA, 15 nt, Human
ucaggaagcucaggg

SEQ ID NO: 1214124 - RNA, 14 nt, Human
ucaggaagcucagg

SEQ ID NO: 1214125 - RNA, 13 nt, Human
ucaggaagcucag

SEQ ID NO: 1214126 - RNA, 22 nt, Human
ucauccuucuggaauaaggaga

SEQ ID NO: 1214127 - RNA, 14 nt, Human
ucauccuucuggaa

SEQ ID NO: 1214128 - RNA, 19 nt, Human
ucauccuccucagaucuuc

SEQ ID NO: 1214129 - RNA, 13 nt, Human
ucauccuccucag

SEQ ID NO: 1214130 - RNA, 18 nt, Human
ucauccucauacccaccc

SEQ ID NO: 1214131 - RNA, 15 nt, Human
ucauccuaagcuauu

SEQ ID NO: 1214132 - RNA, 23 nt, Human
accuccugccucgaacuggcugc

SEQ ID NO: 1214133 - RNA, 13 nt, Human
accuccugccucg

SEQ ID NO: 1214134 - RNA, 14 nt, Human
accugaggcccuuc

SEQ ID NO: 1214135 - RNA, 18 nt, Human
accugauugugucucuug

SEQ ID NO: 1214136 - RNA, 17 nt, Human
accugauugugucucuu

SEQ ID NO: 1214137 - RNA, 15 nt, Human
accugauugugucuc

SEQ ID NO: 1214138 - RNA, 22 nt, Human
accugaggcccuucucuccagc

SEQ ID NO: 1214139 - RNA, 21 nt, Human
accugaggcccuucucuccag

SEQ ID NO: 1214140 - RNA, 20 nt, Human
accugaggcccuucucucca

SEQ ID NO: 1214141 - RNA, 16 nt, Human
accugaggcccuucuc

SEQ ID NO: 1214142 - RNA, 15 nt, Human
accugaggcccuucu

SEQ ID NO: 1214143 - RNA, 19 nt, Human
accucggugccuuccucuu

SEQ ID NO: 1214144 - RNA, 13 nt, Human
accuccugggcua

SEQ ID NO: 1214145 - RNA, 19 nt, Human
ucauugaccugaggcccuu

SEQ ID NO: 1214146 - RNA, 15 nt, Human
ucauugaccugaggc

SEQ ID NO: 1214147 - RNA, 14 nt, Human
ucauugaccugagg

SEQ ID NO: 1214148 - RNA, 12 nt, Human
ucauugaccuga

SEQ ID NO: 1214149 - RNA, 22 nt, Human
ucauugaaaucuuuuugcuuug

SEQ ID NO: 1214150 - RNA, 13 nt, Human
ucauugaaaucuu

SEQ ID NO: 1214151 - RNA, 12 nt, Human
ucauugaaaucu

SEQ ID NO: 1214152 - RNA, 12 nt, Human
ucauucuucugu

SEQ ID NO: 1214153 - RNA, 16 nt, Human
ucaaaagcugggcagg

SEQ ID NO: 1214154 - RNA, 18 nt, Human
ucaaauaacuaaaaggua

SEQ ID NO: 1214155 - RNA, 20 nt, Human
acaugagcaucaggccaggc

SEQ ID NO: 1214156 - RNA, 19 nt, Human
acaugaucuucuuuauaau

SEQ ID NO: 1214157 - RNA, 17 nt, Human
acaugaucuucuuuaua

SEQ ID NO: 1214158 - RNA, 15 nt, Human
acaugaucuucuuua

SEQ ID NO: 1214159 - RNA, 19 nt, Human
acaugagcaucaggccagg

SEQ ID NO: 1214160 - RNA, 18 nt, Human
acaugagcaucaggccag

SEQ ID NO: 1214161 - RNA, 17 nt, Human
acaugagcaucaggcca

SEQ ID NO: 1214162 - RNA, 23 nt, Human
ucaaguauuauaccuuuuuuaga

SEQ ID NO: 1214163 - RNA, 21 nt, Human
ucaaguauuauaccuuuuuua

SEQ ID NO: 1214164 - RNA, 16 nt, Human
ucaaguauuauaccuu

SEQ ID NO: 1214165 - RNA, 15 nt, Human
ucaaguauuauaccu

SEQ ID NO: 1214166 - RNA, 11 nt, Human
ucaaguauuau

SEQ ID NO: 1214167 - RNA, 16 nt, Human
ucaacagguuuuccug

SEQ ID NO: 1214168 - RNA, 17 nt, Human
ucaaauuucuaaaucuc

SEQ ID NO: 1214169 - RNA, 16 nt, Human
ucaaauuucuaaaucu

SEQ ID NO: 1214170 - RNA, 15 nt, Human
ucaaauuucuaaauc

SEQ ID NO: 1214171 - RNA, 15 nt, Human
acauucuguuaauca

SEQ ID NO: 1214172 - RNA, 12 nt, Human
acauucuguuaa

SEQ ID NO: 1214173 - RNA, 21 nt, Human
acauguccaagaagcccagga

SEQ ID NO: 1214174 - RNA, 22 nt, Human
uauuucccucaccuuucccauc

SEQ ID NO: 1214175 - RNA, 23 nt, Human
uauuuccuauauuguuuucagug

SEQ ID NO: 1214176 - RNA, 16 nt, Human
acaguugaaaaacagc

SEQ ID NO: 1214177 - RNA, 15 nt, Human
acaguugaaaaacag

SEQ ID NO: 1214178 - RNA, 20 nt, Human
acaguugaaaaacagcugag

SEQ ID NO: 1214179 - RNA, 20 nt, Human
acaguuuguuaguaugaggc

SEQ ID NO: 1214180 - RNA, 16 nt, Human
acaguuuguuaguaug

SEQ ID NO: 1214181 - RNA, 14 nt, Human
acauacucugcuua

SEQ ID NO: 1214182 - RNA, 17 nt, Human
acauacucccaucugug

SEQ ID NO: 1214183 - RNA, 13 nt, Human
acauacucccauc

SEQ ID NO: 1214184 - RNA, 22 nt, Human
acauacuaaccagcagaaaugc

SEQ ID NO: 1214185 - RNA, 21 nt, Human
acauacuaaccagcagaaaug

SEQ ID NO: 1214186 - RNA, 13 nt, Human
acauacuaaccag

SEQ ID NO: 1214187 - RNA, 22 nt, Human
acaugaaaacacauuuuucuua

SEQ ID NO: 1214188 - RNA, 22 nt, Human
acaucuugcucugcugacagac

SEQ ID NO: 1214189 - RNA, 19 nt, Human
acaugaaaacacauuuuuc

SEQ ID NO: 1214190 - RNA, 18 nt, Human
acaugaaaacacauuuuu

SEQ ID NO: 1214191 - RNA, 17 nt, Human
acaugaaaacacauuuu

SEQ ID NO: 1214192 - RNA, 21 nt, Human
acaucuugcucugcugacaga

SEQ ID NO: 1214193 - RNA, 19 nt, Human
acaucuugcucugcugaca

SEQ ID NO: 1214194 - RNA, 18 nt, Human
acaucuugcucugcugac

SEQ ID NO: 1214195 - RNA, 14 nt, Human
acaucuugcucugc

SEQ ID NO: 1214196 - RNA, 13 nt, Human
acaucuugcucug

SEQ ID NO: 1214197 - RNA, 18 nt, Human
acaucaacaucuugguca

SEQ ID NO: 1214198 - RNA, 16 nt, Human
acaucaacaucuuggu

SEQ ID NO: 1214199 - RNA, 23 nt, Human
acauauugauuuccguuaaaaua

SEQ ID NO: 1214200 - RNA, 22 nt, Human
acauauugauuuccguuaaaau

SEQ ID NO: 1214201 - RNA, 18 nt, Human
acauauugauuuccguua

SEQ ID NO: 1214202 - RNA, 16 nt, Human
acauauugauuuccgu

SEQ ID NO: 1214203 - RNA, 14 nt, Human
acauauugauuucc

SEQ ID NO: 1214204 - RNA, 16 nt, Human
accagagcccaccuug

SEQ ID NO: 1214205 - RNA, 14 nt, Human
accagagcccaccu

SEQ ID NO: 1214206 - RNA, 17 nt, Human
accagacaccuugacag

SEQ ID NO: 1214207 - RNA, 14 nt, Human
accagacaccuuga

SEQ ID NO: 1214208 - RNA, 22 nt, Human
accacuuuuguucuugguuugu

SEQ ID NO: 1214209 - RNA, 21 nt, Human
accacuuuuguucuugguuug

SEQ ID NO: 1214210 - RNA, 16 nt, Human
accacuuuuguucuug

SEQ ID NO: 1214211 - RNA, 15 nt, Human
accacuuuuguucuu

SEQ ID NO: 1214212 - RNA, 20 nt, Human
accacugcacuccagccugg

SEQ ID NO: 1214213 - RNA, 18 nt, Human
ucaccccggccaccugcg

SEQ ID NO: 1214214 - RNA, 17 nt, Human
ucaccccggccaccugc

SEQ ID NO: 1214215 - RNA, 22 nt, Human
ucaccccggccaccugcggugc

SEQ ID NO: 1214216 - RNA, 21 nt, Human
accacugcacuccagccuggg

SEQ ID NO: 1214217 - RNA, 20 nt, Human
ucacuauguugcccaggcag

SEQ ID NO: 1214218 - RNA, 19 nt, Human
ucacuauguugcccaggca

SEQ ID NO: 1214219 - RNA, 18 nt, Human
ucacuauguugcccaggc

SEQ ID NO: 1214220 - RNA, 16 nt, Human
ucaccugccccucaac

SEQ ID NO: 1214221 - RNA, 15 nt, Human
ucaccugccccucaa

SEQ ID NO: 1214222 - RNA, 13 nt, Human
ucaccugccccuc

SEQ ID NO: 1214223 - RNA, 16 nt, Human
ucaccugaagacucau

SEQ ID NO: 1214224 - RNA, 15 nt, Human
ucaccucucccuugg

SEQ ID NO: 1214225 - RNA, 17 nt, Human
accagagcccaccuugg

SEQ ID NO: 1214226 - RNA, 15 nt, Human
accaauguucucucu

SEQ ID NO: 1214227 - RNA, 22 nt, Human
accaacauacucccaucuguga

SEQ ID NO: 1214228 - RNA, 21 nt, Human
accaacauacucccaucugug

SEQ ID NO: 1214229 - RNA, 19 nt, Human
accaacauacucccaucug

SEQ ID NO: 1214230 - RNA, 15 nt, Human
ucaagugaaaaagga

SEQ ID NO: 1214231 - RNA, 22 nt, Human
ucaaguccucuuuucugagagg

SEQ ID NO: 1214232 - RNA, 23 nt, Human
ucaagugaaaaaggaggaagaga

SEQ ID NO: 1214233 - RNA, 15 nt, Human
ucaccccggccaccu

SEQ ID NO: 1214234 - RNA, 20 nt, Human
ucaccccagccccaaaacuc

SEQ ID NO: 1214235 - RNA, 14 nt, Human
ucaccccagcccca

SEQ ID NO: 1214236 - RNA, 13 nt, Human
ucaccccagcccc

SEQ ID NO: 1214237 - RNA, 15 nt, Human
ucacauaucugucau

SEQ ID NO: 1214238 - RNA, 12 nt, Human
ucacauaucugu

SEQ ID NO: 1214239 - RNA, 15 nt, Human
ucacaguucucuccu

SEQ ID NO: 1214240 - RNA, 23 nt, Human
ucacucuuauugcccacgcugga

SEQ ID NO: 1214241 - RNA, 21 nt, Human
ucacucuuauugcccacgcug

SEQ ID NO: 1214242 - RNA, 22 nt, Human
accauggucggaaaacaugcua

SEQ ID NO: 1214243 - RNA, 11 nt, Human
acccacugcuu

SEQ ID NO: 1214244 - RNA, 15 nt, Human
acccacugcucuggu

SEQ ID NO: 1214245 - RNA, 14 nt, Human
acccacugcucugg

SEQ ID NO: 1214246 - RNA, 13 nt, Human
acccacugcucug

SEQ ID NO: 1214247 - RNA, 11 nt, Human
acccacugcuc

SEQ ID NO: 1214248 - RNA, 10 nt, Human
acccacugcu

SEQ ID NO: 1214249 - RNA, 18 nt, Human
ucagagccugcaguuauu

SEQ ID NO: 1214250 - RNA, 15 nt, Human
ucagagccugcaguu

SEQ ID NO: 1214251 - RNA, 14 nt, Human
ucagagccugcagu

SEQ ID NO: 1214252 - RNA, 13 nt, Human
ucagagccugcag

SEQ ID NO: 1214253 - RNA, 12 nt, Human
ucagagccugca

SEQ ID NO: 1214254 - RNA, 23 nt, Human
ucagagagggugggagugggccc

SEQ ID NO: 1214255 - RNA, 21 nt, Human
ucagagagggugggagugggc

SEQ ID NO: 1214256 - RNA, 16 nt, Human
ucagagagggugggag

SEQ ID NO: 1214257 - RNA, 22 nt, Human
ucagagacuccugcaggcagcc

SEQ ID NO: 1214258 - RNA, 21 nt, Human
ucagagacuccugcaggcagc

SEQ ID NO: 1214259 - RNA, 20 nt, Human
ucagagacuccugcaggcag

SEQ ID NO: 1214260 - RNA, 17 nt, Human
ucagagacuccugcagg

SEQ ID NO: 1214261 - RNA, 23 nt, Human
ucagaaguuucugccgcagcccu

SEQ ID NO: 1214262 - RNA, 19 nt, Human
ucagaaucucaaauaacua

SEQ ID NO: 1214263 - RNA, 18 nt, Human
ucagaaucucaaauaacu

SEQ ID NO: 1214264 - RNA, 22 nt, Human
ucagaaguuucugccgcagccc

SEQ ID NO: 1214265 - RNA, 19 nt, Human
ucagaaguuucugccgcag

SEQ ID NO: 1214266 - RNA, 23 nt, Human
ucagccguguaaccauggaccca

SEQ ID NO: 1214267 - RNA, 23 nt, Human
acccagcgagcccugguggcagu

SEQ ID NO: 1214268 - RNA, 19 nt, Human
acccagcgagcccuggugg

SEQ ID NO: 1214269 - RNA, 22 nt, Human
ucagccaagaauucuuaaauau

SEQ ID NO: 1214270 - RNA, 24 nt, Human
acccagcgagcccugguggcagug

SEQ ID NO: 1214271 - RNA, 16 nt, Human
accccuucgcuccugu

SEQ ID NO: 1214272 - RNA, 15 nt, Human
accccuucgcuccug

SEQ ID NO: 1214273 - RNA, 14 nt, Human
accccuucgcuccu

SEQ ID NO: 1214274 - RNA, 12 nt, Human
acccccacccaa

SEQ ID NO: 1214275 - RNA, 20 nt, Human
ucagcuuguaaauagcucag

SEQ ID NO: 1214276 - RNA, 15 nt, Human
ucagcggggacagcu

SEQ ID NO: 1214277 - RNA, 14 nt, Human
ucagcggggacagc

SEQ ID NO: 1214278 - RNA, 15 nt, Human
uacaaaagcauguga

SEQ ID NO: 1214279 - RNA, 20 nt, Human
uacaaaaagcauaaaaauua

SEQ ID NO: 1214280 - RNA, 13 nt, Human
aaugcugugcccu

SEQ ID NO: 1214281 - RNA, 21 nt, Human
aaugcugugcccuaaagugua

SEQ ID NO: 1214282 - RNA, 20 nt, Human
aaugcugugcccuaaagugu

SEQ ID NO: 1214283 - RNA, 24 nt, Human
aaugcccagccccuucugacccau

SEQ ID NO: 1214284 - RNA, 23 nt, Human
aaugcccagccccuucugaccca

SEQ ID NO: 1214285 - RNA, 22 nt, Human
aaugcccagccccuucugaccc

SEQ ID NO: 1214286 - RNA, 20 nt, Human
aaugcccagccccuucugac

SEQ ID NO: 1214287 - RNA, 16 nt, Human
aauggacguguuauga

SEQ ID NO: 1214288 - RNA, 15 nt, Human
aaugcccagccccuu

SEQ ID NO: 1214289 - RNA, 14 nt, Human
aaugcccagccccu

SEQ ID NO: 1214290 - RNA, 18 nt, Human
uacagaggccaugggccu

SEQ ID NO: 1214291 - RNA, 20 nt, Human
uacaccacuacauucuguua

SEQ ID NO: 1214292 - RNA, 19 nt, Human
uacaccacuacauucuguu

SEQ ID NO: 1214293 - RNA, 18 nt, Human
uacaccacuacauucugu

SEQ ID NO: 1214294 - RNA, 17 nt, Human
uacaccacuacauucug

SEQ ID NO: 1214295 - RNA, 16 nt, Human
uacaccacuacauucu

SEQ ID NO: 1214296 - RNA, 15 nt, Human
uacaccacuacauuc

SEQ ID NO: 1214297 - RNA, 21 nt, Human
aauggacguguuaugacucca

SEQ ID NO: 1214298 - RNA, 18 nt, Human
aauguacugcauaugaaa

SEQ ID NO: 1214299 - RNA, 14 nt, Human
aauguacugcauau

SEQ ID NO: 1214300 - RNA, 19 nt, Human
aauguauguguaaguauuc

SEQ ID NO: 1214301 - RNA, 14 nt, Human
aauguauguguaag

SEQ ID NO: 1214302 - RNA, 12 nt, Human
aauguaugugua

SEQ ID NO: 1214303 - RNA, 17 nt, Human
uacauaaugcgugcaua

SEQ ID NO: 1214304 - RNA, 15 nt, Human
uacaguaucucaggg

SEQ ID NO: 1214305 - RNA, 20 nt, Human
uacauaaugcgugcauacca

SEQ ID NO: 1214306 - RNA, 19 nt, Human
uacauaaugcgugcauacc

SEQ ID NO: 1214307 - RNA, 21 nt, Human
uacauaaugcgugcauaccac

SEQ ID NO: 1214308 - RNA, 12 nt, Human
aauguacugcau

SEQ ID NO: 1214309 - RNA, 19 nt, Human
uaaugaaagacuguacaaa

SEQ ID NO: 1214310 - RNA, 18 nt, Human
uaaugaaagacuguacaa

SEQ ID NO: 1214311 - RNA, 17 nt, Human
uaaugaaagacuguaca

SEQ ID NO: 1214312 - RNA, 14 nt, Human
uaaugaaagacugu

SEQ ID NO: 1214313 - RNA, 23 nt, Human
uaaugaaagacuguacaaaguag

SEQ ID NO: 1214314 - RNA, 22 nt, Human
uaaugaaagacuguacaaagua

SEQ ID NO: 1214315 - RNA, 21 nt, Human
uaaugacuuaagcacacuuga

SEQ ID NO: 1214316 - RNA, 15 nt, Human
uaaugacuuaagcac

SEQ ID NO: 1214317 - RNA, 23 nt, Human
aaucuucugaacuuggcgcugcc

SEQ ID NO: 1214318 - RNA, 20 nt, Human
aaucuucugaacuuggcgcu

SEQ ID NO: 1214319 - RNA, 13 nt, Human
aaucuucugaacu

SEQ ID NO: 1214320 - RNA, 15 nt, Human
aaugagccuggcaag

SEQ ID NO: 1214321 - RNA, 18 nt, Human
aaugacuuacuguacaug

SEQ ID NO: 1214322 - RNA, 17 nt, Human
aaugacuuacuguacau

SEQ ID NO: 1214323 - RNA, 14 nt, Human
aaugacuuacugua

SEQ ID NO: 1214324 - RNA, 13 nt, Human
uaaugaggaaacu

SEQ ID NO: 1214325 - RNA, 18 nt, Human
aaucuaaauggaaccacu

SEQ ID NO: 1214326 - RNA, 15 nt, Human
aaucuaaauggaacc

SEQ ID NO: 1214327 - RNA, 13 nt, Human
aaucuaaauggaa

SEQ ID NO: 1214328 - RNA, 15 nt, Human
aaucucaaauuucua

SEQ ID NO: 1214329 - RNA, 14 nt, Human
aaucucaaauuucu

SEQ ID NO: 1214330 - RNA, 12 nt, Human
aaucucaaauuu

SEQ ID NO: 1214331 - RNA, 15 nt, Human
aaucucaaauaacua

SEQ ID NO: 1214332 - RNA, 20 nt, Human
uaaguuuuuauggcuuuugu

SEQ ID NO: 1214333 - RNA, 19 nt, Human
aauaggaaaaacugauuuu

SEQ ID NO: 1214334 - RNA, 18 nt, Human
aauaggaaaaacugauuu

SEQ ID NO: 1214335 - RNA, 17 nt, Human
aauaggaaaaacugauu

SEQ ID NO: 1214336 - RNA, 16 nt, Human
aauaggaaaaacugau

SEQ ID NO: 1214337 - RNA, 15 nt, Human
aauaggaaaaacuga

SEQ ID NO: 1214338 - RNA, 14 nt, Human
aauagcugggacua

SEQ ID NO: 1214339 - RNA, 13 nt, Human
aauagcugggacu

SEQ ID NO: 1214340 - RNA, 20 nt, Human
aauagccugccucuucucua

SEQ ID NO: 1214341 - RNA, 23 nt, Human
aauagacaauuuauuauggcaca

SEQ ID NO: 1214342 - RNA, 18 nt, Human
aauagacaauuuauuaug

SEQ ID NO: 1214343 - RNA, 16 nt, Human
uaacauggaaguacua

SEQ ID NO: 1214344 - RNA, 15 nt, Human
uaacauggaaguacu

SEQ ID NO: 1214345 - RNA, 15 nt, Human
uaacuaaaagguaug

SEQ ID NO: 1214346 - RNA, 14 nt, Human
uaacauggaaguac

SEQ ID NO: 1214347 - RNA, 19 nt, Human
uaacuuuuauaaacuuuac

SEQ ID NO: 1214348 - RNA, 18 nt, Human
uaacuuuuauaaacuuua

SEQ ID NO: 1214349 - RNA, 17 nt, Human
uaacuuuuauaaacuuu

SEQ ID NO: 1214350 - RNA, 15 nt, Human
uaacuuuuauaaacu

SEQ ID NO: 1214351 - RNA, 19 nt, Human
aauaucugaaaauguaugu

SEQ ID NO: 1214352 - RNA, 18 nt, Human
aauaucugaaaauguaug

SEQ ID NO: 1214353 - RNA, 17 nt, Human
aauaucugaaaauguau

SEQ ID NO: 1214354 - RNA, 16 nt, Human
aauaucugaaaaugua

SEQ ID NO: 1214355 - RNA, 20 nt, Human
aauaucugaaaauguaugug

SEQ ID NO: 1214356 - RNA, 22 nt, Human
aauauugcugauggugcaauga

SEQ ID NO: 1214357 - RNA, 21 nt, Human
aauauugcugauggugcaaug

SEQ ID NO: 1214358 - RNA, 18 nt, Human
aauauugcugauggugca

SEQ ID NO: 1214359 - RNA, 15 nt, Human
aauauugcugauggu

SEQ ID NO: 1214360 - RNA, 13 nt, Human
aauauugcugaug

SEQ ID NO: 1214361 - RNA, 12 nt, Human
aauauugcugau

SEQ ID NO: 1214362 - RNA, 11 nt, Human
aauauugcuga

SEQ ID NO: 1214363 - RNA, 18 nt, Human
aauauugauaugcuuaua

SEQ ID NO: 1214364 - RNA, 15 nt, Human
aauaugcacacauuu

SEQ ID NO: 1214365 - RNA, 19 nt, Human
uaaauaaugugaaacugga

SEQ ID NO: 1214366 - RNA, 18 nt, Human
uaaauuaacuuuuauaaa

SEQ ID NO: 1214367 - RNA, 17 nt, Human
uaaauuaacuuuuauaa

SEQ ID NO: 1214368 - RNA, 16 nt, Human
uaaauuaacuuuuaua

SEQ ID NO: 1214369 - RNA, 15 nt, Human
uaaauuaacuuuuau

SEQ ID NO: 1214370 - RNA, 14 nt, Human
uaaauuaacuuuua

SEQ ID NO: 1214371 - RNA, 12 nt, Human
uaaauuaacuuu

SEQ ID NO: 1214372 - RNA, 20 nt, Human
uaaauguugaaagaucaaaa

SEQ ID NO: 1214373 - RNA, 15 nt, Human
uaaauguugaaagau

SEQ ID NO: 1214374 - RNA, 23 nt, Human
uaaaugcaccuggaauauauaac

SEQ ID NO: 1214375 - RNA, 18 nt, Human
uaaaucuccaaaauaaaa

SEQ ID NO: 1214376 - RNA, 15 nt, Human
uaaaucuccaaaaua

SEQ ID NO: 1214377 - RNA, 14 nt, Human
uaaaucuccaaaau

SEQ ID NO: 1214378 - RNA, 20 nt, Human
aaguuuuuauggcuuuugug

SEQ ID NO: 1214379 - RNA, 16 nt, Human
aauaaaucauaaaacu

SEQ ID NO: 1214380 - RNA, 18 nt, Human
aauaaaacuuuuuaaaau

SEQ ID NO: 1214381 - RNA, 15 nt, Human
aauaaaacuuuuuaa

SEQ ID NO: 1214382 - RNA, 14 nt, Human
aauaaaacuuuuua

SEQ ID NO: 1214383 - RNA, 12 nt, Human
aauaaaacuuuu

SEQ ID NO: 1214384 - RNA, 19 nt, Human
acacccagcccacuucugc

SEQ ID NO: 1214385 - RNA, 18 nt, Human
acaccucugcacaagcug

SEQ ID NO: 1214386 - RNA, 16 nt, Human
acaccuugacagggca

SEQ ID NO: 1214387 - RNA, 15 nt, Human
acaccuugacagggc

SEQ ID NO: 1214388 - RNA, 14 nt, Human
acaccuugacaggg

SEQ ID NO: 1214389 - RNA, 19 nt, Human
acaccucugcacaagcugc

SEQ ID NO: 1214390 - RNA, 20 nt, Human
acacuaaccacgcuggaccu

SEQ ID NO: 1214391 - RNA, 19 nt, Human
acacuaaccacgcuggacc

SEQ ID NO: 1214392 - RNA, 17 nt, Human
acacuaaccacgcugga

SEQ ID NO: 1214393 - RNA, 16 nt, Human
acacuaaccacgcugg

SEQ ID NO: 1214394 - RNA, 22 nt, Human
uauaaccaguguuguggauuua

SEQ ID NO: 1214395 - RNA, 13 nt, Human
acacccagcccac

SEQ ID NO: 1214396 - RNA, 12 nt, Human
acacccagccca

SEQ ID NO: 1214397 - RNA, 13 nt, Human
acacauuuuauuu

SEQ ID NO: 1214398 - RNA, 22 nt, Human
acacauguccaagaagcccagg

SEQ ID NO: 1214399 - RNA, 21 nt, Human
acacauguccaagaagcccag

SEQ ID NO: 1214400 - RNA, 19 nt, Human
acacauguccaagaagccc

SEQ ID NO: 1214401 - RNA, 18 nt, Human
acacauguccaagaagcc

SEQ ID NO: 1214402 - RNA, 13 nt, Human
acacauguccaag

SEQ ID NO: 1214403 - RNA, 18 nt, Human
uaguucagguaacaggca

SEQ ID NO: 1214404 - RNA, 21 nt, Human
uagguuggcaaaaaggcagga

SEQ ID NO: 1214405 - RNA, 13 nt, Human
acacagugagucg

SEQ ID NO: 1214406 - RNA, 11 nt, Human
acacagugagu

SEQ ID NO: 1214407 - RNA, 13 nt, Human
uaguagagacagg

SEQ ID NO: 1214408 - RNA, 14 nt, Human
uaguagagacaggg

SEQ ID NO: 1214409 - RNA, 12 nt, Human
acacacagcucu

SEQ ID NO: 1214410 - RNA, 11 nt, Human
acacacagcuc

SEQ ID NO: 1214411 - RNA, 14 nt, Human
acacacacauacac

SEQ ID NO: 1214412 - RNA, 21 nt, Human
acaaugguuuucuuguguguu

SEQ ID NO: 1214413 - RNA, 15 nt, Human
acaaugguuuucuug

SEQ ID NO: 1214414 - RNA, 13 nt, Human
acacucugagacu

SEQ ID NO: 1214415 - RNA, 11 nt, Human
acacucugaga

SEQ ID NO: 1214416 - RNA, 23 nt, Human
acacuguucucugcccuccaaga

SEQ ID NO: 1214417 - RNA, 22 nt, Human
acacuguucucugcccuccaag

SEQ ID NO: 1214418 - RNA, 20 nt, Human
acacuguucucugcccucca

SEQ ID NO: 1214419 - RNA, 18 nt, Human
acacuguucucugcccuc

SEQ ID NO: 1214420 - RNA, 17 nt, Human
acacuguucucugcccu

SEQ ID NO: 1214421 - RNA, 16 nt, Human
acacuguucucugccc

SEQ ID NO: 1214422 - RNA, 15 nt, Human
acacuguucucugcc

SEQ ID NO: 1214423 - RNA, 14 nt, Human
acacuguucucugc

SEQ ID NO: 1214424 - RNA, 22 nt, Human
acagacuggaagcacagcuuca

SEQ ID NO: 1214425 - RNA, 21 nt, Human
acagacuggaagcacagcuuc

SEQ ID NO: 1214426 - RNA, 19 nt, Human
acagacuggaagcacagcu

SEQ ID NO: 1214427 - RNA, 22 nt, Human
acagacacaggcccggcuccag

SEQ ID NO: 1214428 - RNA, 18 nt, Human
acagacacaggcccggcu

SEQ ID NO: 1214429 - RNA, 17 nt, Human
acagacacaggcccggc

SEQ ID NO: 1214430 - RNA, 16 nt, Human
acacuguuucaaacuu

SEQ ID NO: 1214431 - RNA, 15 nt, Human
acacuguuucaaacu

SEQ ID NO: 1214432 - RNA, 20 nt, Human
acagauagauauaugcucug

SEQ ID NO: 1214433 - RNA, 20 nt, Human
acagauacuccuccaagguu

SEQ ID NO: 1214434 - RNA, 22 nt, Human
acagaguuguuacauuuuuaag

SEQ ID NO: 1214435 - RNA, 21 nt, Human
acagaguuguuacauuuuuaa

SEQ ID NO: 1214436 - RNA, 23 nt, Human
acagaugggugcuuggaggaagg

SEQ ID NO: 1214437 - RNA, 23 nt, Human
acagcccgggcucugccucccau

SEQ ID NO: 1214438 - RNA, 22 nt, Human
acagcccgggcucugccuccca

SEQ ID NO: 1214439 - RNA, 21 nt, Human
acagcccgggcucugccuccc

SEQ ID NO: 1214440 - RNA, 16 nt, Human
acagcaaggagauuua

SEQ ID NO: 1214441 - RNA, 20 nt, Human
acagaguuguuacauuuuua

SEQ ID NO: 1214442 - RNA, 19 nt, Human
acagaguuguuacauuuuu

SEQ ID NO: 1214443 - RNA, 18 nt, Human
acagaguuguuacauuuu

SEQ ID NO: 1214444 - RNA, 17 nt, Human
acagaguuguuacauuu

SEQ ID NO: 1214445 - RNA, 16 nt, Human
acagaguuguuacauu

SEQ ID NO: 1214446 - RNA, 14 nt, Human
acagagcccacgcc

SEQ ID NO: 1214447 - RNA, 21 nt, Human
acagagcaagugagacccugu

SEQ ID NO: 1214448 - RNA, 15 nt, Human
uaucucagggccugg

SEQ ID NO: 1214449 - RNA, 13 nt, Human
uaucucagggccu

SEQ ID NO: 1214450 - RNA, 20 nt, Human
uaucccuacuguaauuugug

SEQ ID NO: 1214451 - RNA, 19 nt, Human
uaucccuacuguaauuugu

SEQ ID NO: 1214452 - RNA, 17 nt, Human
uacuguaauuugugaua

SEQ ID NO: 1214453 - RNA, 16 nt, Human
uacuguaauuugugau

SEQ ID NO: 1214454 - RNA, 15 nt, Human
uacuguaauuuguga

SEQ ID NO: 1214455 - RNA, 18 nt, Human
uacuguacaugaaaacac

SEQ ID NO: 1214456 - RNA, 22 nt, Human
uacucuacccucuuagaaaaac

SEQ ID NO: 1214457 - RNA, 13 nt, Human
uacgugaguccug

SEQ ID NO: 1214458 - RNA, 18 nt, Human
uacgggaggguaaggcug

SEQ ID NO: 1214459 - RNA, 16 nt, Human
uacgucugacaggcaa

SEQ ID NO: 1214460 - RNA, 15 nt, Human
uacgucugacaggca

SEQ ID NO: 1214461 - RNA, 17 nt, Human
aauuuauuauggcacau

SEQ ID NO: 1214462 - RNA, 14 nt, Human
aauuuauuauggca

SEQ ID NO: 1214463 - RNA, 13 nt, Human
aauuuauuauggc

SEQ ID NO: 1214464 - RNA, 17 nt, Human
aauuuaccugaagucuu

SEQ ID NO: 1214465 - RNA, 15 nt, Human
aauuuacauacucug

SEQ ID NO: 1214466 - RNA, 16 nt, Human
uacuucuuauacauuu

SEQ ID NO: 1214467 - RNA, 15 nt, Human
uacuucuuauacauu

SEQ ID NO: 1214468 - RNA, 14 nt, Human
uacuucuuauacau

SEQ ID NO: 1214469 - RNA, 15 nt, Human
uacuucugcuacaua

SEQ ID NO: 1214470 - RNA, 20 nt, Human
uacuucuccacccugcucuc

SEQ ID NO: 1214471 - RNA, 18 nt, Human
uacuucuccacccugcuc

SEQ ID NO: 1214472 - RNA, 13 nt, Human
uacuucuccaccc

SEQ ID NO: 1214473 - RNA, 16 nt, Human
aauuuguuauaaugaa

SEQ ID NO: 1214474 - RNA, 22 nt, Human
aauuuuuuuaucgucacugcuu

SEQ ID NO: 1214475 - RNA, 14 nt, Human
acaaaacuuuucua

SEQ ID NO: 1214476 - RNA, 21 nt, Human
acaaagcgugguggacaugca

SEQ ID NO: 1214477 - RNA, 16 nt, Human
uagcucaggugucccu

SEQ ID NO: 1214478 - RNA, 19 nt, Human
acaagcuccaagcucccag

SEQ ID NO: 1214479 - RNA, 17 nt, Human
acaagcuccaagcuccc

SEQ ID NO: 1214480 - RNA, 16 nt, Human
acaagcuccaagcucc

SEQ ID NO: 1214481 - RNA, 15 nt, Human
acaagcuccaagcuc

SEQ ID NO: 1214482 - RNA, 22 nt, Human
acaagcuccaagcucccaggca

SEQ ID NO: 1214483 - RNA, 18 nt, Human
acaagcgugagccacugc

SEQ ID NO: 1214484 - RNA, 13 nt, Human
acaagcuccaagc

SEQ ID NO: 1214485 - RNA, 17 nt, Human
acaagcgugagccacug

SEQ ID NO: 1214486 - RNA, 22 nt, Human
acaagagcccaggccuccuaca

SEQ ID NO: 1214487 - RNA, 18 nt, Human
acaagaccacguuucuaa

SEQ ID NO: 1214488 - RNA, 17 nt, Human
acaagaccacguuucua

SEQ ID NO: 1214489 - RNA, 16 nt, Human
acaagaccacguuucu

SEQ ID NO: 1214490 - RNA, 17 nt, Human
acaacaucuuuuucuac

SEQ ID NO: 1214491 - RNA, 19 nt, Human
aaggcuaccuuuguauucu

SEQ ID NO: 1214492 - RNA, 18 nt, Human
aaggccaaaggaagcaca

SEQ ID NO: 1214493 - RNA, 21 nt, Human
guugcccaggcuggcgugcag

SEQ ID NO: 1214494 - RNA, 19 nt, Human
guugcccaggcaggucuug

SEQ ID NO: 1214495 - RNA, 18 nt, Human
guugcccaggcaggucuu

SEQ ID NO: 1214496 - RNA, 17 nt, Human
guugcccaggcaggucu

SEQ ID NO: 1214497 - RNA, 14 nt, Human
aaggcuccaggagc

SEQ ID NO: 1214498 - RNA, 16 nt, Human
aaggaugcuuguacau

SEQ ID NO: 1214499 - RNA, 15 nt, Human
aaggaugcuuguaca

SEQ ID NO: 1214500 - RNA, 22 nt, Human
aaggaugcacagaguuguuaca

SEQ ID NO: 1214501 - RNA, 20 nt, Human
aaggauccugagccagauuu

SEQ ID NO: 1214502 - RNA, 18 nt, Human
aaggaugcacagaguugu

SEQ ID NO: 1214503 - RNA, 19 nt, Human
aaggaugcuuguacauaau

SEQ ID NO: 1214504 - RNA, 17 nt, Human
aaggaugcuuguacaua

SEQ ID NO: 1214505 - RNA, 23 nt, Human
aaggaugaucuaggaagacuuug

SEQ ID NO: 1214506 - RNA, 18 nt, Human
aaggaugaucuaggaaga

SEQ ID NO: 1214507 - RNA, 17 nt, Human
aaggauccugagccaga

SEQ ID NO: 1214508 - RNA, 15 nt, Human
aaggauccugagcca

SEQ ID NO: 1214509 - RNA, 14 nt, Human
aaggauccugagcc

SEQ ID NO: 1214510 - RNA, 23 nt, Human
guugaugaucuuugcagacaggc

SEQ ID NO: 1214511 - RNA, 18 nt, Human
guuggucccccuuccaug

SEQ ID NO: 1214512 - RNA, 12 nt, Human
guuuucuguucu

SEQ ID NO: 1214513 - RNA, 11 nt, Human
guuuucuguuc

SEQ ID NO: 1214514 - RNA, 15 nt, Human
guuuuacugcagcuu

SEQ ID NO: 1214515 - RNA, 18 nt, Human
guuuggggaugagaaagg

SEQ ID NO: 1214516 - RNA, 16 nt, Human
guuugccucugccucu

SEQ ID NO: 1214517 - RNA, 13 nt, Human
guuugccucugcc

SEQ ID NO: 1214518 - RNA, 22 nt, Human
guuugauucagacagcugccug

SEQ ID NO: 1214519 - RNA, 23 nt, Human
guuucuaaaggcuaccuuuguau

SEQ ID NO: 1214520 - RNA, 22 nt, Human
guuucuaaaggcuaccuuugua

SEQ ID NO: 1214521 - RNA, 23 nt, Human
aaggggaauguuugccucugccu

SEQ ID NO: 1214522 - RNA, 22 nt, Human
aaggggaauguuugccucugcc

SEQ ID NO: 1214523 - RNA, 19 nt, Human
aagggccuggccugagcug

SEQ ID NO: 1214524 - RNA, 17 nt, Human
aagggccuggccugagc

SEQ ID NO: 1214525 - RNA, 14 nt, Human
aagggccuggccug

SEQ ID NO: 1214526 - RNA, 19 nt, Human
guuucuaaaggcuaccuuu

SEQ ID NO: 1214527 - RNA, 17 nt, Human
aaguaauaugcacacau

SEQ ID NO: 1214528 - RNA, 16 nt, Human
aaguaauaugcacaca

SEQ ID NO: 1214529 - RNA, 15 nt, Human
aaguaauaugcacac

SEQ ID NO: 1214530 - RNA, 12 nt, Human
aaguaauaugca

SEQ ID NO: 1214531 - RNA, 17 nt, Human
aaggguaucaggugcug

SEQ ID NO: 1214532 - RNA, 16 nt, Human
aaggguaucaggugcu

SEQ ID NO: 1214533 - RNA, 22 nt, Human
aagcuaggccuggccagaugca

SEQ ID NO: 1214534 - RNA, 18 nt, Human
aagcuaggccuggccaga

SEQ ID NO: 1214535 - RNA, 17 nt, Human
aagcuaggccuggccag

SEQ ID NO: 1214536 - RNA, 20 nt, Human
guucaggguuggccccugcc

SEQ ID NO: 1214537 - RNA, 19 nt, Human
guucaggguuggccccugc

SEQ ID NO: 1214538 - RNA, 18 nt, Human
guucaggguuggccccug

SEQ ID NO: 1214539 - RNA, 17 nt, Human
guucaggguuggccccu

SEQ ID NO: 1214540 - RNA, 18 nt, Human
guucagcuccagcucacc

SEQ ID NO: 1214541 - RNA, 17 nt, Human
guucagcuccagcucac

SEQ ID NO: 1214542 - RNA, 16 nt, Human
guucagcuccagcuca

SEQ ID NO: 1214543 - RNA, 20 nt, Human
guuaguaugaggcauuuguu

SEQ ID NO: 1214544 - RNA, 17 nt, Human
guuaguaugaggcauuu

SEQ ID NO: 1214545 - RNA, 18 nt, Human
guuaaugauagcuacugu

SEQ ID NO: 1214546 - RNA, 22 nt, Human
guugaugaucuuugcagacagg

SEQ ID NO: 1214547 - RNA, 21 nt, Human
guucuugguuuguaaauuaac

SEQ ID NO: 1214548 - RNA, 17 nt, Human
guucuuaguuugcaguu

SEQ ID NO: 1214549 - RNA, 13 nt, Human
guucucuccuucu

SEQ ID NO: 1214550 - RNA, 16 nt, Human
guucuacccaggugcu

SEQ ID NO: 1214551 - RNA, 22 nt, Human
guucccuuugacgccaucccag

SEQ ID NO: 1214552 - RNA, 21 nt, Human
guucccuuugacgccauccca

SEQ ID NO: 1214553 - RNA, 20 nt, Human
guucccuuugacgccauccc

SEQ ID NO: 1214554 - RNA, 21 nt, Human
aagcucuacugaggugcuaug

SEQ ID NO: 1214555 - RNA, 22 nt, Human
aagcuauucaguaauaacucua

SEQ ID NO: 1214556 - RNA, 20 nt, Human
guuccauggccucuucagau

SEQ ID NO: 1214557 - RNA, 16 nt, Human
guucccauuugcuccu

SEQ ID NO: 1214558 - RNA, 20 nt, Human
guucccauuugcuccuuucu

SEQ ID NO: 1214559 - RNA, 17 nt, Human
gugugacuacuccccca

SEQ ID NO: 1214560 - RNA, 18 nt, Human
gugucuuuuuucacuaca

SEQ ID NO: 1214561 - RNA, 19 nt, Human
gugucuugcaauggcagcc

SEQ ID NO: 1214562 - RNA, 18 nt, Human
gugucuugcaauggcagc

SEQ ID NO: 1214563 - RNA, 17 nt, Human
gugucuugcaauggcag

SEQ ID NO: 1214564 - RNA, 23 nt, Human
guguuuccuggcacugcuuccag

SEQ ID NO: 1214565 - RNA, 18 nt, Human
aagagguuuuaaaaaaau

SEQ ID NO: 1214566 - RNA, 17 nt, Human
gugguuuucuguucuuu

SEQ ID NO: 1214567 - RNA, 20 nt, Human
guggugguuuucuguucuuu

SEQ ID NO: 1214568 - RNA, 12 nt, Human
aagaugcagccg

SEQ ID NO: 1214569 - RNA, 15 nt, Human
aagauauuuugcuuu

SEQ ID NO: 1214570 - RNA, 13 nt, Human
aagcaaaggagau

SEQ ID NO: 1214571 - RNA, 12 nt, Human
aagcaaaggaga

SEQ ID NO: 1214572 - RNA, 16 nt, Human
aagaugcuucucacug

SEQ ID NO: 1214573 - RNA, 18 nt, Human
aagaugugacauguuuua

SEQ ID NO: 1214574 - RNA, 14 nt, Human
aagaugugacaugu

SEQ ID NO: 1214575 - RNA, 13 nt, Human
gugggauccucca

SEQ ID NO: 1214576 - RNA, 14 nt, Human
gugggagugggccc

SEQ ID NO: 1214577 - RNA, 13 nt, Human
gugggagugggcc

SEQ ID NO: 1214578 - RNA, 23 nt, Human
guggcgcagcauauucaggaagc

SEQ ID NO: 1214579 - RNA, 14 nt, Human
guggugguuuucug

SEQ ID NO: 1214580 - RNA, 16 nt, Human
gugguuucagaaaugu

SEQ ID NO: 1214581 - RNA, 20 nt, Human
gugggggaucacagccucug

SEQ ID NO: 1214582 - RNA, 14 nt, Human
guggguacgggagg

SEQ ID NO: 1214583 - RNA, 17 nt, Human
aagacuguacaaaguag

SEQ ID NO: 1214584 - RNA, 22 nt, Human
aagacugaguacguugugcauu

SEQ ID NO: 1214585 - RNA, 21 nt, Human
aagacugaguacguugugcau

SEQ ID NO: 1214586 - RNA, 17 nt, Human
aagacugaguacguugu

SEQ ID NO: 1214587 - RNA, 18 nt, Human
aagacuaucuaaauguug

SEQ ID NO: 1214588 - RNA, 17 nt, Human
aagacuaucuaaauguu

SEQ ID NO: 1214589 - RNA, 16 nt, Human
aagacuaucuaaaugu

SEQ ID NO: 1214590 - RNA, 22 nt, Human
aagacccuuguggucccacccc

SEQ ID NO: 1214591 - RNA, 21 nt, Human
aagacccuuguggucccaccc

SEQ ID NO: 1214592 - RNA, 18 nt, Human
aagacccuugugguccca

SEQ ID NO: 1214593 - RNA, 21 nt, Human
gugcuaucucccccagcccca

SEQ ID NO: 1214594 - RNA, 22 nt, Human
gugcuaggaacacuccuucaca

SEQ ID NO: 1214595 - RNA, 18 nt, Human
gugcuaggaacacuccuu

SEQ ID NO: 1214596 - RNA, 22 nt, Human
aagaaagacuaucuaaauguug

SEQ ID NO: 1214597 - RNA, 20 nt, Human
aagaaagacuaucuaaaugu

SEQ ID NO: 1214598 - RNA, 19 nt, Human
aagaaaaaggaugcacaga

SEQ ID NO: 1214599 - RNA, 18 nt, Human
aagaaaaaggaugcacag

SEQ ID NO: 1214600 - RNA, 17 nt, Human
aagaaaaaggaugcaca

SEQ ID NO: 1214601 - RNA, 15 nt, Human
aagaaaaaggaugca

SEQ ID NO: 1214602 - RNA, 13 nt, Human
aacuuuaccuuuu

SEQ ID NO: 1214603 - RNA, 22 nt, Human
aacuugucuuuggacccugagg

SEQ ID NO: 1214604 - RNA, 18 nt, Human
aacuugucuuuggacccu

SEQ ID NO: 1214605 - RNA, 21 nt, Human
gugaaccaccacacccagccc

SEQ ID NO: 1214606 - RNA, 15 nt, Human
gugccucaagagaag

SEQ ID NO: 1214607 - RNA, 23 nt, Human
gugccuuauggaacacucugaga

SEQ ID NO: 1214608 - RNA, 21 nt, Human
gugccuuauggaacacucuga

SEQ ID NO: 1214609 - RNA, 14 nt, Human
gugccuuauggaac

SEQ ID NO: 1214610 - RNA, 14 nt, Human
gugccucugggacu

SEQ ID NO: 1214611 - RNA, 13 nt, Human
gugccucugggac

SEQ ID NO: 1214612 - RNA, 12 nt, Human
gugccucuggga

SEQ ID NO: 1214613 - RNA, 20 nt, Human
gugcugggauuacaggugug

SEQ ID NO: 1214614 - RNA, 22 nt, Human
gugcugggauuacaagcgugag

SEQ ID NO: 1214615 - RNA, 21 nt, Human
gugcugggauuacaagcguga

SEQ ID NO: 1214616 - RNA, 12 nt, Human
gugcuauguucu

SEQ ID NO: 1214617 - RNA, 22 nt, Human
gugcuaucucccccagccccau

SEQ ID NO: 1214618 - RNA, 23 nt, Human
guggacacagcucuucuccaggc

SEQ ID NO: 1214619 - RNA, 22 nt, Human
guggacacagcucuucuccagg

SEQ ID NO: 1214620 - RNA, 18 nt, Human
guggacacagcucuucuc

SEQ ID NO: 1214621 - RNA, 21 nt, Human
guggaugccugguggcagcug

SEQ ID NO: 1214622 - RNA, 19 nt, Human
guggcaccagcagccugga

SEQ ID NO: 1214623 - RNA, 20 nt, Human
guggauuuaacagaaaugua

SEQ ID NO: 1214624 - RNA, 19 nt, Human
guggauuuaacagaaaugu

SEQ ID NO: 1214625 - RNA, 18 nt, Human
guggauuuaacagaaaug

SEQ ID NO: 1214626 - RNA, 20 nt, Human
guggcagcucaccucucccu

SEQ ID NO: 1214627 - RNA, 16 nt, Human
guggcagcucaccucu

SEQ ID NO: 1214628 - RNA, 14 nt, Human
guggcagcucaccu

SEQ ID NO: 1214629 - RNA, 16 nt, Human
aagaauugaagcagga

SEQ ID NO: 1214630 - RNA, 15 nt, Human
guaggaagacuuugg

SEQ ID NO: 1214631 - RNA, 18 nt, Human
guaggaagguuaauguuc

SEQ ID NO: 1214632 - RNA, 14 nt, Human
aaaggaugcacaga

SEQ ID NO: 1214633 - RNA, 17 nt, Human
aaaggagagcuagcagc

SEQ ID NO: 1214634 - RNA, 19 nt, Human
guagcugggacuacaggca

SEQ ID NO: 1214635 - RNA, 18 nt, Human
guagcugggacuacaggc

SEQ ID NO: 1214636 - RNA, 12 nt, Human
guagcugggacu

SEQ ID NO: 1214637 - RNA, 21 nt, Human
guagcugggacuacaggcacc

SEQ ID NO: 1214638 - RNA, 19 nt, Human
aaaucucaaauuucuaaau

SEQ ID NO: 1214639 - RNA, 17 nt, Human
aaaucucaaauuucuaa

SEQ ID NO: 1214640 - RNA, 16 nt, Human
aaaucucaaauuucua

SEQ ID NO: 1214641 - RNA, 15 nt, Human
aaaucucaaauuucu

SEQ ID NO: 1214642 - RNA, 17 nt, Human
aaaugaaaaucgugaca

SEQ ID NO: 1214643 - RNA, 18 nt, Human
aaaucccuuaccucggug

SEQ ID NO: 1214644 - RNA, 15 nt, Human
aaaucccauuuaaaa

SEQ ID NO: 1214645 - RNA, 13 nt, Human
aaaucgaugcagu

SEQ ID NO: 1214646 - RNA, 19 nt, Human
aaaugaggucagagccugc

SEQ ID NO: 1214647 - RNA, 17 nt, Human
aaaugaggucagagccu

SEQ ID NO: 1214648 - RNA, 23 nt, Human
aaaugagguacucuccuggaaau

SEQ ID NO: 1214649 - RNA, 16 nt, Human
aaaugagguacucucc

SEQ ID NO: 1214650 - RNA, 19 nt, Human
aaaugagccuggcaagaau

SEQ ID NO: 1214651 - RNA, 13 nt, Human
aaaugagccuggc

SEQ ID NO: 1214652 - RNA, 22 nt, Human
aaaugcaccuggaauauauaac

SEQ ID NO: 1214653 - RNA, 18 nt, Human
aaaugcaccuggaauaua

SEQ ID NO: 1214654 - RNA, 14 nt, Human
aaaugcaccuggaa

SEQ ID NO: 1214655 - RNA, 20 nt, Human
aaaugggcagagcagagacc

SEQ ID NO: 1214656 - RNA, 18 nt, Human
aaaugggcagagcagaga

SEQ ID NO: 1214657 - RNA, 15 nt, Human
aaaugggcagagcag

SEQ ID NO: 1214658 - RNA, 23 nt, Human
aaaugccuuacccucauguucuu

SEQ ID NO: 1214659 - RNA, 13 nt, Human
aaaugcccagcuu

SEQ ID NO: 1214660 - RNA, 18 nt, Human
aaaugcccagccccuucu

SEQ ID NO: 1214661 - RNA, 15 nt, Human
aaaugcccagccccu

SEQ ID NO: 1214662 - RNA, 14 nt, Human
aaaugcccagcccc

SEQ ID NO: 1214663 - RNA, 13 nt, Human
aaaugcccagccc

SEQ ID NO: 1214664 - RNA, 13 nt, Human
guaugguggcugg

SEQ ID NO: 1214665 - RNA, 15 nt, Human
guaugggagagaaga

SEQ ID NO: 1214666 - RNA, 15 nt, Human
guauucuuauuuaau

SEQ ID NO: 1214667 - RNA, 14 nt, Human
guaugggagagaag

SEQ ID NO: 1214668 - RNA, 15 nt, Human
guaucccuacuguaa

SEQ ID NO: 1214669 - RNA, 19 nt, Human
aaaugggggugcauuugag

SEQ ID NO: 1214670 - RNA, 18 nt, Human
aaaugggggugcauuuga

SEQ ID NO: 1214671 - RNA, 17 nt, Human
aaaugggggugcauuug

SEQ ID NO: 1214672 - RNA, 16 nt, Human
aaaugggggugcauuu

SEQ ID NO: 1214673 - RNA, 15 nt, Human
aaaugggggugcauu

SEQ ID NO: 1214674 - RNA, 22 nt, Human
guauuggcuagagguucaaaga

SEQ ID NO: 1214675 - RNA, 23 nt, Human
aaauuaacuuuuauaaacuuuac

SEQ ID NO: 1214676 - RNA, 22 nt, Human
aaauuaacuuuuauaaacuuua

SEQ ID NO: 1214677 - RNA, 21 nt, Human
aaauuaacuuuuauaaacuuu

SEQ ID NO: 1214678 - RNA, 14 nt, Human
aaauucaugcugcu

SEQ ID NO: 1214679 - RNA, 12 nt, Human
aaauuucuaaau

SEQ ID NO: 1214680 - RNA, 15 nt, Human
guauuuuuuuacuaa

SEQ ID NO: 1214681 - RNA, 14 nt, Human
guauuuuuuuacua

SEQ ID NO: 1214682 - RNA, 20 nt, Human
gucacacaguauuacuucug

SEQ ID NO: 1214683 - RNA, 16 nt, Human
gucacacacuuuggcu

SEQ ID NO: 1214684 - RNA, 19 nt, Human
gucaaaguggugagaggca

SEQ ID NO: 1214685 - RNA, 21 nt, Human
guauuuuuuuacuaauagaca

SEQ ID NO: 1214686 - RNA, 17 nt, Human
guauuuuuuuacuaaua

SEQ ID NO: 1214687 - RNA, 23 nt, Human
aaccaucauugaaaucuuuuugc

SEQ ID NO: 1214688 - RNA, 21 nt, Human
aaccaucauugaaaucuuuuu

SEQ ID NO: 1214689 - RNA, 20 nt, Human
aaccaucauugaaaucuuuu

SEQ ID NO: 1214690 - RNA, 19 nt, Human
aaccaucauugaaaucuuu

SEQ ID NO: 1214691 - RNA, 22 nt, Human
aaccacaucuugcucugcugac

SEQ ID NO: 1214692 - RNA, 20 nt, Human
aaccacaucuugcucugcug

SEQ ID NO: 1214693 - RNA, 14 nt, Human
aaccuccugggcua

SEQ ID NO: 1214694 - RNA, 17 nt, Human
aaccuccgccucuuggg

SEQ ID NO: 1214695 - RNA, 15 nt, Human
aacccccagccugcu

SEQ ID NO: 1214696 - RNA, 14 nt, Human
aacccccagccugc

SEQ ID NO: 1214697 - RNA, 13 nt, Human
aacccccagccug

SEQ ID NO: 1214698 - RNA, 17 nt, Human
aacccagcucuggucca

SEQ ID NO: 1214699 - RNA, 14 nt, Human
aacccagcucuggu

SEQ ID NO: 1214700 - RNA, 13 nt, Human
aacccagcucugg

SEQ ID NO: 1214701 - RNA, 11 nt, Human
aacccagcucu

SEQ ID NO: 1214702 - RNA, 19 nt, Human
gugaaccaccacacccagc

SEQ ID NO: 1214703 - RNA, 22 nt, Human
aacguggcugcuucaaggaucc

SEQ ID NO: 1214704 - RNA, 19 nt, Human
aacguggcugcuucaagga

SEQ ID NO: 1214705 - RNA, 16 nt, Human
aacguggcugcuucaa

SEQ ID NO: 1214706 - RNA, 24 nt, Human
gucuuuucuugcaugaggcuagug

SEQ ID NO: 1214707 - RNA, 19 nt, Human
gucuuuucuugcaugaggc

SEQ ID NO: 1214708 - RNA, 14 nt, Human
gucuuuucuugcau

SEQ ID NO: 1214709 - RNA, 18 nt, Human
gucuuuggacccugaggc

SEQ ID NO: 1214710 - RNA, 17 nt, Human
gucuuuggacccugagg

SEQ ID NO: 1214711 - RNA, 15 nt, Human
gucuuuggacccuga

SEQ ID NO: 1214712 - RNA, 14 nt, Human
gucuuuggacccug

SEQ ID NO: 1214713 - RNA, 15 nt, Human
gucuuagauguauau

SEQ ID NO: 1214714 - RNA, 20 nt, Human
aacacuguucucugcccucc

SEQ ID NO: 1214715 - RNA, 15 nt, Human
aacacuguucucugc

SEQ ID NO: 1214716 - RNA, 14 nt, Human
aacacucugagacu

SEQ ID NO: 1214717 - RNA, 13 nt, Human
aacacucugagac

SEQ ID NO: 1214718 - RNA, 12 nt, Human
aacacucugaga

SEQ ID NO: 1214719 - RNA, 11 nt, Human
aacacucugag

SEQ ID NO: 1214720 - RNA, 12 nt, Human
aacacuccuuca

SEQ ID NO: 1214721 - RNA, 21 nt, Human
aacacucauugaccugaggcc

SEQ ID NO: 1214722 - RNA, 22 nt, Human
gucauuugagcagggcucagcg

SEQ ID NO: 1214723 - RNA, 16 nt, Human
aacacuguucucugcc

SEQ ID NO: 1214724 - RNA, 21 nt, Human
aacacuguucucugcccucca

SEQ ID NO: 1214725 - RNA, 21 nt, Human
gucauuugagcagggcucagc

SEQ ID NO: 1214726 - RNA, 15 nt, Human
aacaaggcaaggcug

SEQ ID NO: 1214727 - RNA, 20 nt, Human
aacaagaccacguuucuaaa

SEQ ID NO: 1214728 - RNA, 19 nt, Human
aacaagaccacguuucuaa

SEQ ID NO: 1214729 - RNA, 17 nt, Human
aacaagaccacguuucu

SEQ ID NO: 1214730 - RNA, 16 nt, Human
aacaagaccacguuuc

SEQ ID NO: 1214731 - RNA, 21 nt, Human
gucacacaguauuacuucugc

SEQ ID NO: 1214732 - RNA, 16 nt, Human
gucacaggcaggucca

SEQ ID NO: 1214733 - RNA, 15 nt, Human
gucacaggcaggucc

SEQ ID NO: 1214734 - RNA, 13 nt, Human
gucacaggcaggu

SEQ ID NO: 1214735 - RNA, 23 nt, Human
aacaggcugggcuucaguggcag

SEQ ID NO: 1214736 - RNA, 22 nt, Human
aacaggcugggcuucaguggca

SEQ ID NO: 1214737 - RNA, 20 nt, Human
aacagacuggaagcacagcu

SEQ ID NO: 1214738 - RNA, 19 nt, Human
aacagacuggaagcacagc

SEQ ID NO: 1214739 - RNA, 21 nt, Human
aacagaaauguacagcaagga

SEQ ID NO: 1214740 - RNA, 11 nt, Human
aacagaaaugu

SEQ ID NO: 1214741 - RNA, 10 nt, Human
aacagaaaug

SEQ ID NO: 1214742 - RNA, 21 nt, Human
guccggucccugucccagugc

SEQ ID NO: 1214743 - RNA, 16 nt, Human
aacauacucccaucug

SEQ ID NO: 1214744 - RNA, 15 nt, Human
aacauacucccaucu

SEQ ID NO: 1214745 - RNA, 14 nt, Human
aacauacucccauc

SEQ ID NO: 1214746 - RNA, 17 nt, Human
caagagggucugaggaa

SEQ ID NO: 1214747 - RNA, 16 nt, Human
caagagggucugagga

SEQ ID NO: 1214748 - RNA, 12 nt, Human
caagagggucug

SEQ ID NO: 1214749 - RNA, 23 nt, Human
caagacgcugugcugcccugccc

SEQ ID NO: 1214750 - RNA, 22 nt, Human
caagacgcugugcugcccugcc

SEQ ID NO: 1214751 - RNA, 21 nt, Human
caagacgcugugcugcccugc

SEQ ID NO: 1214752 - RNA, 20 nt, Human
caagacgcugugcugcccug

SEQ ID NO: 1214753 - RNA, 14 nt, Human
caagaccuucuccu

SEQ ID NO: 1214754 - RNA, 13 nt, Human
caagaccuucucc

SEQ ID NO: 1214755 - RNA, 21 nt, Human
caaggcugucaauuacaggaa

SEQ ID NO: 1214756 - RNA, 14 nt, Human
caaggcugucaauu

SEQ ID NO: 1214757 - RNA, 13 nt, Human
caaggcugucaau

SEQ ID NO: 1214758 - RNA, 21 nt, Human
caaggcugggggaagaagcuc

SEQ ID NO: 1214759 - RNA, 17 nt, Human
caaggauccugagccag

SEQ ID NO: 1214760 - RNA, 16 nt, Human
caaggauccugagcca

SEQ ID NO: 1214761 - RNA, 15 nt, Human
caaggauccugagcc

SEQ ID NO: 1214762 - RNA, 14 nt, Human
caaggauccugagc

SEQ ID NO: 1214763 - RNA, 16 nt, Human
caagggccuggccuga

SEQ ID NO: 1214764 - RNA, 21 nt, Human
caagugauucuccugccucag

SEQ ID NO: 1214765 - RNA, 20 nt, Human
caagugauucuccugccuca

SEQ ID NO: 1214766 - RNA, 19 nt, Human
caagugauucuccugccuc

SEQ ID NO: 1214767 - RNA, 19 nt, Human
caagugagacccugucuca

SEQ ID NO: 1214768 - RNA, 15 nt, Human
caagugagacccugu

SEQ ID NO: 1214769 - RNA, 14 nt, Human
caagugagacccug

SEQ ID NO: 1214770 - RNA, 23 nt, Human
caagugaaaaaggaggaagagaa

SEQ ID NO: 1214771 - RNA, 22 nt, Human
caagugaaaaaggaggaagaga

SEQ ID NO: 1214772 - RNA, 13 nt, Human
caaggucauuuuu

SEQ ID NO: 1214773 - RNA, 17 nt, Human
caaggggcccaaauucu

SEQ ID NO: 1214774 - RNA, 23 nt, Human
caaggggaauguuugccucugcc

SEQ ID NO: 1214775 - RNA, 21 nt, Human
caaggggaauguuugccucug

SEQ ID NO: 1214776 - RNA, 15 nt, Human
caagggccuggccug

SEQ ID NO: 1214777 - RNA, 14 nt, Human
caagggccuggccu

SEQ ID NO: 1214778 - RNA, 13 nt, Human
caagggccuggcc

SEQ ID NO: 1214779 - RNA, 16 nt, Human
caacugcauuggcuuu

SEQ ID NO: 1214780 - RNA, 23 nt, Human
caacugcaucaagaugugacaug

SEQ ID NO: 1214781 - RNA, 20 nt, Human
caacugcaucaagaugugac

SEQ ID NO: 1214782 - RNA, 17 nt, Human
caacugcaucaagaugu

SEQ ID NO: 1214783 - RNA, 21 nt, Human
caaccugauugugucucuugg

SEQ ID NO: 1214784 - RNA, 19 nt, Human
caaccugauugugucucuu

SEQ ID NO: 1214785 - RNA, 17 nt, Human
caaccugauugugucuc

SEQ ID NO: 1214786 - RNA, 16 nt, Human
caacauacucccaucu

SEQ ID NO: 1214787 - RNA, 15 nt, Human
caacauacucccauc

SEQ ID NO: 1214788 - RNA, 14 nt, Human
caacauacucccau

SEQ ID NO: 1214789 - RNA, 17 nt, Human
caacaggcugggcuuca

SEQ ID NO: 1214790 - RNA, 14 nt, Human
caacaggcugggcu

SEQ ID NO: 1214791 - RNA, 20 nt, Human
caacaggcugggcuucagug

SEQ ID NO: 1214792 - RNA, 19 nt, Human
caaaguggugagaggcauc

SEQ ID NO: 1214793 - RNA, 17 nt, Human
caaaguggugagaggca

SEQ ID NO: 1214794 - RNA, 16 nt, Human
caaaguggugagaggc

SEQ ID NO: 1214795 - RNA, 23 nt, Human
caaaggguaucaggugcugccau

SEQ ID NO: 1214796 - RNA, 21 nt, Human
caaaggguaucaggugcugcc

SEQ ID NO: 1214797 - RNA, 20 nt, Human
caaaggguaucaggugcugc

SEQ ID NO: 1214798 - RNA, 20 nt, Human
caaaggagauuggaaggaac

SEQ ID NO: 1214799 - RNA, 14 nt, Human
caaaggagauugga

SEQ ID NO: 1214800 - RNA, 21 nt, Human
caaagagguuuuaaaaaaauc

SEQ ID NO: 1214801 - RNA, 14 nt, Human
caaagagguuuuaa

SEQ ID NO: 1214802 - RNA, 20 nt, Human
cacacccagcccacuucugc

SEQ ID NO: 1214803 - RNA, 14 nt, Human
cacacccagcccac

SEQ ID NO: 1214804 - RNA, 16 nt, Human
cacacagcucuguccu

SEQ ID NO: 1214805 - RNA, 22 nt, Human
cacaccagagcccaccuuggcu

SEQ ID NO: 1214806 - RNA, 21 nt, Human
cacaccagagcccaccuuggc

SEQ ID NO: 1214807 - RNA, 15 nt, Human
cacacagcucugucc

SEQ ID NO: 1214808 - RNA, 14 nt, Human
cacacagcucuguc

SEQ ID NO: 1214809 - RNA, 13 nt, Human
cacacagcucugu

SEQ ID NO: 1214810 - RNA, 14 nt, Human
cacacacuuuggcu

SEQ ID NO: 1214811 - RNA, 20 nt, Human
cacacaccagagcccaccuu

SEQ ID NO: 1214812 - RNA, 16 nt, Human
cacacaccagagccca

SEQ ID NO: 1214813 - RNA, 17 nt, Human
cacaaacgggcucagca

SEQ ID NO: 1214814 - RNA, 18 nt, Human
caaugguuuucuugugug

SEQ ID NO: 1214815 - RNA, 14 nt, Human
caaugcacuuuguu

SEQ ID NO: 1214816 - RNA, 13 nt, Human
caaugcacuuugu

SEQ ID NO: 1214817 - RNA, 14 nt, Human
caaugcacugacau

SEQ ID NO: 1214818 - RNA, 23 nt, Human
caaugcaaaccaucauugaaauc

SEQ ID NO: 1214819 - RNA, 22 nt, Human
caaugcaaaccaucauugaaau

SEQ ID NO: 1214820 - RNA, 21 nt, Human
caaugcaaaccaucauugaaa

SEQ ID NO: 1214821 - RNA, 14 nt, Human
caaugcaaaccauc

SEQ ID NO: 1214822 - RNA, 14 nt, Human
caaugauggucacc

SEQ ID NO: 1214823 - RNA, 13 nt, Human
caaugauggucac

SEQ ID NO: 1214824 - RNA, 21 nt, Human
caaugaccuuucaauaggaaa

SEQ ID NO: 1214825 - RNA, 16 nt, Human
caaugaccuuucaaua

SEQ ID NO: 1214826 - RNA, 15 nt, Human
caaugaccuuucaau

SEQ ID NO: 1214827 - RNA, 14 nt, Human
caaugaccuuucaa

SEQ ID NO: 1214828 - RNA, 22 nt, Human
cacacggacacucaaaagcugg

SEQ ID NO: 1214829 - RNA, 23 nt, Human
cacaguccuuaccagcagagcac

SEQ ID NO: 1214830 - RNA, 14 nt, Human
cacaggcccggcuc

SEQ ID NO: 1214831 - RNA, 21 nt, Human
cacagcucuucuccaggcugu

SEQ ID NO: 1214832 - RNA, 20 nt, Human
cacagcucuucuccaggcug

SEQ ID NO: 1214833 - RNA, 19 nt, Human
cacagcucuucuccaggcu

SEQ ID NO: 1214834 - RNA, 17 nt, Human
cacaugagcaucaggcc

SEQ ID NO: 1214835 - RNA, 13 nt, Human
cacaugagcauca

SEQ ID NO: 1214836 - RNA, 21 nt, Human
cacaugagcaucaggccaggc

SEQ ID NO: 1214837 - RNA, 20 nt, Human
cacaugagcaucaggccagg

SEQ ID NO: 1214838 - RNA, 19 nt, Human
cacaugagcaucaggccag

SEQ ID NO: 1214839 - RNA, 18 nt, Human
cacaugagcaucaggcca

SEQ ID NO: 1214840 - RNA, 19 nt, Human
cacaugcaaggucauuuuu

SEQ ID NO: 1214841 - RNA, 17 nt, Human
cacaugcaaggucauuu

SEQ ID NO: 1214842 - RNA, 18 nt, Human
cacaugcacgugugugca

SEQ ID NO: 1214843 - RNA, 20 nt, Human
cacaugcaaggucauuuuuu

SEQ ID NO: 1214844 - RNA, 17 nt, Human
cacauguccaagaagcc

SEQ ID NO: 1214845 - RNA, 16 nt, Human
cacauguccaagaagc

SEQ ID NO: 1214846 - RNA, 13 nt, Human
cacaugccucucu

SEQ ID NO: 1214847 - RNA, 21 nt, Human
cacaugccucucucaggccaa

SEQ ID NO: 1214848 - RNA, 20 nt, Human
cacaugccucucucaggcca

SEQ ID NO: 1214849 - RNA, 19 nt, Human
caccacacccagcccacuu

SEQ ID NO: 1214850 - RNA, 22 nt, Human
caccagagcccaccuuggcuca

SEQ ID NO: 1214851 - RNA, 20 nt, Human
caccagagcccaccuuggcu

SEQ ID NO: 1214852 - RNA, 18 nt, Human
caccagagcccaccuugg

SEQ ID NO: 1214853 - RNA, 17 nt, Human
caccagagcccaccuug

SEQ ID NO: 1214854 - RNA, 15 nt, Human
caccagagcccaccu

SEQ ID NO: 1214855 - RNA, 15 nt, Human
caccaagcccaguua

SEQ ID NO: 1214856 - RNA, 13 nt, Human
caccaagcccagu

SEQ ID NO: 1214857 - RNA, 12 nt, Human
caccaagcccag

SEQ ID NO: 1214858 - RNA, 23 nt, Human
cacauguccaagaagcccaggaa

SEQ ID NO: 1214859 - RNA, 17 nt, Human
caccaacgucugugcca

SEQ ID NO: 1214860 - RNA, 22 nt, Human
cacauguccaagaagcccagga

SEQ ID NO: 1214861 - RNA, 21 nt, Human
cacauguccaagaagcccagg

SEQ ID NO: 1214862 - RNA, 19 nt, Human
cacauguccaagaagccca

SEQ ID NO: 1214863 - RNA, 18 nt, Human
cacauguccaagaagccc

SEQ ID NO: 1214864 - RNA, 18 nt, Human
caccaucaugucuggcua

SEQ ID NO: 1214865 - RNA, 17 nt, Human
caccaucaugucuggcu

SEQ ID NO: 1214866 - RNA, 15 nt, Human
caccaucaugucugg

SEQ ID NO: 1214867 - RNA, 24 nt, Human
caccaucaagccaccaacauacuc

SEQ ID NO: 1214868 - RNA, 19 nt, Human
caccaucaagccaccaaca

SEQ ID NO: 1214869 - RNA, 17 nt, Human
caccaucaagccaccaa

SEQ ID NO: 1214870 - RNA, 16 nt, Human
caccaucaagccacca

SEQ ID NO: 1214871 - RNA, 12 nt, Human
caccagcagccu

SEQ ID NO: 1214872 - RNA, 15 nt, Human
caccaucaagccacc

SEQ ID NO: 1214873 - RNA, 14 nt, Human
caccaucaagccac

SEQ ID NO: 1214874 - RNA, 13 nt, Human
caccaucaagcca

SEQ ID NO: 1214875 - RNA, 21 nt, Human
caccauauuaccacagacaua

SEQ ID NO: 1214876 - RNA, 13 nt, Human
cacccaagggccu

SEQ ID NO: 1214877 - RNA, 15 nt, Human
uuuacuuuguguuca

SEQ ID NO: 1214878 - RNA, 20 nt, Human
uuguauuuuacuaauaaaau

SEQ ID NO: 1214879 - RNA, 18 nt, Human
uuuauaaacuuuaccuuu

SEQ ID NO: 1214880 - RNA, 21 nt, Human
uuuaucgucacugcuuaacuu

SEQ ID NO: 1214881 - RNA, 16 nt, Human
uuuauaaacuuuaccu

SEQ ID NO: 1214882 - RNA, 14 nt, Human
uuuauaaacuuuac

SEQ ID NO: 1214883 - RNA, 18 nt, Human
uuuagaguugauacuaca

SEQ ID NO: 1214884 - RNA, 16 nt, Human
uuuauugucaaagugg

SEQ ID NO: 1214885 - RNA, 14 nt, Human
uuuauugucaaagu

SEQ ID NO: 1214886 - RNA, 15 nt, Human
uuucuagccagagga

SEQ ID NO: 1214887 - RNA, 18 nt, Human
uuucuaaaggcuaccuuu

SEQ ID NO: 1214888 - RNA, 14 nt, Human
uuucuaaaggcuac

SEQ ID NO: 1214889 - RNA, 17 nt, Human
uuucuaaagcugccagc

SEQ ID NO: 1214890 - RNA, 21 nt, Human
uuuccucuuuggucuacacug

SEQ ID NO: 1214891 - RNA, 13 nt, Human
uuuccaggaaggc

SEQ ID NO: 1214892 - RNA, 15 nt, Human
uuuccaaaguacacu

SEQ ID NO: 1214893 - RNA, 12 nt, Human
uuuccaaaguac

SEQ ID NO: 1214894 - RNA, 22 nt, Human
uuucauugcugggcuugucugu

SEQ ID NO: 1214895 - RNA, 16 nt, Human
uuucagccaagaauuc

SEQ ID NO: 1214896 - RNA, 15 nt, Human
uuucagccaagaauu

SEQ ID NO: 1214897 - RNA, 22 nt, Human
uuucaauaggaaaaacugauuu

SEQ ID NO: 1214898 - RNA, 20 nt, Human
uuucaauaggaaaaacugau

SEQ ID NO: 1214899 - RNA, 13 nt, Human
uuugagugccuua

SEQ ID NO: 1214900 - RNA, 22 nt, Human
uuugaggucuguucuuuccaaa

SEQ ID NO: 1214901 - RNA, 15 nt, Human
uuugagcagggcuca

SEQ ID NO: 1214902 - RNA, 14 nt, Human
uuugcagacaggca

SEQ ID NO: 1214903 - RNA, 22 nt, Human
uuugccauguuggccaggcugg

SEQ ID NO: 1214904 - RNA, 18 nt, Human
uuugccauguuggccagg

SEQ ID NO: 1214905 - RNA, 22 nt, Human
uuuguaaauuaacuuuuauaaa

SEQ ID NO: 1214906 - RNA, 17 nt, Human
uuuguaaauuaacuuuu

SEQ ID NO: 1214907 - RNA, 16 nt, Human
uuuguaaauuaacuuu

SEQ ID NO: 1214908 - RNA, 15 nt, Human
uuuguaaauuaacuu

SEQ ID NO: 1214909 - RNA, 21 nt, Human
uuuguccccaccgcagacagg

SEQ ID NO: 1214910 - RNA, 13 nt, Human
uuuguccccaccg

SEQ ID NO: 1214911 - RNA, 19 nt, Human
uuuuaucgucacugcuuaa

SEQ ID NO: 1214912 - RNA, 18 nt, Human
uuuuaucgucacugcuua

SEQ ID NO: 1214913 - RNA, 19 nt, Human
uuuuccaugaguccccugu

SEQ ID NO: 1214914 - RNA, 18 nt, Human
uuuuccaugaguccccug

SEQ ID NO: 1214915 - RNA, 17 nt, Human
uuuucuugcaugaggcu

SEQ ID NO: 1214916 - RNA, 15 nt, Human
uuuuccuucagugcc

SEQ ID NO: 1214917 - RNA, 15 nt, Human
uuuucacaguucucu

SEQ ID NO: 1214918 - RNA, 18 nt, Human
uucaauucucauuuguca

SEQ ID NO: 1214919 - RNA, 21 nt, Human
uucaacagguuuuccugaaga

SEQ ID NO: 1214920 - RNA, 14 nt, Human
uuacgugaguccug

SEQ ID NO: 1214921 - RNA, 13 nt, Human
uuacgugaguccu

SEQ ID NO: 1214922 - RNA, 13 nt, Human
uucaaagauauuu

SEQ ID NO: 1214923 - RNA, 14 nt, Human
uucacucuccuugg

SEQ ID NO: 1214924 - RNA, 19 nt, Human
uucagagacuccugcaggc

SEQ ID NO: 1214925 - RNA, 15 nt, Human
uucagagacuccugc

SEQ ID NO: 1214926 - RNA, 16 nt, Human
uucaggaagcucaggg

SEQ ID NO: 1214927 - RNA, 21 nt, Human
uucagcugguugagguuucaa

SEQ ID NO: 1214928 - RNA, 17 nt, Human
uucagcugacuuuucug

SEQ ID NO: 1214929 - RNA, 18 nt, Human
uucagcugcauacaguuu

SEQ ID NO: 1214930 - RNA, 24 nt, Human
uucagcucugcaagaauugaagca

SEQ ID NO: 1214931 - RNA, 17 nt, Human
uucagcucugcaagaau

SEQ ID NO: 1214932 - RNA, 23 nt, Human
uucagcuccagcucaccagcccc

SEQ ID NO: 1214933 - RNA, 20 nt, Human
uucaggaagcucagggccug

SEQ ID NO: 1214934 - RNA, 19 nt, Human
uucaggaagcucagggccu

SEQ ID NO: 1214935 - RNA, 17 nt, Human
uucaggaagcucagggc

SEQ ID NO: 1214936 - RNA, 17 nt, Human
uuccaugaguccccugu

SEQ ID NO: 1214937 - RNA, 19 nt, Human
uucauuuaggugaggaagc

SEQ ID NO: 1214938 - RNA, 17 nt, Human
uucaucuugaauuguaa

SEQ ID NO: 1214939 - RNA, 12 nt, Human
uucaucuugaau

SEQ ID NO: 1214940 - RNA, 11 nt, Human
uucaucuugaa

SEQ ID NO: 1214941 - RNA, 20 nt, Human
uucaucuuccaacucaaacu

SEQ ID NO: 1214942 - RNA, 23 nt, Human
uucauaaugacuuaagcacacuu

SEQ ID NO: 1214943 - RNA, 13 nt, Human
uucauaaugacuu

SEQ ID NO: 1214944 - RNA, 13 nt, Human
uucaguggcagcu

SEQ ID NO: 1214945 - RNA, 21 nt, Human
uucagugccuuauggaacacu

SEQ ID NO: 1214946 - RNA, 19 nt, Human
uucagugccuuauggaaca

SEQ ID NO: 1214947 - RNA, 19 nt, Human
uucccuuugacgccauccc

SEQ ID NO: 1214948 - RNA, 22 nt, Human
uuccccacuugagaauuacccu

SEQ ID NO: 1214949 - RNA, 23 nt, Human
uuccucauaguaugguggcuggg

SEQ ID NO: 1214950 - RNA, 22 nt, Human
uuccucccucccucuuucccuc

SEQ ID NO: 1214951 - RNA, 21 nt, Human
uuccucccucccucuuucccu

SEQ ID NO: 1214952 - RNA, 19 nt, Human
uuccucccucccucuuucc

SEQ ID NO: 1214953 - RNA, 12 nt, Human
uuccucccuccc

SEQ ID NO: 1214954 - RNA, 19 nt, Human
uucuaaaggcuaccuuugu

SEQ ID NO: 1214955 - RNA, 18 nt, Human
uucuaaaggcuaccuuug

SEQ ID NO: 1214956 - RNA, 17 nt, Human
uucuaaaggcuaccuuu

SEQ ID NO: 1214957 - RNA, 16 nt, Human
uucuaaaggcuaccuu

SEQ ID NO: 1214958 - RNA, 19 nt, Human
uuccuucauucaacccacc

SEQ ID NO: 1214959 - RNA, 23 nt, Human
uuccuucagugccuuauggaaca

SEQ ID NO: 1214960 - RNA, 19 nt, Human
uuccuucagugccuuaugg

SEQ ID NO: 1214961 - RNA, 16 nt, Human
uuccuucagugccuua

SEQ ID NO: 1214962 - RNA, 22 nt, Human
uucugacccaugcugcccugug

SEQ ID NO: 1214963 - RNA, 21 nt, Human
uucugacccaugcugcccugu

SEQ ID NO: 1214964 - RNA, 20 nt, Human
uucugacccaugcugcccug

SEQ ID NO: 1214965 - RNA, 18 nt, Human
uucugacccaugcugccc

SEQ ID NO: 1214966 - RNA, 18 nt, Human
uucucuccagccccugga

SEQ ID NO: 1214967 - RNA, 11 nt, Human
uucuccaggcu

SEQ ID NO: 1214968 - RNA, 16 nt, Human
uucuccacccugcucu

SEQ ID NO: 1214969 - RNA, 13 nt, Human
uucuccacccugc

SEQ ID NO: 1214970 - RNA, 16 nt, Human
uucuccaagcaggaca

SEQ ID NO: 1214971 - RNA, 17 nt, Human
uucuaugacacaugcaa

SEQ ID NO: 1214972 - RNA, 16 nt, Human
uucuaugacacaugca

SEQ ID NO: 1214973 - RNA, 14 nt, Human
uucuauuguuucuu

SEQ ID NO: 1214974 - RNA, 16 nt, Human
uugaacugauaaagau

SEQ ID NO: 1214975 - RNA, 19 nt, Human
uugaacucuucaaucucuu

SEQ ID NO: 1214976 - RNA, 22 nt, Human
uugaacuuugaccucugcagca

SEQ ID NO: 1214977 - RNA, 19 nt, Human
uugaagacuuuucuuucag

SEQ ID NO: 1214978 - RNA, 17 nt, Human
uugaagacagagcuaca

SEQ ID NO: 1214979 - RNA, 22 nt, Human
uugaaaacacuguucucugccc

SEQ ID NO: 1214980 - RNA, 21 nt, Human
uugaaaacacuguucucugcc

SEQ ID NO: 1214981 - RNA, 19 nt, Human
uugaaaacacuguucucug

SEQ ID NO: 1214982 - RNA, 18 nt, Human
uucuuuauaauucuacuu

SEQ ID NO: 1214983 - RNA, 23 nt, Human
uucuugguuuguaaauuaacuuu

SEQ ID NO: 1214984 - RNA, 18 nt, Human
uucuugguuuguaaauua

SEQ ID NO: 1214985 - RNA, 17 nt, Human
uucuugguuuguaaauu

SEQ ID NO: 1214986 - RNA, 16 nt, Human
uucuugguuuguaaau

SEQ ID NO: 1214987 - RNA, 13 nt, Human
uucuugguuugua

SEQ ID NO: 1214988 - RNA, 23 nt, Human
uucuuauuuaaugaaagacugua

SEQ ID NO: 1214989 - RNA, 19 nt, Human
uucuuauuuaaugaaagac

SEQ ID NO: 1214990 - RNA, 11 nt, Human
uucuguucuuu

SEQ ID NO: 1214991 - RNA, 21 nt, Human
uucuguccgagcuuugaaaau

SEQ ID NO: 1214992 - RNA, 17 nt, Human
uucuguccgagcuuuga

SEQ ID NO: 1214993 - RNA, 19 nt, Human
uucuguccuacucuguguc

SEQ ID NO: 1214994 - RNA, 17 nt, Human
uucuguccuacucugug

SEQ ID NO: 1214995 - RNA, 23 nt, Human
uucuguggguuucuaaagcugcc

SEQ ID NO: 1214996 - RNA, 21 nt, Human
uugaccucaggugauccaccc

SEQ ID NO: 1214997 - RNA, 15 nt, Human
uugaccucaggugau

SEQ ID NO: 1214998 - RNA, 21 nt, Human
uugaccgugaggccagagaca

SEQ ID NO: 1214999 - RNA, 20 nt, Human
uugaccgugaggccagagac

SEQ ID NO: 1215000 - RNA, 22 nt, Human
uugacgccaucccagccccaau

SEQ ID NO: 1215001 - RNA, 15 nt, Human
uugacgccaucccag

SEQ ID NO: 1215002 - RNA, 14 nt, Human
uugacgccauccca

SEQ ID NO: 1215003 - RNA, 19 nt, Human
uugaccugaggcccuucuc

SEQ ID NO: 1215004 - RNA, 12 nt, Human
uugaccugaggc

SEQ ID NO: 1215005 - RNA, 22 nt, Human
uugaccugaggcccuucucucc

SEQ ID NO: 1215006 - RNA, 20 nt, Human
uugauagcacagacccugcc

SEQ ID NO: 1215007 - RNA, 19 nt, Human
uugauagcacagacccugc

SEQ ID NO: 1215008 - RNA, 23 nt, Human
uugauagcacagacccugcccug

SEQ ID NO: 1215009 - RNA, 21 nt, Human
uugauagcacagacccugccc

SEQ ID NO: 1215010 - RNA, 18 nt, Human
uugauuuccguuaaaaua

SEQ ID NO: 1215011 - RNA, 17 nt, Human
uugcaacaggcugggcu

SEQ ID NO: 1215012 - RNA, 14 nt, Human
uugcaacaggcugg

SEQ ID NO: 1215013 - RNA, 16 nt, Human
uugcagacaggcaagc

SEQ ID NO: 1215014 - RNA, 22 nt, Human
uugcagacaggcaagcaccucc

SEQ ID NO: 1215015 - RNA, 15 nt, Human
uuggacccugaggcc

SEQ ID NO: 1215016 - RNA, 17 nt, Human
uuggcaaaaaggcagga

SEQ ID NO: 1215017 - RNA, 14 nt, Human
uuggauuguccccg

SEQ ID NO: 1215018 - RNA, 19 nt, Human
uuggaaggaacguccccug

SEQ ID NO: 1215019 - RNA, 20 nt, Human
uugcuggggccgaaagaaca

SEQ ID NO: 1215020 - RNA, 22 nt, Human
uugcugauggugcaaugaccuu

SEQ ID NO: 1215021 - RNA, 20 nt, Human
uugcugauggugcaaugacc

SEQ ID NO: 1215022 - RNA, 18 nt, Human
uugccucugccucugaca

SEQ ID NO: 1215023 - RNA, 16 nt, Human
uugccucugccucuga

SEQ ID NO: 1215024 - RNA, 14 nt, Human
uugccucugccucu

SEQ ID NO: 1215025 - RNA, 11 nt, Human
uugccucugcc

SEQ ID NO: 1215026 - RNA, 11 nt, Human
uugcccaggca

SEQ ID NO: 1215027 - RNA, 18 nt, Human
uugccagucaccccggcc

SEQ ID NO: 1215028 - RNA, 13 nt, Human
uuggcauucccca

SEQ ID NO: 1215029 - RNA, 24 nt, Human
uuggccaaagccaaagcuaggccu

SEQ ID NO: 1215030 - RNA, 14 nt, Human
uuggccaggcuggu

SEQ ID NO: 1215031 - RNA, 22 nt, Human
uuggcugggggccucagugcca

SEQ ID NO: 1215032 - RNA, 21 nt, Human
uuggcugggggccucagugcc

SEQ ID NO: 1215033 - RNA, 18 nt, Human
uuggcugggggccucagu

SEQ ID NO: 1215034 - RNA, 16 nt, Human
uuggguggaugccugg

SEQ ID NO: 1215035 - RNA, 16 nt, Human
uugggaggccauuugu

SEQ ID NO: 1215036 - RNA, 22 nt, Human
uuggcuuuggguugcaggaccu

SEQ ID NO: 1215037 - RNA, 13 nt, Human
uugguccugcugc

SEQ ID NO: 1215038 - RNA, 12 nt, Human
uugguccugcug

SEQ ID NO: 1215039 - RNA, 22 nt, Human
uuggucccccuuccauggacuu

SEQ ID NO: 1215040 - RNA, 13 nt, Human
uuguacagacaac

SEQ ID NO: 1215041 - RNA, 12 nt, Human
uuguacagacaa

SEQ ID NO: 1215042 - RNA, 14 nt, Human
uuguacauaaugcg

SEQ ID NO: 1215043 - RNA, 15 nt, Human
uuguagagccagggu

SEQ ID NO: 1215044 - RNA, 14 nt, Human
uuguagagccaggg

SEQ ID NO: 1215045 - RNA, 17 nt, Human
uguaaauuaacuuuuau

SEQ ID NO: 1215046 - RNA, 16 nt, Human
uguaaauuaacuuuua

SEQ ID NO: 1215047 - RNA, 15 nt, Human
uguaaauuaacuuuu

SEQ ID NO: 1215048 - RNA, 14 nt, Human
uguaaauuaacuuu

SEQ ID NO: 1215049 - RNA, 13 nt, Human
uguaaauuaacuu

SEQ ID NO: 1215050 - RNA, 23 nt, Human
uguaccucuugagccuugaacuu

SEQ ID NO: 1215051 - RNA, 22 nt, Human
uguaccucuugagccuugaacu

SEQ ID NO: 1215052 - RNA, 19 nt, Human
uguacugcauaugaaagga

SEQ ID NO: 1215053 - RNA, 17 nt, Human
uguacgucugacaggca

SEQ ID NO: 1215054 - RNA, 23 nt, Human
ugucccaaaaagaaaggagggga

SEQ ID NO: 1215055 - RNA, 14 nt, Human
ugucagugugacug

SEQ ID NO: 1215056 - RNA, 20 nt, Human
ugucagugugacugaucucu

SEQ ID NO: 1215057 - RNA, 12 nt, Human
ugucagugugac

SEQ ID NO: 1215058 - RNA, 23 nt, Human
uguaucccaugagccucagcauc

SEQ ID NO: 1215059 - RNA, 19 nt, Human
uguaucccaugagccucag

SEQ ID NO: 1215060 - RNA, 18 nt, Human
ugugaguacuacaguccu

SEQ ID NO: 1215061 - RNA, 23 nt, Human
ugugaguacuacaguccucccau

SEQ ID NO: 1215062 - RNA, 20 nt, Human
ugugaguacuacaguccucc

SEQ ID NO: 1215063 - RNA, 19 nt, Human
ugugaguacuacaguccuc

SEQ ID NO: 1215064 - RNA, 21 nt, Human
ugugauacaaugcugugcccu

SEQ ID NO: 1215065 - RNA, 15 nt, Human
ugugagucaccaagc

SEQ ID NO: 1215066 - RNA, 15 nt, Human
ugugacauguuuuau

SEQ ID NO: 1215067 - RNA, 21 nt, Human
ugugacaaggauugcuacugu

SEQ ID NO: 1215068 - RNA, 13 nt, Human
uguccccaccgca

SEQ ID NO: 1215069 - RNA, 14 nt, Human
ugugaaaggaaaga

SEQ ID NO: 1215070 - RNA, 13 nt, Human
ugugaaaggaaag

SEQ ID NO: 1215071 - RNA, 22 nt, Human
ugucuuuggacccugaggccca

SEQ ID NO: 1215072 - RNA, 19 nt, Human
ugucuuuggacccugaggc

SEQ ID NO: 1215073 - RNA, 18 nt, Human
ugucuuuggacccugagg

SEQ ID NO: 1215074 - RNA, 12 nt, Human
ugugggaagggg

SEQ ID NO: 1215075 - RNA, 14 nt, Human
uguggacacagcuc

SEQ ID NO: 1215076 - RNA, 16 nt, Human
uguggacacagcucuu

SEQ ID NO: 1215077 - RNA, 15 nt, Human
uguggacacagcucu

SEQ ID NO: 1215078 - RNA, 21 nt, Human
uguggagaagcggcuggcagc

SEQ ID NO: 1215079 - RNA, 12 nt, Human
uguggagaagcg

SEQ ID NO: 1215080 - RNA, 20 nt, Human
ugugcgugcauguguguuca

SEQ ID NO: 1215081 - RNA, 17 nt, Human
ugugccucugggacugg

SEQ ID NO: 1215082 - RNA, 14 nt, Human
ugugcacguacaca

SEQ ID NO: 1215083 - RNA, 22 nt, Human
ugugcacaugcacgugugugca

SEQ ID NO: 1215084 - RNA, 16 nt, Human
ugugccucugggacug

SEQ ID NO: 1215085 - RNA, 15 nt, Human
ugugccucugggacu

SEQ ID NO: 1215086 - RNA, 13 nt, Human
ugugccucuggga

SEQ ID NO: 1215087 - RNA, 14 nt, Human
uguuggccaggcug

SEQ ID NO: 1215088 - RNA, 11 nt, Human
uguuggccagg

SEQ ID NO: 1215089 - RNA, 12 nt, Human
uguucucugccc

SEQ ID NO: 1215090 - RNA, 18 nt, Human
uguucucugaggacacua

SEQ ID NO: 1215091 - RNA, 16 nt, Human
uguucucugaggacac

SEQ ID NO: 1215092 - RNA, 11 nt, Human
uguugaaagau

SEQ ID NO: 1215093 - RNA, 23 nt, Human
uguucuuucuggcuaugcauuug

SEQ ID NO: 1215094 - RNA, 22 nt, Human
uguucuuucuggcuaugcauuu

SEQ ID NO: 1215095 - RNA, 20 nt, Human
uguucuuucuggcuaugcau

SEQ ID NO: 1215096 - RNA, 15 nt, Human
uguucugacccugcu

SEQ ID NO: 1215097 - RNA, 19 nt, Human
uguucucugcccuccaaga

SEQ ID NO: 1215098 - RNA, 18 nt, Human
uguucugacccugcuuca

SEQ ID NO: 1215099 - RNA, 14 nt, Human
uguucuuucuggcu

SEQ ID NO: 1215100 - RNA, 13 nt, Human
uguguuuauuguc

SEQ ID NO: 1215101 - RNA, 19 nt, Human
ugugucagcauagaaguaa

SEQ ID NO: 1215102 - RNA, 11 nt, Human
uguucagcugg

SEQ ID NO: 1215103 - RNA, 18 nt, Human
uguucagcuccagcucac

SEQ ID NO: 1215104 - RNA, 16 nt, Human
uguucagcuccagcuc

SEQ ID NO: 1215105 - RNA, 15 nt, Human
uguucagcuccagcu

SEQ ID NO: 1215106 - RNA, 16 nt, Human
uguuacugucuucagu

SEQ ID NO: 1215107 - RNA, 15 nt, Human
uguuacugucuucag

SEQ ID NO: 1215108 - RNA, 22 nt, Human
uguuacauuuuuaagugcugca

SEQ ID NO: 1215109 - RNA, 13 nt, Human
uguuacauuuuua

SEQ ID NO: 1215110 - RNA, 20 nt, Human
uuacgguuuuccagguuuaa

SEQ ID NO: 1215111 - RNA, 22 nt, Human
uuaccuuuuuuauacauaaaca

SEQ ID NO: 1215112 - RNA, 20 nt, Human
uuaccuuuuuuauacauaaa

SEQ ID NO: 1215113 - RNA, 19 nt, Human
uuaccuuuuuuauacauaa

SEQ ID NO: 1215114 - RNA, 14 nt, Human
uuaccagcagagca

SEQ ID NO: 1215115 - RNA, 23 nt, Human
uuacauuuuuaagugcugcauuu

SEQ ID NO: 1215116 - RNA, 22 nt, Human
uuacauuuuuaagugcugcauu

SEQ ID NO: 1215117 - RNA, 21 nt, Human
uuacauuuuuaagugcugcau

SEQ ID NO: 1215118 - RNA, 20 nt, Human
uuacauuuuuaagugcugca

SEQ ID NO: 1215119 - RNA, 18 nt, Human
uuaaugucacaggcaggu

SEQ ID NO: 1215120 - RNA, 17 nt, Human
uuaaugucacaggcagg

SEQ ID NO: 1215121 - RNA, 22 nt, Human
uuaaggaugcuuguacauaaug

SEQ ID NO: 1215122 - RNA, 20 nt, Human
uuaaggaugcuuguacauaa

SEQ ID NO: 1215123 - RNA, 19 nt, Human
uuaaggaugcuuguacaua

SEQ ID NO: 1215124 - RNA, 18 nt, Human
uuaaggaugcuuguacau

SEQ ID NO: 1215125 - RNA, 17 nt, Human
uuaaggaugcuuguaca

SEQ ID NO: 1215126 - RNA, 21 nt, Human
uuaaggaagacaaugugaaaa

SEQ ID NO: 1215127 - RNA, 18 nt, Human
uuaaaugcaccuggaaua

SEQ ID NO: 1215128 - RNA, 17 nt, Human
uuaaaugcaccuggaau

SEQ ID NO: 1215129 - RNA, 16 nt, Human
uuaaaugcaccuggaa

SEQ ID NO: 1215130 - RNA, 18 nt, Human
uuaaaugcccagccccuu

SEQ ID NO: 1215131 - RNA, 13 nt, Human
uuaaaugcccagc

SEQ ID NO: 1215132 - RNA, 18 nt, Human
uuaaacuuaaucuaaaug

SEQ ID NO: 1215133 - RNA, 16 nt, Human
uuaaacuuaaucuaaa

SEQ ID NO: 1215134 - RNA, 14 nt, Human
uuaaaacccaagug

SEQ ID NO: 1215135 - RNA, 22 nt, Human
uuaaacuuaaucuaaauggaac

SEQ ID NO: 1215136 - RNA, 20 nt, Human
uuaaacuuaaucuaaaugga

SEQ ID NO: 1215137 - RNA, 23 nt, Human
uguuuccuggcacugcuuccagu

SEQ ID NO: 1215138 - RNA, 22 nt, Human
uguuuccuggcacugcuuccag

SEQ ID NO: 1215139 - RNA, 21 nt, Human
uguuuccuggcacugcuucca

SEQ ID NO: 1215140 - RNA, 20 nt, Human
uguuuccuggcacugcuucc

SEQ ID NO: 1215141 - RNA, 17 nt, Human
uguuuguugucagcuga

SEQ ID NO: 1215142 - RNA, 17 nt, Human
ugggguggggaccucag

SEQ ID NO: 1215143 - RNA, 16 nt, Human
uggguucacugcaacc

SEQ ID NO: 1215144 - RNA, 23 nt, Human
uggguucaagcgauucuucugcu

SEQ ID NO: 1215145 - RNA, 14 nt, Human
uggguguggcgcag

SEQ ID NO: 1215146 - RNA, 23 nt, Human
ugggugucaagagggucugagga

SEQ ID NO: 1215147 - RNA, 21 nt, Human
ugggugucaagagggucugag

SEQ ID NO: 1215148 - RNA, 15 nt, Human
uggguucuacccagg

SEQ ID NO: 1215149 - RNA, 14 nt, Human
ugggccuccugugu

SEQ ID NO: 1215150 - RNA, 22 nt, Human
ugggccuccugugugugcgccu

SEQ ID NO: 1215151 - RNA, 16 nt, Human
ugggccuccugugugu

SEQ ID NO: 1215152 - RNA, 24 nt, Human
ugggagcugccuguucagcuccag

SEQ ID NO: 1215153 - RNA, 16 nt, Human
uggggcagcuugaggg

SEQ ID NO: 1215154 - RNA, 22 nt, Human
ugggcuuggggaccagagcugc

SEQ ID NO: 1215155 - RNA, 21 nt, Human
ugggcuuggggaccagagcug

SEQ ID NO: 1215156 - RNA, 19 nt, Human
ugggcuuggggaccagagc

SEQ ID NO: 1215157 - RNA, 20 nt, Human
ugggcuucaguggcagcugc

SEQ ID NO: 1215158 - RNA, 21 nt, Human
ugggcuucaguggcagcugcu

SEQ ID NO: 1215159 - RNA, 19 nt, Human
ugggcuucaguggcagcug

SEQ ID NO: 1215160 - RNA, 18 nt, Human
ugggcuucaguggcagcu

SEQ ID NO: 1215161 - RNA, 16 nt, Human
ugggacaugggaaagg

SEQ ID NO: 1215162 - RNA, 15 nt, Human
uggcugggggccuca

SEQ ID NO: 1215163 - RNA, 22 nt, Human
uggcugguuagagguucccuuu

SEQ ID NO: 1215164 - RNA, 14 nt, Human
uggcugggggccuc

SEQ ID NO: 1215165 - RNA, 22 nt, Human
ugggaaugaaugucagugugac

SEQ ID NO: 1215166 - RNA, 22 nt, Human
uggcgugcaguggugcgaucug

SEQ ID NO: 1215167 - RNA, 15 nt, Human
uggcgcugccccugg

SEQ ID NO: 1215168 - RNA, 14 nt, Human
uggcgcugccccug

SEQ ID NO: 1215169 - RNA, 15 nt, Human
uggccagaugcacca

SEQ ID NO: 1215170 - RNA, 12 nt, Human
uggcugggggcc

SEQ ID NO: 1215171 - RNA, 19 nt, Human
uggcucuuccaggcuggga

SEQ ID NO: 1215172 - RNA, 16 nt, Human
uggcucuuccaggcug

SEQ ID NO: 1215173 - RNA, 15 nt, Human
uggcucuuccaggcu

SEQ ID NO: 1215174 - RNA, 13 nt, Human
uggcucuuccagg

SEQ ID NO: 1215175 - RNA, 14 nt, Human
uggcuaaauucaug

SEQ ID NO: 1215176 - RNA, 22 nt, Human
uggcucagguggggucacucug

SEQ ID NO: 1215177 - RNA, 20 nt, Human
uggcucagguggggucacuc

SEQ ID NO: 1215178 - RNA, 15 nt, Human
uggaagacagcucuu

SEQ ID NO: 1215179 - RNA, 14 nt, Human
uggaagacagcucu

SEQ ID NO: 1215180 - RNA, 12 nt, Human
uggaagacagcu

SEQ ID NO: 1215181 - RNA, 11 nt, Human
uggaagacagc

SEQ ID NO: 1215182 - RNA, 16 nt, Human
uggaaaauaaauuauu

SEQ ID NO: 1215183 - RNA, 15 nt, Human
uggaaaauaaauuau

SEQ ID NO: 1215184 - RNA, 17 nt, Human
uggaaaaauagccugcc

SEQ ID NO: 1215185 - RNA, 12 nt, Human
ugcuucucacug

SEQ ID NO: 1215186 - RNA, 16 nt, Human
ugcuucuucagagacu

SEQ ID NO: 1215187 - RNA, 21 nt, Human
ugcuuccagugaggcucugcc

SEQ ID NO: 1215188 - RNA, 20 nt, Human
ugcuuccagugaggcucugc

SEQ ID NO: 1215189 - RNA, 19 nt, Human
ugcuuccagugaggcucug

SEQ ID NO: 1215190 - RNA, 18 nt, Human
ugcuuccagugaggcucu

SEQ ID NO: 1215191 - RNA, 16 nt, Human
uggacaggcauguucu

SEQ ID NO: 1215192 - RNA, 12 nt, Human
uggacaggcaug

SEQ ID NO: 1215193 - RNA, 17 nt, Human
uggacaggcauguucuc

SEQ ID NO: 1215194 - RNA, 22 nt, Human
uggaggcaugugaugagaggaa

SEQ ID NO: 1215195 - RNA, 23 nt, Human
uggcagcugcgguccacccagga

SEQ ID NO: 1215196 - RNA, 22 nt, Human
uggcagcugcgguccacccagg

SEQ ID NO: 1215197 - RNA, 21 nt, Human
uggcagcugcgguccacccag

SEQ ID NO: 1215198 - RNA, 18 nt, Human
uggcacugcuuccaguga

SEQ ID NO: 1215199 - RNA, 16 nt, Human
uggcacugcuuccagu

SEQ ID NO: 1215200 - RNA, 14 nt, Human
uggcacugcuucca

SEQ ID NO: 1215201 - RNA, 15 nt, Human
uggaugccugguggc

SEQ ID NO: 1215202 - RNA, 14 nt, Human
uggaugccuggugg

SEQ ID NO: 1215203 - RNA, 19 nt, Human
uggcagugggagcugccug

SEQ ID NO: 1215204 - RNA, 16 nt, Human
uggcagugggagcugc

SEQ ID NO: 1215205 - RNA, 15 nt, Human
uggcagugggagcug

SEQ ID NO: 1215206 - RNA, 14 nt, Human
uggcagugggagcu

SEQ ID NO: 1215207 - RNA, 20 nt, Human
uggcagugggagcugccugu

SEQ ID NO: 1215208 - RNA, 14 nt, Human
ugcaggaccucagg

SEQ ID NO: 1215209 - RNA, 18 nt, Human
ugcaggaccucaggugag

SEQ ID NO: 1215210 - RNA, 16 nt, Human
ugcaggaccucaggug

SEQ ID NO: 1215211 - RNA, 15 nt, Human
ugcaggaccucaggu

SEQ ID NO: 1215212 - RNA, 20 nt, Human
ugcagcaauaaagcagcguu

SEQ ID NO: 1215213 - RNA, 16 nt, Human
ugcagcaauaaagcag

SEQ ID NO: 1215214 - RNA, 15 nt, Human
ugcagcaauaaagca

SEQ ID NO: 1215215 - RNA, 14 nt, Human
ugcagcaauaaagc

SEQ ID NO: 1215216 - RNA, 20 nt, Human
ugcacuuuguucuggcucuu

SEQ ID NO: 1215217 - RNA, 19 nt, Human
ugcacuuuguucuggcucu

SEQ ID NO: 1215218 - RNA, 18 nt, Human
ugcacuuuguucuggcuc

SEQ ID NO: 1215219 - RNA, 15 nt, Human
ugcacuuuguucugg

SEQ ID NO: 1215220 - RNA, 21 nt, Human
ugcacuugcagacucuacaga

SEQ ID NO: 1215221 - RNA, 19 nt, Human
ugcacguacacacacauac

SEQ ID NO: 1215222 - RNA, 16 nt, Human
ugcacguacacacaca

SEQ ID NO: 1215223 - RNA, 22 nt, Human
ugaagucuuuguacagacaaca

SEQ ID NO: 1215224 - RNA, 20 nt, Human
ugaagucuuuguacagacaa

SEQ ID NO: 1215225 - RNA, 17 nt, Human
ugaagucuuuguacaga

SEQ ID NO: 1215226 - RNA, 16 nt, Human
ugaaggcuggguucug

SEQ ID NO: 1215227 - RNA, 22 nt, Human
ugcacagaguuguuacauuuuu

SEQ ID NO: 1215228 - RNA, 21 nt, Human
ugcacagaguuguuacauuuu

SEQ ID NO: 1215229 - RNA, 23 nt, Human
ugcacagaguuguuacauuuuua

SEQ ID NO: 1215230 - RNA, 17 nt, Human
ugcacagcuaacaugga

SEQ ID NO: 1215231 - RNA, 20 nt, Human
ugcacagcuaacauggaagu

SEQ ID NO: 1215232 - RNA, 18 nt, Human
ugcacagcuaacauggaa

SEQ ID NO: 1215233 - RNA, 23 nt, Human
ugcacagcuaacauggaaguacu

SEQ ID NO: 1215234 - RNA, 10 nt, Human
ugcccagccc

SEQ ID NO: 1215235 - RNA, 19 nt, Human
ugcccaccuggccucugca

SEQ ID NO: 1215236 - RNA, 18 nt, Human
ugcccaccuggccucugc

SEQ ID NO: 1215237 - RNA, 17 nt, Human
ugcccaccuggccucug

SEQ ID NO: 1215238 - RNA, 15 nt, Human
ugcccaccuggccuc

SEQ ID NO: 1215239 - RNA, 14 nt, Human
ugccagucaccccg

SEQ ID NO: 1215240 - RNA, 22 nt, Human
ugccagggacagaggggguggc

SEQ ID NO: 1215241 - RNA, 11 nt, Human
ugccagggaca

SEQ ID NO: 1215242 - RNA, 19 nt, Human
ugcauguuacauaagauaa

SEQ ID NO: 1215243 - RNA, 19 nt, Human
ugcaggcagccaggccaca

SEQ ID NO: 1215244 - RNA, 18 nt, Human
ugcaggcagccaggccac

SEQ ID NO: 1215245 - RNA, 17 nt, Human
ugcaggcagccaggcca

SEQ ID NO: 1215246 - RNA, 16 nt, Human
ugcaggcagccaggcc

SEQ ID NO: 1215247 - RNA, 17 nt, Human
ugcaucguuucaucuuc

SEQ ID NO: 1215248 - RNA, 15 nt, Human
ugcaucguuucaucu

SEQ ID NO: 1215249 - RNA, 16 nt, Human
ugcugcaguugccagu

SEQ ID NO: 1215250 - RNA, 15 nt, Human
ugcugcaguugccag

SEQ ID NO: 1215251 - RNA, 23 nt, Human
ugcugauggugcaaugaccuuuc

SEQ ID NO: 1215252 - RNA, 20 nt, Human
ugcugauggugcaaugaccu

SEQ ID NO: 1215253 - RNA, 19 nt, Human
ugcugacagacacaggccc

SEQ ID NO: 1215254 - RNA, 16 nt, Human
ugcugacagacacagg

SEQ ID NO: 1215255 - RNA, 15 nt, Human
ugcugacagacacag

SEQ ID NO: 1215256 - RNA, 22 nt, Human
ugcugaaugguuuucaaaauaa

SEQ ID NO: 1215257 - RNA, 18 nt, Human
ugcugaaugguuuucaaa

SEQ ID NO: 1215258 - RNA, 17 nt, Human
ugcugaaugguuuucaa

SEQ ID NO: 1215259 - RNA, 23 nt, Human
ugcugaauacagaggcaacugca

SEQ ID NO: 1215260 - RNA, 18 nt, Human
ugcugaauacagaggcaa

SEQ ID NO: 1215261 - RNA, 19 nt, Human
ugcuccuggcccacugcau

SEQ ID NO: 1215262 - RNA, 19 nt, Human
ugcuccucuccccagcaag

SEQ ID NO: 1215263 - RNA, 20 nt, Human
ugcuaggaacacuccuucac

SEQ ID NO: 1215264 - RNA, 19 nt, Human
ugcuaggaacacuccuuca

SEQ ID NO: 1215265 - RNA, 17 nt, Human
ugcuaggaacacuccuu

SEQ ID NO: 1215266 - RNA, 16 nt, Human
ugcuaggaacacuccu

SEQ ID NO: 1215267 - RNA, 23 nt, Human
ugcggugcuaucucccccagccc

SEQ ID NO: 1215268 - RNA, 13 nt, Human
ugcgccuacagga

SEQ ID NO: 1215269 - RNA, 22 nt, Human
ugccuuauggaacacucugaga

SEQ ID NO: 1215270 - RNA, 21 nt, Human
ugccuuauggaacacucugag

SEQ ID NO: 1215271 - RNA, 20 nt, Human
ugccuuauggaacacucuga

SEQ ID NO: 1215272 - RNA, 18 nt, Human
ugccuuauggaacacucu

SEQ ID NO: 1215273 - RNA, 22 nt, Human
ugccugaagucacacagugagu

SEQ ID NO: 1215274 - RNA, 18 nt, Human
ugccugaagucacacagu

SEQ ID NO: 1215275 - RNA, 20 nt, Human
ugccuccuuugugaggaagc

SEQ ID NO: 1215276 - RNA, 18 nt, Human
ugccuccuuugugaggaa

SEQ ID NO: 1215277 - RNA, 17 nt, Human
ugccuccuuugugagga

SEQ ID NO: 1215278 - RNA, 16 nt, Human
ugccuccuuugugagg

SEQ ID NO: 1215279 - RNA, 23 nt, Human
ugcccaggcuggcgugcaguggu

SEQ ID NO: 1215280 - RNA, 12 nt, Human
ugcccagccccu

SEQ ID NO: 1215281 - RNA, 11 nt, Human
ugcccagcccc

SEQ ID NO: 1215282 - RNA, 23 nt, Human
ucuguggguuucuaaagcugcca

SEQ ID NO: 1215283 - RNA, 18 nt, Human
ucuguacgucugacaggc

SEQ ID NO: 1215284 - RNA, 17 nt, Human
ucuguacgucugacagg

SEQ ID NO: 1215285 - RNA, 19 nt, Human
ucuguccgagcuuugaaaa

SEQ ID NO: 1215286 - RNA, 22 nt, Human
ucuguggguuucuaaagcugcc

SEQ ID NO: 1215287 - RNA, 14 nt, Human
ucuguccuacucug

SEQ ID NO: 1215288 - RNA, 18 nt, Human
ucuuaaaaaguggaaaaa

SEQ ID NO: 1215289 - RNA, 13 nt, Human
ucugggacacagu

SEQ ID NO: 1215290 - RNA, 12 nt, Human
ucugggacacag

SEQ ID NO: 1215291 - RNA, 18 nt, Human
ucuggcucuuccaggcug

SEQ ID NO: 1215292 - RNA, 17 nt, Human
ucuggcucuuccaggcu

SEQ ID NO: 1215293 - RNA, 16 nt, Human
ucuggcucuuccaggc

SEQ ID NO: 1215294 - RNA, 15 nt, Human
ucuggcucuuccagg

SEQ ID NO: 1215295 - RNA, 17 nt, Human
ucuggcuaugcauuuga

SEQ ID NO: 1215296 - RNA, 14 nt, Human
ucuggcuaugcauu

SEQ ID NO: 1215297 - RNA, 18 nt, Human
ucuggagguacgaaaaga

SEQ ID NO: 1215298 - RNA, 21 nt, Human
ucuugaauuguaaggaaugau

SEQ ID NO: 1215299 - RNA, 18 nt, Human
ucuugaacuccuggccuc

SEQ ID NO: 1215300 - RNA, 17 nt, Human
ucuugaacuccuggccu

SEQ ID NO: 1215301 - RNA, 16 nt, Human
ucuugaacuccuggcc

SEQ ID NO: 1215302 - RNA, 15 nt, Human
ucuucuccaggcugu

SEQ ID NO: 1215303 - RNA, 14 nt, Human
ucuucuccaggcug

SEQ ID NO: 1215304 - RNA, 13 nt, Human
ucuucuccaggcu

SEQ ID NO: 1215305 - RNA, 12 nt, Human
ucuucuccaggc

SEQ ID NO: 1215306 - RNA, 13 nt, Human
ucuugcucugcug

SEQ ID NO: 1215307 - RNA, 12 nt, Human
ucuugcucugcu

SEQ ID NO: 1215308 - RNA, 11 nt, Human
ucuugcucugc

SEQ ID NO: 1215309 - RNA, 15 nt, Human
ucuucaguaagccgu

SEQ ID NO: 1215310 - RNA, 13 nt, Human
ucuuaugggcugg

SEQ ID NO: 1215311 - RNA, 14 nt, Human
ucuuagugugugca

SEQ ID NO: 1215312 - RNA, 15 nt, Human
ucuuauacauuugau

SEQ ID NO: 1215313 - RNA, 14 nt, Human
ucuuccaggcuggg

SEQ ID NO: 1215314 - RNA, 16 nt, Human
ucuucaguaagccgug

SEQ ID NO: 1215315 - RNA, 21 nt, Human
ucuuccacaagagcccaggcc

SEQ ID NO: 1215316 - RNA, 21 nt, Human
ucuucuccacuuucuagccag

SEQ ID NO: 1215317 - RNA, 19 nt, Human
ucuucuccacuuucuagcc

SEQ ID NO: 1215318 - RNA, 19 nt, Human
ucuuuugccguuauuaaaa

SEQ ID NO: 1215319 - RNA, 17 nt, Human
ucuuuugccguuauuaa

SEQ ID NO: 1215320 - RNA, 15 nt, Human
ugaaaagaaaaauga

SEQ ID NO: 1215321 - RNA, 16 nt, Human
ucuuuuugcuuugcuu

SEQ ID NO: 1215322 - RNA, 16 nt, Human
ugaaacgcaaccacca

SEQ ID NO: 1215323 - RNA, 12 nt, Human
ugaaaggaaaga

SEQ ID NO: 1215324 - RNA, 17 nt, Human
ugaaaggaaagaggcuc

SEQ ID NO: 1215325 - RNA, 23 nt, Human
ugaaaugaggucagagccugcag

SEQ ID NO: 1215326 - RNA, 22 nt, Human
ugaaaugaggucagagccugca

SEQ ID NO: 1215327 - RNA, 21 nt, Human
ugaaaugaggucagagccugc

SEQ ID NO: 1215328 - RNA, 20 nt, Human
ugaaaugaggucagagccug

SEQ ID NO: 1215329 - RNA, 19 nt, Human
ugaaaugaggucagagccu

SEQ ID NO: 1215330 - RNA, 17 nt, Human
ugaaaucuuuuugcuuu

SEQ ID NO: 1215331 - RNA, 18 nt, Human
ugaaagggcccagagagg

SEQ ID NO: 1215332 - RNA, 17 nt, Human
ugaaagggcccagagag

SEQ ID NO: 1215333 - RNA, 16 nt, Human
ugaaagggcccagaga

SEQ ID NO: 1215334 - RNA, 13 nt, Human
ugaacugauaaag

SEQ ID NO: 1215335 - RNA, 15 nt, Human
ugaacugauaaagau

SEQ ID NO: 1215336 - RNA, 15 nt, Human
ugaacucuucaaucu

SEQ ID NO: 1215337 - RNA, 22 nt, Human
ugaaccacaucuugcucugcug

SEQ ID NO: 1215338 - RNA, 21 nt, Human
ugaaccacaucuugcucugcu

SEQ ID NO: 1215339 - RNA, 20 nt, Human
ugaaccacaucuugcucugc

SEQ ID NO: 1215340 - RNA, 18 nt, Human
ugaacucuucaaucucuu

SEQ ID NO: 1215341 - RNA, 21 nt, Human
ugaaggcucgagcaugccugg

SEQ ID NO: 1215342 - RNA, 20 nt, Human
ugaaggcucgagcaugccug

SEQ ID NO: 1215343 - RNA, 12 nt, Human
ugaacuugguuc

SEQ ID NO: 1215344 - RNA, 14 nt, Human
ugaacuuggcgcug

SEQ ID NO: 1215345 - RNA, 19 nt, Human
ugaacuggguacuugugga

SEQ ID NO: 1215346 - RNA, 16 nt, Human
ugaagacagagcuaca

SEQ ID NO: 1215347 - RNA, 14 nt, Human
ugaagacagagcua

SEQ ID NO: 1215348 - RNA, 23 nt, Human
ugaacuggguacuuguggacaca

SEQ ID NO: 1215349 - RNA, 14 nt, Human
ugaagacuuuucuu

SEQ ID NO: 1215350 - RNA, 22 nt, Human
ugaagacuuuucuuucagccaa

SEQ ID NO: 1215351 - RNA, 17 nt, Human
ugaagacuuuucuuuca

SEQ ID NO: 1215352 - RNA, 14 nt, Human
uccuuaccagcaga

SEQ ID NO: 1215353 - RNA, 19 nt, Human
uccuucuguccuacucugu

SEQ ID NO: 1215354 - RNA, 12 nt, Human
uccuucuguccu

SEQ ID NO: 1215355 - RNA, 17 nt, Human
uccuggcccacugcauc

SEQ ID NO: 1215356 - RNA, 22 nt, Human
uccuggcaugggaaugaauguc

SEQ ID NO: 1215357 - RNA, 10 nt, Human
ucccucccuu

SEQ ID NO: 1215358 - RNA, 15 nt, Human
uccugguguggaaga

SEQ ID NO: 1215359 - RNA, 17 nt, Human
ucgaguuacagacaaag

SEQ ID NO: 1215360 - RNA, 15 nt, Human
ucgaguuacagacaa

SEQ ID NO: 1215361 - RNA, 22 nt, Human
ucuaacuucaccauauuaccac

SEQ ID NO: 1215362 - RNA, 16 nt, Human
ucuaacuucaccauau

SEQ ID NO: 1215363 - RNA, 15 nt, Human
ucuaacuucaccaua

SEQ ID NO: 1215364 - RNA, 22 nt, Human
ucuagggaaaaaccagcgugug

SEQ ID NO: 1215365 - RNA, 22 nt, Human
ucuacugaggugcuauguucuu

SEQ ID NO: 1215366 - RNA, 19 nt, Human
ucuacugaggugcuauguu

SEQ ID NO: 1215367 - RNA, 18 nt, Human
ucuacugaggugcuaugu

SEQ ID NO: 1215368 - RNA, 21 nt, Human
ucuacacugugcugagucuga

SEQ ID NO: 1215369 - RNA, 15 nt, Human
ucuacacugugcuga

SEQ ID NO: 1215370 - RNA, 14 nt, Human
ucuacacugugcug

SEQ ID NO: 1215371 - RNA, 12 nt, Human
ucuacacugugc

SEQ ID NO: 1215372 - RNA, 21 nt, Human
ucucagaaucucaaauaacua

SEQ ID NO: 1215373 - RNA, 17 nt, Human
ucucagaaucucaaaua

SEQ ID NO: 1215374 - RNA, 21 nt, Human
ucucacuguugcccaggcugg

SEQ ID NO: 1215375 - RNA, 20 nt, Human
ucucacuguugcccaggcug

SEQ ID NO: 1215376 - RNA, 19 nt, Human
ucucacuguugcccaggcu

SEQ ID NO: 1215377 - RNA, 18 nt, Human
ucucacuguugcccaggc

SEQ ID NO: 1215378 - RNA, 22 nt, Human
ucucacucugucgcccagucug

SEQ ID NO: 1215379 - RNA, 18 nt, Human
ucucacucugucgcccag

SEQ ID NO: 1215380 - RNA, 17 nt, Human
ucucacucugucgccca

SEQ ID NO: 1215381 - RNA, 22 nt, Human
ucucaaacucuugaccucaggu

SEQ ID NO: 1215382 - RNA, 21 nt, Human
ucucaaacucuugaccucagg

SEQ ID NO: 1215383 - RNA, 13 nt, Human
ucucaaacucuug

SEQ ID NO: 1215384 - RNA, 17 nt, Human
ucucccccagccccauc

SEQ ID NO: 1215385 - RNA, 15 nt, Human
ucucccccagcccca

SEQ ID NO: 1215386 - RNA, 14 nt, Human
ucucccccagcccc

SEQ ID NO: 1215387 - RNA, 22 nt, Human
ucucccccagccccauccucug

SEQ ID NO: 1215388 - RNA, 20 nt, Human
ucucccccagccccauccuc

SEQ ID NO: 1215389 - RNA, 18 nt, Human
ucucccccagccccaucc

SEQ ID NO: 1215390 - RNA, 22 nt, Human
ucuccugccucagccucccaaa

SEQ ID NO: 1215391 - RNA, 14 nt, Human
ucucugaggacacu

SEQ ID NO: 1215392 - RNA, 13 nt, Human
ucucugaggacac

SEQ ID NO: 1215393 - RNA, 19 nt, Human
ucucuaguuugauuaaauu

SEQ ID NO: 1215394 - RNA, 18 nt, Human
ucucuaguuugauuaaau

SEQ ID NO: 1215395 - RNA, 13 nt, Human
ucuccuguaccuc

SEQ ID NO: 1215396 - RNA, 15 nt, Human
ucucuacaaaaagca

SEQ ID NO: 1215397 - RNA, 13 nt, Human
ucugaaagggacg

SEQ ID NO: 1215398 - RNA, 23 nt, Human
ucugaaaauguauguguaaguau

SEQ ID NO: 1215399 - RNA, 16 nt, Human
ucugaaaauguaugug

SEQ ID NO: 1215400 - RNA, 16 nt, Human
ucucuuuucaaaacau

SEQ ID NO: 1215401 - RNA, 15 nt, Human
ucucuuuucaaaaca

SEQ ID NO: 1215402 - RNA, 23 nt, Human
ucugauucccaagcucugcuccu

SEQ ID NO: 1215403 - RNA, 14 nt, Human
ucugcacaagcugc

SEQ ID NO: 1215404 - RNA, 19 nt, Human
ucugcacaagcugcacccu

SEQ ID NO: 1215405 - RNA, 23 nt, Human
ucugaggacacuaaccacgcugg

SEQ ID NO: 1215406 - RNA, 20 nt, Human
ucugaggacacuaaccacgc

SEQ ID NO: 1215407 - RNA, 17 nt, Human
ucugaggaauccagacc

SEQ ID NO: 1215408 - RNA, 16 nt, Human
ucugaggaauccagac

SEQ ID NO: 1215409 - RNA, 14 nt, Human
ucugacccaugcug

SEQ ID NO: 1215410 - RNA, 21 nt, Human
ucugaacuuggcgcugccccu

SEQ ID NO: 1215411 - RNA, 20 nt, Human
ucugaacuuggcgcugcccc

SEQ ID NO: 1215412 - RNA, 18 nt, Human
ucugacccaugcugcccu

SEQ ID NO: 1215413 - RNA, 17 nt, Human
ucugacccaugcugccc

SEQ ID NO: 1215414 - RNA, 16 nt, Human
ucugacccaugcugcc

SEQ ID NO: 1215415 - RNA, 15 nt, Human
ucugacccaugcugc

SEQ ID NO: 1215416 - RNA, 19 nt, Human
ucugacccaugcugcccug

SEQ ID NO: 1215417 - RNA, 15 nt, Human
ucagucuggcccuuc

SEQ ID NO: 1215418 - RNA, 24 nt, Human
ucagucugauucccaagcucugcu

SEQ ID NO: 1215419 - RNA, 17 nt, Human
ucagugugacugaucuc

SEQ ID NO: 1215420 - RNA, 13 nt, Human
ucagugugacuga

SEQ ID NO: 1215421 - RNA, 11 nt, Human
ucaguguacau

SEQ ID NO: 1215422 - RNA, 23 nt, Human
ucagugguuggcaauuguuucaa

SEQ ID NO: 1215423 - RNA, 13 nt, Human
ucauacccacccc

SEQ ID NO: 1215424 - RNA, 17 nt, Human
ucaguuguuaguguguc

SEQ ID NO: 1215425 - RNA, 22 nt, Human
ucauuaggugugacugaauuuc

SEQ ID NO: 1215426 - RNA, 21 nt, Human
ucauuaggugugacugaauuu

SEQ ID NO: 1215427 - RNA, 18 nt, Human
ucauuaggugugacugaa

SEQ ID NO: 1215428 - RNA, 16 nt, Human
ucauuaggugugacug

SEQ ID NO: 1215429 - RNA, 21 nt, Human
ucauacccacccccacccaag

SEQ ID NO: 1215430 - RNA, 20 nt, Human
ucauacccacccccacccaa

SEQ ID NO: 1215431 - RNA, 15 nt, Human
ucauacccaccccca

SEQ ID NO: 1215432 - RNA, 14 nt, Human
ucauacccaccccc

SEQ ID NO: 1215433 - RNA, 18 nt, Human
uccaaaauaaaacuuuuu

SEQ ID NO: 1215434 - RNA, 17 nt, Human
uccaaaauaaaacuuuu

SEQ ID NO: 1215435 - RNA, 16 nt, Human
uccaaaauaaaacuuu

SEQ ID NO: 1215436 - RNA, 20 nt, Human
uccaagaagcccaggaaagg

SEQ ID NO: 1215437 - RNA, 22 nt, Human
uccaagaagcccaggaaaggcu

SEQ ID NO: 1215438 - RNA, 19 nt, Human
uccaagaccuucuccuuca

SEQ ID NO: 1215439 - RNA, 23 nt, Human
uccagccaaagccuccuccagcc

SEQ ID NO: 1215440 - RNA, 15 nt, Human
uccaccugccaggga

SEQ ID NO: 1215441 - RNA, 13 nt, Human
uccaccugccagg

SEQ ID NO: 1215442 - RNA, 12 nt, Human
uccaccugccag

SEQ ID NO: 1215443 - RNA, 15 nt, Human
uccacaagagcccag

SEQ ID NO: 1215444 - RNA, 14 nt, Human
uccacaagagccca

SEQ ID NO: 1215445 - RNA, 21 nt, Human
ucccaucugugaaaggaaaga

SEQ ID NO: 1215446 - RNA, 23 nt, Human
ucccaucucacacaugagcauca

SEQ ID NO: 1215447 - RNA, 20 nt, Human
ucccaucucacacaugagca

SEQ ID NO: 1215448 - RNA, 21 nt, Human
ucccaggcauuccccaggagg

SEQ ID NO: 1215449 - RNA, 20 nt, Human
ucccaggcauuccccaggag

SEQ ID NO: 1215450 - RNA, 22 nt, Human
ucccaggcauuccccaggaggc

SEQ ID NO: 1215451 - RNA, 23 nt, Human
ucccaggcauuccccaggaggcc

SEQ ID NO: 1215452 - RNA, 16 nt, Human
ucccaccucagccucc

SEQ ID NO: 1215453 - RNA, 15 nt, Human
ucccaccucagccuc

SEQ ID NO: 1215454 - RNA, 14 nt, Human
ucccaccucagccu

SEQ ID NO: 1215455 - RNA, 13 nt, Human
ucccaccucagcc

SEQ ID NO: 1215456 - RNA, 16 nt, Human
ucccaacucaccccag

SEQ ID NO: 1215457 - RNA, 15 nt, Human
ucccaacucacccca

SEQ ID NO: 1215458 - RNA, 14 nt, Human
ucccaacucacccc

SEQ ID NO: 1215459 - RNA, 15 nt, Human
ucccaagcucugcuc

SEQ ID NO: 1215460 - RNA, 14 nt, Human
ucccaagcucugcu

SEQ ID NO: 1215461 - RNA, 13 nt, Human
ucccaagcucugc

SEQ ID NO: 1215462 - RNA, 12 nt, Human
ucccaagcucug

SEQ ID NO: 1215463 - RNA, 17 nt, Human
ucccaacucaccccagc

SEQ ID NO: 1215464 - RNA, 17 nt, Human
ucccaagcucugcuccu

SEQ ID NO: 1215465 - RNA, 15 nt, Human
uccauggacuuuguu

SEQ ID NO: 1215466 - RNA, 14 nt, Human
uccauggacuuugu

SEQ ID NO: 1215467 - RNA, 23 nt, Human
uccagcucaccagccccagugcc

SEQ ID NO: 1215468 - RNA, 13 nt, Human
uccccaggaggcc

SEQ ID NO: 1215469 - RNA, 20 nt, Human
uccccgcacugggcuugggg

SEQ ID NO: 1215470 - RNA, 15 nt, Human
ucccuacuguaauuu

SEQ ID NO: 1215471 - RNA, 17 nt, Human
ucccucccucuuucccu

SEQ ID NO: 1215472 - RNA, 15 nt, Human
ucccucccucuuucc

SEQ ID NO: 1215473 - RNA, 18 nt, Human
uccccuguuuguuucuga

SEQ ID NO: 1215474 - RNA, 21 nt, Human
uccccugcuggguguggcgca

SEQ ID NO: 1215475 - RNA, 20 nt, Human
uccccugcuggguguggcgc

SEQ ID NO: 1215476 - RNA, 15 nt, Human
uccccugcugggugu

SEQ ID NO: 1215477 - RNA, 14 nt, Human
uccccugcugggug

SEQ ID NO: 1215478 - RNA, 19 nt, Human
uccccuguagagugggagc

SEQ ID NO: 1215479 - RNA, 24 nt, Human
uccccugcuggguguggcgcagca

SEQ ID NO: 1215480 - RNA, 23 nt, Human
uccccuguccccgcacugggcuu

SEQ ID NO: 1215481 - RNA, 22 nt, Human
uccccuguagagugggagcuga

SEQ ID NO: 1215482 - RNA, 16 nt, Human
ucacgccacugcacua

SEQ ID NO: 1215483 - RNA, 14 nt, Human
ucacgccacugcac

SEQ ID NO: 1215484 - RNA, 13 nt, Human
ucacgccacugca

SEQ ID NO: 1215485 - RNA, 20 nt, Human
ucacgccuguaauccuagca

SEQ ID NO: 1215486 - RNA, 19 nt, Human
ucacgccuguaauccuagc

SEQ ID NO: 1215487 - RNA, 22 nt, Human
ucaccuuuguccccaccgcaga

SEQ ID NO: 1215488 - RNA, 18 nt, Human
ucaccuuuguccccaccg

SEQ ID NO: 1215489 - RNA, 17 nt, Human
ucaccuuuguccccacc

SEQ ID NO: 1215490 - RNA, 15 nt, Human
ucaccuuugucccca

SEQ ID NO: 1215491 - RNA, 14 nt, Human
ucaccuuugucccc

SEQ ID NO: 1215492 - RNA, 12 nt, Human
ucaccuuugucc

SEQ ID NO: 1215493 - RNA, 14 nt, Human
ucaccuuucccauc

SEQ ID NO: 1215494 - RNA, 15 nt, Human
ucacaggcaggucca

SEQ ID NO: 1215495 - RNA, 12 nt, Human
ucacaggcaggu

SEQ ID NO: 1215496 - RNA, 16 nt, Human
ucacaggcagguccag

SEQ ID NO: 1215497 - RNA, 22 nt, Human
ucacucuggcagcucagagagg

SEQ ID NO: 1215498 - RNA, 20 nt, Human
ucacucuggcagcucagaga

SEQ ID NO: 1215499 - RNA, 19 nt, Human
ucacucuggcagcucagag

SEQ ID NO: 1215500 - RNA, 18 nt, Human
ucacucuggcagcucaga

SEQ ID NO: 1215501 - RNA, 17 nt, Human
ucacucuggcagcucag

SEQ ID NO: 1215502 - RNA, 16 nt, Human
ucacucuggcagcuca

SEQ ID NO: 1215503 - RNA, 15 nt, Human
ucacucuggcagcuc

SEQ ID NO: 1215504 - RNA, 14 nt, Human
ucacucuggcagcu

SEQ ID NO: 1215505 - RNA, 13 nt, Human
ucacucuggcagc

SEQ ID NO: 1215506 - RNA, 12 nt, Human
ucacucuggcag

SEQ ID NO: 1215507 - RNA, 23 nt, Human
ucacucuccuuggugucgggcau

SEQ ID NO: 1215508 - RNA, 14 nt, Human
ucacucuccuuggu

SEQ ID NO: 1215509 - RNA, 12 nt, Human
ucacucuccuug

SEQ ID NO: 1215510 - RNA, 20 nt, Human
ucacggcucacugcagccuc

SEQ ID NO: 1215511 - RNA, 15 nt, Human
ucacggcucacugca

SEQ ID NO: 1215512 - RNA, 13 nt, Human
ucacggcucacug

SEQ ID NO: 1215513 - RNA, 17 nt, Human
ucacggaagagccuugc

SEQ ID NO: 1215514 - RNA, 16 nt, Human
ucacggaagagccuug

SEQ ID NO: 1215515 - RNA, 14 nt, Human
ucacggaagagccu

SEQ ID NO: 1215516 - RNA, 13 nt, Human
ucacuccuugaaa

SEQ ID NO: 1215517 - RNA, 20 nt, Human
ucagacagcugccugggauc

SEQ ID NO: 1215518 - RNA, 19 nt, Human
ucagacagcugccugggau

SEQ ID NO: 1215519 - RNA, 18 nt, Human
ucagacagcugccuggga

SEQ ID NO: 1215520 - RNA, 17 nt, Human
ucagacagcugccuggg

SEQ ID NO: 1215521 - RNA, 16 nt, Human
ucagacagcugccugg

SEQ ID NO: 1215522 - RNA, 15 nt, Human
ucagacagcugccug

SEQ ID NO: 1215523 - RNA, 19 nt, Human
ucagcacgauuucuguuua

SEQ ID NO: 1215524 - RNA, 20 nt, Human
ucacugcuuaacuucacaua

SEQ ID NO: 1215525 - RNA, 18 nt, Human
ucacugcuuaacuucaca

SEQ ID NO: 1215526 - RNA, 17 nt, Human
ucacugcuuaacuucac

SEQ ID NO: 1215527 - RNA, 15 nt, Human
ucacugcuuaacuuc

SEQ ID NO: 1215528 - RNA, 22 nt, Human
ucacucugucgcccagucugga

SEQ ID NO: 1215529 - RNA, 19 nt, Human
ucacucugucgcccagucu

SEQ ID NO: 1215530 - RNA, 16 nt, Human
ucacucugucgcccag

SEQ ID NO: 1215531 - RNA, 12 nt, Human
ucacucugucgc

SEQ ID NO: 1215532 - RNA, 14 nt, Human
ucaaacucuuaaaa

SEQ ID NO: 1215533 - RNA, 22 nt, Human
ucaaaacgguuuuacugcagcu

SEQ ID NO: 1215534 - RNA, 23 nt, Human
uauuuauuaaaugcccagccccu

SEQ ID NO: 1215535 - RNA, 20 nt, Human
uaucugaaaauguaugugua

SEQ ID NO: 1215536 - RNA, 15 nt, Human
uaucugaaaauguau

SEQ ID NO: 1215537 - RNA, 14 nt, Human
uaucugaaaaugua

SEQ ID NO: 1215538 - RNA, 22 nt, Human
ucaagugauucuccugccucag

SEQ ID NO: 1215539 - RNA, 23 nt, Human
ucaaggauccugagccagauuuc

SEQ ID NO: 1215540 - RNA, 20 nt, Human
ucaaggauccugagccagau

SEQ ID NO: 1215541 - RNA, 19 nt, Human
ucaaggauccugagccaga

SEQ ID NO: 1215542 - RNA, 18 nt, Human
ucaaggauccugagccag

SEQ ID NO: 1215543 - RNA, 17 nt, Human
ucaagcgauucuucugc

SEQ ID NO: 1215544 - RNA, 16 nt, Human
ucaagcgauucuucug

SEQ ID NO: 1215545 - RNA, 14 nt, Human
ucaaccuccugggc

SEQ ID NO: 1215546 - RNA, 13 nt, Human
ucaaccuccuggg

SEQ ID NO: 1215547 - RNA, 16 nt, Human
ucaaacuuuacuaugg

SEQ ID NO: 1215548 - RNA, 15 nt, Human
ucaaacuuuacuaug

SEQ ID NO: 1215549 - RNA, 22 nt, Human
ucaaacucuugaccucagguga

SEQ ID NO: 1215550 - RNA, 11 nt, Human
ucacaggcagg

SEQ ID NO: 1215551 - RNA, 22 nt, Human
ucacacaugagcaucaggccag

SEQ ID NO: 1215552 - RNA, 21 nt, Human
ucacacaugagcaucaggcca

SEQ ID NO: 1215553 - RNA, 23 nt, Human
ucacacagugagucgaggacagg

SEQ ID NO: 1215554 - RNA, 22 nt, Human
ucacacagugagucgaggacag

SEQ ID NO: 1215555 - RNA, 13 nt, Human
ucacacagugagu

SEQ ID NO: 1215556 - RNA, 22 nt, Human
ucacacaguauuacuucugcua

SEQ ID NO: 1215557 - RNA, 21 nt, Human
ucacacaguauuacuucugcu

SEQ ID NO: 1215558 - RNA, 20 nt, Human
ucaauuacaggaaguacugg

SEQ ID NO: 1215559 - RNA, 19 nt, Human
ucaauuacaggaaguacug

SEQ ID NO: 1215560 - RNA, 14 nt, Human
ucaaugcacugaca

SEQ ID NO: 1215561 - RNA, 17 nt, Human
ucaauaggaaaaacuga

SEQ ID NO: 1215562 - RNA, 14 nt, Human
ucaauaggaaaaac

SEQ ID NO: 1215563 - RNA, 13 nt, Human
ucaauaggaaaaa

SEQ ID NO: 1215564 - RNA, 18 nt, Human
ucaauuacaggaaguacu

SEQ ID NO: 1215565 - RNA, 13 nt, Human
ucaauuacaggaa

SEQ ID NO: 1215566 - RNA, 18 nt, Human
ucaaugcacugacauugu

SEQ ID NO: 1215567 - RNA, 21 nt, Human
gguuggccccugcccggcugc

SEQ ID NO: 1215568 - RNA, 18 nt, Human
guuucagaaauguguuau

SEQ ID NO: 1215569 - RNA, 22 nt, Human
guuuccuggcacugcuuccagu

SEQ ID NO: 1215570 - RNA, 21 nt, Human
guuuccuggcacugcuuccag

SEQ ID NO: 1215571 - RNA, 20 nt, Human
guuuccuggcacugcuucca

SEQ ID NO: 1215572 - RNA, 16 nt, Human
guuuccuggcacugcu

SEQ ID NO: 1215573 - RNA, 16 nt, Human
guuugaaccaagaacu

SEQ ID NO: 1215574 - RNA, 20 nt, Human
guuucuaaagcugccagccg

SEQ ID NO: 1215575 - RNA, 16 nt, Human
guuucuaaagcugcca

SEQ ID NO: 1215576 - RNA, 15 nt, Human
guuucuaaagcugcc

SEQ ID NO: 1215577 - RNA, 14 nt, Human
guuucuaaagcugc

SEQ ID NO: 1215578 - RNA, 23 nt, Human
guuugauuaaauucuugcaaagu

SEQ ID NO: 1215579 - RNA, 22 nt, Human
guuugauuaaauucuugcaaag

SEQ ID NO: 1215580 - RNA, 19 nt, Human
guuugauuaaauucuugca

SEQ ID NO: 1215581 - RNA, 17 nt, Human
guuugauuaaauucuug

SEQ ID NO: 1215582 - RNA, 20 nt, Human
guuuguaaauuaacuuuuau

SEQ ID NO: 1215583 - RNA, 19 nt, Human
guuuguaaauuaacuuuua

SEQ ID NO: 1215584 - RNA, 17 nt, Human
guuuguaaauuaacuuu

SEQ ID NO: 1215585 - RNA, 23 nt, Human
uaaaaaacugcugacuguuuucu

SEQ ID NO: 1215586 - RNA, 20 nt, Human
uaaaaaacugcugacuguuu

SEQ ID NO: 1215587 - RNA, 23 nt, Human
guuuuuauggcuuuugugcauua

SEQ ID NO: 1215588 - RNA, 22 nt, Human
guuuuuauggcuuuugugcauu

SEQ ID NO: 1215589 - RNA, 19 nt, Human
guuuuuauggcuuuugugc

SEQ ID NO: 1215590 - RNA, 19 nt, Human
guuuucucuugagagggug

SEQ ID NO: 1215591 - RNA, 12 nt, Human
guuuucucuuga

SEQ ID NO: 1215592 - RNA, 20 nt, Human
guuuuccagguuuaagcugu

SEQ ID NO: 1215593 - RNA, 17 nt, Human
guuuucaguguacaugg

SEQ ID NO: 1215594 - RNA, 16 nt, Human
guuuucaguguacaug

SEQ ID NO: 1215595 - RNA, 18 nt, Human
guuuguuucugaaaggga

SEQ ID NO: 1215596 - RNA, 18 nt, Human
uaaacaagaccacguuuc

SEQ ID NO: 1215597 - RNA, 19 nt, Human
uaaacaagaccacguuucu

SEQ ID NO: 1215598 - RNA, 22 nt, Human
uaaacuuuaccuuuuuuauaca

SEQ ID NO: 1215599 - RNA, 16 nt, Human
uaaacuuuaccuuuuu

SEQ ID NO: 1215600 - RNA, 19 nt, Human
uaaacuuaaucuaaaugga

SEQ ID NO: 1215601 - RNA, 18 nt, Human
uaaacuuaaucuaaaugg

SEQ ID NO: 1215602 - RNA, 14 nt, Human
uaaacuuaaucuaa

SEQ ID NO: 1215603 - RNA, 19 nt, Human
uaaaucagccguguaacca

SEQ ID NO: 1215604 - RNA, 23 nt, Human
uaaaguguauuuuuuuacuaaua

SEQ ID NO: 1215605 - RNA, 22 nt, Human
uaaaguguauuuuuuuacuaau

SEQ ID NO: 1215606 - RNA, 21 nt, Human
uaaaguguauuuuuuuacuaa

SEQ ID NO: 1215607 - RNA, 13 nt, Human
uaaaguuucuguu

SEQ ID NO: 1215608 - RNA, 22 nt, Human
uaauugacaggauuauuggaaa

SEQ ID NO: 1215609 - RNA, 20 nt, Human
uaauugacaggauuauugga

SEQ ID NO: 1215610 - RNA, 18 nt, Human
uaauucuuagcucauucu

SEQ ID NO: 1215611 - RNA, 17 nt, Human
uaauuaaaacacaacau

SEQ ID NO: 1215612 - RNA, 14 nt, Human
uaaugcgugcauac

SEQ ID NO: 1215613 - RNA, 18 nt, Human
uaauuugugauacaaugc

SEQ ID NO: 1215614 - RNA, 15 nt, Human
uaauuugugauacaa

SEQ ID NO: 1215615 - RNA, 14 nt, Human
uaauuugugauaca

SEQ ID NO: 1215616 - RNA, 22 nt, Human
uaauuugugauacaaugcugug

SEQ ID NO: 1215617 - RNA, 19 nt, Human
uaauuugugauacaaugcu

SEQ ID NO: 1215618 - RNA, 14 nt, Human
uaauacaccacuac

SEQ ID NO: 1215619 - RNA, 21 nt, Human
uaauaguucagguaacaggca

SEQ ID NO: 1215620 - RNA, 20 nt, Human
uaagugguacuaacuuuccu

SEQ ID NO: 1215621 - RNA, 12 nt, Human
uaaucuaaaugg

SEQ ID NO: 1215622 - RNA, 11 nt, Human
uaaucuaaaug

SEQ ID NO: 1215623 - RNA, 15 nt, Human
uaacagaaauguaca

SEQ ID NO: 1215624 - RNA, 14 nt, Human
uaacagaaauguac

SEQ ID NO: 1215625 - RNA, 13 nt, Human
uaacagaaaugua

SEQ ID NO: 1215626 - RNA, 19 nt, Human
uaaccagcagaaaugccuu

SEQ ID NO: 1215627 - RNA, 16 nt, Human
uaaccagcagaaaugc

SEQ ID NO: 1215628 - RNA, 14 nt, Human
uaaccagcagaaau

SEQ ID NO: 1215629 - RNA, 19 nt, Human
uaacaggcagauacaggaa

SEQ ID NO: 1215630 - RNA, 20 nt, Human
uaacuuuuauaaacuuuacc

SEQ ID NO: 1215631 - RNA, 16 nt, Human
uaaggauguucuagca

SEQ ID NO: 1215632 - RNA, 23 nt, Human
uaaggaugcuuguacauaaugcg

SEQ ID NO: 1215633 - RNA, 22 nt, Human
uaaggaugcuuguacauaaugc

SEQ ID NO: 1215634 - RNA, 21 nt, Human
uaaggaugcuuguacauaaug

SEQ ID NO: 1215635 - RNA, 20 nt, Human
uaaggaugcuuguacauaau

SEQ ID NO: 1215636 - RNA, 19 nt, Human
uaaggaugcuuguacauaa

SEQ ID NO: 1215637 - RNA, 22 nt, Human
uaacuuuuauaaacuuuaccuu

SEQ ID NO: 1215638 - RNA, 21 nt, Human
uaacuuuuauaaacuuuaccu

SEQ ID NO: 1215639 - RNA, 17 nt, Human
uaagauaaaugugcuga

SEQ ID NO: 1215640 - RNA, 16 nt, Human
uaagauaaaugugcug

SEQ ID NO: 1215641 - RNA, 14 nt, Human
uaagauaaaugugc

SEQ ID NO: 1215642 - RNA, 23 nt, Human
uaagagggagggagggcuccaga

SEQ ID NO: 1215643 - RNA, 22 nt, Human
uaagagggagggagggcuccag

SEQ ID NO: 1215644 - RNA, 12 nt, Human
uaagagggaggg

SEQ ID NO: 1215645 - RNA, 12 nt, Human
uagauguauaua

SEQ ID NO: 1215646 - RNA, 18 nt, Human
uagauaauacaccacuac

SEQ ID NO: 1215647 - RNA, 23 nt, Human
uagcagagaaugaaagggcccag

SEQ ID NO: 1215648 - RNA, 19 nt, Human
uagcagagaaugaaagggc

SEQ ID NO: 1215649 - RNA, 21 nt, Human
uagagguucaaagauauuuug

SEQ ID NO: 1215650 - RNA, 19 nt, Human
uagagguucaaagauauuu

SEQ ID NO: 1215651 - RNA, 16 nt, Human
uagagagagaccacuu

SEQ ID NO: 1215652 - RNA, 21 nt, Human
uaggaacuuaaauaaugugaa

SEQ ID NO: 1215653 - RNA, 17 nt, Human
uaggaacacuccuucac

SEQ ID NO: 1215654 - RNA, 14 nt, Human
uaggaacacuccuu

SEQ ID NO: 1215655 - RNA, 13 nt, Human
uaggaacacuccu

SEQ ID NO: 1215656 - RNA, 17 nt, Human
uaggaagacuuuggaaa

SEQ ID NO: 1215657 - RNA, 16 nt, Human
uaggaagacuuuggaa

SEQ ID NO: 1215658 - RNA, 15 nt, Human
uaggaagacuuugga

SEQ ID NO: 1215659 - RNA, 14 nt, Human
uaggaagacuuugg

SEQ ID NO: 1215660 - RNA, 13 nt, Human
uaggaagacuuug

SEQ ID NO: 1215661 - RNA, 14 nt, Human
uaggccuggccaga

SEQ ID NO: 1215662 - RNA, 13 nt, Human
uaggccuggccag

SEQ ID NO: 1215663 - RNA, 15 nt, Human
uaggaagguuaaugu

SEQ ID NO: 1215664 - RNA, 14 nt, Human
uagcccaaaaccaa

SEQ ID NO: 1215665 - RNA, 16 nt, Human
uagcauacguacacau

SEQ ID NO: 1215666 - RNA, 17 nt, Human
uagccugccucuucucu

SEQ ID NO: 1215667 - RNA, 21 nt, Human
uagcucuaggagggcuggcaa

SEQ ID NO: 1215668 - RNA, 11 nt, Human
uagcugggacu

SEQ ID NO: 1215669 - RNA, 20 nt, Human
uagcugggacuacaggcacc

SEQ ID NO: 1215670 - RNA, 12 nt, Human
uagcugggacua

SEQ ID NO: 1215671 - RNA, 18 nt, Human
uagcugggacuacaggug

SEQ ID NO: 1215672 - RNA, 12 nt, Human
uaguuugcaguu

SEQ ID NO: 1215673 - RNA, 23 nt, Human
uaguuugauuaaauucuugcaaa

SEQ ID NO: 1215674 - RNA, 13 nt, Human
uaguuucuccaag

SEQ ID NO: 1215675 - RNA, 15 nt, Human
uaguggauguucuga

SEQ ID NO: 1215676 - RNA, 20 nt, Human
uauaaugaaugaaacauuuu

SEQ ID NO: 1215677 - RNA, 18 nt, Human
uauaaugaaugaaacauu

SEQ ID NO: 1215678 - RNA, 17 nt, Human
uauaauucuacuuugag

SEQ ID NO: 1215679 - RNA, 20 nt, Human
uauaauguaagcucuacuga

SEQ ID NO: 1215680 - RNA, 19 nt, Human
uauaauguaagcucuacug

SEQ ID NO: 1215681 - RNA, 14 nt, Human
uauaauguaagcuc

SEQ ID NO: 1215682 - RNA, 20 nt, Human
uauaugcucugcauguuaca

SEQ ID NO: 1215683 - RNA, 16 nt, Human
uaucuaaauguugaaa

SEQ ID NO: 1215684 - RNA, 15 nt, Human
uaucuaaauguugaa

SEQ ID NO: 1215685 - RNA, 19 nt, Human
uaucgucacugcuuaacuu

SEQ ID NO: 1215686 - RNA, 17 nt, Human
uaucaggugcugccauc

SEQ ID NO: 1215687 - RNA, 16 nt, Human
uaucaugacaaagacu

SEQ ID NO: 1215688 - RNA, 17 nt, Human
uaucaugacaaagacug

SEQ ID NO: 1215689 - RNA, 22 nt, Human
uacagcuugaccgugaggccag

SEQ ID NO: 1215690 - RNA, 18 nt, Human
uacaggaaaagcugcuga

SEQ ID NO: 1215691 - RNA, 17 nt, Human
uacaggaaaagcugcug

SEQ ID NO: 1215692 - RNA, 23 nt, Human
uacagcuugaccgugaggccaga

SEQ ID NO: 1215693 - RNA, 16 nt, Human
uacaggcacccaccau

SEQ ID NO: 1215694 - RNA, 19 nt, Human
uacaggaaaagcugcugac

SEQ ID NO: 1215695 - RNA, 13 nt, Human
uacacuuuaugca

SEQ ID NO: 1215696 - RNA, 19 nt, Human
uacacuguuucaaacuuua

SEQ ID NO: 1215697 - RNA, 18 nt, Human
uacacuguuucaaacuuu

SEQ ID NO: 1215698 - RNA, 17 nt, Human
uacacuguuucaaacuu

SEQ ID NO: 1215699 - RNA, 16 nt, Human
uacacugugcugaguc

SEQ ID NO: 1215700 - RNA, 14 nt, Human
uacacuguuucaaa

SEQ ID NO: 1215701 - RNA, 22 nt, Human
uacacacugcauguuugugauu

SEQ ID NO: 1215702 - RNA, 15 nt, Human
uacacacacauacac

SEQ ID NO: 1215703 - RNA, 21 nt, Human
uacacacacacgcgugcacac

SEQ ID NO: 1215704 - RNA, 23 nt, Human
uacacaaugguuuucuugugugu

SEQ ID NO: 1215705 - RNA, 21 nt, Human
uacacaaugguuuucuugugu

SEQ ID NO: 1215706 - RNA, 17 nt, Human
uacacaaugguuuucuu

SEQ ID NO: 1215707 - RNA, 15 nt, Human
uacccacccccaccc

SEQ ID NO: 1215708 - RNA, 12 nt, Human
uacccaccccca

SEQ ID NO: 1215709 - RNA, 23 nt, Human
uacccacccccacccaagggccu

SEQ ID NO: 1215710 - RNA, 19 nt, Human
uacccacccccacccaagg

SEQ ID NO: 1215711 - RNA, 17 nt, Human
uacccacccccacccaa

SEQ ID NO: 1215712 - RNA, 22 nt, Human
uacccaggugcuaggaacacuc

SEQ ID NO: 1215713 - RNA, 18 nt, Human
uacccagcgagcccuggu

SEQ ID NO: 1215714 - RNA, 15 nt, Human
uacccacugcucugg

SEQ ID NO: 1215715 - RNA, 14 nt, Human
uacccacugcucug

SEQ ID NO: 1215716 - RNA, 13 nt, Human
uacccacugcucu

SEQ ID NO: 1215717 - RNA, 12 nt, Human
uacccacugcuc

SEQ ID NO: 1215718 - RNA, 11 nt, Human
uacccacugcu

SEQ ID NO: 1215719 - RNA, 13 nt, Human
uaccacagacaua

SEQ ID NO: 1215720 - RNA, 23 nt, Human
uaccauuuugggguacccacugc

SEQ ID NO: 1215721 - RNA, 22 nt, Human
uacauaagauaaaugugcugaa

SEQ ID NO: 1215722 - RNA, 19 nt, Human
uacauaagauaaaugugcu

SEQ ID NO: 1215723 - RNA, 18 nt, Human
uacauaagauaaaugugc

SEQ ID NO: 1215724 - RNA, 23 nt, Human
uacaguuacucagaauucucuag

SEQ ID NO: 1215725 - RNA, 19 nt, Human
uacaguuacucagaauucu

SEQ ID NO: 1215726 - RNA, 17 nt, Human
uacuacaguccucccau

SEQ ID NO: 1215727 - RNA, 12 nt, Human
uacuacaguccu

SEQ ID NO: 1215728 - RNA, 20 nt, Human
uacuaauagacaauuuauua

SEQ ID NO: 1215729 - RNA, 17 nt, Human
uacuaauagacaauuua

SEQ ID NO: 1215730 - RNA, 15 nt, Human
uacuaauagacaauu

SEQ ID NO: 1215731 - RNA, 13 nt, Human
uacuaacuuuccu

SEQ ID NO: 1215732 - RNA, 19 nt, Human
uacuaaccagcagaaaugc

SEQ ID NO: 1215733 - RNA, 18 nt, Human
uacuaaccagcagaaaug

SEQ ID NO: 1215734 - RNA, 22 nt, Human
uaccuuuuuuauacauaaacaa

SEQ ID NO: 1215735 - RNA, 20 nt, Human
uaccuuuuuuauacauaaac

SEQ ID NO: 1215736 - RNA, 19 nt, Human
uaccuuuuuuauacauaaa

SEQ ID NO: 1215737 - RNA, 18 nt, Human
uaccuuuuuuauacauaa

SEQ ID NO: 1215738 - RNA, 20 nt, Human
uaccuuuguauucucuccug

SEQ ID NO: 1215739 - RNA, 22 nt, Human
uacccaucccauaugccugggc

SEQ ID NO: 1215740 - RNA, 22 nt, Human
uacucagaauucucuaguuuga

SEQ ID NO: 1215741 - RNA, 16 nt, Human
uacucagaauucucua

SEQ ID NO: 1215742 - RNA, 14 nt, Human
uacucaccucaccc

SEQ ID NO: 1215743 - RNA, 12 nt, Human
uacucaccucac

SEQ ID NO: 1215744 - RNA, 13 nt, Human
uacuacuccugua

SEQ ID NO: 1215745 - RNA, 20 nt, Human
uacuacaguccucccaucuc

SEQ ID NO: 1215746 - RNA, 17 nt, Human
uacucccaucugugaaa

SEQ ID NO: 1215747 - RNA, 16 nt, Human
uacucccaucugugaa

SEQ ID NO: 1215748 - RNA, 14 nt, Human
uacucccaucugug

SEQ ID NO: 1215749 - RNA, 15 nt, Human
uacugaggugcuaug

SEQ ID NO: 1215750 - RNA, 18 nt, Human
uacucgaguuacagacaa

SEQ ID NO: 1215751 - RNA, 23 nt, Human
uagaaauaucugaaaauguaugu

SEQ ID NO: 1215752 - RNA, 21 nt, Human
uagaaauaucugaaaauguau

SEQ ID NO: 1215753 - RNA, 20 nt, Human
uagaaauaucugaaaaugua

SEQ ID NO: 1215754 - RNA, 15 nt, Human
uagaaauauaauuga

SEQ ID NO: 1215755 - RNA, 19 nt, Human
uacuuguggacacagcucu

SEQ ID NO: 1215756 - RNA, 18 nt, Human
uacuuguggacacagcuc

SEQ ID NO: 1215757 - RNA, 15 nt, Human
uacuuguggacacag

SEQ ID NO: 1215758 - RNA, 17 nt, Human
uacugcauaugaaagga

SEQ ID NO: 1215759 - RNA, 21 nt, Human
uacuguaucaugacaaagacu

SEQ ID NO: 1215760 - RNA, 16 nt, Human
gguggugaccucugcc

SEQ ID NO: 1215761 - RNA, 15 nt, Human
gguggugaccucugc

SEQ ID NO: 1215762 - RNA, 14 nt, Human
gguggugaccucug

SEQ ID NO: 1215763 - RNA, 12 nt, Human
gguggcuggguu

SEQ ID NO: 1215764 - RNA, 21 nt, Human
ggugguuauggagaggguguc

SEQ ID NO: 1215765 - RNA, 18 nt, Human
ggugguuucagaaaugug

SEQ ID NO: 1215766 - RNA, 17 nt, Human
ggugguuucagaaaugu

SEQ ID NO: 1215767 - RNA, 18 nt, Human
ggugguuuucuguucuuu

SEQ ID NO: 1215768 - RNA, 15 nt, Human
ggugguuuucuguuc

SEQ ID NO: 1215769 - RNA, 19 nt, Human
ggugucaccugaagacuca

SEQ ID NO: 1215770 - RNA, 19 nt, Human
ggugucaagagggucugag

SEQ ID NO: 1215771 - RNA, 17 nt, Human
ggugucaagagggucug

SEQ ID NO: 1215772 - RNA, 21 nt, Human
gguuacccaguuagcucucaa

SEQ ID NO: 1215773 - RNA, 17 nt, Human
gguuaggcauuguggga

SEQ ID NO: 1215774 - RNA, 13 nt, Human
gguuauggagagg

SEQ ID NO: 1215775 - RNA, 20 nt, Human
gguucacugcaaccuccgcc

SEQ ID NO: 1215776 - RNA, 13 nt, Human
gguugagguuuca

SEQ ID NO: 1215777 - RNA, 21 nt, Human
gguucaaagauauuuugcuuu

SEQ ID NO: 1215778 - RNA, 13 nt, Human
gguucaaagauau

SEQ ID NO: 1215779 - RNA, 22 nt, Human
ggugaccagcaccaucucuccu

SEQ ID NO: 1215780 - RNA, 14 nt, Human
ggucugacccacug

SEQ ID NO: 1215781 - RNA, 23 nt, Human
ggucucacucugucgcccagucu

SEQ ID NO: 1215782 - RNA, 22 nt, Human
ggucucacucugucgcccaguc

SEQ ID NO: 1215783 - RNA, 21 nt, Human
ggucucacuauguugcccagg

SEQ ID NO: 1215784 - RNA, 22 nt, Human
ggucccaccccacacacgccag

SEQ ID NO: 1215785 - RNA, 17 nt, Human
ggucccaccccacacac

SEQ ID NO: 1215786 - RNA, 20 nt, Human
ggugcuaucucccccagccc

SEQ ID NO: 1215787 - RNA, 19 nt, Human
ggugcuaucucccccagcc

SEQ ID NO: 1215788 - RNA, 17 nt, Human
ggugcuaucucccccag

SEQ ID NO: 1215789 - RNA, 16 nt, Human
ggugcuaucuccccca

SEQ ID NO: 1215790 - RNA, 15 nt, Human
ggugcgaucuggguu

SEQ ID NO: 1215791 - RNA, 16 nt, Human
ggugagaggggaacag

SEQ ID NO: 1215792 - RNA, 15 nt, Human
ggugagaagcagagg

SEQ ID NO: 1215793 - RNA, 22 nt, Human
gguggcagugggagcugccugu

SEQ ID NO: 1215794 - RNA, 19 nt, Human
gguggcagugggagcugcc

SEQ ID NO: 1215795 - RNA, 21 nt, Human
ggugcugccauccagguucag

SEQ ID NO: 1215796 - RNA, 15 nt, Human
ggugcugccauccag

SEQ ID NO: 1215797 - RNA, 21 nt, Human
ggugcuaucucccccagcccc

SEQ ID NO: 1215798 - RNA, 23 nt, Human
gguggccucccaacucaccccag

SEQ ID NO: 1215799 - RNA, 22 nt, Human
gguggccucccaacucacccca

SEQ ID NO: 1215800 - RNA, 22 nt, Human
gggggaggugggauccuccagg

SEQ ID NO: 1215801 - RNA, 23 nt, Human
ggggcugcaccggcuggccuggc

SEQ ID NO: 1215802 - RNA, 22 nt, Human
ggggcugcaccggcuggccugg

SEQ ID NO: 1215803 - RNA, 21 nt, Human
ggggcugcaccggcuggccug

SEQ ID NO: 1215804 - RNA, 12 nt, Human
ggggcugcaccg

SEQ ID NO: 1215805 - RNA, 19 nt, Human
ggggcugaggugggaggau

SEQ ID NO: 1215806 - RNA, 17 nt, Human
gggguggggaccucagg

SEQ ID NO: 1215807 - RNA, 12 nt, Human
gggguggccucc

SEQ ID NO: 1215808 - RNA, 17 nt, Human
gggggaucacagccucu

SEQ ID NO: 1215809 - RNA, 21 nt, Human
gggucugaggaauccagaccc

SEQ ID NO: 1215810 - RNA, 12 nt, Human
gggucugaggaa

SEQ ID NO: 1215811 - RNA, 14 nt, Human
gggucucacucugu

SEQ ID NO: 1215812 - RNA, 17 nt, Human
ggguaagugagagaggg

SEQ ID NO: 1215813 - RNA, 16 nt, Human
ggggcaacccugguga

SEQ ID NO: 1215814 - RNA, 17 nt, Human
ggggcugaggugggagg

SEQ ID NO: 1215815 - RNA, 19 nt, Human
ggggaaaaucagccugcuc

SEQ ID NO: 1215816 - RNA, 17 nt, Human
ggggaaaaucagccugc

SEQ ID NO: 1215817 - RNA, 16 nt, Human
ggggaaaaucagccug

SEQ ID NO: 1215818 - RNA, 24 nt, Human
ggggaaaaucagccugcuccagcu

SEQ ID NO: 1215819 - RNA, 21 nt, Human
ggggaaaaucagccugcucca

SEQ ID NO: 1215820 - RNA, 19 nt, Human
gggugacagagcaagugag

SEQ ID NO: 1215821 - RNA, 17 nt, Human
gggugaagugaagacaa

SEQ ID NO: 1215822 - RNA, 23 nt, Human
ggguucaagcgauucuucugcuu

SEQ ID NO: 1215823 - RNA, 22 nt, Human
ggguucaagcgauucuucugcu

SEQ ID NO: 1215824 - RNA, 16 nt, Human
ggguuggccccugccc

SEQ ID NO: 1215825 - RNA, 17 nt, Human
ggguucuacccaggugc

SEQ ID NO: 1215826 - RNA, 12 nt, Human
ggguucuaccca

SEQ ID NO: 1215827 - RNA, 22 nt, Human
gguagaagcccuucuaccuucc

SEQ ID NO: 1215828 - RNA, 23 nt, Human
gguagaaauaucugaaaauguau

SEQ ID NO: 1215829 - RNA, 20 nt, Human
gguacuuguggacacagcuc

SEQ ID NO: 1215830 - RNA, 17 nt, Human
gguacuuguggacacag

SEQ ID NO: 1215831 - RNA, 16 nt, Human
gguacuuguggacaca

SEQ ID NO: 1215832 - RNA, 16 nt, Human
gguacccacugcucug

SEQ ID NO: 1215833 - RNA, 13 nt, Human
gguacccacugcu

SEQ ID NO: 1215834 - RNA, 11 nt, Human
gguacccacug

SEQ ID NO: 1215835 - RNA, 16 nt, Human
ggucccaccccacaca

SEQ ID NO: 1215836 - RNA, 15 nt, Human
ggucccaccccacac

SEQ ID NO: 1215837 - RNA, 11 nt, Human
ggucagagccu

SEQ ID NO: 1215838 - RNA, 12 nt, Human
ggucacucuggc

SEQ ID NO: 1215839 - RNA, 19 nt, Human
gggccuggccugagcuggg

SEQ ID NO: 1215840 - RNA, 13 nt, Human
gggccuggcuccc

SEQ ID NO: 1215841 - RNA, 18 nt, Human
gggccuggccugagcugg

SEQ ID NO: 1215842 - RNA, 14 nt, Human
gggccuggccugag

SEQ ID NO: 1215843 - RNA, 13 nt, Human
gggccuggccuga

SEQ ID NO: 1215844 - RNA, 13 nt, Human
gggcccugccucc

SEQ ID NO: 1215845 - RNA, 12 nt, Human
gggcaugacacg

SEQ ID NO: 1215846 - RNA, 17 nt, Human
gggcccagagagggugg

SEQ ID NO: 1215847 - RNA, 23 nt, Human
gggccacagagaaaguacuucuc

SEQ ID NO: 1215848 - RNA, 16 nt, Human
gggccacagagaaagu

SEQ ID NO: 1215849 - RNA, 13 nt, Human
gggauagagagag

SEQ ID NO: 1215850 - RNA, 21 nt, Human
gggauaugauuuaaaucagcc

SEQ ID NO: 1215851 - RNA, 16 nt, Human
gggauccuccaggugc

SEQ ID NO: 1215852 - RNA, 15 nt, Human
gggauccuccaggug

SEQ ID NO: 1215853 - RNA, 18 nt, Human
gggcaacccuggugacca

SEQ ID NO: 1215854 - RNA, 23 nt, Human
gggauccuggaguucugguuccu

SEQ ID NO: 1215855 - RNA, 14 nt, Human
gggagugagcuggu

SEQ ID NO: 1215856 - RNA, 11 nt, Human
gggagugagcu

SEQ ID NO: 1215857 - RNA, 18 nt, Human
gggagugacagaggcagc

SEQ ID NO: 1215858 - RNA, 20 nt, Human
gggaggugggauccuccagg

SEQ ID NO: 1215859 - RNA, 17 nt, Human
gggaggugggauccucc

SEQ ID NO: 1215860 - RNA, 16 nt, Human
gggaggugaccccagg

SEQ ID NO: 1215861 - RNA, 17 nt, Human
gggcagguugguggggg

SEQ ID NO: 1215862 - RNA, 12 nt, Human
gggcagagcaga

SEQ ID NO: 1215863 - RNA, 11 nt, Human
gggcagagcag

SEQ ID NO: 1215864 - RNA, 18 nt, Human
gggcagaaggaagacuuc

SEQ ID NO: 1215865 - RNA, 14 nt, Human
gggcagaaggaaga

SEQ ID NO: 1215866 - RNA, 20 nt, Human
gggcacucagaagacacuga

SEQ ID NO: 1215867 - RNA, 21 nt, Human
gggcacagaaaauggaagaca

SEQ ID NO: 1215868 - RNA, 20 nt, Human
gggcacagaaaauggaagac

SEQ ID NO: 1215869 - RNA, 18 nt, Human
gggcacagaaaauggaag

SEQ ID NO: 1215870 - RNA, 23 nt, Human
gggcacaccgggcacucagaaga

SEQ ID NO: 1215871 - RNA, 16 nt, Human
gggcacagggucucua

SEQ ID NO: 1215872 - RNA, 13 nt, Human
gggcacagggucu

SEQ ID NO: 1215873 - RNA, 19 nt, Human
gggcacucagaagacacug

SEQ ID NO: 1215874 - RNA, 16 nt, Human
gggcacucagaagaca

SEQ ID NO: 1215875 - RNA, 23 nt, Human
gggaaggauacaaaagcauguga

SEQ ID NO: 1215876 - RNA, 21 nt, Human
gggaaggauacaaaagcaugu

SEQ ID NO: 1215877 - RNA, 14 nt, Human
ggcuuuugugcauu

SEQ ID NO: 1215878 - RNA, 17 nt, Human
gggaagggggcugggac

SEQ ID NO: 1215879 - RNA, 16 nt, Human
gggaagggggcuggga

SEQ ID NO: 1215880 - RNA, 14 nt, Human
gggaagggggcugg

SEQ ID NO: 1215881 - RNA, 16 nt, Human
gggacucaaugcacug

SEQ ID NO: 1215882 - RNA, 17 nt, Human
gggacuacaggcaccca

SEQ ID NO: 1215883 - RNA, 15 nt, Human
gggaccucaggccug

SEQ ID NO: 1215884 - RNA, 13 nt, Human
gggaccucaggcc

SEQ ID NO: 1215885 - RNA, 12 nt, Human
gggaccucaggc

SEQ ID NO: 1215886 - RNA, 21 nt, Human
ggcuuggggaccagagcugcc

SEQ ID NO: 1215887 - RNA, 10 nt, Human
ggcuuuugug

SEQ ID NO: 1215888 - RNA, 18 nt, Human
ggcugggcuucaguggca

SEQ ID NO: 1215889 - RNA, 17 nt, Human
ggcugggcuucaguggc

SEQ ID NO: 1215890 - RNA, 13 nt, Human
ggcugggcuucag

SEQ ID NO: 1215891 - RNA, 12 nt, Human
ggcugggcuuca

SEQ ID NO: 1215892 - RNA, 18 nt, Human
ggcugggcucccuuccca

SEQ ID NO: 1215893 - RNA, 17 nt, Human
ggcugggcucccuuccc

SEQ ID NO: 1215894 - RNA, 21 nt, Human
ggcuuagucacugagacagcc

SEQ ID NO: 1215895 - RNA, 23 nt, Human
ggcugcuucaaggauccugagcc

SEQ ID NO: 1215896 - RNA, 19 nt, Human
ggcugggagagccuuccag

SEQ ID NO: 1215897 - RNA, 19 nt, Human
ggcugggcagaggaaagca

SEQ ID NO: 1215898 - RNA, 15 nt, Human
ggcugggcagaggaa

SEQ ID NO: 1215899 - RNA, 23 nt, Human
ggcugggagagccuuccaggggu

SEQ ID NO: 1215900 - RNA, 20 nt, Human
ggcugggagagccuuccagg

SEQ ID NO: 1215901 - RNA, 14 nt, Human
ggcugggcagagga

SEQ ID NO: 1215902 - RNA, 13 nt, Human
ggcugggcagagg

SEQ ID NO: 1215903 - RNA, 22 nt, Human
ggcugcuucaaggauccugagc

SEQ ID NO: 1215904 - RNA, 14 nt, Human
ggcugcuucaagga

SEQ ID NO: 1215905 - RNA, 12 nt, Human
ggcugcuucaag

SEQ ID NO: 1215906 - RNA, 11 nt, Human
ggcugcuucaa

SEQ ID NO: 1215907 - RNA, 17 nt, Human
ggcugcagggaguccga

SEQ ID NO: 1215908 - RNA, 18 nt, Human
ggcugcugaaggcucgag

SEQ ID NO: 1215909 - RNA, 17 nt, Human
ggcugcugaaggcucga

SEQ ID NO: 1215910 - RNA, 15 nt, Human
ggcugcugaaggcuc

SEQ ID NO: 1215911 - RNA, 14 nt, Human
ggcugcugaaggcu

SEQ ID NO: 1215912 - RNA, 13 nt, Human
ggcugcagggagu

SEQ ID NO: 1215913 - RNA, 12 nt, Human
ggcugcagggag

SEQ ID NO: 1215914 - RNA, 20 nt, Human
ggccccugcccggcugcgga

SEQ ID NO: 1215915 - RNA, 17 nt, Human
ggccccugcccggcugc

SEQ ID NO: 1215916 - RNA, 16 nt, Human
ggccccugcccggcug

SEQ ID NO: 1215917 - RNA, 15 nt, Human
ggcugaggugggagg

SEQ ID NO: 1215918 - RNA, 13 nt, Human
ggcugagguggga

SEQ ID NO: 1215919 - RNA, 19 nt, Human
ggcugcaccggcuggccug

SEQ ID NO: 1215920 - RNA, 18 nt, Human
ggcugcaccggcuggccu

SEQ ID NO: 1215921 - RNA, 17 nt, Human
ggcugcaccggcuggcc

SEQ ID NO: 1215922 - RNA, 24 nt, Human
ggcugcaaaggguaucaggugcug

SEQ ID NO: 1215923 - RNA, 23 nt, Human
ggcugcaaaggguaucaggugcu

SEQ ID NO: 1215924 - RNA, 22 nt, Human
ggcugcaaaggguaucaggugc

SEQ ID NO: 1215925 - RNA, 18 nt, Human
ggcugcaaaggguaucag

SEQ ID NO: 1215926 - RNA, 17 nt, Human
ggcagguuggugggggc

SEQ ID NO: 1215927 - RNA, 15 nt, Human
ggcagguuggugggg

SEQ ID NO: 1215928 - RNA, 23 nt, Human
ggcauguucucugaggacacuaa

SEQ ID NO: 1215929 - RNA, 22 nt, Human
ggccaccugcggugcuaucucc

SEQ ID NO: 1215930 - RNA, 16 nt, Human
ggccaccugcggugcu

SEQ ID NO: 1215931 - RNA, 17 nt, Human
ggccacaagacccuugu

SEQ ID NO: 1215932 - RNA, 16 nt, Human
ggccacaagacccuug

SEQ ID NO: 1215933 - RNA, 16 nt, Human
ggcauuccccaggagg

SEQ ID NO: 1215934 - RNA, 15 nt, Human
ggcauuccccaggag

SEQ ID NO: 1215935 - RNA, 16 nt, Human
ggccaggagccuccug

SEQ ID NO: 1215936 - RNA, 20 nt, Human
ggccacugugaagagaacca

SEQ ID NO: 1215937 - RNA, 14 nt, Human
ggccaggagccucc

SEQ ID NO: 1215938 - RNA, 16 nt, Human
ggccacugugaagaga

SEQ ID NO: 1215939 - RNA, 11 nt, Human
ggccacuguga

SEQ ID NO: 1215940 - RNA, 16 nt, Human
ggccaggccagaggga

SEQ ID NO: 1215941 - RNA, 14 nt, Human
ggccaggccagagg

SEQ ID NO: 1215942 - RNA, 11 nt, Human
ggccaggcugg

SEQ ID NO: 1215943 - RNA, 12 nt, Human
ggccccugccac

SEQ ID NO: 1215944 - RNA, 16 nt, Human
ggccccugccacccug

SEQ ID NO: 1215945 - RNA, 13 nt, Human
ggccccugccacc

SEQ ID NO: 1215946 - RNA, 13 nt, Human
ggccccugcccgg

SEQ ID NO: 1215947 - RNA, 18 nt, Human
ggccccugccacccuggg

SEQ ID NO: 1215948 - RNA, 17 nt, Human
ggccccugccacccugg

SEQ ID NO: 1215949 - RNA, 21 nt, Human
ggccccucagggucccuggug

SEQ ID NO: 1215950 - RNA, 20 nt, Human
ggccccucagggucccuggu

SEQ ID NO: 1215951 - RNA, 19 nt, Human
ggccccucagggucccugg

SEQ ID NO: 1215952 - RNA, 16 nt, Human
ggccccucaggguccc

SEQ ID NO: 1215953 - RNA, 16 nt, Human
ggccaugggccuccug

SEQ ID NO: 1215954 - RNA, 13 nt, Human
ggccaugggccuc

SEQ ID NO: 1215955 - RNA, 14 nt, Human
ggccaggcccucug

SEQ ID NO: 1215956 - RNA, 12 nt, Human
ggccaggcuggu

SEQ ID NO: 1215957 - RNA, 21 nt, Human
ggaucagucugauucccaagc

SEQ ID NO: 1215958 - RNA, 18 nt, Human
ggcaacugcauuggcuuu

SEQ ID NO: 1215959 - RNA, 19 nt, Human
ggcaacugcauuggcuuug

SEQ ID NO: 1215960 - RNA, 22 nt, Human
ggcagagcagagaccaucccug

SEQ ID NO: 1215961 - RNA, 20 nt, Human
ggcagagcagagaccauccc

SEQ ID NO: 1215962 - RNA, 16 nt, Human
ggcagagcagagacca

SEQ ID NO: 1215963 - RNA, 15 nt, Human
ggcagagcagagacc

SEQ ID NO: 1215964 - RNA, 17 nt, Human
ggcacccggccccugcu

SEQ ID NO: 1215965 - RNA, 16 nt, Human
ggcacccggccccugc

SEQ ID NO: 1215966 - RNA, 15 nt, Human
ggcacccggccccug

SEQ ID NO: 1215967 - RNA, 16 nt, Human
ggcaaggcugucaauu

SEQ ID NO: 1215968 - RNA, 23 nt, Human
ggcaggucuugaacuccuggccu

SEQ ID NO: 1215969 - RNA, 13 nt, Human
ggcagguccaggg

SEQ ID NO: 1215970 - RNA, 21 nt, Human
ggcagcuugaggguugggcug

SEQ ID NO: 1215971 - RNA, 21 nt, Human
ggcagcugcgguccacccagg

SEQ ID NO: 1215972 - RNA, 19 nt, Human
ggcagcugcgguccaccca

SEQ ID NO: 1215973 - RNA, 13 nt, Human
ggcagcucagaga

SEQ ID NO: 1215974 - RNA, 22 nt, Human
ggcagcucaccucucccuugga

SEQ ID NO: 1215975 - RNA, 21 nt, Human
ggcagcucaccucucccuugg

SEQ ID NO: 1215976 - RNA, 18 nt, Human
ggcagcucaccucucccu

SEQ ID NO: 1215977 - RNA, 23 nt, Human
ggcagauacaggaaaagcugcug

SEQ ID NO: 1215978 - RNA, 23 nt, Human
ggcagaguugaagacagagcuac

SEQ ID NO: 1215979 - RNA, 17 nt, Human
ggcagaggaaagcaaag

SEQ ID NO: 1215980 - RNA, 23 nt, Human
ggagugaguugauagcacagacc

SEQ ID NO: 1215981 - RNA, 16 nt, Human
ggaucacagccucuga

SEQ ID NO: 1215982 - RNA, 21 nt, Human
ggagugaguugauagcacaga

SEQ ID NO: 1215983 - RNA, 14 nt, Human
ggagugagcugguu

SEQ ID NO: 1215984 - RNA, 12 nt, Human
ggagugagcugg

SEQ ID NO: 1215985 - RNA, 21 nt, Human
ggagugacagaggcagcccca

SEQ ID NO: 1215986 - RNA, 19 nt, Human
ggagugacagaggcagccc

SEQ ID NO: 1215987 - RNA, 18 nt, Human
ggagugacagaggcagcc

SEQ ID NO: 1215988 - RNA, 17 nt, Human
ggagugacagaggcagc

SEQ ID NO: 1215989 - RNA, 16 nt, Human
ggagugacagaggcag

SEQ ID NO: 1215990 - RNA, 11 nt, Human
ggagugacaga

SEQ ID NO: 1215991 - RNA, 21 nt, Human
ggagucccaccuuggcugcag

SEQ ID NO: 1215992 - RNA, 20 nt, Human
ggagucccaccuuggcugca

SEQ ID NO: 1215993 - RNA, 17 nt, Human
ggagggcuccagacaca

SEQ ID NO: 1215994 - RNA, 15 nt, Human
ggagggcuccagaca

SEQ ID NO: 1215995 - RNA, 14 nt, Human
ggagggcuccagac

SEQ ID NO: 1215996 - RNA, 12 nt, Human
ggagggagggcu

SEQ ID NO: 1215997 - RNA, 13 nt, Human
ggagggcuccaga

SEQ ID NO: 1215998 - RNA, 12 nt, Human
ggagggcuccag

SEQ ID NO: 1215999 - RNA, 15 nt, Human
ggaggauguucuggg

SEQ ID NO: 1216000 - RNA, 21 nt, Human
ggaggaucucuugagccuggg

SEQ ID NO: 1216001 - RNA, 17 nt, Human
ggaggaucucuugagcc

SEQ ID NO: 1216002 - RNA, 23 nt, Human
ggaggaucacuugaguccagaag

SEQ ID NO: 1216003 - RNA, 20 nt, Human
ggaagccagcaggcucucag

SEQ ID NO: 1216004 - RNA, 20 nt, Human
ggagcaaaaucgaugcagug

SEQ ID NO: 1216005 - RNA, 20 nt, Human
ggagauuuacaacuggggga

SEQ ID NO: 1216006 - RNA, 15 nt, Human
ggagaggggcacagg

SEQ ID NO: 1216007 - RNA, 21 nt, Human
ggagagcuagcagcagggagg

SEQ ID NO: 1216008 - RNA, 13 nt, Human
ggaagagccuugc

SEQ ID NO: 1216009 - RNA, 17 nt, Human
ggaagcacaugccucuc

SEQ ID NO: 1216010 - RNA, 15 nt, Human
ggaagcacaugccuc

SEQ ID NO: 1216011 - RNA, 14 nt, Human
ggaagcacaugccu

SEQ ID NO: 1216012 - RNA, 13 nt, Human
ggaagcacaugcc

SEQ ID NO: 1216013 - RNA, 17 nt, Human
ggaagcacagcuucauu

SEQ ID NO: 1216014 - RNA, 18 nt, Human
ggaagccagcaggcucuc

SEQ ID NO: 1216015 - RNA, 17 nt, Human
ggaagccagcaggcucu

SEQ ID NO: 1216016 - RNA, 16 nt, Human
ggaagccagcaggcuc

SEQ ID NO: 1216017 - RNA, 15 nt, Human
ggaagccagcaggcu

SEQ ID NO: 1216018 - RNA, 14 nt, Human
ggaagccagcaggc

SEQ ID NO: 1216019 - RNA, 13 nt, Human
ggaagccagcagg

SEQ ID NO: 1216020 - RNA, 23 nt, Human
ggaagcacaugccucucucaggc

SEQ ID NO: 1216021 - RNA, 22 nt, Human
ggaagcacaugccucucucagg

SEQ ID NO: 1216022 - RNA, 21 nt, Human
ggaagcacaugccucucucag

SEQ ID NO: 1216023 - RNA, 20 nt, Human
ggaacagacuggaagcacag

SEQ ID NO: 1216024 - RNA, 19 nt, Human
ggaacagacuggaagcaca

SEQ ID NO: 1216025 - RNA, 15 nt, Human
ggaaaaucagccugc

SEQ ID NO: 1216026 - RNA, 14 nt, Human
ggaaaauaaauuau

SEQ ID NO: 1216027 - RNA, 22 nt, Human
gcuuccagugaggcucugcccu

SEQ ID NO: 1216028 - RNA, 17 nt, Human
gcuucucacugccaugc

SEQ ID NO: 1216029 - RNA, 21 nt, Human
gcuuccagugaggcucugccc

SEQ ID NO: 1216030 - RNA, 20 nt, Human
gcuuccagugaggcucugcc

SEQ ID NO: 1216031 - RNA, 19 nt, Human
gcuuccagugaggcucugc

SEQ ID NO: 1216032 - RNA, 13 nt, Human
gcuguucagcugg

SEQ ID NO: 1216033 - RNA, 15 nt, Human
gcuuggaggaaggaa

SEQ ID NO: 1216034 - RNA, 14 nt, Human
gcuuggaggaagga

SEQ ID NO: 1216035 - RNA, 13 nt, Human
gcuuggaggaagg

SEQ ID NO: 1216036 - RNA, 13 nt, Human
ggaaaaauagccu

SEQ ID NO: 1216037 - RNA, 14 nt, Human
ggaaaaacugauuu

SEQ ID NO: 1216038 - RNA, 15 nt, Human
ggaaaaauagccugc

SEQ ID NO: 1216039 - RNA, 14 nt, Human
gcuuuuacuuaaac

SEQ ID NO: 1216040 - RNA, 17 nt, Human
gcugggcuucaguggca

SEQ ID NO: 1216041 - RNA, 22 nt, Human
gcugggagagccuuccaggggu

SEQ ID NO: 1216042 - RNA, 19 nt, Human
gcugggagagccuuccagg

SEQ ID NO: 1216043 - RNA, 18 nt, Human
gcugggagagccuuccag

SEQ ID NO: 1216044 - RNA, 17 nt, Human
gcugggagagccuucca

SEQ ID NO: 1216045 - RNA, 13 nt, Human
gcugggagagccu

SEQ ID NO: 1216046 - RNA, 12 nt, Human
gcugggagagcc

SEQ ID NO: 1216047 - RNA, 19 nt, Human
gcuggucccacucagucca

SEQ ID NO: 1216048 - RNA, 15 nt, Human
gcuggucccacucag

SEQ ID NO: 1216049 - RNA, 13 nt, Human
gcugggggccuca

SEQ ID NO: 1216050 - RNA, 20 nt, Human
gcugggggccucagugccac

SEQ ID NO: 1216051 - RNA, 19 nt, Human
gcugggggccucagugcca

SEQ ID NO: 1216052 - RNA, 23 nt, Human
gcugggggaagaagcucucuccu

SEQ ID NO: 1216053 - RNA, 12 nt, Human
gcuggggccagu

SEQ ID NO: 1216054 - RNA, 19 nt, Human
gcugggcuucaguggcagc

SEQ ID NO: 1216055 - RNA, 18 nt, Human
gcugggcuucaguggcag

SEQ ID NO: 1216056 - RNA, 22 nt, Human
gcugucccuuacgugaguccug

SEQ ID NO: 1216057 - RNA, 21 nt, Human
gcugucccuuacgugaguccu

SEQ ID NO: 1216058 - RNA, 19 nt, Human
gcugucccuuacgugaguc

SEQ ID NO: 1216059 - RNA, 23 nt, Human
gcugucaauuacaggaaguacug

SEQ ID NO: 1216060 - RNA, 22 nt, Human
gcugucaauuacaggaaguacu

SEQ ID NO: 1216061 - RNA, 19 nt, Human
gcugucaauuacaggaagu

SEQ ID NO: 1216062 - RNA, 17 nt, Human
gcugucaauuacaggaa

SEQ ID NO: 1216063 - RNA, 16 nt, Human
gcugucaauuacagga

SEQ ID NO: 1216064 - RNA, 22 nt, Human
gcugguucaggguuggccccug

SEQ ID NO: 1216065 - RNA, 15 nt, Human
gcugguucaggguug

SEQ ID NO: 1216066 - RNA, 21 nt, Human
gcugguuagagguucccuuug

SEQ ID NO: 1216067 - RNA, 18 nt, Human
gcuggugucaccugaaga

SEQ ID NO: 1216068 - RNA, 20 nt, Human
gcuggucccacucaguccau

SEQ ID NO: 1216069 - RNA, 12 nt, Human
gcuggccuggcc

SEQ ID NO: 1216070 - RNA, 20 nt, Human
gcugggacaugggaaagggg

SEQ ID NO: 1216071 - RNA, 19 nt, Human
gcugggacuacagguguga

SEQ ID NO: 1216072 - RNA, 20 nt, Human
gcugggacuacaggcaccca

SEQ ID NO: 1216073 - RNA, 19 nt, Human
gcugggacuacaggcaccc

SEQ ID NO: 1216074 - RNA, 18 nt, Human
gcugggacuacaggcacc

SEQ ID NO: 1216075 - RNA, 13 nt, Human
gcugggacuacag

SEQ ID NO: 1216076 - RNA, 22 nt, Human
gcuggaccuugaacuggguacu

SEQ ID NO: 1216077 - RNA, 21 nt, Human
gcuggaccuugaacuggguac

SEQ ID NO: 1216078 - RNA, 18 nt, Human
gcuggaccuugaacuggg

SEQ ID NO: 1216079 - RNA, 22 nt, Human
gcugcuugggcuucauccuccu

SEQ ID NO: 1216080 - RNA, 17 nt, Human
gcugcuugggcuucauc

SEQ ID NO: 1216081 - RNA, 14 nt, Human
gcugcccugugagu

SEQ ID NO: 1216082 - RNA, 12 nt, Human
gcugcccuguga

SEQ ID NO: 1216083 - RNA, 11 nt, Human
gcugcccugug

SEQ ID NO: 1216084 - RNA, 22 nt, Human
gcuagcagcagggagggcuucu

SEQ ID NO: 1216085 - RNA, 16 nt, Human
gcugcuugggcuucau

SEQ ID NO: 1216086 - RNA, 23 nt, Human
gcugcuucaaggauccugagcca

SEQ ID NO: 1216087 - RNA, 22 nt, Human
gcugcuucaaggauccugagcc

SEQ ID NO: 1216088 - RNA, 21 nt, Human
gcugcuucaaggauccugagc

SEQ ID NO: 1216089 - RNA, 13 nt, Human
gcugcuucaagga

SEQ ID NO: 1216090 - RNA, 19 nt, Human
gcugcgguccacccaggag

SEQ ID NO: 1216091 - RNA, 18 nt, Human
gcugcgguccacccagga

SEQ ID NO: 1216092 - RNA, 17 nt, Human
gcugcgguccacccagg

SEQ ID NO: 1216093 - RNA, 19 nt, Human
gccgcagcccugcagaggg

SEQ ID NO: 1216094 - RNA, 17 nt, Human
gccgcagcccugcagag

SEQ ID NO: 1216095 - RNA, 16 nt, Human
gccgcagcccugcaga

SEQ ID NO: 1216096 - RNA, 15 nt, Human
gccgcagcccugcag

SEQ ID NO: 1216097 - RNA, 19 nt, Human
gccgagauagccaaggcca

SEQ ID NO: 1216098 - RNA, 17 nt, Human
gccgagauagccaaggc

SEQ ID NO: 1216099 - RNA, 16 nt, Human
gccgagauagccaagg

SEQ ID NO: 1216100 - RNA, 13 nt, Human
gcccuucucucca

SEQ ID NO: 1216101 - RNA, 21 nt, Human
gccucagcauccuggcacccg

SEQ ID NO: 1216102 - RNA, 18 nt, Human
gccucagcauccuggcac

SEQ ID NO: 1216103 - RNA, 24 nt, Human
gccucaagugauucuccugccuca

SEQ ID NO: 1216104 - RNA, 23 nt, Human
gccgucuaccugaggggccucuu

SEQ ID NO: 1216105 - RNA, 22 nt, Human
gccgucuaccugaggggccucu

SEQ ID NO: 1216106 - RNA, 20 nt, Human
gccgucuaccugaggggccu

SEQ ID NO: 1216107 - RNA, 12 nt, Human
gccugcccaggc

SEQ ID NO: 1216108 - RNA, 11 nt, Human
gccugcccagg

SEQ ID NO: 1216109 - RNA, 20 nt, Human
gccucugcacuccccugcug

SEQ ID NO: 1216110 - RNA, 19 nt, Human
gccucugcacuccccugcu

SEQ ID NO: 1216111 - RNA, 18 nt, Human
gccucugcacuccccugc

SEQ ID NO: 1216112 - RNA, 17 nt, Human
gccucugcacuccccug

SEQ ID NO: 1216113 - RNA, 16 nt, Human
gccucugcacuccccu

SEQ ID NO: 1216114 - RNA, 16 nt, Human
gccucugacacacagc

SEQ ID NO: 1216115 - RNA, 15 nt, Human
gccucugacacacag

SEQ ID NO: 1216116 - RNA, 15 nt, Human
gccugaagucacaca

SEQ ID NO: 1216117 - RNA, 21 nt, Human
gccucugcacuccccugcugg

SEQ ID NO: 1216118 - RNA, 15 nt, Human
gccucucccaucacu

SEQ ID NO: 1216119 - RNA, 23 nt, Human
gccucccgaguagcugggacuac

SEQ ID NO: 1216120 - RNA, 21 nt, Human
gccucccgaguagcugggacu

SEQ ID NO: 1216121 - RNA, 21 nt, Human
gccucccgaauagcugggacu

SEQ ID NO: 1216122 - RNA, 20 nt, Human
gccucccgaauagcugggac

SEQ ID NO: 1216123 - RNA, 19 nt, Human
gccucccgaauagcuggga

SEQ ID NO: 1216124 - RNA, 18 nt, Human
gccucccgaauagcuggg

SEQ ID NO: 1216125 - RNA, 22 nt, Human
gccucagccucccaaagugcug

SEQ ID NO: 1216126 - RNA, 14 nt, Human
gccucagccuccca

SEQ ID NO: 1216127 - RNA, 12 nt, Human
gccucagccucc

SEQ ID NO: 1216128 - RNA, 18 nt, Human
gcuaacauggaaguacua

SEQ ID NO: 1216129 - RNA, 17 nt, Human
gcuaacauggaaguacu

SEQ ID NO: 1216130 - RNA, 14 nt, Human
gcgugagccacugc

SEQ ID NO: 1216131 - RNA, 15 nt, Human
gcgugagccacugca

SEQ ID NO: 1216132 - RNA, 16 nt, Human
gcgugagccacugcac

SEQ ID NO: 1216133 - RNA, 22 nt, Human
gcuagacgagcaggcuucuucc

SEQ ID NO: 1216134 - RNA, 21 nt, Human
gcuagacgagcaggcuucuuc

SEQ ID NO: 1216135 - RNA, 23 nt, Human
gcgguccacccaggagccccgag

SEQ ID NO: 1216136 - RNA, 23 nt, Human
gcggggacagcuccuucuguccu

SEQ ID NO: 1216137 - RNA, 19 nt, Human
gcggggacagcuccuucug

SEQ ID NO: 1216138 - RNA, 23 nt, Human
gcggacagccacggccaggccag

SEQ ID NO: 1216139 - RNA, 19 nt, Human
gcggacagccacggccagg

SEQ ID NO: 1216140 - RNA, 19 nt, Human
gcggaaugaaccacaucuu

SEQ ID NO: 1216141 - RNA, 21 nt, Human
gcgccuacaggagugagcacu

SEQ ID NO: 1216142 - RNA, 20 nt, Human
gcgccuacaggagugagcac

SEQ ID NO: 1216143 - RNA, 14 nt, Human
gcgcugccccuggc

SEQ ID NO: 1216144 - RNA, 17 nt, Human
gcgcugccccuggcagc

SEQ ID NO: 1216145 - RNA, 17 nt, Human
gccugguggcagcugcg

SEQ ID NO: 1216146 - RNA, 16 nt, Human
gccugguggcagcugc

SEQ ID NO: 1216147 - RNA, 15 nt, Human
gccugguggcagcug

SEQ ID NO: 1216148 - RNA, 23 nt, Human
gccuuauggaacacucugagacu

SEQ ID NO: 1216149 - RNA, 22 nt, Human
gccuuauggaacacucugagac

SEQ ID NO: 1216150 - RNA, 21 nt, Human
gccuuauggaacacucugaga

SEQ ID NO: 1216151 - RNA, 14 nt, Human
gccccgcccaggcu

SEQ ID NO: 1216152 - RNA, 23 nt, Human
gccccgaggccuucucugaagga

SEQ ID NO: 1216153 - RNA, 23 nt, Human
gccccauucugccugcccaggcc

SEQ ID NO: 1216154 - RNA, 22 nt, Human
gccccauucugccugcccaggc

SEQ ID NO: 1216155 - RNA, 21 nt, Human
gccccucagggucccuggugg

SEQ ID NO: 1216156 - RNA, 19 nt, Human
gccccucagggucccuggu

SEQ ID NO: 1216157 - RNA, 23 nt, Human
gccccucaacucuccuccagagu

SEQ ID NO: 1216158 - RNA, 23 nt, Human
gccccuggcagccccuguucugg

SEQ ID NO: 1216159 - RNA, 18 nt, Human
gcccgggcucugccuccc

SEQ ID NO: 1216160 - RNA, 15 nt, Human
gcccgggcucugccu

SEQ ID NO: 1216161 - RNA, 14 nt, Human
gcccgggcucugcc

SEQ ID NO: 1216162 - RNA, 13 nt, Human
gcccgggcucugc

SEQ ID NO: 1216163 - RNA, 15 nt, Human
gcccggcuccaggcu

SEQ ID NO: 1216164 - RNA, 14 nt, Human
gcccggcuccaggc

SEQ ID NO: 1216165 - RNA, 13 nt, Human
gcccggcuccagg

SEQ ID NO: 1216166 - RNA, 20 nt, Human
gccccuucugacccaugcug

SEQ ID NO: 1216167 - RNA, 19 nt, Human
gccccuucugacccaugcu

SEQ ID NO: 1216168 - RNA, 22 nt, Human
gcccucugcccacucccugcaa

SEQ ID NO: 1216169 - RNA, 21 nt, Human
gcccgggcucugccucccauc

SEQ ID NO: 1216170 - RNA, 20 nt, Human
gcccgggcucugccucccau

SEQ ID NO: 1216171 - RNA, 19 nt, Human
gcccgggcucugccuccca

SEQ ID NO: 1216172 - RNA, 21 nt, Human
gccccauucugccugcccagg

SEQ ID NO: 1216173 - RNA, 20 nt, Human
gccccauucugccugcccag

SEQ ID NO: 1216174 - RNA, 18 nt, Human
gccccauucugccugccc

SEQ ID NO: 1216175 - RNA, 17 nt, Human
gccccauucugccugcc

SEQ ID NO: 1216176 - RNA, 23 nt, Human
gccccauccucuguacagagccc

SEQ ID NO: 1216177 - RNA, 21 nt, Human
gccccagugcccacaggauca

SEQ ID NO: 1216178 - RNA, 17 nt, Human
gccccagugcccacagg

SEQ ID NO: 1216179 - RNA, 16 nt, Human
gccccagugcccacag

SEQ ID NO: 1216180 - RNA, 15 nt, Human
gcccaguugggugga

SEQ ID NO: 1216181 - RNA, 22 nt, Human
gcccagucuggaaugcaguggu

SEQ ID NO: 1216182 - RNA, 16 nt, Human
gcccaggcuggcgugc

SEQ ID NO: 1216183 - RNA, 15 nt, Human
gcccaggcuggcgug

SEQ ID NO: 1216184 - RNA, 14 nt, Human
gcccaggcuggcgu

SEQ ID NO: 1216185 - RNA, 18 nt, Human
gcccaggccuccuacagc

SEQ ID NO: 1216186 - RNA, 16 nt, Human
gcccaggaaaggcucc

SEQ ID NO: 1216187 - RNA, 15 nt, Human
gcccaggaaaggcuc

SEQ ID NO: 1216188 - RNA, 12 nt, Human
gcccaggaaagg

SEQ ID NO: 1216189 - RNA, 11 nt, Human
gcccaggcugg

SEQ ID NO: 1216190 - RNA, 19 nt, Human
gccacugcaccgggccaca

SEQ ID NO: 1216191 - RNA, 18 nt, Human
gccacugcaccgggccac

SEQ ID NO: 1216192 - RNA, 17 nt, Human
gccacugcaccgggcca

SEQ ID NO: 1216193 - RNA, 18 nt, Human
gccagagggagugacaga

SEQ ID NO: 1216194 - RNA, 15 nt, Human
gccagagacacaagc

SEQ ID NO: 1216195 - RNA, 12 nt, Human
gccagagacaca

SEQ ID NO: 1216196 - RNA, 21 nt, Human
gccacuauuguuagucucuug

SEQ ID NO: 1216197 - RNA, 17 nt, Human
gccacggccaggccaga

SEQ ID NO: 1216198 - RNA, 16 nt, Human
gccacggccaggccag

SEQ ID NO: 1216199 - RNA, 15 nt, Human
gccacggccaggcca

SEQ ID NO: 1216200 - RNA, 14 nt, Human
gccacggccaggcc

SEQ ID NO: 1216201 - RNA, 13 nt, Human
gccaaagccaaag

SEQ ID NO: 1216202 - RNA, 16 nt, Human
gccagcugcuugggcu

SEQ ID NO: 1216203 - RNA, 15 nt, Human
gccagcugcuugggc

SEQ ID NO: 1216204 - RNA, 14 nt, Human
gccagcugcuuggg

SEQ ID NO: 1216205 - RNA, 22 nt, Human
gccagccuugaccauucuccac

SEQ ID NO: 1216206 - RNA, 21 nt, Human
gccagccuugaccauucucca

SEQ ID NO: 1216207 - RNA, 20 nt, Human
gccagccuugaccauucucc

SEQ ID NO: 1216208 - RNA, 14 nt, Human
gccagccuugacca

SEQ ID NO: 1216209 - RNA, 12 nt, Human
gccagccuugac

SEQ ID NO: 1216210 - RNA, 21 nt, Human
gccagccgagauagccaaggc

SEQ ID NO: 1216211 - RNA, 20 nt, Human
gccagccgagauagccaagg

SEQ ID NO: 1216212 - RNA, 19 nt, Human
gccagauucuuuccugagg

SEQ ID NO: 1216213 - RNA, 17 nt, Human
gccagauucuuuccuga

SEQ ID NO: 1216214 - RNA, 16 nt, Human
gccagauucuuuccug

SEQ ID NO: 1216215 - RNA, 20 nt, Human
gccagagggagugacagagg

SEQ ID NO: 1216216 - RNA, 19 nt, Human
gccagagggagugacagag

SEQ ID NO: 1216217 - RNA, 15 nt, Human
gcccaccccucaaca

SEQ ID NO: 1216218 - RNA, 19 nt, Human
gcccacaggaucagucuga

SEQ ID NO: 1216219 - RNA, 18 nt, Human
gcccacaggaucagucug

SEQ ID NO: 1216220 - RNA, 13 nt, Human
gcccacaggauca

SEQ ID NO: 1216221 - RNA, 16 nt, Human
gccauuuguguuuaua

SEQ ID NO: 1216222 - RNA, 16 nt, Human
gcccaaagaugcagcc

SEQ ID NO: 1216223 - RNA, 22 nt, Human
gccauuucuuccacaagagccc

SEQ ID NO: 1216224 - RNA, 20 nt, Human
gccauuucuuccacaagagc

SEQ ID NO: 1216225 - RNA, 17 nt, Human
gccauuucuuccacaag

SEQ ID NO: 1216226 - RNA, 23 nt, Human
gccaggggaaaaucagccugcuc

SEQ ID NO: 1216227 - RNA, 22 nt, Human
gccaggggaaaaucagccugcu

SEQ ID NO: 1216228 - RNA, 21 nt, Human
gccaggggaaaaucagccugc

SEQ ID NO: 1216229 - RNA, 17 nt, Human
gccaggggaaaaucagc

SEQ ID NO: 1216230 - RNA, 20 nt, Human
gccaggaagccagcaggcuc

SEQ ID NO: 1216231 - RNA, 19 nt, Human
gccaggaagccagcaggcu

SEQ ID NO: 1216232 - RNA, 18 nt, Human
gccaggaagccagcaggc

SEQ ID NO: 1216233 - RNA, 17 nt, Human
gccaggaagccagcagg

SEQ ID NO: 1216234 - RNA, 11 nt, Human
gccaggaagcc

SEQ ID NO: 1216235 - RNA, 17 nt, Human
gccaucccagccccaau

SEQ ID NO: 1216236 - RNA, 16 nt, Human
gccaucccagccccaa

SEQ ID NO: 1216237 - RNA, 15 nt, Human
gccaucccagcccca

SEQ ID NO: 1216238 - RNA, 14 nt, Human
gccaucccagcccc

SEQ ID NO: 1216239 - RNA, 13 nt, Human
gccaucccagccc

SEQ ID NO: 1216240 - RNA, 20 nt, Human
gccauccagguucagcuugu

SEQ ID NO: 1216241 - RNA, 19 nt, Human
gccauccagguucagcuug

SEQ ID NO: 1216242 - RNA, 20 nt, Human
gcaggaggaucacuugaguc

SEQ ID NO: 1216243 - RNA, 14 nt, Human
gcagccuggacccu

SEQ ID NO: 1216244 - RNA, 22 nt, Human
gcagccucaaccuccugggcua

SEQ ID NO: 1216245 - RNA, 21 nt, Human
gcagccucaaccuccugggcu

SEQ ID NO: 1216246 - RNA, 15 nt, Human
gcagccucacagucc

SEQ ID NO: 1216247 - RNA, 20 nt, Human
gcagccucaaccuccugggc

SEQ ID NO: 1216248 - RNA, 19 nt, Human
gcagccucaaccuccuggg

SEQ ID NO: 1216249 - RNA, 20 nt, Human
gcagaguugaagacagagcu

SEQ ID NO: 1216250 - RNA, 19 nt, Human
gcagaguugaagacagagc

SEQ ID NO: 1216251 - RNA, 17 nt, Human
gcagaguugaagacaga

SEQ ID NO: 1216252 - RNA, 16 nt, Human
gcagaguugaagacag

SEQ ID NO: 1216253 - RNA, 12 nt, Human
gcagcaauaaag

SEQ ID NO: 1216254 - RNA, 15 nt, Human
gcagaguugaagaca

SEQ ID NO: 1216255 - RNA, 19 nt, Human
gcagagaccaucccugaag

SEQ ID NO: 1216256 - RNA, 17 nt, Human
gcagagaccaucccuga

SEQ ID NO: 1216257 - RNA, 15 nt, Human
gcagagaccaucccu

SEQ ID NO: 1216258 - RNA, 14 nt, Human
gcagagaccauccc

SEQ ID NO: 1216259 - RNA, 21 nt, Human
gcagagaauucucuuauccaa

SEQ ID NO: 1216260 - RNA, 23 nt, Human
gcagagaaugaaagggcccagag

SEQ ID NO: 1216261 - RNA, 22 nt, Human
gcagagaaugaaagggcccaga

SEQ ID NO: 1216262 - RNA, 21 nt, Human
gcagagaaugaaagggcccag

SEQ ID NO: 1216263 - RNA, 20 nt, Human
gcagagaaugaaagggccca

SEQ ID NO: 1216264 - RNA, 19 nt, Human
gcagagaaugaaagggccc

SEQ ID NO: 1216265 - RNA, 18 nt, Human
gcagaaggaagacuucau

SEQ ID NO: 1216266 - RNA, 19 nt, Human
gcacagcuaacauggaagu

SEQ ID NO: 1216267 - RNA, 15 nt, Human
gcaaugaccuuucaa

SEQ ID NO: 1216268 - RNA, 14 nt, Human
gcaaugaccuuuca

SEQ ID NO: 1216269 - RNA, 13 nt, Human
gcaaugaccuuuc

SEQ ID NO: 1216270 - RNA, 21 nt, Human
gcacagcuucauuuccugugu

SEQ ID NO: 1216271 - RNA, 16 nt, Human
gcacagcuucauuucc

SEQ ID NO: 1216272 - RNA, 15 nt, Human
gcaccuccugccucg

SEQ ID NO: 1216273 - RNA, 14 nt, Human
gcaccuccugccuc

SEQ ID NO: 1216274 - RNA, 17 nt, Human
gcacccggccccugcug

SEQ ID NO: 1216275 - RNA, 15 nt, Human
gcacccggccccugc

SEQ ID NO: 1216276 - RNA, 20 nt, Human
gcaccacugcacuccagccu

SEQ ID NO: 1216277 - RNA, 19 nt, Human
gcaccacugcacuccagcc

SEQ ID NO: 1216278 - RNA, 14 nt, Human
gcagaaggaagacu

SEQ ID NO: 1216279 - RNA, 13 nt, Human
gcagaaggaagac

SEQ ID NO: 1216280 - RNA, 12 nt, Human
gcagaaggaaga

SEQ ID NO: 1216281 - RNA, 23 nt, Human
gcacugggcuuggggaccagagc

SEQ ID NO: 1216282 - RNA, 22 nt, Human
gcacugggcuuggggaccagag

SEQ ID NO: 1216283 - RNA, 17 nt, Human
gcacuaaggugugcucu

SEQ ID NO: 1216284 - RNA, 18 nt, Human
gcacccggccccugcugg

SEQ ID NO: 1216285 - RNA, 19 nt, Human
gcacuaaggugugcucuga

SEQ ID NO: 1216286 - RNA, 18 nt, Human
gcacuaaggugugcucug

SEQ ID NO: 1216287 - RNA, 16 nt, Human
gcagugggagcugccu

SEQ ID NO: 1216288 - RNA, 23 nt, Human
gcagugcuuccaaggauggacca

SEQ ID NO: 1216289 - RNA, 14 nt, Human
gcagggcucagcgg

SEQ ID NO: 1216290 - RNA, 12 nt, Human
gcagggcucagc

SEQ ID NO: 1216291 - RNA, 16 nt, Human
gcagggagggcuucug

SEQ ID NO: 1216292 - RNA, 20 nt, Human
gcaggauucuuccucccucc

SEQ ID NO: 1216293 - RNA, 18 nt, Human
gcagugggagcugccugu

SEQ ID NO: 1216294 - RNA, 17 nt, Human
gcagugggagcugccug

SEQ ID NO: 1216295 - RNA, 21 nt, Human
gcaucaagaugugacauguuu

SEQ ID NO: 1216296 - RNA, 20 nt, Human
gcauauucaggaagcucagg

SEQ ID NO: 1216297 - RNA, 18 nt, Human
gcauauucaggaagcuca

SEQ ID NO: 1216298 - RNA, 17 nt, Human
gcauauucaggaagcuc

SEQ ID NO: 1216299 - RNA, 15 nt, Human
gcauauucaggaagc

SEQ ID NO: 1216300 - RNA, 17 nt, Human
gcauguuugugauugac

SEQ ID NO: 1216301 - RNA, 15 nt, Human
gcaugcugucccuua

SEQ ID NO: 1216302 - RNA, 22 nt, Human
gcaugccuggauggggcugcac

SEQ ID NO: 1216303 - RNA, 17 nt, Human
gcaugccuggauggggc

SEQ ID NO: 1216304 - RNA, 20 nt, Human
gcaugacacgaauauugcug

SEQ ID NO: 1216305 - RNA, 18 nt, Human
gcaucaggccaggcccuc

SEQ ID NO: 1216306 - RNA, 17 nt, Human
gcaucaggccaggcccu

SEQ ID NO: 1216307 - RNA, 16 nt, Human
gcaucaggccaggccc

SEQ ID NO: 1216308 - RNA, 15 nt, Human
gcaucaggccaggcc

SEQ ID NO: 1216309 - RNA, 20 nt, Human
gccaaaggaagcacaugccu

SEQ ID NO: 1216310 - RNA, 16 nt, Human
gccaaaggaagcacau

SEQ ID NO: 1216311 - RNA, 14 nt, Human
gccaaaggaagcac

SEQ ID NO: 1216312 - RNA, 21 nt, Human
gccaaacucaccugccccuca

SEQ ID NO: 1216313 - RNA, 22 nt, Human
gcauuuugcuaaaugugaauga

SEQ ID NO: 1216314 - RNA, 21 nt, Human
gcauuuggugguuucagaaau

SEQ ID NO: 1216315 - RNA, 23 nt, Human
gcauuugcugaauacagaggcaa

SEQ ID NO: 1216316 - RNA, 12 nt, Human
gcauuccccagg

SEQ ID NO: 1216317 - RNA, 12 nt, Human
gcauuccccacu

SEQ ID NO: 1216318 - RNA, 20 nt, Human
gaguucauacccuguuacca

SEQ ID NO: 1216319 - RNA, 24 nt, Human
gauaauacaccacuacauucuguu

SEQ ID NO: 1216320 - RNA, 23 nt, Human
gauaauacaccacuacauucugu

SEQ ID NO: 1216321 - RNA, 14 nt, Human
gauaauacaccacu

SEQ ID NO: 1216322 - RNA, 12 nt, Human
gauaauacacca

SEQ ID NO: 1216323 - RNA, 13 nt, Human
gaguucugguucc

SEQ ID NO: 1216324 - RNA, 23 nt, Human
gaucacggcucacugcagccuca

SEQ ID NO: 1216325 - RNA, 18 nt, Human
gauauaugcucugcaugu

SEQ ID NO: 1216326 - RNA, 20 nt, Human
gauagugucccacggugccu

SEQ ID NO: 1216327 - RNA, 17 nt, Human
gauacaaaagcauguga

SEQ ID NO: 1216328 - RNA, 16 nt, Human
gauacaaaagcaugug

SEQ ID NO: 1216329 - RNA, 16 nt, Human
gaugccugguggcagc

SEQ ID NO: 1216330 - RNA, 15 nt, Human
gaugccugguggcag

SEQ ID NO: 1216331 - RNA, 14 nt, Human
gaugcagugcuucc

SEQ ID NO: 1216332 - RNA, 16 nt, Human
gaugagaggaaaucac

SEQ ID NO: 1216333 - RNA, 23 nt, Human
gaugcaccagcccuuagcaggga

SEQ ID NO: 1216334 - RNA, 15 nt, Human
gaugcaccagcccuu

SEQ ID NO: 1216335 - RNA, 14 nt, Human
gaugagaggaaauc

SEQ ID NO: 1216336 - RNA, 20 nt, Human
gaugaccuugaaugaugcca

SEQ ID NO: 1216337 - RNA, 18 nt, Human
gaugaccuugaaugaugc

SEQ ID NO: 1216338 - RNA, 21 nt, Human
gaugaaaugaggucagagccu

SEQ ID NO: 1216339 - RNA, 15 nt, Human
gaugaaaugagguca

SEQ ID NO: 1216340 - RNA, 19 nt, Human
gaucuucuuuauaauucua

SEQ ID NO: 1216341 - RNA, 22 nt, Human
gaucuucuguggguuucuaaag

SEQ ID NO: 1216342 - RNA, 20 nt, Human
gaucuaggaagacuuuggaa

SEQ ID NO: 1216343 - RNA, 18 nt, Human
gaucuaggaagacuuugg

SEQ ID NO: 1216344 - RNA, 14 nt, Human
gaucuaggaagacu

SEQ ID NO: 1216345 - RNA, 13 nt, Human
gaucuaggaagac

SEQ ID NO: 1216346 - RNA, 13 nt, Human
gauccugagccag

SEQ ID NO: 1216347 - RNA, 12 nt, Human
gauccugagcca

SEQ ID NO: 1216348 - RNA, 16 nt, Human
gaucauccacugugcc

SEQ ID NO: 1216349 - RNA, 13 nt, Human
gaucauccacugu

SEQ ID NO: 1216350 - RNA, 18 nt, Human
gauccucccaccucagcc

SEQ ID NO: 1216351 - RNA, 17 nt, Human
gauccucccaccucagc

SEQ ID NO: 1216352 - RNA, 16 nt, Human
gauccucccaccucag

SEQ ID NO: 1216353 - RNA, 14 nt, Human
gauccuccaggugc

SEQ ID NO: 1216354 - RNA, 18 nt, Human
gauccuaggcauuugcug

SEQ ID NO: 1216355 - RNA, 12 nt, Human
gauuuaaaucag

SEQ ID NO: 1216356 - RNA, 22 nt, Human
gauuucuguuuagauaauacac

SEQ ID NO: 1216357 - RNA, 18 nt, Human
gauugcuugagcucagga

SEQ ID NO: 1216358 - RNA, 18 nt, Human
gauugcaacaggcugggc

SEQ ID NO: 1216359 - RNA, 17 nt, Human
gauugcaacaggcuggg

SEQ ID NO: 1216360 - RNA, 16 nt, Human
gauugcaacaggcugg

SEQ ID NO: 1216361 - RNA, 22 nt, Human
gauucuuuccugaggcugggcu

SEQ ID NO: 1216362 - RNA, 20 nt, Human
gauucuuuccugaggcuggg

SEQ ID NO: 1216363 - RNA, 18 nt, Human
gauucccaagcucugcuc

SEQ ID NO: 1216364 - RNA, 19 nt, Human
gauucuuuccugaggcugg

SEQ ID NO: 1216365 - RNA, 17 nt, Human
gauucccaagcucugcu

SEQ ID NO: 1216366 - RNA, 16 nt, Human
gauucccaagcucugc

SEQ ID NO: 1216367 - RNA, 15 nt, Human
gauucccaagcucug

SEQ ID NO: 1216368 - RNA, 18 nt, Human
gauucagacagcugccug

SEQ ID NO: 1216369 - RNA, 17 nt, Human
gauucagacagcugccu

SEQ ID NO: 1216370 - RNA, 14 nt, Human
gauucagacagcug

SEQ ID NO: 1216371 - RNA, 13 nt, Human
gauucagacagcu

SEQ ID NO: 1216372 - RNA, 21 nt, Human
gauuacaagcgugagccacug

SEQ ID NO: 1216373 - RNA, 13 nt, Human
gauuacaagcgug

SEQ ID NO: 1216374 - RNA, 21 nt, Human
gauguuuuaaggaugcuugua

SEQ ID NO: 1216375 - RNA, 14 nt, Human
gauguucugggaca

SEQ ID NO: 1216376 - RNA, 18 nt, Human
gauguucuagcauggcug

SEQ ID NO: 1216377 - RNA, 17 nt, Human
gaugccugguggcagcu

SEQ ID NO: 1216378 - RNA, 17 nt, Human
gcaauccugcaagaaca

SEQ ID NO: 1216379 - RNA, 18 nt, Human
gcaaggcugucaauuaca

SEQ ID NO: 1216380 - RNA, 14 nt, Human
gcaaggcugucaau

SEQ ID NO: 1216381 - RNA, 20 nt, Human
gcaagcaccuccugccucga

SEQ ID NO: 1216382 - RNA, 18 nt, Human
gcaagcaccuccugccuc

SEQ ID NO: 1216383 - RNA, 16 nt, Human
gcaagcaccuccugcc

SEQ ID NO: 1216384 - RNA, 15 nt, Human
gcaagcaccuccugc

SEQ ID NO: 1216385 - RNA, 21 nt, Human
gcaaaccaucauugaaaucuu

SEQ ID NO: 1216386 - RNA, 20 nt, Human
gcaaaccaucauugaaaucu

SEQ ID NO: 1216387 - RNA, 19 nt, Human
gcaaaccaucauugaaauc

SEQ ID NO: 1216388 - RNA, 17 nt, Human
gcaaaccaucauugaaa

SEQ ID NO: 1216389 - RNA, 16 nt, Human
gcaaaccaucauugaa

SEQ ID NO: 1216390 - RNA, 18 nt, Human
gcaacugcauuggcuuug

SEQ ID NO: 1216391 - RNA, 19 nt, Human
gaagagaaugcacaaacag

SEQ ID NO: 1216392 - RNA, 17 nt, Human
gaagacuuuggaaagag

SEQ ID NO: 1216393 - RNA, 14 nt, Human
gaagacuuuggaaa

SEQ ID NO: 1216394 - RNA, 20 nt, Human
gaagacuuuucuuucagcca

SEQ ID NO: 1216395 - RNA, 13 nt, Human
gaagacuuuggaa

SEQ ID NO: 1216396 - RNA, 11 nt, Human
gaagacuuugg

SEQ ID NO: 1216397 - RNA, 23 nt, Human
gaacuuugaccucugcagcaaua

SEQ ID NO: 1216398 - RNA, 20 nt, Human
gaagauaauauuaaggaaga

SEQ ID NO: 1216399 - RNA, 18 nt, Human
gaagcauuuacuuugugu

SEQ ID NO: 1216400 - RNA, 17 nt, Human
gaagcauuuacuuugug

SEQ ID NO: 1216401 - RNA, 23 nt, Human
gaagcccuucuaccuuccugcaa

SEQ ID NO: 1216402 - RNA, 23 nt, Human
gaagccagcaggcucucaggcca

SEQ ID NO: 1216403 - RNA, 19 nt, Human
gaagcccaggaaaggcucc

SEQ ID NO: 1216404 - RNA, 16 nt, Human
gaagcccaggaaaggc

SEQ ID NO: 1216405 - RNA, 15 nt, Human
gaagcccaggaaagg

SEQ ID NO: 1216406 - RNA, 13 nt, Human
gaagcccaggaaa

SEQ ID NO: 1216407 - RNA, 22 nt, Human
gaagccagcaggcucucaggcc

SEQ ID NO: 1216408 - RNA, 21 nt, Human
gaagccagcaggcucucaggc

SEQ ID NO: 1216409 - RNA, 20 nt, Human
gaagccagcaggcucucagg

SEQ ID NO: 1216410 - RNA, 15 nt, Human
gaacacucugagacu

SEQ ID NO: 1216411 - RNA, 14 nt, Human
gaacacucugagac

SEQ ID NO: 1216412 - RNA, 13 nt, Human
gaacacucugaga

SEQ ID NO: 1216413 - RNA, 21 nt, Human
gaaccuuuugagugccuuaca

SEQ ID NO: 1216414 - RNA, 19 nt, Human
gaaccuuuugagugccuua

SEQ ID NO: 1216415 - RNA, 18 nt, Human
gaaccuuuugagugccuu

SEQ ID NO: 1216416 - RNA, 22 nt, Human
gaaccuuuugagugccuuacac

SEQ ID NO: 1216417 - RNA, 19 nt, Human
gaagggggcugggacaugg

SEQ ID NO: 1216418 - RNA, 16 nt, Human
gaagggggcugggaca

SEQ ID NO: 1216419 - RNA, 15 nt, Human
gaaguacuggagaaa

SEQ ID NO: 1216420 - RNA, 18 nt, Human
gaaguacuauaauuuacc

SEQ ID NO: 1216421 - RNA, 22 nt, Human
gaaguaauaugcacacauuuuu

SEQ ID NO: 1216422 - RNA, 18 nt, Human
gaagucuuagauguauau

SEQ ID NO: 1216423 - RNA, 21 nt, Human
gaaguuucugccgcagcccug

SEQ ID NO: 1216424 - RNA, 15 nt, Human
gaagucuuagaugua

SEQ ID NO: 1216425 - RNA, 22 nt, Human
gaauagcugggacuacaggugu

SEQ ID NO: 1216426 - RNA, 23 nt, Human
gaauagcugggacuacaggugug

SEQ ID NO: 1216427 - RNA, 13 nt, Human
gaauaccuguccc

SEQ ID NO: 1216428 - RNA, 15 nt, Human
gaauaccuguccccc

SEQ ID NO: 1216429 - RNA, 19 nt, Human
gaauaacauguaauuaagu

SEQ ID NO: 1216430 - RNA, 18 nt, Human
gaauaacauguaauuaag

SEQ ID NO: 1216431 - RNA, 20 nt, Human
gaaguuugagaucagccugg

SEQ ID NO: 1216432 - RNA, 17 nt, Human
gaauaauacaguaucuc

SEQ ID NO: 1216433 - RNA, 21 nt, Human
gaauacagaggcaacugcauu

SEQ ID NO: 1216434 - RNA, 23 nt, Human
gaaugaaccacaucuugcucugc

SEQ ID NO: 1216435 - RNA, 22 nt, Human
gaaugaaccacaucuugcucug

SEQ ID NO: 1216436 - RNA, 22 nt, Human
gaaugguuuucaaaauaaaaau

SEQ ID NO: 1216437 - RNA, 14 nt, Human
gaaugucaguguga

SEQ ID NO: 1216438 - RNA, 22 nt, Human
gaauuguaaggaaugauuaauu

SEQ ID NO: 1216439 - RNA, 15 nt, Human
gaauuucccaaagca

SEQ ID NO: 1216440 - RNA, 14 nt, Human
gaauugaagcagga

SEQ ID NO: 1216441 - RNA, 14 nt, Human
gaauugaaaaacca

SEQ ID NO: 1216442 - RNA, 19 nt, Human
gaauucucuaguuugauua

SEQ ID NO: 1216443 - RNA, 17 nt, Human
gaauucucuaguuugau

SEQ ID NO: 1216444 - RNA, 17 nt, Human
gaauucucagaaucuca

SEQ ID NO: 1216445 - RNA, 21 nt, Human
gaaugucagugugacugaucu

SEQ ID NO: 1216446 - RNA, 20 nt, Human
gaaugucagugugacugauc

SEQ ID NO: 1216447 - RNA, 12 nt, Human
gacccugaggcc

SEQ ID NO: 1216448 - RNA, 11 nt, Human
gacccugaggc

SEQ ID NO: 1216449 - RNA, 22 nt, Human
gacccugcccugugggccccca

SEQ ID NO: 1216450 - RNA, 20 nt, Human
gacccugcccugugggcccc

SEQ ID NO: 1216451 - RNA, 18 nt, Human
gacccugaggcccagagg

SEQ ID NO: 1216452 - RNA, 16 nt, Human
gacccugaggcccaga

SEQ ID NO: 1216453 - RNA, 20 nt, Human
gacccaugcugcccugugag

SEQ ID NO: 1216454 - RNA, 19 nt, Human
gacccaugcugcccuguga

SEQ ID NO: 1216455 - RNA, 18 nt, Human
gacccaugcugcccugug

SEQ ID NO: 1216456 - RNA, 13 nt, Human
gacccaugcugcc

SEQ ID NO: 1216457 - RNA, 21 nt, Human
gaccagcaccaucucuccucc

SEQ ID NO: 1216458 - RNA, 20 nt, Human
gaccagcaccaucucuccuc

SEQ ID NO: 1216459 - RNA, 21 nt, Human
gaccagagcugccaccugccu

SEQ ID NO: 1216460 - RNA, 24 nt, Human
gaccagacaccuugacagggcaca

SEQ ID NO: 1216461 - RNA, 23 nt, Human
gaccagacaccuugacagggcac

SEQ ID NO: 1216462 - RNA, 22 nt, Human
gaccagacaccuugacagggca

SEQ ID NO: 1216463 - RNA, 18 nt, Human
gaccacaaaacuuuucua

SEQ ID NO: 1216464 - RNA, 21 nt, Human
gacaggcauguucucugagga

SEQ ID NO: 1216465 - RNA, 24 nt, Human
gacaggcaaugcuggcuguuggcu

SEQ ID NO: 1216466 - RNA, 23 nt, Human
gacaggcaaugcuggcuguuggc

SEQ ID NO: 1216467 - RNA, 19 nt, Human
gacaggcaaugcuggcugu

SEQ ID NO: 1216468 - RNA, 21 nt, Human
gacaggcaagcaccuccugcc

SEQ ID NO: 1216469 - RNA, 20 nt, Human
gacaggcaagcaccuccugc

SEQ ID NO: 1216470 - RNA, 18 nt, Human
gacaggcaagcaccuccu

SEQ ID NO: 1216471 - RNA, 17 nt, Human
gacaggcaagcaccucc

SEQ ID NO: 1216472 - RNA, 13 nt, Human
gacaggcaagcac

SEQ ID NO: 1216473 - RNA, 23 nt, Human
gacaucaacugcaucaagaugug

SEQ ID NO: 1216474 - RNA, 16 nt, Human
gacaucaacugcauca

SEQ ID NO: 1216475 - RNA, 22 nt, Human
gacaggcauguucucugaggac

SEQ ID NO: 1216476 - RNA, 22 nt, Human
gacagacacaggcccggcucca

SEQ ID NO: 1216477 - RNA, 20 nt, Human
gacagacacaggcccggcuc

SEQ ID NO: 1216478 - RNA, 16 nt, Human
gacacuagaagauuuu

SEQ ID NO: 1216479 - RNA, 22 nt, Human
gacacgaauauugcugauggug

SEQ ID NO: 1216480 - RNA, 22 nt, Human
gaauuucccaaagcagugcaug

SEQ ID NO: 1216481 - RNA, 18 nt, Human
gaauuucccaaagcagug

SEQ ID NO: 1216482 - RNA, 16 nt, Human
gaauuucccaaagcag

SEQ ID NO: 1216483 - RNA, 19 nt, Human
gacagagugagacucuguc

SEQ ID NO: 1216484 - RNA, 16 nt, Human
gacagagugagacucu

SEQ ID NO: 1216485 - RNA, 21 nt, Human
gacagagucucacuguugccc

SEQ ID NO: 1216486 - RNA, 13 nt, Human
gacagagggggug

SEQ ID NO: 1216487 - RNA, 23 nt, Human
gacagaggcagccccauucugcc

SEQ ID NO: 1216488 - RNA, 12 nt, Human
gacagaggcagc

SEQ ID NO: 1216489 - RNA, 20 nt, Human
gacagagcuacacaggggaa

SEQ ID NO: 1216490 - RNA, 23 nt, Human
gacuaacuugucuuuggacccug

SEQ ID NO: 1216491 - RNA, 16 nt, Human
gacuaacuugucuuug

SEQ ID NO: 1216492 - RNA, 15 nt, Human
gacguguuaugacuc

SEQ ID NO: 1216493 - RNA, 14 nt, Human
gacguguuaugacu

SEQ ID NO: 1216494 - RNA, 11 nt, Human
gacguguuaug

SEQ ID NO: 1216495 - RNA, 14 nt, Human
gacggagucccacc

SEQ ID NO: 1216496 - RNA, 13 nt, Human
gacggagucccac

SEQ ID NO: 1216497 - RNA, 22 nt, Human
gacgcugugcugcccugcccac

SEQ ID NO: 1216498 - RNA, 20 nt, Human
gaccuuucaauaggaaaaac

SEQ ID NO: 1216499 - RNA, 19 nt, Human
gaccuuucaauaggaaaaa

SEQ ID NO: 1216500 - RNA, 11 nt, Human
gaccuuucaau

SEQ ID NO: 1216501 - RNA, 23 nt, Human
gaccuugaacuggguacuugugg

SEQ ID NO: 1216502 - RNA, 14 nt, Human
gaccuugaacuggg

SEQ ID NO: 1216503 - RNA, 21 nt, Human
gaccuucuccuucaccuuugu

SEQ ID NO: 1216504 - RNA, 20 nt, Human
gaccuucuccuucaccuuug

SEQ ID NO: 1216505 - RNA, 16 nt, Human
gaccuucuccuucacc

SEQ ID NO: 1216506 - RNA, 15 nt, Human
gaccuucuccuucac

SEQ ID NO: 1216507 - RNA, 14 nt, Human
gaccuucuccuuca

SEQ ID NO: 1216508 - RNA, 15 nt, Human
gacccuugugguccc

SEQ ID NO: 1216509 - RNA, 23 nt, Human
gacccuugccgucuaccugaggg

SEQ ID NO: 1216510 - RNA, 20 nt, Human
gacccuugccgucuaccuga

SEQ ID NO: 1216511 - RNA, 19 nt, Human
gacccuugccgucuaccug

SEQ ID NO: 1216512 - RNA, 23 nt, Human
gacuggccaagguuuggggaaga

SEQ ID NO: 1216513 - RNA, 23 nt, Human
gacuuacuguacaugaaaacaca

SEQ ID NO: 1216514 - RNA, 18 nt, Human
gacuuacuguacaugaaa

SEQ ID NO: 1216515 - RNA, 16 nt, Human
gacuuacuguacauga

SEQ ID NO: 1216516 - RNA, 15 nt, Human
gacuuacuguacaug

SEQ ID NO: 1216517 - RNA, 12 nt, Human
gacuuacuguac

SEQ ID NO: 1216518 - RNA, 20 nt, Human
gacuucaucccucuggggcu

SEQ ID NO: 1216519 - RNA, 12 nt, Human
gacuucaucccu

SEQ ID NO: 1216520 - RNA, 21 nt, Human
gacucuacagaggccaugggc

SEQ ID NO: 1216521 - RNA, 15 nt, Human
gacucuacagaggcc

SEQ ID NO: 1216522 - RNA, 21 nt, Human
gacuccugcaggcagccaggc

SEQ ID NO: 1216523 - RNA, 20 nt, Human
gacuccugcaggcagccagg

SEQ ID NO: 1216524 - RNA, 19 nt, Human
gacuccugcaggcagccag

SEQ ID NO: 1216525 - RNA, 13 nt, Human
gacuacaggugug

SEQ ID NO: 1216526 - RNA, 18 nt, Human
gacuccugcaggcagcca

SEQ ID NO: 1216527 - RNA, 18 nt, Human
gacuacaggcacccacca

SEQ ID NO: 1216528 - RNA, 15 nt, Human
gacuacaggcaccca

SEQ ID NO: 1216529 - RNA, 13 nt, Human
gacuacaggcacc

SEQ ID NO: 1216530 - RNA, 18 nt, Human
gacugaguacguugugca

SEQ ID NO: 1216531 - RNA, 15 nt, Human
cuucgcuccuguguc

SEQ ID NO: 1216532 - RNA, 14 nt, Human
cuucgcuccugugu

SEQ ID NO: 1216533 - RNA, 13 nt, Human
cuucgcuccugug

SEQ ID NO: 1216534 - RNA, 16 nt, Human
cuucgcuccugugucu

SEQ ID NO: 1216535 - RNA, 21 nt, Human
cuucgggaggucgaggcagga

SEQ ID NO: 1216536 - RNA, 20 nt, Human
cuucgggaggucgaggcagg

SEQ ID NO: 1216537 - RNA, 18 nt, Human
cuucugcuucagccuccc

SEQ ID NO: 1216538 - RNA, 17 nt, Human
cuucugcuucagccucc

SEQ ID NO: 1216539 - RNA, 16 nt, Human
cuucugcuucagccuc

SEQ ID NO: 1216540 - RNA, 20 nt, Human
cuucugccauuucugagauc

SEQ ID NO: 1216541 - RNA, 21 nt, Human
cuucugccauauucuguuggc

SEQ ID NO: 1216542 - RNA, 17 nt, Human
cuucugccauauucugu

SEQ ID NO: 1216543 - RNA, 12 nt, Human
cuucucuccagc

SEQ ID NO: 1216544 - RNA, 17 nt, Human
cuucuccaggcuguauc

SEQ ID NO: 1216545 - RNA, 16 nt, Human
cuucuccacccugcuc

SEQ ID NO: 1216546 - RNA, 15 nt, Human
cuucuccacccugcu

SEQ ID NO: 1216547 - RNA, 14 nt, Human
cuucuccacccugc

SEQ ID NO: 1216548 - RNA, 22 nt, Human
cuucuccuucaccuuugucccc

SEQ ID NO: 1216549 - RNA, 23 nt, Human
cuuccacaagagcccaggccucc

SEQ ID NO: 1216550 - RNA, 18 nt, Human
cuucauuuccugugucuu

SEQ ID NO: 1216551 - RNA, 14 nt, Human
cuucagugccuuau

SEQ ID NO: 1216552 - RNA, 13 nt, Human
cuucagugccuua

SEQ ID NO: 1216553 - RNA, 12 nt, Human
cuucagugccuu

SEQ ID NO: 1216554 - RNA, 11 nt, Human
cuucagugccu

SEQ ID NO: 1216555 - RNA, 11 nt, Human
cuucagcugac

SEQ ID NO: 1216556 - RNA, 17 nt, Human
cuuccagugaggcucug

SEQ ID NO: 1216557 - RNA, 15 nt, Human
cuuccagugaggcuc

SEQ ID NO: 1216558 - RNA, 14 nt, Human
cuuccagugaggcu

SEQ ID NO: 1216559 - RNA, 24 nt, Human
cuuccaggggugggacacccugug

SEQ ID NO: 1216560 - RNA, 22 nt, Human
cuuccaggggugggacacccug

SEQ ID NO: 1216561 - RNA, 14 nt, Human
cuguuuagauaaua

SEQ ID NO: 1216562 - RNA, 12 nt, Human
cuguuuagauaa

SEQ ID NO: 1216563 - RNA, 18 nt, Human
cuguuuguuucugaaagg

SEQ ID NO: 1216564 - RNA, 17 nt, Human
cuguuuucucuugagag

SEQ ID NO: 1216565 - RNA, 14 nt, Human
cuguuuucucuuga

SEQ ID NO: 1216566 - RNA, 21 nt, Human
cuguuuuauuuuaauucaguu

SEQ ID NO: 1216567 - RNA, 23 nt, Human
cuguuuguuucugaaagggacgc

SEQ ID NO: 1216568 - RNA, 21 nt, Human
cuguuuguuucugaaagggac

SEQ ID NO: 1216569 - RNA, 22 nt, Human
cuuaacuucacauauugauuuc

SEQ ID NO: 1216570 - RNA, 17 nt, Human
cuuaacuucacauauug

SEQ ID NO: 1216571 - RNA, 16 nt, Human
cuuaacuucacauauu

SEQ ID NO: 1216572 - RNA, 15 nt, Human
cuuaacuucacauau

SEQ ID NO: 1216573 - RNA, 14 nt, Human
cuuaacuucacaua

SEQ ID NO: 1216574 - RNA, 12 nt, Human
cuuaacuucaca

SEQ ID NO: 1216575 - RNA, 16 nt, Human
cuuaaucuaaauggaa

SEQ ID NO: 1216576 - RNA, 14 nt, Human
cuuaaucuaaaugg

SEQ ID NO: 1216577 - RNA, 15 nt, Human
cuuauuuaaugaaag

SEQ ID NO: 1216578 - RNA, 15 nt, Human
cuuauacauuugaua

SEQ ID NO: 1216579 - RNA, 21 nt, Human
cuuagguuggcaaaaaggcag

SEQ ID NO: 1216580 - RNA, 17 nt, Human
cuuagguuggcaaaaag

SEQ ID NO: 1216581 - RNA, 16 nt, Human
cuuacuguacaugaaa

SEQ ID NO: 1216582 - RNA, 15 nt, Human
cuuacgugaguccug

SEQ ID NO: 1216583 - RNA, 19 nt, Human
cuuagacagucccugccaa

SEQ ID NO: 1216584 - RNA, 18 nt, Human
cuuagacagucccugcca

SEQ ID NO: 1216585 - RNA, 17 nt, Human
cuuagacagucccugcc

SEQ ID NO: 1216586 - RNA, 16 nt, Human
cuuagacagucccugc

SEQ ID NO: 1216587 - RNA, 15 nt, Human
cuuagacagucccug

SEQ ID NO: 1216588 - RNA, 14 nt, Human
cuuagacagucccu

SEQ ID NO: 1216589 - RNA, 15 nt, Human
cuuagaagucacaca

SEQ ID NO: 1216590 - RNA, 20 nt, Human
cuuggaagcuccgcuuucua

SEQ ID NO: 1216591 - RNA, 22 nt, Human
cuugcucugcugacagacacag

SEQ ID NO: 1216592 - RNA, 17 nt, Human
cuugcaugaggcuagug

SEQ ID NO: 1216593 - RNA, 14 nt, Human
cuugcaugaggcua

SEQ ID NO: 1216594 - RNA, 13 nt, Human
cuugcaugaggcu

SEQ ID NO: 1216595 - RNA, 21 nt, Human
cuugcagacucuacagaggcc

SEQ ID NO: 1216596 - RNA, 18 nt, Human
cuugcaauggcagccuug

SEQ ID NO: 1216597 - RNA, 17 nt, Human
cuugcaauggcagccuu

SEQ ID NO: 1216598 - RNA, 16 nt, Human
cuugcaauggcagccu

SEQ ID NO: 1216599 - RNA, 15 nt, Human
cuugcaauggcagcc

SEQ ID NO: 1216600 - RNA, 21 nt, Human
cuugaguugauucagcucugc

SEQ ID NO: 1216601 - RNA, 20 nt, Human
cuugaguugauucagcucug

SEQ ID NO: 1216602 - RNA, 19 nt, Human
cuugaguugauucagcucu

SEQ ID NO: 1216603 - RNA, 17 nt, Human
cuugaggguugggcugg

SEQ ID NO: 1216604 - RNA, 15 nt, Human
cuugaggguugggcu

SEQ ID NO: 1216605 - RNA, 16 nt, Human
cuugagccugggaggu

SEQ ID NO: 1216606 - RNA, 15 nt, Human
cuugagccugggagg

SEQ ID NO: 1216607 - RNA, 12 nt, Human
cuugagccuggg

SEQ ID NO: 1216608 - RNA, 20 nt, Human
cuugggccacugugaagaga

SEQ ID NO: 1216609 - RNA, 12 nt, Human
cuuguacauaau

SEQ ID NO: 1216610 - RNA, 20 nt, Human
cuugguuuguaaauuaacuu

SEQ ID NO: 1216611 - RNA, 15 nt, Human
cuugguuuguaaauu

SEQ ID NO: 1216612 - RNA, 14 nt, Human
cuugguuuguaaau

SEQ ID NO: 1216613 - RNA, 16 nt, Human
cuuguuaagauaguua

SEQ ID NO: 1216614 - RNA, 19 nt, Human
cuuguggucccaccccaca

SEQ ID NO: 1216615 - RNA, 16 nt, Human
cuuguggucccacccc

SEQ ID NO: 1216616 - RNA, 15 nt, Human
cuuguggucccaccc

SEQ ID NO: 1216617 - RNA, 22 nt, Human
cuuuaccuuuuuuauacauaaa

SEQ ID NO: 1216618 - RNA, 20 nt, Human
cuuuaccuuuuuuauacaua

SEQ ID NO: 1216619 - RNA, 19 nt, Human
cuuuaccuuuuuuauacau

SEQ ID NO: 1216620 - RNA, 17 nt, Human
cuuuaccuuuuuuauac

SEQ ID NO: 1216621 - RNA, 16 nt, Human
cuuuccucuuuggucu

SEQ ID NO: 1216622 - RNA, 13 nt, Human
cuuucugaaauaa

SEQ ID NO: 1216623 - RNA, 21 nt, Human
cuuuguucuggcucuuccagg

SEQ ID NO: 1216624 - RNA, 16 nt, Human
cuuuguucuggcucuu

SEQ ID NO: 1216625 - RNA, 13 nt, Human
cuuuguggcuucc

SEQ ID NO: 1216626 - RNA, 12 nt, Human
cuuugugauuuu

SEQ ID NO: 1216627 - RNA, 23 nt, Human
cuuugugaggaagccgcuggggc

SEQ ID NO: 1216628 - RNA, 17 nt, Human
cuuugggccuggcuccc

SEQ ID NO: 1216629 - RNA, 23 nt, Human
cuuuggaaagacuuuuccaaccc

SEQ ID NO: 1216630 - RNA, 12 nt, Human
cuuuggaaagac

SEQ ID NO: 1216631 - RNA, 14 nt, Human
cuuugcuugaaaga

SEQ ID NO: 1216632 - RNA, 13 nt, Human
cuuugaccucugc

SEQ ID NO: 1216633 - RNA, 18 nt, Human
gaaaacaugcuacacacu

SEQ ID NO: 1216634 - RNA, 21 nt, Human
gaaaacacuguucucugcccu

SEQ ID NO: 1216635 - RNA, 20 nt, Human
gaaaacacuguucucugccc

SEQ ID NO: 1216636 - RNA, 19 nt, Human
gaaaacacuguucucugcc

SEQ ID NO: 1216637 - RNA, 16 nt, Human
cuuuuuuagaguugau

SEQ ID NO: 1216638 - RNA, 14 nt, Human
gaaaacguggcugc

SEQ ID NO: 1216639 - RNA, 22 nt, Human
gaaaacacuguucucugcccuc

SEQ ID NO: 1216640 - RNA, 19 nt, Human
gaaaacaugcuacacacug

SEQ ID NO: 1216641 - RNA, 22 nt, Human
cuuuuguucuugguuuguaaau

SEQ ID NO: 1216642 - RNA, 18 nt, Human
cuuuucuugcaugaggcu

SEQ ID NO: 1216643 - RNA, 15 nt, Human
cuuuucuguuugcua

SEQ ID NO: 1216644 - RNA, 21 nt, Human
cuuuguuuguugucagcugaa

SEQ ID NO: 1216645 - RNA, 14 nt, Human
cuggcacugcuucc

SEQ ID NO: 1216646 - RNA, 13 nt, Human
cuggcacugcuuc

SEQ ID NO: 1216647 - RNA, 23 nt, Human
cuggcacuauaauguaagcucua

SEQ ID NO: 1216648 - RNA, 23 nt, Human
cuggauuaaacuuaaucuaaaug

SEQ ID NO: 1216649 - RNA, 13 nt, Human
cuggauuaaacuu

SEQ ID NO: 1216650 - RNA, 16 nt, Human
cuggauggggcugcac

SEQ ID NO: 1216651 - RNA, 15 nt, Human
cuggauggggcugca

SEQ ID NO: 1216652 - RNA, 22 nt, Human
cuggccucaagugauucuccug

SEQ ID NO: 1216653 - RNA, 23 nt, Human
cuggccuagcauacguacacauu

SEQ ID NO: 1216654 - RNA, 17 nt, Human
cuggccuagcauacgua

SEQ ID NO: 1216655 - RNA, 13 nt, Human
cuggcccacugca

SEQ ID NO: 1216656 - RNA, 12 nt, Human
cuggcccacugc

SEQ ID NO: 1216657 - RNA, 22 nt, Human
cuggccagaugcaccagcccuu

SEQ ID NO: 1216658 - RNA, 21 nt, Human
cuggccagaugcaccagcccu

SEQ ID NO: 1216659 - RNA, 20 nt, Human
cuggccagaugcaccagccc

SEQ ID NO: 1216660 - RNA, 19 nt, Human
cuggccagaugcaccagcc

SEQ ID NO: 1216661 - RNA, 18 nt, Human
cuggccagaugcaccagc

SEQ ID NO: 1216662 - RNA, 17 nt, Human
cuggccagaugcaccag

SEQ ID NO: 1216663 - RNA, 16 nt, Human
cuggccagaugcacca

SEQ ID NO: 1216664 - RNA, 18 nt, Human
cuggcacugcuuccagug

SEQ ID NO: 1216665 - RNA, 17 nt, Human
cuggcacugcuuccagu

SEQ ID NO: 1216666 - RNA, 16 nt, Human
cuggcacugcuuccag

SEQ ID NO: 1216667 - RNA, 15 nt, Human
cuggcacugcuucca

SEQ ID NO: 1216668 - RNA, 14 nt, Human
cuggacaggcaugu

SEQ ID NO: 1216669 - RNA, 15 nt, Human
cuggaaugcaguggu

SEQ ID NO: 1216670 - RNA, 18 nt, Human
cuggaagcacagcuucau

SEQ ID NO: 1216671 - RNA, 15 nt, Human
cuggaagcacagcuu

SEQ ID NO: 1216672 - RNA, 18 nt, Human
cugggaggucaaggcugc

SEQ ID NO: 1216673 - RNA, 20 nt, Human
cugggcaaugugauaaaacc

SEQ ID NO: 1216674 - RNA, 16 nt, Human
cugggagugagcuggu

SEQ ID NO: 1216675 - RNA, 13 nt, Human
cugggagugagcu

SEQ ID NO: 1216676 - RNA, 19 nt, Human
cuggcuguuggcugggggc

SEQ ID NO: 1216677 - RNA, 22 nt, Human
cuggcuggguggcaccagcagc

SEQ ID NO: 1216678 - RNA, 21 nt, Human
cuggcuggguggcaccagcag

SEQ ID NO: 1216679 - RNA, 20 nt, Human
cuggcuguuggcugggggcc

SEQ ID NO: 1216680 - RNA, 20 nt, Human
cuggcucuuccaggcuggga

SEQ ID NO: 1216681 - RNA, 19 nt, Human
cuggcucuuccaggcuggg

SEQ ID NO: 1216682 - RNA, 18 nt, Human
cuggcucuuccaggcugg

SEQ ID NO: 1216683 - RNA, 15 nt, Human
cuggccugagcuggg

SEQ ID NO: 1216684 - RNA, 17 nt, Human
cuggcucuuccaggcug

SEQ ID NO: 1216685 - RNA, 13 nt, Human
cuggccugagcug

SEQ ID NO: 1216686 - RNA, 23 nt, Human
cuggguacuuguggacacagcuc

SEQ ID NO: 1216687 - RNA, 21 nt, Human
cuggguacuuguggacacagc

SEQ ID NO: 1216688 - RNA, 20 nt, Human
cuggguacuuguggacacag

SEQ ID NO: 1216689 - RNA, 23 nt, Human
cugggguggggaccucaggccug

SEQ ID NO: 1216690 - RNA, 22 nt, Human
cugggguggggaccucaggccu

SEQ ID NO: 1216691 - RNA, 21 nt, Human
cugggguggggaccucaggcc

SEQ ID NO: 1216692 - RNA, 19 nt, Human
cugggguggggaccucagg

SEQ ID NO: 1216693 - RNA, 18 nt, Human
cugggguggggaccucag

SEQ ID NO: 1216694 - RNA, 17 nt, Human
cugggguggggaccuca

SEQ ID NO: 1216695 - RNA, 18 nt, Human
cugggggccucagugcca

SEQ ID NO: 1216696 - RNA, 17 nt, Human
cugggggccucagugcc

SEQ ID NO: 1216697 - RNA, 13 nt, Human
cugggggccucag

SEQ ID NO: 1216698 - RNA, 19 nt, Human
cugggcucccuucccaccu

SEQ ID NO: 1216699 - RNA, 21 nt, Human
cugggcuuggggaccagagcu

SEQ ID NO: 1216700 - RNA, 20 nt, Human
cugggcuuggggaccagagc

SEQ ID NO: 1216701 - RNA, 17 nt, Human
cugggcuuggggaccag

SEQ ID NO: 1216702 - RNA, 23 nt, Human
cugggcuucaguggcagcugcuu

SEQ ID NO: 1216703 - RNA, 22 nt, Human
cugggcuucaguggcagcugcu

SEQ ID NO: 1216704 - RNA, 21 nt, Human
cugggcuucaguggcagcugc

SEQ ID NO: 1216705 - RNA, 20 nt, Human
cugggcuucaguggcagcug

SEQ ID NO: 1216706 - RNA, 19 nt, Human
cugggcuucaguggcagcu

SEQ ID NO: 1216707 - RNA, 18 nt, Human
cugggcuucaguggcagc

SEQ ID NO: 1216708 - RNA, 23 nt, Human
cugguggcagugggagcugccug

SEQ ID NO: 1216709 - RNA, 18 nt, Human
cuggucccacucagucca

SEQ ID NO: 1216710 - RNA, 15 nt, Human
cuggucccacucagu

SEQ ID NO: 1216711 - RNA, 21 nt, Human
cugguccauagagagcaagac

SEQ ID NO: 1216712 - RNA, 18 nt, Human
cugguccauagagagcaa

SEQ ID NO: 1216713 - RNA, 17 nt, Human
cugguccauagagagca

SEQ ID NO: 1216714 - RNA, 15 nt, Human
cugguccauagagag

SEQ ID NO: 1216715 - RNA, 13 nt, Human
cuggguuggaggg

SEQ ID NO: 1216716 - RNA, 15 nt, Human
cugcccggcugcgga

SEQ ID NO: 1216717 - RNA, 11 nt, Human
cugcccggcug

SEQ ID NO: 1216718 - RNA, 16 nt, Human
cugcccugcccaccug

SEQ ID NO: 1216719 - RNA, 15 nt, Human
cugcccugcccaccu

SEQ ID NO: 1216720 - RNA, 14 nt, Human
cugcccugcccacc

SEQ ID NO: 1216721 - RNA, 13 nt, Human
cugcccugcccac

SEQ ID NO: 1216722 - RNA, 17 nt, Human
cugccccuggcagcccc

SEQ ID NO: 1216723 - RNA, 16 nt, Human
cugccccuggcagccc

SEQ ID NO: 1216724 - RNA, 15 nt, Human
cugccccuggcagcc

SEQ ID NO: 1216725 - RNA, 14 nt, Human
cugccccuggcagc

SEQ ID NO: 1216726 - RNA, 13 nt, Human
cugcccaggcccc

SEQ ID NO: 1216727 - RNA, 19 nt, Human
cugccaugccagcuuaucu

SEQ ID NO: 1216728 - RNA, 17 nt, Human
cugccaugccagcuuau

SEQ ID NO: 1216729 - RNA, 19 nt, Human
cugccaggaagccagcagg

SEQ ID NO: 1216730 - RNA, 18 nt, Human
cugccaggaagccagcag

SEQ ID NO: 1216731 - RNA, 16 nt, Human
cugccaggaagccagc

SEQ ID NO: 1216732 - RNA, 15 nt, Human
cugccaggaagccag

SEQ ID NO: 1216733 - RNA, 19 nt, Human
cugccagccgagauagcca

SEQ ID NO: 1216734 - RNA, 20 nt, Human
cugccacccuggggagaaag

SEQ ID NO: 1216735 - RNA, 16 nt, Human
cugccacccuggggag

SEQ ID NO: 1216736 - RNA, 15 nt, Human
cugccacccugggga

SEQ ID NO: 1216737 - RNA, 18 nt, Human
cugcuccucuccccagca

SEQ ID NO: 1216738 - RNA, 17 nt, Human
cugcuccucuccccagc

SEQ ID NO: 1216739 - RNA, 16 nt, Human
cugcuccucuccccag

SEQ ID NO: 1216740 - RNA, 15 nt, Human
cugcuccagcuguuc

SEQ ID NO: 1216741 - RNA, 14 nt, Human
cugcuccagcuguu

SEQ ID NO: 1216742 - RNA, 17 nt, Human
cugcgguccacccagga

SEQ ID NO: 1216743 - RNA, 16 nt, Human
cugcgguccacccagg

SEQ ID NO: 1216744 - RNA, 15 nt, Human
cugcgguccacccag

SEQ ID NO: 1216745 - RNA, 21 nt, Human
cugcggaaugaaccacaucuu

SEQ ID NO: 1216746 - RNA, 20 nt, Human
cugcggaaugaaccacaucu

SEQ ID NO: 1216747 - RNA, 15 nt, Human
cugccugcccaggcc

SEQ ID NO: 1216748 - RNA, 14 nt, Human
cugccugcccaggc

SEQ ID NO: 1216749 - RNA, 13 nt, Human
cugccugcccagg

SEQ ID NO: 1216750 - RNA, 14 nt, Human
cugccucuucucua

SEQ ID NO: 1216751 - RNA, 13 nt, Human
cugccucuucucu

SEQ ID NO: 1216752 - RNA, 14 nt, Human
cugccucagccucc

SEQ ID NO: 1216753 - RNA, 13 nt, Human
cugccucagccuc

SEQ ID NO: 1216754 - RNA, 17 nt, Human
cugcccugcccaccugg

SEQ ID NO: 1216755 - RNA, 21 nt, Human
cugauaaagaugagugagcau

SEQ ID NO: 1216756 - RNA, 14 nt, Human
cugaucucucguga

SEQ ID NO: 1216757 - RNA, 22 nt, Human
cugauucccaagcucugcuccu

SEQ ID NO: 1216758 - RNA, 20 nt, Human
cugauucccaagcucugcuc

SEQ ID NO: 1216759 - RNA, 19 nt, Human
cugauucccaagcucugcu

SEQ ID NO: 1216760 - RNA, 18 nt, Human
cugauucccaagcucugc

SEQ ID NO: 1216761 - RNA, 17 nt, Human
cugauucccaagcucug

SEQ ID NO: 1216762 - RNA, 15 nt, Human
cugauucccaagcuc

SEQ ID NO: 1216763 - RNA, 13 nt, Human
cugacccaugcug

SEQ ID NO: 1216764 - RNA, 12 nt, Human
cugacccacugc

SEQ ID NO: 1216765 - RNA, 13 nt, Human
cugauaaagauga

SEQ ID NO: 1216766 - RNA, 22 nt, Human
cugagugggggaucacagccuc

SEQ ID NO: 1216767 - RNA, 16 nt, Human
cugagucugaaggcug

SEQ ID NO: 1216768 - RNA, 15 nt, Human
cugagucugaaggcu

SEQ ID NO: 1216769 - RNA, 14 nt, Human
cugagucugaaggc

SEQ ID NO: 1216770 - RNA, 13 nt, Human
cugagucugaagg

SEQ ID NO: 1216771 - RNA, 17 nt, Human
cugagucugaaggcugg

SEQ ID NO: 1216772 - RNA, 17 nt, Human
cugcacuugcagacucu

SEQ ID NO: 1216773 - RNA, 16 nt, Human
cugcacuugcagacuc

SEQ ID NO: 1216774 - RNA, 14 nt, Human
cugcacuugcagac

SEQ ID NO: 1216775 - RNA, 20 nt, Human
cugcaccggcuggccuggcc

SEQ ID NO: 1216776 - RNA, 19 nt, Human
cugcaccggcuggccuggc

SEQ ID NO: 1216777 - RNA, 18 nt, Human
cugcaccggcuggccugg

SEQ ID NO: 1216778 - RNA, 17 nt, Human
cugcaccggcuggccug

SEQ ID NO: 1216779 - RNA, 11 nt, Human
cugcagccuca

SEQ ID NO: 1216780 - RNA, 23 nt, Human
cugcagccucaaccuccugggcu

SEQ ID NO: 1216781 - RNA, 22 nt, Human
cugcagccucaaccuccugggc

SEQ ID NO: 1216782 - RNA, 20 nt, Human
cugcagccucaaccuccugg

SEQ ID NO: 1216783 - RNA, 19 nt, Human
cugcagccucaaccuccug

SEQ ID NO: 1216784 - RNA, 22 nt, Human
cugcagggaguccgaaagggac

SEQ ID NO: 1216785 - RNA, 18 nt, Human
cugcacccucaggcaggu

SEQ ID NO: 1216786 - RNA, 17 nt, Human
cugcacccucaggcagg

SEQ ID NO: 1216787 - RNA, 16 nt, Human
cugcacaagcugcacc

SEQ ID NO: 1216788 - RNA, 15 nt, Human
cugcacaagcugcac

SEQ ID NO: 1216789 - RNA, 14 nt, Human
cugcacaagcugca

SEQ ID NO: 1216790 - RNA, 13 nt, Human
cugcacaagcugc

SEQ ID NO: 1216791 - RNA, 18 nt, Human
cugcacaagcugcacccu

SEQ ID NO: 1216792 - RNA, 21 nt, Human
cugaagacucauucuucugua

SEQ ID NO: 1216793 - RNA, 21 nt, Human
cugaacuuggcgcugccccug

SEQ ID NO: 1216794 - RNA, 16 nt, Human
cugaacuuggcgcugc

SEQ ID NO: 1216795 - RNA, 15 nt, Human
cugaacuuggcgcug

SEQ ID NO: 1216796 - RNA, 21 nt, Human
cugaaccuggguaacuaggga

SEQ ID NO: 1216797 - RNA, 21 nt, Human
cucuuuggucuacacugugcu

SEQ ID NO: 1216798 - RNA, 19 nt, Human
cucuuuggucuacacugug

SEQ ID NO: 1216799 - RNA, 18 nt, Human
cucuuugggccuggcucc

SEQ ID NO: 1216800 - RNA, 16 nt, Human
cugaauacagaggcaa

SEQ ID NO: 1216801 - RNA, 14 nt, Human
cugaagucacacag

SEQ ID NO: 1216802 - RNA, 15 nt, Human
cugaagucacacagu

SEQ ID NO: 1216803 - RNA, 16 nt, Human
cugaagucacacagug

SEQ ID NO: 1216804 - RNA, 11 nt, Human
cugacaggcaa

SEQ ID NO: 1216805 - RNA, 21 nt, Human
cugacagacacaggcccggcu

SEQ ID NO: 1216806 - RNA, 17 nt, Human
cugacauuguuggccaa

SEQ ID NO: 1216807 - RNA, 21 nt, Human
cugacaggcaaugcuggcugu

SEQ ID NO: 1216808 - RNA, 20 nt, Human
cugacaggcaaugcuggcug

SEQ ID NO: 1216809 - RNA, 19 nt, Human
cugacaggcaaugcuggcu

SEQ ID NO: 1216810 - RNA, 18 nt, Human
cugacaggcaaugcuggc

SEQ ID NO: 1216811 - RNA, 17 nt, Human
cugacaggcaaugcugg

SEQ ID NO: 1216812 - RNA, 16 nt, Human
cugacaggcaaugcug

SEQ ID NO: 1216813 - RNA, 11 nt, Human
cugacccacug

SEQ ID NO: 1216814 - RNA, 21 nt, Human
cugacauuguuggccaaagcc

SEQ ID NO: 1216815 - RNA, 19 nt, Human
cucuugguccugcugcagu

SEQ ID NO: 1216816 - RNA, 18 nt, Human
cucuugguccugcugcag

SEQ ID NO: 1216817 - RNA, 13 nt, Human
cucuugagccugg

SEQ ID NO: 1216818 - RNA, 16 nt, Human
cucuugaccucaggug

SEQ ID NO: 1216819 - RNA, 15 nt, Human
cucuugaccucaggu

SEQ ID NO: 1216820 - RNA, 13 nt, Human
cucuugaccucag

SEQ ID NO: 1216821 - RNA, 18 nt, Human
cucuuuggacacucacac

SEQ ID NO: 1216822 - RNA, 15 nt, Human
cucuuuggacacuca

SEQ ID NO: 1216823 - RNA, 13 nt, Human
cucuuucccuccc

SEQ ID NO: 1216824 - RNA, 17 nt, Human
cucuuuccaucuacccu

SEQ ID NO: 1216825 - RNA, 23 nt, Human
cucuuccaggcugggagagccuu

SEQ ID NO: 1216826 - RNA, 22 nt, Human
cucuuccaggcugggagagccu

SEQ ID NO: 1216827 - RNA, 12 nt, Human
cucuucuccagg

SEQ ID NO: 1216828 - RNA, 13 nt, Human
cucuucuccaggc

SEQ ID NO: 1216829 - RNA, 24 nt, Human
cucuuaaaacccaagugccuuagc

SEQ ID NO: 1216830 - RNA, 18 nt, Human
cucuggcagcucagagag

SEQ ID NO: 1216831 - RNA, 17 nt, Human
cucuggcagcucagaga

SEQ ID NO: 1216832 - RNA, 20 nt, Human
cucuggcagcucagagaggg

SEQ ID NO: 1216833 - RNA, 19 nt, Human
cucuggcagcucagagagg

SEQ ID NO: 1216834 - RNA, 23 nt, Human
cucucaggccagcugcuugggcu

SEQ ID NO: 1216835 - RNA, 20 nt, Human
cucucccaucacuucccuac

SEQ ID NO: 1216836 - RNA, 18 nt, Human
cucucccaucacuucccu

SEQ ID NO: 1216837 - RNA, 14 nt, Human
cucucccaucacuu

SEQ ID NO: 1216838 - RNA, 13 nt, Human
cucucccaucacu

SEQ ID NO: 1216839 - RNA, 13 nt, Human
cucuccagccccu

SEQ ID NO: 1216840 - RNA, 12 nt, Human
cucuccagcccc

SEQ ID NO: 1216841 - RNA, 13 nt, Human
cucucucaggcca

SEQ ID NO: 1216842 - RNA, 12 nt, Human
cucucucaggcc

SEQ ID NO: 1216843 - RNA, 16 nt, Human
cucucucacuccuuga

SEQ ID NO: 1216844 - RNA, 15 nt, Human
cucucucacuccuug

SEQ ID NO: 1216845 - RNA, 22 nt, Human
cucuccuguaccucuugagccu

SEQ ID NO: 1216846 - RNA, 18 nt, Human
cucuccuguaccucuuga

SEQ ID NO: 1216847 - RNA, 17 nt, Human
cucuccuguaccucuug

SEQ ID NO: 1216848 - RNA, 15 nt, Human
cucuccuguaccucu

SEQ ID NO: 1216849 - RNA, 14 nt, Human
cucuccuguaccuc

SEQ ID NO: 1216850 - RNA, 13 nt, Human
cucuccuguaccu

SEQ ID NO: 1216851 - RNA, 13 nt, Human
cucuccccagcaa

SEQ ID NO: 1216852 - RNA, 14 nt, Human
cucuggacaggcau

SEQ ID NO: 1216853 - RNA, 16 nt, Human
cucugccucugacaca

SEQ ID NO: 1216854 - RNA, 14 nt, Human
cucugccucugaca

SEQ ID NO: 1216855 - RNA, 23 nt, Human
cucugcccuccaagaccuucucc

SEQ ID NO: 1216856 - RNA, 16 nt, Human
cucugcccuccaagac

SEQ ID NO: 1216857 - RNA, 15 nt, Human
cucugcccuccaaga

SEQ ID NO: 1216858 - RNA, 14 nt, Human
cucugcccuccaag

SEQ ID NO: 1216859 - RNA, 12 nt, Human
cucugcccuugg

SEQ ID NO: 1216860 - RNA, 10 nt, Human
cucugcacaa

SEQ ID NO: 1216861 - RNA, 22 nt, Human
cucugcaagaauugaagcagga

SEQ ID NO: 1216862 - RNA, 20 nt, Human
cucugagacucgcgacaaug

SEQ ID NO: 1216863 - RNA, 14 nt, Human
cucauucuucugua

SEQ ID NO: 1216864 - RNA, 13 nt, Human
cucauucuucugu

SEQ ID NO: 1216865 - RNA, 16 nt, Human
cucauugaccugaggc

SEQ ID NO: 1216866 - RNA, 15 nt, Human
cucauugaccugagg

SEQ ID NO: 1216867 - RNA, 13 nt, Human
cucauugaccuga

SEQ ID NO: 1216868 - RNA, 23 nt, Human
cucauucuucuguacgucugaca

SEQ ID NO: 1216869 - RNA, 21 nt, Human
cucauuagcauuuugcuaaau

SEQ ID NO: 1216870 - RNA, 14 nt, Human
cucaggugagaagc

SEQ ID NO: 1216871 - RNA, 19 nt, Human
cucaggugucccugcacuu

SEQ ID NO: 1216872 - RNA, 18 nt, Human
cucaggugucccugcacu

SEQ ID NO: 1216873 - RNA, 17 nt, Human
cucaggugucccugcac

SEQ ID NO: 1216874 - RNA, 20 nt, Human
cucauaguaugguggcuggg

SEQ ID NO: 1216875 - RNA, 19 nt, Human
cucauaguaugguggcugg

SEQ ID NO: 1216876 - RNA, 18 nt, Human
cucauaguaugguggcug

SEQ ID NO: 1216877 - RNA, 15 nt, Human
cucauacccaccccc

SEQ ID NO: 1216878 - RNA, 12 nt, Human
cucagggucccu

SEQ ID NO: 1216879 - RNA, 23 nt, Human
cuaaaagguaugcaaucaaaucu

SEQ ID NO: 1216880 - RNA, 16 nt, Human
cucaggugucccugca

SEQ ID NO: 1216881 - RNA, 15 nt, Human
cucaggugucccugc

SEQ ID NO: 1216882 - RNA, 23 nt, Human
cucagguggggucacucuggcag

SEQ ID NO: 1216883 - RNA, 22 nt, Human
cucagguggggucacucuggca

SEQ ID NO: 1216884 - RNA, 14 nt, Human
cucagggucccugg

SEQ ID NO: 1216885 - RNA, 22 nt, Human
cucccaaggggcccaaauucuu

SEQ ID NO: 1216886 - RNA, 21 nt, Human
cucccaaggggcccaaauucu

SEQ ID NO: 1216887 - RNA, 21 nt, Human
cucccaggcauuccccaggag

SEQ ID NO: 1216888 - RNA, 20 nt, Human
cucccaggcauuccccagga

SEQ ID NO: 1216889 - RNA, 19 nt, Human
cucccaggcauuccccagg

SEQ ID NO: 1216890 - RNA, 17 nt, Human
cucccaggcauucccca

SEQ ID NO: 1216891 - RNA, 22 nt, Human
cucccaggcauuccccaggagg

SEQ ID NO: 1216892 - RNA, 19 nt, Human
cuccagcuguucagcuggu

SEQ ID NO: 1216893 - RNA, 18 nt, Human
cuccagcuguucagcugg

SEQ ID NO: 1216894 - RNA, 13 nt, Human
cuccagcuguuca

SEQ ID NO: 1216895 - RNA, 15 nt, Human
cuccaggcuccuuua

SEQ ID NO: 1216896 - RNA, 11 nt, Human
cuccaggcucc

SEQ ID NO: 1216897 - RNA, 21 nt, Human
cuccaccugccagggacagag

SEQ ID NO: 1216898 - RNA, 18 nt, Human
cuccaccugccagggaca

SEQ ID NO: 1216899 - RNA, 17 nt, Human
cuccaccugccagggac

SEQ ID NO: 1216900 - RNA, 12 nt, Human
cuccacccugcu

SEQ ID NO: 1216901 - RNA, 11 nt, Human
cuccacccugc

SEQ ID NO: 1216902 - RNA, 20 nt, Human
cuccagcucaccagccccag

SEQ ID NO: 1216903 - RNA, 19 nt, Human
cuccagcucaccagcccca

SEQ ID NO: 1216904 - RNA, 14 nt, Human
cuccugugugugcg

SEQ ID NO: 1216905 - RNA, 21 nt, Human
cuccuucaccuuuguccccac

SEQ ID NO: 1216906 - RNA, 19 nt, Human
cuccuucaccuuugucccc

SEQ ID NO: 1216907 - RNA, 16 nt, Human
cuccuucaccuuuguc

SEQ ID NO: 1216908 - RNA, 14 nt, Human
cuccuucaccuuug

SEQ ID NO: 1216909 - RNA, 16 nt, Human
cuccugcaggcagcca

SEQ ID NO: 1216910 - RNA, 22 nt, Human
cuccugcaggcagccaggccac

SEQ ID NO: 1216911 - RNA, 15 nt, Human
cuccugcaggcagcc

SEQ ID NO: 1216912 - RNA, 11 nt, Human
cuccugugugu

SEQ ID NO: 1216913 - RNA, 23 nt, Human
cuccugugucuugcaauggcagc

SEQ ID NO: 1216914 - RNA, 21 nt, Human
cuccuugaaaacacuguucuc

SEQ ID NO: 1216915 - RNA, 11 nt, Human
cuccuucuucc

SEQ ID NO: 1216916 - RNA, 20 nt, Human
cuccuucuguccuacucugu

SEQ ID NO: 1216917 - RNA, 15 nt, Human
cuccuucuguccuac

SEQ ID NO: 1216918 - RNA, 14 nt, Human
cuccuucuguccua

SEQ ID NO: 1216919 - RNA, 20 nt, Human
cucgaguuacagacaaagcg

SEQ ID NO: 1216920 - RNA, 16 nt, Human
cucgaguuacagacaa

SEQ ID NO: 1216921 - RNA, 15 nt, Human
cucgcgacaaugcaa

SEQ ID NO: 1216922 - RNA, 14 nt, Human
cuccugcaggcagc

SEQ ID NO: 1216923 - RNA, 13 nt, Human
cuccugcaggcag

SEQ ID NO: 1216924 - RNA, 14 nt, Human
cuccucagaucuuc

SEQ ID NO: 1216925 - RNA, 12 nt, Human
cuccucagaucu

SEQ ID NO: 1216926 - RNA, 17 nt, Human
cucccuuucuucccuac

SEQ ID NO: 1216927 - RNA, 20 nt, Human
cucccuuggauuguccccga

SEQ ID NO: 1216928 - RNA, 17 nt, Human
cucccuuggauuguccc

SEQ ID NO: 1216929 - RNA, 14 nt, Human
cucccuuccucuuu

SEQ ID NO: 1216930 - RNA, 13 nt, Human
cucccuuccucuu

SEQ ID NO: 1216931 - RNA, 10 nt, Human
cucccuuccu

SEQ ID NO: 1216932 - RNA, 21 nt, Human
cucccaucucacacaugagca

SEQ ID NO: 1216933 - RNA, 18 nt, Human
cucccaucucacacauga

SEQ ID NO: 1216934 - RNA, 15 nt, Human
cucccaucucacaca

SEQ ID NO: 1216935 - RNA, 14 nt, Human
cucccaucucacac

SEQ ID NO: 1216936 - RNA, 14 nt, Human
cucccaucacccgc

SEQ ID NO: 1216937 - RNA, 23 nt, Human
cggugcuaucucccccagcccca

SEQ ID NO: 1216938 - RNA, 23 nt, Human
cgugcauaccacuuuuguucuug

SEQ ID NO: 1216939 - RNA, 19 nt, Human
cgugcauaccacuuuuguu

SEQ ID NO: 1216940 - RNA, 18 nt, Human
cgugcauaccacuuuugu

SEQ ID NO: 1216941 - RNA, 14 nt, Human
cgugcauaccacuu

SEQ ID NO: 1216942 - RNA, 22 nt, Human
cgugcacacaccagagcccacc

SEQ ID NO: 1216943 - RNA, 21 nt, Human
cgugcacacaccagagcccac

SEQ ID NO: 1216944 - RNA, 20 nt, Human
cgugcacacaccagagccca

SEQ ID NO: 1216945 - RNA, 12 nt, Human
cgugacaacacu

SEQ ID NO: 1216946 - RNA, 14 nt, Human
cgucugacaggcaa

SEQ ID NO: 1216947 - RNA, 13 nt, Human
cgucugacaggca

SEQ ID NO: 1216948 - RNA, 16 nt, Human
cgucuaccugaggggc

SEQ ID NO: 1216949 - RNA, 14 nt, Human
cgucuaccugaggg

SEQ ID NO: 1216950 - RNA, 14 nt, Human
cguccccugucccc

SEQ ID NO: 1216951 - RNA, 11 nt, Human
cguccccuguc

SEQ ID NO: 1216952 - RNA, 20 nt, Human
cguuucuaugacacaugcaa

SEQ ID NO: 1216953 - RNA, 21 nt, Human
cguuucuaaaggcuaccuuug

SEQ ID NO: 1216954 - RNA, 19 nt, Human
cguuucuaaaggcuaccuu

SEQ ID NO: 1216955 - RNA, 17 nt, Human
cguggcugcuucaagga

SEQ ID NO: 1216956 - RNA, 15 nt, Human
cguggcugcuucaag

SEQ ID NO: 1216957 - RNA, 14 nt, Human
cguggcugcuucaa

SEQ ID NO: 1216958 - RNA, 12 nt, Human
cguggcugcuuc

SEQ ID NO: 1216959 - RNA, 21 nt, Human
cgauucuucugcuucagccuc

SEQ ID NO: 1216960 - RNA, 19 nt, Human
cgauucuucugcuucagcc

SEQ ID NO: 1216961 - RNA, 13 nt, Human
cgauucuucugcu

SEQ ID NO: 1216962 - RNA, 19 nt, Human
cgaucuggguucacugcaa

SEQ ID NO: 1216963 - RNA, 12 nt, Human
cgauuucuguuu

SEQ ID NO: 1216964 - RNA, 20 nt, Human
cgauuucuguuuagauaaua

SEQ ID NO: 1216965 - RNA, 19 nt, Human
cgaggccuucucugaagga

SEQ ID NO: 1216966 - RNA, 18 nt, Human
cgaggccuucucugaagg

SEQ ID NO: 1216967 - RNA, 14 nt, Human
cgaggacagggagg

SEQ ID NO: 1216968 - RNA, 13 nt, Human
cgaggacagggag

SEQ ID NO: 1216969 - RNA, 12 nt, Human
cgaggacaggga

SEQ ID NO: 1216970 - RNA, 20 nt, Human
ccuuuguauucucuccugua

SEQ ID NO: 1216971 - RNA, 18 nt, Human
ccuuuguauucucuccug

SEQ ID NO: 1216972 - RNA, 15 nt, Human
ccuuuguauucucuc

SEQ ID NO: 1216973 - RNA, 14 nt, Human
ccuuuaagagaaau

SEQ ID NO: 1216974 - RNA, 13 nt, Human
ccuuuaagagaaa

SEQ ID NO: 1216975 - RNA, 14 nt, Human
ccuuggcugcaggg

SEQ ID NO: 1216976 - RNA, 20 nt, Human
ccuuguggucccaccccaca

SEQ ID NO: 1216977 - RNA, 19 nt, Human
ccuuguggucccaccccac

SEQ ID NO: 1216978 - RNA, 16 nt, Human
ccuuguggucccaccc

SEQ ID NO: 1216979 - RNA, 13 nt, Human
ccuuggcugcagg

SEQ ID NO: 1216980 - RNA, 12 nt, Human
ccuuggcugcag

SEQ ID NO: 1216981 - RNA, 16 nt, Human
ccuuugcuugaaagaa

SEQ ID NO: 1216982 - RNA, 21 nt, Human
cgcuaagagggagggagggcu

SEQ ID NO: 1216983 - RNA, 16 nt, Human
cgcuaagagggaggga

SEQ ID NO: 1216984 - RNA, 15 nt, Human
cgcuaagagggaggg

SEQ ID NO: 1216985 - RNA, 14 nt, Human
cgcuaagagggagg

SEQ ID NO: 1216986 - RNA, 20 nt, Human
cgcgugcacacaccagagcc

SEQ ID NO: 1216987 - RNA, 19 nt, Human
cgcgugcacacaccagagc

SEQ ID NO: 1216988 - RNA, 16 nt, Human
cgcgugcacacaccag

SEQ ID NO: 1216989 - RNA, 17 nt, Human
cgcgacaaugcaaacca

SEQ ID NO: 1216990 - RNA, 16 nt, Human
cgcgacaaugcaaacc

SEQ ID NO: 1216991 - RNA, 14 nt, Human
cgcagacaggacca

SEQ ID NO: 1216992 - RNA, 13 nt, Human
cgcagacaggacc

SEQ ID NO: 1216993 - RNA, 15 nt, Human
cgcccccacugguga

SEQ ID NO: 1216994 - RNA, 21 nt, Human
cgggaggauguucugggacac

SEQ ID NO: 1216995 - RNA, 20 nt, Human
cgggaggauguucugggaca

SEQ ID NO: 1216996 - RNA, 15 nt, Human
cgggcaugacacgaa

SEQ ID NO: 1216997 - RNA, 12 nt, Human
cgggcaugacac

SEQ ID NO: 1216998 - RNA, 17 nt, Human
cgggaggucgaggcagg

SEQ ID NO: 1216999 - RNA, 16 nt, Human
cgggaggucgaggcag

SEQ ID NO: 1217000 - RNA, 19 nt, Human
cggcuggccuggccccuca

SEQ ID NO: 1217001 - RNA, 18 nt, Human
cggcuggccuggccccuc

SEQ ID NO: 1217002 - RNA, 16 nt, Human
cggcuggccuggcccc

SEQ ID NO: 1217003 - RNA, 15 nt, Human
cggcuggccuggccc

SEQ ID NO: 1217004 - RNA, 15 nt, Human
cggccuuuggcuuca

SEQ ID NO: 1217005 - RNA, 18 nt, Human
cggacagccacggccagg

SEQ ID NO: 1217006 - RNA, 16 nt, Human
cggacagccacggcca

SEQ ID NO: 1217007 - RNA, 15 nt, Human
cggacagccacggcc

SEQ ID NO: 1217008 - RNA, 20 nt, Human
cggaaugaaccacaucuugc

SEQ ID NO: 1217009 - RNA, 13 nt, Human
cgcuccugugucu

SEQ ID NO: 1217010 - RNA, 20 nt, Human
cggacagccacggccaggcc

SEQ ID NO: 1217011 - RNA, 14 nt, Human
ccuggacccugugg

SEQ ID NO: 1217012 - RNA, 13 nt, Human
ccuggacccugug

SEQ ID NO: 1217013 - RNA, 20 nt, Human
ccuggcacugcuuccaguga

SEQ ID NO: 1217014 - RNA, 16 nt, Human
ccuggcagccccuguu

SEQ ID NO: 1217015 - RNA, 21 nt, Human
ccuggcacugcuuccagugag

SEQ ID NO: 1217016 - RNA, 17 nt, Human
ccuggcaugggaaugaa

SEQ ID NO: 1217017 - RNA, 16 nt, Human
ccuggcaugggaauga

SEQ ID NO: 1217018 - RNA, 23 nt, Human
ccuggcaugggaaugaaugucag

SEQ ID NO: 1217019 - RNA, 18 nt, Human
ccuggcaugggaaugaau

SEQ ID NO: 1217020 - RNA, 16 nt, Human
ccuggccccucagggu

SEQ ID NO: 1217021 - RNA, 14 nt, Human
ccuggccccucagg

SEQ ID NO: 1217022 - RNA, 15 nt, Human
ccugggcagaaggaa

SEQ ID NO: 1217023 - RNA, 14 nt, Human
ccugggcagaagga

SEQ ID NO: 1217024 - RNA, 12 nt, Human
ccugggcagaag

SEQ ID NO: 1217025 - RNA, 20 nt, Human
ccugggaucccucauccuca

SEQ ID NO: 1217026 - RNA, 16 nt, Human
ccugggaucccucauc

SEQ ID NO: 1217027 - RNA, 20 nt, Human
ccugggaggucaaggcugca

SEQ ID NO: 1217028 - RNA, 22 nt, Human
ccugcuccagcuguucagcugg

SEQ ID NO: 1217029 - RNA, 14 nt, Human
ccugcuccagcugu

SEQ ID NO: 1217030 - RNA, 13 nt, Human
ccugcuccagcug

SEQ ID NO: 1217031 - RNA, 12 nt, Human
ccugcuccagcu

SEQ ID NO: 1217032 - RNA, 17 nt, Human
ccugcuaauuccccaga

SEQ ID NO: 1217033 - RNA, 23 nt, Human
ccugcgucucauacucaccucac

SEQ ID NO: 1217034 - RNA, 21 nt, Human
ccugcaaccugauugugucuc

SEQ ID NO: 1217035 - RNA, 16 nt, Human
ccugcaaccugauugu

SEQ ID NO: 1217036 - RNA, 19 nt, Human
ccugcaacaccuuguuucc

SEQ ID NO: 1217037 - RNA, 18 nt, Human
ccugcaacaccuuguuuc

SEQ ID NO: 1217038 - RNA, 19 nt, Human
ccugcugguucaggguugg

SEQ ID NO: 1217039 - RNA, 13 nt, Human
ccugcugguucag

SEQ ID NO: 1217040 - RNA, 20 nt, Human
ccugugaguacuacaguccu

SEQ ID NO: 1217041 - RNA, 18 nt, Human
ccuguccccgcacugggc

SEQ ID NO: 1217042 - RNA, 17 nt, Human
ccugucccccugacaac

SEQ ID NO: 1217043 - RNA, 22 nt, Human
ccugugauggggcccugccucc

SEQ ID NO: 1217044 - RNA, 21 nt, Human
ccugugauggggcccugccuc

SEQ ID NO: 1217045 - RNA, 20 nt, Human
ccugugauggggcccugccu

SEQ ID NO: 1217046 - RNA, 19 nt, Human
ccugugauggggcccugcc

SEQ ID NO: 1217047 - RNA, 18 nt, Human
ccugugauggggcccugc

SEQ ID NO: 1217048 - RNA, 17 nt, Human
ccugugauggggcccug

SEQ ID NO: 1217049 - RNA, 19 nt, Human
ccugugccucugggacugg

SEQ ID NO: 1217050 - RNA, 17 nt, Human
ccugugccucugggacu

SEQ ID NO: 1217051 - RNA, 15 nt, Human
ccugugccucuggga

SEQ ID NO: 1217052 - RNA, 23 nt, Human
ccuguagagugggagcugagugg

SEQ ID NO: 1217053 - RNA, 21 nt, Human
ccuguagagugggagcugagu

SEQ ID NO: 1217054 - RNA, 20 nt, Human
ccuguaauccuagcacuuug

SEQ ID NO: 1217055 - RNA, 18 nt, Human
ccugguggcagcucaccu

SEQ ID NO: 1217056 - RNA, 17 nt, Human
ccugguggcagcucacc

SEQ ID NO: 1217057 - RNA, 16 nt, Human
ccugguggcagcucac

SEQ ID NO: 1217058 - RNA, 14 nt, Human
ccugguggcagcuc

SEQ ID NO: 1217059 - RNA, 13 nt, Human
ccugguggcagcu

SEQ ID NO: 1217060 - RNA, 12 nt, Human
ccugguggcagc

SEQ ID NO: 1217061 - RNA, 14 nt, Human
ccuugacagggcac

SEQ ID NO: 1217062 - RNA, 20 nt, Human
ccuugaccauucuccaccug

SEQ ID NO: 1217063 - RNA, 19 nt, Human
ccuugaccauucuccaccu

SEQ ID NO: 1217064 - RNA, 17 nt, Human
ccuugacagggcacacc

SEQ ID NO: 1217065 - RNA, 15 nt, Human
ccuugacagggcaca

SEQ ID NO: 1217066 - RNA, 23 nt, Human
ccuugaguugauucagcucugca

SEQ ID NO: 1217067 - RNA, 22 nt, Human
ccuugaguugauucagcucugc

SEQ ID NO: 1217068 - RNA, 22 nt, Human
ccuugaccauucuccaccugcc

SEQ ID NO: 1217069 - RNA, 21 nt, Human
ccuugaccauucuccaccugc

SEQ ID NO: 1217070 - RNA, 19 nt, Human
ccuugaacuuugaccucug

SEQ ID NO: 1217071 - RNA, 17 nt, Human
ccuugaacuuugaccuc

SEQ ID NO: 1217072 - RNA, 16 nt, Human
ccuugaacuggguacu

SEQ ID NO: 1217073 - RNA, 14 nt, Human
ccuugaacugggua

SEQ ID NO: 1217074 - RNA, 22 nt, Human
ccuugaaaacacuguucucugc

SEQ ID NO: 1217075 - RNA, 21 nt, Human
ccuugaaaacacuguucucug

SEQ ID NO: 1217076 - RNA, 19 nt, Human
ccuugaaaacacuguucuc

SEQ ID NO: 1217077 - RNA, 18 nt, Human
ccuucgcuccugugucuu

SEQ ID NO: 1217078 - RNA, 15 nt, Human
ccuucgcuccugugu

SEQ ID NO: 1217079 - RNA, 14 nt, Human
ccuucgcuccugug

SEQ ID NO: 1217080 - RNA, 13 nt, Human
ccuucgcuccugu

SEQ ID NO: 1217081 - RNA, 15 nt, Human
ccuugaaaacacugu

SEQ ID NO: 1217082 - RNA, 13 nt, Human
ccuugacagggca

SEQ ID NO: 1217083 - RNA, 11 nt, Human
ccuuuggcuuc

SEQ ID NO: 1217084 - RNA, 19 nt, Human
ccuucagugccuuauggaa

SEQ ID NO: 1217085 - RNA, 20 nt, Human
ccuucagugccuuauggaac

SEQ ID NO: 1217086 - RNA, 15 nt, Human
ccuucagugccuuau

SEQ ID NO: 1217087 - RNA, 14 nt, Human
ccuucagugccuua

SEQ ID NO: 1217088 - RNA, 13 nt, Human
ccuucagugccuu

SEQ ID NO: 1217089 - RNA, 10 nt, Human
ccuucagugc

SEQ ID NO: 1217090 - RNA, 14 nt, Human
ccuuccucuuucca

SEQ ID NO: 1217091 - RNA, 16 nt, Human
ccuuccagggguggga

SEQ ID NO: 1217092 - RNA, 15 nt, Human
ccuuccagggguggg

SEQ ID NO: 1217093 - RNA, 22 nt, Human
ccuuccaggggugggacacccu

SEQ ID NO: 1217094 - RNA, 18 nt, Human
ccuuccaggggugggaca

SEQ ID NO: 1217095 - RNA, 14 nt, Human
ccuuaccugccagg

SEQ ID NO: 1217096 - RNA, 20 nt, Human
ccuuaccucggugccuuccu

SEQ ID NO: 1217097 - RNA, 17 nt, Human
ccuuaccagcagagcac

SEQ ID NO: 1217098 - RNA, 16 nt, Human
ccuuaccagcagagca

SEQ ID NO: 1217099 - RNA, 15 nt, Human
ccuuaccagcagagc

SEQ ID NO: 1217100 - RNA, 14 nt, Human
ccuuaccagcagag

SEQ ID NO: 1217101 - RNA, 21 nt, Human
ccuuagacagucccugccaau

SEQ ID NO: 1217102 - RNA, 19 nt, Human
ccuuagacagucccugcca

SEQ ID NO: 1217103 - RNA, 18 nt, Human
ccuuagacagucccugcc

SEQ ID NO: 1217104 - RNA, 17 nt, Human
ccuuagacagucccugc

SEQ ID NO: 1217105 - RNA, 16 nt, Human
ccuuagacagucccug

SEQ ID NO: 1217106 - RNA, 23 nt, Human
ccuccugugugugcgccuacagg

SEQ ID NO: 1217107 - RNA, 12 nt, Human
ccucucccauca

SEQ ID NO: 1217108 - RNA, 16 nt, Human
ccucugacacacagcu

SEQ ID NO: 1217109 - RNA, 23 nt, Human
ccucugaaaaccaauguucucuc

SEQ ID NO: 1217110 - RNA, 22 nt, Human
ccucugcacuccccugcugggu

SEQ ID NO: 1217111 - RNA, 21 nt, Human
ccucugcacuccccugcuggg

SEQ ID NO: 1217112 - RNA, 20 nt, Human
ccucugcacuccccugcugg

SEQ ID NO: 1217113 - RNA, 15 nt, Human
ccucugcacuccccu

SEQ ID NO: 1217114 - RNA, 14 nt, Human
ccucugcacucccc

SEQ ID NO: 1217115 - RNA, 20 nt, Human
ccucugcacaagcugcaccc

SEQ ID NO: 1217116 - RNA, 19 nt, Human
ccucugcacaagcugcacc

SEQ ID NO: 1217117 - RNA, 17 nt, Human
ccucugcacaagcugca

SEQ ID NO: 1217118 - RNA, 15 nt, Human
ccucugcacaagcug

SEQ ID NO: 1217119 - RNA, 18 nt, Human
ccucugacacacagcucu

SEQ ID NO: 1217120 - RNA, 17 nt, Human
ccucugacacacagcuc

SEQ ID NO: 1217121 - RNA, 12 nt, Human
ccucugggacug

SEQ ID NO: 1217122 - RNA, 13 nt, Human
ccuccugccucga

SEQ ID NO: 1217123 - RNA, 22 nt, Human
ccuccugugugugcgccuacag

SEQ ID NO: 1217124 - RNA, 15 nt, Human
ccuccugugugugcg

SEQ ID NO: 1217125 - RNA, 13 nt, Human
ccuccugugugug

SEQ ID NO: 1217126 - RNA, 13 nt, Human
ccuccugggcuaa

SEQ ID NO: 1217127 - RNA, 16 nt, Human
ccucccucccucuuuc

SEQ ID NO: 1217128 - RNA, 15 nt, Human
ccucccucccucuuu

SEQ ID NO: 1217129 - RNA, 13 nt, Human
ccucccucccucu

SEQ ID NO: 1217130 - RNA, 15 nt, Human
ccucagucuggcccu

SEQ ID NO: 1217131 - RNA, 19 nt, Human
ccucagucuggcccuuccu

SEQ ID NO: 1217132 - RNA, 17 nt, Human
ccucaggugagaagcag

SEQ ID NO: 1217133 - RNA, 22 nt, Human
ccucaggugauccacccaccuc

SEQ ID NO: 1217134 - RNA, 19 nt, Human
ccucaggugauccacccac

SEQ ID NO: 1217135 - RNA, 17 nt, Human
ccucaggugauccaccc

SEQ ID NO: 1217136 - RNA, 16 nt, Human
ccucaggugagaagca

SEQ ID NO: 1217137 - RNA, 15 nt, Human
ccucagggucccugg

SEQ ID NO: 1217138 - RNA, 14 nt, Human
ccucagggucccug

SEQ ID NO: 1217139 - RNA, 23 nt, Human
ccucaggccugggggcugggcag

SEQ ID NO: 1217140 - RNA, 21 nt, Human
ccucaggccugggggcugggc

SEQ ID NO: 1217141 - RNA, 14 nt, Human
ccucaggccugggg

SEQ ID NO: 1217142 - RNA, 11 nt, Human
ccucaggccug

SEQ ID NO: 1217143 - RNA, 17 nt, Human
ccucagcauccuggcac

SEQ ID NO: 1217144 - RNA, 16 nt, Human
ccucagcauccuggca

SEQ ID NO: 1217145 - RNA, 21 nt, Human
ccugaagacucauucuucugu

SEQ ID NO: 1217146 - RNA, 17 nt, Human
ccugaagucacacagug

SEQ ID NO: 1217147 - RNA, 16 nt, Human
ccugaagucacacagu

SEQ ID NO: 1217148 - RNA, 15 nt, Human
ccugaagucacacag

SEQ ID NO: 1217149 - RNA, 13 nt, Human
ccugaaggccccg

SEQ ID NO: 1217150 - RNA, 19 nt, Human
ccugaagucacacagugag

SEQ ID NO: 1217151 - RNA, 14 nt, Human
ccugaaggccccgc

SEQ ID NO: 1217152 - RNA, 17 nt, Human
ccucuuaugggcugggu

SEQ ID NO: 1217153 - RNA, 22 nt, Human
ccucuuuggucuacacugugcu

SEQ ID NO: 1217154 - RNA, 16 nt, Human
ccucuuaugggcuggg

SEQ ID NO: 1217155 - RNA, 15 nt, Human
ccucuuaugggcugg

SEQ ID NO: 1217156 - RNA, 14 nt, Human
ccucuuaugggcug

SEQ ID NO: 1217157 - RNA, 14 nt, Human
ccucuuagaaaaac

SEQ ID NO: 1217158 - RNA, 23 nt, Human
ccucuguacagagcccacgcccc

SEQ ID NO: 1217159 - RNA, 18 nt, Human
ccucuguacagagcccac

SEQ ID NO: 1217160 - RNA, 17 nt, Human
ccucuguacagagccca

SEQ ID NO: 1217161 - RNA, 16 nt, Human
ccucuguacagagccc

SEQ ID NO: 1217162 - RNA, 15 nt, Human
ccucuguacagagcc

SEQ ID NO: 1217163 - RNA, 14 nt, Human
ccucuguacagagc

SEQ ID NO: 1217164 - RNA, 12 nt, Human
ccugaggcccag

SEQ ID NO: 1217165 - RNA, 14 nt, Human
ccugaggcccagag

SEQ ID NO: 1217166 - RNA, 13 nt, Human
ccugaggcccaga

SEQ ID NO: 1217167 - RNA, 16 nt, Human
ccugacaacacucauu

SEQ ID NO: 1217168 - RNA, 15 nt, Human
ccugacaacacucau

SEQ ID NO: 1217169 - RNA, 14 nt, Human
ccugacaacacuca

SEQ ID NO: 1217170 - RNA, 12 nt, Human
ccugacaacacu

SEQ ID NO: 1217171 - RNA, 23 nt, Human
ccugaggcccuucucuccagccc

SEQ ID NO: 1217172 - RNA, 22 nt, Human
ccugaggcccuucucuccagcc

SEQ ID NO: 1217173 - RNA, 21 nt, Human
ccugaggcccuucucuccagc

SEQ ID NO: 1217174 - RNA, 20 nt, Human
ccugaggcccuucucuccag

SEQ ID NO: 1217175 - RNA, 19 nt, Human
ccugaggcccuucucucca

SEQ ID NO: 1217176 - RNA, 17 nt, Human
ccugaggcccuucucuc

SEQ ID NO: 1217177 - RNA, 16 nt, Human
ccugaggcccuucucu

SEQ ID NO: 1217178 - RNA, 23 nt, Human
ccugauugugucucuugguccug

SEQ ID NO: 1217179 - RNA, 19 nt, Human
ccugaugcuucuucagaga

SEQ ID NO: 1217180 - RNA, 18 nt, Human
ccugaugcuucuucagag

SEQ ID NO: 1217181 - RNA, 17 nt, Human
ccugaugcuucuucaga

SEQ ID NO: 1217182 - RNA, 14 nt, Human
ccugaugcuucuuc

SEQ ID NO: 1217183 - RNA, 23 nt, Human
ccugacaacacucauugaccuga

SEQ ID NO: 1217184 - RNA, 19 nt, Human
cccuuuuuuggcugcugaa

SEQ ID NO: 1217185 - RNA, 22 nt, Human
ccgagauagccaaggccaaagg

SEQ ID NO: 1217186 - RNA, 19 nt, Human
ccgagauagccaaggccaa

SEQ ID NO: 1217187 - RNA, 17 nt, Human
ccgagaaggaagccucc

SEQ ID NO: 1217188 - RNA, 18 nt, Human
cccuuuuuuggcugcuga

SEQ ID NO: 1217189 - RNA, 17 nt, Human
cccuuuuuuggcugcug

SEQ ID NO: 1217190 - RNA, 13 nt, Human
cccuuuucuguuu

SEQ ID NO: 1217191 - RNA, 11 nt, Human
cccuuuuccuu

SEQ ID NO: 1217192 - RNA, 18 nt, Human
ccgagaucacgccacugc

SEQ ID NO: 1217193 - RNA, 20 nt, Human
cccuuguggucccaccccac

SEQ ID NO: 1217194 - RNA, 18 nt, Human
cccuuguggucccacccc

SEQ ID NO: 1217195 - RNA, 16 nt, Human
cccuuguggucccacc

SEQ ID NO: 1217196 - RNA, 14 nt, Human
cccuugugguccca

SEQ ID NO: 1217197 - RNA, 18 nt, Human
cccuuggggagcaggcuc

SEQ ID NO: 1217198 - RNA, 20 nt, Human
cccuuugacgccaucccagc

SEQ ID NO: 1217199 - RNA, 22 nt, Human
cccuugccgucuaccugagggg

SEQ ID NO: 1217200 - RNA, 18 nt, Human
cccuugccgucuaccuga

SEQ ID NO: 1217201 - RNA, 17 nt, Human
cccuugccgucuaccug

SEQ ID NO: 1217202 - RNA, 19 nt, Human
cccuuaccucggugccuuc

SEQ ID NO: 1217203 - RNA, 16 nt, Human
cccuguuuguuucuga

SEQ ID NO: 1217204 - RNA, 15 nt, Human
cccuguuuguuucug

SEQ ID NO: 1217205 - RNA, 18 nt, Human
cccugugggcccccaaau

SEQ ID NO: 1217206 - RNA, 16 nt, Human
cccugugggcccccaa

SEQ ID NO: 1217207 - RNA, 21 nt, Human
cccuguagagugggagcugag

SEQ ID NO: 1217208 - RNA, 20 nt, Human
ccccucagggucccuggugg

SEQ ID NO: 1217209 - RNA, 18 nt, Human
ccccucagggucccuggu

SEQ ID NO: 1217210 - RNA, 17 nt, Human
ccccucagggucccugg

SEQ ID NO: 1217211 - RNA, 19 nt, Human
cccugguggcagugggagc

SEQ ID NO: 1217212 - RNA, 16 nt, Human
cccugguggcaguggg

SEQ ID NO: 1217213 - RNA, 21 nt, Human
cccugguggcagugggagcug

SEQ ID NO: 1217214 - RNA, 21 nt, Human
cccccgcugucagccauuccu

SEQ ID NO: 1217215 - RNA, 12 nt, Human
cccccagcccca

SEQ ID NO: 1217216 - RNA, 14 nt, Human
ccccacuggugaca

SEQ ID NO: 1217217 - RNA, 13 nt, Human
ccccacuggugac

SEQ ID NO: 1217218 - RNA, 12 nt, Human
ccccacugguga

SEQ ID NO: 1217219 - RNA, 22 nt, Human
ccccaggaggccagccuugacc

SEQ ID NO: 1217220 - RNA, 21 nt, Human
ccccaggaggccagccuugac

SEQ ID NO: 1217221 - RNA, 15 nt, Human
ccccaggaggccagc

SEQ ID NO: 1217222 - RNA, 14 nt, Human
ccccaggaggccag

SEQ ID NO: 1217223 - RNA, 17 nt, Human
ccucaccuuucccaucu

SEQ ID NO: 1217224 - RNA, 15 nt, Human
ccucaccccacugug

SEQ ID NO: 1217225 - RNA, 12 nt, Human
ccucaccccacu

SEQ ID NO: 1217226 - RNA, 22 nt, Human
ccucacaguccuuaccagcaga

SEQ ID NO: 1217227 - RNA, 20 nt, Human
ccucacaguccuuaccagca

SEQ ID NO: 1217228 - RNA, 17 nt, Human
ccucacaguccuuacca

SEQ ID NO: 1217229 - RNA, 14 nt, Human
ccuaaaguguauuu

SEQ ID NO: 1217230 - RNA, 20 nt, Human
ccgggcacucagaagacacu

SEQ ID NO: 1217231 - RNA, 15 nt, Human
ccgggcacucagaag

SEQ ID NO: 1217232 - RNA, 15 nt, Human
ccggcuggccuggcc

SEQ ID NO: 1217233 - RNA, 13 nt, Human
ccggcuggccugg

SEQ ID NO: 1217234 - RNA, 12 nt, Human
ccggcuggccug

SEQ ID NO: 1217235 - RNA, 23 nt, Human
cccaagggccuggccugagcugg

SEQ ID NO: 1217236 - RNA, 19 nt, Human
cccaagggccuggccugag

SEQ ID NO: 1217237 - RNA, 18 nt, Human
cccaagggccuggccuga

SEQ ID NO: 1217238 - RNA, 18 nt, Human
cccagcaagugagagcug

SEQ ID NO: 1217239 - RNA, 22 nt, Human
cccagauugcaacaggcugggc

SEQ ID NO: 1217240 - RNA, 21 nt, Human
cccagauugcaacaggcuggg

SEQ ID NO: 1217241 - RNA, 20 nt, Human
cccagauugcaacaggcugg

SEQ ID NO: 1217242 - RNA, 20 nt, Human
cccagagggccugcaaggga

SEQ ID NO: 1217243 - RNA, 23 nt, Human
cccagcgagcccugguggcagug

SEQ ID NO: 1217244 - RNA, 19 nt, Human
cccagcgagcccugguggc

SEQ ID NO: 1217245 - RNA, 18 nt, Human
cccagcgagcccuggugg

SEQ ID NO: 1217246 - RNA, 17 nt, Human
cccagcgagcccuggug

SEQ ID NO: 1217247 - RNA, 12 nt, Human
cccagccugcua

SEQ ID NO: 1217248 - RNA, 18 nt, Human
cccagccccuucugaccc

SEQ ID NO: 1217249 - RNA, 11 nt, Human
cccagccccuu

SEQ ID NO: 1217250 - RNA, 23 nt, Human
cccagauugcaacaggcugggcu

SEQ ID NO: 1217251 - RNA, 23 nt, Human
cccagcaagugagagcugggugu

SEQ ID NO: 1217252 - RNA, 22 nt, Human
cccagcaagugagagcugggug

SEQ ID NO: 1217253 - RNA, 21 nt, Human
cccagcaagugagagcugggu

SEQ ID NO: 1217254 - RNA, 20 nt, Human
cccagcaagugagagcuggg

SEQ ID NO: 1217255 - RNA, 19 nt, Human
cccagcaagugagagcugg

SEQ ID NO: 1217256 - RNA, 22 nt, Human
cccaggccccugccacccuggg

SEQ ID NO: 1217257 - RNA, 21 nt, Human
cccaggccccugccacccugg

SEQ ID NO: 1217258 - RNA, 18 nt, Human
cccaggccccugccaccc

SEQ ID NO: 1217259 - RNA, 16 nt, Human
cccaggccccugccac

SEQ ID NO: 1217260 - RNA, 11 nt, Human
cccaggccccu

SEQ ID NO: 1217261 - RNA, 23 nt, Human
cccaggcauuccccaggaggcca

SEQ ID NO: 1217262 - RNA, 22 nt, Human
cccaggcauuccccaggaggcc

SEQ ID NO: 1217263 - RNA, 21 nt, Human
cccaggcauuccccaggaggc

SEQ ID NO: 1217264 - RNA, 20 nt, Human
cccaggcauuccccaggagg

SEQ ID NO: 1217265 - RNA, 17 nt, Human
cccaggcaggucuugaa

SEQ ID NO: 1217266 - RNA, 13 nt, Human
cccaggcaggucu

SEQ ID NO: 1217267 - RNA, 11 nt, Human
cccaggcaggu

SEQ ID NO: 1217268 - RNA, 22 nt, Human
cccaggaggccagccuugacca

SEQ ID NO: 1217269 - RNA, 13 nt, Human
cccaggaggccag

SEQ ID NO: 1217270 - RNA, 21 nt, Human
cccaggagccccgaggccuuc

SEQ ID NO: 1217271 - RNA, 13 nt, Human
cccagugcccaca

SEQ ID NO: 1217272 - RNA, 20 nt, Human
cccagucuggaaugcagugg

SEQ ID NO: 1217273 - RNA, 23 nt, Human
cccaggugcuaggaacacuccuu

SEQ ID NO: 1217274 - RNA, 22 nt, Human
cccaggugcuaggaacacuccu

SEQ ID NO: 1217275 - RNA, 18 nt, Human
cccaggccuccuacagcu

SEQ ID NO: 1217276 - RNA, 17 nt, Human
cccaggccuccuacagc

SEQ ID NO: 1217277 - RNA, 22 nt, Human
ccccucagggucccugguggca

SEQ ID NO: 1217278 - RNA, 17 nt, Human
ccccaggaggccagccu

SEQ ID NO: 1217279 - RNA, 18 nt, Human
cccaugcugcccugugag

SEQ ID NO: 1217280 - RNA, 17 nt, Human
cccaugcugcccuguga

SEQ ID NO: 1217281 - RNA, 16 nt, Human
cccaugcugcccugug

SEQ ID NO: 1217282 - RNA, 15 nt, Human
cccaugcugcccugu

SEQ ID NO: 1217283 - RNA, 18 nt, Human
cccagugccgagaaggaa

SEQ ID NO: 1217284 - RNA, 21 nt, Human
cccagugcccacaggaucagu

SEQ ID NO: 1217285 - RNA, 20 nt, Human
cccagugcccacaggaucag

SEQ ID NO: 1217286 - RNA, 15 nt, Human
cccagugcccacagg

SEQ ID NO: 1217287 - RNA, 22 nt, Human
ccccaaauggaaaugggcagag

SEQ ID NO: 1217288 - RNA, 13 nt, Human
cccauucugccug

SEQ ID NO: 1217289 - RNA, 21 nt, Human
ccccacccaagggccuggccu

SEQ ID NO: 1217290 - RNA, 20 nt, Human
ccccacccaagggccuggcc

SEQ ID NO: 1217291 - RNA, 14 nt, Human
ccccacccaagggc

SEQ ID NO: 1217292 - RNA, 22 nt, Human
ccaucauugaaaucuuuuugcu

SEQ ID NO: 1217293 - RNA, 18 nt, Human
ccauccagguucagcuug

SEQ ID NO: 1217294 - RNA, 19 nt, Human
ccauccucuguacagagcc

SEQ ID NO: 1217295 - RNA, 12 nt, Human
ccauccucugua

SEQ ID NO: 1217296 - RNA, 13 nt, Human
ccaucaccagaca

SEQ ID NO: 1217297 - RNA, 13 nt, Human
ccauaugccuggg

SEQ ID NO: 1217298 - RNA, 20 nt, Human
ccagugaggcucugcccuug

SEQ ID NO: 1217299 - RNA, 19 nt, Human
ccagugaggcucugcccuu

SEQ ID NO: 1217300 - RNA, 18 nt, Human
ccagugaggcucugcccu

SEQ ID NO: 1217301 - RNA, 15 nt, Human
ccaugcugcccugug

SEQ ID NO: 1217302 - RNA, 14 nt, Human
ccaugcugcccugu

SEQ ID NO: 1217303 - RNA, 13 nt, Human
ccaugcugcccug

SEQ ID NO: 1217304 - RNA, 11 nt, Human
ccaugcugccc

SEQ ID NO: 1217305 - RNA, 13 nt, Human
ccaugcuccuggc

SEQ ID NO: 1217306 - RNA, 21 nt, Human
ccaugauuaaccacuucagcu

SEQ ID NO: 1217307 - RNA, 19 nt, Human
ccaugauuaaccacuucag

SEQ ID NO: 1217308 - RNA, 18 nt, Human
ccaugauguuuuccauga

SEQ ID NO: 1217309 - RNA, 20 nt, Human
ccauccucuguacagagccc

SEQ ID NO: 1217310 - RNA, 16 nt, Human
cccaaagcagugcaug

SEQ ID NO: 1217311 - RNA, 15 nt, Human
cccaaagaugcagcc

SEQ ID NO: 1217312 - RNA, 12 nt, Human
cccaaagaugca

SEQ ID NO: 1217313 - RNA, 22 nt, Human
ccauuuugggguacccacugcu

SEQ ID NO: 1217314 - RNA, 20 nt, Human
ccauuuugggguacccacug

SEQ ID NO: 1217315 - RNA, 21 nt, Human
ccauuuuguauuuuacuaaua

SEQ ID NO: 1217316 - RNA, 21 nt, Human
ccauucugccugcccaggccc

SEQ ID NO: 1217317 - RNA, 20 nt, Human
ccauucugccugcccaggcc

SEQ ID NO: 1217318 - RNA, 19 nt, Human
ccauucugccugcccaggc

SEQ ID NO: 1217319 - RNA, 18 nt, Human
ccauucugccugcccagg

SEQ ID NO: 1217320 - RNA, 17 nt, Human
ccauucugccugcccag

SEQ ID NO: 1217321 - RNA, 18 nt, Human
ccauucuccaccugccag

SEQ ID NO: 1217322 - RNA, 17 nt, Human
ccauucuccaccugcca

SEQ ID NO: 1217323 - RNA, 16 nt, Human
ccauucuccaccugcc

SEQ ID NO: 1217324 - RNA, 15 nt, Human
ccauucuccaccugc

SEQ ID NO: 1217325 - RNA, 14 nt, Human
ccauggacuuuguu

SEQ ID NO: 1217326 - RNA, 13 nt, Human
ccauggacuuugu

SEQ ID NO: 1217327 - RNA, 21 nt, Human
cccacaaaggagagcuagcag

SEQ ID NO: 1217328 - RNA, 13 nt, Human
ccagcugcuuggg

SEQ ID NO: 1217329 - RNA, 23 nt, Human
ccagcugcuugggcuucauccuc

SEQ ID NO: 1217330 - RNA, 22 nt, Human
ccagcucugguccauagagagc

SEQ ID NO: 1217331 - RNA, 21 nt, Human
ccagcucugguccauagagag

SEQ ID NO: 1217332 - RNA, 17 nt, Human
ccagcucugguccauag

SEQ ID NO: 1217333 - RNA, 14 nt, Human
ccagcucuggucca

SEQ ID NO: 1217334 - RNA, 13 nt, Human
ccagcucuggucc

SEQ ID NO: 1217335 - RNA, 12 nt, Human
ccagcucugguc

SEQ ID NO: 1217336 - RNA, 11 nt, Human
ccagcucuggu

SEQ ID NO: 1217337 - RNA, 21 nt, Human
ccagcgagcccugguggcagu

SEQ ID NO: 1217338 - RNA, 16 nt, Human
ccagcgagcccuggug

SEQ ID NO: 1217339 - RNA, 15 nt, Human
ccagcgagcccuggu

SEQ ID NO: 1217340 - RNA, 14 nt, Human
ccagcgagcccugg

SEQ ID NO: 1217341 - RNA, 22 nt, Human
ccagccuugaccauucuccacc

SEQ ID NO: 1217342 - RNA, 20 nt, Human
ccagccuugaccauucucca

SEQ ID NO: 1217343 - RNA, 19 nt, Human
ccagccuugaccauucucc

SEQ ID NO: 1217344 - RNA, 22 nt, Human
ccagagcccaccuuggcucaag

SEQ ID NO: 1217345 - RNA, 16 nt, Human
ccagagcccaccuugg

SEQ ID NO: 1217346 - RNA, 22 nt, Human
ccaggaagccagcaggcucuca

SEQ ID NO: 1217347 - RNA, 21 nt, Human
ccaggccacaagacccuugug

SEQ ID NO: 1217348 - RNA, 24 nt, Human
ccaggcauuccccaggaggccagc

SEQ ID NO: 1217349 - RNA, 23 nt, Human
ccaggcauuccccaggaggccag

SEQ ID NO: 1217350 - RNA, 17 nt, Human
ccaggcauuccccagga

SEQ ID NO: 1217351 - RNA, 14 nt, Human
ccaggcauucccca

SEQ ID NO: 1217352 - RNA, 13 nt, Human
ccaggcauggugg

SEQ ID NO: 1217353 - RNA, 14 nt, Human
ccaggaggccagcc

SEQ ID NO: 1217354 - RNA, 13 nt, Human
ccaggaggccagc

SEQ ID NO: 1217355 - RNA, 12 nt, Human
ccaggaggccag

SEQ ID NO: 1217356 - RNA, 19 nt, Human
ccaggagccuccugcccuu

SEQ ID NO: 1217357 - RNA, 16 nt, Human
ccaggagccccgaggc

SEQ ID NO: 1217358 - RNA, 18 nt, Human
ccaggagccuccugcccu

SEQ ID NO: 1217359 - RNA, 14 nt, Human
ccaggagccuccug

SEQ ID NO: 1217360 - RNA, 13 nt, Human
ccaggagccuccu

SEQ ID NO: 1217361 - RNA, 15 nt, Human
ccaggagccccgagg

SEQ ID NO: 1217362 - RNA, 16 nt, Human
ccaggagcagccacau

SEQ ID NO: 1217363 - RNA, 19 nt, Human
ccaggugcuaggaacacuc

SEQ ID NO: 1217364 - RNA, 18 nt, Human
ccaggugcacaagcucca

SEQ ID NO: 1217365 - RNA, 14 nt, Human
ccagguucagcuug

SEQ ID NO: 1217366 - RNA, 21 nt, Human
ccaggugcuaggaacacuccu

SEQ ID NO: 1217367 - RNA, 15 nt, Human
ccagguucagcuugu

SEQ ID NO: 1217368 - RNA, 13 nt, Human
ccaguaucuugaa

SEQ ID NO: 1217369 - RNA, 24 nt, Human
ccaggcuguaucccaugagccuca

SEQ ID NO: 1217370 - RNA, 13 nt, Human
ccaggccccugcc

SEQ ID NO: 1217371 - RNA, 20 nt, Human
ccaggcuguaucccaugagc

SEQ ID NO: 1217372 - RNA, 19 nt, Human
ccaggcuggucucaaacuc

SEQ ID NO: 1217373 - RNA, 22 nt, Human
ccacacccagcccacuucugcc

SEQ ID NO: 1217374 - RNA, 21 nt, Human
ccacacccagcccacuucugc

SEQ ID NO: 1217375 - RNA, 20 nt, Human
ccacacccagcccacuucug

SEQ ID NO: 1217376 - RNA, 16 nt, Human
ccacaggaucagucug

SEQ ID NO: 1217377 - RNA, 21 nt, Human
ccaccaacauacucccaucug

SEQ ID NO: 1217378 - RNA, 16 nt, Human
ccacauuccugaugcu

SEQ ID NO: 1217379 - RNA, 16 nt, Human
ccacaugugcacaugc

SEQ ID NO: 1217380 - RNA, 20 nt, Human
ccacaucuugcucugcugac

SEQ ID NO: 1217381 - RNA, 19 nt, Human
ccacaucuugcucugcuga

SEQ ID NO: 1217382 - RNA, 18 nt, Human
ccacaucuugcucugcug

SEQ ID NO: 1217383 - RNA, 17 nt, Human
ccacccccacccaaggg

SEQ ID NO: 1217384 - RNA, 23 nt, Human
ccacccaggagccccgaggccuu

SEQ ID NO: 1217385 - RNA, 14 nt, Human
ccacuacauucugu

SEQ ID NO: 1217386 - RNA, 23 nt, Human
ccacggccaggccagagggagug

SEQ ID NO: 1217387 - RNA, 18 nt, Human
ccacggccaggccagagg

SEQ ID NO: 1217388 - RNA, 16 nt, Human
ccacggccaggccaga

SEQ ID NO: 1217389 - RNA, 19 nt, Human
ccacgcuggagugcaguga

SEQ ID NO: 1217390 - RNA, 18 nt, Human
ccacgcuggagugcagug

SEQ ID NO: 1217391 - RNA, 16 nt, Human
ccacgcuggagugcag

SEQ ID NO: 1217392 - RNA, 15 nt, Human
ccacccccacccaag

SEQ ID NO: 1217393 - RNA, 15 nt, Human
ccaccccacacacgc

SEQ ID NO: 1217394 - RNA, 18 nt, Human
ccacucaguccauagcag

SEQ ID NO: 1217395 - RNA, 15 nt, Human
ccacuacauucuguu

SEQ ID NO: 1217396 - RNA, 11 nt, Human
ccacuacauuc

SEQ ID NO: 1217397 - RNA, 17 nt, Human
ccacuacauucuguuaa

SEQ ID NO: 1217398 - RNA, 16 nt, Human
ccacuacauucuguua

SEQ ID NO: 1217399 - RNA, 22 nt, Human
ccagaaguuugagaucagccug

SEQ ID NO: 1217400 - RNA, 23 nt, Human
ccagaaguuugagaucagccugg

SEQ ID NO: 1217401 - RNA, 18 nt, Human
ccagaauuucccaaagca

SEQ ID NO: 1217402 - RNA, 14 nt, Human
ccacuucagcugac

SEQ ID NO: 1217403 - RNA, 13 nt, Human
ccacuucagcuga

SEQ ID NO: 1217404 - RNA, 21 nt, Human
ccagacaccuugacagggcac

SEQ ID NO: 1217405 - RNA, 21 nt, Human
ccagaauuucccaaagcagug

SEQ ID NO: 1217406 - RNA, 19 nt, Human
ccagaauuucccaaagcag

SEQ ID NO: 1217407 - RNA, 12 nt, Human
ccagaauuuccc

SEQ ID NO: 1217408 - RNA, 17 nt, Human
ccaaggccaaaggaagc

SEQ ID NO: 1217409 - RNA, 22 nt, Human
ccaagcucccaggcauucccca

SEQ ID NO: 1217410 - RNA, 16 nt, Human
ccaagcucccaggcau

SEQ ID NO: 1217411 - RNA, 15 nt, Human
ccaagcucccaggca

SEQ ID NO: 1217412 - RNA, 22 nt, Human
ccaaggggaauguuugccucug

SEQ ID NO: 1217413 - RNA, 19 nt, Human
ccaagggccuggccugagc

SEQ ID NO: 1217414 - RNA, 18 nt, Human
ccaagggccuggccugag

SEQ ID NO: 1217415 - RNA, 16 nt, Human
ccaagggccuggccug

SEQ ID NO: 1217416 - RNA, 15 nt, Human
ccaagggccuggccu

SEQ ID NO: 1217417 - RNA, 21 nt, Human
ccaaggccaaaggaagcacau

SEQ ID NO: 1217418 - RNA, 18 nt, Human
ccaaggccaaaggaagca

SEQ ID NO: 1217419 - RNA, 20 nt, Human
ccaagucaagugaaaaagga

SEQ ID NO: 1217420 - RNA, 23 nt, Human
ccaagguuuggggaagaacgaag

SEQ ID NO: 1217421 - RNA, 18 nt, Human
ccaaggugggaggauugc

SEQ ID NO: 1217422 - RNA, 13 nt, Human
ccaaggugggagg

SEQ ID NO: 1217423 - RNA, 20 nt, Human
ccaaaguacacuguuucaaa

SEQ ID NO: 1217424 - RNA, 18 nt, Human
ccaaaguacacuguuuca

SEQ ID NO: 1217425 - RNA, 15 nt, Human
ccaaaguacacuguu

SEQ ID NO: 1217426 - RNA, 20 nt, Human
ccaacauacucccaucugug

SEQ ID NO: 1217427 - RNA, 19 nt, Human
ccaacauacucccaucugu

SEQ ID NO: 1217428 - RNA, 18 nt, Human
ccaacauacucccaucug

SEQ ID NO: 1217429 - RNA, 17 nt, Human
ccaacauacucccaucu

SEQ ID NO: 1217430 - RNA, 22 nt, Human
ccaacauacucccaucugugaa

SEQ ID NO: 1217431 - RNA, 21 nt, Human
ccaacauacucccaucuguga

SEQ ID NO: 1217432 - RNA, 13 nt, Human
ccaacaucaacau

SEQ ID NO: 1217433 - RNA, 22 nt, Human
ccaaagccuccuccagccgcca

SEQ ID NO: 1217434 - RNA, 17 nt, Human
ccaaagccuccuccagc

SEQ ID NO: 1217435 - RNA, 19 nt, Human
ccaaagccaaagcuaggcc

SEQ ID NO: 1217436 - RNA, 23 nt, Human
ccaaagcagugcaugcugucccu

SEQ ID NO: 1217437 - RNA, 20 nt, Human
ccaaacucaccugccccuca

SEQ ID NO: 1217438 - RNA, 15 nt, Human
ccaaagcuaggccug

SEQ ID NO: 1217439 - RNA, 17 nt, Human
ccaaagcuaggccuggc

SEQ ID NO: 1217440 - RNA, 16 nt, Human
ccaaagcuaggccugg

SEQ ID NO: 1217441 - RNA, 21 nt, Human
ccaaagcuaggccuggccaga

SEQ ID NO: 1217442 - RNA, 23 nt, Human
ccaaaggaagcacaugccucucu

SEQ ID NO: 1217443 - RNA, 15 nt, Human
ccaaaggaagcacau

SEQ ID NO: 1217444 - RNA, 23 nt, Human
ccaagcagagguugggaggccau

SEQ ID NO: 1217445 - RNA, 20 nt, Human
ccaagaagcccaggaaaggc

SEQ ID NO: 1217446 - RNA, 19 nt, Human
ccaagaagcccaggaaagg

SEQ ID NO: 1217447 - RNA, 13 nt, Human
ccaacccucauca

SEQ ID NO: 1217448 - RNA, 12 nt, Human
ccaacccucauc

SEQ ID NO: 1217449 - RNA, 18 nt, Human
cauuguuggccaaagcca

SEQ ID NO: 1217450 - RNA, 17 nt, Human
cauuguuggccaaagcc

SEQ ID NO: 1217451 - RNA, 13 nt, Human
cauugugggaagg

SEQ ID NO: 1217452 - RNA, 15 nt, Human
cacccaagggccugg

SEQ ID NO: 1217453 - RNA, 14 nt, Human
cacccaagggccug

SEQ ID NO: 1217454 - RNA, 13 nt, Human
cauuuccuguguc

SEQ ID NO: 1217455 - RNA, 12 nt, Human
cauuuccugugu

SEQ ID NO: 1217456 - RNA, 21 nt, Human
cauuuaaaagauacaguuacu

SEQ ID NO: 1217457 - RNA, 16 nt, Human
cauuuaaaagauacag

SEQ ID NO: 1217458 - RNA, 15 nt, Human
cauuuaaaagauaca

SEQ ID NO: 1217459 - RNA, 12 nt, Human
cauuuaaaagau

SEQ ID NO: 1217460 - RNA, 16 nt, Human
cacccaagggccuggc

SEQ ID NO: 1217461 - RNA, 23 nt, Human
cauuuuucuuagggaaggauaca

SEQ ID NO: 1217462 - RNA, 22 nt, Human
cauuuguuugaacugauaaaga

SEQ ID NO: 1217463 - RNA, 20 nt, Human
cauuuguuugaacugauaaa

SEQ ID NO: 1217464 - RNA, 13 nt, Human
cauuugcugaaua

SEQ ID NO: 1217465 - RNA, 14 nt, Human
cauuugcuccuuuc

SEQ ID NO: 1217466 - RNA, 13 nt, Human
cauuugcuccuuu

SEQ ID NO: 1217467 - RNA, 20 nt, Human
cauuugagcagggcucagcg

SEQ ID NO: 1217468 - RNA, 18 nt, Human
cauuugagcagggcucag

SEQ ID NO: 1217469 - RNA, 17 nt, Human
cauuugagcagggcuca

SEQ ID NO: 1217470 - RNA, 22 nt, Human
cauuugaaaauuuugauguuuu

SEQ ID NO: 1217471 - RNA, 18 nt, Human
cugaaggccccgcccagg

SEQ ID NO: 1217472 - RNA, 17 nt, Human
cugaaggccccgcccag

SEQ ID NO: 1217473 - RNA, 14 nt, Human
cugaaggccccgcc

SEQ ID NO: 1217474 - RNA, 13 nt, Human
cugaaggccccgc

SEQ ID NO: 1217475 - RNA, 21 nt, Human
cugaaggacauugcggacagc

SEQ ID NO: 1217476 - RNA, 20 nt, Human
cugaaggacauugcggacag

SEQ ID NO: 1217477 - RNA, 19 nt, Human
cugaaggacauugcggaca

SEQ ID NO: 1217478 - RNA, 16 nt, Human
cugaaaauguaugugu

SEQ ID NO: 1217479 - RNA, 20 nt, Human
cugacccaugcugcccugug

SEQ ID NO: 1217480 - RNA, 19 nt, Human
cugacccaugcugcccugu

SEQ ID NO: 1217481 - RNA, 18 nt, Human
cugacccaugcugcccug

SEQ ID NO: 1217482 - RNA, 15 nt, Human
cugacagacacaggc

SEQ ID NO: 1217483 - RNA, 14 nt, Human
cugacagacacagg

SEQ ID NO: 1217484 - RNA, 12 nt, Human
cugacagacaca

SEQ ID NO: 1217485 - RNA, 20 nt, Human
cuccgcuuucuacccagcga

SEQ ID NO: 1217486 - RNA, 15 nt, Human
cucucacuccuugaa

SEQ ID NO: 1217487 - RNA, 19 nt, Human
cucucagauuguaccauug

SEQ ID NO: 1217488 - RNA, 14 nt, Human
cucucacuccuuga

SEQ ID NO: 1217489 - RNA, 12 nt, Human
cucucacuccuu

SEQ ID NO: 1217490 - RNA, 15 nt, Human
cucugaaggacauug

SEQ ID NO: 1217491 - RNA, 12 nt, Human
cucuccuccaga

SEQ ID NO: 1217492 - RNA, 22 nt, Human
cucugaaggacauugcggacag

SEQ ID NO: 1217493 - RNA, 23 nt, Human
cucugcagcaauaaagcagcguu

SEQ ID NO: 1217494 - RNA, 19 nt, Human
cucugcagcaauaaagcag

SEQ ID NO: 1217495 - RNA, 18 nt, Human
cucugcagcaauaaagca

SEQ ID NO: 1217496 - RNA, 14 nt, Human
cucugcacuccccu

SEQ ID NO: 1217497 - RNA, 21 nt, Human
cucuguacagagcccacgccc

SEQ ID NO: 1217498 - RNA, 13 nt, Human
cucuguacagagc

SEQ ID NO: 1217499 - RNA, 17 nt, Human
cucuguacagagcccac

SEQ ID NO: 1217500 - RNA, 20 nt, Human
cucugcugacagacacaggc

SEQ ID NO: 1217501 - RNA, 19 nt, Human
cucugcugacagacacagg

SEQ ID NO: 1217502 - RNA, 18 nt, Human
cucugcugacagacacag

SEQ ID NO: 1217503 - RNA, 17 nt, Human
cucugcugacagacaca

SEQ ID NO: 1217504 - RNA, 18 nt, Human
cucugguccauagagagc

SEQ ID NO: 1217505 - RNA, 16 nt, Human
cucugguccauagaga

SEQ ID NO: 1217506 - RNA, 19 nt, Human
cucugguccauagagagca

SEQ ID NO: 1217507 - RNA, 13 nt, Human
cucagugccacua

SEQ ID NO: 1217508 - RNA, 20 nt, Human
cucagucuggcccuuccuuu

SEQ ID NO: 1217509 - RNA, 18 nt, Human
cucagucuggcccuuccu

SEQ ID NO: 1217510 - RNA, 17 nt, Human
cucagucuggcccuucc

SEQ ID NO: 1217511 - RNA, 19 nt, Human
cucauguucuuaauucuua

SEQ ID NO: 1217512 - RNA, 18 nt, Human
cucauguucuuaauucuu

SEQ ID NO: 1217513 - RNA, 14 nt, Human
cucauguucuuaau

SEQ ID NO: 1217514 - RNA, 20 nt, Human
cucaggccugggggcugggc

SEQ ID NO: 1217515 - RNA, 14 nt, Human
cucaggccuggggg

SEQ ID NO: 1217516 - RNA, 21 nt, Human
cucaggccugggggcugggca

SEQ ID NO: 1217517 - RNA, 22 nt, Human
cucaggccugggggcugggcag

SEQ ID NO: 1217518 - RNA, 22 nt, Human
cucaggccagcugcuugggcuu

SEQ ID NO: 1217519 - RNA, 21 nt, Human
cucaggccagcugcuugggcu

SEQ ID NO: 1217520 - RNA, 15 nt, Human
cucaggccagcugcu

SEQ ID NO: 1217521 - RNA, 14 nt, Human
cucaggccagcugc

SEQ ID NO: 1217522 - RNA, 13 nt, Human
cucaggccagcug

SEQ ID NO: 1217523 - RNA, 13 nt, Human
cucagcggggaca

SEQ ID NO: 1217524 - RNA, 13 nt, Human
cucagccucccga

SEQ ID NO: 1217525 - RNA, 22 nt, Human
cucagccucccaaagugcuggg

SEQ ID NO: 1217526 - RNA, 16 nt, Human
cucagccucccaaagu

SEQ ID NO: 1217527 - RNA, 14 nt, Human
cucagccucccaaa

SEQ ID NO: 1217528 - RNA, 21 nt, Human
cucagccucccaaagugcugg

SEQ ID NO: 1217529 - RNA, 13 nt, Human
cucagccucccaa

SEQ ID NO: 1217530 - RNA, 13 nt, Human
cucccaccucagc

SEQ ID NO: 1217531 - RNA, 12 nt, Human
cucccaccucag

SEQ ID NO: 1217532 - RNA, 19 nt, Human
cuccgcuuucuacccagcg

SEQ ID NO: 1217533 - RNA, 11 nt, Human
cuccaggugca

SEQ ID NO: 1217534 - RNA, 19 nt, Human
cuccagacacauguccaag

SEQ ID NO: 1217535 - RNA, 17 nt, Human
cuccagacacaugucca

SEQ ID NO: 1217536 - RNA, 21 nt, Human
cuccagaauuucccaaagcag

SEQ ID NO: 1217537 - RNA, 18 nt, Human
cuccagaauuucccaaag

SEQ ID NO: 1217538 - RNA, 15 nt, Human
cuccagaauuuccca

SEQ ID NO: 1217539 - RNA, 22 nt, Human
cuccacuuucuagccagaggag

SEQ ID NO: 1217540 - RNA, 21 nt, Human
cuccaagaccuucuccuucac

SEQ ID NO: 1217541 - RNA, 18 nt, Human
cuccaagaccuucuccuu

SEQ ID NO: 1217542 - RNA, 17 nt, Human
cuccaagaccuucuccu

SEQ ID NO: 1217543 - RNA, 16 nt, Human
cuccaagaccuucucc

SEQ ID NO: 1217544 - RNA, 15 nt, Human
cuaacuucaccauau

SEQ ID NO: 1217545 - RNA, 16 nt, Human
cuaacuucaccauauu

SEQ ID NO: 1217546 - RNA, 19 nt, Human
cuacaguugaaaaacagcu

SEQ ID NO: 1217547 - RNA, 13 nt, Human
cuacaguugaaaa

SEQ ID NO: 1217548 - RNA, 18 nt, Human
cuacaguccucccaucuc

SEQ ID NO: 1217549 - RNA, 17 nt, Human
cuacaguccucccaucu

SEQ ID NO: 1217550 - RNA, 16 nt, Human
cuacaguccucccauc

SEQ ID NO: 1217551 - RNA, 15 nt, Human
cuacaguccucccau

SEQ ID NO: 1217552 - RNA, 18 nt, Human
cuacauacaauuccaaac

SEQ ID NO: 1217553 - RNA, 22 nt, Human
cuaagugauccucccaccucag

SEQ ID NO: 1217554 - RNA, 20 nt, Human
cuaagugauccucccaccuc

SEQ ID NO: 1217555 - RNA, 18 nt, Human
cuaagugaggaugaaaaa

SEQ ID NO: 1217556 - RNA, 17 nt, Human
cuagcauggcugccaau

SEQ ID NO: 1217557 - RNA, 23 nt, Human
cuagcagcagggagggcuucugc

SEQ ID NO: 1217558 - RNA, 22 nt, Human
cuagcagcagggagggcuucug

SEQ ID NO: 1217559 - RNA, 19 nt, Human
cuagaaauuccccacccug

SEQ ID NO: 1217560 - RNA, 14 nt, Human
cuaccugaggggcc

SEQ ID NO: 1217561 - RNA, 11 nt, Human
cuaccugaggg

SEQ ID NO: 1217562 - RNA, 15 nt, Human
cuaccugaggggccu

SEQ ID NO: 1217563 - RNA, 20 nt, Human
cuaguuccaccaucaagcca

SEQ ID NO: 1217564 - RNA, 18 nt, Human
cuaguuccaccaucaagc

SEQ ID NO: 1217565 - RNA, 21 nt, Human
cuagggaaaaaccagcgugug

SEQ ID NO: 1217566 - RNA, 19 nt, Human
cuagggaaaaaccagcgug

SEQ ID NO: 1217567 - RNA, 19 nt, Human
cuagccugugccucuggga

SEQ ID NO: 1217568 - RNA, 22 nt, Human
cuaguuguuugauucagacagc

SEQ ID NO: 1217569 - RNA, 22 nt, Human
cuaguuccaccaucaagccacc

SEQ ID NO: 1217570 - RNA, 18 nt, Human
cggcucacugcagccuca

SEQ ID NO: 1217571 - RNA, 19 nt, Human
cggcucacugcagccucaa

SEQ ID NO: 1217572 - RNA, 14 nt, Human
cggagucccaccuu

SEQ ID NO: 1217573 - RNA, 16 nt, Human
cgaguagcugggacua

SEQ ID NO: 1217574 - RNA, 15 nt, Human
cgaguagcugggacu

SEQ ID NO: 1217575 - RNA, 14 nt, Human
cgaguagcugggac

SEQ ID NO: 1217576 - RNA, 18 nt, Human
cgaguuacagacaaagcg

SEQ ID NO: 1217577 - RNA, 17 nt, Human
cgaguuacagacaaagc

SEQ ID NO: 1217578 - RNA, 14 nt, Human
cgccuacaggagug

SEQ ID NO: 1217579 - RNA, 16 nt, Human
cgccaaggcuggggga

SEQ ID NO: 1217580 - RNA, 13 nt, Human
cgccaaggcuggg

SEQ ID NO: 1217581 - RNA, 23 nt, Human
cgccaaggcugggggaagaagcu

SEQ ID NO: 1217582 - RNA, 12 nt, Human
cgccaaggcugg

SEQ ID NO: 1217583 - RNA, 22 nt, Human
ccuucuggaauaaggagaauga

SEQ ID NO: 1217584 - RNA, 23 nt, Human
ccuucugacccaugcugcccugu

SEQ ID NO: 1217585 - RNA, 22 nt, Human
ccuucugacccaugcugcccug

SEQ ID NO: 1217586 - RNA, 21 nt, Human
ccuucugacccaugcugcccu

SEQ ID NO: 1217587 - RNA, 20 nt, Human
ccuucugacccaugcugccc

SEQ ID NO: 1217588 - RNA, 17 nt, Human
ccuucugacccaugcug

SEQ ID NO: 1217589 - RNA, 16 nt, Human
ccuucugacccaugcu

SEQ ID NO: 1217590 - RNA, 12 nt, Human
ccuucugaccca

SEQ ID NO: 1217591 - RNA, 20 nt, Human
ccuggccugagcugggauga

SEQ ID NO: 1217592 - RNA, 15 nt, Human
ccuggccugagcugg

SEQ ID NO: 1217593 - RNA, 14 nt, Human
ccuggccugagcug

SEQ ID NO: 1217594 - RNA, 20 nt, Human
ccuugccgucuaccugaggg

SEQ ID NO: 1217595 - RNA, 20 nt, Human
ccuuuagcgcccaguugggu

SEQ ID NO: 1217596 - RNA, 14 nt, Human
ccuuuagcgcccag

SEQ ID NO: 1217597 - RNA, 12 nt, Human
ccuuuuuuauac

SEQ ID NO: 1217598 - RNA, 18 nt, Human
ccuuuuuuauacauaaac

SEQ ID NO: 1217599 - RNA, 17 nt, Human
ccuuuuuuauacauaaa

SEQ ID NO: 1217600 - RNA, 19 nt, Human
ccuuuuuuauacauaaaca

SEQ ID NO: 1217601 - RNA, 23 nt, Human
cgaccagacaccuugacagggca

SEQ ID NO: 1217602 - RNA, 20 nt, Human
ccagagggccugcaagggag

SEQ ID NO: 1217603 - RNA, 19 nt, Human
ccagagggccugcaaggga

SEQ ID NO: 1217604 - RNA, 18 nt, Human
ccagagggccugcaaggg

SEQ ID NO: 1217605 - RNA, 17 nt, Human
ccagagggccugcaagg

SEQ ID NO: 1217606 - RNA, 16 nt, Human
ccaccuuggcucaagu

SEQ ID NO: 1217607 - RNA, 17 nt, Human
ccagaugcaccagcccu

SEQ ID NO: 1217608 - RNA, 18 nt, Human
ccagaugcaccagcccuu

SEQ ID NO: 1217609 - RNA, 23 nt, Human
ccagaugcaccagcccuuagcag

SEQ ID NO: 1217610 - RNA, 16 nt, Human
ccagcuuaucucaggg

SEQ ID NO: 1217611 - RNA, 19 nt, Human
ccagcuuaaaggggcuaga

SEQ ID NO: 1217612 - RNA, 17 nt, Human
ccagcuguucagcuggu

SEQ ID NO: 1217613 - RNA, 22 nt, Human
ccagcucaccagccccagugcc

SEQ ID NO: 1217614 - RNA, 16 nt, Human
ccagcucaccagcccc

SEQ ID NO: 1217615 - RNA, 15 nt, Human
ccagcucaccagccc

SEQ ID NO: 1217616 - RNA, 12 nt, Human
ccagccccugga

SEQ ID NO: 1217617 - RNA, 11 nt, Human
ccagccccugg

SEQ ID NO: 1217618 - RNA, 17 nt, Human
ccaggaaaggcuccagg

SEQ ID NO: 1217619 - RNA, 16 nt, Human
ccaggaaaggcuccag

SEQ ID NO: 1217620 - RNA, 15 nt, Human
ccaggaaaggcucca

SEQ ID NO: 1217621 - RNA, 14 nt, Human
ccaggaaaggcucc

SEQ ID NO: 1217622 - RNA, 12 nt, Human
ccaggaagccag

SEQ ID NO: 1217623 - RNA, 13 nt, Human
ccaggaagccagc

SEQ ID NO: 1217624 - RNA, 14 nt, Human
ccaggaagccagca

SEQ ID NO: 1217625 - RNA, 15 nt, Human
ccagcaggcucucag

SEQ ID NO: 1217626 - RNA, 13 nt, Human
ccagcaggcucuc

SEQ ID NO: 1217627 - RNA, 23 nt, Human
ccaugagccucagcauccuggca

SEQ ID NO: 1217628 - RNA, 21 nt, Human
ccaugagccucagcauccugg

SEQ ID NO: 1217629 - RNA, 20 nt, Human
ccauggucggaaaacaugcu

SEQ ID NO: 1217630 - RNA, 20 nt, Human
ccaucccugaaggccccgcc

SEQ ID NO: 1217631 - RNA, 17 nt, Human
ccaucccugaaggcccc

SEQ ID NO: 1217632 - RNA, 15 nt, Human
ccaucccugaaggcc

SEQ ID NO: 1217633 - RNA, 14 nt, Human
ccaucccugaaggc

SEQ ID NO: 1217634 - RNA, 15 nt, Human
ccaucccagccccaa

SEQ ID NO: 1217635 - RNA, 14 nt, Human
ccaucccagcccca

SEQ ID NO: 1217636 - RNA, 23 nt, Human
ccaguuggucccccuuccaugga

SEQ ID NO: 1217637 - RNA, 23 nt, Human
ccaguuggguggaugccuggugg

SEQ ID NO: 1217638 - RNA, 20 nt, Human
ccaguuggguggaugccugg

SEQ ID NO: 1217639 - RNA, 19 nt, Human
ccaguuggguggaugccug

SEQ ID NO: 1217640 - RNA, 17 nt, Human
ccaguuggguggaugcc

SEQ ID NO: 1217641 - RNA, 19 nt, Human
ccaggggugggacacccug

SEQ ID NO: 1217642 - RNA, 21 nt, Human
ccaggggaaaaucagccugcu

SEQ ID NO: 1217643 - RNA, 17 nt, Human
ccaggggugggacaccc

SEQ ID NO: 1217644 - RNA, 14 nt, Human
ccaggggugggaca

SEQ ID NO: 1217645 - RNA, 13 nt, Human
ccaggggugggac

SEQ ID NO: 1217646 - RNA, 20 nt, Human
ccaggggaaaaucagccugc

SEQ ID NO: 1217647 - RNA, 19 nt, Human
ccaggggaaaaucagccug

SEQ ID NO: 1217648 - RNA, 19 nt, Human
ccaggcuggcgugcagugg

SEQ ID NO: 1217649 - RNA, 18 nt, Human
ccaggcuggcgugcagug

SEQ ID NO: 1217650 - RNA, 17 nt, Human
ccaggcuggcgugcagu

SEQ ID NO: 1217651 - RNA, 21 nt, Human
ccaggcuccuuuagcgcccag

SEQ ID NO: 1217652 - RNA, 20 nt, Human
ccaggcuccuuuagcgccca

SEQ ID NO: 1217653 - RNA, 23 nt, Human
ccccgaggccuucucugaaggac

SEQ ID NO: 1217654 - RNA, 13 nt, Human
ccccggccaccug

SEQ ID NO: 1217655 - RNA, 23 nt, Human
ccccaaaacucuccucugcugcu

SEQ ID NO: 1217656 - RNA, 22 nt, Human
ccccaaaacucuccucugcugc

SEQ ID NO: 1217657 - RNA, 22 nt, Human
cccccaaauggaaaugggcaga

SEQ ID NO: 1217658 - RNA, 22 nt, Human
ccccagcaagugagagcugggu

SEQ ID NO: 1217659 - RNA, 17 nt, Human
cccggccaccugcggug

SEQ ID NO: 1217660 - RNA, 18 nt, Human
cccuauuagagaagagau

SEQ ID NO: 1217661 - RNA, 16 nt, Human
cccggcuccaggcucc

SEQ ID NO: 1217662 - RNA, 15 nt, Human
cccggcuccaggcuc

SEQ ID NO: 1217663 - RNA, 14 nt, Human
cccggcuccaggcu

SEQ ID NO: 1217664 - RNA, 13 nt, Human
cccggcuccaggc

SEQ ID NO: 1217665 - RNA, 12 nt, Human
cccggcuccagg

SEQ ID NO: 1217666 - RNA, 14 nt, Human
cccggccaccugcg

SEQ ID NO: 1217667 - RNA, 13 nt, Human
cccggccaccugc

SEQ ID NO: 1217668 - RNA, 16 nt, Human
cccgaauagcugggac

SEQ ID NO: 1217669 - RNA, 14 nt, Human
cccgaauagcuggg

SEQ ID NO: 1217670 - RNA, 23 nt, Human
cccagcucugguccauagagagc

SEQ ID NO: 1217671 - RNA, 13 nt, Human
cccauccucugua

SEQ ID NO: 1217672 - RNA, 17 nt, Human
cccaggcuggcgugcag

SEQ ID NO: 1217673 - RNA, 13 nt, Human
cccaggcuggcgu

SEQ ID NO: 1217674 - RNA, 15 nt, Human
cccaggaaaggcucc

SEQ ID NO: 1217675 - RNA, 12 nt, Human
cccacuucugcc

SEQ ID NO: 1217676 - RNA, 18 nt, Human
cccacccugaaagcccug

SEQ ID NO: 1217677 - RNA, 15 nt, Human
cccacccccacccaa

SEQ ID NO: 1217678 - RNA, 17 nt, Human
cccacccccacccaagg

SEQ ID NO: 1217679 - RNA, 22 nt, Human
cccacccaagggccuggccuga

SEQ ID NO: 1217680 - RNA, 21 nt, Human
cccacccaagggccuggccug

SEQ ID NO: 1217681 - RNA, 20 nt, Human
cccacccaagggccuggccu

SEQ ID NO: 1217682 - RNA, 22 nt, Human
cccacugcuuuuggucugugug

SEQ ID NO: 1217683 - RNA, 19 nt, Human
cccacugcuuuuggucugu

SEQ ID NO: 1217684 - RNA, 13 nt, Human
cccacugcucugg

SEQ ID NO: 1217685 - RNA, 12 nt, Human
cccacugcucug

SEQ ID NO: 1217686 - RNA, 12 nt, Human
cccacucccugc

SEQ ID NO: 1217687 - RNA, 19 nt, Human
ccucuugagccuugaacuu

SEQ ID NO: 1217688 - RNA, 13 nt, Human
ccucuugagccuu

SEQ ID NO: 1217689 - RNA, 22 nt, Human
ccugcacuugcagacucuacag

SEQ ID NO: 1217690 - RNA, 14 nt, Human
ccucucucaggcca

SEQ ID NO: 1217691 - RNA, 12 nt, Human
ccucucucaggc

SEQ ID NO: 1217692 - RNA, 17 nt, Human
ccucucucacuccuuga

SEQ ID NO: 1217693 - RNA, 15 nt, Human
ccucucucacuccuu

SEQ ID NO: 1217694 - RNA, 14 nt, Human
ccucucucacuccu

SEQ ID NO: 1217695 - RNA, 13 nt, Human
ccucucucacucc

SEQ ID NO: 1217696 - RNA, 18 nt, Human
ccucugcugcuggcuggu

SEQ ID NO: 1217697 - RNA, 17 nt, Human
ccucugcugcuggcugg

SEQ ID NO: 1217698 - RNA, 16 nt, Human
ccucugcugcuggcug

SEQ ID NO: 1217699 - RNA, 15 nt, Human
ccucugcugcuggcu

SEQ ID NO: 1217700 - RNA, 14 nt, Human
ccucugcugcuggc

SEQ ID NO: 1217701 - RNA, 13 nt, Human
ccucugcugcugg

SEQ ID NO: 1217702 - RNA, 22 nt, Human
ccucugccugaagucacacagu

SEQ ID NO: 1217703 - RNA, 13 nt, Human
ccuggccugagcu

SEQ ID NO: 1217704 - RNA, 16 nt, Human
ccuggccucugcacuc

SEQ ID NO: 1217705 - RNA, 15 nt, Human
ccuggccucugcacu

SEQ ID NO: 1217706 - RNA, 14 nt, Human
ccuggccucugcac

SEQ ID NO: 1217707 - RNA, 12 nt, Human
ccuggccucugc

SEQ ID NO: 1217708 - RNA, 21 nt, Human
ccugcuggguguggcgcagca

SEQ ID NO: 1217709 - RNA, 20 nt, Human
ccugcuggguguggcgcagc

SEQ ID NO: 1217710 - RNA, 14 nt, Human
ccugcugggugugg

SEQ ID NO: 1217711 - RNA, 12 nt, Human
ccugcugggugu

SEQ ID NO: 1217712 - RNA, 18 nt, Human
ccugcccaggccccugcc

SEQ ID NO: 1217713 - RNA, 16 nt, Human
ccugcccaggccccug

SEQ ID NO: 1217714 - RNA, 15 nt, Human
ccugcccaggccccu

SEQ ID NO: 1217715 - RNA, 14 nt, Human
ccugcccaggcccc

SEQ ID NO: 1217716 - RNA, 17 nt, Human
ccuggaguucugguucc

SEQ ID NO: 1217717 - RNA, 16 nt, Human
ccuggaguucugguuc

SEQ ID NO: 1217718 - RNA, 15 nt, Human
ccuggaguucugguu

SEQ ID NO: 1217719 - RNA, 19 nt, Human
ccuggaugcagccucacag

SEQ ID NO: 1217720 - RNA, 17 nt, Human
ccuggaugcagccucac

SEQ ID NO: 1217721 - RNA, 14 nt, Human
ccuggaugcagccu

SEQ ID NO: 1217722 - RNA, 13 nt, Human
ccuggaugcagcc

SEQ ID NO: 1217723 - RNA, 18 nt, Human
ccuggcacccggccccug

SEQ ID NO: 1217724 - RNA, 23 nt, Human
cccuucugacccaugcugcccug

SEQ ID NO: 1217725 - RNA, 22 nt, Human
cccuucugacccaugcugcccu

SEQ ID NO: 1217726 - RNA, 21 nt, Human
cccuucugacccaugcugccc

SEQ ID NO: 1217727 - RNA, 18 nt, Human
cccuucgcuccugugucu

SEQ ID NO: 1217728 - RNA, 16 nt, Human
cccuucgcuccugugu

SEQ ID NO: 1217729 - RNA, 16 nt, Human
cccuucuaccuuccug

SEQ ID NO: 1217730 - RNA, 17 nt, Human
ccgccaaggcuggggga

SEQ ID NO: 1217731 - RNA, 16 nt, Human
ccgacccuugccgucu

SEQ ID NO: 1217732 - RNA, 20 nt, Human
ccgaauagcugggacuacag

SEQ ID NO: 1217733 - RNA, 20 nt, Human
ccgcccaggcuuagucacug

SEQ ID NO: 1217734 - RNA, 16 nt, Human
ccgccaugcuccuggc

SEQ ID NO: 1217735 - RNA, 16 nt, Human
cccuggcagccccugu

SEQ ID NO: 1217736 - RNA, 14 nt, Human
cccuggcagccccu

SEQ ID NO: 1217737 - RNA, 13 nt, Human
cccuggcagcccc

SEQ ID NO: 1217738 - RNA, 12 nt, Human
cccuggcagccc

SEQ ID NO: 1217739 - RNA, 21 nt, Human
cccugcccugugggcccccaa

SEQ ID NO: 1217740 - RNA, 20 nt, Human
cccugcccugugggccccca

SEQ ID NO: 1217741 - RNA, 16 nt, Human
cccugcccugugggcc

SEQ ID NO: 1217742 - RNA, 15 nt, Human
cccugcccugugggc

SEQ ID NO: 1217743 - RNA, 14 nt, Human
cccugcccuguggg

SEQ ID NO: 1217744 - RNA, 13 nt, Human
cccugcccugugg

SEQ ID NO: 1217745 - RNA, 12 nt, Human
cccugcccugug

SEQ ID NO: 1217746 - RNA, 17 nt, Human
ccuagcacuuugggagg

SEQ ID NO: 1217747 - RNA, 23 nt, Human
ccuaggcauuugcugaauacaga

SEQ ID NO: 1217748 - RNA, 12 nt, Human
ccggcuccaggc

SEQ ID NO: 1217749 - RNA, 22 nt, Human
ccucagccucccaaagugcugg

SEQ ID NO: 1217750 - RNA, 11 nt, Human
ccucagccucc

SEQ ID NO: 1217751 - RNA, 19 nt, Human
ccucaacucuccuccagag

SEQ ID NO: 1217752 - RNA, 15 nt, Human
ccucaagagaaggca

SEQ ID NO: 1217753 - RNA, 15 nt, Human
ccucaacucuccucc

SEQ ID NO: 1217754 - RNA, 22 nt, Human
ccucccaaggggcccaaauucu

SEQ ID NO: 1217755 - RNA, 19 nt, Human
ccucauguucuuaauucuu

SEQ ID NO: 1217756 - RNA, 18 nt, Human
ccucauuagcauuuugcu

SEQ ID NO: 1217757 - RNA, 13 nt, Human
ccucauguucuua

SEQ ID NO: 1217758 - RNA, 22 nt, Human
ccucagccucccgaauagcugg

SEQ ID NO: 1217759 - RNA, 23 nt, Human
ccucagccucccaaagugcuggg

SEQ ID NO: 1217760 - RNA, 11 nt, Human
auucuuuccug

SEQ ID NO: 1217761 - RNA, 14 nt, Human
auucuucugcuuca

SEQ ID NO: 1217762 - RNA, 12 nt, Human
auucuucugcuu

SEQ ID NO: 1217763 - RNA, 11 nt, Human
auucuucugcu

SEQ ID NO: 1217764 - RNA, 13 nt, Human
auucuuuccugag

SEQ ID NO: 1217765 - RNA, 22 nt, Human
auugcuacuguccuacccaccc

SEQ ID NO: 1217766 - RNA, 20 nt, Human
auugcuacuguccuacccac

SEQ ID NO: 1217767 - RNA, 15 nt, Human
auugcuacuguccua

SEQ ID NO: 1217768 - RNA, 17 nt, Human
auugauaugcuuauaca

SEQ ID NO: 1217769 - RNA, 21 nt, Human
auugauaagaaccuuuugagu

SEQ ID NO: 1217770 - RNA, 16 nt, Human
auuguuagucucuuga

SEQ ID NO: 1217771 - RNA, 23 nt, Human
auugugucucuugguccugcugc

SEQ ID NO: 1217772 - RNA, 21 nt, Human
auugugucucuugguccugcu

SEQ ID NO: 1217773 - RNA, 18 nt, Human
auugcuugagcucaggag

SEQ ID NO: 1217774 - RNA, 14 nt, Human
auugcuugagcuca

SEQ ID NO: 1217775 - RNA, 12 nt, Human
auugcugcuuga

SEQ ID NO: 1217776 - RNA, 23 nt, Human
auugcugauggugcaaugaccuu

SEQ ID NO: 1217777 - RNA, 19 nt, Human
auugcugauggugcaauga

SEQ ID NO: 1217778 - RNA, 18 nt, Human
auugcugauggugcaaug

SEQ ID NO: 1217779 - RNA, 16 nt, Human
auugcugauggugcaa

SEQ ID NO: 1217780 - RNA, 15 nt, Human
auugcugauggugca

SEQ ID NO: 1217781 - RNA, 17 nt, Human
auuacaggaaguacugg

SEQ ID NO: 1217782 - RNA, 22 nt, Human
auuacaagcgugagccacugca

SEQ ID NO: 1217783 - RNA, 18 nt, Human
auguuugccucugccucu

SEQ ID NO: 1217784 - RNA, 23 nt, Human
auuaugcaugaaguaauaugcac

SEQ ID NO: 1217785 - RNA, 21 nt, Human
auuaggugugacugaauuucu

SEQ ID NO: 1217786 - RNA, 18 nt, Human
auuaggugugacugaauu

SEQ ID NO: 1217787 - RNA, 16 nt, Human
auuaggugugacugaa

SEQ ID NO: 1217788 - RNA, 19 nt, Human
auucauaaugacuuaagca

SEQ ID NO: 1217789 - RNA, 15 nt, Human
auucauaaugacuua

SEQ ID NO: 1217790 - RNA, 14 nt, Human
auucauaaugacuu

SEQ ID NO: 1217791 - RNA, 23 nt, Human
auuuguuugaacugauaaagaug

SEQ ID NO: 1217792 - RNA, 22 nt, Human
auuuguuugaacugauaaagau

SEQ ID NO: 1217793 - RNA, 17 nt, Human
auuugugauacaaugcu

SEQ ID NO: 1217794 - RNA, 20 nt, Human
auuugugauacaaugcugug

SEQ ID NO: 1217795 - RNA, 13 nt, Human
auuugcuccuuuc

SEQ ID NO: 1217796 - RNA, 21 nt, Human
caaaccaucauugaaaucuuu

SEQ ID NO: 1217797 - RNA, 18 nt, Human
caaaagaugcuucucacu

SEQ ID NO: 1217798 - RNA, 16 nt, Human
caaaagaugcuucuca

SEQ ID NO: 1217799 - RNA, 20 nt, Human
caaagauauuuugcuuugug

SEQ ID NO: 1217800 - RNA, 20 nt, Human
caacaccucugcacaagcug

SEQ ID NO: 1217801 - RNA, 22 nt, Human
caaauggaaaugggcagagcag

SEQ ID NO: 1217802 - RNA, 21 nt, Human
caaauggaaaugggcagagca

SEQ ID NO: 1217803 - RNA, 20 nt, Human
caaauggaaaugggcagagc

SEQ ID NO: 1217804 - RNA, 22 nt, Human
caacacucacauuuauucugcu

SEQ ID NO: 1217805 - RNA, 13 nt, Human
caaagugcuggga

SEQ ID NO: 1217806 - RNA, 22 nt, Human
caaaguagaagucuuagaugua

SEQ ID NO: 1217807 - RNA, 21 nt, Human
caaaguagaagucuuagaugu

SEQ ID NO: 1217808 - RNA, 14 nt, Human
caaaguagaagucu

SEQ ID NO: 1217809 - RNA, 17 nt, Human
caaagcagugcaugcug

SEQ ID NO: 1217810 - RNA, 15 nt, Human
caaagcagugcaugc

SEQ ID NO: 1217811 - RNA, 23 nt, Human
caaagauauuuugcuuugugauu

SEQ ID NO: 1217812 - RNA, 22 nt, Human
caaagauauuuugcuuugugau

SEQ ID NO: 1217813 - RNA, 14 nt, Human
cacugcagccucaa

SEQ ID NO: 1217814 - RNA, 13 nt, Human
cacugcagccuca

SEQ ID NO: 1217815 - RNA, 16 nt, Human
cacugcauguuuguga

SEQ ID NO: 1217816 - RNA, 12 nt, Human
cacugcagccuc

SEQ ID NO: 1217817 - RNA, 20 nt, Human
cacugcacuccagccugggu

SEQ ID NO: 1217818 - RNA, 19 nt, Human
cacugcacuccagccuggg

SEQ ID NO: 1217819 - RNA, 18 nt, Human
cacugcacuccagccugg

SEQ ID NO: 1217820 - RNA, 16 nt, Human
cacugcacuccagccu

SEQ ID NO: 1217821 - RNA, 15 nt, Human
cacugcacuccagcc

SEQ ID NO: 1217822 - RNA, 18 nt, Human
cacuuacacuuuaugcac

SEQ ID NO: 1217823 - RNA, 16 nt, Human
cacuuacacuuuaugc

SEQ ID NO: 1217824 - RNA, 15 nt, Human
cacuccccugcuggg

SEQ ID NO: 1217825 - RNA, 14 nt, Human
cacuccccugcugg

SEQ ID NO: 1217826 - RNA, 13 nt, Human
cacuccccugcug

SEQ ID NO: 1217827 - RNA, 12 nt, Human
cacuccccugcu

SEQ ID NO: 1217828 - RNA, 16 nt, Human
cacuccagccugggug

SEQ ID NO: 1217829 - RNA, 11 nt, Human
caccccagccc

SEQ ID NO: 1217830 - RNA, 12 nt, Human
caccccagcccc

SEQ ID NO: 1217831 - RNA, 16 nt, Human
caccugccccucaacu

SEQ ID NO: 1217832 - RNA, 15 nt, Human
caccugccccucaac

SEQ ID NO: 1217833 - RNA, 14 nt, Human
caccugccccucaa

SEQ ID NO: 1217834 - RNA, 14 nt, Human
caccucagccuccc

SEQ ID NO: 1217835 - RNA, 13 nt, Human
caccucagccucc

SEQ ID NO: 1217836 - RNA, 17 nt, Human
cacccuggggagaaagu

SEQ ID NO: 1217837 - RNA, 16 nt, Human
cacccuggggagaaag

SEQ ID NO: 1217838 - RNA, 15 nt, Human
cacccuggggagaaa

SEQ ID NO: 1217839 - RNA, 17 nt, Human
cacccugaaagcccuga

SEQ ID NO: 1217840 - RNA, 14 nt, Human
cacccucaggcagg

SEQ ID NO: 1217841 - RNA, 24 nt, Human
caccugccuguugggccaggagcc

SEQ ID NO: 1217842 - RNA, 19 nt, Human
caccugccuguugggccag

SEQ ID NO: 1217843 - RNA, 17 nt, Human
caccugccuguugggcc

SEQ ID NO: 1217844 - RNA, 13 nt, Human
caccuuggcugca

SEQ ID NO: 1217845 - RNA, 15 nt, Human
caccuuggcucaagu

SEQ ID NO: 1217846 - RNA, 14 nt, Human
caccuuggcugcag

SEQ ID NO: 1217847 - RNA, 13 nt, Human
cacagacccugcc

SEQ ID NO: 1217848 - RNA, 11 nt, Human
cacagccucug

SEQ ID NO: 1217849 - RNA, 21 nt, Human
cacagacauacuaaccagcag

SEQ ID NO: 1217850 - RNA, 19 nt, Human
cacagacauacuaaccagc

SEQ ID NO: 1217851 - RNA, 19 nt, Human
cacagaaaauucuucucca

SEQ ID NO: 1217852 - RNA, 23 nt, Human
cacagaaaauggaagacagcucu

SEQ ID NO: 1217853 - RNA, 22 nt, Human
cacagaaaauggaagacagcuc

SEQ ID NO: 1217854 - RNA, 20 nt, Human
cacagaaaauggaagacagc

SEQ ID NO: 1217855 - RNA, 19 nt, Human
cacagaaaauggaagacag

SEQ ID NO: 1217856 - RNA, 18 nt, Human
cacagaaaauggaagaca

SEQ ID NO: 1217857 - RNA, 22 nt, Human
cacacaugagcaucaggccagg

SEQ ID NO: 1217858 - RNA, 21 nt, Human
cacacaugagcaucaggccag

SEQ ID NO: 1217859 - RNA, 20 nt, Human
cacacaugagcaucaggcca

SEQ ID NO: 1217860 - RNA, 15 nt, Human
cacacauacacacac

SEQ ID NO: 1217861 - RNA, 23 nt, Human
cacacagugagucgaggacaggg

SEQ ID NO: 1217862 - RNA, 21 nt, Human
cacacagugagucgaggacag

SEQ ID NO: 1217863 - RNA, 18 nt, Human
cacacagugagucgagga

SEQ ID NO: 1217864 - RNA, 23 nt, Human
cacacaguauuacuucugcuaca

SEQ ID NO: 1217865 - RNA, 20 nt, Human
cacacaguauuacuucugcu

SEQ ID NO: 1217866 - RNA, 21 nt, Human
cacaguauuacuucugcuaca

SEQ ID NO: 1217867 - RNA, 20 nt, Human
cacaguauuacuucugcuac

SEQ ID NO: 1217868 - RNA, 19 nt, Human
cacaggggaaaagaggagu

SEQ ID NO: 1217869 - RNA, 18 nt, Human
cacaggggaaaagaggag

SEQ ID NO: 1217870 - RNA, 17 nt, Human
cacaggggaaaagagga

SEQ ID NO: 1217871 - RNA, 20 nt, Human
cacacagcucuguccuggga

SEQ ID NO: 1217872 - RNA, 17 nt, Human
cacacagcucuguccug

SEQ ID NO: 1217873 - RNA, 23 nt, Human
cacaagcugcacccucaggcagg

SEQ ID NO: 1217874 - RNA, 17 nt, Human
cacaagcugcacccuca

SEQ ID NO: 1217875 - RNA, 23 nt, Human
cacaagcuccaagcucccaggca

SEQ ID NO: 1217876 - RNA, 17 nt, Human
cacaagcuccaagcucc

SEQ ID NO: 1217877 - RNA, 17 nt, Human
cacaagagcccaggccu

SEQ ID NO: 1217878 - RNA, 15 nt, Human
cacaagcuccaagcu

SEQ ID NO: 1217879 - RNA, 14 nt, Human
cacaagcuccaagc

SEQ ID NO: 1217880 - RNA, 16 nt, Human
cacaagagcccaggcc

SEQ ID NO: 1217881 - RNA, 14 nt, Human
cacaagagcccagg

SEQ ID NO: 1217882 - RNA, 13 nt, Human
caauuuauuaugg

SEQ ID NO: 1217883 - RNA, 12 nt, Human
caauggcagccu

SEQ ID NO: 1217884 - RNA, 11 nt, Human
caauggcagcc

SEQ ID NO: 1217885 - RNA, 19 nt, Human
caauaaagcagcguuucua

SEQ ID NO: 1217886 - RNA, 17 nt, Human
caagucaagugaaaaag

SEQ ID NO: 1217887 - RNA, 13 nt, Human
caagucaagugaa

SEQ ID NO: 1217888 - RNA, 16 nt, Human
caaggccaaaggaagc

SEQ ID NO: 1217889 - RNA, 15 nt, Human
caaggccaaaggaag

SEQ ID NO: 1217890 - RNA, 18 nt, Human
caaggccaaaggaagcac

SEQ ID NO: 1217891 - RNA, 17 nt, Human
caaggccaaaggaagca

SEQ ID NO: 1217892 - RNA, 20 nt, Human
caagcugcacccucaggcag

SEQ ID NO: 1217893 - RNA, 18 nt, Human
caagcugcacccucaggc

SEQ ID NO: 1217894 - RNA, 14 nt, Human
caagcugcacccuc

SEQ ID NO: 1217895 - RNA, 15 nt, Human
caagcucugcuccuc

SEQ ID NO: 1217896 - RNA, 14 nt, Human
caagcucugcuccu

SEQ ID NO: 1217897 - RNA, 17 nt, Human
caagcuccaagcuccca

SEQ ID NO: 1217898 - RNA, 12 nt, Human
caagcuccaagc

SEQ ID NO: 1217899 - RNA, 13 nt, Human
caagcucugcucc

SEQ ID NO: 1217900 - RNA, 17 nt, Human
cagucaccccggccacc

SEQ ID NO: 1217901 - RNA, 16 nt, Human
cagucaccccggccac

SEQ ID NO: 1217902 - RNA, 20 nt, Human
caguaaaugggggugcauuu

SEQ ID NO: 1217903 - RNA, 19 nt, Human
caguaaaugggggugcauu

SEQ ID NO: 1217904 - RNA, 18 nt, Human
caguaaaugggggugcau

SEQ ID NO: 1217905 - RNA, 14 nt, Human
caggugcugccauc

SEQ ID NO: 1217906 - RNA, 13 nt, Human
caggugcugccau

SEQ ID NO: 1217907 - RNA, 21 nt, Human
caggguuggccccugcccggc

SEQ ID NO: 1217908 - RNA, 17 nt, Human
caggguuggccccugcc

SEQ ID NO: 1217909 - RNA, 23 nt, Human
cagguuuuuggucugacccacug

SEQ ID NO: 1217910 - RNA, 16 nt, Human
caggguuggccccugc

SEQ ID NO: 1217911 - RNA, 15 nt, Human
caggguuggccccug

SEQ ID NO: 1217912 - RNA, 21 nt, Human
cagggucucuaccauccccug

SEQ ID NO: 1217913 - RNA, 23 nt, Human
cagggucucacucugucgcccag

SEQ ID NO: 1217914 - RNA, 20 nt, Human
caggcugggagagccuucca

SEQ ID NO: 1217915 - RNA, 19 nt, Human
caggcugggagagccuucc

SEQ ID NO: 1217916 - RNA, 18 nt, Human
caggcugggagagccuuc

SEQ ID NO: 1217917 - RNA, 16 nt, Human
caggcugggagagccu

SEQ ID NO: 1217918 - RNA, 19 nt, Human
caggcuggcgugcaguggu

SEQ ID NO: 1217919 - RNA, 18 nt, Human
caggcuggcgugcagugg

SEQ ID NO: 1217920 - RNA, 17 nt, Human
caggcuggcgugcagug

SEQ ID NO: 1217921 - RNA, 23 nt, Human
caggccugggggcugggcagagg

SEQ ID NO: 1217922 - RNA, 22 nt, Human
caggccugggggcugggcagag

SEQ ID NO: 1217923 - RNA, 20 nt, Human
caggccugggggcugggcag

SEQ ID NO: 1217924 - RNA, 15 nt, Human
caggcugggcuucag

SEQ ID NO: 1217925 - RNA, 14 nt, Human
caggcugggcuuca

SEQ ID NO: 1217926 - RNA, 15 nt, Human
cagggcucagcgggg

SEQ ID NO: 1217927 - RNA, 12 nt, Human
cagggcucagcg

SEQ ID NO: 1217928 - RNA, 20 nt, Human
cagggcucagcggggacagc

SEQ ID NO: 1217929 - RNA, 16 nt, Human
cagggagggcuucugc

SEQ ID NO: 1217930 - RNA, 23 nt, Human
caggaaaggcuccaggagcagcc

SEQ ID NO: 1217931 - RNA, 22 nt, Human
caggaaaggcuccaggagcagc

SEQ ID NO: 1217932 - RNA, 21 nt, Human
caggaaaggcuccaggagcag

SEQ ID NO: 1217933 - RNA, 20 nt, Human
caggaaaagcugcugacagu

SEQ ID NO: 1217934 - RNA, 19 nt, Human
caggaaaagcugcugacag

SEQ ID NO: 1217935 - RNA, 19 nt, Human
cagcuguucagcugguuga

SEQ ID NO: 1217936 - RNA, 16 nt, Human
cagcuguucagcuggu

SEQ ID NO: 1217937 - RNA, 15 nt, Human
cagcuguucagcugg

SEQ ID NO: 1217938 - RNA, 13 nt, Human
caggaccucaggu

SEQ ID NO: 1217939 - RNA, 21 nt, Human
caggaccagggauuuccauga

SEQ ID NO: 1217940 - RNA, 13 nt, Human
caggaccagggau

SEQ ID NO: 1217941 - RNA, 16 nt, Human
caggccaggcccucug

SEQ ID NO: 1217942 - RNA, 15 nt, Human
caggccaggcccucu

SEQ ID NO: 1217943 - RNA, 14 nt, Human
caggccaggcccuc

SEQ ID NO: 1217944 - RNA, 13 nt, Human
caggccaggcccu

SEQ ID NO: 1217945 - RNA, 17 nt, Human
caggccagcugcuuggg

SEQ ID NO: 1217946 - RNA, 15 nt, Human
caggccagcugcuug

SEQ ID NO: 1217947 - RNA, 13 nt, Human
caggccagcugcu

SEQ ID NO: 1217948 - RNA, 20 nt, Human
caggcaaugcuggcuguugg

SEQ ID NO: 1217949 - RNA, 19 nt, Human
caggcaaugcuggcuguug

SEQ ID NO: 1217950 - RNA, 13 nt, Human
caggaggccagcc

SEQ ID NO: 1217951 - RNA, 12 nt, Human
caggaggccagc

SEQ ID NO: 1217952 - RNA, 14 nt, Human
caggaggccagccu

SEQ ID NO: 1217953 - RNA, 21 nt, Human
caggcaaugcuggcuguuggc

SEQ ID NO: 1217954 - RNA, 23 nt, Human
cagccgccaugcuccuggcccac

SEQ ID NO: 1217955 - RNA, 15 nt, Human
cagcccuuagcaggg

SEQ ID NO: 1217956 - RNA, 13 nt, Human
cagcccuuagcag

SEQ ID NO: 1217957 - RNA, 17 nt, Human
cagccucugaaaaccaa

SEQ ID NO: 1217958 - RNA, 14 nt, Human
cagcggggacagcu

SEQ ID NO: 1217959 - RNA, 19 nt, Human
cagcguuucuaugacacau

SEQ ID NO: 1217960 - RNA, 16 nt, Human
cagcguuucuaugaca

SEQ ID NO: 1217961 - RNA, 14 nt, Human
cagcguuucuauga

SEQ ID NO: 1217962 - RNA, 24 nt, Human
cagccccauucugccugcccaggc

SEQ ID NO: 1217963 - RNA, 23 nt, Human
cagccccauucugccugcccagg

SEQ ID NO: 1217964 - RNA, 22 nt, Human
cagccccauucugccugcccag

SEQ ID NO: 1217965 - RNA, 20 nt, Human
cagccccauucugccugccc

SEQ ID NO: 1217966 - RNA, 19 nt, Human
cagccccauucugccugcc

SEQ ID NO: 1217967 - RNA, 18 nt, Human
cagcauauucaggaagcu

SEQ ID NO: 1217968 - RNA, 17 nt, Human
cagcauauucaggaagc

SEQ ID NO: 1217969 - RNA, 16 nt, Human
cagcauauucaggaag

SEQ ID NO: 1217970 - RNA, 19 nt, Human
cagauuucacucuccuugg

SEQ ID NO: 1217971 - RNA, 18 nt, Human
cagauuucacucuccuug

SEQ ID NO: 1217972 - RNA, 16 nt, Human
cagauuucacucuccu

SEQ ID NO: 1217973 - RNA, 15 nt, Human
cagauuucacucucc

SEQ ID NO: 1217974 - RNA, 22 nt, Human
cagagcuacacaggggaaaaga

SEQ ID NO: 1217975 - RNA, 17 nt, Human
cagagcuacacagggga

SEQ ID NO: 1217976 - RNA, 23 nt, Human
cagagagggugggagugggccca

SEQ ID NO: 1217977 - RNA, 14 nt, Human
cagagccugcaguu

SEQ ID NO: 1217978 - RNA, 22 nt, Human
cagagagggugggagugggccc

SEQ ID NO: 1217979 - RNA, 20 nt, Human
cagagagggugggagugggc

SEQ ID NO: 1217980 - RNA, 16 nt, Human
cagagagggugggagu

SEQ ID NO: 1217981 - RNA, 22 nt, Human
cagagacuccugcaggcagcca

SEQ ID NO: 1217982 - RNA, 21 nt, Human
cagagacuccugcaggcagcc

SEQ ID NO: 1217983 - RNA, 23 nt, Human
cagagacuccugcaggcagccag

SEQ ID NO: 1217984 - RNA, 20 nt, Human
cagagacuccugcaggcagc

SEQ ID NO: 1217985 - RNA, 17 nt, Human
cauaaugcgugcauacc

SEQ ID NO: 1217986 - RNA, 14 nt, Human
cauaaugcgugcau

SEQ ID NO: 1217987 - RNA, 21 nt, Human
caguuuguuaguaugaggcau

SEQ ID NO: 1217988 - RNA, 21 nt, Human
cauauuaccacagacauacua

SEQ ID NO: 1217989 - RNA, 20 nt, Human
cauauuaccacagacauacu

SEQ ID NO: 1217990 - RNA, 17 nt, Human
cauauuaccacagacau

SEQ ID NO: 1217991 - RNA, 22 nt, Human
cauauuaccacagacauacuaa

SEQ ID NO: 1217992 - RNA, 15 nt, Human
cauacaauuccaaac

SEQ ID NO: 1217993 - RNA, 23 nt, Human
cauaaugcgugcauaccacuuuu

SEQ ID NO: 1217994 - RNA, 21 nt, Human
cauaaugcgugcauaccacuu

SEQ ID NO: 1217995 - RNA, 18 nt, Human
cagucaccccggccaccu

SEQ ID NO: 1217996 - RNA, 19 nt, Human
cagucaccccggccaccug

SEQ ID NO: 1217997 - RNA, 17 nt, Human
caucccagccccaauga

SEQ ID NO: 1217998 - RNA, 16 nt, Human
caucccagccccaaug

SEQ ID NO: 1217999 - RNA, 14 nt, Human
caucccagccccaa

SEQ ID NO: 1218000 - RNA, 13 nt, Human
caucccagcccca

SEQ ID NO: 1218001 - RNA, 23 nt, Human
caucaggccaggcccucugccca

SEQ ID NO: 1218002 - RNA, 22 nt, Human
caucaggccaggcccucugccc

SEQ ID NO: 1218003 - RNA, 21 nt, Human
caucaggccaggcccucugcc

SEQ ID NO: 1218004 - RNA, 14 nt, Human
caucaggccaggcc

SEQ ID NO: 1218005 - RNA, 13 nt, Human
caucaggccaggc

SEQ ID NO: 1218006 - RNA, 19 nt, Human
caucagcacgauuucuguu

SEQ ID NO: 1218007 - RNA, 18 nt, Human
caucagcacgauuucugu

SEQ ID NO: 1218008 - RNA, 17 nt, Human
caucagcacgauuucug

SEQ ID NO: 1218009 - RNA, 22 nt, Human
caucuuagguuggcaaaaaggc

SEQ ID NO: 1218010 - RNA, 21 nt, Human
caucuuagguuggcaaaaagg

SEQ ID NO: 1218011 - RNA, 19 nt, Human
caucugugaaaggaaagag

SEQ ID NO: 1218012 - RNA, 18 nt, Human
caucugugaaaggaaaga

SEQ ID NO: 1218013 - RNA, 18 nt, Human
caugacacgaauauugcu

SEQ ID NO: 1218014 - RNA, 17 nt, Human
caugacacgaauauugc

SEQ ID NO: 1218015 - RNA, 14 nt, Human
caugacacgaauau

SEQ ID NO: 1218016 - RNA, 22 nt, Human
caugcaaggucauuuuuuuuaa

SEQ ID NO: 1218017 - RNA, 18 nt, Human
caugcaaggucauuuuuu

SEQ ID NO: 1218018 - RNA, 17 nt, Human
caugcaaggucauuuuu

SEQ ID NO: 1218019 - RNA, 18 nt, Human
caugcugcccugugagua

SEQ ID NO: 1218020 - RNA, 16 nt, Human
caugcugcccugugag

SEQ ID NO: 1218021 - RNA, 19 nt, Human
cauggccuuugcuugaaag

SEQ ID NO: 1218022 - RNA, 22 nt, Human
cauggccuuugcuugaaagaaa

SEQ ID NO: 1218023 - RNA, 16 nt, Human
cauuuauucugcucac

SEQ ID NO: 1218024 - RNA, 17 nt, Human
ccaaaacucuccucugc

SEQ ID NO: 1218025 - RNA, 23 nt, Human
cauuuggugguuucagaaaugug

SEQ ID NO: 1218026 - RNA, 22 nt, Human
cauuuggugguuucagaaaugu

SEQ ID NO: 1218027 - RNA, 18 nt, Human
cauugcugggcuugucug

SEQ ID NO: 1218028 - RNA, 21 nt, Human
cauugcggacagccacggcca

SEQ ID NO: 1218029 - RNA, 17 nt, Human
cauugcggacagccacg

SEQ ID NO: 1218030 - RNA, 15 nt, Human
cauugcggacagcca

SEQ ID NO: 1218031 - RNA, 14 nt, Human
cauugcggacagcc

SEQ ID NO: 1218032 - RNA, 22 nt, Human
cauggcugccaaugggagcuca

SEQ ID NO: 1218033 - RNA, 17 nt, Human
cauuaucuagauacugu

SEQ ID NO: 1218034 - RNA, 16 nt, Human
cauuaucuagauacug

SEQ ID NO: 1218035 - RNA, 15 nt, Human
cauguucucugagga

SEQ ID NO: 1218036 - RNA, 20 nt, Human
cauucuccuuguguuacuaa

SEQ ID NO: 1218037 - RNA, 16 nt, Human
cauucuccuuguguua

SEQ ID NO: 1218038 - RNA, 18 nt, Human
cauuaucuagauacugua

SEQ ID NO: 1218039 - RNA, 20 nt, Human
ccaaaacucuccucugcugc

SEQ ID NO: 1218040 - RNA, 23 nt, Human
ccaaugcacuuuguucuggcucu

SEQ ID NO: 1218041 - RNA, 22 nt, Human
ccaaugcacuuuguucuggcuc

SEQ ID NO: 1218042 - RNA, 20 nt, Human
ccaaugcacuuuguucuggc

SEQ ID NO: 1218043 - RNA, 20 nt, Human
ccaauguucucucuucucca

SEQ ID NO: 1218044 - RNA, 17 nt, Human
ccaccaucaagccacca

SEQ ID NO: 1218045 - RNA, 16 nt, Human
ccaccaucaagccacc

SEQ ID NO: 1218046 - RNA, 17 nt, Human
ccaccgcagacaggacc

SEQ ID NO: 1218047 - RNA, 14 nt, Human
ccaccgcagacagg

SEQ ID NO: 1218048 - RNA, 18 nt, Human
ccaccaucaccagacagg

SEQ ID NO: 1218049 - RNA, 20 nt, Human
ccaccaucaagccaccaaca

SEQ ID NO: 1218050 - RNA, 15 nt, Human
ccaccuuggcucaag

SEQ ID NO: 1218051 - RNA, 14 nt, Human
ccaccuuggcucaa

SEQ ID NO: 1218052 - RNA, 19 nt, Human
ccaccgcagacaggaccag

SEQ ID NO: 1218053 - RNA, 18 nt, Human
ccaccgcagacaggacca

SEQ ID NO: 1218054 - RNA, 23 nt, Human
ggcucagcggggacagcuccuuc

SEQ ID NO: 1218055 - RNA, 22 nt, Human
ggcucagcggggacagcuccuu

SEQ ID NO: 1218056 - RNA, 21 nt, Human
ggcucagcggggacagcuccu

SEQ ID NO: 1218057 - RNA, 23 nt, Human
ggcucagcaaaagaugcuucuca

SEQ ID NO: 1218058 - RNA, 19 nt, Human
ggcgugcaguggugcgauc

SEQ ID NO: 1218059 - RNA, 16 nt, Human
ggcucacugcagccuc

SEQ ID NO: 1218060 - RNA, 17 nt, Human
ggcucacugcagccuca

SEQ ID NO: 1218061 - RNA, 15 nt, Human
ggccugagcugggau

SEQ ID NO: 1218062 - RNA, 14 nt, Human
ggccuuuggcuuca

SEQ ID NO: 1218063 - RNA, 16 nt, Human
ggccuucucugaagga

SEQ ID NO: 1218064 - RNA, 15 nt, Human
ggccuucucugaagg

SEQ ID NO: 1218065 - RNA, 13 nt, Human
ggccuuuggcuuc

SEQ ID NO: 1218066 - RNA, 12 nt, Human
ggccuucucuga

SEQ ID NO: 1218067 - RNA, 21 nt, Human
ggccugugucuaguuguuuga

SEQ ID NO: 1218068 - RNA, 21 nt, Human
ggccuggccagaugcaccagc

SEQ ID NO: 1218069 - RNA, 17 nt, Human
ggcccuucucuccagcc

SEQ ID NO: 1218070 - RNA, 16 nt, Human
ggcccuucucuccagc

SEQ ID NO: 1218071 - RNA, 18 nt, Human
ggcccuucucuccagccc

SEQ ID NO: 1218072 - RNA, 19 nt, Human
ggcccuucucuccagcccc

SEQ ID NO: 1218073 - RNA, 17 nt, Human
ggcagugggagcugccu

SEQ ID NO: 1218074 - RNA, 24 nt, Human
ggcacugcuuccagugaggcucug

SEQ ID NO: 1218075 - RNA, 16 nt, Human
ggcaccagcagccugg

SEQ ID NO: 1218076 - RNA, 15 nt, Human
ggcaccagcagccug

SEQ ID NO: 1218077 - RNA, 18 nt, Human
ggcauccaguaucuugaa

SEQ ID NO: 1218078 - RNA, 19 nt, Human
ggcagugggagcugccugu

SEQ ID NO: 1218079 - RNA, 18 nt, Human
ggcagugggagcugccug

SEQ ID NO: 1218080 - RNA, 16 nt, Human
ggccagugugacaagg

SEQ ID NO: 1218081 - RNA, 18 nt, Human
ggccaggcuggucucaaa

SEQ ID NO: 1218082 - RNA, 16 nt, Human
ggccaggcuggucuca

SEQ ID NO: 1218083 - RNA, 14 nt, Human
ggccaggcuggucu

SEQ ID NO: 1218084 - RNA, 21 nt, Human
ggccaaacucaccugccccuc

SEQ ID NO: 1218085 - RNA, 17 nt, Human
ggccaaacucaccugcc

SEQ ID NO: 1218086 - RNA, 16 nt, Human
ggaggggggagguggg

SEQ ID NO: 1218087 - RNA, 14 nt, Human
ggaggugaccccag

SEQ ID NO: 1218088 - RNA, 14 nt, Human
ggaggucgaggcag

SEQ ID NO: 1218089 - RNA, 20 nt, Human
ggaggucaaggcugcaguga

SEQ ID NO: 1218090 - RNA, 12 nt, Human
ggaggccagccu

SEQ ID NO: 1218091 - RNA, 11 nt, Human
ggaggccagcc

SEQ ID NO: 1218092 - RNA, 23 nt, Human
ggaggaaggaaacccagcucugg

SEQ ID NO: 1218093 - RNA, 20 nt, Human
ggaggaaggaaacccagcuc

SEQ ID NO: 1218094 - RNA, 22 nt, Human
ggagcugccuguucagcuccag

SEQ ID NO: 1218095 - RNA, 21 nt, Human
ggagcugccuguucagcucca

SEQ ID NO: 1218096 - RNA, 12 nt, Human
ggagcugccugu

SEQ ID NO: 1218097 - RNA, 22 nt, Human
ggagccccgaggccuucucuga

SEQ ID NO: 1218098 - RNA, 16 nt, Human
ggagccccgaggccuu

SEQ ID NO: 1218099 - RNA, 14 nt, Human
ggauccugagccag

SEQ ID NO: 1218100 - RNA, 13 nt, Human
ggauccugagcca

SEQ ID NO: 1218101 - RNA, 15 nt, Human
ggauccuccaggugc

SEQ ID NO: 1218102 - RNA, 18 nt, Human
ggauggauuuccagccaa

SEQ ID NO: 1218103 - RNA, 16 nt, Human
ggauggggcugcaccg

SEQ ID NO: 1218104 - RNA, 15 nt, Human
ggaguucugguuccu

SEQ ID NO: 1218105 - RNA, 14 nt, Human
ggaguggccacaga

SEQ ID NO: 1218106 - RNA, 15 nt, Human
ggauguucugggaca

SEQ ID NO: 1218107 - RNA, 16 nt, Human
ggauguucugggacac

SEQ ID NO: 1218108 - RNA, 24 nt, Human
ggcacagaaaauggaagacagcuc

SEQ ID NO: 1218109 - RNA, 14 nt, Human
aaauaaugugaaac

SEQ ID NO: 1218110 - RNA, 13 nt, Human
aaauaaugugaaa

SEQ ID NO: 1218111 - RNA, 12 nt, Human
aaauaaugugaa

SEQ ID NO: 1218112 - RNA, 23 nt, Human
aaaguuucucuuuucaaaacauu

SEQ ID NO: 1218113 - RNA, 21 nt, Human
aaaguuucucuuuucaaaaca

SEQ ID NO: 1218114 - RNA, 21 nt, Human
gguucccuuugacgccauccc

SEQ ID NO: 1218115 - RNA, 22 nt, Human
gguucccuuugacgccauccca

SEQ ID NO: 1218116 - RNA, 22 nt, Human
gguucaggguuggccccugccc

SEQ ID NO: 1218117 - RNA, 21 nt, Human
gguucaggguuggccccugcc

SEQ ID NO: 1218118 - RNA, 18 nt, Human
gguucaggguuggccccu

SEQ ID NO: 1218119 - RNA, 12 nt, Human
gguguggagaag

SEQ ID NO: 1218120 - RNA, 12 nt, Human
gguguggaagag

SEQ ID NO: 1218121 - RNA, 13 nt, Human
ggugugcucugau

SEQ ID NO: 1218122 - RNA, 21 nt, Human
ggugugcggccuuuggcuuca

SEQ ID NO: 1218123 - RNA, 15 nt, Human
gguuucagaaaugug

SEQ ID NO: 1218124 - RNA, 14 nt, Human
gguuucagaaaugu

SEQ ID NO: 1218125 - RNA, 13 nt, Human
gguuucagaaaug

SEQ ID NO: 1218126 - RNA, 12 nt, Human
gguuucagaaau

SEQ ID NO: 1218127 - RNA, 20 nt, Human
ggugggaggauugcuugagc

SEQ ID NO: 1218128 - RNA, 15 nt, Human
ggugggauccuccag

SEQ ID NO: 1218129 - RNA, 14 nt, Human
ggugggauccucca

SEQ ID NO: 1218130 - RNA, 17 nt, Human
gguggggcagcuugagg

SEQ ID NO: 1218131 - RNA, 13 nt, Human
gguggggcagcuu

SEQ ID NO: 1218132 - RNA, 19 nt, Human
ggugggauccuccaggugc

SEQ ID NO: 1218133 - RNA, 18 nt, Human
ggugugagucaccaagcc

SEQ ID NO: 1218134 - RNA, 16 nt, Human
ggugugacugaauuuc

SEQ ID NO: 1218135 - RNA, 16 nt, Human
ggugucgggcaugaca

SEQ ID NO: 1218136 - RNA, 13 nt, Human
ggugucgggcaug

SEQ ID NO: 1218137 - RNA, 23 nt, Human
gguggggucacucuggcagcuca

SEQ ID NO: 1218138 - RNA, 15 nt, Human
gguggggucacucug

SEQ ID NO: 1218139 - RNA, 17 nt, Human
ggucuacacugugcuga

SEQ ID NO: 1218140 - RNA, 14 nt, Human
ggucggaaaacaug

SEQ ID NO: 1218141 - RNA, 13 nt, Human
ggucggaaaacau

SEQ ID NO: 1218142 - RNA, 13 nt, Human
aaagcaaaggaga

SEQ ID NO: 1218143 - RNA, 23 nt, Human
gguccugcugcaguugccaguca

SEQ ID NO: 1218144 - RNA, 21 nt, Human
gguccugcugcaguugccagu

SEQ ID NO: 1218145 - RNA, 20 nt, Human
ggugcaaugaccuuucaaua

SEQ ID NO: 1218146 - RNA, 19 nt, Human
ggugcaaugaccuuucaau

SEQ ID NO: 1218147 - RNA, 18 nt, Human
ggugcaaugaccuuucaa

SEQ ID NO: 1218148 - RNA, 16 nt, Human
ggugcacaagcuccaa

SEQ ID NO: 1218149 - RNA, 21 nt, Human
ggucuugaacuccuggccuca

SEQ ID NO: 1218150 - RNA, 14 nt, Human
gguggaugccuggu

SEQ ID NO: 1218151 - RNA, 21 nt, Human
gguggaugccugguggcagcu

SEQ ID NO: 1218152 - RNA, 22 nt, Human
aaagcagcguuucuaugacaca

SEQ ID NO: 1218153 - RNA, 18 nt, Human
aaagcagcguuucuauga

SEQ ID NO: 1218154 - RNA, 16 nt, Human
aaagcagcguuucuau

SEQ ID NO: 1218155 - RNA, 14 nt, Human
gguaugcaaucaaa

SEQ ID NO: 1218156 - RNA, 22 nt, Human
gguaugaucacggcucacugca

SEQ ID NO: 1218157 - RNA, 19 nt, Human
gguccacccaggagccccg

SEQ ID NO: 1218158 - RNA, 17 nt, Human
gguccacccaggagccc

SEQ ID NO: 1218159 - RNA, 16 nt, Human
gguccacccaggagcc

SEQ ID NO: 1218160 - RNA, 15 nt, Human
gguccacccaggagc

SEQ ID NO: 1218161 - RNA, 13 nt, Human
gguccacccagga

SEQ ID NO: 1218162 - RNA, 12 nt, Human
gguccacccagg

SEQ ID NO: 1218163 - RNA, 17 nt, Human
aaagacuaucuaaaugu

SEQ ID NO: 1218164 - RNA, 22 nt, Human
aaacuuuaccuuuuuuauacau

SEQ ID NO: 1218165 - RNA, 15 nt, Human
gguccauagagagca

SEQ ID NO: 1218166 - RNA, 18 nt, Human
aaacuuuacuauggcccu

SEQ ID NO: 1218167 - RNA, 12 nt, Human
aaacuuuacuau

SEQ ID NO: 1218168 - RNA, 17 nt, Human
ggguguggcgcagcaua

SEQ ID NO: 1218169 - RNA, 12 nt, Human
ggguggugaccu

SEQ ID NO: 1218170 - RNA, 20 nt, Human
ggguggggaccucaggccug

SEQ ID NO: 1218171 - RNA, 19 nt, Human
ggguggcaccagcagccug

SEQ ID NO: 1218172 - RNA, 15 nt, Human
ggguggcaccagcag

SEQ ID NO: 1218173 - RNA, 17 nt, Human
ggguggaugccuggugg

SEQ ID NO: 1218174 - RNA, 13 nt, Human
ggguggaugccug

SEQ ID NO: 1218175 - RNA, 18 nt, Human
gguaacuagggaagauaa

SEQ ID NO: 1218176 - RNA, 20 nt, Human
gguaacaggcagauacagga

SEQ ID NO: 1218177 - RNA, 14 nt, Human
gguaacaggcagau

SEQ ID NO: 1218178 - RNA, 17 nt, Human
ggguuucuaaagcugcc

SEQ ID NO: 1218179 - RNA, 18 nt, Human
gggcugcaugcgggcuuc

SEQ ID NO: 1218180 - RNA, 21 nt, Human
gggcugcaugcgggcuuccuc

SEQ ID NO: 1218181 - RNA, 18 nt, Human
gggcucagcaaaagaugc

SEQ ID NO: 1218182 - RNA, 22 nt, Human
gggcugcaccggcuggccuggc

SEQ ID NO: 1218183 - RNA, 10 nt, Human
gggcucagca

SEQ ID NO: 1218184 - RNA, 20 nt, Human
gggcuggguucuacccaggu

SEQ ID NO: 1218185 - RNA, 12 nt, Human
gggcugggcaga

SEQ ID NO: 1218186 - RNA, 22 nt, Human
gggcuggguucuacccaggugc

SEQ ID NO: 1218187 - RNA, 20 nt, Human
aaacaagaccacguuucuaa

SEQ ID NO: 1218188 - RNA, 16 nt, Human
aaacacauuuuucuua

SEQ ID NO: 1218189 - RNA, 16 nt, Human
aaacaugcuacacacu

SEQ ID NO: 1218190 - RNA, 20 nt, Human
ggggacagcuccuucugucc

SEQ ID NO: 1218191 - RNA, 14 nt, Human
ggggacagcuccuu

SEQ ID NO: 1218192 - RNA, 12 nt, Human
ggggacagcucc

SEQ ID NO: 1218193 - RNA, 23 nt, Human
gggccaguuggucccccuuccau

SEQ ID NO: 1218194 - RNA, 22 nt, Human
gggccaguuggucccccuucca

SEQ ID NO: 1218195 - RNA, 18 nt, Human
gggccaguuggucccccu

SEQ ID NO: 1218196 - RNA, 14 nt, Human
gggccaguuggucc

SEQ ID NO: 1218197 - RNA, 15 nt, Human
gggcgggaggauguu

SEQ ID NO: 1218198 - RNA, 20 nt, Human
gggccucuuaugggcugggu

SEQ ID NO: 1218199 - RNA, 13 nt, Human
gggccuccugugu

SEQ ID NO: 1218200 - RNA, 15 nt, Human
gggccuccugugugu

SEQ ID NO: 1218201 - RNA, 12 nt, Human
gggccaggagcc

SEQ ID NO: 1218202 - RNA, 11 nt, Human
gggccaggagc

SEQ ID NO: 1218203 - RNA, 21 nt, Human
aaaaugagccuggcaagaaug

SEQ ID NO: 1218204 - RNA, 14 nt, Human
aaaaugagccuggc

SEQ ID NO: 1218205 - RNA, 19 nt, Human
gggaggucgaggcaggagg

SEQ ID NO: 1218206 - RNA, 18 nt, Human
gggaggucgaggcaggag

SEQ ID NO: 1218207 - RNA, 17 nt, Human
gggaggucgaggcagga

SEQ ID NO: 1218208 - RNA, 18 nt, Human
gggagggcuccagacaca

SEQ ID NO: 1218209 - RNA, 17 nt, Human
gggagggcuccagacac

SEQ ID NO: 1218210 - RNA, 15 nt, Human
gggagggcuccagac

SEQ ID NO: 1218211 - RNA, 14 nt, Human
gggagggcuccaga

SEQ ID NO: 1218212 - RNA, 19 nt, Human
aaaagguaugcaaucaaau

SEQ ID NO: 1218213 - RNA, 15 nt, Human
gggauuacaggugug

SEQ ID NO: 1218214 - RNA, 16 nt, Human
gggcagagcagagacc

SEQ ID NO: 1218215 - RNA, 20 nt, Human
gggcaacccccagccugcua

SEQ ID NO: 1218216 - RNA, 18 nt, Human
gggcaacccccagccugc

SEQ ID NO: 1218217 - RNA, 16 nt, Human
gggcaacccccagccu

SEQ ID NO: 1218218 - RNA, 22 nt, Human
gggcagagcagagaccaucccu

SEQ ID NO: 1218219 - RNA, 17 nt, Human
gggcagagcagagacca

SEQ ID NO: 1218220 - RNA, 23 nt, Human
gggcagagcagagaccaucccug

SEQ ID NO: 1218221 - RNA, 23 nt, Human
gggacagaggggguggccuccca

SEQ ID NO: 1218222 - RNA, 22 nt, Human
gggacagaggggguggccuccc

SEQ ID NO: 1218223 - RNA, 13 nt, Human
gggacagaggggg

SEQ ID NO: 1218224 - RNA, 16 nt, Human
gggaaggauacaaaag

SEQ ID NO: 1218225 - RNA, 13 nt, Human
gggaaggauacaa

SEQ ID NO: 1218226 - RNA, 21 nt, Human
gggacagcuccuucuguccua

SEQ ID NO: 1218227 - RNA, 13 nt, Human
aaaagaugcuucu

SEQ ID NO: 1218228 - RNA, 23 nt, Human
aaaacugcugacuguuuucucuu

SEQ ID NO: 1218229 - RNA, 22 nt, Human
aaaacugcugacuguuuucucu

SEQ ID NO: 1218230 - RNA, 17 nt, Human
aaaaaucucaaauuucu

SEQ ID NO: 1218231 - RNA, 14 nt, Human
aaaaaucucaaauu

SEQ ID NO: 1218232 - RNA, 16 nt, Human
gcugcacccucaggca

SEQ ID NO: 1218233 - RNA, 15 nt, Human
gcugcacccucaggc

SEQ ID NO: 1218234 - RNA, 13 nt, Human
gcugcacccucag

SEQ ID NO: 1218235 - RNA, 13 nt, Human
gcugccauccagg

SEQ ID NO: 1218236 - RNA, 12 nt, Human
gcugccauccag

SEQ ID NO: 1218237 - RNA, 17 nt, Human
gcugccccuggcagccc

SEQ ID NO: 1218238 - RNA, 16 nt, Human
gcugccccuggcagcc

SEQ ID NO: 1218239 - RNA, 15 nt, Human
gcugccccuggcagc

SEQ ID NO: 1218240 - RNA, 13 nt, Human
gcugccccuggca

SEQ ID NO: 1218241 - RNA, 17 nt, Human
gcugccauccagguuca

SEQ ID NO: 1218242 - RNA, 12 nt, Human
gcugcugacagu

SEQ ID NO: 1218243 - RNA, 23 nt, Human
gcucugaucauccacugugccau

SEQ ID NO: 1218244 - RNA, 22 nt, Human
gcucugaucauccacugugcca

SEQ ID NO: 1218245 - RNA, 21 nt, Human
gcucugaucauccacugugcc

SEQ ID NO: 1218246 - RNA, 20 nt, Human
gcucugaucauccacugugc

SEQ ID NO: 1218247 - RNA, 13 nt, Human
gcugacagacaca

SEQ ID NO: 1218248 - RNA, 22 nt, Human
gcugaauacagaggcaacugca

SEQ ID NO: 1218249 - RNA, 17 nt, Human
gcugaauacagaggcaa

SEQ ID NO: 1218250 - RNA, 14 nt, Human
gcucuguccuggga

SEQ ID NO: 1218251 - RNA, 20 nt, Human
gcucucaggccagcugcuug

SEQ ID NO: 1218252 - RNA, 19 nt, Human
gcucucaggccagcugcuu

SEQ ID NO: 1218253 - RNA, 18 nt, Human
gcucucaggccagcugcu

SEQ ID NO: 1218254 - RNA, 17 nt, Human
gcucucaggccagcugc

SEQ ID NO: 1218255 - RNA, 18 nt, Human
gcucucaaguuaucaggg

SEQ ID NO: 1218256 - RNA, 19 nt, Human
gcucuacugaggugcuaug

SEQ ID NO: 1218257 - RNA, 19 nt, Human
gcuccucuccccagcaagu

SEQ ID NO: 1218258 - RNA, 16 nt, Human
gcuccucuccccagca

SEQ ID NO: 1218259 - RNA, 15 nt, Human
gcuccucuccccagc

SEQ ID NO: 1218260 - RNA, 17 nt, Human
gcuccagcucaccagcc

SEQ ID NO: 1218261 - RNA, 14 nt, Human
gcuccagcucacca

SEQ ID NO: 1218262 - RNA, 13 nt, Human
gcuccagcucacc

SEQ ID NO: 1218263 - RNA, 9 nt, Human
gcuccagac

SEQ ID NO: 1218264 - RNA, 23 nt, Human
gcuccagacacauguccaagaag

SEQ ID NO: 1218265 - RNA, 21 nt, Human
gcuccagacacauguccaaga

SEQ ID NO: 1218266 - RNA, 18 nt, Human
gcuccagacacaugucca

SEQ ID NO: 1218267 - RNA, 17 nt, Human
gcuuugaucccuucuua

SEQ ID NO: 1218268 - RNA, 14 nt, Human
gcuuugaucccuuc

SEQ ID NO: 1218269 - RNA, 18 nt, Human
gcuuuugucuaugggacu

SEQ ID NO: 1218270 - RNA, 15 nt, Human
gcuuuuggucugugu

SEQ ID NO: 1218271 - RNA, 18 nt, Human
ggaaaauuuuaaaaauac

SEQ ID NO: 1218272 - RNA, 16 nt, Human
ggaaacccagcucugg

SEQ ID NO: 1218273 - RNA, 12 nt, Human
gcuuuugugcau

SEQ ID NO: 1218274 - RNA, 20 nt, Human
ggaagacuucaucccucugg

SEQ ID NO: 1218275 - RNA, 17 nt, Human
ggaagacuucaucccuc

SEQ ID NO: 1218276 - RNA, 22 nt, Human
ggaagacaaugugaaaagaaaa

SEQ ID NO: 1218277 - RNA, 12 nt, Human
ggaagacuuugg

SEQ ID NO: 1218278 - RNA, 16 nt, Human
ggaagacaaugugaaa

SEQ ID NO: 1218279 - RNA, 14 nt, Human
ggaagacaauguga

SEQ ID NO: 1218280 - RNA, 19 nt, Human
ggaacacuccuucacagau

SEQ ID NO: 1218281 - RNA, 15 nt, Human
ggaacacuccuucac

SEQ ID NO: 1218282 - RNA, 23 nt, Human
ggaacaaggcaaggcugucaauu

SEQ ID NO: 1218283 - RNA, 13 nt, Human
ggaacaccuccuc

SEQ ID NO: 1218284 - RNA, 22 nt, Human
ggaaaugggcagagcagagacc

SEQ ID NO: 1218285 - RNA, 18 nt, Human
ggaaaugggcagagcaga

SEQ ID NO: 1218286 - RNA, 17 nt, Human
ggaaaugggcagagcag

SEQ ID NO: 1218287 - RNA, 16 nt, Human
ggaaaugggcagagca

SEQ ID NO: 1218288 - RNA, 14 nt, Human
ggaaaugggcagag

SEQ ID NO: 1218289 - RNA, 21 nt, Human
ggaacaaggcaaggcugucaa

SEQ ID NO: 1218290 - RNA, 17 nt, Human
ggaacaaggcaaggcug

SEQ ID NO: 1218291 - RNA, 15 nt, Human
ggaacaaggcaaggc

SEQ ID NO: 1218292 - RNA, 15 nt, Human
gcuucaguggcagcu

SEQ ID NO: 1218293 - RNA, 14 nt, Human
gcuucaguggcagc

SEQ ID NO: 1218294 - RNA, 18 nt, Human
gcuucaaggauccugagc

SEQ ID NO: 1218295 - RNA, 14 nt, Human
gcuucaaggauccu

SEQ ID NO: 1218296 - RNA, 14 nt, Human
gcuguuggcugggg

SEQ ID NO: 1218297 - RNA, 13 nt, Human
gcuguuggcuggg

SEQ ID NO: 1218298 - RNA, 23 nt, Human
gcugguucaggguuggccccugc

SEQ ID NO: 1218299 - RNA, 17 nt, Human
gcuuguaaauagcucag

SEQ ID NO: 1218300 - RNA, 22 nt, Human
gcuugaccuuuaagagaaauga

SEQ ID NO: 1218301 - RNA, 16 nt, Human
gcuugaccgugaggcc

SEQ ID NO: 1218302 - RNA, 18 nt, Human
gcuugaccuuuaagagaa

SEQ ID NO: 1218303 - RNA, 23 nt, Human
gcuugaccgugaggccagagaca

SEQ ID NO: 1218304 - RNA, 19 nt, Human
gcuuguaaauagcucaggu

SEQ ID NO: 1218305 - RNA, 18 nt, Human
gcuuguaaauagcucagg

SEQ ID NO: 1218306 - RNA, 15 nt, Human
gcuucuucagagacu

SEQ ID NO: 1218307 - RNA, 12 nt, Human
gcuucuucagag

SEQ ID NO: 1218308 - RNA, 23 nt, Human
gcuuccagugaggcucugcccuu

SEQ ID NO: 1218309 - RNA, 21 nt, Human
gccuccuuugugaggaagccg

SEQ ID NO: 1218310 - RNA, 20 nt, Human
gccuccuuugugaggaagcc

SEQ ID NO: 1218311 - RNA, 19 nt, Human
gccuccuuugugaggaagc

SEQ ID NO: 1218312 - RNA, 13 nt, Human
gccugcuccagcu

SEQ ID NO: 1218313 - RNA, 23 nt, Human
gccugcuaauuccccagauugca

SEQ ID NO: 1218314 - RNA, 17 nt, Human
gccugcuaauuccccag

SEQ ID NO: 1218315 - RNA, 13 nt, Human
gcgauucuucugc

SEQ ID NO: 1218316 - RNA, 15 nt, Human
gcgagcccugguggc

SEQ ID NO: 1218317 - RNA, 17 nt, Human
gcgauucuucugcuuca

SEQ ID NO: 1218318 - RNA, 14 nt, Human
gcgauucuucugcu

SEQ ID NO: 1218319 - RNA, 16 nt, Human
gcggccuuuggcuuca

SEQ ID NO: 1218320 - RNA, 20 nt, Human
gcgugguggacaugcacagc

SEQ ID NO: 1218321 - RNA, 19 nt, Human
gcgugcacacaccagagcc

SEQ ID NO: 1218322 - RNA, 18 nt, Human
gcgugcacacaccagagc

SEQ ID NO: 1218323 - RNA, 14 nt, Human
gcgugcacacacca

SEQ ID NO: 1218324 - RNA, 20 nt, Human
gcuacuguccuacccacccu

SEQ ID NO: 1218325 - RNA, 19 nt, Human
gcuacuguccuacccaccc

SEQ ID NO: 1218326 - RNA, 16 nt, Human
gcuaauuuuucauuuu

SEQ ID NO: 1218327 - RNA, 17 nt, Human
gcguuucuaugacacau

SEQ ID NO: 1218328 - RNA, 18 nt, Human
gcccaggccccugccacc

SEQ ID NO: 1218329 - RNA, 17 nt, Human
gcccaggccccugccac

SEQ ID NO: 1218330 - RNA, 15 nt, Human
gcccaggccccugcc

SEQ ID NO: 1218331 - RNA, 16 nt, Human
gcccaggcaggucuug

SEQ ID NO: 1218332 - RNA, 14 nt, Human
gcccaggcaggucu

SEQ ID NO: 1218333 - RNA, 13 nt, Human
gcccaggcagguc

SEQ ID NO: 1218334 - RNA, 14 nt, Human
gccaugugccaggu

SEQ ID NO: 1218335 - RNA, 22 nt, Human
gccccugcugguucaggguugg

SEQ ID NO: 1218336 - RNA, 15 nt, Human
gccccuggaugcagc

SEQ ID NO: 1218337 - RNA, 13 nt, Human
gccagugugacaa

SEQ ID NO: 1218338 - RNA, 13 nt, Human
gccaguugguccc

SEQ ID NO: 1218339 - RNA, 23 nt, Human
gccaguuggucccccuuccaugg

SEQ ID NO: 1218340 - RNA, 22 nt, Human
gccaguuggucccccuuccaug

SEQ ID NO: 1218341 - RNA, 21 nt, Human
gccaguuggucccccuuccau

SEQ ID NO: 1218342 - RNA, 20 nt, Human
gccaguuggucccccuucca

SEQ ID NO: 1218343 - RNA, 18 nt, Human
gccaguuggucccccuuc

SEQ ID NO: 1218344 - RNA, 16 nt, Human
gccaguuggucccccu

SEQ ID NO: 1218345 - RNA, 15 nt, Human
gccaggcccucugcc

SEQ ID NO: 1218346 - RNA, 14 nt, Human
gccaggcccucugc

SEQ ID NO: 1218347 - RNA, 13 nt, Human
gccaggcccucug

SEQ ID NO: 1218348 - RNA, 23 nt, Human
gccaggccacaagacccuugugg

SEQ ID NO: 1218349 - RNA, 22 nt, Human
gccaggccagagggagugacag

SEQ ID NO: 1218350 - RNA, 15 nt, Human
gccaggccagaggga

SEQ ID NO: 1218351 - RNA, 21 nt, Human
gccaggccacaagacccuugu

SEQ ID NO: 1218352 - RNA, 18 nt, Human
gccaggccacaagacccu

SEQ ID NO: 1218353 - RNA, 13 nt, Human
gccaggccacaag

SEQ ID NO: 1218354 - RNA, 17 nt, Human
gcagccccauucugccu

SEQ ID NO: 1218355 - RNA, 16 nt, Human
gcagccaggccacaag

SEQ ID NO: 1218356 - RNA, 14 nt, Human
gcagccaggccaca

SEQ ID NO: 1218357 - RNA, 13 nt, Human
gcagccaggccac

SEQ ID NO: 1218358 - RNA, 12 nt, Human
gcagccaggcca

SEQ ID NO: 1218359 - RNA, 14 nt, Human
gcagccacuauugu

SEQ ID NO: 1218360 - RNA, 16 nt, Human
gcagccacauuccuga

SEQ ID NO: 1218361 - RNA, 20 nt, Human
gcauaccacuuuuguucuug

SEQ ID NO: 1218362 - RNA, 17 nt, Human
gcauaccacuuuuguuc

SEQ ID NO: 1218363 - RNA, 14 nt, Human
gcauacguacacau

SEQ ID NO: 1218364 - RNA, 13 nt, Human
gcagggaaacagc

SEQ ID NO: 1218365 - RNA, 22 nt, Human
gcaggcucucaggccagcugcu

SEQ ID NO: 1218366 - RNA, 20 nt, Human
gcaggcucucaggccagcug

SEQ ID NO: 1218367 - RNA, 19 nt, Human
gcagcugcgguccacccag

SEQ ID NO: 1218368 - RNA, 17 nt, Human
gcagcugcgguccaccc

SEQ ID NO: 1218369 - RNA, 23 nt, Human
gcaggcucucaggccagcugcuu

SEQ ID NO: 1218370 - RNA, 12 nt, Human
gcacugacauug

SEQ ID NO: 1218371 - RNA, 20 nt, Human
gcagagcagagaccaucccu

SEQ ID NO: 1218372 - RNA, 19 nt, Human
gcagagcagagaccauccc

SEQ ID NO: 1218373 - RNA, 15 nt, Human
gcagagcagagacca

SEQ ID NO: 1218374 - RNA, 14 nt, Human
gcagagcagagacc

SEQ ID NO: 1218375 - RNA, 12 nt, Human
gcagagcagaga

SEQ ID NO: 1218376 - RNA, 24 nt, Human
gcagagcaccuuagacagucccug

SEQ ID NO: 1218377 - RNA, 23 nt, Human
gcagagcaccuuagacagucccu

SEQ ID NO: 1218378 - RNA, 22 nt, Human
gcagagcaccuuagacaguccc

SEQ ID NO: 1218379 - RNA, 19 nt, Human
gcagagcaccuuagacagu

SEQ ID NO: 1218380 - RNA, 14 nt, Human
gcacaagcugcacc

SEQ ID NO: 1218381 - RNA, 23 nt, Human
gcacaagcuccaagcucccaggc

SEQ ID NO: 1218382 - RNA, 22 nt, Human
gcacaagcuccaagcucccagg

SEQ ID NO: 1218383 - RNA, 23 nt, Human
gcaauaaggggagaguaacccug

SEQ ID NO: 1218384 - RNA, 15 nt, Human
gcaagugagagcugg

SEQ ID NO: 1218385 - RNA, 13 nt, Human
gcaagugagagcu

SEQ ID NO: 1218386 - RNA, 23 nt, Human
gcaccggcuggccuggccccuca

SEQ ID NO: 1218387 - RNA, 21 nt, Human
gcaccggcuggccuggccccu

SEQ ID NO: 1218388 - RNA, 19 nt, Human
gcaccggcuggccuggccc

SEQ ID NO: 1218389 - RNA, 22 nt, Human
gcacaugccucucucaggccaa

SEQ ID NO: 1218390 - RNA, 21 nt, Human
gcacaugccucucucaggcca

SEQ ID NO: 1218391 - RNA, 20 nt, Human
gcacaugccucucucaggcc

SEQ ID NO: 1218392 - RNA, 19 nt, Human
gcacaugccucucucaggc

SEQ ID NO: 1218393 - RNA, 18 nt, Human
gcacaugccucucucagg

SEQ ID NO: 1218394 - RNA, 17 nt, Human
gcacaugccucucucag

SEQ ID NO: 1218395 - RNA, 14 nt, Human
gcacaugccucucu

SEQ ID NO: 1218396 - RNA, 13 nt, Human
gcacaugccucuc

SEQ ID NO: 1218397 - RNA, 21 nt, Human
gcacaucagcacgauuucugu

SEQ ID NO: 1218398 - RNA, 20 nt, Human
gcacaucagcacgauuucug

SEQ ID NO: 1218399 - RNA, 19 nt, Human
gcacaucagcacgauuucu

SEQ ID NO: 1218400 - RNA, 22 nt, Human
gcacaagcugcacccucaggca

SEQ ID NO: 1218401 - RNA, 16 nt, Human
gauacuacaguuuguu

SEQ ID NO: 1218402 - RNA, 11 nt, Human
gauacuacagu

SEQ ID NO: 1218403 - RNA, 14 nt, Human
gauacccaucccau

SEQ ID NO: 1218404 - RNA, 13 nt, Human
gauacccauccca

SEQ ID NO: 1218405 - RNA, 22 nt, Human
gaguuguuacauuuuuaagugc

SEQ ID NO: 1218406 - RNA, 20 nt, Human
gaguuguuacauuuuuaagu

SEQ ID NO: 1218407 - RNA, 16 nt, Human
gaguuguuacauuuuu

SEQ ID NO: 1218408 - RNA, 13 nt, Human
gagugcagugagc

SEQ ID NO: 1218409 - RNA, 20 nt, Human
gaguuugggguaugggagag

SEQ ID NO: 1218410 - RNA, 12 nt, Human
gagugcagugag

SEQ ID NO: 1218411 - RNA, 11 nt, Human
gagugcaguga

SEQ ID NO: 1218412 - RNA, 12 nt, Human
gagugagcuggu

SEQ ID NO: 1218413 - RNA, 21 nt, Human
gagucccaccuuggcugcagg

SEQ ID NO: 1218414 - RNA, 20 nt, Human
gagucccaccuuggcugcag

SEQ ID NO: 1218415 - RNA, 16 nt, Human
gagucccaccuuggcu

SEQ ID NO: 1218416 - RNA, 15 nt, Human
gagucaccaagccca

SEQ ID NO: 1218417 - RNA, 14 nt, Human
gagucaccaagccc

SEQ ID NO: 1218418 - RNA, 13 nt, Human
gagucaccaagcc

SEQ ID NO: 1218419 - RNA, 13 nt, Human
gaggugggauccu

SEQ ID NO: 1218420 - RNA, 12 nt, Human
gaggugggaucc

SEQ ID NO: 1218421 - RNA, 11 nt, Human
gaggugggagg

SEQ ID NO: 1218422 - RNA, 14 nt, Human
gaggucuguucuuu

SEQ ID NO: 1218423 - RNA, 13 nt, Human
gaggucuguucuu

SEQ ID NO: 1218424 - RNA, 21 nt, Human
gaugaugaaaugaggucagag

SEQ ID NO: 1218425 - RNA, 21 nt, Human
gaugaucuuugcagacaggca

SEQ ID NO: 1218426 - RNA, 20 nt, Human
gaugaucuuugcagacaggc

SEQ ID NO: 1218427 - RNA, 16 nt, Human
gaucucuugagccugg

SEQ ID NO: 1218428 - RNA, 12 nt, Human
gaucucuugagc

SEQ ID NO: 1218429 - RNA, 17 nt, Human
gaucucuugagccuggg

SEQ ID NO: 1218430 - RNA, 18 nt, Human
gaucucuugagccuggga

SEQ ID NO: 1218431 - RNA, 15 nt, Human
gaucucuaacuucac

SEQ ID NO: 1218432 - RNA, 17 nt, Human
gauauuuuuuucuuuuc

SEQ ID NO: 1218433 - RNA, 15 nt, Human
gauauuuuuuucuuu

SEQ ID NO: 1218434 - RNA, 16 nt, Human
gauauuuugcuuugug

SEQ ID NO: 1218435 - RNA, 22 nt, Human
gacuaucuaaauguugaaagau

SEQ ID NO: 1218436 - RNA, 19 nt, Human
gacucugucucaaaaaaac

SEQ ID NO: 1218437 - RNA, 12 nt, Human
gacucugucuca

SEQ ID NO: 1218438 - RNA, 16 nt, Human
gagaagcggcuggcag

SEQ ID NO: 1218439 - RNA, 15 nt, Human
gagaagcggcuggca

SEQ ID NO: 1218440 - RNA, 13 nt, Human
gagaagcggcugg

SEQ ID NO: 1218441 - RNA, 12 nt, Human
gagaaggaagcc

SEQ ID NO: 1218442 - RNA, 21 nt, Human
gagacccugucucaaaaaaag

SEQ ID NO: 1218443 - RNA, 21 nt, Human
gacuuuucuuuguggcuuccu

SEQ ID NO: 1218444 - RNA, 23 nt, Human
gacuuuucuuucagccaagaauu

SEQ ID NO: 1218445 - RNA, 22 nt, Human
gagaggcauccaguaucuugaa

SEQ ID NO: 1218446 - RNA, 21 nt, Human
gagaugaugccaugggcccuc

SEQ ID NO: 1218447 - RNA, 14 nt, Human
gagaggcauccagu

SEQ ID NO: 1218448 - RNA, 18 nt, Human
gagacuccugcaggcagc

SEQ ID NO: 1218449 - RNA, 17 nt, Human
gagacuccugcaggcag

SEQ ID NO: 1218450 - RNA, 16 nt, Human
gagacuccugcaggca

SEQ ID NO: 1218451 - RNA, 15 nt, Human
gagacuccugcaggc

SEQ ID NO: 1218452 - RNA, 13 nt, Human
gagauuuacaacu

SEQ ID NO: 1218453 - RNA, 21 nt, Human
gagauugcaccacugcacucc

SEQ ID NO: 1218454 - RNA, 18 nt, Human
gagauugcaccacugcac

SEQ ID NO: 1218455 - RNA, 14 nt, Human
gagcagggcucagc

SEQ ID NO: 1218456 - RNA, 13 nt, Human
gagcaucaggcca

SEQ ID NO: 1218457 - RNA, 22 nt, Human
gagcaugccuggauggggcugc

SEQ ID NO: 1218458 - RNA, 12 nt, Human
gagcaucaggcc

SEQ ID NO: 1218459 - RNA, 21 nt, Human
gagcagggcucagcggggaca

SEQ ID NO: 1218460 - RNA, 18 nt, Human
gagcugggugucaagagg

SEQ ID NO: 1218461 - RNA, 22 nt, Human
gagcugccuguucagcuccagc

SEQ ID NO: 1218462 - RNA, 21 nt, Human
gagcugccuguucagcuccag

SEQ ID NO: 1218463 - RNA, 21 nt, Human
gagcggagaaaggaagggcug

SEQ ID NO: 1218464 - RNA, 18 nt, Human
gagcggagaaaggaaggg

SEQ ID NO: 1218465 - RNA, 13 nt, Human
gagccccgaggcc

SEQ ID NO: 1218466 - RNA, 22 nt, Human
gagccuugaacuuugaccucug

SEQ ID NO: 1218467 - RNA, 17 nt, Human
gagccuuccaggggugg

SEQ ID NO: 1218468 - RNA, 16 nt, Human
gagccuuccaggggug

SEQ ID NO: 1218469 - RNA, 15 nt, Human
gagccuuccaggggu

SEQ ID NO: 1218470 - RNA, 14 nt, Human
gagccuuccagggg

SEQ ID NO: 1218471 - RNA, 22 nt, Human
gaaugaaugucagugugacuga

SEQ ID NO: 1218472 - RNA, 18 nt, Human
gaaugaaugucaguguga

SEQ ID NO: 1218473 - RNA, 14 nt, Human
gaaugaaugucagu

SEQ ID NO: 1218474 - RNA, 11 nt, Human
gaaugaauguc

SEQ ID NO: 1218475 - RNA, 23 nt, Human
gaagcucagggccuggcucaggu

SEQ ID NO: 1218476 - RNA, 21 nt, Human
gaagcucagggccuggcucag

SEQ ID NO: 1218477 - RNA, 20 nt, Human
gaagcucagggccuggcuca

SEQ ID NO: 1218478 - RNA, 19 nt, Human
gaagcucagggccuggcuc

SEQ ID NO: 1218479 - RNA, 18 nt, Human
gaagcucagggccuggcu

SEQ ID NO: 1218480 - RNA, 17 nt, Human
gaagcucagggccuggc

SEQ ID NO: 1218481 - RNA, 16 nt, Human
gaagcucagggccugg

SEQ ID NO: 1218482 - RNA, 15 nt, Human
gaagcucagggccug

SEQ ID NO: 1218483 - RNA, 14 nt, Human
gaagcucagggccu

SEQ ID NO: 1218484 - RNA, 18 nt, Human
gaagucuuuguacagaca

SEQ ID NO: 1218485 - RNA, 20 nt, Human
gaagucuuuguacagacaac

SEQ ID NO: 1218486 - RNA, 19 nt, Human
gaagucuuuguacagacaa

SEQ ID NO: 1218487 - RNA, 19 nt, Human
gaaggcucgagcaugccug

SEQ ID NO: 1218488 - RNA, 17 nt, Human
gaaggcucgagcaugcc

SEQ ID NO: 1218489 - RNA, 16 nt, Human
gaaggcucgagcaugc

SEQ ID NO: 1218490 - RNA, 19 nt, Human
gaagcuccgcuuucuaccc

SEQ ID NO: 1218491 - RNA, 21 nt, Human
gacacacagcucuguccuggg

SEQ ID NO: 1218492 - RNA, 19 nt, Human
gaauuuuggcugugucucc

SEQ ID NO: 1218493 - RNA, 14 nt, Human
gacacacagcucug

SEQ ID NO: 1218494 - RNA, 19 nt, Human
gacacacagcucuguccug

SEQ ID NO: 1218495 - RNA, 18 nt, Human
gacacacagcucuguccu

SEQ ID NO: 1218496 - RNA, 17 nt, Human
gacacacagcucugucc

SEQ ID NO: 1218497 - RNA, 15 nt, Human
gacacacagcucugu

SEQ ID NO: 1218498 - RNA, 21 nt, Human
gaauuuugugcccccauguaa

SEQ ID NO: 1218499 - RNA, 20 nt, Human
gaauuuugugcccccaugua

SEQ ID NO: 1218500 - RNA, 23 nt, Human
gaauuuuggcugugucucccuuc

SEQ ID NO: 1218501 - RNA, 22 nt, Human
gacaggguuuugccauguuggc

SEQ ID NO: 1218502 - RNA, 20 nt, Human
gacaggguuuugccauguug

SEQ ID NO: 1218503 - RNA, 11 nt, Human
gacagcuccuu

SEQ ID NO: 1218504 - RNA, 23 nt, Human
gacagcccgggcucugccuccca

SEQ ID NO: 1218505 - RNA, 22 nt, Human
gacagcccgggcucugccuccc

SEQ ID NO: 1218506 - RNA, 21 nt, Human
gacagcccgggcucugccucc

SEQ ID NO: 1218507 - RNA, 12 nt, Human
gacagacacagg

SEQ ID NO: 1218508 - RNA, 15 nt, Human
gacacugaugggcaa

SEQ ID NO: 1218509 - RNA, 13 nt, Human
gacacugaugggc

SEQ ID NO: 1218510 - RNA, 22 nt, Human
cuuuccugaggcugggcucccu

SEQ ID NO: 1218511 - RNA, 23 nt, Human
cuuucagccaagaauucuuaaau

SEQ ID NO: 1218512 - RNA, 14 nt, Human
cuuuuauaaacuuu

SEQ ID NO: 1218513 - RNA, 13 nt, Human
cuuuuauaaacuu

SEQ ID NO: 1218514 - RNA, 15 nt, Human
cuuucuagccagagg

SEQ ID NO: 1218515 - RNA, 16 nt, Human
cuuucuagccagagga

SEQ ID NO: 1218516 - RNA, 21 nt, Human
gaaaggcuccaggagcagcca

SEQ ID NO: 1218517 - RNA, 22 nt, Human
gaaaggcuccaggagcagccac

SEQ ID NO: 1218518 - RNA, 21 nt, Human
gaaagaaaauaccaaggaaca

SEQ ID NO: 1218519 - RNA, 19 nt, Human
gaaagggacuuggaagcuc

SEQ ID NO: 1218520 - RNA, 20 nt, Human
gaaagggacgcuacccggga

SEQ ID NO: 1218521 - RNA, 22 nt, Human
gaaagggacuuggaagcuccgc

SEQ ID NO: 1218522 - RNA, 23 nt, Human
cuuuugcccacacuugggagcaa

SEQ ID NO: 1218523 - RNA, 16 nt, Human
cuuuugccguuauuaa

SEQ ID NO: 1218524 - RNA, 18 nt, Human
cuuuugucuaugggacuc

SEQ ID NO: 1218525 - RNA, 13 nt, Human
cuuuugugcauua

SEQ ID NO: 1218526 - RNA, 12 nt, Human
cuuuugugcauu

SEQ ID NO: 1218527 - RNA, 23 nt, Human
cuuuuuuggcugcugaaggcucg

SEQ ID NO: 1218528 - RNA, 14 nt, Human
gaaaauuuuaaaaa

SEQ ID NO: 1218529 - RNA, 15 nt, Human
gaaaauguaugugua

SEQ ID NO: 1218530 - RNA, 23 nt, Human
gaaaauggacguguuaugacucc

SEQ ID NO: 1218531 - RNA, 19 nt, Human
gaaaauggacguguuauga

SEQ ID NO: 1218532 - RNA, 14 nt, Human
gaaaaacugauuuu

SEQ ID NO: 1218533 - RNA, 18 nt, Human
gaaaagaaaaaugagccu

SEQ ID NO: 1218534 - RNA, 21 nt, Human
gaaaauggaagacagcucuua

SEQ ID NO: 1218535 - RNA, 20 nt, Human
cuuggcgcugccccuggcag

SEQ ID NO: 1218536 - RNA, 17 nt, Human
cuuggcgcugccccugg

SEQ ID NO: 1218537 - RNA, 14 nt, Human
cuuggcgcugcccc

SEQ ID NO: 1218538 - RNA, 12 nt, Human
cuuggcgcugcc

SEQ ID NO: 1218539 - RNA, 13 nt, Human
cuugacagggcac

SEQ ID NO: 1218540 - RNA, 15 nt, Human
cuugacagggcacac

SEQ ID NO: 1218541 - RNA, 14 nt, Human
cuugacagggcaca

SEQ ID NO: 1218542 - RNA, 19 nt, Human
cuugaauuguaaggaauga

SEQ ID NO: 1218543 - RNA, 20 nt, Human
cuugacagggcacaccgggc

SEQ ID NO: 1218544 - RNA, 17 nt, Human
cuugauauccucuuuga

SEQ ID NO: 1218545 - RNA, 23 nt, Human
cuucugacccaugcugcccugug

SEQ ID NO: 1218546 - RNA, 22 nt, Human
cuucugacccaugcugcccugu

SEQ ID NO: 1218547 - RNA, 21 nt, Human
cuucugacccaugcugcccug

SEQ ID NO: 1218548 - RNA, 15 nt, Human
cuucugccauauucu

SEQ ID NO: 1218549 - RNA, 17 nt, Human
cuuccugcaacaccuug

SEQ ID NO: 1218550 - RNA, 23 nt, Human
cuucccaccucucucacuccuug

SEQ ID NO: 1218551 - RNA, 21 nt, Human
cuucccaccucucucacuccu

SEQ ID NO: 1218552 - RNA, 11 nt, Human
cuucccaccuc

SEQ ID NO: 1218553 - RNA, 20 nt, Human
cuucagagacuccugcaggc

SEQ ID NO: 1218554 - RNA, 19 nt, Human
cuucagagacuccugcagg

SEQ ID NO: 1218555 - RNA, 18 nt, Human
cuucagagacuccugcag

SEQ ID NO: 1218556 - RNA, 23 nt, Human
cuuccagugaggcucugcccuug

SEQ ID NO: 1218557 - RNA, 22 nt, Human
cuuccagugaggcucugcccuu

SEQ ID NO: 1218558 - RNA, 21 nt, Human
cuuccagugaggcucugcccu

SEQ ID NO: 1218559 - RNA, 19 nt, Human
cugugcugagucugaaggc

SEQ ID NO: 1218560 - RNA, 14 nt, Human
cugugcugagucug

SEQ ID NO: 1218561 - RNA, 12 nt, Human
cugugcugaguc

SEQ ID NO: 1218562 - RNA, 21 nt, Human
cuucaccuuuguccccaccgc

SEQ ID NO: 1218563 - RNA, 22 nt, Human
cuucaccuuuguccccaccgca

SEQ ID NO: 1218564 - RNA, 19 nt, Human
cuucacggaagagccuugc

SEQ ID NO: 1218565 - RNA, 15 nt, Human
cuucacggaagagcc

SEQ ID NO: 1218566 - RNA, 12 nt, Human
cuuauugcccac

SEQ ID NO: 1218567 - RNA, 21 nt, Human
cuuauggaacacucugagacu

SEQ ID NO: 1218568 - RNA, 20 nt, Human
cuuauggaacacucugagac

SEQ ID NO: 1218569 - RNA, 19 nt, Human
cuuauggaacacucugaga

SEQ ID NO: 1218570 - RNA, 17 nt, Human
cuuauggaacacucuga

SEQ ID NO: 1218571 - RNA, 16 nt, Human
cuuauggaacacucug

SEQ ID NO: 1218572 - RNA, 13 nt, Human
cuuauggaacacu

SEQ ID NO: 1218573 - RNA, 11 nt, Human
cugcugacagu

SEQ ID NO: 1218574 - RNA, 23 nt, Human
cugcugacagacacaggcccggc

SEQ ID NO: 1218575 - RNA, 21 nt, Human
cugcugacagacacaggcccg

SEQ ID NO: 1218576 - RNA, 20 nt, Human
cugcugacagacacaggccc

SEQ ID NO: 1218577 - RNA, 19 nt, Human
cugcugacagacacaggcc

SEQ ID NO: 1218578 - RNA, 18 nt, Human
cugcugacagacacaggc

SEQ ID NO: 1218579 - RNA, 15 nt, Human
cugcugacagacaca

SEQ ID NO: 1218580 - RNA, 17 nt, Human
cuggaacacuaaugagg

SEQ ID NO: 1218581 - RNA, 16 nt, Human
cuggaaauauuaagaa

SEQ ID NO: 1218582 - RNA, 23 nt, Human
cugcuucagccucccgaguagcu

SEQ ID NO: 1218583 - RNA, 22 nt, Human
cugcuuuuuaaagaaugcucuu

SEQ ID NO: 1218584 - RNA, 16 nt, Human
cugcuucagccucccg

SEQ ID NO: 1218585 - RNA, 14 nt, Human
cugcuucagccucc

SEQ ID NO: 1218586 - RNA, 13 nt, Human
cugcuucagccuc

SEQ ID NO: 1218587 - RNA, 20 nt, Human
cugcuuaacuucacauauug

SEQ ID NO: 1218588 - RNA, 17 nt, Human
cugcuuaacuucacaua

SEQ ID NO: 1218589 - RNA, 15 nt, Human
cugcuuaacuucaca

SEQ ID NO: 1218590 - RNA, 13 nt, Human
cugcuuaacuuca

SEQ ID NO: 1218591 - RNA, 19 nt, Human
cugcccugugggcccccaa

SEQ ID NO: 1218592 - RNA, 15 nt, Human
cugccuguucagcuc

SEQ ID NO: 1218593 - RNA, 14 nt, Human
cugccuguucagcu

SEQ ID NO: 1218594 - RNA, 23 nt, Human
cugccugggaucccucauccuca

SEQ ID NO: 1218595 - RNA, 19 nt, Human
cugccucgaacuggcugca

SEQ ID NO: 1218596 - RNA, 18 nt, Human
cugccucgaacuggcugc

SEQ ID NO: 1218597 - RNA, 17 nt, Human
cugccucgaacuggcug

SEQ ID NO: 1218598 - RNA, 15 nt, Human
cugccucgaacuggc

SEQ ID NO: 1218599 - RNA, 15 nt, Human
cugcuacagagcaga

SEQ ID NO: 1218600 - RNA, 16 nt, Human
cugcuaauuccccaga

SEQ ID NO: 1218601 - RNA, 19 nt, Human
cugccuguugggccaggag

SEQ ID NO: 1218602 - RNA, 18 nt, Human
cugccuguugggccagga

SEQ ID NO: 1218603 - RNA, 16 nt, Human
cugccuguugggccag

SEQ ID NO: 1218604 - RNA, 20 nt, Human
cugagacucgcgacaaugca

SEQ ID NO: 1218605 - RNA, 19 nt, Human
cugagacucgcgacaaugc

SEQ ID NO: 1218606 - RNA, 17 nt, Human
cugagacucgcgacaau

SEQ ID NO: 1218607 - RNA, 15 nt, Human
cugcauguuugugau

SEQ ID NO: 1218608 - RNA, 13 nt, Human
cugcauguuacau

SEQ ID NO: 1218609 - RNA, 22 nt, Human
cugcauuuaaaagauacaguua

SEQ ID NO: 1218610 - RNA, 20 nt, Human
cugcauuuaaaagauacagu

SEQ ID NO: 1218611 - RNA, 13 nt, Human
cugcauuggcuuu

SEQ ID NO: 1218612 - RNA, 17 nt, Human
cugccaaugggagcuca

SEQ ID NO: 1218613 - RNA, 15 nt, Human
cugccaaugggagcu

SEQ ID NO: 1218614 - RNA, 12 nt, Human
cugccauccagg

SEQ ID NO: 1218615 - RNA, 23 nt, Human
cugccauauucuguuggccagug

SEQ ID NO: 1218616 - RNA, 22 nt, Human
cugccauauucuguuggccagu

SEQ ID NO: 1218617 - RNA, 21 nt, Human
cugccauauucuguuggccag

SEQ ID NO: 1218618 - RNA, 20 nt, Human
cugccauauucuguuggcca

SEQ ID NO: 1218619 - RNA, 15 nt, Human
cugccagggacagag

SEQ ID NO: 1218620 - RNA, 12 nt, Human
cugccagggaca

SEQ ID NO: 1218621 - RNA, 11 nt, Human
cugccagggac

SEQ ID NO: 1218622 - RNA, 18 nt, Human
cugcccugugggccccca

SEQ ID NO: 1218623 - RNA, 16 nt, Human
cugcccugugggcccc

SEQ ID NO: 1218624 - RNA, 15 nt, Human
cugcccugugggccc

SEQ ID NO: 1218625 - RNA, 13 nt, Human
cugcccugugagu

SEQ ID NO: 1218626 - RNA, 12 nt, Human
cugcccugugag

SEQ ID NO: 1218627 - RNA, 22 nt, Human
cugccccucaacucuccuccag

SEQ ID NO: 1218628 - RNA, 14 nt, Human
cugccccucaacuc

SEQ ID NO: 1218629 - RNA, 21 nt, Human
cuguaggaagguuaauguuca

SEQ ID NO: 1218630 - RNA, 18 nt, Human
cugucagccauuccuguu

SEQ ID NO: 1218631 - RNA, 18 nt, Human
cugucauuugagcagggc

SEQ ID NO: 1218632 - RNA, 17 nt, Human
cugucauuugagcaggg

SEQ ID NO: 1218633 - RNA, 20 nt, Human
cugucauuugagcagggcuc

SEQ ID NO: 1218634 - RNA, 15 nt, Human
cugugcucuggacag

SEQ ID NO: 1218635 - RNA, 14 nt, Human
cugugcucuggaca

SEQ ID NO: 1218636 - RNA, 15 nt, Human
cugugaagagaacca

SEQ ID NO: 1218637 - RNA, 15 nt, Human
cugucgcccagucug

SEQ ID NO: 1218638 - RNA, 13 nt, Human
cugucgcccaguc

SEQ ID NO: 1218639 - RNA, 23 nt, Human
cuggugacuuuccucuuuggucu

SEQ ID NO: 1218640 - RNA, 17 nt, Human
cuggguguggcgcagca

SEQ ID NO: 1218641 - RNA, 16 nt, Human
cuggguguggcgcagc

SEQ ID NO: 1218642 - RNA, 23 nt, Human
cuggguggcaccagcagccugga

SEQ ID NO: 1218643 - RNA, 21 nt, Human
cuggugacuuuccucuuuggu

SEQ ID NO: 1218644 - RNA, 20 nt, Human
cuggugacuuuccucuuugg

SEQ ID NO: 1218645 - RNA, 15 nt, Human
cuggugacuuuccuc

SEQ ID NO: 1218646 - RNA, 14 nt, Human
cuggguucuaccca

SEQ ID NO: 1218647 - RNA, 15 nt, Human
cuggguucacugcaa

SEQ ID NO: 1218648 - RNA, 14 nt, Human
cuggguucacugca

SEQ ID NO: 1218649 - RNA, 17 nt, Human
cugggcagaaggaagac

SEQ ID NO: 1218650 - RNA, 18 nt, Human
cugggcagaaggaagacu

SEQ ID NO: 1218651 - RNA, 12 nt, Human
cugggcagagga

SEQ ID NO: 1218652 - RNA, 16 nt, Human
cuggggccgaaagaac

SEQ ID NO: 1218653 - RNA, 13 nt, Human
cugggacacaguu

SEQ ID NO: 1218654 - RNA, 12 nt, Human
cugggacacagu

SEQ ID NO: 1218655 - RNA, 21 nt, Human
cuggccccucagggucccugg

SEQ ID NO: 1218656 - RNA, 20 nt, Human
cuggccccucagggucccug

SEQ ID NO: 1218657 - RNA, 18 nt, Human
cuggccccucaggguccc

SEQ ID NO: 1218658 - RNA, 17 nt, Human
cuggccccucagggucc

SEQ ID NO: 1218659 - RNA, 12 nt, Human
cuggcagcucag

SEQ ID NO: 1218660 - RNA, 14 nt, Human
cuggcagcucagag

SEQ ID NO: 1218661 - RNA, 13 nt, Human
cuggcagcucaga

SEQ ID NO: 1218662 - RNA, 13 nt, Human
cuggccccucagg

SEQ ID NO: 1218663 - RNA, 15 nt, Human
cuggcagcucagaga

SEQ ID NO: 1218664 - RNA, 16 nt, Human
augucagugugacuga

SEQ ID NO: 1218665 - RNA, 21 nt, Human
augucagugugacugaucucu

SEQ ID NO: 1218666 - RNA, 23 nt, Human
auguccaagaagcccaggaaagg

SEQ ID NO: 1218667 - RNA, 19 nt, Human
auguccaagaagcccagga

SEQ ID NO: 1218668 - RNA, 15 nt, Human
auguauguguaagua

SEQ ID NO: 1218669 - RNA, 12 nt, Human
auguauguguaa

SEQ ID NO: 1218670 - RNA, 15 nt, Human
auguaucugagcagg

SEQ ID NO: 1218671 - RNA, 22 nt, Human
uuugggggaaaauuuagaaaua

SEQ ID NO: 1218672 - RNA, 14 nt, Human
uuuggggauauuuu

SEQ ID NO: 1218673 - RNA, 22 nt, Human
uuugggaggccaaggugggagg

SEQ ID NO: 1218674 - RNA, 13 nt, Human
uuuguagagccag

SEQ ID NO: 1218675 - RNA, 14 nt, Human
uuuguuugaacuga

SEQ ID NO: 1218676 - RNA, 13 nt, Human
uuuguuugaacug

SEQ ID NO: 1218677 - RNA, 12 nt, Human
uuuguuugaacu

SEQ ID NO: 1218678 - RNA, 15 nt, Human
uuugugauacaaugc

SEQ ID NO: 1218679 - RNA, 19 nt, Human
uuugugaggaagccgcugg

SEQ ID NO: 1218680 - RNA, 18 nt, Human
uuugugaggaagccgcug

SEQ ID NO: 1218681 - RNA, 16 nt, Human
uuuuaagaggcagggu

SEQ ID NO: 1218682 - RNA, 15 nt, Human
uuuuaagaggcaggg

SEQ ID NO: 1218683 - RNA, 15 nt, Human
uuuuaagugcugcau

SEQ ID NO: 1218684 - RNA, 18 nt, Human
uuuguuugaacugauaaa

SEQ ID NO: 1218685 - RNA, 14 nt, Human
auguuuuccaugag

SEQ ID NO: 1218686 - RNA, 18 nt, Human
auguuuuucuucucccuc

SEQ ID NO: 1218687 - RNA, 14 nt, Human
auuaagaaagacua

SEQ ID NO: 1218688 - RNA, 13 nt, Human
auuaagaaagacu

SEQ ID NO: 1218689 - RNA, 23 nt, Human
auuaacuuuuauaaacuuuaccu

SEQ ID NO: 1218690 - RNA, 20 nt, Human
auuaacuuuuauaaacuuua

SEQ ID NO: 1218691 - RNA, 19 nt, Human
auuaacuuuuauaaacuuu

SEQ ID NO: 1218692 - RNA, 17 nt, Human
auuaacuuuuauaaacu

SEQ ID NO: 1218693 - RNA, 16 nt, Human
auuaacuuuuauaaac

SEQ ID NO: 1218694 - RNA, 12 nt, Human
auuaacuuuuau

SEQ ID NO: 1218695 - RNA, 20 nt, Human
auuaaccacuucagcugacu

SEQ ID NO: 1218696 - RNA, 18 nt, Human
auuaaccacuucagcuga

SEQ ID NO: 1218697 - RNA, 17 nt, Human
auuaaccacuucagcug

SEQ ID NO: 1218698 - RNA, 21 nt, Human
auuaaacuuaaucuaaaugga

SEQ ID NO: 1218699 - RNA, 19 nt, Human
auuaaacuuaaucuaaaug

SEQ ID NO: 1218700 - RNA, 17 nt, Human
auuaaacuuaaucuaaa

SEQ ID NO: 1218701 - RNA, 19 nt, Human
uuuuccagguuuaagcugu

SEQ ID NO: 1218702 - RNA, 19 nt, Human
uuuuauaaacuuuaccuuu

SEQ ID NO: 1218703 - RNA, 17 nt, Human
uuuuauaaacuuuaccu

SEQ ID NO: 1218704 - RNA, 14 nt, Human
uuuuauaaacuuua

SEQ ID NO: 1218705 - RNA, 13 nt, Human
uuuuauaaacuuu

SEQ ID NO: 1218706 - RNA, 12 nt, Human
uuuuauaaacuu

SEQ ID NO: 1218707 - RNA, 14 nt, Human
auguuggccaggcu

SEQ ID NO: 1218708 - RNA, 16 nt, Human
auguuggccaggcugg

SEQ ID NO: 1218709 - RNA, 21 nt, Human
uuuuaagugcugcauuuaaaa

SEQ ID NO: 1218710 - RNA, 17 nt, Human
uuuuaagugcugcauuu

SEQ ID NO: 1218711 - RNA, 16 nt, Human
uuuuaagugcugcauu

SEQ ID NO: 1218712 - RNA, 21 nt, Human
auguucaucauccuaagcuau

SEQ ID NO: 1218713 - RNA, 23 nt, Human
auuauuuauuaaaugcccagccc

SEQ ID NO: 1218714 - RNA, 22 nt, Human
auuaccugaauuuuggcugugu

SEQ ID NO: 1218715 - RNA, 19 nt, Human
auuaccacagacauacuaa

SEQ ID NO: 1218716 - RNA, 19 nt, Human
auuccccaggaggccagcc

SEQ ID NO: 1218717 - RNA, 16 nt, Human
auuccccaggaggcca

SEQ ID NO: 1218718 - RNA, 20 nt, Human
auuccccagauugcaacagg

SEQ ID NO: 1218719 - RNA, 21 nt, Human
auucaguuguuagugugucuu

SEQ ID NO: 1218720 - RNA, 23 nt, Human
auucaggaagcucagggccuggc

SEQ ID NO: 1218721 - RNA, 22 nt, Human
auucaggaagcucagggccugg

SEQ ID NO: 1218722 - RNA, 21 nt, Human
auucaggaagcucagggccug

SEQ ID NO: 1218723 - RNA, 18 nt, Human
auucagcucugcaagaau

SEQ ID NO: 1218724 - RNA, 14 nt, Human
auucagcucugcaa

SEQ ID NO: 1218725 - RNA, 21 nt, Human
auugcaacaggcugggcuuca

SEQ ID NO: 1218726 - RNA, 16 nt, Human
auugcaacaggcuggg

SEQ ID NO: 1218727 - RNA, 15 nt, Human
auugcaacaggcugg

SEQ ID NO: 1218728 - RNA, 17 nt, Human
auugaccugaggcccuu

SEQ ID NO: 1218729 - RNA, 13 nt, Human
auugaccugaggc

SEQ ID NO: 1218730 - RNA, 18 nt, Human
auugacaggauuauugga

SEQ ID NO: 1218731 - RNA, 19 nt, Human
auugcggacagccacggcc

SEQ ID NO: 1218732 - RNA, 18 nt, Human
auugcggacagccacggc

SEQ ID NO: 1218733 - RNA, 16 nt, Human
auugcggacagccacg

SEQ ID NO: 1218734 - RNA, 21 nt, Human
auugcccacgcuggagugcag

SEQ ID NO: 1218735 - RNA, 17 nt, Human
auugcccacgcuggagu

SEQ ID NO: 1218736 - RNA, 23 nt, Human
auugccauuucuuccacaagagc

SEQ ID NO: 1218737 - RNA, 14 nt, Human
auucucagaaucuc

SEQ ID NO: 1218738 - RNA, 16 nt, Human
auucuacuuugagugc

SEQ ID NO: 1218739 - RNA, 13 nt, Human
auucuacuuugag

SEQ ID NO: 1218740 - RNA, 17 nt, Human
auucuccaccugccagg

SEQ ID NO: 1218741 - RNA, 16 nt, Human
auucuccaccugccag

SEQ ID NO: 1218742 - RNA, 13 nt, Human
auucuccaccugc

SEQ ID NO: 1218743 - RNA, 20 nt, Human
auucucagaaucucaaauaa

SEQ ID NO: 1218744 - RNA, 18 nt, Human
auucucagaaucucaaau

SEQ ID NO: 1218745 - RNA, 18 nt, Human
auucuccaccugccaggg

SEQ ID NO: 1218746 - RNA, 14 nt, Human
auugcuacuguccu

SEQ ID NO: 1218747 - RNA, 21 nt, Human
auuguuuggggaugagaaagg

SEQ ID NO: 1218748 - RNA, 16 nt, Human
auuuaacagaaaugua

SEQ ID NO: 1218749 - RNA, 20 nt, Human
auuuaacagaaauguacagc

SEQ ID NO: 1218750 - RNA, 19 nt, Human
auuuaacagaaauguacag

SEQ ID NO: 1218751 - RNA, 17 nt, Human
auuuaacagaaauguac

SEQ ID NO: 1218752 - RNA, 23 nt, Human
auuuaauuuuuuugagacagagu

SEQ ID NO: 1218753 - RNA, 19 nt, Human
auuuaauuuuuuugagaca

SEQ ID NO: 1218754 - RNA, 22 nt, Human
auuuacaacugggggaggguga

SEQ ID NO: 1218755 - RNA, 23 nt, Human
auuggcuuuggguugcaggaccu

SEQ ID NO: 1218756 - RNA, 13 nt, Human
auuuaaaagauac

SEQ ID NO: 1218757 - RNA, 16 nt, Human
auuuauuauggcacau

SEQ ID NO: 1218758 - RNA, 14 nt, Human
auuuccugugucuu

SEQ ID NO: 1218759 - RNA, 21 nt, Human
auuucuaaaucuccaaaauaa

SEQ ID NO: 1218760 - RNA, 13 nt, Human
auuucuaaaucuc

SEQ ID NO: 1218761 - RNA, 12 nt, Human
auuucuaaaucu

SEQ ID NO: 1218762 - RNA, 13 nt, Human
auuuauuauggca

SEQ ID NO: 1218763 - RNA, 22 nt, Human
auuuauuaaaugcccagccccu

SEQ ID NO: 1218764 - RNA, 20 nt, Human
auuuauuaaaugcccagccc

SEQ ID NO: 1218765 - RNA, 20 nt, Human
auuucuuuugccguuauuaa

SEQ ID NO: 1218766 - RNA, 23 nt, Human
auuugaggucuguucuuuccaaa

SEQ ID NO: 1218767 - RNA, 15 nt, Human
auuugaggucuguuc

SEQ ID NO: 1218768 - RNA, 17 nt, Human
auuugagcagggcucag

SEQ ID NO: 1218769 - RNA, 21 nt, Human
auuuggugguuucagaaaugu

SEQ ID NO: 1218770 - RNA, 20 nt, Human
auuuggugguuucagaaaug

SEQ ID NO: 1218771 - RNA, 18 nt, Human
auuuggugguuucagaaa

SEQ ID NO: 1218772 - RNA, 17 nt, Human
auuuggugguuucagaa

SEQ ID NO: 1218773 - RNA, 17 nt, Human
auuuuauuaugcaugaa

SEQ ID NO: 1218774 - RNA, 15 nt, Human
auuuuauuaugcaug

SEQ ID NO: 1218775 - RNA, 14 nt, Human
auuuuauuaugcau

SEQ ID NO: 1218776 - RNA, 13 nt, Human
auuuuauuaugca

SEQ ID NO: 1218777 - RNA, 21 nt, Human
auuuuacuuuaaaaggagcca

SEQ ID NO: 1218778 - RNA, 23 nt, Human
auuucuuuugccguuauuaaaaa

SEQ ID NO: 1218779 - RNA, 19 nt, Human
aucuggguucacugcaacc

SEQ ID NO: 1218780 - RNA, 19 nt, Human
aucuugcucugcugacaga

SEQ ID NO: 1218781 - RNA, 18 nt, Human
aucuugaauuguaaggaa

SEQ ID NO: 1218782 - RNA, 14 nt, Human
uugccguuauuaaa

SEQ ID NO: 1218783 - RNA, 19 nt, Human
uugccgucuaccugagggg

SEQ ID NO: 1218784 - RNA, 18 nt, Human
uugccgucuaccugaggg

SEQ ID NO: 1218785 - RNA, 15 nt, Human
uugccgucuaccuga

SEQ ID NO: 1218786 - RNA, 13 nt, Human
uugccgucuaccu

SEQ ID NO: 1218787 - RNA, 13 nt, Human
aucuccaaaauaa

SEQ ID NO: 1218788 - RNA, 14 nt, Human
aucucccccagccc

SEQ ID NO: 1218789 - RNA, 13 nt, Human
aucucccccagcc

SEQ ID NO: 1218790 - RNA, 12 nt, Human
aucucccccagc

SEQ ID NO: 1218791 - RNA, 16 nt, Human
aucucacacaugagca

SEQ ID NO: 1218792 - RNA, 15 nt, Human
aucucacacaugagc

SEQ ID NO: 1218793 - RNA, 19 nt, Human
auccuaguuccaccaucaa

SEQ ID NO: 1218794 - RNA, 15 nt, Human
auccuaguuccacca

SEQ ID NO: 1218795 - RNA, 14 nt, Human
aucucagggccugg

SEQ ID NO: 1218796 - RNA, 12 nt, Human
uugcaugaggcu

SEQ ID NO: 1218797 - RNA, 14 nt, Human
uugcaccacugcac

SEQ ID NO: 1218798 - RNA, 16 nt, Human
uugauucagacagcug

SEQ ID NO: 1218799 - RNA, 15 nt, Human
uugauucagacagcu

SEQ ID NO: 1218800 - RNA, 14 nt, Human
uugauucagacagc

SEQ ID NO: 1218801 - RNA, 15 nt, Human
augaaagggcccaga

SEQ ID NO: 1218802 - RNA, 22 nt, Human
uuggggggcugaggugggagga

SEQ ID NO: 1218803 - RNA, 18 nt, Human
uuggcuagagguucaaag

SEQ ID NO: 1218804 - RNA, 23 nt, Human
uuggcgcugccccuggcagcccc

SEQ ID NO: 1218805 - RNA, 13 nt, Human
uuggcugcaggga

SEQ ID NO: 1218806 - RNA, 22 nt, Human
augacacaugcaaggucauuuu

SEQ ID NO: 1218807 - RNA, 14 nt, Human
augacacaugcaag

SEQ ID NO: 1218808 - RNA, 22 nt, Human
augagaaagguugaagcaccaa

SEQ ID NO: 1218809 - RNA, 21 nt, Human
augagaaagguugaagcacca

SEQ ID NO: 1218810 - RNA, 17 nt, Human
augacuuacuguacaug

SEQ ID NO: 1218811 - RNA, 16 nt, Human
augacuuacuguacau

SEQ ID NO: 1218812 - RNA, 18 nt, Human
augacacgaauauugcug

SEQ ID NO: 1218813 - RNA, 14 nt, Human
augacuuacuguac

SEQ ID NO: 1218814 - RNA, 22 nt, Human
augacuuaagcacacuugacau

SEQ ID NO: 1218815 - RNA, 24 nt, Human
uuuauggcuuuugugcauuaucua

SEQ ID NO: 1218816 - RNA, 23 nt, Human
augcugucccuuacgugaguccu

SEQ ID NO: 1218817 - RNA, 19 nt, Human
augcugucccuuacgugag

SEQ ID NO: 1218818 - RNA, 15 nt, Human
auggaacacucugag

SEQ ID NO: 1218819 - RNA, 14 nt, Human
auggaacacucuga

SEQ ID NO: 1218820 - RNA, 15 nt, Human
auggaagacagcucu

SEQ ID NO: 1218821 - RNA, 17 nt, Human
auggaacacucugagac

SEQ ID NO: 1218822 - RNA, 16 nt, Human
auggaacacucugaga

SEQ ID NO: 1218823 - RNA, 15 nt, Human
augcucugcauguua

SEQ ID NO: 1218824 - RNA, 22 nt, Human
augcuguaacuuucugaaauaa

SEQ ID NO: 1218825 - RNA, 16 nt, Human
auggaagacagcucuu

SEQ ID NO: 1218826 - RNA, 19 nt, Human
auggacaugaucuucuuua

SEQ ID NO: 1218827 - RNA, 14 nt, Human
auggacaugaucuu

SEQ ID NO: 1218828 - RNA, 20 nt, Human
auggccuuugcuugaaagaa

SEQ ID NO: 1218829 - RNA, 21 nt, Human
auggccgggcgcgguggcuca

SEQ ID NO: 1218830 - RNA, 19 nt, Human
auggacuaacuugucuuug

SEQ ID NO: 1218831 - RNA, 23 nt, Human
auggacguguuaugacuccagaa

SEQ ID NO: 1218832 - RNA, 18 nt, Human
auggauuuccagccaaag

SEQ ID NO: 1218833 - RNA, 20 nt, Human
auggacguguuaugacucca

SEQ ID NO: 1218834 - RNA, 19 nt, Human
auggacguguuaugacucc

SEQ ID NO: 1218835 - RNA, 23 nt, Human
auggcacaucagcacgauuucug

SEQ ID NO: 1218836 - RNA, 17 nt, Human
auggcacaucagcacga

SEQ ID NO: 1218837 - RNA, 21 nt, Human
augauucaacagguuuuccug

SEQ ID NO: 1218838 - RNA, 19 nt, Human
augauuaaccacuucagcu

SEQ ID NO: 1218839 - RNA, 21 nt, Human
augauuaaccacuucagcuga

SEQ ID NO: 1218840 - RNA, 20 nt, Human
augauuaaccacuucagcug

SEQ ID NO: 1218841 - RNA, 12 nt, Human
augcacuuuguu

SEQ ID NO: 1218842 - RNA, 14 nt, Human
augcaccagcccuu

SEQ ID NO: 1218843 - RNA, 13 nt, Human
augcaccagcccu

SEQ ID NO: 1218844 - RNA, 19 nt, Human
uugugauacaaugcugugc

SEQ ID NO: 1218845 - RNA, 18 nt, Human
uugugauacaaugcugug

SEQ ID NO: 1218846 - RNA, 22 nt, Human
uuguucuggcucuuccaggcug

SEQ ID NO: 1218847 - RNA, 20 nt, Human
uuguucuggcucuuccaggc

SEQ ID NO: 1218848 - RNA, 19 nt, Human
uuguucuggcucuuccagg

SEQ ID NO: 1218849 - RNA, 17 nt, Human
uuguguguuuauuguca

SEQ ID NO: 1218850 - RNA, 13 nt, Human
uugugguuaaucu

SEQ ID NO: 1218851 - RNA, 16 nt, Human
uuguuuucaguguaca

SEQ ID NO: 1218852 - RNA, 13 nt, Human
uuguuuucagugu

SEQ ID NO: 1218853 - RNA, 16 nt, Human
augcacuuuguucugg

SEQ ID NO: 1218854 - RNA, 15 nt, Human
augcacuuuguucug

SEQ ID NO: 1218855 - RNA, 16 nt, Human
uuuaagugcugcauuu

SEQ ID NO: 1218856 - RNA, 15 nt, Human
uuuaagugcugcauu

SEQ ID NO: 1218857 - RNA, 19 nt, Human
uuuaagugcugcauuuaaa

SEQ ID NO: 1218858 - RNA, 17 nt, Human
uuuaagugcugcauuua

SEQ ID NO: 1218859 - RNA, 11 nt, Human
augcccagccc

SEQ ID NO: 1218860 - RNA, 17 nt, Human
augcagccucacagucc

SEQ ID NO: 1218861 - RNA, 15 nt, Human
augcagccucacagu

SEQ ID NO: 1218862 - RNA, 14 nt, Human
augcagccucacag

SEQ ID NO: 1218863 - RNA, 13 nt, Human
augcagccucaca

SEQ ID NO: 1218864 - RNA, 19 nt, Human
uuuaauuuuuuugagacag

SEQ ID NO: 1218865 - RNA, 13 nt, Human
augcagugcuucc

SEQ ID NO: 1218866 - RNA, 21 nt, Human
uucucacugccaugccagcuu

SEQ ID NO: 1218867 - RNA, 14 nt, Human
aucaggccaggccc

SEQ ID NO: 1218868 - RNA, 13 nt, Human
aucaggccaggcc

SEQ ID NO: 1218869 - RNA, 13 nt, Human
uucucagaaucuc

SEQ ID NO: 1218870 - RNA, 19 nt, Human
uucuaaaucuccaaaauaa

SEQ ID NO: 1218871 - RNA, 13 nt, Human
uucgcuccugugu

SEQ ID NO: 1218872 - RNA, 21 nt, Human
uucgcaggauucuuccucccu

SEQ ID NO: 1218873 - RNA, 20 nt, Human
uucccuuuuuuggcugcuga

SEQ ID NO: 1218874 - RNA, 19 nt, Human
uucccuuuuuuggcugcug

SEQ ID NO: 1218875 - RNA, 18 nt, Human
uucccuuuuuuggcugcu

SEQ ID NO: 1218876 - RNA, 15 nt, Human
uucccuauuagagaa

SEQ ID NO: 1218877 - RNA, 20 nt, Human
aucaaccccuucgcuccugu

SEQ ID NO: 1218878 - RNA, 19 nt, Human
aucaaccccuucgcuccug

SEQ ID NO: 1218879 - RNA, 22 nt, Human
aucaaccccuucgcuccugugu

SEQ ID NO: 1218880 - RNA, 21 nt, Human
aucauugaaaucuuuuugcuu

SEQ ID NO: 1218881 - RNA, 23 nt, Human
aucaggccaggcccucugcccac

SEQ ID NO: 1218882 - RNA, 22 nt, Human
aucaggccaggcccucugccca

SEQ ID NO: 1218883 - RNA, 21 nt, Human
aucaggccaggcccucugccc

SEQ ID NO: 1218884 - RNA, 16 nt, Human
uucucuuuucaaaaca

SEQ ID NO: 1218885 - RNA, 17 nt, Human
uucucuacucuagggaa

SEQ ID NO: 1218886 - RNA, 13 nt, Human
uucugccgcagcc

SEQ ID NO: 1218887 - RNA, 19 nt, Human
uucugcagccacuauuguu

SEQ ID NO: 1218888 - RNA, 14 nt, Human
uucugacccaugcu

SEQ ID NO: 1218889 - RNA, 16 nt, Human
uucugacccaugcugc

SEQ ID NO: 1218890 - RNA, 15 nt, Human
uucuggcucuuccag

SEQ ID NO: 1218891 - RNA, 16 nt, Human
uucugccgcagcccug

SEQ ID NO: 1218892 - RNA, 20 nt, Human
uucuggcuaugcauuugaaa

SEQ ID NO: 1218893 - RNA, 18 nt, Human
uucuggcuaugcauuuga

SEQ ID NO: 1218894 - RNA, 15 nt, Human
uucugccgcagcccu

SEQ ID NO: 1218895 - RNA, 14 nt, Human
uucugccgcagccc

SEQ ID NO: 1218896 - RNA, 13 nt, Human
auccuaguuccac

SEQ ID NO: 1218897 - RNA, 21 nt, Human
auccuaggcauuugcugaaua

SEQ ID NO: 1218898 - RNA, 21 nt, Human
uugaaauuuuuauuaaauuau

SEQ ID NO: 1218899 - RNA, 11 nt, Human
uugaaaucuuu

SEQ ID NO: 1218900 - RNA, 20 nt, Human
uugaaauauaggaacuuaaa

SEQ ID NO: 1218901 - RNA, 13 nt, Human
uucuugcaaagua

SEQ ID NO: 1218902 - RNA, 12 nt, Human
uucuugcaaagu

SEQ ID NO: 1218903 - RNA, 22 nt, Human
uucuuucuggcuaugcauuuga

SEQ ID NO: 1218904 - RNA, 13 nt, Human
uucuuaauucuua

SEQ ID NO: 1218905 - RNA, 20 nt, Human
uucuguuuuucuaggccugg

SEQ ID NO: 1218906 - RNA, 21 nt, Human
uucuguuggccagugugacaa

SEQ ID NO: 1218907 - RNA, 18 nt, Human
uucuguucuuucuggcua

SEQ ID NO: 1218908 - RNA, 17 nt, Human
auaggaaaaacugauuu

SEQ ID NO: 1218909 - RNA, 16 nt, Human
auaggaaaaacugauu

SEQ ID NO: 1218910 - RNA, 14 nt, Human
auaggaaaaacuga

SEQ ID NO: 1218911 - RNA, 12 nt, Human
auaggaaaaacu

SEQ ID NO: 1218912 - RNA, 19 nt, Human
auaggaacuuaaauaaugu

SEQ ID NO: 1218913 - RNA, 20 nt, Human
uucacaguucucuccuucuu

SEQ ID NO: 1218914 - RNA, 15 nt, Human
uucacaguucucucc

SEQ ID NO: 1218915 - RNA, 20 nt, Human
uucacagaugggugcuugga

SEQ ID NO: 1218916 - RNA, 18 nt, Human
uuauuuuuagacagaguc

SEQ ID NO: 1218917 - RNA, 17 nt, Human
uuauuuuuagacagagu

SEQ ID NO: 1218918 - RNA, 17 nt, Human
uucaaaauaaaaaugag

SEQ ID NO: 1218919 - RNA, 21 nt, Human
uucaagcgauucuucugcuuc

SEQ ID NO: 1218920 - RNA, 13 nt, Human
auauauaaccagu

SEQ ID NO: 1218921 - RNA, 12 nt, Human
auauauaaccag

SEQ ID NO: 1218922 - RNA, 22 nt, Human
auaguuggcuaggaccccucca

SEQ ID NO: 1218923 - RNA, 22 nt, Human
auaguuaagcgugcauaaguua

SEQ ID NO: 1218924 - RNA, 15 nt, Human
auaguggugugauuu

SEQ ID NO: 1218925 - RNA, 17 nt, Human
auaguggcuuaaaacaa

SEQ ID NO: 1218926 - RNA, 18 nt, Human
uucauuuaggugaggaag

SEQ ID NO: 1218927 - RNA, 17 nt, Human
uuccaaggguacuaagg

SEQ ID NO: 1218928 - RNA, 15 nt, Human
uuccaaggguacuaa

SEQ ID NO: 1218929 - RNA, 16 nt, Human
auauguggaguucauc

SEQ ID NO: 1218930 - RNA, 15 nt, Human
auauguggaguucau

SEQ ID NO: 1218931 - RNA, 19 nt, Human
uuccaccaucaagccacca

SEQ ID NO: 1218932 - RNA, 22 nt, Human
uucccaccucucucacuccuug

SEQ ID NO: 1218933 - RNA, 12 nt, Human
uucccaccucuc

SEQ ID NO: 1218934 - RNA, 18 nt, Human
uucccaagcucugcuccu

SEQ ID NO: 1218935 - RNA, 16 nt, Human
uucccaagcucugcuc

SEQ ID NO: 1218936 - RNA, 15 nt, Human
uucccaagcucugcu

SEQ ID NO: 1218937 - RNA, 14 nt, Human
uucccaagcucugc

SEQ ID NO: 1218938 - RNA, 13 nt, Human
uucccaagcucug

SEQ ID NO: 1218939 - RNA, 22 nt, Human
uuccagugaggcucugcccuug

SEQ ID NO: 1218940 - RNA, 21 nt, Human
uuccagugaggcucugcccuu

SEQ ID NO: 1218941 - RNA, 20 nt, Human
uuccagugaggcucugcccu

SEQ ID NO: 1218942 - RNA, 19 nt, Human
uuccagugaggcucugccc

SEQ ID NO: 1218943 - RNA, 13 nt, Human
uuccaggcuggga

SEQ ID NO: 1218944 - RNA, 21 nt, Human
uuccaggggugggacacccug

SEQ ID NO: 1218945 - RNA, 23 nt, Human
uucccaaagcagugcaugcuguc

SEQ ID NO: 1218946 - RNA, 17 nt, Human
uuccagguuuaagcugu

SEQ ID NO: 1218947 - RNA, 22 nt, Human
auaucugaaaauguauguguaa

SEQ ID NO: 1218948 - RNA, 20 nt, Human
auaucugaaaauguaugugu

SEQ ID NO: 1218949 - RNA, 17 nt, Human
auaucugaaaauguaug

SEQ ID NO: 1218950 - RNA, 16 nt, Human
auaucugaaaauguau

SEQ ID NO: 1218951 - RNA, 22 nt, Human
auaugcacacauuuuuuaaaug

SEQ ID NO: 1218952 - RNA, 16 nt, Human
auaugcacacauuuuu

SEQ ID NO: 1218953 - RNA, 15 nt, Human
auaugcacacauuuu

SEQ ID NO: 1218954 - RNA, 14 nt, Human
auaugcacacauuu

SEQ ID NO: 1218955 - RNA, 17 nt, Human
auauguaacaagccacc

SEQ ID NO: 1218956 - RNA, 16 nt, Human
auauguaacaagccac

SEQ ID NO: 1218957 - RNA, 18 nt, Human
uucagugccuuauggaac

SEQ ID NO: 1218958 - RNA, 13 nt, Human
uucagugccuuau

SEQ ID NO: 1218959 - RNA, 12 nt, Human
uucagugccuua

SEQ ID NO: 1218960 - RNA, 13 nt, Human
uucagaaaugugu

SEQ ID NO: 1218961 - RNA, 11 nt, Human
uucagaaaugu

SEQ ID NO: 1218962 - RNA, 21 nt, Human
uucaucccucuggggcuguuc

SEQ ID NO: 1218963 - RNA, 17 nt, Human
uucaucccucuggggcu

SEQ ID NO: 1218964 - RNA, 14 nt, Human
uuagcggagacgga

SEQ ID NO: 1218965 - RNA, 18 nt, Human
uuagccaagugugguaga

SEQ ID NO: 1218966 - RNA, 18 nt, Human
auaauuuaccugaagucu

SEQ ID NO: 1218967 - RNA, 18 nt, Human
uuagcaaauucuguuuuu

SEQ ID NO: 1218968 - RNA, 22 nt, Human
uuaguuugcaguuacacuaaaa

SEQ ID NO: 1218969 - RNA, 15 nt, Human
uuaguuucuccaagc

SEQ ID NO: 1218970 - RNA, 21 nt, Human
uuaggugugacugaauuucuu

SEQ ID NO: 1218971 - RNA, 16 nt, Human
uuaggugugacugaau

SEQ ID NO: 1218972 - RNA, 16 nt, Human
uuaggugaggaagcaa

SEQ ID NO: 1218973 - RNA, 20 nt, Human
uuagggaaggauacaaaagc

SEQ ID NO: 1218974 - RNA, 21 nt, Human
auaauacaccacuacauucug

SEQ ID NO: 1218975 - RNA, 20 nt, Human
auaauacaccacuacauucu

SEQ ID NO: 1218976 - RNA, 18 nt, Human
auaauacaccacuacauu

SEQ ID NO: 1218977 - RNA, 12 nt, Human
auaauacaccac

SEQ ID NO: 1218978 - RNA, 14 nt, Human
uuagacagucccug

SEQ ID NO: 1218979 - RNA, 22 nt, Human
auaauugacaggauuauuggaa

SEQ ID NO: 1218980 - RNA, 20 nt, Human
auaaugcgugcauaccacuu

SEQ ID NO: 1218981 - RNA, 15 nt, Human
auaaugcgugcauac

SEQ ID NO: 1218982 - RNA, 15 nt, Human
auaaugaaugaaaca

SEQ ID NO: 1218983 - RNA, 11 nt, Human
auaaauuauuu

SEQ ID NO: 1218984 - RNA, 16 nt, Human
auaacuaaaagguaug

SEQ ID NO: 1218985 - RNA, 13 nt, Human
uuagacagucccu

SEQ ID NO: 1218986 - RNA, 20 nt, Human
uuagacagagucucacuguu

SEQ ID NO: 1218987 - RNA, 19 nt, Human
uuacccucauguucuuaau

SEQ ID NO: 1218988 - RNA, 17 nt, Human
aguuggguggaugccug

SEQ ID NO: 1218989 - RNA, 19 nt, Human
aguugggcuuccucauagu

SEQ ID NO: 1218990 - RNA, 23 nt, Human
aguugccagucaccccggccacc

SEQ ID NO: 1218991 - RNA, 13 nt, Human
uuaaaaaaaaucc

SEQ ID NO: 1218992 - RNA, 17 nt, Human
aguuggucccccuucca

SEQ ID NO: 1218993 - RNA, 13 nt, Human
aguuggucccccu

SEQ ID NO: 1218994 - RNA, 11 nt, Human
aguuggucccc

SEQ ID NO: 1218995 - RNA, 20 nt, Human
uuaacagaaauguacagcaa

SEQ ID NO: 1218996 - RNA, 19 nt, Human
uuaacagaaauguacagca

SEQ ID NO: 1218997 - RNA, 19 nt, Human
uuaaauaaugugaaacugg

SEQ ID NO: 1218998 - RNA, 18 nt, Human
uuaaauaaugugaaacug

SEQ ID NO: 1218999 - RNA, 16 nt, Human
uuaaauaaugugaaac

SEQ ID NO: 1219000 - RNA, 17 nt, Human
uuaaaaaucucaaauuu

SEQ ID NO: 1219001 - RNA, 16 nt, Human
uuaaaaaucucaaauu

SEQ ID NO: 1219002 - RNA, 15 nt, Human
uuaaaaaucucaaau

SEQ ID NO: 1219003 - RNA, 14 nt, Human
uuaaaaaucucaaa

SEQ ID NO: 1219004 - RNA, 15 nt, Human
uuaaauaaugugaaa

SEQ ID NO: 1219005 - RNA, 21 nt, Human
uuaagaaaaaggaugcacaga

SEQ ID NO: 1219006 - RNA, 20 nt, Human
uuaagaaaaaggaugcacag

SEQ ID NO: 1219007 - RNA, 23 nt, Human
aguuuuuauggcuuuugugcauu

SEQ ID NO: 1219008 - RNA, 22 nt, Human
uuaagugcugcauuuaaaagau

SEQ ID NO: 1219009 - RNA, 19 nt, Human
uuaagugcugcauuuaaaa

SEQ ID NO: 1219010 - RNA, 16 nt, Human
uuaagugcugcauuua

SEQ ID NO: 1219011 - RNA, 15 nt, Human
uuaagugcugcauuu

SEQ ID NO: 1219012 - RNA, 9 nt, Human
uuaaggugg

SEQ ID NO: 1219013 - RNA, 22 nt, Human
uuaagaaagacuaucuaaaugu

SEQ ID NO: 1219014 - RNA, 20 nt, Human
uuaaugaaagacuguacaaa

SEQ ID NO: 1219015 - RNA, 19 nt, Human
uuaaugaaagacuguacaa

SEQ ID NO: 1219016 - RNA, 18 nt, Human
uuaaugaaagacuguaca

SEQ ID NO: 1219017 - RNA, 22 nt, Human
uuaaucugguuuauuuuuguuc

SEQ ID NO: 1219018 - RNA, 23 nt, Human
uuaaucauuaggugugacugaau

SEQ ID NO: 1219019 - RNA, 22 nt, Human
uuaaucauuaggugugacugaa

SEQ ID NO: 1219020 - RNA, 13 nt, Human
uuaaucauuaggu

SEQ ID NO: 1219021 - RNA, 18 nt, Human
uguucuuaguuugcaguu

SEQ ID NO: 1219022 - RNA, 18 nt, Human
uguucuagcauggcugcc

SEQ ID NO: 1219023 - RNA, 20 nt, Human
uguugcccaggcuggcgugc

SEQ ID NO: 1219024 - RNA, 15 nt, Human
uguugcccaggcugg

SEQ ID NO: 1219025 - RNA, 13 nt, Human
uguugcccaggcu

SEQ ID NO: 1219026 - RNA, 19 nt, Human
uguucuuucacccuuuucu

SEQ ID NO: 1219027 - RNA, 22 nt, Human
uguucuugguuuguaaauuaac

SEQ ID NO: 1219028 - RNA, 20 nt, Human
uguucuugguuuguaaauua

SEQ ID NO: 1219029 - RNA, 17 nt, Human
uguuuauugucaaagug

SEQ ID NO: 1219030 - RNA, 14 nt, Human
uguuuauugucaaa

SEQ ID NO: 1219031 - RNA, 12 nt, Human
aguucucuccuu

SEQ ID NO: 1219032 - RNA, 16 nt, Human
aguucaauucucauuu

SEQ ID NO: 1219033 - RNA, 23 nt, Human
aguuccucauuagcauuuugcua

SEQ ID NO: 1219034 - RNA, 14 nt, Human
uguguuaugaagca

SEQ ID NO: 1219035 - RNA, 16 nt, Human
ugugucucuugguccu

SEQ ID NO: 1219036 - RNA, 13 nt, Human
ugugucucuuggu

SEQ ID NO: 1219037 - RNA, 20 nt, Human
ugugucagguggggcagcuu

SEQ ID NO: 1219038 - RNA, 19 nt, Human
ugugucagguggggcagcu

SEQ ID NO: 1219039 - RNA, 17 nt, Human
ugugucagguggggcag

SEQ ID NO: 1219040 - RNA, 19 nt, Human
aguggaaaaauagccugcc

SEQ ID NO: 1219041 - RNA, 18 nt, Human
aguggaaaaauagccugc

SEQ ID NO: 1219042 - RNA, 11 nt, Human
aguggaaaaau

SEQ ID NO: 1219043 - RNA, 19 nt, Human
uguuaaugauagcuacugu

SEQ ID NO: 1219044 - RNA, 21 nt, Human
uguuaacauggacaugaucuu

SEQ ID NO: 1219045 - RNA, 12 nt, Human
ugugguuucauu

SEQ ID NO: 1219046 - RNA, 16 nt, Human
agugcuuccaaggaug

SEQ ID NO: 1219047 - RNA, 17 nt, Human
agugccuuacacaaugg

SEQ ID NO: 1219048 - RNA, 20 nt, Human
agugcugcauuuaaaagaua

SEQ ID NO: 1219049 - RNA, 15 nt, Human
agugccuuacacaau

SEQ ID NO: 1219050 - RNA, 20 nt, Human
agugcugggauuacaagcgu

SEQ ID NO: 1219051 - RNA, 22 nt, Human
agugcugcauuuaaaagauaca

SEQ ID NO: 1219052 - RNA, 20 nt, Human
agugcugggauuacaggugu

SEQ ID NO: 1219053 - RNA, 19 nt, Human
agugcugggauuacaggug

SEQ ID NO: 1219054 - RNA, 15 nt, Human
ugugcugcccugccc

SEQ ID NO: 1219055 - RNA, 14 nt, Human
ugugcugcccugcc

SEQ ID NO: 1219056 - RNA, 13 nt, Human
ugugcugcccugc

SEQ ID NO: 1219057 - RNA, 19 nt, Human
ugugcucuggacaggcaug

SEQ ID NO: 1219058 - RNA, 18 nt, Human
ugugcucuggacaggcau

SEQ ID NO: 1219059 - RNA, 16 nt, Human
ugugcucuggacaggc

SEQ ID NO: 1219060 - RNA, 21 nt, Human
ugugcccuaaaguguauuuuu

SEQ ID NO: 1219061 - RNA, 20 nt, Human
ugugcccuaaaguguauuuu

SEQ ID NO: 1219062 - RNA, 21 nt, Human
agucucacuguugcccaggcu

SEQ ID NO: 1219063 - RNA, 20 nt, Human
agucucacuguugcccaggc

SEQ ID NO: 1219064 - RNA, 19 nt, Human
agucucacuguugcccagg

SEQ ID NO: 1219065 - RNA, 18 nt, Human
agucucacuguugcccag

SEQ ID NO: 1219066 - RNA, 15 nt, Human
ugugcucuggacagg

SEQ ID NO: 1219067 - RNA, 23 nt, Human
ugugcucugaucauccacugugc

SEQ ID NO: 1219068 - RNA, 22 nt, Human
ugugcucugaucauccacugug

SEQ ID NO: 1219069 - RNA, 14 nt, Human
agugcccacaggau

SEQ ID NO: 1219070 - RNA, 14 nt, Human
agugcaugcugucc

SEQ ID NO: 1219071 - RNA, 16 nt, Human
agugccaaaaacaaca

SEQ ID NO: 1219072 - RNA, 21 nt, Human
agugaguugauagcacagacc

SEQ ID NO: 1219073 - RNA, 24 nt, Human
agugauucuccugccucagccucc

SEQ ID NO: 1219074 - RNA, 22 nt, Human
agugauucuccugccucagccu

SEQ ID NO: 1219075 - RNA, 16 nt, Human
agugagucgaggacag

SEQ ID NO: 1219076 - RNA, 17 nt, Human
aggugguuauggagagg

SEQ ID NO: 1219077 - RNA, 14 nt, Human
agguuggugggggc

SEQ ID NO: 1219078 - RNA, 17 nt, Human
uguaacuuucugaaaua

SEQ ID NO: 1219079 - RNA, 22 nt, Human
uguaagcucuacugaggugcua

SEQ ID NO: 1219080 - RNA, 23 nt, Human
aggucuugaacuccuggccucaa

SEQ ID NO: 1219081 - RNA, 20 nt, Human
aggugcacaagcuccaagcu

SEQ ID NO: 1219082 - RNA, 18 nt, Human
aggugcacaagcuccaag

SEQ ID NO: 1219083 - RNA, 17 nt, Human
aggugcacaagcuccaa

SEQ ID NO: 1219084 - RNA, 16 nt, Human
aggugcacaagcucca

SEQ ID NO: 1219085 - RNA, 15 nt, Human
aggugcacaagcucc

SEQ ID NO: 1219086 - RNA, 20 nt, Human
aggugggauccuccaggugc

SEQ ID NO: 1219087 - RNA, 21 nt, Human
aggugcacaagcuccaagcuc

SEQ ID NO: 1219088 - RNA, 14 nt, Human
uguaauuugugaua

SEQ ID NO: 1219089 - RNA, 14 nt, Human
uguagagugggagc

SEQ ID NO: 1219090 - RNA, 13 nt, Human
uguagagugggag

SEQ ID NO: 1219091 - RNA, 20 nt, Human
aguaauaugcacacauuuuu

SEQ ID NO: 1219092 - RNA, 19 nt, Human
aguaauaugcacacauuuu

SEQ ID NO: 1219093 - RNA, 18 nt, Human
aguaauaugcacacauuu

SEQ ID NO: 1219094 - RNA, 11 nt, Human
agguuuuccug

SEQ ID NO: 1219095 - RNA, 20 nt, Human
aguacacuguuucaaacuuu

SEQ ID NO: 1219096 - RNA, 16 nt, Human
aguacacuguuucaaa

SEQ ID NO: 1219097 - RNA, 14 nt, Human
aguacacuguuuca

SEQ ID NO: 1219098 - RNA, 17 nt, Human
aguagaagucuuagaug

SEQ ID NO: 1219099 - RNA, 12 nt, Human
aguagagacagg

SEQ ID NO: 1219100 - RNA, 20 nt, Human
uguaggaagguuaauguuca

SEQ ID NO: 1219101 - RNA, 16 nt, Human
ugucagguggggcagc

SEQ ID NO: 1219102 - RNA, 19 nt, Human
ugucagcugaaccugggua

SEQ ID NO: 1219103 - RNA, 19 nt, Human
agucacugagacagcccgg

SEQ ID NO: 1219104 - RNA, 16 nt, Human
ugucagcugaaccugg

SEQ ID NO: 1219105 - RNA, 14 nt, Human
agucaccaagccca

SEQ ID NO: 1219106 - RNA, 13 nt, Human
agucaccaagccc

SEQ ID NO: 1219107 - RNA, 16 nt, Human
uguauuuuuuuacuaa

SEQ ID NO: 1219108 - RNA, 14 nt, Human
uguauuuuuuuacu

SEQ ID NO: 1219109 - RNA, 15 nt, Human
ugucaagccauaauu

SEQ ID NO: 1219110 - RNA, 19 nt, Human
ugucaagagggucugagga

SEQ ID NO: 1219111 - RNA, 22 nt, Human
aguaggaagacuuuggaaagac

SEQ ID NO: 1219112 - RNA, 19 nt, Human
aguaggaagacuuuggaaa

SEQ ID NO: 1219113 - RNA, 18 nt, Human
aguaggaagacuuuggaa

SEQ ID NO: 1219114 - RNA, 17 nt, Human
aguaggaagacuuugga

SEQ ID NO: 1219115 - RNA, 16 nt, Human
aguaggaagacuuugg

SEQ ID NO: 1219116 - RNA, 12 nt, Human
agucccugccaa

SEQ ID NO: 1219117 - RNA, 19 nt, Human
agucagggguucccuuuuu

SEQ ID NO: 1219118 - RNA, 17 nt, Human
agucucacuguugccca

SEQ ID NO: 1219119 - RNA, 16 nt, Human
agucucacuguugccc

SEQ ID NO: 1219120 - RNA, 23 nt, Human
aguccgaaagggacuuggaagcu

SEQ ID NO: 1219121 - RNA, 15 nt, Human
ugucgggcaugacac

SEQ ID NO: 1219122 - RNA, 14 nt, Human
ugucgggcaugaca

SEQ ID NO: 1219123 - RNA, 15 nt, Human
ugucgcccagucugg

SEQ ID NO: 1219124 - RNA, 14 nt, Human
ugucgcccagucug

SEQ ID NO: 1219125 - RNA, 12 nt, Human
ugucgggcauga

SEQ ID NO: 1219126 - RNA, 14 nt, Human
uguccgagcuuuga

SEQ ID NO: 1219127 - RNA, 13 nt, Human
uguccgagcuuug

SEQ ID NO: 1219128 - RNA, 16 nt, Human
uguccuacccacccuc

SEQ ID NO: 1219129 - RNA, 16 nt, Human
ugguacuaacuuuccu

SEQ ID NO: 1219130 - RNA, 15 nt, Human
agggugggagugggc

SEQ ID NO: 1219131 - RNA, 22 nt, Human
ugggugcuuggaggaaggaaac

SEQ ID NO: 1219132 - RNA, 19 nt, Human
ugggugcuuggaggaagga

SEQ ID NO: 1219133 - RNA, 15 nt, Human
ugggugcuuggagga

SEQ ID NO: 1219134 - RNA, 22 nt, Human
agggucucacucugucgcccag

SEQ ID NO: 1219135 - RNA, 20 nt, Human
uggggucacucuggcagcuc

SEQ ID NO: 1219136 - RNA, 19 nt, Human
uggggucacucuggcagcu

SEQ ID NO: 1219137 - RNA, 23 nt, Human
aggggagcaaaaucgaugcagug

SEQ ID NO: 1219138 - RNA, 23 nt, Human
agggucucacuauguugcccagg

SEQ ID NO: 1219139 - RNA, 22 nt, Human
agggucucacuauguugcccag

SEQ ID NO: 1219140 - RNA, 21 nt, Human
agggucucacuauguugccca

SEQ ID NO: 1219141 - RNA, 24 nt, Human
agggguucccuuuuuuggcugcug

SEQ ID NO: 1219142 - RNA, 22 nt, Human
aggggugggacacccugugaug

SEQ ID NO: 1219143 - RNA, 20 nt, Human
aggggugggacacccuguga

SEQ ID NO: 1219144 - RNA, 18 nt, Human
aggggguggccucccaac

SEQ ID NO: 1219145 - RNA, 17 nt, Human
aggggguggccucccaa

SEQ ID NO: 1219146 - RNA, 15 nt, Human
aggggguggccuccc

SEQ ID NO: 1219147 - RNA, 23 nt, Human
uggucucaaacucuugaccucag

SEQ ID NO: 1219148 - RNA, 17 nt, Human
uggucucaaacucuuga

SEQ ID NO: 1219149 - RNA, 13 nt, Human
uggucccacucag

SEQ ID NO: 1219150 - RNA, 16 nt, Human
uggucccaccccacac

SEQ ID NO: 1219151 - RNA, 16 nt, Human
uggucucaaacucuug

SEQ ID NO: 1219152 - RNA, 20 nt, Human
uggucaccaaaucagcugcu

SEQ ID NO: 1219153 - RNA, 18 nt, Human
uggucaccaaaucagcug

SEQ ID NO: 1219154 - RNA, 15 nt, Human
uggucccaccccaca

SEQ ID NO: 1219155 - RNA, 14 nt, Human
uggucccaccccac

SEQ ID NO: 1219156 - RNA, 13 nt, Human
aggguuauaauaa

SEQ ID NO: 1219157 - RNA, 22 nt, Human
aggguguccggucccuguccca

SEQ ID NO: 1219158 - RNA, 18 nt, Human
uggucugacccacugcuu

SEQ ID NO: 1219159 - RNA, 17 nt, Human
uggucugacccacugcu

SEQ ID NO: 1219160 - RNA, 16 nt, Human
uggucugacccacugc

SEQ ID NO: 1219161 - RNA, 20 nt, Human
aggucauuuuuuuuaagaaa

SEQ ID NO: 1219162 - RNA, 17 nt, Human
aggucauuuuuuuuaag

SEQ ID NO: 1219163 - RNA, 13 nt, Human
aggucagagccug

SEQ ID NO: 1219164 - RNA, 12 nt, Human
aggucagagccu

SEQ ID NO: 1219165 - RNA, 23 nt, Human
aggguuggccccugcccggcugc

SEQ ID NO: 1219166 - RNA, 18 nt, Human
aggguuggccccugcccg

SEQ ID NO: 1219167 - RNA, 13 nt, Human
aggguugggcugg

SEQ ID NO: 1219168 - RNA, 19 nt, Human
agguagaaauaucugaaaa

SEQ ID NO: 1219169 - RNA, 17 nt, Human
agguagaaauaucugaa

SEQ ID NO: 1219170 - RNA, 23 nt, Human
agguagaaauaucugaaaaugua

SEQ ID NO: 1219171 - RNA, 21 nt, Human
agguaugcaaucaaaucugcu

SEQ ID NO: 1219172 - RNA, 22 nt, Human
uggggcugcaccggcuggccug

SEQ ID NO: 1219173 - RNA, 20 nt, Human
uggggcugcaccggcuggcc

SEQ ID NO: 1219174 - RNA, 14 nt, Human
ugggguacccacug

SEQ ID NO: 1219175 - RNA, 15 nt, Human
ugggguaugggagag

SEQ ID NO: 1219176 - RNA, 18 nt, Human
uggggucacucuggcagc

SEQ ID NO: 1219177 - RNA, 17 nt, Human
uggggucacucuggcag

SEQ ID NO: 1219178 - RNA, 16 nt, Human
ugggguacccacugcu

SEQ ID NO: 1219179 - RNA, 15 nt, Human
ugggguacccacugc

SEQ ID NO: 1219180 - RNA, 14 nt, Human
uggggcccugccuc

SEQ ID NO: 1219181 - RNA, 12 nt, Human
uggggagaaagu

SEQ ID NO: 1219182 - RNA, 23 nt, Human
uggggaccucaggccugggggcu

SEQ ID NO: 1219183 - RNA, 16 nt, Human
uggggcccugccuccu

SEQ ID NO: 1219184 - RNA, 15 nt, Human
uggggcccugccucc

SEQ ID NO: 1219185 - RNA, 18 nt, Human
uggggcggugagagggga

SEQ ID NO: 1219186 - RNA, 15 nt, Human
uggggaccagagcug

SEQ ID NO: 1219187 - RNA, 14 nt, Human
uggggaccagagcu

SEQ ID NO: 1219188 - RNA, 13 nt, Human
uggggaccucagg

SEQ ID NO: 1219189 - RNA, 18 nt, Human
uggggaccagagcugcca

SEQ ID NO: 1219190 - RNA, 17 nt, Human
uggggaccagagcugcc

SEQ ID NO: 1219191 - RNA, 23 nt, Human
ugggcuggguucuacccaggugc

SEQ ID NO: 1219192 - RNA, 19 nt, Human
ugggcuggguucuacccag

SEQ ID NO: 1219193 - RNA, 18 nt, Human
ugggcuggguucuaccca

SEQ ID NO: 1219194 - RNA, 19 nt, Human
ugggcucccuucccaccuc

SEQ ID NO: 1219195 - RNA, 18 nt, Human
ugggcucccuucccaccu

SEQ ID NO: 1219196 - RNA, 23 nt, Human
agggcuucugccauuucugagau

SEQ ID NO: 1219197 - RNA, 21 nt, Human
ugggcucccuucccaccucuc

SEQ ID NO: 1219198 - RNA, 20 nt, Human
ugggcucccuucccaccucu

SEQ ID NO: 1219199 - RNA, 23 nt, Human
agggcccagagaggguggugacc

SEQ ID NO: 1219200 - RNA, 20 nt, Human
agggagugacagaggcagcc

SEQ ID NO: 1219201 - RNA, 19 nt, Human
agggagugacagaggcagc

SEQ ID NO: 1219202 - RNA, 18 nt, Human
agggagugacagaggcag

SEQ ID NO: 1219203 - RNA, 17 nt, Human
agggagugacagaggca

SEQ ID NO: 1219204 - RNA, 17 nt, Human
agggaggugaccccagg

SEQ ID NO: 1219205 - RNA, 23 nt, Human
ugggaggucaaggcugcagugag

SEQ ID NO: 1219206 - RNA, 20 nt, Human
ugggaggucaaggcugcagu

SEQ ID NO: 1219207 - RNA, 19 nt, Human
ugggaggucaaggcugcag

SEQ ID NO: 1219208 - RNA, 18 nt, Human
ugggaggucaaggcugca

SEQ ID NO: 1219209 - RNA, 20 nt, Human
ugggcccaaugcacuuuguu

SEQ ID NO: 1219210 - RNA, 16 nt, Human
ugggccaggagccucc

SEQ ID NO: 1219211 - RNA, 14 nt, Human
ugggccaggagccu

SEQ ID NO: 1219212 - RNA, 13 nt, Human
ugggccaggagcc

SEQ ID NO: 1219213 - RNA, 21 nt, Human
ugggcaacccccagccugcua

SEQ ID NO: 1219214 - RNA, 20 nt, Human
ugggcaacccccagccugcu

SEQ ID NO: 1219215 - RNA, 17 nt, Human
ugggcaacccccagccu

SEQ ID NO: 1219216 - RNA, 21 nt, Human
ugcuugaggcaacucaucuua

SEQ ID NO: 1219217 - RNA, 13 nt, Human
ugcuuguacauaa

SEQ ID NO: 1219218 - RNA, 12 nt, Human
ugcuuguacaua

SEQ ID NO: 1219219 - RNA, 16 nt, Human
ugcuuggaggaaggaa

SEQ ID NO: 1219220 - RNA, 15 nt, Human
ugcuuggaggaagga

SEQ ID NO: 1219221 - RNA, 14 nt, Human
ugcuuggaggaagg

SEQ ID NO: 1219222 - RNA, 17 nt, Human
ugcuuuuggucugugug

SEQ ID NO: 1219223 - RNA, 14 nt, Human
ugcuuuuggucugu

SEQ ID NO: 1219224 - RNA, 17 nt, Human
ugcuuugugauuuuugu

SEQ ID NO: 1219225 - RNA, 16 nt, Human
ugcuuugugauuuuug

SEQ ID NO: 1219226 - RNA, 14 nt, Human
ugcuuugugauuuu

SEQ ID NO: 1219227 - RNA, 12 nt, Human
ugcuuugugauu

SEQ ID NO: 1219228 - RNA, 22 nt, Human
ugcuuguacauaaugcgugcau

SEQ ID NO: 1219229 - RNA, 16 nt, Human
ugcuuguacauaaugc

SEQ ID NO: 1219230 - RNA, 14 nt, Human
ugcuuguacauaau

SEQ ID NO: 1219231 - RNA, 14 nt, Human
aggauccugagcca

SEQ ID NO: 1219232 - RNA, 13 nt, Human
aggauccugagcc

SEQ ID NO: 1219233 - RNA, 18 nt, Human
uggaaguacuauaauuua

SEQ ID NO: 1219234 - RNA, 16 nt, Human
uggaagcacagcuuca

SEQ ID NO: 1219235 - RNA, 18 nt, Human
uggaaaugggcagagcag

SEQ ID NO: 1219236 - RNA, 17 nt, Human
uggaaaugggcagagca

SEQ ID NO: 1219237 - RNA, 19 nt, Human
aggaucucuugagccuggg

SEQ ID NO: 1219238 - RNA, 18 nt, Human
aggaucucuugagccugg

SEQ ID NO: 1219239 - RNA, 17 nt, Human
aggaucucuugagccug

SEQ ID NO: 1219240 - RNA, 22 nt, Human
uggacacagcucuucuccaggc

SEQ ID NO: 1219241 - RNA, 14 nt, Human
uggacacagcucuu

SEQ ID NO: 1219242 - RNA, 13 nt, Human
uggacacagcucu

SEQ ID NO: 1219243 - RNA, 20 nt, Human
uggaccuugaacuggguacu

SEQ ID NO: 1219244 - RNA, 23 nt, Human
uggacccuguggaugauaaaaca

SEQ ID NO: 1219245 - RNA, 21 nt, Human
uggacccugaggcccagaggg

SEQ ID NO: 1219246 - RNA, 20 nt, Human
uggacccugaggcccagagg

SEQ ID NO: 1219247 - RNA, 19 nt, Human
uggacccugaggcccagag

SEQ ID NO: 1219248 - RNA, 18 nt, Human
uggacccugaggcccaga

SEQ ID NO: 1219249 - RNA, 16 nt, Human
uggacccugaggccca

SEQ ID NO: 1219250 - RNA, 23 nt, Human
uggacacagcucuucuccaggcu

SEQ ID NO: 1219251 - RNA, 22 nt, Human
aggcacccaccaucaugucugg

SEQ ID NO: 1219252 - RNA, 21 nt, Human
aggcacccaccaucaugucug

SEQ ID NO: 1219253 - RNA, 20 nt, Human
aggcacccaccaucaugucu

SEQ ID NO: 1219254 - RNA, 14 nt, Human
aggcaaugcuggcu

SEQ ID NO: 1219255 - RNA, 22 nt, Human
uggagaagcggcuggcagccca

SEQ ID NO: 1219256 - RNA, 13 nt, Human
uggagaagcggcu

SEQ ID NO: 1219257 - RNA, 11 nt, Human
uggacuuuguu

SEQ ID NO: 1219258 - RNA, 21 nt, Human
uggccuggccccucagggucc

SEQ ID NO: 1219259 - RNA, 18 nt, Human
uggccuggccccucaggg

SEQ ID NO: 1219260 - RNA, 18 nt, Human
uggccugagcugggauga

SEQ ID NO: 1219261 - RNA, 20 nt, Human
aggccugggggcugggcaga

SEQ ID NO: 1219262 - RNA, 18 nt, Human
aggccugggggcugggca

SEQ ID NO: 1219263 - RNA, 12 nt, Human
aggccuggggac

SEQ ID NO: 1219264 - RNA, 13 nt, Human
uggccucuucaga

SEQ ID NO: 1219265 - RNA, 13 nt, Human
uggcccacgcacu

SEQ ID NO: 1219266 - RNA, 12 nt, Human
aggccccugcca

SEQ ID NO: 1219267 - RNA, 17 nt, Human
aggccccgcccaggcuu

SEQ ID NO: 1219268 - RNA, 23 nt, Human
uggccagugugacaaggauugcu

SEQ ID NO: 1219269 - RNA, 23 nt, Human
uggccaaagccaaagcuaggccu

SEQ ID NO: 1219270 - RNA, 21 nt, Human
uggccaaagccaaagcuaggc

SEQ ID NO: 1219271 - RNA, 21 nt, Human
aggcccagagggccugcaagg

SEQ ID NO: 1219272 - RNA, 20 nt, Human
aggccagagggagugacaga

SEQ ID NO: 1219273 - RNA, 16 nt, Human
aggccccgcccaggcu

SEQ ID NO: 1219274 - RNA, 14 nt, Human
aggccagagggagu

SEQ ID NO: 1219275 - RNA, 19 nt, Human
aggccacaagacccuugug

SEQ ID NO: 1219276 - RNA, 18 nt, Human
aggccacaagacccuugu

SEQ ID NO: 1219277 - RNA, 17 nt, Human
aggccacaagacccuug

SEQ ID NO: 1219278 - RNA, 19 nt, Human
uggcagcucaccucucccu

SEQ ID NO: 1219279 - RNA, 15 nt, Human
uggcagcucaccucu

SEQ ID NO: 1219280 - RNA, 17 nt, Human
uggcagccuuggcaaac

SEQ ID NO: 1219281 - RNA, 20 nt, Human
uggagguacgaaaagagggg

SEQ ID NO: 1219282 - RNA, 18 nt, Human
aggccaaggugggaggau

SEQ ID NO: 1219283 - RNA, 16 nt, Human
aggccaaggugggagg

SEQ ID NO: 1219284 - RNA, 20 nt, Human
aggccaaaggaagcacaugc

SEQ ID NO: 1219285 - RNA, 19 nt, Human
aggccaaaggaagcacaug

SEQ ID NO: 1219286 - RNA, 18 nt, Human
aggccaaaggaagcacau

SEQ ID NO: 1219287 - RNA, 16 nt, Human
aggccaaaggaagcac

SEQ ID NO: 1219288 - RNA, 17 nt, Human
aggcagccccauucugc

SEQ ID NO: 1219289 - RNA, 16 nt, Human
aggcagccccauucug

SEQ ID NO: 1219290 - RNA, 21 nt, Human
uggauuguccccgacccuugc

SEQ ID NO: 1219291 - RNA, 13 nt, Human
uggauuguccccg

SEQ ID NO: 1219292 - RNA, 14 nt, Human
uggaguauauguca

SEQ ID NO: 1219293 - RNA, 20 nt, Human
ugcuaucucccccagcccca

SEQ ID NO: 1219294 - RNA, 19 nt, Human
ugcuaucucccccagcccc

SEQ ID NO: 1219295 - RNA, 14 nt, Human
ugcucuggacaggc

SEQ ID NO: 1219296 - RNA, 16 nt, Human
ugcucuggacaggcau

SEQ ID NO: 1219297 - RNA, 15 nt, Human
ugcucuggacaggca

SEQ ID NO: 1219298 - RNA, 17 nt, Human
ugcucuggacaggcaug

SEQ ID NO: 1219299 - RNA, 23 nt, Human
aggaaggaaacccagcucugguc

SEQ ID NO: 1219300 - RNA, 22 nt, Human
aggaaggaaacccagcucuggu

SEQ ID NO: 1219301 - RNA, 20 nt, Human
aggaaggaaacccagcucug

SEQ ID NO: 1219302 - RNA, 12 nt, Human
aggaagcucagg

SEQ ID NO: 1219303 - RNA, 20 nt, Human
aggaagccgcuggggccagu

SEQ ID NO: 1219304 - RNA, 19 nt, Human
aggaagccgcuggggccag

SEQ ID NO: 1219305 - RNA, 18 nt, Human
aggaagccgcuggggcca

SEQ ID NO: 1219306 - RNA, 23 nt, Human
aggaagccagcaggcucucaggc

SEQ ID NO: 1219307 - RNA, 22 nt, Human
aggaagccagcaggcucucagg

SEQ ID NO: 1219308 - RNA, 21 nt, Human
aggaagccagcaggcucucag

SEQ ID NO: 1219309 - RNA, 22 nt, Human
aggaagcacaugccucucucag

SEQ ID NO: 1219310 - RNA, 19 nt, Human
aggaaaucaccgaaaacgu

SEQ ID NO: 1219311 - RNA, 15 nt, Human
aggaaaucaccgaaa

SEQ ID NO: 1219312 - RNA, 17 nt, Human
aggaagcacaugccucu

SEQ ID NO: 1219313 - RNA, 16 nt, Human
aggaagcacaugccuc

SEQ ID NO: 1219314 - RNA, 11 nt, Human
aggaagcacau

SEQ ID NO: 1219315 - RNA, 16 nt, Human
aggaaaggcuccagga

SEQ ID NO: 1219316 - RNA, 15 nt, Human
aggaaaggcuccagg

SEQ ID NO: 1219317 - RNA, 14 nt, Human
aggaaaggcuccag

SEQ ID NO: 1219318 - RNA, 13 nt, Human
aggaaaggcucca

SEQ ID NO: 1219319 - RNA, 16 nt, Human
ugcugacuguuuucuc

SEQ ID NO: 1219320 - RNA, 17 nt, Human
ugcugggauuacaggug

SEQ ID NO: 1219321 - RNA, 21 nt, Human
ugcugggauuacaagcgugag

SEQ ID NO: 1219322 - RNA, 20 nt, Human
ugcugggauuacagguguga

SEQ ID NO: 1219323 - RNA, 19 nt, Human
ugcugggauuacaagcgug

SEQ ID NO: 1219324 - RNA, 21 nt, Human
ugcuggcuguuggcugggggc

SEQ ID NO: 1219325 - RNA, 19 nt, Human
ugcuggcuguuggcugggg

SEQ ID NO: 1219326 - RNA, 12 nt, Human
ugcugcccugug

SEQ ID NO: 1219327 - RNA, 11 nt, Human
ugcugcccugu

SEQ ID NO: 1219328 - RNA, 21 nt, Human
ugcugcccugcccaccuggcc

SEQ ID NO: 1219329 - RNA, 19 nt, Human
ugcugcccugcccaccugg

SEQ ID NO: 1219330 - RNA, 18 nt, Human
ugcugcccugcccaccug

SEQ ID NO: 1219331 - RNA, 17 nt, Human
ugcugcccugcccaccu

SEQ ID NO: 1219332 - RNA, 16 nt, Human
ugcugcccugcccacc

SEQ ID NO: 1219333 - RNA, 13 nt, Human
ugcugcccugccc

SEQ ID NO: 1219334 - RNA, 23 nt, Human
ugcuucaaggauccugagccaga

SEQ ID NO: 1219335 - RNA, 21 nt, Human
ugcuucaaggauccugagcca

SEQ ID NO: 1219336 - RNA, 12 nt, Human
ugcuucaaggau

SEQ ID NO: 1219337 - RNA, 18 nt, Human
aggacacuaaccacgcug

SEQ ID NO: 1219338 - RNA, 16 nt, Human
ugcuuccagugaggcu

SEQ ID NO: 1219339 - RNA, 19 nt, Human
aggacacuaaccacgcugg

SEQ ID NO: 1219340 - RNA, 15 nt, Human
ugcugucccuuuucc

SEQ ID NO: 1219341 - RNA, 19 nt, Human
ugcugucccuuacgugagu

SEQ ID NO: 1219342 - RNA, 17 nt, Human
ugcugucccuuuuccuu

SEQ ID NO: 1219343 - RNA, 15 nt, Human
agcugggacuacagg

SEQ ID NO: 1219344 - RNA, 23 nt, Human
agcugugcucuggacaggcaugu

SEQ ID NO: 1219345 - RNA, 21 nt, Human
agcugugcucuggacaggcau

SEQ ID NO: 1219346 - RNA, 20 nt, Human
agcugugcucuggacaggca

SEQ ID NO: 1219347 - RNA, 14 nt, Human
agcuguuacugucu

SEQ ID NO: 1219348 - RNA, 20 nt, Human
ugccuguucagcuccagcuc

SEQ ID NO: 1219349 - RNA, 18 nt, Human
ugccuguucagcuccagc

SEQ ID NO: 1219350 - RNA, 14 nt, Human
agcuguucagcugg

SEQ ID NO: 1219351 - RNA, 13 nt, Human
agcuguucagcug

SEQ ID NO: 1219352 - RNA, 16 nt, Human
ugccuuauggaacacu

SEQ ID NO: 1219353 - RNA, 15 nt, Human
ugccuuauggaacac

SEQ ID NO: 1219354 - RNA, 20 nt, Human
ugccuguugggccaggagcc

SEQ ID NO: 1219355 - RNA, 21 nt, Human
ugccuguucagcuccagcuca

SEQ ID NO: 1219356 - RNA, 22 nt, Human
agcugcuuuugucuaugggacu

SEQ ID NO: 1219357 - RNA, 21 nt, Human
agcugcuuuugucuaugggac

SEQ ID NO: 1219358 - RNA, 21 nt, Human
agcugcuugggcuucauccuc

SEQ ID NO: 1219359 - RNA, 22 nt, Human
agcugccuguucagcuccagcu

SEQ ID NO: 1219360 - RNA, 21 nt, Human
agcugccuguucagcuccagc

SEQ ID NO: 1219361 - RNA, 20 nt, Human
agcugccuguucagcuccag

SEQ ID NO: 1219362 - RNA, 15 nt, Human
ugccuggauggggcu

SEQ ID NO: 1219363 - RNA, 14 nt, Human
ugccuggauggggc

SEQ ID NO: 1219364 - RNA, 16 nt, Human
ugccugcccaggcccc

SEQ ID NO: 1219365 - RNA, 15 nt, Human
ugccugcccaggccc

SEQ ID NO: 1219366 - RNA, 14 nt, Human
ugccugcccaggcc

SEQ ID NO: 1219367 - RNA, 17 nt, Human
ugccucugccucugaca

SEQ ID NO: 1219368 - RNA, 15 nt, Human
ugccucugccucuga

SEQ ID NO: 1219369 - RNA, 14 nt, Human
ugccucugccucug

SEQ ID NO: 1219370 - RNA, 13 nt, Human
ugccucugccucu

SEQ ID NO: 1219371 - RNA, 14 nt, Human
ugcccaggcagguc

SEQ ID NO: 1219372 - RNA, 13 nt, Human
ugcccaggcaggu

SEQ ID NO: 1219373 - RNA, 12 nt, Human
ugcccaggcagg

SEQ ID NO: 1219374 - RNA, 18 nt, Human
agcuuguaaauagcucag

SEQ ID NO: 1219375 - RNA, 22 nt, Human
agcuugaggguugggcuggugu

SEQ ID NO: 1219376 - RNA, 18 nt, Human
agcuugaggguugggcug

SEQ ID NO: 1219377 - RNA, 14 nt, Human
agcuugaggguugg

SEQ ID NO: 1219378 - RNA, 19 nt, Human
agcuugaccgugaggccag

SEQ ID NO: 1219379 - RNA, 11 nt, Human
ugcuacacacu

SEQ ID NO: 1219380 - RNA, 23 nt, Human
ugcggacagccacggccaggcca

SEQ ID NO: 1219381 - RNA, 22 nt, Human
ugcggacagccacggccaggcc

SEQ ID NO: 1219382 - RNA, 20 nt, Human
ugcgggcuuccuccuggugu

SEQ ID NO: 1219383 - RNA, 19 nt, Human
ugcggccuuuggcuucacg

SEQ ID NO: 1219384 - RNA, 17 nt, Human
ugcggccuuuggcuuca

SEQ ID NO: 1219385 - RNA, 21 nt, Human
ugcggugcuaucucccccagc

SEQ ID NO: 1219386 - RNA, 17 nt, Human
ugcggugcuaucucccc

SEQ ID NO: 1219387 - RNA, 18 nt, Human
ugcgguccacccaggagc

SEQ ID NO: 1219388 - RNA, 18 nt, Human
agcucaggugucccugca

SEQ ID NO: 1219389 - RNA, 22 nt, Human
agcucaggugucccugcacuug

SEQ ID NO: 1219390 - RNA, 21 nt, Human
agcucaggugucccugcacuu

SEQ ID NO: 1219391 - RNA, 20 nt, Human
agcucaggugucccugcacu

SEQ ID NO: 1219392 - RNA, 16 nt, Human
agcuaggccuggccag

SEQ ID NO: 1219393 - RNA, 15 nt, Human
agcuaggccuggcca

SEQ ID NO: 1219394 - RNA, 14 nt, Human
agcuaggccuggcc

SEQ ID NO: 1219395 - RNA, 12 nt, Human
agcuaggccugg

SEQ ID NO: 1219396 - RNA, 21 nt, Human
ugcccagccccuucugaccca

SEQ ID NO: 1219397 - RNA, 20 nt, Human
ugcccacaggaucagucuga

SEQ ID NO: 1219398 - RNA, 19 nt, Human
ugcccacaggaucagucug

SEQ ID NO: 1219399 - RNA, 21 nt, Human
agcucauucuccuuguguuac

SEQ ID NO: 1219400 - RNA, 20 nt, Human
agcucauucuccuuguguua

SEQ ID NO: 1219401 - RNA, 15 nt, Human
agcgugcauaaguua

SEQ ID NO: 1219402 - RNA, 22 nt, Human
agcgugagccacugcaccgggc

SEQ ID NO: 1219403 - RNA, 19 nt, Human
agcgugagccacugcaccg

SEQ ID NO: 1219404 - RNA, 18 nt, Human
agcuagacgagcaggcuu

SEQ ID NO: 1219405 - RNA, 22 nt, Human
agccugggugacagagcaagug

SEQ ID NO: 1219406 - RNA, 22 nt, Human
agccugcuccagcuguucagcu

SEQ ID NO: 1219407 - RNA, 19 nt, Human
agccugcuccagcuguuca

SEQ ID NO: 1219408 - RNA, 17 nt, Human
agccugcuccagcuguu

SEQ ID NO: 1219409 - RNA, 16 nt, Human
agccugcuccagcugu

SEQ ID NO: 1219410 - RNA, 15 nt, Human
agccugcuccagcug

SEQ ID NO: 1219411 - RNA, 14 nt, Human
ugcauaccacuuuu

SEQ ID NO: 1219412 - RNA, 12 nt, Human
ugcauaccacuu

SEQ ID NO: 1219413 - RNA, 21 nt, Human
agccugugccucugggacugg

SEQ ID NO: 1219414 - RNA, 20 nt, Human
ugcauuaucuagauacugua

SEQ ID NO: 1219415 - RNA, 18 nt, Human
agcggagacggaguccca

SEQ ID NO: 1219416 - RNA, 20 nt, Human
agcggagaaaggaagggcug

SEQ ID NO: 1219417 - RNA, 16 nt, Human
agcggagaaaggaagg

SEQ ID NO: 1219418 - RNA, 17 nt, Human
agccuuccagggguggg

SEQ ID NO: 1219419 - RNA, 16 nt, Human
agccuuccaggggugg

SEQ ID NO: 1219420 - RNA, 14 nt, Human
agccuuccaggggu

SEQ ID NO: 1219421 - RNA, 11 nt, Human
agccuuccagg

SEQ ID NO: 1219422 - RNA, 22 nt, Human
ugcauuaucuagauacuguauc

SEQ ID NO: 1219423 - RNA, 21 nt, Human
ugcauuaucuagauacuguau

SEQ ID NO: 1219424 - RNA, 17 nt, Human
agccucccaaagugcug

SEQ ID NO: 1219425 - RNA, 17 nt, Human
ugcagccucacaguccu

SEQ ID NO: 1219426 - RNA, 16 nt, Human
ugcagccucacagucc

SEQ ID NO: 1219427 - RNA, 15 nt, Human
ugcagccucacaguc

SEQ ID NO: 1219428 - RNA, 13 nt, Human
ugcagccucacag

SEQ ID NO: 1219429 - RNA, 17 nt, Human
ugcauaaguuaacuucc

SEQ ID NO: 1219430 - RNA, 14 nt, Human
ugcauaaguuaacu

SEQ ID NO: 1219431 - RNA, 21 nt, Human
agccucagcauccuggcaccc

SEQ ID NO: 1219432 - RNA, 20 nt, Human
agccucagcauccuggcacc

SEQ ID NO: 1219433 - RNA, 19 nt, Human
agccucagcauccuggcac

SEQ ID NO: 1219434 - RNA, 17 nt, Human
agccucagcauccuggc

SEQ ID NO: 1219435 - RNA, 23 nt, Human
agccucagcauccuggcacccgg

SEQ ID NO: 1219436 - RNA, 22 nt, Human
agccucagcauccuggcacccg

SEQ ID NO: 1219437 - RNA, 16 nt, Human
agccucccaaagugcu

SEQ ID NO: 1219438 - RNA, 23 nt, Human
agcccuucuaccuuccugcaaca

SEQ ID NO: 1219439 - RNA, 23 nt, Human
ugcacuauagccuaggugacaga

SEQ ID NO: 1219440 - RNA, 20 nt, Human
agccgagauagccaaggcca

SEQ ID NO: 1219441 - RNA, 20 nt, Human
ugauucuccugccucagccu

SEQ ID NO: 1219442 - RNA, 19 nt, Human
ugauucuccugccucagcc

SEQ ID NO: 1219443 - RNA, 15 nt, Human
ugauucuccugccuc

SEQ ID NO: 1219444 - RNA, 22 nt, Human
agccccaaaacucuccucugcu

SEQ ID NO: 1219445 - RNA, 21 nt, Human
agccccaaaacucuccucugc

SEQ ID NO: 1219446 - RNA, 20 nt, Human
agccccaaaacucuccucug

SEQ ID NO: 1219447 - RNA, 22 nt, Human
agccccgaggccuucucugaag

SEQ ID NO: 1219448 - RNA, 17 nt, Human
agccccgaggccuucuc

SEQ ID NO: 1219449 - RNA, 24 nt, Human
agccccaaaacucuccucugcugc

SEQ ID NO: 1219450 - RNA, 22 nt, Human
agccccuggaugcagccucaca

SEQ ID NO: 1219451 - RNA, 19 nt, Human
agccccuggaugcagccuc

SEQ ID NO: 1219452 - RNA, 18 nt, Human
agccccuggaugcagccu

SEQ ID NO: 1219453 - RNA, 17 nt, Human
agccccuggaugcagcc

SEQ ID NO: 1219454 - RNA, 15 nt, Human
ugcacgugugugcac

SEQ ID NO: 1219455 - RNA, 14 nt, Human
ugcacgugugugca

SEQ ID NO: 1219456 - RNA, 17 nt, Human
ugcacccucaggcaggu

SEQ ID NO: 1219457 - RNA, 16 nt, Human
ugcacccucaggcagg

SEQ ID NO: 1219458 - RNA, 11 nt, Human
ugcacacauuu

SEQ ID NO: 1219459 - RNA, 10 nt, Human
ugcacacauu

SEQ ID NO: 1219460 - RNA, 15 nt, Human
ugcacaagcugcacc

SEQ ID NO: 1219461 - RNA, 23 nt, Human
agcccugguggcagugggagcug

SEQ ID NO: 1219462 - RNA, 22 nt, Human
agcccugguggcagugggagcu

SEQ ID NO: 1219463 - RNA, 21 nt, Human
ugcacaagcugcacccucagg

SEQ ID NO: 1219464 - RNA, 18 nt, Human
ugcacaagcugcacccuc

SEQ ID NO: 1219465 - RNA, 24 nt, Human
agccccuucugacccaugcugccc

SEQ ID NO: 1219466 - RNA, 20 nt, Human
agccccuucugacccaugcu

SEQ ID NO: 1219467 - RNA, 21 nt, Human
ugagugggugaauaauacagu

SEQ ID NO: 1219468 - RNA, 20 nt, Human
ugagugccuuacacaauggu

SEQ ID NO: 1219469 - RNA, 17 nt, Human
ugagugccuuacacaau

SEQ ID NO: 1219470 - RNA, 17 nt, Human
ugagucaccaagcccag

SEQ ID NO: 1219471 - RNA, 16 nt, Human
ugagucaccaagccca

SEQ ID NO: 1219472 - RNA, 14 nt, Human
ugagucaccaagcc

SEQ ID NO: 1219473 - RNA, 18 nt, Human
ugaguucauacccuguua

SEQ ID NO: 1219474 - RNA, 17 nt, Human
ugaguucauacccuguu

SEQ ID NO: 1219475 - RNA, 21 nt, Human
ugauacaaugcugugcccuaa

SEQ ID NO: 1219476 - RNA, 20 nt, Human
ugauacaaugcugugcccua

SEQ ID NO: 1219477 - RNA, 17 nt, Human
ugauacuacaguuuguu

SEQ ID NO: 1219478 - RNA, 14 nt, Human
ugauacuacaguuu

SEQ ID NO: 1219479 - RNA, 21 nt, Human
agcauacguacacauuuuauu

SEQ ID NO: 1219480 - RNA, 20 nt, Human
agcauacguacacauuuuau

SEQ ID NO: 1219481 - RNA, 19 nt, Human
agcauacguacacauuuua

SEQ ID NO: 1219482 - RNA, 18 nt, Human
agcauacguacacauuuu

SEQ ID NO: 1219483 - RNA, 17 nt, Human
agcauacguacacauuu

SEQ ID NO: 1219484 - RNA, 16 nt, Human
agcauacguacacauu

SEQ ID NO: 1219485 - RNA, 15 nt, Human
agcauacguacacau

SEQ ID NO: 1219486 - RNA, 16 nt, Human
agcauauucaggaagc

SEQ ID NO: 1219487 - RNA, 14 nt, Human
agcauauucaggaa

SEQ ID NO: 1219488 - RNA, 15 nt, Human
ugaguacuacagucc

SEQ ID NO: 1219489 - RNA, 23 nt, Human
ugaguacuacaguccucccaucu

SEQ ID NO: 1219490 - RNA, 22 nt, Human
ugaguacuacaguccucccauc

SEQ ID NO: 1219491 - RNA, 21 nt, Human
ugaguacuacaguccucccau

SEQ ID NO: 1219492 - RNA, 17 nt, Human
ugaguacuacaguccuc

SEQ ID NO: 1219493 - RNA, 19 nt, Human
ugaucacggcucacugcag

SEQ ID NO: 1219494 - RNA, 21 nt, Human
ugaucacggcucacugcagcc

SEQ ID NO: 1219495 - RNA, 20 nt, Human
ugaucacggcucacugcagc

SEQ ID NO: 1219496 - RNA, 22 nt, Human
agcauauucaggaagcucaggg

SEQ ID NO: 1219497 - RNA, 13 nt, Human
agcaucaggccag

SEQ ID NO: 1219498 - RNA, 20 nt, Human
agcaucaggccaggcccucu

SEQ ID NO: 1219499 - RNA, 19 nt, Human
agcaucaggccaggcccuc

SEQ ID NO: 1219500 - RNA, 18 nt, Human
agcaucaggccaggcccu

SEQ ID NO: 1219501 - RNA, 17 nt, Human
agcaucaggccaggccc

SEQ ID NO: 1219502 - RNA, 16 nt, Human
agcaucaggccaggcc

SEQ ID NO: 1219503 - RNA, 14 nt, Human
agcaucaggccagg

SEQ ID NO: 1219504 - RNA, 13 nt, Human
agcauggcugcca

SEQ ID NO: 1219505 - RNA, 21 nt, Human
agcaucaggccaggcccucug

SEQ ID NO: 1219506 - RNA, 12 nt, Human
agcauggcugcc

SEQ ID NO: 1219507 - RNA, 16 nt, Human
agccacggccaggcca

SEQ ID NO: 1219508 - RNA, 15 nt, Human
agccacggccaggcc

SEQ ID NO: 1219509 - RNA, 23 nt, Human
agccaccaacauacucccaucug

SEQ ID NO: 1219510 - RNA, 20 nt, Human
agccaccaacauacucccau

SEQ ID NO: 1219511 - RNA, 19 nt, Human
agccaccaacauacuccca

SEQ ID NO: 1219512 - RNA, 18 nt, Human
agccacauuccugaugcu

SEQ ID NO: 1219513 - RNA, 14 nt, Human
agccacauuccuga

SEQ ID NO: 1219514 - RNA, 14 nt, Human
agccacggccaggc

SEQ ID NO: 1219515 - RNA, 23 nt, Human
ugauggugcaaugaccuuucaau

SEQ ID NO: 1219516 - RNA, 17 nt, Human
ugauggugcaaugaccu

SEQ ID NO: 1219517 - RNA, 16 nt, Human
ugauggugcaaugacc

SEQ ID NO: 1219518 - RNA, 20 nt, Human
ugaugauccuaggcauuugc

SEQ ID NO: 1219519 - RNA, 14 nt, Human
ugaugauccuaggc

SEQ ID NO: 1219520 - RNA, 18 nt, Human
ugauguuuuaaggaugcu

SEQ ID NO: 1219521 - RNA, 17 nt, Human
ugauguuuuaaggaugc

SEQ ID NO: 1219522 - RNA, 22 nt, Human
agccacugcaccgggccacaga

SEQ ID NO: 1219523 - RNA, 21 nt, Human
agccacugcaccgggccacag

SEQ ID NO: 1219524 - RNA, 16 nt, Human
agccacugcaccgggc

SEQ ID NO: 1219525 - RNA, 13 nt, Human
agccacugcaccg

SEQ ID NO: 1219526 - RNA, 22 nt, Human
agccaggccacaagacccuugu

SEQ ID NO: 1219527 - RNA, 21 nt, Human
agccaggccacaagacccuug

SEQ ID NO: 1219528 - RNA, 12 nt, Human
agccagggucuc

SEQ ID NO: 1219529 - RNA, 23 nt, Human
agccaguaaaugggggugcauuu

SEQ ID NO: 1219530 - RNA, 14 nt, Human
agccaggccacaag

SEQ ID NO: 1219531 - RNA, 12 nt, Human
agccaggccaca

SEQ ID NO: 1219532 - RNA, 21 nt, Human
ugauucccaagcucugcuccu

SEQ ID NO: 1219533 - RNA, 19 nt, Human
ugauucccaagcucugcuc

SEQ ID NO: 1219534 - RNA, 18 nt, Human
ugauucccaagcucugcu

SEQ ID NO: 1219535 - RNA, 16 nt, Human
ugauucccaagcucug

SEQ ID NO: 1219536 - RNA, 15 nt, Human
ugauucccaagcucu

SEQ ID NO: 1219537 - RNA, 15 nt, Human
ugauucauaaugacu

SEQ ID NO: 1219538 - RNA, 14 nt, Human
ugauucagcucugc

SEQ ID NO: 1219539 - RNA, 13 nt, Human
ugauucagcucug

SEQ ID NO: 1219540 - RNA, 24 nt, Human
agcccaggaaaggcuccaggagca

SEQ ID NO: 1219541 - RNA, 23 nt, Human
agcccaggaaaggcuccaggagc

SEQ ID NO: 1219542 - RNA, 22 nt, Human
agcccaggaaaggcuccaggag

SEQ ID NO: 1219543 - RNA, 21 nt, Human
agcccaggaaaggcuccagga

SEQ ID NO: 1219544 - RNA, 20 nt, Human
agcccaggaaaggcuccagg

SEQ ID NO: 1219545 - RNA, 19 nt, Human
agcccaggaaaggcuccag

SEQ ID NO: 1219546 - RNA, 19 nt, Human
ugaccugaggcccuucucu

SEQ ID NO: 1219547 - RNA, 18 nt, Human
ugaccugaggcccuucuc

SEQ ID NO: 1219548 - RNA, 16 nt, Human
ugacuuacuguacaug

SEQ ID NO: 1219549 - RNA, 15 nt, Human
ugacuuacuguacau

SEQ ID NO: 1219550 - RNA, 13 nt, Human
ugacuuacuguac

SEQ ID NO: 1219551 - RNA, 21 nt, Human
ugacccaugcugcccugugag

SEQ ID NO: 1219552 - RNA, 17 nt, Human
ugacccaugcugcccug

SEQ ID NO: 1219553 - RNA, 16 nt, Human
ugacccaugcugcccu

SEQ ID NO: 1219554 - RNA, 15 nt, Human
ugacccaugcugccc

SEQ ID NO: 1219555 - RNA, 14 nt, Human
ugacccaugcugcc

SEQ ID NO: 1219556 - RNA, 16 nt, Human
agaugccgcauuugga

SEQ ID NO: 1219557 - RNA, 20 nt, Human
ugagaagcagaggaaggaga

SEQ ID NO: 1219558 - RNA, 23 nt, Human
agcaagacgcugugcugcccugc

SEQ ID NO: 1219559 - RNA, 22 nt, Human
agcaagacgcugugcugcccug

SEQ ID NO: 1219560 - RNA, 21 nt, Human
agcaagacgcugugcugcccu

SEQ ID NO: 1219561 - RNA, 20 nt, Human
agcaagacgcugugcugccc

SEQ ID NO: 1219562 - RNA, 17 nt, Human
agcaagacgcugugcug

SEQ ID NO: 1219563 - RNA, 16 nt, Human
agcaagacgcugugcu

SEQ ID NO: 1219564 - RNA, 13 nt, Human
agcaagacgcugu

SEQ ID NO: 1219565 - RNA, 21 nt, Human
agauuuugaaauuuuuauuaa

SEQ ID NO: 1219566 - RNA, 17 nt, Human
agauuugaacucuucaa

SEQ ID NO: 1219567 - RNA, 13 nt, Human
agauuggaaggaa

SEQ ID NO: 1219568 - RNA, 19 nt, Human
ugacuuacuguacaugaaa

SEQ ID NO: 1219569 - RNA, 22 nt, Human
agauucauauuuacuucuuaua

SEQ ID NO: 1219570 - RNA, 16 nt, Human
agagguggggagcaga

SEQ ID NO: 1219571 - RNA, 13 nt, Human
agagguucaaaga

SEQ ID NO: 1219572 - RNA, 15 nt, Human
agagguuaagguggg

SEQ ID NO: 1219573 - RNA, 20 nt, Human
agagggagggagggcuccag

SEQ ID NO: 1219574 - RNA, 16 nt, Human
agagggagggagggcu

SEQ ID NO: 1219575 - RNA, 14 nt, Human
ugaagucacacagu

SEQ ID NO: 1219576 - RNA, 22 nt, Human
agauauuuugcuuugugauuuu

SEQ ID NO: 1219577 - RNA, 18 nt, Human
agaucaaaagguuaauaa

SEQ ID NO: 1219578 - RNA, 21 nt, Human
agauauuuugcuuugugauuu

SEQ ID NO: 1219579 - RNA, 20 nt, Human
agauauuuugcuuugugauu

SEQ ID NO: 1219580 - RNA, 16 nt, Human
agauacuguaucauga

SEQ ID NO: 1219581 - RNA, 15 nt, Human
agauacuguaucaug

SEQ ID NO: 1219582 - RNA, 11 nt, Human
agauacuguau

SEQ ID NO: 1219583 - RNA, 22 nt, Human
agauacaguuacucagaauucu

SEQ ID NO: 1219584 - RNA, 13 nt, Human
agauacaguuacu

SEQ ID NO: 1219585 - RNA, 20 nt, Human
agauacaggaaaagcugcug

SEQ ID NO: 1219586 - RNA, 22 nt, Human
agauaauauuaaggaagacaau

SEQ ID NO: 1219587 - RNA, 18 nt, Human
agauaauauuaaggaaga

SEQ ID NO: 1219588 - RNA, 17 nt, Human
agauaaggguaucuggu

SEQ ID NO: 1219589 - RNA, 21 nt, Human
agaguuguuacauuuuuaagu

SEQ ID NO: 1219590 - RNA, 20 nt, Human
agaguuguuacauuuuuaag

SEQ ID NO: 1219591 - RNA, 19 nt, Human
agaguuguuacauuuuuaa

SEQ ID NO: 1219592 - RNA, 17 nt, Human
agaguuguuacauuuuu

SEQ ID NO: 1219593 - RNA, 22 nt, Human
agagucagaaguuucugccgca

SEQ ID NO: 1219594 - RNA, 15 nt, Human
agagucacuggaaca

SEQ ID NO: 1219595 - RNA, 20 nt, Human
ugacacaugcaaggucauuu

SEQ ID NO: 1219596 - RNA, 12 nt, Human
ugacacaugcaa

SEQ ID NO: 1219597 - RNA, 20 nt, Human
ugacacacagcucuguccug

SEQ ID NO: 1219598 - RNA, 19 nt, Human
ugacacacagcucuguccu

SEQ ID NO: 1219599 - RNA, 18 nt, Human
ugacacacagcucugucc

SEQ ID NO: 1219600 - RNA, 16 nt, Human
ugacacacagcucugu

SEQ ID NO: 1219601 - RNA, 19 nt, Human
ugacaaagacugaguacgu

SEQ ID NO: 1219602 - RNA, 23 nt, Human
ugaauuucuuuugccguuauuaa

SEQ ID NO: 1219603 - RNA, 15 nt, Human
ugaaagacuguacaa

SEQ ID NO: 1219604 - RNA, 13 nt, Human
ugaaagacuguac

SEQ ID NO: 1219605 - RNA, 22 nt, Human
agagacuccugcaggcagccag

SEQ ID NO: 1219606 - RNA, 21 nt, Human
agagacuccugcaggcagcca

SEQ ID NO: 1219607 - RNA, 20 nt, Human
agagacuccugcaggcagcc

SEQ ID NO: 1219608 - RNA, 19 nt, Human
agagacuccugcaggcagc

SEQ ID NO: 1219609 - RNA, 18 nt, Human
agagacuccugcaggcag

SEQ ID NO: 1219610 - RNA, 17 nt, Human
agagacuccugcaggca

SEQ ID NO: 1219611 - RNA, 11 nt, Human
agagacuccug

SEQ ID NO: 1219612 - RNA, 23 nt, Human
agagcaagacgcugugcugcccu

SEQ ID NO: 1219613 - RNA, 19 nt, Human
agagcaagacgcugugcug

SEQ ID NO: 1219614 - RNA, 22 nt, Human
agagaucaaccccuucgcuccu

SEQ ID NO: 1219615 - RNA, 23 nt, Human
agagacuccugcaggcagccagg

SEQ ID NO: 1219616 - RNA, 14 nt, Human
agagcugccaccug

SEQ ID NO: 1219617 - RNA, 20 nt, Human
agagcuagcagcagggaggg

SEQ ID NO: 1219618 - RNA, 13 nt, Human
agagccagggucu

SEQ ID NO: 1219619 - RNA, 22 nt, Human
agagccuuccaggggugggaca

SEQ ID NO: 1219620 - RNA, 17 nt, Human
agagccuuccaggggug

SEQ ID NO: 1219621 - RNA, 15 nt, Human
agagccuuccagggg

SEQ ID NO: 1219622 - RNA, 13 nt, Human
agagccuuccagg

SEQ ID NO: 1219623 - RNA, 23 nt, Human
agagcaccuuagacagucccugc

SEQ ID NO: 1219624 - RNA, 22 nt, Human
agagcaccuuagacagucccug

SEQ ID NO: 1219625 - RNA, 17 nt, Human
ugaaaauguauguguaa

SEQ ID NO: 1219626 - RNA, 19 nt, Human
ugaaaaucgugacaacacu

SEQ ID NO: 1219627 - RNA, 22 nt, Human
ugaaaaaggaggaagagaaaaa

SEQ ID NO: 1219628 - RNA, 20 nt, Human
ugaaaaaggaggaagagaaa

SEQ ID NO: 1219629 - RNA, 16 nt, Human
ugaaaaaggaggaaga

SEQ ID NO: 1219630 - RNA, 22 nt, Human
ucuuuggucuacacugugcuga

SEQ ID NO: 1219631 - RNA, 21 nt, Human
ucuuucuggcuaugcauuuga

SEQ ID NO: 1219632 - RNA, 20 nt, Human
ucuuucuggcuaugcauuug

SEQ ID NO: 1219633 - RNA, 14 nt, Human
ucuugguccugcug

SEQ ID NO: 1219634 - RNA, 17 nt, Human
ucuuggucagauuugaa

SEQ ID NO: 1219635 - RNA, 23 nt, Human
ucuugcaauggcagccuuggcaa

SEQ ID NO: 1219636 - RNA, 22 nt, Human
ucuugcaauggcagccuuggca

SEQ ID NO: 1219637 - RNA, 19 nt, Human
ucuugcaauggcagccuug

SEQ ID NO: 1219638 - RNA, 19 nt, Human
ucuugguccugcugcaguu

SEQ ID NO: 1219639 - RNA, 17 nt, Human
ucuugguccugcugcag

SEQ ID NO: 1219640 - RNA, 15 nt, Human
ucuugguccugcugc

SEQ ID NO: 1219641 - RNA, 17 nt, Human
ucuuuccugaggcuggg

SEQ ID NO: 1219642 - RNA, 13 nt, Human
ucuugauucauaa

SEQ ID NO: 1219643 - RNA, 16 nt, Human
ucuugagccuugaacu

SEQ ID NO: 1219644 - RNA, 16 nt, Human
ucuugagccugggagg

SEQ ID NO: 1219645 - RNA, 13 nt, Human
ucuugagccuggg

SEQ ID NO: 1219646 - RNA, 23 nt, Human
agaccuucuccuucaccuuuguc

SEQ ID NO: 1219647 - RNA, 21 nt, Human
agaccuucuccuucaccuuug

SEQ ID NO: 1219648 - RNA, 18 nt, Human
agaccuucuccuucaccu

SEQ ID NO: 1219649 - RNA, 15 nt, Human
agaccuucuccuuca

SEQ ID NO: 1219650 - RNA, 11 nt, Human
agaccuucucc

SEQ ID NO: 1219651 - RNA, 23 nt, Human
agacauacuaaccagcagaaaug

SEQ ID NO: 1219652 - RNA, 19 nt, Human
agacauacuaaccagcaga

SEQ ID NO: 1219653 - RNA, 19 nt, Human
ucuucugcuucagccuccc

SEQ ID NO: 1219654 - RNA, 12 nt, Human
ucuucugcuuca

SEQ ID NO: 1219655 - RNA, 21 nt, Human
ucuucugaacuuggcgcugcc

SEQ ID NO: 1219656 - RNA, 20 nt, Human
ucuucuguggguuucuaaag

SEQ ID NO: 1219657 - RNA, 20 nt, Human
ucuucuguacgucugacagg

SEQ ID NO: 1219658 - RNA, 15 nt, Human
ucuucuguacgucug

SEQ ID NO: 1219659 - RNA, 14 nt, Human
ucuuccucccuccc

SEQ ID NO: 1219660 - RNA, 22 nt, Human
ucuucccuacaguugaaaaaca

SEQ ID NO: 1219661 - RNA, 19 nt, Human
ucuucccuacaguugaaaa

SEQ ID NO: 1219662 - RNA, 15 nt, Human
ucuuccucccucccu

SEQ ID NO: 1219663 - RNA, 20 nt, Human
ucuuccaggcugggagagcc

SEQ ID NO: 1219664 - RNA, 17 nt, Human
ucuuccaggcugggaga

SEQ ID NO: 1219665 - RNA, 15 nt, Human
ucuuccaggcuggga

SEQ ID NO: 1219666 - RNA, 20 nt, Human
ucuucagagacuccugcagg

SEQ ID NO: 1219667 - RNA, 21 nt, Human
ucuuccaggcugggagagccu

SEQ ID NO: 1219668 - RNA, 18 nt, Human
ucuucagagacuccugca

SEQ ID NO: 1219669 - RNA, 17 nt, Human
ucuucagagacuccugc

SEQ ID NO: 1219670 - RNA, 17 nt, Human
ucuggcagcucagagag

SEQ ID NO: 1219671 - RNA, 23 nt, Human
ucuggcagaguugaagacagagc

SEQ ID NO: 1219672 - RNA, 20 nt, Human
ucuggcagaguugaagacag

SEQ ID NO: 1219673 - RNA, 21 nt, Human
ucuggcagcucagagagggug

SEQ ID NO: 1219674 - RNA, 18 nt, Human
ucuggcagcucagagagg

SEQ ID NO: 1219675 - RNA, 19 nt, Human
ucuggaauaaggagaauga

SEQ ID NO: 1219676 - RNA, 23 nt, Human
ucugcuuuuuaaagaaugcucuu

SEQ ID NO: 1219677 - RNA, 22 nt, Human
ucugcuuugggguuuaucagaa

SEQ ID NO: 1219678 - RNA, 22 nt, Human
agaaguuugagaucagccuggg

SEQ ID NO: 1219679 - RNA, 23 nt, Human
agaaccuuuugagugccuuacac

SEQ ID NO: 1219680 - RNA, 19 nt, Human
agaaccuuuugagugccuu

SEQ ID NO: 1219681 - RNA, 23 nt, Human
ucugcccuugguuaggcauugug

SEQ ID NO: 1219682 - RNA, 12 nt, Human
ucugcccuuggu

SEQ ID NO: 1219683 - RNA, 16 nt, Human
agaagcagaggaagga

SEQ ID NO: 1219684 - RNA, 12 nt, Human
ucucucaggcca

SEQ ID NO: 1219685 - RNA, 21 nt, Human
ucucucaggccaaacucaccu

SEQ ID NO: 1219686 - RNA, 23 nt, Human
ucuccuuggugucgggcaugaca

SEQ ID NO: 1219687 - RNA, 21 nt, Human
ucuccuuggugucgggcauga

SEQ ID NO: 1219688 - RNA, 18 nt, Human
acuuuguguucaccuugu

SEQ ID NO: 1219689 - RNA, 16 nt, Human
acuuuguguucaccuu

SEQ ID NO: 1219690 - RNA, 23 nt, Human
acuuuggaaagaguaggaagacu

SEQ ID NO: 1219691 - RNA, 14 nt, Human
acuuuggaaagagu

SEQ ID NO: 1219692 - RNA, 13 nt, Human
acuuuggaaagag

SEQ ID NO: 1219693 - RNA, 12 nt, Human
acuuuggaaaga

SEQ ID NO: 1219694 - RNA, 14 nt, Human
acuuguggacacag

SEQ ID NO: 1219695 - RNA, 18 nt, Human
acuugucuuuggacccug

SEQ ID NO: 1219696 - RNA, 16 nt, Human
acuuuaaaaggagcca

SEQ ID NO: 1219697 - RNA, 15 nt, Human
acuuguggacacagc

SEQ ID NO: 1219698 - RNA, 18 nt, Human
ucugaaggcuggguucug

SEQ ID NO: 1219699 - RNA, 22 nt, Human
agaaagacuaucuaaauguuga

SEQ ID NO: 1219700 - RNA, 20 nt, Human
agaaagacuaucuaaauguu

SEQ ID NO: 1219701 - RNA, 18 nt, Human
ucucuugguccugcugca

SEQ ID NO: 1219702 - RNA, 17 nt, Human
ucucuugguccugcugc

SEQ ID NO: 1219703 - RNA, 23 nt, Human
agaaaaaauauuuuccugccagg

SEQ ID NO: 1219704 - RNA, 17 nt, Human
agaaaaaauauuuuccu

SEQ ID NO: 1219705 - RNA, 18 nt, Human
agaaaaaugagccuggca

SEQ ID NO: 1219706 - RNA, 19 nt, Human
ucuaccugaggggccucuu

SEQ ID NO: 1219707 - RNA, 12 nt, Human
ucuaccugaggg

SEQ ID NO: 1219708 - RNA, 20 nt, Human
acuuagagguggggagcaga

SEQ ID NO: 1219709 - RNA, 15 nt, Human
acuuacuguacauga

SEQ ID NO: 1219710 - RNA, 14 nt, Human
acuuacuguacaug

SEQ ID NO: 1219711 - RNA, 13 nt, Human
acuuacuguacau

SEQ ID NO: 1219712 - RNA, 16 nt, Human
acuuacuguacaugaa

SEQ ID NO: 1219713 - RNA, 17 nt, Human
acuuccacugccauccu

SEQ ID NO: 1219714 - RNA, 18 nt, Human
acuuccaauuuacauacu

SEQ ID NO: 1219715 - RNA, 23 nt, Human
ucuaguuugauuaaauucuugca

SEQ ID NO: 1219716 - RNA, 24 nt, Human
ucuagauacuguaucaugacaaag

SEQ ID NO: 1219717 - RNA, 19 nt, Human
acuugagaauuacccuuuu

SEQ ID NO: 1219718 - RNA, 14 nt, Human
acuuggaagcuccg

SEQ ID NO: 1219719 - RNA, 14 nt, Human
acuugucuuuggac

SEQ ID NO: 1219720 - RNA, 22 nt, Human
acuucgggaggucgaggcagga

SEQ ID NO: 1219721 - RNA, 20 nt, Human
acuucgggaggucgaggcag

SEQ ID NO: 1219722 - RNA, 17 nt, Human
acuucgggaggucgagg

SEQ ID NO: 1219723 - RNA, 16 nt, Human
ucucaaaaaaagaaaa

SEQ ID NO: 1219724 - RNA, 16 nt, Human
ucuauuguuucuuuca

SEQ ID NO: 1219725 - RNA, 22 nt, Human
acugggcuuggggaccagagcu

SEQ ID NO: 1219726 - RNA, 21 nt, Human
acugggcuuggggaccagagc

SEQ ID NO: 1219727 - RNA, 15 nt, Human
acuggguacuugugg

SEQ ID NO: 1219728 - RNA, 23 nt, Human
ucgcugugucagcauagaaguaa

SEQ ID NO: 1219729 - RNA, 20 nt, Human
acuguaucaugacaaagacu

SEQ ID NO: 1219730 - RNA, 16 nt, Human
acuguaucaugacaaa

SEQ ID NO: 1219731 - RNA, 19 nt, Human
acuguacaugaaaacacau

SEQ ID NO: 1219732 - RNA, 22 nt, Human
acuguacaaaguagaagucuua

SEQ ID NO: 1219733 - RNA, 16 nt, Human
acuguacaaaguagaa

SEQ ID NO: 1219734 - RNA, 18 nt, Human
acuggguacuuguggaca

SEQ ID NO: 1219735 - RNA, 17 nt, Human
acuggguacuuguggac

SEQ ID NO: 1219736 - RNA, 14 nt, Human
acuguaucaugaca

SEQ ID NO: 1219737 - RNA, 21 nt, Human
acuguacaugaaaacacauuu

SEQ ID NO: 1219738 - RNA, 20 nt, Human
acuguacaugaaaacacauu

SEQ ID NO: 1219739 - RNA, 17 nt, Human
ucgggaggucgaggcag

SEQ ID NO: 1219740 - RNA, 23 nt, Human
ucgucacugcuuaacuucacaua

SEQ ID NO: 1219741 - RNA, 21 nt, Human
acuguuaauaguucagguaac

SEQ ID NO: 1219742 - RNA, 17 nt, Human
acuguuaauaguucagg

SEQ ID NO: 1219743 - RNA, 14 nt, Human
ucuacccuggcacu

SEQ ID NO: 1219744 - RNA, 21 nt, Human
ucuacccucuuagaaaaacca

SEQ ID NO: 1219745 - RNA, 17 nt, Human
ucuaaaggcuaccuuug

SEQ ID NO: 1219746 - RNA, 16 nt, Human
ucuaaaggcuaccuuu

SEQ ID NO: 1219747 - RNA, 13 nt, Human
ucuaaaggcuacc

SEQ ID NO: 1219748 - RNA, 17 nt, Human
ucuaaagcugccagccg

SEQ ID NO: 1219749 - RNA, 16 nt, Human
acaucuugcucugcug

SEQ ID NO: 1219750 - RNA, 15 nt, Human
acaucuugcucugcu

SEQ ID NO: 1219751 - RNA, 19 nt, Human
acaucuuggucagauuuga

SEQ ID NO: 1219752 - RNA, 17 nt, Human
acaucuugcucugcuga

SEQ ID NO: 1219753 - RNA, 16 nt, Human
acaugaaaacacauuu

SEQ ID NO: 1219754 - RNA, 15 nt, Human
acaugaaaacacauu

SEQ ID NO: 1219755 - RNA, 20 nt, Human
uauuuugcuuugugauuuuu

SEQ ID NO: 1219756 - RNA, 15 nt, Human
uauuuugcuuuguga

SEQ ID NO: 1219757 - RNA, 13 nt, Human
uauuuugcuuugu

SEQ ID NO: 1219758 - RNA, 17 nt, Human
uauuuuuguagagccag

SEQ ID NO: 1219759 - RNA, 23 nt, Human
acaugaaaacacauuuuucuuag

SEQ ID NO: 1219760 - RNA, 13 nt, Human
acaugagcaucag

SEQ ID NO: 1219761 - RNA, 22 nt, Human
ucaaagauauuuugcuuuguga

SEQ ID NO: 1219762 - RNA, 20 nt, Human
ucaaagauauuuugcuuugu

SEQ ID NO: 1219763 - RNA, 13 nt, Human
ucaaagauauuuu

SEQ ID NO: 1219764 - RNA, 14 nt, Human
acauggccuuugcu

SEQ ID NO: 1219765 - RNA, 19 nt, Human
acauggaguauaugucaag

SEQ ID NO: 1219766 - RNA, 15 nt, Human
acauggaguauaugu

SEQ ID NO: 1219767 - RNA, 20 nt, Human
acauggaauaacauguaauu

SEQ ID NO: 1219768 - RNA, 18 nt, Human
acauggaauaacauguaa

SEQ ID NO: 1219769 - RNA, 23 nt, Human
acaugagcaucaggccaggcccu

SEQ ID NO: 1219770 - RNA, 21 nt, Human
acaugucuuuucuugcaugag

SEQ ID NO: 1219771 - RNA, 22 nt, Human
acauugcggacagccacggcca

SEQ ID NO: 1219772 - RNA, 21 nt, Human
acauugcggacagccacggcc

SEQ ID NO: 1219773 - RNA, 23 nt, Human
acauuuuucuuagggaaggauac

SEQ ID NO: 1219774 - RNA, 13 nt, Human
acauuuuucuuag

SEQ ID NO: 1219775 - RNA, 19 nt, Human
acauuuuuaagugcugcau

SEQ ID NO: 1219776 - RNA, 18 nt, Human
acauuuuuaagugcugca

SEQ ID NO: 1219777 - RNA, 15 nt, Human
acauuuuuaagugcu

SEQ ID NO: 1219778 - RNA, 14 nt, Human
acauuuuauuuuau

SEQ ID NO: 1219779 - RNA, 22 nt, Human
ucaauaggaaaaacugauuuuu

SEQ ID NO: 1219780 - RNA, 19 nt, Human
ucaauaggaaaaacugauu

SEQ ID NO: 1219781 - RNA, 18 nt, Human
ucaauaggaaaaacugau

SEQ ID NO: 1219782 - RNA, 18 nt, Human
ucaagugauucuccugcc

SEQ ID NO: 1219783 - RNA, 17 nt, Human
ucaagugauucuccugc

SEQ ID NO: 1219784 - RNA, 16 nt, Human
ucaagugauucuccug

SEQ ID NO: 1219785 - RNA, 17 nt, Human
ucaagagggucugagga

SEQ ID NO: 1219786 - RNA, 15 nt, Human
ucacagaugggugcu

SEQ ID NO: 1219787 - RNA, 14 nt, Human
ucacagaugggugc

SEQ ID NO: 1219788 - RNA, 17 nt, Human
ucaccagccccagugcc

SEQ ID NO: 1219789 - RNA, 20 nt, Human
ucacauauugauuuccguua

SEQ ID NO: 1219790 - RNA, 18 nt, Human
ucacauauugauuuccgu

SEQ ID NO: 1219791 - RNA, 16 nt, Human
ucacauauugauuucc

SEQ ID NO: 1219792 - RNA, 20 nt, Human
accaaccacugcgaccacaa

SEQ ID NO: 1219793 - RNA, 17 nt, Human
accaacauacucccauc

SEQ ID NO: 1219794 - RNA, 16 nt, Human
accaacauacucccau

SEQ ID NO: 1219795 - RNA, 19 nt, Human
accaaaucagcugcuacua

SEQ ID NO: 1219796 - RNA, 16 nt, Human
accaaaucagcugcua

SEQ ID NO: 1219797 - RNA, 23 nt, Human
accacacccagcccacuucugcc

SEQ ID NO: 1219798 - RNA, 21 nt, Human
accacacccagcccacuucug

SEQ ID NO: 1219799 - RNA, 20 nt, Human
accacacccagcccacuucu

SEQ ID NO: 1219800 - RNA, 16 nt, Human
accacacccagcccac

SEQ ID NO: 1219801 - RNA, 15 nt, Human
accacacccagccca

SEQ ID NO: 1219802 - RNA, 17 nt, Human
accacacagaggcugcc

SEQ ID NO: 1219803 - RNA, 23 nt, Human
ucacugagacagcccgggcucug

SEQ ID NO: 1219804 - RNA, 22 nt, Human
ucaccagccccagugcccacag

SEQ ID NO: 1219805 - RNA, 21 nt, Human
ucacuauguugcccaggcagg

SEQ ID NO: 1219806 - RNA, 16 nt, Human
ucacuguugcccaggc

SEQ ID NO: 1219807 - RNA, 15 nt, Human
ucacuguugcccagg

SEQ ID NO: 1219808 - RNA, 14 nt, Human
ucacuguugcccag

SEQ ID NO: 1219809 - RNA, 18 nt, Human
ucacugcaaccuccgccu

SEQ ID NO: 1219810 - RNA, 22 nt, Human
accauuuugggguacccacugc

SEQ ID NO: 1219811 - RNA, 20 nt, Human
acccacugcuuuuggucugu

SEQ ID NO: 1219812 - RNA, 21 nt, Human
accauuuugggguacccacug

SEQ ID NO: 1219813 - RNA, 23 nt, Human
accauuuugcugucccuuuuccu

SEQ ID NO: 1219814 - RNA, 22 nt, Human
accauuuugcugucccuuuucc

SEQ ID NO: 1219815 - RNA, 21 nt, Human
accauucuccaccugccaggg

SEQ ID NO: 1219816 - RNA, 20 nt, Human
accauucuccaccugccagg

SEQ ID NO: 1219817 - RNA, 19 nt, Human
accauucuccaccugccag

SEQ ID NO: 1219818 - RNA, 13 nt, Human
accccagguuucu

SEQ ID NO: 1219819 - RNA, 23 nt, Human
acccaggugcuaggaacacuccu

SEQ ID NO: 1219820 - RNA, 11 nt, Human
acccaggugcu

SEQ ID NO: 1219821 - RNA, 19 nt, Human
acccaggagccccgaggcc

SEQ ID NO: 1219822 - RNA, 15 nt, Human
acccaggagccccga

SEQ ID NO: 1219823 - RNA, 13 nt, Human
acccaggagcccc

SEQ ID NO: 1219824 - RNA, 17 nt, Human
acccagcgagcccuggu

SEQ ID NO: 1219825 - RNA, 16 nt, Human
acccagcgagcccugg

SEQ ID NO: 1219826 - RNA, 13 nt, Human
acccagcgagccc

SEQ ID NO: 1219827 - RNA, 16 nt, Human
ucagaauucucuaguu

SEQ ID NO: 1219828 - RNA, 20 nt, Human
ucagaauucucagaaucuca

SEQ ID NO: 1219829 - RNA, 12 nt, Human
ucagaauucuca

SEQ ID NO: 1219830 - RNA, 10 nt, Human
ucagaauucu

SEQ ID NO: 1219831 - RNA, 15 nt, Human
acccagcccacuucu

SEQ ID NO: 1219832 - RNA, 16 nt, Human
ucagaucucuaacuuc

SEQ ID NO: 1219833 - RNA, 16 nt, Human
ucagagacuccugcag

SEQ ID NO: 1219834 - RNA, 23 nt, Human
ucagagacuccugcaggcagcca

SEQ ID NO: 1219835 - RNA, 21 nt, Human
acccuccuuucaccacaugug

SEQ ID NO: 1219836 - RNA, 17 nt, Human
acccucauguucuuaau

SEQ ID NO: 1219837 - RNA, 15 nt, Human
acccucauguucuua

SEQ ID NO: 1219838 - RNA, 14 nt, Human
acccucauguucuu

SEQ ID NO: 1219839 - RNA, 22 nt, Human
acccgggaagggggcugggaca

SEQ ID NO: 1219840 - RNA, 20 nt, Human
acccgggaagggggcuggga

SEQ ID NO: 1219841 - RNA, 19 nt, Human
acccgggaagggggcuggg

SEQ ID NO: 1219842 - RNA, 23 nt, Human
acccugaggcccagagggccugc

SEQ ID NO: 1219843 - RNA, 21 nt, Human
acccugaggcccagagggccu

SEQ ID NO: 1219844 - RNA, 19 nt, Human
acccugaggcccagagggc

SEQ ID NO: 1219845 - RNA, 13 nt, Human
acccugaggccca

SEQ ID NO: 1219846 - RNA, 11 nt, Human
acccugaggcc

SEQ ID NO: 1219847 - RNA, 23 nt, Human
ucaggggugugcggccuuuggcu

SEQ ID NO: 1219848 - RNA, 19 nt, Human
ucaggggugugcggccuuu

SEQ ID NO: 1219849 - RNA, 12 nt, Human
ucaggggugugc

SEQ ID NO: 1219850 - RNA, 20 nt, Human
ucaggccaggcccucugccc

SEQ ID NO: 1219851 - RNA, 19 nt, Human
ucaggccaggcccucugcc

SEQ ID NO: 1219852 - RNA, 18 nt, Human
ucaggccaggcccucugc

SEQ ID NO: 1219853 - RNA, 17 nt, Human
ucaggccaggcccucug

SEQ ID NO: 1219854 - RNA, 19 nt, Human
acccgcuaagagggaggga

SEQ ID NO: 1219855 - RNA, 19 nt, Human
ucaggguuggccccugccc

SEQ ID NO: 1219856 - RNA, 18 nt, Human
ucaggguuggccccugcc

SEQ ID NO: 1219857 - RNA, 23 nt, Human
ucaggguuggccccugcccggcu

SEQ ID NO: 1219858 - RNA, 18 nt, Human
ucaggcaggugggaugga

SEQ ID NO: 1219859 - RNA, 17 nt, Human
ucaggcaggugggaugg

SEQ ID NO: 1219860 - RNA, 14 nt, Human
acccccagccugcu

SEQ ID NO: 1219861 - RNA, 13 nt, Human
acccccagccugc

SEQ ID NO: 1219862 - RNA, 12 nt, Human
acccccagccug

SEQ ID NO: 1219863 - RNA, 16 nt, Human
ucaggccaggcccucu

SEQ ID NO: 1219864 - RNA, 15 nt, Human
ucaggccaggcccuc

SEQ ID NO: 1219865 - RNA, 14 nt, Human
ucaggccaggcccu

SEQ ID NO: 1219866 - RNA, 13 nt, Human
ucaggccaggccc

SEQ ID NO: 1219867 - RNA, 14 nt, Human
ucaggccagcugcu

SEQ ID NO: 1219868 - RNA, 13 nt, Human
ucaggccagcugc

SEQ ID NO: 1219869 - RNA, 22 nt, Human
ucagguggggucacucuggcag

SEQ ID NO: 1219870 - RNA, 22 nt, Human
accgaaaacguggcugcuucaa

SEQ ID NO: 1219871 - RNA, 21 nt, Human
accgaaaacguggcugcuuca

SEQ ID NO: 1219872 - RNA, 18 nt, Human
ucaggugucccugcacuu

SEQ ID NO: 1219873 - RNA, 17 nt, Human
ucaggugucccugcacu

SEQ ID NO: 1219874 - RNA, 15 nt, Human
ucaggugucccugca

SEQ ID NO: 1219875 - RNA, 23 nt, Human
ucagguggggucacucuggcagc

SEQ ID NO: 1219876 - RNA, 15 nt, Human
acccuugugguccca

SEQ ID NO: 1219877 - RNA, 20 nt, Human
acccuugccgucuaccugag

SEQ ID NO: 1219878 - RNA, 13 nt, Human
ucaguaauaacuc

SEQ ID NO: 1219879 - RNA, 13 nt, Human
ucaguaagccgug

SEQ ID NO: 1219880 - RNA, 22 nt, Human
ucaggugucccugcacuugcag

SEQ ID NO: 1219881 - RNA, 19 nt, Human
ucaguuguuagugugucuu

SEQ ID NO: 1219882 - RNA, 23 nt, Human
ucagugccuuauggaacacucug

SEQ ID NO: 1219883 - RNA, 22 nt, Human
ucagugccuuauggaacacucu

SEQ ID NO: 1219884 - RNA, 20 nt, Human
ucagugccuuauggaacacu

SEQ ID NO: 1219885 - RNA, 19 nt, Human
ucagugccuuauggaacac

SEQ ID NO: 1219886 - RNA, 16 nt, Human
ucaguggcagcugcuu

SEQ ID NO: 1219887 - RNA, 15 nt, Human
ucaguggcagcugcu

SEQ ID NO: 1219888 - RNA, 14 nt, Human
ucaguggcagcugc

SEQ ID NO: 1219889 - RNA, 12 nt, Human
uccucugcugcu

SEQ ID NO: 1219890 - RNA, 15 nt, Human
uccugaagaauugaa

SEQ ID NO: 1219891 - RNA, 21 nt, Human
uccucccaccucagccucccg

SEQ ID NO: 1219892 - RNA, 20 nt, Human
uccucccaccucagccuccc

SEQ ID NO: 1219893 - RNA, 18 nt, Human
uccucccaccucagccuc

SEQ ID NO: 1219894 - RNA, 16 nt, Human
uccucccaccucagcc

SEQ ID NO: 1219895 - RNA, 15 nt, Human
uccucccaccucagc

SEQ ID NO: 1219896 - RNA, 14 nt, Human
uccucccaccucag

SEQ ID NO: 1219897 - RNA, 17 nt, Human
acucgcgacaaugcaaa

SEQ ID NO: 1219898 - RNA, 16 nt, Human
acucgcgacaaugcaa

SEQ ID NO: 1219899 - RNA, 15 nt, Human
acucgcgacaaugca

SEQ ID NO: 1219900 - RNA, 21 nt, Human
acucuuauugcccacgcugga

SEQ ID NO: 1219901 - RNA, 20 nt, Human
acucuggcagcucagagagg

SEQ ID NO: 1219902 - RNA, 19 nt, Human
acucuggcagcucagagag

SEQ ID NO: 1219903 - RNA, 17 nt, Human
acucuggcagcucagag

SEQ ID NO: 1219904 - RNA, 16 nt, Human
acucuggcagcucaga

SEQ ID NO: 1219905 - RNA, 12 nt, Human
uccuacucugug

SEQ ID NO: 1219906 - RNA, 21 nt, Human
uccuagccugugccucuggga

SEQ ID NO: 1219907 - RNA, 16 nt, Human
acucgaguuacagaca

SEQ ID NO: 1219908 - RNA, 15 nt, Human
uccguuaaaauacca

SEQ ID NO: 1219909 - RNA, 13 nt, Human
uccguuaaaauac

SEQ ID NO: 1219910 - RNA, 22 nt, Human
acucauugaccugaggcccuuc

SEQ ID NO: 1219911 - RNA, 18 nt, Human
acucauugaccugaggcc

SEQ ID NO: 1219912 - RNA, 17 nt, Human
acucauugaccugaggc

SEQ ID NO: 1219913 - RNA, 16 nt, Human
acucauugaccugagg

SEQ ID NO: 1219914 - RNA, 12 nt, Human
acucaucuuagg

SEQ ID NO: 1219915 - RNA, 22 nt, Human
acucagaauucucuaguuugau

SEQ ID NO: 1219916 - RNA, 21 nt, Human
acucagaauucucuaguuuga

SEQ ID NO: 1219917 - RNA, 14 nt, Human
acucagaauucucu

SEQ ID NO: 1219918 - RNA, 18 nt, Human
acucagaagacacugaug

SEQ ID NO: 1219919 - RNA, 17 nt, Human
acucagaagacacugau

SEQ ID NO: 1219920 - RNA, 16 nt, Human
acucagaagacacuga

SEQ ID NO: 1219921 - RNA, 15 nt, Human
acucagaagacacug

SEQ ID NO: 1219922 - RNA, 14 nt, Human
acucagaagacacu

SEQ ID NO: 1219923 - RNA, 21 nt, Human
acucaccugccccucaacucu

SEQ ID NO: 1219924 - RNA, 19 nt, Human
acucaccugccccucaacu

SEQ ID NO: 1219925 - RNA, 14 nt, Human
acucaccugccccu

SEQ ID NO: 1219926 - RNA, 13 nt, Human
ucccucuuucccu

SEQ ID NO: 1219927 - RNA, 11 nt, Human
ucccucuuucc

SEQ ID NO: 1219928 - RNA, 20 nt, Human
ucccucagucuggcccuucc

SEQ ID NO: 1219929 - RNA, 18 nt, Human
ucccucagucuggcccuu

SEQ ID NO: 1219930 - RNA, 22 nt, Human
ucccugaaggccccgcccaggc

SEQ ID NO: 1219931 - RNA, 21 nt, Human
ucccugaaggccccgcccagg

SEQ ID NO: 1219932 - RNA, 18 nt, Human
ucccugaaggccccgccc

SEQ ID NO: 1219933 - RNA, 14 nt, Human
ucccucuuucccuc

SEQ ID NO: 1219934 - RNA, 23 nt, Human
ucccugaaggccccgcccaggcu

SEQ ID NO: 1219935 - RNA, 17 nt, Human
acucaccccagccccaa

SEQ ID NO: 1219936 - RNA, 18 nt, Human
acuacggaauaguuggcu

SEQ ID NO: 1219937 - RNA, 11 nt, Human
ucccccagccc

SEQ ID NO: 1219938 - RNA, 22 nt, Human
uccccacuugagaauuacccuu

SEQ ID NO: 1219939 - RNA, 14 nt, Human
acguacacauuuua

SEQ ID NO: 1219940 - RNA, 13 nt, Human
acguacacauuuu

SEQ ID NO: 1219941 - RNA, 12 nt, Human
acguacacauuu

SEQ ID NO: 1219942 - RNA, 13 nt, Human
acguacacacaca

SEQ ID NO: 1219943 - RNA, 21 nt, Human
acucacauuuauucugcucac

SEQ ID NO: 1219944 - RNA, 20 nt, Human
acucacauuuauucugcuca

SEQ ID NO: 1219945 - RNA, 19 nt, Human
acucacauuuauucugcuc

SEQ ID NO: 1219946 - RNA, 14 nt, Human
acucaaugcacuga

SEQ ID NO: 1219947 - RNA, 12 nt, Human
acuauguaucaa

SEQ ID NO: 1219948 - RNA, 14 nt, Human
acuauaauguaagc

SEQ ID NO: 1219949 - RNA, 13 nt, Human
acuauaauguaag

SEQ ID NO: 1219950 - RNA, 12 nt, Human
acuauaauguaa

SEQ ID NO: 1219951 - RNA, 21 nt, Human
acuauaauguaagcucuacug

SEQ ID NO: 1219952 - RNA, 20 nt, Human
uccagugaggcucugcccuu

SEQ ID NO: 1219953 - RNA, 19 nt, Human
uccagugaggcucugcccu

SEQ ID NO: 1219954 - RNA, 18 nt, Human
uccagugaggcucugccc

SEQ ID NO: 1219955 - RNA, 15 nt, Human
acggcucacugcagc

SEQ ID NO: 1219956 - RNA, 14 nt, Human
acggcucacugcag

SEQ ID NO: 1219957 - RNA, 17 nt, Human
uccaugaguccccuguu

SEQ ID NO: 1219958 - RNA, 16 nt, Human
uccaugaguccccugu

SEQ ID NO: 1219959 - RNA, 15 nt, Human
uccaugaguccccug

SEQ ID NO: 1219960 - RNA, 14 nt, Human
ucccaccccacaca

SEQ ID NO: 1219961 - RNA, 11 nt, Human
ucccaccccac

SEQ ID NO: 1219962 - RNA, 14 nt, Human
ucccacaaaggaga

SEQ ID NO: 1219963 - RNA, 21 nt, Human
ucccaaagugcugggauuaca

SEQ ID NO: 1219964 - RNA, 15 nt, Human
ucccaaagugcuggg

SEQ ID NO: 1219965 - RNA, 16 nt, Human
ucccaaagugcuggga

SEQ ID NO: 1219966 - RNA, 16 nt, Human
acggccaggccagagg

SEQ ID NO: 1219967 - RNA, 21 nt, Human
acggagucccaccuuggcugc

SEQ ID NO: 1219968 - RNA, 19 nt, Human
acggagucccaccuuggcu

SEQ ID NO: 1219969 - RNA, 18 nt, Human
acgcuacccgggaagggg

SEQ ID NO: 1219970 - RNA, 17 nt, Human
acgcuacccgggaaggg

SEQ ID NO: 1219971 - RNA, 13 nt, Human
acgcuacccggga

SEQ ID NO: 1219972 - RNA, 23 nt, Human
acgcgugcacacaccagagccca

SEQ ID NO: 1219973 - RNA, 14 nt, Human
acgcccccacuggu

SEQ ID NO: 1219974 - RNA, 14 nt, Human
acgaauauugcuga

SEQ ID NO: 1219975 - RNA, 18 nt, Human
uccaggcugggagagccu

SEQ ID NO: 1219976 - RNA, 17 nt, Human
uccaggcugggagagcc

SEQ ID NO: 1219977 - RNA, 14 nt, Human
uccaggcugggaga

SEQ ID NO: 1219978 - RNA, 18 nt, Human
acgccaucccagccccaa

SEQ ID NO: 1219979 - RNA, 17 nt, Human
acgccaucccagcccca

SEQ ID NO: 1219980 - RNA, 16 nt, Human
acgccaucccagcccc

SEQ ID NO: 1219981 - RNA, 15 nt, Human
acgccaucccagccc

SEQ ID NO: 1219982 - RNA, 14 nt, Human
acgccaucccagcc

SEQ ID NO: 1219983 - RNA, 11 nt, Human
acgccauccca

SEQ ID NO: 1219984 - RNA, 23 nt, Human
acgccaggggaaaaucagccugc

SEQ ID NO: 1219985 - RNA, 18 nt, Human
acgccaggggaaaaucag

SEQ ID NO: 1219986 - RNA, 15 nt, Human
acgacugcccggcag

SEQ ID NO: 1219987 - RNA, 13 nt, Human
accuggccucugc

SEQ ID NO: 1219988 - RNA, 12 nt, Human
accuggccucug

SEQ ID NO: 1219989 - RNA, 20 nt, Human
uccacccaggagccccgagg

SEQ ID NO: 1219990 - RNA, 17 nt, Human
uccacccaccucagccu

SEQ ID NO: 1219991 - RNA, 13 nt, Human
uccacccaccuca

SEQ ID NO: 1219992 - RNA, 12 nt, Human
uccacccaccuc

SEQ ID NO: 1219993 - RNA, 18 nt, Human
uccaaggguacuaaggaa

SEQ ID NO: 1219994 - RNA, 21 nt, Human
accuggguaacuagggaagau

SEQ ID NO: 1219995 - RNA, 18 nt, Human
accuuuuuuauacauaaa

SEQ ID NO: 1219996 - RNA, 17 nt, Human
accuuuuuuauacauaa

SEQ ID NO: 1219997 - RNA, 16 nt, Human
accuuuuuuauacaua

SEQ ID NO: 1219998 - RNA, 16 nt, Human
accuuuguccccaccg

SEQ ID NO: 1219999 - RNA, 15 nt, Human
accuuuguccccacc

SEQ ID NO: 1220000 - RNA, 14 nt, Human
accuuuguccccac

SEQ ID NO: 1220001 - RNA, 22 nt, Human
accuucuccuucaccuuugucc

SEQ ID NO: 1220002 - RNA, 16 nt, Human
ucauuugucacacacu

SEQ ID NO: 1220003 - RNA, 14 nt, Human
ucauuugucacaca

SEQ ID NO: 1220004 - RNA, 19 nt, Human
ucauuuuuaguagagacag

SEQ ID NO: 1220005 - RNA, 18 nt, Human
ucauuuuuuuuaagaaaa

SEQ ID NO: 1220006 - RNA, 18 nt, Human
accugcggugcuaucucc

SEQ ID NO: 1220007 - RNA, 21 nt, Human
accugcgucucauacucaccu

SEQ ID NO: 1220008 - RNA, 16 nt, Human
accugcggugcuaucu

SEQ ID NO: 1220009 - RNA, 23 nt, Human
accugccuguugggccaggagcc

SEQ ID NO: 1220010 - RNA, 20 nt, Human
accuggaauauauaaccagu

SEQ ID NO: 1220011 - RNA, 14 nt, Human
accugauugugucu

SEQ ID NO: 1220012 - RNA, 16 nt, Human
accugaggggccucuu

SEQ ID NO: 1220013 - RNA, 14 nt, Human
accugaggggccuc

SEQ ID NO: 1220014 - RNA, 17 nt, Human
accugccaggaagccag

SEQ ID NO: 1220015 - RNA, 16 nt, Human
accugccaggaagcca

SEQ ID NO: 1220016 - RNA, 19 nt, Human
accugccaggaagccagca

SEQ ID NO: 1220017 - RNA, 18 nt, Human
accugccaggaagccagc

SEQ ID NO: 1220018 - RNA, 19 nt, Human
accugaauuuuggcugugu

SEQ ID NO: 1220019 - RNA, 18 nt, Human
accugaagacucauucuu

SEQ ID NO: 1220020 - RNA, 13 nt, Human
ucauaaugacuua

SEQ ID NO: 1220021 - RNA, 12 nt, Human
ucauaaugacuu

SEQ ID NO: 1220022 - RNA, 23 nt, Human
accugaggcccuucucuccagcc

SEQ ID NO: 1220023 - RNA, 21 nt, Human
uagacagagucucacuguugc

SEQ ID NO: 1220024 - RNA, 21 nt, Human
uagacagucccugccaaugga

SEQ ID NO: 1220025 - RNA, 17 nt, Human
uagacagucccugccaa

SEQ ID NO: 1220026 - RNA, 20 nt, Human
aauuugugauacaaugcugu

SEQ ID NO: 1220027 - RNA, 18 nt, Human
aauuugugauacaaugcu

SEQ ID NO: 1220028 - RNA, 17 nt, Human
aauuugugauacaaugc

SEQ ID NO: 1220029 - RNA, 14 nt, Human
aauuugugauacaa

SEQ ID NO: 1220030 - RNA, 18 nt, Human
aauuugggggaaaauuua

SEQ ID NO: 1220031 - RNA, 15 nt, Human
uagaagucacacagu

SEQ ID NO: 1220032 - RNA, 10 nt, Human
uagacagagu

SEQ ID NO: 1220033 - RNA, 22 nt, Human
uagagcggagaaaggaagggcu

SEQ ID NO: 1220034 - RNA, 14 nt, Human
uagagccagggucu

SEQ ID NO: 1220035 - RNA, 21 nt, Human
uagcacagacccugcccugug

SEQ ID NO: 1220036 - RNA, 20 nt, Human
uagcacagacccugcccugu

SEQ ID NO: 1220037 - RNA, 16 nt, Human
uagcacagacccugcc

SEQ ID NO: 1220038 - RNA, 15 nt, Human
uagcacagacccugc

SEQ ID NO: 1220039 - RNA, 14 nt, Human
uagcacagacccug

SEQ ID NO: 1220040 - RNA, 14 nt, Human
uagccaaggccaaa

SEQ ID NO: 1220041 - RNA, 13 nt, Human
uagccaaggccaa

SEQ ID NO: 1220042 - RNA, 12 nt, Human
uagccaaggcca

SEQ ID NO: 1220043 - RNA, 16 nt, Human
uagcacuuugggaggc

SEQ ID NO: 1220044 - RNA, 24 nt, Human
uagcacagacccugcccugugggc

SEQ ID NO: 1220045 - RNA, 22 nt, Human
uagcacagacccugcccugugg

SEQ ID NO: 1220046 - RNA, 14 nt, Human
uaggaaaaacugau

SEQ ID NO: 1220047 - RNA, 13 nt, Human
uaggaaaaacuga

SEQ ID NO: 1220048 - RNA, 20 nt, Human
uagccuuagaagucacacag

SEQ ID NO: 1220049 - RNA, 14 nt, Human
uagcgcccaguugg

SEQ ID NO: 1220050 - RNA, 21 nt, Human
uagccuuagaagucacacagu

SEQ ID NO: 1220051 - RNA, 17 nt, Human
uagcgcccaguugggug

SEQ ID NO: 1220052 - RNA, 17 nt, Human
uaggaaaaacugauuuu

SEQ ID NO: 1220053 - RNA, 16 nt, Human
uaggaaaaacugauuu

SEQ ID NO: 1220054 - RNA, 21 nt, Human
uagggaaggauacaaaagcau

SEQ ID NO: 1220055 - RNA, 13 nt, Human
uagggaagauaau

SEQ ID NO: 1220056 - RNA, 14 nt, Human
uaggcauuguggga

SEQ ID NO: 1220057 - RNA, 22 nt, Human
uaguagagacaggguuuugcca

SEQ ID NO: 1220058 - RNA, 15 nt, Human
uaguagagacagggu

SEQ ID NO: 1220059 - RNA, 14 nt, Human
uagucacugagaca

SEQ ID NO: 1220060 - RNA, 16 nt, Human
acacaguauuacuucu

SEQ ID NO: 1220061 - RNA, 24 nt, Human
acacaggcccggcuccaggcuccu

SEQ ID NO: 1220062 - RNA, 23 nt, Human
acacaggcccggcuccaggcucc

SEQ ID NO: 1220063 - RNA, 22 nt, Human
acacaggcccggcuccaggcuc

SEQ ID NO: 1220064 - RNA, 21 nt, Human
acacaggcccggcuccaggcu

SEQ ID NO: 1220065 - RNA, 20 nt, Human
acacaggcccggcuccaggc

SEQ ID NO: 1220066 - RNA, 19 nt, Human
acacaggcccggcuccagg

SEQ ID NO: 1220067 - RNA, 18 nt, Human
acacaggcccggcuccag

SEQ ID NO: 1220068 - RNA, 17 nt, Human
acacaggcccggcucca

SEQ ID NO: 1220069 - RNA, 16 nt, Human
acacaggcccggcucc

SEQ ID NO: 1220070 - RNA, 23 nt, Human
acaaugcaaaccaucauugaaau

SEQ ID NO: 1220071 - RNA, 21 nt, Human
acaaugcaaaccaucauugaa

SEQ ID NO: 1220072 - RNA, 19 nt, Human
acaaugcaaaccaucauug

SEQ ID NO: 1220073 - RNA, 18 nt, Human
acaaugcaaaccaucauu

SEQ ID NO: 1220074 - RNA, 17 nt, Human
acaaugcaaaccaucau

SEQ ID NO: 1220075 - RNA, 16 nt, Human
acaaugcaaaccauca

SEQ ID NO: 1220076 - RNA, 11 nt, Human
acaaugcaaac

SEQ ID NO: 1220077 - RNA, 22 nt, Human
acaaugacuuacuguacaugaa

SEQ ID NO: 1220078 - RNA, 20 nt, Human
acaaugacuuacuguacaug

SEQ ID NO: 1220079 - RNA, 17 nt, Human
uaggguuauaauaaugu

SEQ ID NO: 1220080 - RNA, 15 nt, Human
uaggguuauaauaau

SEQ ID NO: 1220081 - RNA, 19 nt, Human
uaggguaagugagagaggg

SEQ ID NO: 1220082 - RNA, 17 nt, Human
uaucagaauucucagaa

SEQ ID NO: 1220083 - RNA, 19 nt, Human
uauccaacaucaacaucuu

SEQ ID NO: 1220084 - RNA, 22 nt, Human
uaucacccagaagaaaauagug

SEQ ID NO: 1220085 - RNA, 19 nt, Human
uaucacccagaagaaaaua

SEQ ID NO: 1220086 - RNA, 19 nt, Human
acagacauacuaaccagca

SEQ ID NO: 1220087 - RNA, 18 nt, Human
acagacauacuaaccagc

SEQ ID NO: 1220088 - RNA, 13 nt, Human
acagaaauguaca

SEQ ID NO: 1220089 - RNA, 16 nt, Human
acacuuacacuuuaug

SEQ ID NO: 1220090 - RNA, 23 nt, Human
acacuguuucaaacuuuacuaug

SEQ ID NO: 1220091 - RNA, 20 nt, Human
acacuguuucaaacuuuacu

SEQ ID NO: 1220092 - RNA, 18 nt, Human
acacuguuucaaacuuua

SEQ ID NO: 1220093 - RNA, 17 nt, Human
acacuguuucaaacuuu

SEQ ID NO: 1220094 - RNA, 19 nt, Human
acacucauugaccugaggc

SEQ ID NO: 1220095 - RNA, 17 nt, Human
acacucauugaccugag

SEQ ID NO: 1220096 - RNA, 21 nt, Human
acacuuacacuuuaugcacaa

SEQ ID NO: 1220097 - RNA, 18 nt, Human
acacuuacacuuuaugca

SEQ ID NO: 1220098 - RNA, 16 nt, Human
acacucauugaccuga

SEQ ID NO: 1220099 - RNA, 18 nt, Human
uauagccuaggugacaga

SEQ ID NO: 1220100 - RNA, 23 nt, Human
uauaggaacuuaaauaaugugaa

SEQ ID NO: 1220101 - RNA, 22 nt, Human
uauacacuuacacuuuaugcac

SEQ ID NO: 1220102 - RNA, 21 nt, Human
uauaauuuaccugaagucuuu

SEQ ID NO: 1220103 - RNA, 18 nt, Human
uauaauuuaccugaaguc

SEQ ID NO: 1220104 - RNA, 21 nt, Human
acacucaaaagcugggcaggu

SEQ ID NO: 1220105 - RNA, 22 nt, Human
acacuaaugaggaaacugcacu

SEQ ID NO: 1220106 - RNA, 15 nt, Human
acacuaaugaggaaa

SEQ ID NO: 1220107 - RNA, 20 nt, Human
uagucacugagacagcccgg

SEQ ID NO: 1220108 - RNA, 17 nt, Human
uagucacugagacagcc

SEQ ID NO: 1220109 - RNA, 10 nt, Human
uaugggagag

SEQ ID NO: 1220110 - RNA, 23 nt, Human
uaugggacucaaugcacugacau

SEQ ID NO: 1220111 - RNA, 16 nt, Human
uaugggacucaaugca

SEQ ID NO: 1220112 - RNA, 22 nt, Human
uauggcccuggccuagcauacg

SEQ ID NO: 1220113 - RNA, 21 nt, Human
uauggcccuggccuagcauac

SEQ ID NO: 1220114 - RNA, 20 nt, Human
uauggcccuggccuagcaua

SEQ ID NO: 1220115 - RNA, 14 nt, Human
uaugcucugcaugu

SEQ ID NO: 1220116 - RNA, 14 nt, Human
uaugaucacggcuc

SEQ ID NO: 1220117 - RNA, 22 nt, Human
uaugcaugaaguaauaugcaca

SEQ ID NO: 1220118 - RNA, 15 nt, Human
acagcccgggcucug

SEQ ID NO: 1220119 - RNA, 16 nt, Human
acagcccgggcucugc

SEQ ID NO: 1220120 - RNA, 23 nt, Human
uaugaggcauuuguuugaacuga

SEQ ID NO: 1220121 - RNA, 21 nt, Human
uaugaggcauuuguuugaacu

SEQ ID NO: 1220122 - RNA, 15 nt, Human
uaugaggcauuuguu

SEQ ID NO: 1220123 - RNA, 14 nt, Human
uaugaggcauuugu

SEQ ID NO: 1220124 - RNA, 21 nt, Human
acaggaaaagcugcugacagu

SEQ ID NO: 1220125 - RNA, 20 nt, Human
acaggaaaagcugcugacag

SEQ ID NO: 1220126 - RNA, 19 nt, Human
acaggaaaagcugcugaca

SEQ ID NO: 1220127 - RNA, 23 nt, Human
acagcuugaccgugaggccagag

SEQ ID NO: 1220128 - RNA, 22 nt, Human
acagcuugaccgugaggccaga

SEQ ID NO: 1220129 - RNA, 21 nt, Human
acagcuugaccgugaggccag

SEQ ID NO: 1220130 - RNA, 20 nt, Human
acagcuugaccgugaggcca

SEQ ID NO: 1220131 - RNA, 17 nt, Human
acagcuugaccgugagg

SEQ ID NO: 1220132 - RNA, 21 nt, Human
acagcuucauuuccugugucu

SEQ ID NO: 1220133 - RNA, 19 nt, Human
acagcuucauuuccugugu

SEQ ID NO: 1220134 - RNA, 17 nt, Human
acagcuucauuuccugu

SEQ ID NO: 1220135 - RNA, 19 nt, Human
acagcuaaugggacacuaa

SEQ ID NO: 1220136 - RNA, 17 nt, Human
acagcuaaugggacacu

SEQ ID NO: 1220137 - RNA, 16 nt, Human
acagcuaaugggacac

SEQ ID NO: 1220138 - RNA, 15 nt, Human
acagcuaaugggaca

SEQ ID NO: 1220139 - RNA, 22 nt, Human
acaggcccggcuccaggcuccu

SEQ ID NO: 1220140 - RNA, 21 nt, Human
acaggcccggcuccaggcucc

SEQ ID NO: 1220141 - RNA, 20 nt, Human
acaggcccggcuccaggcuc

SEQ ID NO: 1220142 - RNA, 18 nt, Human
acaggcccggcuccaggc

SEQ ID NO: 1220143 - RNA, 17 nt, Human
acaggcccggcuccagg

SEQ ID NO: 1220144 - RNA, 16 nt, Human
acaggcccggcuccag

SEQ ID NO: 1220145 - RNA, 13 nt, Human
acaggcaggucca

SEQ ID NO: 1220146 - RNA, 20 nt, Human
acaggaaaauuuuaaaaaua

SEQ ID NO: 1220147 - RNA, 13 nt, Human
aaugcaccuggaa

SEQ ID NO: 1220148 - RNA, 14 nt, Human
aaugcaaaccauca

SEQ ID NO: 1220149 - RNA, 12 nt, Human
aaugcaaaccau

SEQ ID NO: 1220150 - RNA, 11 nt, Human
aaugcaaacca

SEQ ID NO: 1220151 - RNA, 11 nt, Human
aaugagccugg

SEQ ID NO: 1220152 - RNA, 21 nt, Human
aaugaccuuucaauaggaaaa

SEQ ID NO: 1220153 - RNA, 18 nt, Human
aaugaggucagagccugc

SEQ ID NO: 1220154 - RNA, 16 nt, Human
aaugaggucagagccu

SEQ ID NO: 1220155 - RNA, 14 nt, Human
aaugagccuggcaa

SEQ ID NO: 1220156 - RNA, 13 nt, Human
aaugagccuggca

SEQ ID NO: 1220157 - RNA, 12 nt, Human
aaugagccuggc

SEQ ID NO: 1220158 - RNA, 22 nt, Human
uacagagcccacgcccccacug

SEQ ID NO: 1220159 - RNA, 19 nt, Human
uacagagcccacgccccca

SEQ ID NO: 1220160 - RNA, 23 nt, Human
uacagagcagacaguuaagagaa

SEQ ID NO: 1220161 - RNA, 19 nt, Human
uacagacaaagcguggugg

SEQ ID NO: 1220162 - RNA, 15 nt, Human
uacagacaaagcgug

SEQ ID NO: 1220163 - RNA, 14 nt, Human
uacagacaaagcgu

SEQ ID NO: 1220164 - RNA, 13 nt, Human
uacagacaaagcg

SEQ ID NO: 1220165 - RNA, 14 nt, Human
aaugguuuucaaaa

SEQ ID NO: 1220166 - RNA, 18 nt, Human
aauggaagacagcucuua

SEQ ID NO: 1220167 - RNA, 16 nt, Human
aauggaagacagcucu

SEQ ID NO: 1220168 - RNA, 16 nt, Human
aaugguuuucuugugu

SEQ ID NO: 1220169 - RNA, 16 nt, Human
aaugguuuucaaaaua

SEQ ID NO: 1220170 - RNA, 13 nt, Human
aauggaagacagc

SEQ ID NO: 1220171 - RNA, 22 nt, Human
aaugcuggcuguuggcuggggg

SEQ ID NO: 1220172 - RNA, 16 nt, Human
uacaaugcugugcccu

SEQ ID NO: 1220173 - RNA, 14 nt, Human
uacaaugcugugcc

SEQ ID NO: 1220174 - RNA, 13 nt, Human
uacaaugcugugc

SEQ ID NO: 1220175 - RNA, 18 nt, Human
uaauuuuuuugagacaga

SEQ ID NO: 1220176 - RNA, 23 nt, Human
uaccucuugagccuugaacuuug

SEQ ID NO: 1220177 - RNA, 22 nt, Human
uaccucuugagccuugaacuuu

SEQ ID NO: 1220178 - RNA, 15 nt, Human
uacccucauguucuu

SEQ ID NO: 1220179 - RNA, 23 nt, Human
uacccgggaagggggcugggaca

SEQ ID NO: 1220180 - RNA, 14 nt, Human
uaccugaagucuuu

SEQ ID NO: 1220181 - RNA, 13 nt, Human
uaccugaagucuu

SEQ ID NO: 1220182 - RNA, 15 nt, Human
uaccugaggggccuc

SEQ ID NO: 1220183 - RNA, 13 nt, Human
uaccugaggggcc

SEQ ID NO: 1220184 - RNA, 16 nt, Human
uaccugaagucuuugu

SEQ ID NO: 1220185 - RNA, 20 nt, Human
aauuacaggaaguacuggag

SEQ ID NO: 1220186 - RNA, 19 nt, Human
aauuacaggaaguacugga

SEQ ID NO: 1220187 - RNA, 17 nt, Human
aauuacaggaaguacug

SEQ ID NO: 1220188 - RNA, 16 nt, Human
uaccugccaggaagcc

SEQ ID NO: 1220189 - RNA, 16 nt, Human
uaccugaggggccucu

SEQ ID NO: 1220190 - RNA, 22 nt, Human
aauuauuuauuaaaugcccagc

SEQ ID NO: 1220191 - RNA, 22 nt, Human
aauucaguuguuagugugucuu

SEQ ID NO: 1220192 - RNA, 17 nt, Human
aauucaguuguuagugu

SEQ ID NO: 1220193 - RNA, 11 nt, Human
aauucaguugu

SEQ ID NO: 1220194 - RNA, 21 nt, Human
aauuauuuauuaaaugcccag

SEQ ID NO: 1220195 - RNA, 23 nt, Human
uacagagcccacgcccccacugg

SEQ ID NO: 1220196 - RNA, 17 nt, Human
aauuaaguacuauguau

SEQ ID NO: 1220197 - RNA, 16 nt, Human
aauuaaguacuaugua

SEQ ID NO: 1220198 - RNA, 16 nt, Human
aauuaacuuuuauaaa

SEQ ID NO: 1220199 - RNA, 15 nt, Human
aauuaacuuuuauaa

SEQ ID NO: 1220200 - RNA, 13 nt, Human
aauuaacuuuuau

SEQ ID NO: 1220201 - RNA, 12 nt, Human
aauuaacuuuua

SEQ ID NO: 1220202 - RNA, 21 nt, Human
aauguucucucuucuccaccu

SEQ ID NO: 1220203 - RNA, 18 nt, Human
uaccagccaguaaauggg

SEQ ID NO: 1220204 - RNA, 22 nt, Human
uaccagcagagcaccuuagaca

SEQ ID NO: 1220205 - RNA, 14 nt, Human
uaccagcagagcac

SEQ ID NO: 1220206 - RNA, 13 nt, Human
uaccagcagagca

SEQ ID NO: 1220207 - RNA, 12 nt, Human
uaccagcagagc

SEQ ID NO: 1220208 - RNA, 12 nt, Human
uacauucuguua

SEQ ID NO: 1220209 - RNA, 20 nt, Human
uaacuugucuuuggacccug

SEQ ID NO: 1220210 - RNA, 16 nt, Human
uaacuugucuuuggac

SEQ ID NO: 1220211 - RNA, 14 nt, Human
uaacuaaaagguau

SEQ ID NO: 1220212 - RNA, 13 nt, Human
uaacuucacauau

SEQ ID NO: 1220213 - RNA, 19 nt, Human
uaacauguaauuaaguacu

SEQ ID NO: 1220214 - RNA, 21 nt, Human
aauaguucagguaacaggcag

SEQ ID NO: 1220215 - RNA, 16 nt, Human
aauaguggugugauuu

SEQ ID NO: 1220216 - RNA, 19 nt, Human
aauaccagccaguaaaugg

SEQ ID NO: 1220217 - RNA, 17 nt, Human
aauaccagccaguaaau

SEQ ID NO: 1220218 - RNA, 12 nt, Human
aauaccaaggaa

SEQ ID NO: 1220219 - RNA, 18 nt, Human
aauaccugucccccugac

SEQ ID NO: 1220220 - RNA, 15 nt, Human
aauaccugucccccu

SEQ ID NO: 1220221 - RNA, 19 nt, Human
aauaccugucccccugaca

SEQ ID NO: 1220222 - RNA, 21 nt, Human
aauaccugucccccugacaac

SEQ ID NO: 1220223 - RNA, 13 nt, Human
aauacagaggcaa

SEQ ID NO: 1220224 - RNA, 11 nt, Human
uaaauuauuuu

SEQ ID NO: 1220225 - RNA, 22 nt, Human
uaaauuaacuuuuauaaacuuu

SEQ ID NO: 1220226 - RNA, 21 nt, Human
uaaauuaacuuuuauaaacuu

SEQ ID NO: 1220227 - RNA, 18 nt, Human
uaaaugaaaaucgugaca

SEQ ID NO: 1220228 - RNA, 21 nt, Human
aaguguauuuuuuuacuaaua

SEQ ID NO: 1220229 - RNA, 18 nt, Human
aaguguauuuuuuuacua

SEQ ID NO: 1220230 - RNA, 20 nt, Human
uaaauuaacuuuuauaaacu

SEQ ID NO: 1220231 - RNA, 19 nt, Human
uaaauuaacuuuuauaaac

SEQ ID NO: 1220232 - RNA, 13 nt, Human
aaucucaaauaac

SEQ ID NO: 1220233 - RNA, 12 nt, Human
aaucuaaaugga

SEQ ID NO: 1220234 - RNA, 17 nt, Human
aaucccauuuaaaaaaa

SEQ ID NO: 1220235 - RNA, 18 nt, Human
uaaggaugcuuguacaua

SEQ ID NO: 1220236 - RNA, 18 nt, Human
uaaggaauaccugucccc

SEQ ID NO: 1220237 - RNA, 17 nt, Human
uaaggaauaccuguccc

SEQ ID NO: 1220238 - RNA, 9 nt, Human
uaaggaaua

SEQ ID NO: 1220239 - RNA, 13 nt, Human
uaaggaagacaau

SEQ ID NO: 1220240 - RNA, 21 nt, Human
uaagcuauucaguaauaacuc

SEQ ID NO: 1220241 - RNA, 14 nt, Human
uaagauucauauuu

SEQ ID NO: 1220242 - RNA, 19 nt, Human
aaucagccugcuccagcug

SEQ ID NO: 1220243 - RNA, 18 nt, Human
aaucagccugcuccagcu

SEQ ID NO: 1220244 - RNA, 13 nt, Human
aaucagccugcuc

SEQ ID NO: 1220245 - RNA, 11 nt, Human
aaucagccugc

SEQ ID NO: 1220246 - RNA, 22 nt, Human
aaggggcccaaauucuuucagu

SEQ ID NO: 1220247 - RNA, 20 nt, Human
aagguagaaauaucugaaaa

SEQ ID NO: 1220248 - RNA, 18 nt, Human
aaggucauuuuuuuuaag

SEQ ID NO: 1220249 - RNA, 12 nt, Human
aaggucauuuuu

SEQ ID NO: 1220250 - RNA, 18 nt, Human
guuucugaaagggacgcu

SEQ ID NO: 1220251 - RNA, 19 nt, Human
guuucuauguguagggcgg

SEQ ID NO: 1220252 - RNA, 13 nt, Human
guuuauugucaaa

SEQ ID NO: 1220253 - RNA, 13 nt, Human
guugggcuggugu

SEQ ID NO: 1220254 - RNA, 17 nt, Human
guugggccaggagccuc

SEQ ID NO: 1220255 - RNA, 15 nt, Human
guugggccaggagcc

SEQ ID NO: 1220256 - RNA, 15 nt, Human
guugggcugguguca

SEQ ID NO: 1220257 - RNA, 22 nt, Human
aaggcucgagcaugccuggaug

SEQ ID NO: 1220258 - RNA, 20 nt, Human
aaggcucgagcaugccugga

SEQ ID NO: 1220259 - RNA, 19 nt, Human
aaggcucgagcaugccugg

SEQ ID NO: 1220260 - RNA, 18 nt, Human
aaggcucgagcaugccug

SEQ ID NO: 1220261 - RNA, 16 nt, Human
aaggcucgagcaugcc

SEQ ID NO: 1220262 - RNA, 22 nt, Human
aaggcuccaggagcagccacau

SEQ ID NO: 1220263 - RNA, 19 nt, Human
aaggcuccaggagcagcca

SEQ ID NO: 1220264 - RNA, 18 nt, Human
aaggcuccaggagcagcc

SEQ ID NO: 1220265 - RNA, 16 nt, Human
aaggcuccaggagcag

SEQ ID NO: 1220266 - RNA, 17 nt, Human
guuucaaacuuuacuau

SEQ ID NO: 1220267 - RNA, 15 nt, Human
aaggcuccaggagca

SEQ ID NO: 1220268 - RNA, 16 nt, Human
guuucaaacuuuacua

SEQ ID NO: 1220269 - RNA, 14 nt, Human
guuucaaacuuuac

SEQ ID NO: 1220270 - RNA, 13 nt, Human
guuucaaacuuua

SEQ ID NO: 1220271 - RNA, 15 nt, Human
aaggaaagagggagg

SEQ ID NO: 1220272 - RNA, 13 nt, Human
aaggaagcacaug

SEQ ID NO: 1220273 - RNA, 15 nt, Human
aaggaagacuucauc

SEQ ID NO: 1220274 - RNA, 14 nt, Human
aaggaagacuucau

SEQ ID NO: 1220275 - RNA, 16 nt, Human
aaggaagcacaugccu

SEQ ID NO: 1220276 - RNA, 17 nt, Human
aaggaauaccugucccc

SEQ ID NO: 1220277 - RNA, 20 nt, Human
aaggaggggauagagagaga

SEQ ID NO: 1220278 - RNA, 18 nt, Human
aaggaggaagagaaaaaa

SEQ ID NO: 1220279 - RNA, 17 nt, Human
aaggagauuuacaacug

SEQ ID NO: 1220280 - RNA, 14 nt, Human
aaggagauuuacaa

SEQ ID NO: 1220281 - RNA, 11 nt, Human
aaggagagcua

SEQ ID NO: 1220282 - RNA, 18 nt, Human
aaggaauaccuguccccc

SEQ ID NO: 1220283 - RNA, 16 nt, Human
aaggccaaaggaagca

SEQ ID NO: 1220284 - RNA, 21 nt, Human
aaggauacaaaagcaugugag

SEQ ID NO: 1220285 - RNA, 13 nt, Human
aaggauacaaaag

SEQ ID NO: 1220286 - RNA, 14 nt, Human
guugcccaggcugg

SEQ ID NO: 1220287 - RNA, 13 nt, Human
guugcccaggcug

SEQ ID NO: 1220288 - RNA, 12 nt, Human
guugcccaggcu

SEQ ID NO: 1220289 - RNA, 23 nt, Human
guugcccaggcaggucuugaacu

SEQ ID NO: 1220290 - RNA, 22 nt, Human
uaaaacuugauguguuaucucu

SEQ ID NO: 1220291 - RNA, 20 nt, Human
uaaaacuugauguguuaucu

SEQ ID NO: 1220292 - RNA, 21 nt, Human
uaaaaaucucaaauuucuaaa

SEQ ID NO: 1220293 - RNA, 20 nt, Human
uaaaaaucucaaauuucuaa

SEQ ID NO: 1220294 - RNA, 19 nt, Human
uaaaaaucucaaauuucua

SEQ ID NO: 1220295 - RNA, 17 nt, Human
uaaaaaucucaaauuuc

SEQ ID NO: 1220296 - RNA, 16 nt, Human
uaaaaaucucaaauuu

SEQ ID NO: 1220297 - RNA, 15 nt, Human
uaaaaaucucaaauu

SEQ ID NO: 1220298 - RNA, 15 nt, Human
uaaaaaguggaaaaa

SEQ ID NO: 1220299 - RNA, 15 nt, Human
guuuuucuucucccu

SEQ ID NO: 1220300 - RNA, 22 nt, Human
uaaaauaccagccaguaaaugg

SEQ ID NO: 1220301 - RNA, 18 nt, Human
aagugauucuccugccuc

SEQ ID NO: 1220302 - RNA, 17 nt, Human
aagugauucuccugccu

SEQ ID NO: 1220303 - RNA, 16 nt, Human
aagugauucuccugcc

SEQ ID NO: 1220304 - RNA, 15 nt, Human
aagugauucuccugc

SEQ ID NO: 1220305 - RNA, 19 nt, Human
aagugauucuccugccuca

SEQ ID NO: 1220306 - RNA, 20 nt, Human
aagugauucuccugccucag

SEQ ID NO: 1220307 - RNA, 16 nt, Human
aagugaggaugaaaaa

SEQ ID NO: 1220308 - RNA, 23 nt, Human
aaguacacuguuucaaacuuuac

SEQ ID NO: 1220309 - RNA, 20 nt, Human
aaguacacuguuucaaacuu

SEQ ID NO: 1220310 - RNA, 19 nt, Human
aaguacacuguuucaaacu

SEQ ID NO: 1220311 - RNA, 18 nt, Human
aaguacacuguuucaaac

SEQ ID NO: 1220312 - RNA, 13 nt, Human
aaguacacuguuu

SEQ ID NO: 1220313 - RNA, 22 nt, Human
guuuugccauguuggccaggcu

SEQ ID NO: 1220314 - RNA, 21 nt, Human
guuuugccauguuggccaggc

SEQ ID NO: 1220315 - RNA, 20 nt, Human
guuuugccauguuggccagg

SEQ ID NO: 1220316 - RNA, 16 nt, Human
guuuugccauguuggc

SEQ ID NO: 1220317 - RNA, 18 nt, Human
guuucugccgcagcccug

SEQ ID NO: 1220318 - RNA, 15 nt, Human
guuucugccgcagcc

SEQ ID NO: 1220319 - RNA, 14 nt, Human
guuucugccgcagc

SEQ ID NO: 1220320 - RNA, 15 nt, Human
aagugagagcugggu

SEQ ID NO: 1220321 - RNA, 14 nt, Human
aagugagagcuggg

SEQ ID NO: 1220322 - RNA, 12 nt, Human
aagugagagagg

SEQ ID NO: 1220323 - RNA, 19 nt, Human
aagugaagacaaugacuua

SEQ ID NO: 1220324 - RNA, 17 nt, Human
aagugaagacaaugacu

SEQ ID NO: 1220325 - RNA, 21 nt, Human
aagugaaaaaggaggaagaga

SEQ ID NO: 1220326 - RNA, 21 nt, Human
gugugugcgccuacaggagug

SEQ ID NO: 1220327 - RNA, 12 nt, Human
aagcagugcaug

SEQ ID NO: 1220328 - RNA, 20 nt, Human
aagcagugcaugcugucccu

SEQ ID NO: 1220329 - RNA, 15 nt, Human
aagcagugcaugcug

SEQ ID NO: 1220330 - RNA, 14 nt, Human
aagcagugcaugcu

SEQ ID NO: 1220331 - RNA, 17 nt, Human
aagcccaggaaaggcuc

SEQ ID NO: 1220332 - RNA, 14 nt, Human
aagcccaggaaagg

SEQ ID NO: 1220333 - RNA, 22 nt, Human
aagccaaagcuaggccuggcca

SEQ ID NO: 1220334 - RNA, 22 nt, Human
aagcccaggaaaggcuccagga

SEQ ID NO: 1220335 - RNA, 19 nt, Human
aagcccaggaaaggcucca

SEQ ID NO: 1220336 - RNA, 19 nt, Human
aagcccugagcuuucugcu

SEQ ID NO: 1220337 - RNA, 20 nt, Human
aagccgcuggggccaguugg

SEQ ID NO: 1220338 - RNA, 18 nt, Human
guuaagagaaaugagcuu

SEQ ID NO: 1220339 - RNA, 12 nt, Human
guuaagagaaau

SEQ ID NO: 1220340 - RNA, 11 nt, Human
guuaagagaaa

SEQ ID NO: 1220341 - RNA, 20 nt, Human
guuaggcauugugggaaggg

SEQ ID NO: 1220342 - RNA, 19 nt, Human
guuaggcauugugggaagg

SEQ ID NO: 1220343 - RNA, 18 nt, Human
guucaagcgauucuucug

SEQ ID NO: 1220344 - RNA, 22 nt, Human
guucaaagauauuuugcuuugu

SEQ ID NO: 1220345 - RNA, 21 nt, Human
guucaaagauauuuugcuuug

SEQ ID NO: 1220346 - RNA, 20 nt, Human
guucaaagauauuuugcuuu

SEQ ID NO: 1220347 - RNA, 23 nt, Human
guuauuuuuauuuauuuaaauuu

SEQ ID NO: 1220348 - RNA, 18 nt, Human
aagcuccaagcucccagg

SEQ ID NO: 1220349 - RNA, 17 nt, Human
aagcuccaagcucccag

SEQ ID NO: 1220350 - RNA, 20 nt, Human
aagcucagggccuggcucag

SEQ ID NO: 1220351 - RNA, 19 nt, Human
aagcucagggccuggcuca

SEQ ID NO: 1220352 - RNA, 18 nt, Human
aagcucagggccuggcuc

SEQ ID NO: 1220353 - RNA, 17 nt, Human
aagcucagggccuggcu

SEQ ID NO: 1220354 - RNA, 16 nt, Human
aagcucagggccuggc

SEQ ID NO: 1220355 - RNA, 13 nt, Human
aagcucagggccu

SEQ ID NO: 1220356 - RNA, 12 nt, Human
aagcucagggcc

SEQ ID NO: 1220357 - RNA, 16 nt, Human
aagcuaggccuggcca

SEQ ID NO: 1220358 - RNA, 12 nt, Human
aagcuaggccug

SEQ ID NO: 1220359 - RNA, 20 nt, Human
aagccugaguuugcuuucaa

SEQ ID NO: 1220360 - RNA, 15 nt, Human
guucagcuccagcuc

SEQ ID NO: 1220361 - RNA, 13 nt, Human
guucagcuccagc

SEQ ID NO: 1220362 - RNA, 22 nt, Human
guggggucacucuggcagcuca

SEQ ID NO: 1220363 - RNA, 21 nt, Human
guggggucacucuggcagcuc

SEQ ID NO: 1220364 - RNA, 20 nt, Human
guggggucacucuggcagcu

SEQ ID NO: 1220365 - RNA, 17 nt, Human
guggggucacucuggca

SEQ ID NO: 1220366 - RNA, 23 nt, Human
aagagggagggagggcuccagac

SEQ ID NO: 1220367 - RNA, 12 nt, Human
aagaguaggaag

SEQ ID NO: 1220368 - RNA, 22 nt, Human
aagagggucugaggaauccaga

SEQ ID NO: 1220369 - RNA, 14 nt, Human
aagaguaggaagac

SEQ ID NO: 1220370 - RNA, 13 nt, Human
aagaguaggaaga

SEQ ID NO: 1220371 - RNA, 17 nt, Human
aagaugcuucucacugc

SEQ ID NO: 1220372 - RNA, 19 nt, Human
aagaugcuucucacugcca

SEQ ID NO: 1220373 - RNA, 16 nt, Human
gugugguagagugugc

SEQ ID NO: 1220374 - RNA, 22 nt, Human
gugugacaaggauugcuacugu

SEQ ID NO: 1220375 - RNA, 16 nt, Human
gugucagcauagaagu

SEQ ID NO: 1220376 - RNA, 20 nt, Human
gugucaagagggucugagga

SEQ ID NO: 1220377 - RNA, 23 nt, Human
guguauuuuuuuacuaauagaca

SEQ ID NO: 1220378 - RNA, 17 nt, Human
guguauuuuuuuacuaa

SEQ ID NO: 1220379 - RNA, 22 nt, Human
guggccucccaacucaccccag

SEQ ID NO: 1220380 - RNA, 21 nt, Human
guggccucccaacucacccca

SEQ ID NO: 1220381 - RNA, 15 nt, Human
gugggacacccugug

SEQ ID NO: 1220382 - RNA, 14 nt, Human
gugggagcugccug

SEQ ID NO: 1220383 - RNA, 13 nt, Human
gugggacacccug

SEQ ID NO: 1220384 - RNA, 22 nt, Human
guggcgcagcauauucaggaag

SEQ ID NO: 1220385 - RNA, 15 nt, Human
guggggucacucugg

SEQ ID NO: 1220386 - RNA, 18 nt, Human
gugggagcugccuguuca

SEQ ID NO: 1220387 - RNA, 15 nt, Human
gugggagcugccugu

SEQ ID NO: 1220388 - RNA, 22 nt, Human
gugggacacccugugauggggc

SEQ ID NO: 1220389 - RNA, 23 nt, Human
gugggaggaucucuugagccugg

SEQ ID NO: 1220390 - RNA, 16 nt, Human
aagacuuuggaaagac

SEQ ID NO: 1220391 - RNA, 23 nt, Human
aagacugaguacguugugcauuu

SEQ ID NO: 1220392 - RNA, 20 nt, Human
aagacgcugugcugcccugc

SEQ ID NO: 1220393 - RNA, 19 nt, Human
aagaccuucuccuucaccu

SEQ ID NO: 1220394 - RNA, 18 nt, Human
aagaccuucuccuucacc

SEQ ID NO: 1220395 - RNA, 15 nt, Human
aagaccuucuccuuc

SEQ ID NO: 1220396 - RNA, 11 nt, Human
gugccuuaugg

SEQ ID NO: 1220397 - RNA, 19 nt, Human
aagacgcugugcugcccug

SEQ ID NO: 1220398 - RNA, 18 nt, Human
aagacgcugugcugcccu

SEQ ID NO: 1220399 - RNA, 17 nt, Human
aagacgcugugcugccc

SEQ ID NO: 1220400 - RNA, 15 nt, Human
aagacgcugugcugc

SEQ ID NO: 1220401 - RNA, 13 nt, Human
aagacgcugugcu

SEQ ID NO: 1220402 - RNA, 22 nt, Human
guauuuuguuuuugucuuaaaa

SEQ ID NO: 1220403 - RNA, 18 nt, Human
gucaaaguggugagaggc

SEQ ID NO: 1220404 - RNA, 24 nt, Human
aaaugucuaguuguaacaccauga

SEQ ID NO: 1220405 - RNA, 19 nt, Human
aaaugucuaguuguaacac

SEQ ID NO: 1220406 - RNA, 21 nt, Human
guaucccaugagccucagcau

SEQ ID NO: 1220407 - RNA, 14 nt, Human
guaugguggcuggg

SEQ ID NO: 1220408 - RNA, 16 nt, Human
guaugguggcuggguu

SEQ ID NO: 1220409 - RNA, 15 nt, Human
guaugguggcugggu

SEQ ID NO: 1220410 - RNA, 19 nt, Human
guaucccaugagccucagc

SEQ ID NO: 1220411 - RNA, 22 nt, Human
guaucaggugcugccauccagg

SEQ ID NO: 1220412 - RNA, 18 nt, Human
guaucaggugcugccauc

SEQ ID NO: 1220413 - RNA, 16 nt, Human
guaucaggugcugcca

SEQ ID NO: 1220414 - RNA, 12 nt, Human
guaacaggcaga

SEQ ID NO: 1220415 - RNA, 22 nt, Human
guaacaggaaaauuuuaaaaau

SEQ ID NO: 1220416 - RNA, 18 nt, Human
aaauuuguuauaaugaau

SEQ ID NO: 1220417 - RNA, 22 nt, Human
gucacacaguauuacuucugcu

SEQ ID NO: 1220418 - RNA, 23 nt, Human
aaauuuugauguuuuaaggaugc

SEQ ID NO: 1220419 - RNA, 18 nt, Human
aaauuuugauguuuuaag

SEQ ID NO: 1220420 - RNA, 16 nt, Human
aacaaggcaaggcugu

SEQ ID NO: 1220421 - RNA, 23 nt, Human
aacaaggcaaggcugucaauuac

SEQ ID NO: 1220422 - RNA, 21 nt, Human
aacaaggcaaggcugucaauu

SEQ ID NO: 1220423 - RNA, 18 nt, Human
aacaaggcaaggcuguca

SEQ ID NO: 1220424 - RNA, 13 nt, Human
guccuacucugug

SEQ ID NO: 1220425 - RNA, 15 nt, Human
aacagaaauguacag

SEQ ID NO: 1220426 - RNA, 14 nt, Human
aacagaaauguaca

SEQ ID NO: 1220427 - RNA, 13 nt, Human
aacagaaauguac

SEQ ID NO: 1220428 - RNA, 12 nt, Human
aacagaaaugua

SEQ ID NO: 1220429 - RNA, 12 nt, Human
guccuacucugu

SEQ ID NO: 1220430 - RNA, 16 nt, Human
guccuacccacccucc

SEQ ID NO: 1220431 - RNA, 18 nt, Human
gucccccuuccauggacu

SEQ ID NO: 1220432 - RNA, 16 nt, Human
gucccccuuccaugga

SEQ ID NO: 1220433 - RNA, 14 nt, Human
gucccccuuccaug

SEQ ID NO: 1220434 - RNA, 16 nt, Human
gucccaccuuggcugc

SEQ ID NO: 1220435 - RNA, 15 nt, Human
gucccaccuuggcug

SEQ ID NO: 1220436 - RNA, 14 nt, Human
gucccaccuuggcu

SEQ ID NO: 1220437 - RNA, 21 nt, Human
gucccaccccacacacgccag

SEQ ID NO: 1220438 - RNA, 14 nt, Human
guccauagagagca

SEQ ID NO: 1220439 - RNA, 13 nt, Human
guccauagagagc

SEQ ID NO: 1220440 - RNA, 20 nt, Human
guccaagaagcccaggaaag

SEQ ID NO: 1220441 - RNA, 18 nt, Human
guccaagaagcccaggaa

SEQ ID NO: 1220442 - RNA, 17 nt, Human
guccaagaagcccagga

SEQ ID NO: 1220443 - RNA, 16 nt, Human
guccaagaagcccagg

SEQ ID NO: 1220444 - RNA, 15 nt, Human
guccaagaagcccag

SEQ ID NO: 1220445 - RNA, 13 nt, Human
guccaagaagccc

SEQ ID NO: 1220446 - RNA, 21 nt, Human
gucauuuuuuuuaagaaaaag

SEQ ID NO: 1220447 - RNA, 19 nt, Human
gucauuuuuuuuaagaaaa

SEQ ID NO: 1220448 - RNA, 14 nt, Human
gucuggcccuuccu

SEQ ID NO: 1220449 - RNA, 16 nt, Human
gucuuuuuucacuaca

SEQ ID NO: 1220450 - RNA, 23 nt, Human
gugaaccaccacacccagcccac

SEQ ID NO: 1220451 - RNA, 22 nt, Human
gugaaccaccacacccagccca

SEQ ID NO: 1220452 - RNA, 17 nt, Human
aacucuccucugcugcu

SEQ ID NO: 1220453 - RNA, 16 nt, Human
aacucuccucugcugc

SEQ ID NO: 1220454 - RNA, 18 nt, Human
aacucuccuccagaguca

SEQ ID NO: 1220455 - RNA, 15 nt, Human
aacucuccuccagag

SEQ ID NO: 1220456 - RNA, 12 nt, Human
aaccugugucuc

SEQ ID NO: 1220457 - RNA, 19 nt, Human
aaccaccacacccagccca

SEQ ID NO: 1220458 - RNA, 15 nt, Human
aaccaagucaaguga

SEQ ID NO: 1220459 - RNA, 21 nt, Human
aaccaccacacccagcccacu

SEQ ID NO: 1220460 - RNA, 12 nt, Human
aaccaucauuga

SEQ ID NO: 1220461 - RNA, 18 nt, Human
aaccaucauugaaaucuu

SEQ ID NO: 1220462 - RNA, 17 nt, Human
aaccaucauugaaaucu

SEQ ID NO: 1220463 - RNA, 23 nt, Human
aaccauuuugcugucccuuuucc

SEQ ID NO: 1220464 - RNA, 10 nt, Human
aacccagcuc

SEQ ID NO: 1220465 - RNA, 22 nt, Human
gugagucgaggacagggaggug

SEQ ID NO: 1220466 - RNA, 21 nt, Human
aacucuucaaucucuugcacu

SEQ ID NO: 1220467 - RNA, 22 nt, Human
gugaggccagagacacaagccu

SEQ ID NO: 1220468 - RNA, 17 nt, Human
gugaggccagagacaca

SEQ ID NO: 1220469 - RNA, 15 nt, Human
gugagcaauccugca

SEQ ID NO: 1220470 - RNA, 19 nt, Human
gugaacuugggccacugug

SEQ ID NO: 1220471 - RNA, 17 nt, Human
gugaacuugggccacug

SEQ ID NO: 1220472 - RNA, 21 nt, Human
aacuggguacuuguggacaca

SEQ ID NO: 1220473 - RNA, 16 nt, Human
aacuggguacuugugg

SEQ ID NO: 1220474 - RNA, 22 nt, Human
aacugggggagggugaagugaa

SEQ ID NO: 1220475 - RNA, 21 nt, Human
aacugggggagggugaaguga

SEQ ID NO: 1220476 - RNA, 11 nt, Human
aacuggcugca

SEQ ID NO: 1220477 - RNA, 16 nt, Human
aacuggauuaaacuua

SEQ ID NO: 1220478 - RNA, 15 nt, Human
aacuggauuaaacuu

SEQ ID NO: 1220479 - RNA, 23 nt, Human
aacugcugacuguuuucucuuga

SEQ ID NO: 1220480 - RNA, 21 nt, Human
aacugcugacuguuuucucuu

SEQ ID NO: 1220481 - RNA, 20 nt, Human
aacugcugacuguuuucucu

SEQ ID NO: 1220482 - RNA, 15 nt, Human
aacugcugacuguuu

SEQ ID NO: 1220483 - RNA, 19 nt, Human
gugauggggcccugccucc

SEQ ID NO: 1220484 - RNA, 21 nt, Human
gugcacacaccagagcccacc

SEQ ID NO: 1220485 - RNA, 23 nt, Human
gugcauuaucuagauacuguauc

SEQ ID NO: 1220486 - RNA, 19 nt, Human
gugcauuaucuagauacug

SEQ ID NO: 1220487 - RNA, 15 nt, Human
gugcauuaucuagau

SEQ ID NO: 1220488 - RNA, 19 nt, Human
gugcauguguguucaugca

SEQ ID NO: 1220489 - RNA, 18 nt, Human
gugauggggcccugccuc

SEQ ID NO: 1220490 - RNA, 17 nt, Human
gugauggggcccugccu

SEQ ID NO: 1220491 - RNA, 16 nt, Human
gugauggggcccugcc

SEQ ID NO: 1220492 - RNA, 14 nt, Human
gugauggggcccug

SEQ ID NO: 1220493 - RNA, 22 nt, Human
gugaugcgcaugucacggaggg

SEQ ID NO: 1220494 - RNA, 16 nt, Human
gugaugagaggaaauc

SEQ ID NO: 1220495 - RNA, 14 nt, Human
gugaugagaggaaa

SEQ ID NO: 1220496 - RNA, 13 nt, Human
aacuuccaauuua

SEQ ID NO: 1220497 - RNA, 16 nt, Human
accaucccugaaggcc

SEQ ID NO: 1220498 - RNA, 23 nt, Human
accaucauugaaaucuuuuugcu

SEQ ID NO: 1220499 - RNA, 15 nt, Human
accaucauugaaauc

SEQ ID NO: 1220500 - RNA, 15 nt, Human
accaucaagccacca

SEQ ID NO: 1220501 - RNA, 14 nt, Human
accaucaagccacc

SEQ ID NO: 1220502 - RNA, 13 nt, Human
acccaugcugccc

SEQ ID NO: 1220503 - RNA, 15 nt, Human
acccacccuccuuuc

SEQ ID NO: 1220504 - RNA, 17 nt, Human
acccacccccacccaag

SEQ ID NO: 1220505 - RNA, 15 nt, Human
acccacccccaccca

SEQ ID NO: 1220506 - RNA, 14 nt, Human
acauuuauucugcu

SEQ ID NO: 1220507 - RNA, 23 nt, Human
acaugucuuuucuugcaugaggc

SEQ ID NO: 1220508 - RNA, 20 nt, Human
acaugccucucucaggccaa

SEQ ID NO: 1220509 - RNA, 19 nt, Human
acaugccucucucaggcca

SEQ ID NO: 1220510 - RNA, 17 nt, Human
accagccccagugccca

SEQ ID NO: 1220511 - RNA, 16 nt, Human
accagccccagugccc

SEQ ID NO: 1220512 - RNA, 13 nt, Human
accagcagccugg

SEQ ID NO: 1220513 - RNA, 13 nt, Human
accagcagagcac

SEQ ID NO: 1220514 - RNA, 12 nt, Human
accagcagagca

SEQ ID NO: 1220515 - RNA, 20 nt, Human
accagccccagugcccacag

SEQ ID NO: 1220516 - RNA, 19 nt, Human
accagccccagugcccaca

SEQ ID NO: 1220517 - RNA, 18 nt, Human
accagccccagugcccac

SEQ ID NO: 1220518 - RNA, 23 nt, Human
acagugagucgaggacagggagg

SEQ ID NO: 1220519 - RNA, 14 nt, Human
acaggcaaugcugg

SEQ ID NO: 1220520 - RNA, 23 nt, Human
acaggugugagucaccaagccca

SEQ ID NO: 1220521 - RNA, 19 nt, Human
acaggugugaaccaccaca

SEQ ID NO: 1220522 - RNA, 22 nt, Human
acagugagucgaggacagggag

SEQ ID NO: 1220523 - RNA, 14 nt, Human
acagcucuguccug

SEQ ID NO: 1220524 - RNA, 23 nt, Human
acagcuccuucuguccuacucug

SEQ ID NO: 1220525 - RNA, 18 nt, Human
acagcuccuucuguccua

SEQ ID NO: 1220526 - RNA, 16 nt, Human
acagcuccuucugucc

SEQ ID NO: 1220527 - RNA, 21 nt, Human
acagaggggguggccucccaa

SEQ ID NO: 1220528 - RNA, 19 nt, Human
acagaggggguggccuccc

SEQ ID NO: 1220529 - RNA, 18 nt, Human
acagaggggguggccucc

SEQ ID NO: 1220530 - RNA, 17 nt, Human
acagaggggguggccuc

SEQ ID NO: 1220531 - RNA, 17 nt, Human
acagcucuguccuggga

SEQ ID NO: 1220532 - RNA, 16 nt, Human
acagcucuguccuggg

SEQ ID NO: 1220533 - RNA, 23 nt, Human
acaggcaagcaccuccugccucg

SEQ ID NO: 1220534 - RNA, 20 nt, Human
acaggcaagcaccuccugcc

SEQ ID NO: 1220535 - RNA, 13 nt, Human
acagcugccuggg

SEQ ID NO: 1220536 - RNA, 18 nt, Human
acaugccucucucaggcc

SEQ ID NO: 1220537 - RNA, 17 nt, Human
acaugccucucucaggc

SEQ ID NO: 1220538 - RNA, 16 nt, Human
acaugccucucucagg

SEQ ID NO: 1220539 - RNA, 15 nt, Human
acaugccucucucag

SEQ ID NO: 1220540 - RNA, 18 nt, Human
acaugcaaggucauuuuu

SEQ ID NO: 1220541 - RNA, 17 nt, Human
acaugcaaggucauuuu

SEQ ID NO: 1220542 - RNA, 16 nt, Human
acaugcaaggucauuu

SEQ ID NO: 1220543 - RNA, 16 nt, Human
acauaagauaaaugug

SEQ ID NO: 1220544 - RNA, 20 nt, Human
aauuuauuuaugggauccug

SEQ ID NO: 1220545 - RNA, 19 nt, Human
aaugucacaggcaggucca

SEQ ID NO: 1220546 - RNA, 16 nt, Human
aaugucacaggcaggu

SEQ ID NO: 1220547 - RNA, 16 nt, Human
aauuguaaggaaugau

SEQ ID NO: 1220548 - RNA, 12 nt, Human
aauuguaaggaa

SEQ ID NO: 1220549 - RNA, 22 nt, Human
acaaaaugaaacgcaaccacca

SEQ ID NO: 1220550 - RNA, 13 nt, Human
acaaaaugaaacg

SEQ ID NO: 1220551 - RNA, 16 nt, Human
aauuuugugcccccau

SEQ ID NO: 1220552 - RNA, 14 nt, Human
aauuuugauguuuu

SEQ ID NO: 1220553 - RNA, 13 nt, Human
acagaggcagccc

SEQ ID NO: 1220554 - RNA, 23 nt, Human
acagaggccaugggccuccugug

SEQ ID NO: 1220555 - RNA, 21 nt, Human
acagaggccaugggccuccug

SEQ ID NO: 1220556 - RNA, 17 nt, Human
acagaggccaugggccu

SEQ ID NO: 1220557 - RNA, 14 nt, Human
acagaggcagcccc

SEQ ID NO: 1220558 - RNA, 14 nt, Human
acagacaaagcgug

SEQ ID NO: 1220559 - RNA, 22 nt, Human
acacugugcugagucugaaggc

SEQ ID NO: 1220560 - RNA, 21 nt, Human
acaccacuacauucuguuaau

SEQ ID NO: 1220561 - RNA, 21 nt, Human
acacgaauauugcugauggug

SEQ ID NO: 1220562 - RNA, 15 nt, Human
acacgaauauugcug

SEQ ID NO: 1220563 - RNA, 14 nt, Human
acacgaauauugcu

SEQ ID NO: 1220564 - RNA, 20 nt, Human
acaccacuacauucuguuaa

SEQ ID NO: 1220565 - RNA, 17 nt, Human
acaccacuacauucugu

SEQ ID NO: 1220566 - RNA, 15 nt, Human
acaccacuacauucu

SEQ ID NO: 1220567 - RNA, 19 nt, Human
acacauuuuuuaaaugcac

SEQ ID NO: 1220568 - RNA, 18 nt, Human
acacauuuuuuaaaugca

SEQ ID NO: 1220569 - RNA, 16 nt, Human
acacauuuuuuaaaug

SEQ ID NO: 1220570 - RNA, 14 nt, Human
acacauuuuuuaaa

SEQ ID NO: 1220571 - RNA, 22 nt, Human
acacagcucuucuccaggcugu

SEQ ID NO: 1220572 - RNA, 21 nt, Human
acacagcucuucuccaggcug

SEQ ID NO: 1220573 - RNA, 20 nt, Human
acacagcucuucuccaggcu

SEQ ID NO: 1220574 - RNA, 19 nt, Human
acacaaaaguuucucuuuu

SEQ ID NO: 1220575 - RNA, 14 nt, Human
acaauuuauuaugg

SEQ ID NO: 1220576 - RNA, 13 nt, Human
acaauuuauuaug

SEQ ID NO: 1220577 - RNA, 16 nt, Human
acaaggauugcuacug

SEQ ID NO: 1220578 - RNA, 20 nt, Human
acaaggaugaucuaggaaga

SEQ ID NO: 1220579 - RNA, 16 nt, Human
acuauuguuagucucu

SEQ ID NO: 1220580 - RNA, 17 nt, Human
acuagggaagauaauau

SEQ ID NO: 1220581 - RNA, 11 nt, Human
accugugucuc

SEQ ID NO: 1220582 - RNA, 16 nt, Human
acggaagagccuugcg

SEQ ID NO: 1220583 - RNA, 15 nt, Human
acggaagagccuugc

SEQ ID NO: 1220584 - RNA, 15 nt, Human
acggaauaguuggcu

SEQ ID NO: 1220585 - RNA, 19 nt, Human
acgcuggagugcagugagc

SEQ ID NO: 1220586 - RNA, 12 nt, Human
acgucugugcca

SEQ ID NO: 1220587 - RNA, 23 nt, Human
acgucugacaggcaaugcuggcu

SEQ ID NO: 1220588 - RNA, 15 nt, Human
acuaauagacaauuu

SEQ ID NO: 1220589 - RNA, 11 nt, Human
acguggcugcu

SEQ ID NO: 1220590 - RNA, 21 nt, Human
accucuugagccuugaacuuu

SEQ ID NO: 1220591 - RNA, 20 nt, Human
accucuugagccuugaacuu

SEQ ID NO: 1220592 - RNA, 19 nt, Human
accucuugagccuugaacu

SEQ ID NO: 1220593 - RNA, 17 nt, Human
accucuugagccuugaa

SEQ ID NO: 1220594 - RNA, 18 nt, Human
accugccagggacagagg

SEQ ID NO: 1220595 - RNA, 16 nt, Human
accugccagggacaga

SEQ ID NO: 1220596 - RNA, 15 nt, Human
accugccagggacag

SEQ ID NO: 1220597 - RNA, 13 nt, Human
accugccagggac

SEQ ID NO: 1220598 - RNA, 12 nt, Human
accugccaggga

SEQ ID NO: 1220599 - RNA, 11 nt, Human
accugccaggg

SEQ ID NO: 1220600 - RNA, 14 nt, Human
accgugaggccaga

SEQ ID NO: 1220601 - RNA, 20 nt, Human
accgggccacagagaaagua

SEQ ID NO: 1220602 - RNA, 19 nt, Human
accgggccacagagaaagu

SEQ ID NO: 1220603 - RNA, 15 nt, Human
accgggccacagaga

SEQ ID NO: 1220604 - RNA, 19 nt, Human
accggcuggccuggccccu

SEQ ID NO: 1220605 - RNA, 18 nt, Human
accggcuggccuggcccc

SEQ ID NO: 1220606 - RNA, 17 nt, Human
accggcuggccuggccc

SEQ ID NO: 1220607 - RNA, 15 nt, Human
accggcuggccuggc

SEQ ID NO: 1220608 - RNA, 14 nt, Human
accggcuggccugg

SEQ ID NO: 1220609 - RNA, 22 nt, Human
acccugugauggggcccugccu

SEQ ID NO: 1220610 - RNA, 16 nt, Human
accccacacacgccag

SEQ ID NO: 1220611 - RNA, 16 nt, Human
acccaugcugcccugu

SEQ ID NO: 1220612 - RNA, 15 nt, Human
acccaugcugcccug

SEQ ID NO: 1220613 - RNA, 14 nt, Human
acccaugcugcccu

SEQ ID NO: 1220614 - RNA, 17 nt, Human
acccuguuaccauuuug

SEQ ID NO: 1220615 - RNA, 13 nt, Human
accucaggccugg

SEQ ID NO: 1220616 - RNA, 12 nt, Human
accucaggccug

SEQ ID NO: 1220617 - RNA, 17 nt, Human
accgugaggccagagac

SEQ ID NO: 1220618 - RNA, 16 nt, Human
accgugaggccagaga

SEQ ID NO: 1220619 - RNA, 22 nt, Human
accucaggccugggggcugggc

SEQ ID NO: 1220620 - RNA, 14 nt, Human
accucaggccuggg

SEQ ID NO: 1220621 - RNA, 18 nt, Human
accucaggugagaagcag

SEQ ID NO: 1220622 - RNA, 18 nt, Human
acuucuuauacauuugau

SEQ ID NO: 1220623 - RNA, 17 nt, Human
acuucuuauacauuuga

SEQ ID NO: 1220624 - RNA, 20 nt, Human
acuucugccauauucuguug

SEQ ID NO: 1220625 - RNA, 15 nt, Human
acuuaaauaauguga

SEQ ID NO: 1220626 - RNA, 14 nt, Human
acuuaaauaaugug

SEQ ID NO: 1220627 - RNA, 23 nt, Human
acugauuuuuuuuuccuucagug

SEQ ID NO: 1220628 - RNA, 22 nt, Human
acugauuuuuuuuuccuucagu

SEQ ID NO: 1220629 - RNA, 21 nt, Human
acugauuuuuuuuuccuucag

SEQ ID NO: 1220630 - RNA, 23 nt, Human
acugaugggcaacccccagccug

SEQ ID NO: 1220631 - RNA, 22 nt, Human
acugaugggcaacccccagccu

SEQ ID NO: 1220632 - RNA, 12 nt, Human
acugaugggcaa

SEQ ID NO: 1220633 - RNA, 22 nt, Human
acugauggcuaauguacugcau

SEQ ID NO: 1220634 - RNA, 13 nt, Human
acugaucucucgu

SEQ ID NO: 1220635 - RNA, 23 nt, Human
acugacauuguuggccaaagcca

SEQ ID NO: 1220636 - RNA, 21 nt, Human
acucugugucagguggggcag

SEQ ID NO: 1220637 - RNA, 19 nt, Human
acucugucucaaaaaaaca

SEQ ID NO: 1220638 - RNA, 20 nt, Human
acugcuuuuggucuguguga

SEQ ID NO: 1220639 - RNA, 16 nt, Human
acugcuuuuggucugu

SEQ ID NO: 1220640 - RNA, 15 nt, Human
acugcuuuuggucug

SEQ ID NO: 1220641 - RNA, 14 nt, Human
acugccaugccagc

SEQ ID NO: 1220642 - RNA, 22 nt, Human
acugcccggcaggguccuagaa

SEQ ID NO: 1220643 - RNA, 15 nt, Human
acugcccggcagggu

SEQ ID NO: 1220644 - RNA, 17 nt, Human
aagacuuuuccaacccu

SEQ ID NO: 1220645 - RNA, 16 nt, Human
aagacuuuggaaagag

SEQ ID NO: 1220646 - RNA, 20 nt, Human
aagauucauauuuacuucuu

SEQ ID NO: 1220647 - RNA, 19 nt, Human
aagccaccaacauacuccc

SEQ ID NO: 1220648 - RNA, 19 nt, Human
aagauuuugaaauuuuuau

SEQ ID NO: 1220649 - RNA, 20 nt, Human
aagggacuuggaagcuccgc

SEQ ID NO: 1220650 - RNA, 17 nt, Human
aagcgauucuucugcuu

SEQ ID NO: 1220651 - RNA, 16 nt, Human
aagcgauucuucugcu

SEQ ID NO: 1220652 - RNA, 15 nt, Human
aagcgauucuucugc

SEQ ID NO: 1220653 - RNA, 21 nt, Human
aagccaccaacauacucccau

SEQ ID NO: 1220654 - RNA, 15 nt, Human
aagccagcaggcucu

SEQ ID NO: 1220655 - RNA, 18 nt, Human
aagccagcaggcucucag

SEQ ID NO: 1220656 - RNA, 19 nt, Human
aagccagcaggcucucagg

SEQ ID NO: 1220657 - RNA, 23 nt, Human
aaggaaugauuaauuaaaacaca

SEQ ID NO: 1220658 - RNA, 16 nt, Human
aagcugcugacagugu

SEQ ID NO: 1220659 - RNA, 22 nt, Human
aagcugccagccgagauagcca

SEQ ID NO: 1220660 - RNA, 14 nt, Human
aagcugcugacagu

SEQ ID NO: 1220661 - RNA, 12 nt, Human
aagcugccagcc

SEQ ID NO: 1220662 - RNA, 11 nt, Human
aagcugccagc

SEQ ID NO: 1220663 - RNA, 20 nt, Human
aagcgugagccacugcaccg

SEQ ID NO: 1220664 - RNA, 17 nt, Human
aagcgugagccacugca

SEQ ID NO: 1220665 - RNA, 21 nt, Human
aagcgugagccacugcaccgg

SEQ ID NO: 1220666 - RNA, 13 nt, Human
aaggacacuagaa

SEQ ID NO: 1220667 - RNA, 14 nt, Human
aagugcugcauuua

SEQ ID NO: 1220668 - RNA, 13 nt, Human
aagugcugcauuu

SEQ ID NO: 1220669 - RNA, 16 nt, Human
aauauaggaacuuaaa

SEQ ID NO: 1220670 - RNA, 17 nt, Human
aauccagacccggcugc

SEQ ID NO: 1220671 - RNA, 13 nt, Human
aaugauuaauuaa

SEQ ID NO: 1220672 - RNA, 12 nt, Human
aaugauuaauua

SEQ ID NO: 1220673 - RNA, 16 nt, Human
aaugauuaauuaaaac

SEQ ID NO: 1220674 - RNA, 15 nt, Human
aaugauagcuacugu

SEQ ID NO: 1220675 - RNA, 13 nt, Human
aaugggcagagca

SEQ ID NO: 1220676 - RNA, 17 nt, Human
aaugggggugcauuuga

SEQ ID NO: 1220677 - RNA, 15 nt, Human
aaugggggugcauuu

SEQ ID NO: 1220678 - RNA, 14 nt, Human
aaugggagcucaug

SEQ ID NO: 1220679 - RNA, 13 nt, Human
aaugggacacuaa

SEQ ID NO: 1220680 - RNA, 23 nt, Human
aaugcucuuuacuucauggacuu

SEQ ID NO: 1220681 - RNA, 23 nt, Human
aaugcgugcauaccacuuuuguu

SEQ ID NO: 1220682 - RNA, 21 nt, Human
aaugcgugcauaccacuuuug

SEQ ID NO: 1220683 - RNA, 11 nt, Human
aaauaaauuau

SEQ ID NO: 1220684 - RNA, 22 nt, Human
aaaggcuccaggagcagccaca

SEQ ID NO: 1220685 - RNA, 21 nt, Human
aaaggcuccaggagcagccac

SEQ ID NO: 1220686 - RNA, 15 nt, Human
aaaggcuccaggagc

SEQ ID NO: 1220687 - RNA, 14 nt, Human
aaaggcuccaggag

SEQ ID NO: 1220688 - RNA, 17 nt, Human
aaaggcuaccuuuguau

SEQ ID NO: 1220689 - RNA, 15 nt, Human
aaagccaaagcuagg

SEQ ID NO: 1220690 - RNA, 15 nt, Human
aaagauacaguuacu

SEQ ID NO: 1220691 - RNA, 11 nt, Human
aaagagguuuu

SEQ ID NO: 1220692 - RNA, 22 nt, Human
aaacugauuuuuuuuuccuuca

SEQ ID NO: 1220693 - RNA, 20 nt, Human
aaacugauuuuuuuuuccuu

SEQ ID NO: 1220694 - RNA, 19 nt, Human
aaacugauuuuuuuuuccu

SEQ ID NO: 1220695 - RNA, 13 nt, Human
aaacugauuuuuu

SEQ ID NO: 1220696 - RNA, 17 nt, Human
aaacucuugaccucagg

SEQ ID NO: 1220697 - RNA, 14 nt, Human
aaacccuucagugc

SEQ ID NO: 1220698 - RNA, 17 nt, Human
aaaccccaucucuacaa

SEQ ID NO: 1220699 - RNA, 17 nt, Human
aaacagcuaaugggaca

SEQ ID NO: 1220700 - RNA, 15 nt, Human
aaaauuagccaagug

SEQ ID NO: 1220701 - RNA, 22 nt, Human
aaaaucccuuaccucggugccu

SEQ ID NO: 1220702 - RNA, 16 nt, Human
aacagcuaaugggaca

SEQ ID NO: 1220703 - RNA, 15 nt, Human
aacauggaaguacua

SEQ ID NO: 1220704 - RNA, 19 nt, Human
aaccaguguuguggauuua

SEQ ID NO: 1220705 - RNA, 13 nt, Human
aacccuucagugc

SEQ ID NO: 1220706 - RNA, 18 nt, Human
aacucaccccagccccaa

SEQ ID NO: 1220707 - RNA, 17 nt, Human
aacucaccccagcccca

SEQ ID NO: 1220708 - RNA, 16 nt, Human
aacucaccccagcccc

SEQ ID NO: 1220709 - RNA, 17 nt, Human
aacucaaacucuuaaaa

SEQ ID NO: 1220710 - RNA, 13 nt, Human
aacgucugugcca

SEQ ID NO: 1220711 - RNA, 19 nt, Human
aaauuaacuuuuauaaacu

SEQ ID NO: 1220712 - RNA, 14 nt, Human
aaauuaacuuuuau

SEQ ID NO: 1220713 - RNA, 13 nt, Human
aaauuaacuuuua

SEQ ID NO: 1220714 - RNA, 12 nt, Human
aaauuaacuuuu

SEQ ID NO: 1220715 - RNA, 19 nt, Human
aacaccucugcacaagcug

SEQ ID NO: 1220716 - RNA, 22 nt, Human
aacaaaccuguuucugcagcca

SEQ ID NO: 1220717 - RNA, 21 nt, Human
aacacauacaggaagguagaa

SEQ ID NO: 1220718 - RNA, 18 nt, Human
aaaucugcuuuuuaaaga

SEQ ID NO: 1220719 - RNA, 22 nt, Human
aaaucuccaaaauaaaacuuuu

SEQ ID NO: 1220720 - RNA, 17 nt, Human
aaauggacguguuauga

SEQ ID NO: 1220721 - RNA, 15 nt, Human
aaauggacguguuau

SEQ ID NO: 1220722 - RNA, 14 nt, Human
aaauggacguguua

SEQ ID NO: 1220723 - RNA, 16 nt, Human
agagggccugcaaggg

SEQ ID NO: 1220724 - RNA, 13 nt, Human
agagggccugcaa

SEQ ID NO: 1220725 - RNA, 19 nt, Human
agaggggguggccucccaa

SEQ ID NO: 1220726 - RNA, 17 nt, Human
agaggggguggccuccc

SEQ ID NO: 1220727 - RNA, 22 nt, Human
agaggacuuuucuuuguggcuu

SEQ ID NO: 1220728 - RNA, 21 nt, Human
agaggacuuuucuuuguggcu

SEQ ID NO: 1220729 - RNA, 23 nt, Human
agaggacuuuucuuuguggcuuc

SEQ ID NO: 1220730 - RNA, 13 nt, Human
agagcccaccuug

SEQ ID NO: 1220731 - RNA, 16 nt, Human
agacuggaagcacagc

SEQ ID NO: 1220732 - RNA, 16 nt, Human
agagagaccacuuuuc

SEQ ID NO: 1220733 - RNA, 18 nt, Human
agacucugucucaaaaaa

SEQ ID NO: 1220734 - RNA, 23 nt, Human
agacugaguacguugugcauuug

SEQ ID NO: 1220735 - RNA, 22 nt, Human
agacugaguacguugugcauuu

SEQ ID NO: 1220736 - RNA, 20 nt, Human
agacugaguacguugugcau

SEQ ID NO: 1220737 - RNA, 16 nt, Human
agacgcugugcugccc

SEQ ID NO: 1220738 - RNA, 14 nt, Human
agaaguaacuuacu

SEQ ID NO: 1220739 - RNA, 21 nt, Human
agaagagauugugguuucauu

SEQ ID NO: 1220740 - RNA, 21 nt, Human
agaagacacugaugggcaacc

SEQ ID NO: 1220741 - RNA, 13 nt, Human
agaagacacugau

SEQ ID NO: 1220742 - RNA, 21 nt, Human
acuuuccucuuuggucuacac

SEQ ID NO: 1220743 - RNA, 18 nt, Human
agaaugaaagggcccaga

SEQ ID NO: 1220744 - RNA, 22 nt, Human
agaaugcacaaacagaggccgc

SEQ ID NO: 1220745 - RNA, 19 nt, Human
agaaugcacaaacagaggc

SEQ ID NO: 1220746 - RNA, 23 nt, Human
agacagagucucacuguugccca

SEQ ID NO: 1220747 - RNA, 21 nt, Human
agacagagucucacuguugcc

SEQ ID NO: 1220748 - RNA, 20 nt, Human
agacagagucucacuguugc

SEQ ID NO: 1220749 - RNA, 19 nt, Human
agacagagucucacuguug

SEQ ID NO: 1220750 - RNA, 11 nt, Human
agacagagucu

SEQ ID NO: 1220751 - RNA, 15 nt, Human
agacagagcuacaca

SEQ ID NO: 1220752 - RNA, 23 nt, Human
agacaaugacuuacuguacauga

SEQ ID NO: 1220753 - RNA, 22 nt, Human
agacaaugacuuacuguacaug

SEQ ID NO: 1220754 - RNA, 21 nt, Human
agacaaugacuuacuguacau

SEQ ID NO: 1220755 - RNA, 20 nt, Human
agacaaugacuuacuguaca

SEQ ID NO: 1220756 - RNA, 14 nt, Human
agaugagugagcau

SEQ ID NO: 1220757 - RNA, 23 nt, Human
agaggggguggccucccaacuca

SEQ ID NO: 1220758 - RNA, 18 nt, Human
agcaaaagaugcuucuca

SEQ ID NO: 1220759 - RNA, 23 nt, Human
agauugcaacaggcugggcuuca

SEQ ID NO: 1220760 - RNA, 21 nt, Human
agauugcaacaggcugggcuu

SEQ ID NO: 1220761 - RNA, 20 nt, Human
agauugcaacaggcugggcu

SEQ ID NO: 1220762 - RNA, 21 nt, Human
agauucuuuccugaggcuggg

SEQ ID NO: 1220763 - RNA, 19 nt, Human
agauucuuuccugaggcug

SEQ ID NO: 1220764 - RNA, 20 nt, Human
agcaaaggagauuggaagga

SEQ ID NO: 1220765 - RNA, 15 nt, Human
agcacagacccugcc

SEQ ID NO: 1220766 - RNA, 14 nt, Human
agcacagacccugc

SEQ ID NO: 1220767 - RNA, 21 nt, Human
agcacgauuucuguuuagaua

SEQ ID NO: 1220768 - RNA, 19 nt, Human
agcacgauuucuguuuaga

SEQ ID NO: 1220769 - RNA, 16 nt, Human
agcacagacccugccc

SEQ ID NO: 1220770 - RNA, 17 nt, Human
agcacagacccugcccu

SEQ ID NO: 1220771 - RNA, 14 nt, Human
agccagcaggcucu

SEQ ID NO: 1220772 - RNA, 18 nt, Human
agccagaggagagaggac

SEQ ID NO: 1220773 - RNA, 17 nt, Human
agccagaggagagagga

SEQ ID NO: 1220774 - RNA, 15 nt, Human
agccagaggagagag

SEQ ID NO: 1220775 - RNA, 13 nt, Human
agccagaggagag

SEQ ID NO: 1220776 - RNA, 20 nt, Human
agccaaggccaaaggaagca

SEQ ID NO: 1220777 - RNA, 18 nt, Human
agccaaagcuaggccugg

SEQ ID NO: 1220778 - RNA, 16 nt, Human
agccaaagcuaggccu

SEQ ID NO: 1220779 - RNA, 18 nt, Human
agcauccuggcacccggc

SEQ ID NO: 1220780 - RNA, 17 nt, Human
agcauccuggcacccgg

SEQ ID NO: 1220781 - RNA, 14 nt, Human
agcauccuggcacc

SEQ ID NO: 1220782 - RNA, 16 nt, Human
agcccaccuuggcuca

SEQ ID NO: 1220783 - RNA, 15 nt, Human
agcccaccccucaac

SEQ ID NO: 1220784 - RNA, 17 nt, Human
agccagcaggcucucag

SEQ ID NO: 1220785 - RNA, 16 nt, Human
agccagcaggcucuca

SEQ ID NO: 1220786 - RNA, 23 nt, Human
agcccacgcccccacuggugaca

SEQ ID NO: 1220787 - RNA, 15 nt, Human
agcccacgcccccac

SEQ ID NO: 1220788 - RNA, 14 nt, Human
agcccacgccccca

SEQ ID NO: 1220789 - RNA, 13 nt, Human
agcauccuggcac

SEQ ID NO: 1220790 - RNA, 19 nt, Human
agccccauucugccugccc

SEQ ID NO: 1220791 - RNA, 18 nt, Human
agccccauucugccugcc

SEQ ID NO: 1220792 - RNA, 17 nt, Human
agccccauucugccugc

SEQ ID NO: 1220793 - RNA, 23 nt, Human
agccccauccucuguacagagcc

SEQ ID NO: 1220794 - RNA, 17 nt, Human
agccccauccucuguac

SEQ ID NO: 1220795 - RNA, 15 nt, Human
agccccauccucugu

SEQ ID NO: 1220796 - RNA, 21 nt, Human
agcccgggcucugccucccau

SEQ ID NO: 1220797 - RNA, 20 nt, Human
agcccgggcucugccuccca

SEQ ID NO: 1220798 - RNA, 18 nt, Human
agcccgggcucugccucc

SEQ ID NO: 1220799 - RNA, 17 nt, Human
agcccgggcucugccuc

SEQ ID NO: 1220800 - RNA, 20 nt, Human
agccccauucugccugccca

SEQ ID NO: 1220801 - RNA, 21 nt, Human
aggaacuuaaauaaugugaaa

SEQ ID NO: 1220802 - RNA, 23 nt, Human
aggaacaaggcaaggcugucaau

SEQ ID NO: 1220803 - RNA, 20 nt, Human
aggaacaaggcaaggcuguc

SEQ ID NO: 1220804 - RNA, 19 nt, Human
aggaacaaggcaaggcugu

SEQ ID NO: 1220805 - RNA, 17 nt, Human
aggaacaaggcaaggcu

SEQ ID NO: 1220806 - RNA, 16 nt, Human
aggaacaaggcaaggc

SEQ ID NO: 1220807 - RNA, 13 nt, Human
aggaacaaggcaa

SEQ ID NO: 1220808 - RNA, 12 nt, Human
aggaacaaggca

SEQ ID NO: 1220809 - RNA, 22 nt, Human
aggaauaccugucccccugaca

SEQ ID NO: 1220810 - RNA, 18 nt, Human
aggaauaccugucccccu

SEQ ID NO: 1220811 - RNA, 15 nt, Human
aggaauaccuguccc

SEQ ID NO: 1220812 - RNA, 23 nt, Human
aggaacuuaaauaaugugaaacu

SEQ ID NO: 1220813 - RNA, 18 nt, Human
agcuucauuuccuguguc

SEQ ID NO: 1220814 - RNA, 19 nt, Human
agcuucauuuccugugucu

SEQ ID NO: 1220815 - RNA, 23 nt, Human
agcuuuguuuguugucagcugaa

SEQ ID NO: 1220816 - RNA, 16 nt, Human
agcucaccagccccag

SEQ ID NO: 1220817 - RNA, 18 nt, Human
agcucagagaggguggga

SEQ ID NO: 1220818 - RNA, 14 nt, Human
agcucagagagggu

SEQ ID NO: 1220819 - RNA, 12 nt, Human
agcucagagagg

SEQ ID NO: 1220820 - RNA, 19 nt, Human
agcucaccucucccuugga

SEQ ID NO: 1220821 - RNA, 18 nt, Human
agcucaccucucccuugg

SEQ ID NO: 1220822 - RNA, 15 nt, Human
agcucaccucucccu

SEQ ID NO: 1220823 - RNA, 12 nt, Human
agcucaccucuc

SEQ ID NO: 1220824 - RNA, 20 nt, Human
agcucaccagccccagugcc

SEQ ID NO: 1220825 - RNA, 19 nt, Human
agcucaccagccccagugc

SEQ ID NO: 1220826 - RNA, 20 nt, Human
agccugggaggucaaggcug

SEQ ID NO: 1220827 - RNA, 12 nt, Human
agccugggaggu

SEQ ID NO: 1220828 - RNA, 19 nt, Human
agcgagcccugguggcagu

SEQ ID NO: 1220829 - RNA, 13 nt, Human
agcgagcccuggu

SEQ ID NO: 1220830 - RNA, 15 nt, Human
agcugaaccugggua

SEQ ID NO: 1220831 - RNA, 22 nt, Human
agcugguuuuuagcggagacgg

SEQ ID NO: 1220832 - RNA, 19 nt, Human
agcuggucccacucagucc

SEQ ID NO: 1220833 - RNA, 18 nt, Human
agcuggucccacucaguc

SEQ ID NO: 1220834 - RNA, 17 nt, Human
agcuggucccacucagu

SEQ ID NO: 1220835 - RNA, 14 nt, Human
agcugcugacagug

SEQ ID NO: 1220836 - RNA, 13 nt, Human
agcugcugacagu

SEQ ID NO: 1220837 - RNA, 12 nt, Human
agcugcugacag

SEQ ID NO: 1220838 - RNA, 21 nt, Human
agcugcgguccacccaggagc

SEQ ID NO: 1220839 - RNA, 20 nt, Human
agcugcgguccacccaggag

SEQ ID NO: 1220840 - RNA, 19 nt, Human
agcugcgguccacccagga

SEQ ID NO: 1220841 - RNA, 18 nt, Human
agcugcgguccacccagg

SEQ ID NO: 1220842 - RNA, 17 nt, Human
agcugcgguccacccag

SEQ ID NO: 1220843 - RNA, 16 nt, Human
agcugcgguccaccca

SEQ ID NO: 1220844 - RNA, 13 nt, Human
agcugcgguccac

SEQ ID NO: 1220845 - RNA, 14 nt, Human
agggccuggccuga

SEQ ID NO: 1220846 - RNA, 22 nt, Human
aggggcccaaauucuuucagug

SEQ ID NO: 1220847 - RNA, 22 nt, Human
agggucccugguggcagcucac

SEQ ID NO: 1220848 - RNA, 20 nt, Human
agggucccugguggcagcuc

SEQ ID NO: 1220849 - RNA, 17 nt, Human
agggucccugguggcag

SEQ ID NO: 1220850 - RNA, 16 nt, Human
agggucccugguggca

SEQ ID NO: 1220851 - RNA, 14 nt, Human
agggucccuggugg

SEQ ID NO: 1220852 - RNA, 12 nt, Human
agggucccuggu

SEQ ID NO: 1220853 - RNA, 13 nt, Human
aggguauuccaga

SEQ ID NO: 1220854 - RNA, 21 nt, Human
aggguaucuggugacuuuccu

SEQ ID NO: 1220855 - RNA, 13 nt, Human
agggccuggccug

SEQ ID NO: 1220856 - RNA, 12 nt, Human
agggccuggccu

SEQ ID NO: 1220857 - RNA, 15 nt, Human
agggccugcaaggga

SEQ ID NO: 1220858 - RNA, 14 nt, Human
agggccugcaaggg

SEQ ID NO: 1220859 - RNA, 20 nt, Human
agggucucacuauguugccc

SEQ ID NO: 1220860 - RNA, 23 nt, Human
aggguuuugccauguuggccagg

SEQ ID NO: 1220861 - RNA, 22 nt, Human
aggguuuugccauguuggccag

SEQ ID NO: 1220862 - RNA, 16 nt, Human
agguaacaggcagaua

SEQ ID NO: 1220863 - RNA, 14 nt, Human
agguaacaggcaga

SEQ ID NO: 1220864 - RNA, 13 nt, Human
agguaacaggcag

SEQ ID NO: 1220865 - RNA, 14 nt, Human
agguacucuccugg

SEQ ID NO: 1220866 - RNA, 13 nt, Human
agguacucuccug

SEQ ID NO: 1220867 - RNA, 21 nt, Human
aggcuuagucacugagacagc

SEQ ID NO: 1220868 - RNA, 18 nt, Human
aggcuuagucacugagac

SEQ ID NO: 1220869 - RNA, 15 nt, Human
agggacccuccacca

SEQ ID NO: 1220870 - RNA, 17 nt, Human
aggcuuagucacugaga

SEQ ID NO: 1220871 - RNA, 23 nt, Human
aggcuguaucccaugagccucag

SEQ ID NO: 1220872 - RNA, 22 nt, Human
aggcuguaucccaugagccuca

SEQ ID NO: 1220873 - RNA, 21 nt, Human
aggcuguaucccaugagccuc

SEQ ID NO: 1220874 - RNA, 20 nt, Human
aggcuguaucccaugagccu

SEQ ID NO: 1220875 - RNA, 15 nt, Human
aggcuaccuuuguau

SEQ ID NO: 1220876 - RNA, 14 nt, Human
aggcuaccuuugua

SEQ ID NO: 1220877 - RNA, 13 nt, Human
aggcuaccuuugu

SEQ ID NO: 1220878 - RNA, 18 nt, Human
aggcuggguucugauccu

SEQ ID NO: 1220879 - RNA, 18 nt, Human
aggcauuccccaggaggc

SEQ ID NO: 1220880 - RNA, 19 nt, Human
aggcauguucucugaggac

SEQ ID NO: 1220881 - RNA, 18 nt, Human
aggcauguucucugagga

SEQ ID NO: 1220882 - RNA, 17 nt, Human
aggcauguucucugagg

SEQ ID NO: 1220883 - RNA, 21 nt, Human
aggcaugugaugagaggaaau

SEQ ID NO: 1220884 - RNA, 20 nt, Human
aggcaugugaugagaggaaa

SEQ ID NO: 1220885 - RNA, 19 nt, Human
aggcaugugaugagaggaa

SEQ ID NO: 1220886 - RNA, 17 nt, Human
aggcaugugaugagagg

SEQ ID NO: 1220887 - RNA, 15 nt, Human
aggcaugguggccca

SEQ ID NO: 1220888 - RNA, 14 nt, Human
aggagaggggcaca

SEQ ID NO: 1220889 - RNA, 16 nt, Human
aggccaggcccucugc

SEQ ID NO: 1220890 - RNA, 15 nt, Human
aggccaggcccucug

SEQ ID NO: 1220891 - RNA, 14 nt, Human
aggccaggcccucu

SEQ ID NO: 1220892 - RNA, 13 nt, Human
aggccaggcccuc

SEQ ID NO: 1220893 - RNA, 20 nt, Human
aggcauuccccaggaggcca

SEQ ID NO: 1220894 - RNA, 19 nt, Human
aggcauuccccaggaggcc

SEQ ID NO: 1220895 - RNA, 23 nt, Human
aggcccucugcccacucccugca

SEQ ID NO: 1220896 - RNA, 22 nt, Human
aggcccucugcccacucccugc

SEQ ID NO: 1220897 - RNA, 19 nt, Human
aggcccuucucuccagccc

SEQ ID NO: 1220898 - RNA, 15 nt, Human
aggcccuucucucca

SEQ ID NO: 1220899 - RNA, 12 nt, Human
aggcccuucucu

SEQ ID NO: 1220900 - RNA, 18 nt, Human
augcacaaacagaggccg

SEQ ID NO: 1220901 - RNA, 18 nt, Human
augaugaaaugaggucag

SEQ ID NO: 1220902 - RNA, 23 nt, Human
augaugaaaugaggucagagccu

SEQ ID NO: 1220903 - RNA, 15 nt, Human
augaugauccuaggc

SEQ ID NO: 1220904 - RNA, 21 nt, Human
augaucuuugcagacaggcaa

SEQ ID NO: 1220905 - RNA, 19 nt, Human
augaucuuugcagacaggc

SEQ ID NO: 1220906 - RNA, 18 nt, Human
augaucuuugcagacagg

SEQ ID NO: 1220907 - RNA, 17 nt, Human
augaucuuugcagacag

SEQ ID NO: 1220908 - RNA, 20 nt, Human
augccuggauggggcugcac

SEQ ID NO: 1220909 - RNA, 19 nt, Human
augccuggauggggcugca

SEQ ID NO: 1220910 - RNA, 23 nt, Human
augcacagaguuguuacauuuuu

SEQ ID NO: 1220911 - RNA, 22 nt, Human
augcacagaguuguuacauuuu

SEQ ID NO: 1220912 - RNA, 21 nt, Human
augcacagaguuguuacauuu

SEQ ID NO: 1220913 - RNA, 19 nt, Human
augcacagaguuguuacau

SEQ ID NO: 1220914 - RNA, 15 nt, Human
augcacacauuuuuu

SEQ ID NO: 1220915 - RNA, 14 nt, Human
augcacacauuuuu

SEQ ID NO: 1220916 - RNA, 13 nt, Human
augcacacauuuu

SEQ ID NO: 1220917 - RNA, 17 nt, Human
auggcuuuugugcauua

SEQ ID NO: 1220918 - RNA, 16 nt, Human
auggcuuuugugcauu

SEQ ID NO: 1220919 - RNA, 18 nt, Human
auggcuuuugugcauuau

SEQ ID NO: 1220920 - RNA, 16 nt, Human
augcuuguacauaaug

SEQ ID NO: 1220921 - RNA, 15 nt, Human
augcugcccugugag

SEQ ID NO: 1220922 - RNA, 14 nt, Human
augcugcccuguga

SEQ ID NO: 1220923 - RNA, 13 nt, Human
augcugcccugug

SEQ ID NO: 1220924 - RNA, 16 nt, Human
augcugcccugugagu

SEQ ID NO: 1220925 - RNA, 14 nt, Human
auguguaaguauuc

SEQ ID NO: 1220926 - RNA, 13 nt, Human
auguguaaguauu

SEQ ID NO: 1220927 - RNA, 17 nt, Human
auguuugccucugccuc

SEQ ID NO: 1220928 - RNA, 15 nt, Human
auguuugccucugcc

SEQ ID NO: 1220929 - RNA, 14 nt, Human
auguucuuaauucu

SEQ ID NO: 1220930 - RNA, 15 nt, Human
auguucugggacaca

SEQ ID NO: 1220931 - RNA, 14 nt, Human
auguucugggacac

SEQ ID NO: 1220932 - RNA, 17 nt, Human
auguucucugaggacac

SEQ ID NO: 1220933 - RNA, 13 nt, Human
auguucucugagg

SEQ ID NO: 1220934 - RNA, 17 nt, Human
auguucucucuucucca

SEQ ID NO: 1220935 - RNA, 19 nt, Human
augucacaggcagguccag

SEQ ID NO: 1220936 - RNA, 14 nt, Human
augucacaggcagg

SEQ ID NO: 1220937 - RNA, 13 nt, Human
augucacaggcag

SEQ ID NO: 1220938 - RNA, 23 nt, Human
augggugcuuggaggaaggaaac

SEQ ID NO: 1220939 - RNA, 21 nt, Human
augggugcuuggaggaaggaa

SEQ ID NO: 1220940 - RNA, 19 nt, Human
aucccaugagccucagcau

SEQ ID NO: 1220941 - RNA, 19 nt, Human
auccagacccggcugcgug

SEQ ID NO: 1220942 - RNA, 17 nt, Human
auccucauacccacccc

SEQ ID NO: 1220943 - RNA, 15 nt, Human
aucccuacuguaauu

SEQ ID NO: 1220944 - RNA, 23 nt, Human
aucaaagagguuuuaaaaaaauc

SEQ ID NO: 1220945 - RNA, 20 nt, Human
aucaaagagguuuuaaaaaa

SEQ ID NO: 1220946 - RNA, 23 nt, Human
aucacccgcuaagagggagggag

SEQ ID NO: 1220947 - RNA, 13 nt, Human
aucaccagacagg

SEQ ID NO: 1220948 - RNA, 13 nt, Human
aucacagccucug

SEQ ID NO: 1220949 - RNA, 14 nt, Human
aucaugucuggcua

SEQ ID NO: 1220950 - RNA, 17 nt, Human
aucuggguucacugcaa

SEQ ID NO: 1220951 - RNA, 22 nt, Human
augaggcauuuguuugaacuga

SEQ ID NO: 1220952 - RNA, 21 nt, Human
augaggcauuuguuugaacug

SEQ ID NO: 1220953 - RNA, 14 nt, Human
augaggcauuuguu

SEQ ID NO: 1220954 - RNA, 13 nt, Human
augaggcauuugu

SEQ ID NO: 1220955 - RNA, 16 nt, Human
augaaaacacauuuuu

SEQ ID NO: 1220956 - RNA, 15 nt, Human
augaaaacacauuuu

SEQ ID NO: 1220957 - RNA, 14 nt, Human
augaaaacacauuu

SEQ ID NO: 1220958 - RNA, 20 nt, Human
aguccuuaccagcagagcac

SEQ ID NO: 1220959 - RNA, 22 nt, Human
aguccucuuuucugagaggacu

SEQ ID NO: 1220960 - RNA, 19 nt, Human
aguccucuuuucugagagg

SEQ ID NO: 1220961 - RNA, 23 nt, Human
aguaugaggcauuuguuugaacu

SEQ ID NO: 1220962 - RNA, 21 nt, Human
aguaugaggcauuuguuugaa

SEQ ID NO: 1220963 - RNA, 20 nt, Human
aguaugaggcauuuguuuga

SEQ ID NO: 1220964 - RNA, 15 nt, Human
aguaucucagggccu

SEQ ID NO: 1220965 - RNA, 23 nt, Human
agucacacaguauuacuucugcu

SEQ ID NO: 1220966 - RNA, 22 nt, Human
agucacacaguauuacuucugc

SEQ ID NO: 1220967 - RNA, 12 nt, Human
aguacuucuuuu

SEQ ID NO: 1220968 - RNA, 19 nt, Human
aguacuucuccacccugcu

SEQ ID NO: 1220969 - RNA, 17 nt, Human
aguacuucuccacccug

SEQ ID NO: 1220970 - RNA, 14 nt, Human
aguacuauguauca

SEQ ID NO: 1220971 - RNA, 12 nt, Human
aguacuauguau

SEQ ID NO: 1220972 - RNA, 20 nt, Human
aguaagccgugauuuucauu

SEQ ID NO: 1220973 - RNA, 14 nt, Human
aguacuauaauuua

SEQ ID NO: 1220974 - RNA, 22 nt, Human
aguacuacaguccucccaucuc

SEQ ID NO: 1220975 - RNA, 19 nt, Human
aguacuacaguccucccau

SEQ ID NO: 1220976 - RNA, 18 nt, Human
aguacguugugcauuugg

SEQ ID NO: 1220977 - RNA, 17 nt, Human
aguacguugugcauuug

SEQ ID NO: 1220978 - RNA, 16 nt, Human
aguacguugugcauuu

SEQ ID NO: 1220979 - RNA, 15 nt, Human
aguacguugugcauu

SEQ ID NO: 1220980 - RNA, 18 nt, Human
aguaaaugggggugcauu

SEQ ID NO: 1220981 - RNA, 18 nt, Human
aggucuguucuuuccaaa

SEQ ID NO: 1220982 - RNA, 16 nt, Human
aggucuguucuuucca

SEQ ID NO: 1220983 - RNA, 15 nt, Human
aggucuguucuuucc

SEQ ID NO: 1220984 - RNA, 13 nt, Human
aggucuguucuuu

SEQ ID NO: 1220985 - RNA, 22 nt, Human
agugggcccaaugcacuuuguu

SEQ ID NO: 1220986 - RNA, 18 nt, Human
agugccuuauggaacacu

SEQ ID NO: 1220987 - RNA, 16 nt, Human
agugccuuauggaaca

SEQ ID NO: 1220988 - RNA, 15 nt, Human
agugccuuauggaac

SEQ ID NO: 1220989 - RNA, 14 nt, Human
agugccuuauggaa

SEQ ID NO: 1220990 - RNA, 13 nt, Human
agugccuuaugga

SEQ ID NO: 1220991 - RNA, 10 nt, Human
agugccuuau

SEQ ID NO: 1220992 - RNA, 24 nt, Human
agugauccucccaccucagccucc

SEQ ID NO: 1220993 - RNA, 19 nt, Human
agugauccucccaccucag

SEQ ID NO: 1220994 - RNA, 18 nt, Human
agugauccucccaccuca

SEQ ID NO: 1220995 - RNA, 15 nt, Human
agugauccucccacc

SEQ ID NO: 1220996 - RNA, 14 nt, Human
agugauccucccac

SEQ ID NO: 1220997 - RNA, 18 nt, Human
agugccuuacacaauggu

SEQ ID NO: 1220998 - RNA, 17 nt, Human
agugauucuccugccuc

SEQ ID NO: 1220999 - RNA, 15 nt, Human
agugauucuccugcc

SEQ ID NO: 1221000 - RNA, 14 nt, Human
agugauucuccugc

SEQ ID NO: 1221001 - RNA, 19 nt, Human
aguucaucuugaauuguaa

SEQ ID NO: 1221002 - RNA, 15 nt, Human
aguucaucuugaauu

SEQ ID NO: 1221003 - RNA, 13 nt, Human
aguucaucuugaa

SEQ ID NO: 1221004 - RNA, 18 nt, Human
aguucagguaacaggcag

SEQ ID NO: 1221005 - RNA, 14 nt, Human
aguugauagcacag

SEQ ID NO: 1221006 - RNA, 16 nt, Human
aguugauacuacaguu

SEQ ID NO: 1221007 - RNA, 22 nt, Human
aguucaucuugaauuguaagga

SEQ ID NO: 1221008 - RNA, 17 nt, Human
auagccuaggugacaga

SEQ ID NO: 1221009 - RNA, 15 nt, Human
auagccuaggugaca

SEQ ID NO: 1221010 - RNA, 18 nt, Human
auagcacagacccugccc

SEQ ID NO: 1221011 - RNA, 17 nt, Human
auagcacagacccugcc

SEQ ID NO: 1221012 - RNA, 19 nt, Human
auauucaggaagcucaggg

SEQ ID NO: 1221013 - RNA, 17 nt, Human
auaugcucugcauguua

SEQ ID NO: 1221014 - RNA, 20 nt, Human
auaugcucugcauguuacau

SEQ ID NO: 1221015 - RNA, 17 nt, Human
auacccacccccaccca

SEQ ID NO: 1221016 - RNA, 16 nt, Human
auacccacccccaccc

SEQ ID NO: 1221017 - RNA, 14 nt, Human
auacccacccccac

SEQ ID NO: 1221018 - RNA, 13 nt, Human
auacccaccccca

SEQ ID NO: 1221019 - RNA, 22 nt, Human
auacacuuacacuuuaugcaca

SEQ ID NO: 1221020 - RNA, 13 nt, Human
auacacuuacacu

SEQ ID NO: 1221021 - RNA, 17 nt, Human
auacaaugcugugcccu

SEQ ID NO: 1221022 - RNA, 14 nt, Human
auacaaugcugugc

SEQ ID NO: 1221023 - RNA, 16 nt, Human
auaccugucccccuga

SEQ ID NO: 1221024 - RNA, 15 nt, Human
auaccugucccccug

SEQ ID NO: 1221025 - RNA, 14 nt, Human
auaccugucccccu

SEQ ID NO: 1221026 - RNA, 17 nt, Human
auaccugucccccugac

SEQ ID NO: 1221027 - RNA, 18 nt, Human
auaaggguaucuggugac

SEQ ID NO: 1221028 - RNA, 14 nt, Human
auaauguaagcucu

SEQ ID NO: 1221029 - RNA, 23 nt, Human
aguuugauuaaauucuugcaaag

SEQ ID NO: 1221030 - RNA, 11 nt, Human
auaaaacuuuu

SEQ ID NO: 1221031 - RNA, 22 nt, Human
aguuugauuaaauucuugcaaa

SEQ ID NO: 1221032 - RNA, 20 nt, Human
aguuugauuaaauucuugca

SEQ ID NO: 1221033 - RNA, 18 nt, Human
aguuugauuaaauucuug

SEQ ID NO: 1221034 - RNA, 17 nt, Human
aguuugauuaaauucuu

SEQ ID NO: 1221035 - RNA, 20 nt, Human
aguuugagaucagccugggc

SEQ ID NO: 1221036 - RNA, 19 nt, Human
aguuugagaucagccuggg

SEQ ID NO: 1221037 - RNA, 18 nt, Human
aguuugagaucagccugg

SEQ ID NO: 1221038 - RNA, 22 nt, Human
aguuguuacauuuuuaagugcu

SEQ ID NO: 1221039 - RNA, 20 nt, Human
aguuguuacauuuuuaagug

SEQ ID NO: 1221040 - RNA, 18 nt, Human
auaacauguaauuaagua

SEQ ID NO: 1221041 - RNA, 13 nt, Human
auaacauguaauu

SEQ ID NO: 1221042 - RNA, 12 nt, Human
auaacauguaau

SEQ ID NO: 1221043 - RNA, 20 nt, Human
auaacauguaauuaaguacu

SEQ ID NO: 1221044 - RNA, 19 nt, Human
caagcgauucuucugcuuc

SEQ ID NO: 1221045 - RNA, 22 nt, Human
caagcugcacccucaggcaggu

SEQ ID NO: 1221046 - RNA, 21 nt, Human
caagcuggucccacucagucc

SEQ ID NO: 1221047 - RNA, 21 nt, Human
caagcugcacccucaggcagg

SEQ ID NO: 1221048 - RNA, 18 nt, Human
caagcgauucuucugcuu

SEQ ID NO: 1221049 - RNA, 17 nt, Human
caagcgauucuucugcu

SEQ ID NO: 1221050 - RNA, 15 nt, Human
caagcgauucuucug

SEQ ID NO: 1221051 - RNA, 23 nt, Human
caagcuggucccacucaguccau

SEQ ID NO: 1221052 - RNA, 22 nt, Human
caagcuggucccacucagucca

SEQ ID NO: 1221053 - RNA, 19 nt, Human
caaggauccugagccagau

SEQ ID NO: 1221054 - RNA, 18 nt, Human
caaggauccugagccaga

SEQ ID NO: 1221055 - RNA, 16 nt, Human
caaggagauuuacaac

SEQ ID NO: 1221056 - RNA, 22 nt, Human
caaggcugcagugagccgagau

SEQ ID NO: 1221057 - RNA, 17 nt, Human
caaggcugcagugagcc

SEQ ID NO: 1221058 - RNA, 20 nt, Human
caaggauccugagccagauu

SEQ ID NO: 1221059 - RNA, 22 nt, Human
caaggauccugagccagauuuc

SEQ ID NO: 1221060 - RNA, 18 nt, Human
caaggcugggggaagaag

SEQ ID NO: 1221061 - RNA, 17 nt, Human
caauaggaaaaacugau

SEQ ID NO: 1221062 - RNA, 16 nt, Human
caauaggaaaaacuga

SEQ ID NO: 1221063 - RNA, 15 nt, Human
caauaggaaaaacug

SEQ ID NO: 1221064 - RNA, 18 nt, Human
caauaggaaaaacugauu

SEQ ID NO: 1221065 - RNA, 22 nt, Human
caaugugaaaagaaaaaugagc

SEQ ID NO: 1221066 - RNA, 15 nt, Human
cacaaacagaggccg

SEQ ID NO: 1221067 - RNA, 14 nt, Human
cacaaacagaggcc

SEQ ID NO: 1221068 - RNA, 13 nt, Human
cacaaacagaggc

SEQ ID NO: 1221069 - RNA, 18 nt, Human
caauuacaggaaguacug

SEQ ID NO: 1221070 - RNA, 17 nt, Human
cacacacgcgugcacac

SEQ ID NO: 1221071 - RNA, 13 nt, Human
cacaaaggagagc

SEQ ID NO: 1221072 - RNA, 17 nt, Human
cacaaagguagcuuuuc

SEQ ID NO: 1221073 - RNA, 22 nt, Human
cacagaguuguuacauuuuuaa

SEQ ID NO: 1221074 - RNA, 13 nt, Human
cacagaggcugcc

SEQ ID NO: 1221075 - RNA, 21 nt, Human
cacagagaaaguacuucucca

SEQ ID NO: 1221076 - RNA, 20 nt, Human
cacagagaaaguacuucucc

SEQ ID NO: 1221077 - RNA, 19 nt, Human
cacagagaaaguacuucuc

SEQ ID NO: 1221078 - RNA, 15 nt, Human
caagacgcugugcug

SEQ ID NO: 1221079 - RNA, 13 nt, Human
caagacgcugugc

SEQ ID NO: 1221080 - RNA, 23 nt, Human
caagaccuucuccuucaccuuug

SEQ ID NO: 1221081 - RNA, 21 nt, Human
caagaccuucuccuucaccuu

SEQ ID NO: 1221082 - RNA, 13 nt, Human
caagagcccaggc

SEQ ID NO: 1221083 - RNA, 14 nt, Human
caagaagcccagga

SEQ ID NO: 1221084 - RNA, 13 nt, Human
caagaagcccagg

SEQ ID NO: 1221085 - RNA, 22 nt, Human
caaauuucuaaaucuccaaaau

SEQ ID NO: 1221086 - RNA, 15 nt, Human
caaauuucuaaaucu

SEQ ID NO: 1221087 - RNA, 19 nt, Human
caacauacucccaucugug

SEQ ID NO: 1221088 - RNA, 17 nt, Human
caacauacucccaucug

SEQ ID NO: 1221089 - RNA, 12 nt, Human
caacaggcuggg

SEQ ID NO: 1221090 - RNA, 20 nt, Human
caacauacucccaucuguga

SEQ ID NO: 1221091 - RNA, 23 nt, Human
caaauggaaaugggcagagcaga

SEQ ID NO: 1221092 - RNA, 19 nt, Human
caaagugcugggauuacaa

SEQ ID NO: 1221093 - RNA, 23 nt, Human
caaagugcugggauuacaagcgu

SEQ ID NO: 1221094 - RNA, 13 nt, Human
caacaggcugggc

SEQ ID NO: 1221095 - RNA, 14 nt, Human
caaaaguuucucuu

SEQ ID NO: 1221096 - RNA, 19 nt, Human
caaaacucuccucugcugc

SEQ ID NO: 1221097 - RNA, 16 nt, Human
caaaacucuccucugc

SEQ ID NO: 1221098 - RNA, 15 nt, Human
caaaacucuccucug

SEQ ID NO: 1221099 - RNA, 21 nt, Human
caaaacgguuuuacugcagcu

SEQ ID NO: 1221100 - RNA, 15 nt, Human
caaaacgguuuuacu

SEQ ID NO: 1221101 - RNA, 18 nt, Human
auuuuauuuuauuaugca

SEQ ID NO: 1221102 - RNA, 20 nt, Human
caaaauaaaacuuuuuaaaa

SEQ ID NO: 1221103 - RNA, 16 nt, Human
caaaauaaaacuuuuu

SEQ ID NO: 1221104 - RNA, 21 nt, Human
caaaaucgaugcagugcuucc

SEQ ID NO: 1221105 - RNA, 21 nt, Human
caaacucuugaccucagguga

SEQ ID NO: 1221106 - RNA, 20 nt, Human
caaacucuugaccucaggug

SEQ ID NO: 1221107 - RNA, 19 nt, Human
caaacucuugaccucaggu

SEQ ID NO: 1221108 - RNA, 17 nt, Human
caaacucuugaccucag

SEQ ID NO: 1221109 - RNA, 15 nt, Human
caaacagaggccgcc

SEQ ID NO: 1221110 - RNA, 13 nt, Human
caaacagaggccg

SEQ ID NO: 1221111 - RNA, 22 nt, Human
caaaaugaaacgcaaccaccac

SEQ ID NO: 1221112 - RNA, 11 nt, Human
caaaaugaaac

SEQ ID NO: 1221113 - RNA, 17 nt, Human
cacaguucaauucucau

SEQ ID NO: 1221114 - RNA, 19 nt, Human
ugugugcacguacacacac

SEQ ID NO: 1221115 - RNA, 16 nt, Human
uguguuuauugucaaa

SEQ ID NO: 1221116 - RNA, 14 nt, Human
uguucagcuccagc

SEQ ID NO: 1221117 - RNA, 22 nt, Human
uguucagcuccagcucaccagc

SEQ ID NO: 1221118 - RNA, 21 nt, Human
uguucagcuccagcucaccag

SEQ ID NO: 1221119 - RNA, 20 nt, Human
uguucagcuccagcucacca

SEQ ID NO: 1221120 - RNA, 20 nt, Human
uguuaguaugaggcauuugu

SEQ ID NO: 1221121 - RNA, 19 nt, Human
uguuaguaugaggcauuug

SEQ ID NO: 1221122 - RNA, 17 nt, Human
uguuaguaugaggcauu

SEQ ID NO: 1221123 - RNA, 14 nt, Human
uguuacuaaguuuu

SEQ ID NO: 1221124 - RNA, 20 nt, Human
uguucuggcucuuccaggcu

SEQ ID NO: 1221125 - RNA, 17 nt, Human
uguucuggcucuuccag

SEQ ID NO: 1221126 - RNA, 21 nt, Human
uguucuggcucuuccaggcug

SEQ ID NO: 1221127 - RNA, 12 nt, Human
uguucugggaca

SEQ ID NO: 1221128 - RNA, 19 nt, Human
uguucaucauccuaagcua

SEQ ID NO: 1221129 - RNA, 16 nt, Human
uguucucucuucucca

SEQ ID NO: 1221130 - RNA, 15 nt, Human
uguucucucuucucc

SEQ ID NO: 1221131 - RNA, 16 nt, Human
uguucuggcucuucca

SEQ ID NO: 1221132 - RNA, 13 nt, Human
uguucuggcucuu

SEQ ID NO: 1221133 - RNA, 12 nt, Human
uguucuggcucu

SEQ ID NO: 1221134 - RNA, 13 nt, Human
uguucucugagga

SEQ ID NO: 1221135 - RNA, 16 nt, Human
uguucucugcccucca

SEQ ID NO: 1221136 - RNA, 15 nt, Human
uguucucugcccucc

SEQ ID NO: 1221137 - RNA, 14 nt, Human
uguucucugcccuc

SEQ ID NO: 1221138 - RNA, 13 nt, Human
uguucucugcccu

SEQ ID NO: 1221139 - RNA, 19 nt, Human
uguuggcugggggccucag

SEQ ID NO: 1221140 - RNA, 17 nt, Human
uguuggcugggggccuc

SEQ ID NO: 1221141 - RNA, 16 nt, Human
uguuggccaggcuggu

SEQ ID NO: 1221142 - RNA, 15 nt, Human
uguuggccaggcugg

SEQ ID NO: 1221143 - RNA, 15 nt, Human
uguuggccaaagcca

SEQ ID NO: 1221144 - RNA, 15 nt, Human
uguuuccuggcacug

SEQ ID NO: 1221145 - RNA, 16 nt, Human
uguuuuaagaggcagg

SEQ ID NO: 1221146 - RNA, 16 nt, Human
uguuuguugucagcug

SEQ ID NO: 1221147 - RNA, 13 nt, Human
uguuuuugucuua

SEQ ID NO: 1221148 - RNA, 23 nt, Human
uguuuuaaggaugcuuguacaua

SEQ ID NO: 1221149 - RNA, 22 nt, Human
uguuuuaaggaugcuuguacau

SEQ ID NO: 1221150 - RNA, 20 nt, Human
uguuuuaagaggcagggucu

SEQ ID NO: 1221151 - RNA, 17 nt, Human
uguuuuaagaggcaggg

SEQ ID NO: 1221152 - RNA, 16 nt, Human
uuaaaugcccagcccc

SEQ ID NO: 1221153 - RNA, 15 nt, Human
uuaaaugcccagccc

SEQ ID NO: 1221154 - RNA, 14 nt, Human
uuaaaugcccagcc

SEQ ID NO: 1221155 - RNA, 11 nt, Human
uuaaaugcacc

SEQ ID NO: 1221156 - RNA, 14 nt, Human
uuaacuuuuauaaa

SEQ ID NO: 1221157 - RNA, 13 nt, Human
uuaacuuuuauaa

SEQ ID NO: 1221158 - RNA, 12 nt, Human
uuaacuuuuaua

SEQ ID NO: 1221159 - RNA, 17 nt, Human
uuaaaugcccagccccu

SEQ ID NO: 1221160 - RNA, 17 nt, Human
uuacauuuuuaagugcu

SEQ ID NO: 1221161 - RNA, 12 nt, Human
uuacauuuuuaa

SEQ ID NO: 1221162 - RNA, 20 nt, Human
uuacacuuuaugcacaaaau

SEQ ID NO: 1221163 - RNA, 13 nt, Human
uuacacuuuaugc

SEQ ID NO: 1221164 - RNA, 22 nt, Human
ugugggcuaguugggcuuccuc

SEQ ID NO: 1221165 - RNA, 16 nt, Human
uguguagggcgggagg

SEQ ID NO: 1221166 - RNA, 12 nt, Human
uguguagggcgg

SEQ ID NO: 1221167 - RNA, 23 nt, Human
uguggcgcagcauauucaggaag

SEQ ID NO: 1221168 - RNA, 18 nt, Human
uguggacacagcucuucu

SEQ ID NO: 1221169 - RNA, 13 nt, Human
uguggacacagcu

SEQ ID NO: 1221170 - RNA, 19 nt, Human
uguggacacagcucuucuc

SEQ ID NO: 1221171 - RNA, 14 nt, Human
ugugcgccuacagg

SEQ ID NO: 1221172 - RNA, 19 nt, Human
ugugcgccuacaggaguga

SEQ ID NO: 1221173 - RNA, 23 nt, Human
ugugcauuuggugguuucagaaa

SEQ ID NO: 1221174 - RNA, 23 nt, Human
ugugcauuaucuagauacuguau

SEQ ID NO: 1221175 - RNA, 21 nt, Human
ugugcauuaucuagauacugu

SEQ ID NO: 1221176 - RNA, 20 nt, Human
ugugcauuaucuagauacug

SEQ ID NO: 1221177 - RNA, 19 nt, Human
ugugcauuaucuagauacu

SEQ ID NO: 1221178 - RNA, 16 nt, Human
ugugcauuaucuagau

SEQ ID NO: 1221179 - RNA, 14 nt, Human
ugugcauuaucuag

SEQ ID NO: 1221180 - RNA, 16 nt, Human
ugugcacaugcacgug

SEQ ID NO: 1221181 - RNA, 16 nt, Human
ugucuuuggacccuga

SEQ ID NO: 1221182 - RNA, 14 nt, Human
ugucuuuggacccu

SEQ ID NO: 1221183 - RNA, 23 nt, Human
ugugaaaagaaaaaugagccugg

SEQ ID NO: 1221184 - RNA, 17 nt, Human
ugucuuuggacccugag

SEQ ID NO: 1221185 - RNA, 23 nt, Human
ugucuuuucuugcaugaggcuag

SEQ ID NO: 1221186 - RNA, 16 nt, Human
ugucuuuuuucacuac

SEQ ID NO: 1221187 - RNA, 21 nt, Human
ugugagucaccaagcccaguu

SEQ ID NO: 1221188 - RNA, 19 nt, Human
ugugagucaccaagcccag

SEQ ID NO: 1221189 - RNA, 17 nt, Human
ugugagucaccaagccc

SEQ ID NO: 1221190 - RNA, 20 nt, Human
ugugaggaagccgcuggggc

SEQ ID NO: 1221191 - RNA, 18 nt, Human
ugugaggaagccgcuggg

SEQ ID NO: 1221192 - RNA, 13 nt, Human
ugugaggaagccg

SEQ ID NO: 1221193 - RNA, 14 nt, Human
uguaccucuugagc

SEQ ID NO: 1221194 - RNA, 15 nt, Human
uguacgucugacagg

SEQ ID NO: 1221195 - RNA, 16 nt, Human
uguacgucugacaggc

SEQ ID NO: 1221196 - RNA, 21 nt, Human
uguacagagcccacgccccca

SEQ ID NO: 1221197 - RNA, 18 nt, Human
uguacagagcccacgccc

SEQ ID NO: 1221198 - RNA, 17 nt, Human
uguacagagcccacgcc

SEQ ID NO: 1221199 - RNA, 16 nt, Human
uguacagagcccacgc

SEQ ID NO: 1221200 - RNA, 17 nt, Human
uguaauuaaguacuaug

SEQ ID NO: 1221201 - RNA, 13 nt, Human
ugucacaggcagg

SEQ ID NO: 1221202 - RNA, 12 nt, Human
ugucacaggcag

SEQ ID NO: 1221203 - RNA, 17 nt, Human
ugucacacacuuuggcu

SEQ ID NO: 1221204 - RNA, 22 nt, Human
uguauucucuccuguaccucuu

SEQ ID NO: 1221205 - RNA, 13 nt, Human
ugucaccugaaga

SEQ ID NO: 1221206 - RNA, 19 nt, Human
ugucauuugagcagggcuc

SEQ ID NO: 1221207 - RNA, 16 nt, Human
ugucauuugagcaggg

SEQ ID NO: 1221208 - RNA, 17 nt, Human
uguccuacucuguguca

SEQ ID NO: 1221209 - RNA, 12 nt, Human
uguccuacucug

SEQ ID NO: 1221210 - RNA, 20 nt, Human
uguccuacccacccuccuuu

SEQ ID NO: 1221211 - RNA, 17 nt, Human
uguccccgacccuugcc

SEQ ID NO: 1221212 - RNA, 16 nt, Human
uguccccgacccuugc

SEQ ID NO: 1221213 - RNA, 22 nt, Human
uguccccaccgcagacaggacc

SEQ ID NO: 1221214 - RNA, 19 nt, Human
uguccccaccgcagacagg

SEQ ID NO: 1221215 - RNA, 18 nt, Human
uguccccaccgcagacag

SEQ ID NO: 1221216 - RNA, 18 nt, Human
ugggggcugggcagagga

SEQ ID NO: 1221217 - RNA, 17 nt, Human
ugggggcugggcagagg

SEQ ID NO: 1221218 - RNA, 19 nt, Human
ugggggcugggcagaggaa

SEQ ID NO: 1221219 - RNA, 15 nt, Human
ugggggugcauuuga

SEQ ID NO: 1221220 - RNA, 12 nt, Human
ugggggugcauu

SEQ ID NO: 1221221 - RNA, 21 nt, Human
ugggggaucacagccucugaa

SEQ ID NO: 1221222 - RNA, 20 nt, Human
ugggggaucacagccucuga

SEQ ID NO: 1221223 - RNA, 17 nt, Human
ugggcuucaguggcagc

SEQ ID NO: 1221224 - RNA, 15 nt, Human
ugggcuucaguggca

SEQ ID NO: 1221225 - RNA, 17 nt, Human
ugggcuggugucaccug

SEQ ID NO: 1221226 - RNA, 16 nt, Human
ugggcuaguugggcuu

SEQ ID NO: 1221227 - RNA, 22 nt, Human
ugggcuaagugauccucccacc

SEQ ID NO: 1221228 - RNA, 16 nt, Human
ugggcagaggaaagca

SEQ ID NO: 1221229 - RNA, 16 nt, Human
uggguaacuagggaag

SEQ ID NO: 1221230 - RNA, 19 nt, Human
ugggguuuaucagaauucu

SEQ ID NO: 1221231 - RNA, 16 nt, Human
uggguucuacccaggu

SEQ ID NO: 1221232 - RNA, 22 nt, Human
uggguucuacccaggugcuagg

SEQ ID NO: 1221233 - RNA, 23 nt, Human
ugguauuggcuagagguucaaag

SEQ ID NO: 1221234 - RNA, 18 nt, Human
ugguaugaucacggcuca

SEQ ID NO: 1221235 - RNA, 21 nt, Human
uggguuucuaaagcugccagc

SEQ ID NO: 1221236 - RNA, 18 nt, Human
uggguuucuaaagcugcc

SEQ ID NO: 1221237 - RNA, 17 nt, Human
uggguuucuaaagcugc

SEQ ID NO: 1221238 - RNA, 15 nt, Human
ugggauccuccaggu

SEQ ID NO: 1221239 - RNA, 15 nt, Human
ugggagugagcuggu

SEQ ID NO: 1221240 - RNA, 23 nt, Human
ugggagcugccuguucagcucca

SEQ ID NO: 1221241 - RNA, 22 nt, Human
ugggagcugccuguucagcucc

SEQ ID NO: 1221242 - RNA, 21 nt, Human
ugggagcugccuguucagcuc

SEQ ID NO: 1221243 - RNA, 17 nt, Human
ugggagcugccuguuca

SEQ ID NO: 1221244 - RNA, 16 nt, Human
ugggauuacaggugug

SEQ ID NO: 1221245 - RNA, 13 nt, Human
ugggauccuggag

SEQ ID NO: 1221246 - RNA, 18 nt, Human
ugggauccuccaggugca

SEQ ID NO: 1221247 - RNA, 15 nt, Human
ugggcagaggaaagc

SEQ ID NO: 1221248 - RNA, 12 nt, Human
ugggacacccug

SEQ ID NO: 1221249 - RNA, 15 nt, Human
uggcuuuugugcauu

SEQ ID NO: 1221250 - RNA, 13 nt, Human
ugggacacccugu

SEQ ID NO: 1221251 - RNA, 13 nt, Human
ugggagcaaaaga

SEQ ID NO: 1221252 - RNA, 14 nt, Human
ugggagcugccugu

SEQ ID NO: 1221253 - RNA, 13 nt, Human
ugggagcugccug

SEQ ID NO: 1221254 - RNA, 12 nt, Human
ugggagcugccu

SEQ ID NO: 1221255 - RNA, 21 nt, Human
uggcugcuucaaggauccuga

SEQ ID NO: 1221256 - RNA, 21 nt, Human
uggcugggggccucagugcca

SEQ ID NO: 1221257 - RNA, 14 nt, Human
uggcuuuugugcau

SEQ ID NO: 1221258 - RNA, 19 nt, Human
uggacaugcacagcuaaca

SEQ ID NO: 1221259 - RNA, 13 nt, Human
uggacaugcacag

SEQ ID NO: 1221260 - RNA, 19 nt, Human
uggaauaacauguaauuaa

SEQ ID NO: 1221261 - RNA, 15 nt, Human
uggaauaacauguaa

SEQ ID NO: 1221262 - RNA, 14 nt, Human
uggaauaacaugua

SEQ ID NO: 1221263 - RNA, 16 nt, Human
uggaauauauaaccag

SEQ ID NO: 1221264 - RNA, 15 nt, Human
uggaauauauaacca

SEQ ID NO: 1221265 - RNA, 17 nt, Human
uggaauaaggagaauga

SEQ ID NO: 1221266 - RNA, 21 nt, Human
uggaaagacuuuuccaacccu

SEQ ID NO: 1221267 - RNA, 20 nt, Human
uggaaagaguaggaagacuu

SEQ ID NO: 1221268 - RNA, 20 nt, Human
uggaaaaauagccugccucu

SEQ ID NO: 1221269 - RNA, 21 nt, Human
uggccagaugcaccagcccuu

SEQ ID NO: 1221270 - RNA, 13 nt, Human
uggcagugggagc

SEQ ID NO: 1221271 - RNA, 21 nt, Human
uggcacccggccccugcuggu

SEQ ID NO: 1221272 - RNA, 13 nt, Human
uggcagcugcuuu

SEQ ID NO: 1221273 - RNA, 24 nt, Human
uggauuuaacagaaauguacagca

SEQ ID NO: 1221274 - RNA, 20 nt, Human
uggauuuaacagaaauguac

SEQ ID NO: 1221275 - RNA, 20 nt, Human
uggaggaaggaaacccagcu

SEQ ID NO: 1221276 - RNA, 18 nt, Human
uggaggaaggaaacccag

SEQ ID NO: 1221277 - RNA, 12 nt, Human
uggaggaaggaa

SEQ ID NO: 1221278 - RNA, 22 nt, Human
ugccagguuuuuggucugaccc

SEQ ID NO: 1221279 - RNA, 19 nt, Human
ugccagguuuuuggucuga

SEQ ID NO: 1221280 - RNA, 18 nt, Human
ugccagguuuuuggucug

SEQ ID NO: 1221281 - RNA, 10 nt, Human
ugccaggcau

SEQ ID NO: 1221282 - RNA, 19 nt, Human
ugccacccuggggagaaag

SEQ ID NO: 1221283 - RNA, 22 nt, Human
ugccacuacggaauaguuggcu

SEQ ID NO: 1221284 - RNA, 20 nt, Human
ugccacccuggggagaaagu

SEQ ID NO: 1221285 - RNA, 19 nt, Human
ugcaucaagaugugacaug

SEQ ID NO: 1221286 - RNA, 14 nt, Human
ugcaucaagaugug

SEQ ID NO: 1221287 - RNA, 21 nt, Human
ugccauccagguucagcuugu

SEQ ID NO: 1221288 - RNA, 24 nt, Human
ugccagguuuuuggucugacccac

SEQ ID NO: 1221289 - RNA, 14 nt, Human
ugcccaccuggccu

SEQ ID NO: 1221290 - RNA, 13 nt, Human
ugcccaccuggcc

SEQ ID NO: 1221291 - RNA, 13 nt, Human
ugcccaggcuggc

SEQ ID NO: 1221292 - RNA, 21 nt, Human
ugcccacucccugcaaccuga

SEQ ID NO: 1221293 - RNA, 11 nt, Human
ugcccaggcug

SEQ ID NO: 1221294 - RNA, 16 nt, Human
ugcccacucccugcaa

SEQ ID NO: 1221295 - RNA, 15 nt, Human
ugcccacucccugca

SEQ ID NO: 1221296 - RNA, 14 nt, Human
ugcccacucccugc

SEQ ID NO: 1221297 - RNA, 23 nt, Human
ugccccucaacucuccuccagag

SEQ ID NO: 1221298 - RNA, 20 nt, Human
ugaguccccuguuuguuucu

SEQ ID NO: 1221299 - RNA, 22 nt, Human
ugcaccgggccacagagaaagu

SEQ ID NO: 1221300 - RNA, 17 nt, Human
ugcaccgggccacagag

SEQ ID NO: 1221301 - RNA, 15 nt, Human
ugcaccgggccacag

SEQ ID NO: 1221302 - RNA, 14 nt, Human
ugcaccgggccaca

SEQ ID NO: 1221303 - RNA, 23 nt, Human
ugcaccggcuggccuggccccuc

SEQ ID NO: 1221304 - RNA, 19 nt, Human
ugaguccccuguuuguuuc

SEQ ID NO: 1221305 - RNA, 23 nt, Human
ugcagcaauaaagcagcguuucu

SEQ ID NO: 1221306 - RNA, 14 nt, Human
ugcacuuuguucug

SEQ ID NO: 1221307 - RNA, 12 nt, Human
ugcacuuuguuc

SEQ ID NO: 1221308 - RNA, 16 nt, Human
ugcagugcuuccaagg

SEQ ID NO: 1221309 - RNA, 15 nt, Human
ugcaggcagccaggc

SEQ ID NO: 1221310 - RNA, 14 nt, Human
ugcaggcagccagg

SEQ ID NO: 1221311 - RNA, 13 nt, Human
ugcaggcagccag

SEQ ID NO: 1221312 - RNA, 20 nt, Human
ugcaguggugcgaucugggu

SEQ ID NO: 1221313 - RNA, 22 nt, Human
ugcagugguaugaucacggcuc

SEQ ID NO: 1221314 - RNA, 14 nt, Human
ugcaguugccaguc

SEQ ID NO: 1221315 - RNA, 13 nt, Human
ugcaguugccagu

SEQ ID NO: 1221316 - RNA, 15 nt, Human
ugcaguugccaguca

SEQ ID NO: 1221317 - RNA, 18 nt, Human
ugcuccuuucuuguuuua

SEQ ID NO: 1221318 - RNA, 18 nt, Human
ugcuccucuccccagcaa

SEQ ID NO: 1221319 - RNA, 17 nt, Human
ugcuccucuccccagca

SEQ ID NO: 1221320 - RNA, 14 nt, Human
ugcuccucucccca

SEQ ID NO: 1221321 - RNA, 17 nt, Human
ugcucacauaucuguca

SEQ ID NO: 1221322 - RNA, 16 nt, Human
ugcucacauaucuguc

SEQ ID NO: 1221323 - RNA, 15 nt, Human
ugcucacauaucugu

SEQ ID NO: 1221324 - RNA, 13 nt, Human
ugcugcuggcugg

SEQ ID NO: 1221325 - RNA, 14 nt, Human
ugcugcauuuaaaa

SEQ ID NO: 1221326 - RNA, 23 nt, Human
ugcugcaguugccagucaccccg

SEQ ID NO: 1221327 - RNA, 18 nt, Human
ugcugcaguugccaguca

SEQ ID NO: 1221328 - RNA, 18 nt, Human
ugcugauggugcaaugac

SEQ ID NO: 1221329 - RNA, 17 nt, Human
ugcugauggugcaauga

SEQ ID NO: 1221330 - RNA, 15 nt, Human
ugcugauggugcaau

SEQ ID NO: 1221331 - RNA, 13 nt, Human
ugcugauggugca

SEQ ID NO: 1221332 - RNA, 23 nt, Human
ugcugacagacacaggcccggcu

SEQ ID NO: 1221333 - RNA, 22 nt, Human
ugcugacagacacaggcccggc

SEQ ID NO: 1221334 - RNA, 21 nt, Human
ugcugaaggcucgagcaugcc

SEQ ID NO: 1221335 - RNA, 13 nt, Human
ugcugaaggcucg

SEQ ID NO: 1221336 - RNA, 12 nt, Human
ugcugaaggcuc

SEQ ID NO: 1221337 - RNA, 15 nt, Human
ugcgugcauaccacu

SEQ ID NO: 1221338 - RNA, 22 nt, Human
ugcgccuacaggagugagcacu

SEQ ID NO: 1221339 - RNA, 16 nt, Human
ugcgccuacaggagug

SEQ ID NO: 1221340 - RNA, 14 nt, Human
ugcgccuacaggag

SEQ ID NO: 1221341 - RNA, 15 nt, Human
ugcuaaaugugaaug

SEQ ID NO: 1221342 - RNA, 21 nt, Human
ugcgaucuggguucacugcaa

SEQ ID NO: 1221343 - RNA, 20 nt, Human
ugcgaucuggguucacugca

SEQ ID NO: 1221344 - RNA, 19 nt, Human
ugcgaucuggguucacugc

SEQ ID NO: 1221345 - RNA, 15 nt, Human
ugcgaucuggguuca

SEQ ID NO: 1221346 - RNA, 14 nt, Human
ugcgaucuggguuc

SEQ ID NO: 1221347 - RNA, 17 nt, Human
ugccugaagucacacag

SEQ ID NO: 1221348 - RNA, 20 nt, Human
ugccucgaacuggcugcaaa

SEQ ID NO: 1221349 - RNA, 19 nt, Human
ugccucgaacuggcugcaa

SEQ ID NO: 1221350 - RNA, 18 nt, Human
ugccucgaacuggcugca

SEQ ID NO: 1221351 - RNA, 18 nt, Human
ugccccuggcagccccug

SEQ ID NO: 1221352 - RNA, 18 nt, Human
ugccugggcagaaggaag

SEQ ID NO: 1221353 - RNA, 21 nt, Human
ugccugggaucccucauccuc

SEQ ID NO: 1221354 - RNA, 16 nt, Human
ugccugguggcagcug

SEQ ID NO: 1221355 - RNA, 15 nt, Human
ugccugguggcagcu

SEQ ID NO: 1221356 - RNA, 14 nt, Human
ugccugguggcagc

SEQ ID NO: 1221357 - RNA, 20 nt, Human
ugaaggccccgcccaggcuu

SEQ ID NO: 1221358 - RNA, 19 nt, Human
ugaaggccccgcccaggcu

SEQ ID NO: 1221359 - RNA, 18 nt, Human
ugaaggccccgcccaggc

SEQ ID NO: 1221360 - RNA, 20 nt, Human
ugaagacucauucuucugua

SEQ ID NO: 1221361 - RNA, 19 nt, Human
ugaagacucauucuucugu

SEQ ID NO: 1221362 - RNA, 21 nt, Human
ugaaggcuggguucugauccu

SEQ ID NO: 1221363 - RNA, 20 nt, Human
ugaaggcuggguucugaucc

SEQ ID NO: 1221364 - RNA, 13 nt, Human
ugacaacacucau

SEQ ID NO: 1221365 - RNA, 23 nt, Human
ugacaacacucauugaccugagg

SEQ ID NO: 1221366 - RNA, 21 nt, Human
ugaauuguaaggaaugauuaa

SEQ ID NO: 1221367 - RNA, 13 nt, Human
ugaauuguaagga

SEQ ID NO: 1221368 - RNA, 16 nt, Human
ugacagacacaggccc

SEQ ID NO: 1221369 - RNA, 14 nt, Human
ugacagacacaggc

SEQ ID NO: 1221370 - RNA, 13 nt, Human
ugacagacacagg

SEQ ID NO: 1221371 - RNA, 15 nt, Human
ugacacacagcucug

SEQ ID NO: 1221372 - RNA, 14 nt, Human
ugacacacagcucu

SEQ ID NO: 1221373 - RNA, 23 nt, Human
ugacaaggauugcuacuguccua

SEQ ID NO: 1221374 - RNA, 13 nt, Human
ugacauguuuuau

SEQ ID NO: 1221375 - RNA, 23 nt, Human
ugacaucaacugcaucaagaugu

SEQ ID NO: 1221376 - RNA, 22 nt, Human
ugacagagcaagugagacccug

SEQ ID NO: 1221377 - RNA, 18 nt, Human
ugacagacacaggcccgg

SEQ ID NO: 1221378 - RNA, 17 nt, Human
ugacagacacaggcccg

SEQ ID NO: 1221379 - RNA, 13 nt, Human
ugacagaggcagc

SEQ ID NO: 1221380 - RNA, 21 nt, Human
ugacucuuucuauuguuucuu

SEQ ID NO: 1221381 - RNA, 16 nt, Human
ugacuuuccucuuugg

SEQ ID NO: 1221382 - RNA, 14 nt, Human
ugaccauucuccac

SEQ ID NO: 1221383 - RNA, 13 nt, Human
ugaccauucucca

SEQ ID NO: 1221384 - RNA, 22 nt, Human
ugacuuuucuguccgagcuuug

SEQ ID NO: 1221385 - RNA, 15 nt, Human
ugagaaauaaaguuu

SEQ ID NO: 1221386 - RNA, 12 nt, Human
ugagcagggcuc

SEQ ID NO: 1221387 - RNA, 19 nt, Human
ugagaggggaacagacugg

SEQ ID NO: 1221388 - RNA, 18 nt, Human
ugagaggggaacagacug

SEQ ID NO: 1221389 - RNA, 14 nt, Human
ugagaggggaacag

SEQ ID NO: 1221390 - RNA, 14 nt, Human
ugagaccaaccugg

SEQ ID NO: 1221391 - RNA, 16 nt, Human
ugaggcugggcucccu

SEQ ID NO: 1221392 - RNA, 15 nt, Human
ugaggcugggcuccc

SEQ ID NO: 1221393 - RNA, 18 nt, Human
ugaggcucugcccuuggu

SEQ ID NO: 1221394 - RNA, 16 nt, Human
ugaggcucugcccuug

SEQ ID NO: 1221395 - RNA, 19 nt, Human
ugaggucagagccugcagu

SEQ ID NO: 1221396 - RNA, 18 nt, Human
ugaggucagagccugcag

SEQ ID NO: 1221397 - RNA, 21 nt, Human
ugaggcugggcucccuuccca

SEQ ID NO: 1221398 - RNA, 15 nt, Human
ugaggugcuauguuc

SEQ ID NO: 1221399 - RNA, 22 nt, Human
ugaggaugaaaaaauaacacug

SEQ ID NO: 1221400 - RNA, 23 nt, Human
ugagccgagaucacgccacugca

SEQ ID NO: 1221401 - RNA, 22 nt, Human
ugagccgagaucacgccacugc

SEQ ID NO: 1221402 - RNA, 23 nt, Human
ugagcagggcucagcggggacag

SEQ ID NO: 1221403 - RNA, 22 nt, Human
ugagcagggcucagcggggaca

SEQ ID NO: 1221404 - RNA, 20 nt, Human
ugagcagggcucagcgggga

SEQ ID NO: 1221405 - RNA, 19 nt, Human
ugagcucaggaguuugaga

SEQ ID NO: 1221406 - RNA, 11 nt, Human
ugagcucagga

SEQ ID NO: 1221407 - RNA, 15 nt, Human
ucuucagaucucuaa

SEQ ID NO: 1221408 - RNA, 14 nt, Human
ucuucagaucucua

SEQ ID NO: 1221409 - RNA, 21 nt, Human
ucuucagagacuccugcaggc

SEQ ID NO: 1221410 - RNA, 22 nt, Human
ucuuauccaacaucaacaucuu

SEQ ID NO: 1221411 - RNA, 14 nt, Human
ucuuauacauuuga

SEQ ID NO: 1221412 - RNA, 16 nt, Human
ucuuaguggauguucu

SEQ ID NO: 1221413 - RNA, 15 nt, Human
ucuuagauguauaua

SEQ ID NO: 1221414 - RNA, 22 nt, Human
ucugugucagguggggcagcuu

SEQ ID NO: 1221415 - RNA, 20 nt, Human
ucugugucagguggggcagc

SEQ ID NO: 1221416 - RNA, 17 nt, Human
ucugugucagguggggc

SEQ ID NO: 1221417 - RNA, 23 nt, Human
ucuuagguuggcaaaaaggcagg

SEQ ID NO: 1221418 - RNA, 20 nt, Human
ucuuagguuggcaaaaaggc

SEQ ID NO: 1221419 - RNA, 21 nt, Human
ucuugaaauauaggaacuuaa

SEQ ID NO: 1221420 - RNA, 20 nt, Human
ucuugaaauauaggaacuua

SEQ ID NO: 1221421 - RNA, 22 nt, Human
ucuugaagacuuuucuuucagc

SEQ ID NO: 1221422 - RNA, 13 nt, Human
ucuugaagacuuu

SEQ ID NO: 1221423 - RNA, 23 nt, Human
ucuugcucugcugacagacacag

SEQ ID NO: 1221424 - RNA, 15 nt, Human
ucuugcucugcugac

SEQ ID NO: 1221425 - RNA, 14 nt, Human
ucuugcucugcuga

SEQ ID NO: 1221426 - RNA, 12 nt, Human
ucuuucccuccc

SEQ ID NO: 1221427 - RNA, 23 nt, Human
ucuuucccucccuuccucuuucc

SEQ ID NO: 1221428 - RNA, 13 nt, Human
ucuuucccucccu

SEQ ID NO: 1221429 - RNA, 23 nt, Human
ucuuuccaaaguacacuguuuca

SEQ ID NO: 1221430 - RNA, 13 nt, Human
ucuuguguguuua

SEQ ID NO: 1221431 - RNA, 16 nt, Human
ucuuuggacccugagg

SEQ ID NO: 1221432 - RNA, 15 nt, Human
ucuuuggacccugag

SEQ ID NO: 1221433 - RNA, 14 nt, Human
ucuuuggacccuga

SEQ ID NO: 1221434 - RNA, 13 nt, Human
ucuuuggacccug

SEQ ID NO: 1221435 - RNA, 17 nt, Human
ucuuugcagacaggcaa

SEQ ID NO: 1221436 - RNA, 14 nt, Human
ucuuugcagacagg

SEQ ID NO: 1221437 - RNA, 13 nt, Human
ucuuugcagacag

SEQ ID NO: 1221438 - RNA, 23 nt, Human
ucuuugagugaagcugggagaac

SEQ ID NO: 1221439 - RNA, 23 nt, Human
ugaaaacacuguucucugcccuc

SEQ ID NO: 1221440 - RNA, 22 nt, Human
ugaaaacacuguucucugcccu

SEQ ID NO: 1221441 - RNA, 21 nt, Human
ugaaaacacuguucucugccc

SEQ ID NO: 1221442 - RNA, 20 nt, Human
ugaaaacacuguucucugcc

SEQ ID NO: 1221443 - RNA, 17 nt, Human
ugaaaacacuguucucu

SEQ ID NO: 1221444 - RNA, 21 nt, Human
ugaaaacacauuuuucuuagg

SEQ ID NO: 1221445 - RNA, 12 nt, Human
ugaaaauuuuga

SEQ ID NO: 1221446 - RNA, 14 nt, Human
ugaaaauucagugg

SEQ ID NO: 1221447 - RNA, 19 nt, Human
ugaaaagaaaaaugagccu

SEQ ID NO: 1221448 - RNA, 22 nt, Human
ugaaaagaaaaaugagccuggc

SEQ ID NO: 1221449 - RNA, 20 nt, Human
ugaaaagaaaaaugagccug

SEQ ID NO: 1221450 - RNA, 16 nt, Human
ucuggugacuuuccuc

SEQ ID NO: 1221451 - RNA, 13 nt, Human
ucugucuaggaau

SEQ ID NO: 1221452 - RNA, 21 nt, Human
ucuguccugggagugagcugg

SEQ ID NO: 1221453 - RNA, 17 nt, Human
ucugucgcccagucugg

SEQ ID NO: 1221454 - RNA, 12 nt, Human
ucuguccuggga

SEQ ID NO: 1221455 - RNA, 23 nt, Human
ucuguacagagcccacgccccca

SEQ ID NO: 1221456 - RNA, 15 nt, Human
ucuguacagagccca

SEQ ID NO: 1221457 - RNA, 14 nt, Human
ucuguacagagccc

SEQ ID NO: 1221458 - RNA, 17 nt, Human
ucugcugcuggcugguu

SEQ ID NO: 1221459 - RNA, 15 nt, Human
ucugcugcuggcugg

SEQ ID NO: 1221460 - RNA, 14 nt, Human
ucugcugcuggcug

SEQ ID NO: 1221461 - RNA, 20 nt, Human
ucugccugcccaggccccug

SEQ ID NO: 1221462 - RNA, 18 nt, Human
ucugccugcccaggcccc

SEQ ID NO: 1221463 - RNA, 17 nt, Human
ucugccugcccaggccc

SEQ ID NO: 1221464 - RNA, 13 nt, Human
ucugccugcccag

SEQ ID NO: 1221465 - RNA, 13 nt, Human
ucugcugcuggcu

SEQ ID NO: 1221466 - RNA, 11 nt, Human
ucugcugcugg

SEQ ID NO: 1221467 - RNA, 17 nt, Human
ucugcugacagacacag

SEQ ID NO: 1221468 - RNA, 13 nt, Human
ucugcacuccccu

SEQ ID NO: 1221469 - RNA, 23 nt, Human
ucugaggaauccagacccggcug

SEQ ID NO: 1221470 - RNA, 22 nt, Human
ucugaggaauccagacccggcu

SEQ ID NO: 1221471 - RNA, 21 nt, Human
ucugaggaauccagacccggc

SEQ ID NO: 1221472 - RNA, 18 nt, Human
ucugaggaauccagaccc

SEQ ID NO: 1221473 - RNA, 24 nt, Human
ucugagaucaaaacgguuuuacug

SEQ ID NO: 1221474 - RNA, 18 nt, Human
ucugagaggacuuuucuu

SEQ ID NO: 1221475 - RNA, 23 nt, Human
ucugacccaugcugcccugugag

SEQ ID NO: 1221476 - RNA, 22 nt, Human
ucugacccaugcugcccuguga

SEQ ID NO: 1221477 - RNA, 20 nt, Human
ucugacccaugcugcccugu

SEQ ID NO: 1221478 - RNA, 15 nt, Human
ucugccucccaucac

SEQ ID NO: 1221479 - RNA, 13 nt, Human
ucugccucccauc

SEQ ID NO: 1221480 - RNA, 12 nt, Human
ucugccucccau

SEQ ID NO: 1221481 - RNA, 16 nt, Human
ucugcccacucccugc

SEQ ID NO: 1221482 - RNA, 14 nt, Human
ucugcccacucccu

SEQ ID NO: 1221483 - RNA, 13 nt, Human
ucugcccacuccc

SEQ ID NO: 1221484 - RNA, 12 nt, Human
ucugcccacucc

SEQ ID NO: 1221485 - RNA, 23 nt, Human
ucugccauauucuguuggccagu

SEQ ID NO: 1221486 - RNA, 22 nt, Human
ucugccauauucuguuggccag

SEQ ID NO: 1221487 - RNA, 20 nt, Human
ucugccugaagucacacagu

SEQ ID NO: 1221488 - RNA, 19 nt, Human
ucugccugaagucacacag

SEQ ID NO: 1221489 - RNA, 23 nt, Human
ucugccucugacacacagcucug

SEQ ID NO: 1221490 - RNA, 22 nt, Human
ucugccucugacacacagcucu

SEQ ID NO: 1221491 - RNA, 21 nt, Human
ucugccucugacacacagcuc

SEQ ID NO: 1221492 - RNA, 21 nt, Human
ucugccucccaucacccgcua

SEQ ID NO: 1221493 - RNA, 20 nt, Human
ucugccucccaucacccgcu

SEQ ID NO: 1221494 - RNA, 17 nt, Human
ucugccucccaucaccc

SEQ ID NO: 1221495 - RNA, 16 nt, Human
ucugccucccaucacc

SEQ ID NO: 1221496 - RNA, 18 nt, Human
ucugccucugacacacag

SEQ ID NO: 1221497 - RNA, 15 nt, Human
ucugccucugacaca

SEQ ID NO: 1221498 - RNA, 21 nt, Human
uccuuaccagcagagcaccuu

SEQ ID NO: 1221499 - RNA, 23 nt, Human
uccuugaaaacacuguucucugc

SEQ ID NO: 1221500 - RNA, 22 nt, Human
uccuugaaaacacuguucucug

SEQ ID NO: 1221501 - RNA, 22 nt, Human
uccuuugugaggaagccgcugg

SEQ ID NO: 1221502 - RNA, 18 nt, Human
uccuuugugaggaagccg

SEQ ID NO: 1221503 - RNA, 17 nt, Human
uccuuugugaggaagcc

SEQ ID NO: 1221504 - RNA, 22 nt, Human
uccuuggugucgggcaugacac

SEQ ID NO: 1221505 - RNA, 21 nt, Human
uccuuggugucgggcaugaca

SEQ ID NO: 1221506 - RNA, 18 nt, Human
uccuuggugucgggcaug

SEQ ID NO: 1221507 - RNA, 18 nt, Human
ucggaaaacaugcuacac

SEQ ID NO: 1221508 - RNA, 15 nt, Human
ucggaaaacaugcua

SEQ ID NO: 1221509 - RNA, 23 nt, Human
ucgcccagucuggaaugcagugg

SEQ ID NO: 1221510 - RNA, 19 nt, Human
ucgcccagucuggaaugca

SEQ ID NO: 1221511 - RNA, 14 nt, Human
ucgcccagucugga

SEQ ID NO: 1221512 - RNA, 23 nt, Human
ucgcaggauucuuccucccuccc

SEQ ID NO: 1221513 - RNA, 21 nt, Human
ucgcaggauucuuccucccuc

SEQ ID NO: 1221514 - RNA, 17 nt, Human
ucgcaggauucuuccuc

SEQ ID NO: 1221515 - RNA, 22 nt, Human
uccuuuucgcaggauucuuccu

SEQ ID NO: 1221516 - RNA, 19 nt, Human
ucuagggaaaaaccagcgu

SEQ ID NO: 1221517 - RNA, 12 nt, Human
ucuagggaaaaa

SEQ ID NO: 1221518 - RNA, 18 nt, Human
ucuacucuagggaaaaac

SEQ ID NO: 1221519 - RNA, 21 nt, Human
ucuacucgaguuacagacaaa

SEQ ID NO: 1221520 - RNA, 20 nt, Human
ucuacucgaguuacagacaa

SEQ ID NO: 1221521 - RNA, 17 nt, Human
ucucacuguugcccagg

SEQ ID NO: 1221522 - RNA, 15 nt, Human
ucucacuguugccca

SEQ ID NO: 1221523 - RNA, 14 nt, Human
ucucacuguugccc

SEQ ID NO: 1221524 - RNA, 16 nt, Human
ucucacacaugagcau

SEQ ID NO: 1221525 - RNA, 18 nt, Human
ucucaaauuucuaaaucu

SEQ ID NO: 1221526 - RNA, 23 nt, Human
ucucacucugucgcccagucugg

SEQ ID NO: 1221527 - RNA, 21 nt, Human
ucucacacaugagcaucaggc

SEQ ID NO: 1221528 - RNA, 20 nt, Human
ucucacugccaugccagcuu

SEQ ID NO: 1221529 - RNA, 23 nt, Human
ucucacacaugagcaucaggcca

SEQ ID NO: 1221530 - RNA, 16 nt, Human
ucucaaauuucuaaau

SEQ ID NO: 1221531 - RNA, 14 nt, Human
ucucaaauuucuaa

SEQ ID NO: 1221532 - RNA, 13 nt, Human
ucucaaauuucua

SEQ ID NO: 1221533 - RNA, 21 nt, Human
uccucuaggaggucucuaaga

SEQ ID NO: 1221534 - RNA, 21 nt, Human
uccuccuuuucacaguucucu

SEQ ID NO: 1221535 - RNA, 15 nt, Human
uccucuguacagagc

SEQ ID NO: 1221536 - RNA, 13 nt, Human
uccucuguacaga

SEQ ID NO: 1221537 - RNA, 15 nt, Human
uccucuggccugugu

SEQ ID NO: 1221538 - RNA, 19 nt, Human
uccugaggcugggcucccu

SEQ ID NO: 1221539 - RNA, 17 nt, Human
uccugaggcugggcucc

SEQ ID NO: 1221540 - RNA, 16 nt, Human
uccugaggcugggcuc

SEQ ID NO: 1221541 - RNA, 15 nt, Human
uccugaggcugggcu

SEQ ID NO: 1221542 - RNA, 12 nt, Human
uccugaggcugg

SEQ ID NO: 1221543 - RNA, 19 nt, Human
uccugagccagauuucacu

SEQ ID NO: 1221544 - RNA, 18 nt, Human
uccugagccagauuucac

SEQ ID NO: 1221545 - RNA, 21 nt, Human
uccugagccagauuucacucu

SEQ ID NO: 1221546 - RNA, 23 nt, Human
uccucuguacagagcccacgccc

SEQ ID NO: 1221547 - RNA, 17 nt, Human
uccugagccagauuuca

SEQ ID NO: 1221548 - RNA, 12 nt, Human
uccuccucagau

SEQ ID NO: 1221549 - RNA, 22 nt, Human
uccuccaggugcacaagcucca

SEQ ID NO: 1221550 - RNA, 20 nt, Human
uccuccaggugcacaagcuc

SEQ ID NO: 1221551 - RNA, 18 nt, Human
uccuccaggugcacaagc

SEQ ID NO: 1221552 - RNA, 14 nt, Human
uccuccaggugcac

SEQ ID NO: 1221553 - RNA, 13 nt, Human
uccuccaggugca

SEQ ID NO: 1221554 - RNA, 12 nt, Human
uccuccaggugc

SEQ ID NO: 1221555 - RNA, 17 nt, Human
uccuaguuccaccauca

SEQ ID NO: 1221556 - RNA, 14 nt, Human
uccuaguuccacca

SEQ ID NO: 1221557 - RNA, 18 nt, Human
uccuaagcuauucaguaa

SEQ ID NO: 1221558 - RNA, 16 nt, Human
uccuaagcuauucagu

SEQ ID NO: 1221559 - RNA, 22 nt, Human
uccuaguuccaccaucaagcca

SEQ ID NO: 1221560 - RNA, 21 nt, Human
uccuaguuccaccaucaagcc

SEQ ID NO: 1221561 - RNA, 22 nt, Human
ucccaugagccucagcauccug

SEQ ID NO: 1221562 - RNA, 17 nt, Human
ucccaugagccucagca

SEQ ID NO: 1221563 - RNA, 18 nt, Human
ucccucccuuccucuuuc

SEQ ID NO: 1221564 - RNA, 16 nt, Human
ucccugccaauggacu

SEQ ID NO: 1221565 - RNA, 14 nt, Human
ucccugccaaugga

SEQ ID NO: 1221566 - RNA, 17 nt, Human
ucccucuggggcuguuc

SEQ ID NO: 1221567 - RNA, 13 nt, Human
ucccucuggggcu

SEQ ID NO: 1221568 - RNA, 21 nt, Human
uccgcuuucuacccagcgagc

SEQ ID NO: 1221569 - RNA, 22 nt, Human
uccgaaagggacuuggaagcuc

SEQ ID NO: 1221570 - RNA, 21 nt, Human
uccgaaagggacuuggaagcu

SEQ ID NO: 1221571 - RNA, 21 nt, Human
ucccuucccacuggaggcaug

SEQ ID NO: 1221572 - RNA, 17 nt, Human
ucccuucccaccucucu

SEQ ID NO: 1221573 - RNA, 16 nt, Human
ucccuucccaccucuc

SEQ ID NO: 1221574 - RNA, 18 nt, Human
ucccaacucaccccagcc

SEQ ID NO: 1221575 - RNA, 13 nt, Human
ucccaacucaccc

SEQ ID NO: 1221576 - RNA, 21 nt, Human
ucccaacucaccccagcccca

SEQ ID NO: 1221577 - RNA, 19 nt, Human
ucccaacucaccccagccc

SEQ ID NO: 1221578 - RNA, 20 nt, Human
uccauagagagcaagacgcu

SEQ ID NO: 1221579 - RNA, 17 nt, Human
uccauagagagcaagac

SEQ ID NO: 1221580 - RNA, 14 nt, Human
ucccacucagucca

SEQ ID NO: 1221581 - RNA, 21 nt, Human
ucccaccuuggcugcagggag

SEQ ID NO: 1221582 - RNA, 19 nt, Human
ucccaccuuggcugcaggg

SEQ ID NO: 1221583 - RNA, 20 nt, Human
ucccaccucucucacuccuu

SEQ ID NO: 1221584 - RNA, 18 nt, Human
ucccaccucucucacucc

SEQ ID NO: 1221585 - RNA, 17 nt, Human
ucccaccucucucacuc

SEQ ID NO: 1221586 - RNA, 14 nt, Human
ucccaccucucuca

SEQ ID NO: 1221587 - RNA, 18 nt, Human
ucccaccucagccucccg

SEQ ID NO: 1221588 - RNA, 18 nt, Human
ucccaggcauuccccagg

SEQ ID NO: 1221589 - RNA, 17 nt, Human
ucccaggcauuccccag

SEQ ID NO: 1221590 - RNA, 16 nt, Human
ucccaugagccucagc

SEQ ID NO: 1221591 - RNA, 15 nt, Human
ucccaugagccucag

SEQ ID NO: 1221592 - RNA, 19 nt, Human
ucccaggcauuccccagga

SEQ ID NO: 1221593 - RNA, 19 nt, Human
uccacuuucuagccagagg

SEQ ID NO: 1221594 - RNA, 14 nt, Human
uccacuuucuagcc

SEQ ID NO: 1221595 - RNA, 21 nt, Human
uccacccugcucuccgaccag

SEQ ID NO: 1221596 - RNA, 14 nt, Human
uccacccugcucuc

SEQ ID NO: 1221597 - RNA, 22 nt, Human
uccacugugccaugugccaggu

SEQ ID NO: 1221598 - RNA, 20 nt, Human
uccaagaccuucuccuucac

SEQ ID NO: 1221599 - RNA, 19 nt, Human
uccaagaagcccaggaaag

SEQ ID NO: 1221600 - RNA, 22 nt, Human
uccaagcaggacauggacaagg

SEQ ID NO: 1221601 - RNA, 14 nt, Human
uccaagcaggacau

SEQ ID NO: 1221602 - RNA, 16 nt, Human
uccaagaagcccagga

SEQ ID NO: 1221603 - RNA, 15 nt, Human
uccaagaagcccagg

SEQ ID NO: 1221604 - RNA, 14 nt, Human
uccaagaagcccag

SEQ ID NO: 1221605 - RNA, 21 nt, Human
uccacaagagcccaggccucc

SEQ ID NO: 1221606 - RNA, 20 nt, Human
uccacaagagcccaggccuc

SEQ ID NO: 1221607 - RNA, 15 nt, Human
ucagaucucuaacuu

SEQ ID NO: 1221608 - RNA, 13 nt, Human
ucagccucccaaa

SEQ ID NO: 1221609 - RNA, 12 nt, Human
ucagccucccaa

SEQ ID NO: 1221610 - RNA, 18 nt, Human
ucagcauccuggcacccg

SEQ ID NO: 1221611 - RNA, 17 nt, Human
ucagcauccuggcaccc

SEQ ID NO: 1221612 - RNA, 16 nt, Human
ucagcauccuggcacc

SEQ ID NO: 1221613 - RNA, 15 nt, Human
ucagcauccuggcac

SEQ ID NO: 1221614 - RNA, 18 nt, Human
ucagcacgauuucuguuu

SEQ ID NO: 1221615 - RNA, 17 nt, Human
ucagcacgauuucuguu

SEQ ID NO: 1221616 - RNA, 16 nt, Human
ucagcacgauuucugu

SEQ ID NO: 1221617 - RNA, 15 nt, Human
ucagcacgauuucug

SEQ ID NO: 1221618 - RNA, 22 nt, Human
ucagccucccaaagugcuggga

SEQ ID NO: 1221619 - RNA, 20 nt, Human
ucagccucccgaauagcugg

SEQ ID NO: 1221620 - RNA, 12 nt, Human
ucagccucccga

SEQ ID NO: 1221621 - RNA, 16 nt, Human
ucagccugcuccagcu

SEQ ID NO: 1221622 - RNA, 22 nt, Human
ucagcuccagcucaccagcccc

SEQ ID NO: 1221623 - RNA, 21 nt, Human
ucagcuccagcucaccagccc

SEQ ID NO: 1221624 - RNA, 18 nt, Human
ucagcuccagcucaccag

SEQ ID NO: 1221625 - RNA, 15 nt, Human
ucagcugcuacuacu

SEQ ID NO: 1221626 - RNA, 14 nt, Human
ucaucauccuaagc

SEQ ID NO: 1221627 - RNA, 18 nt, Human
ucagugugacugaucucu

SEQ ID NO: 1221628 - RNA, 19 nt, Human
ucagucugauucccaagcu

SEQ ID NO: 1221629 - RNA, 17 nt, Human
ucagucugauucccaag

SEQ ID NO: 1221630 - RNA, 17 nt, Human
ucagguggggcagcuug

SEQ ID NO: 1221631 - RNA, 16 nt, Human
ucagguggggcagcuu

SEQ ID NO: 1221632 - RNA, 15 nt, Human
ucagguggggcagcu

SEQ ID NO: 1221633 - RNA, 14 nt, Human
ucagguggggcagc

SEQ ID NO: 1221634 - RNA, 20 nt, Human
ucaggugcugccauccaggu

SEQ ID NO: 1221635 - RNA, 18 nt, Human
ucaggugcugccauccag

SEQ ID NO: 1221636 - RNA, 21 nt, Human
ucagguggggucacucuggca

SEQ ID NO: 1221637 - RNA, 20 nt, Human
ucagguggggucacucuggc

SEQ ID NO: 1221638 - RNA, 17 nt, Human
ucagguggggucacucu

SEQ ID NO: 1221639 - RNA, 15 nt, Human
ucaguccauagcaga

SEQ ID NO: 1221640 - RNA, 20 nt, Human
uaucaggugcugccauccag

SEQ ID NO: 1221641 - RNA, 19 nt, Human
uaucaggugcugccaucca

SEQ ID NO: 1221642 - RNA, 21 nt, Human
uaguuugauuaaauucuugca

SEQ ID NO: 1221643 - RNA, 16 nt, Human
uaguuugauuaaauuc

SEQ ID NO: 1221644 - RNA, 15 nt, Human
uaguuugauuaaauu

SEQ ID NO: 1221645 - RNA, 11 nt, Human
uauaaacuuua

SEQ ID NO: 1221646 - RNA, 14 nt, Human
uauaaacuuuaccu

SEQ ID NO: 1221647 - RNA, 13 nt, Human
uauaaacuuuacc

SEQ ID NO: 1221648 - RNA, 18 nt, Human
uauaaacuuuaccuuuuu

SEQ ID NO: 1221649 - RNA, 17 nt, Human
uauaaacuuuaccuuuu

SEQ ID NO: 1221650 - RNA, 16 nt, Human
uauaaacuuuaccuuu

SEQ ID NO: 1221651 - RNA, 15 nt, Human
uauaaacuuuaccuu

SEQ ID NO: 1221652 - RNA, 16 nt, Human
uaguaugguggcuggg

SEQ ID NO: 1221653 - RNA, 20 nt, Human
uaguggcuuaaaacaacacu

SEQ ID NO: 1221654 - RNA, 22 nt, Human
uaguuguuugauucagacagcu

SEQ ID NO: 1221655 - RNA, 21 nt, Human
uaguuguuugauucagacagc

SEQ ID NO: 1221656 - RNA, 20 nt, Human
uaguuguuugauucagacag

SEQ ID NO: 1221657 - RNA, 16 nt, Human
uaggugacagagugag

SEQ ID NO: 1221658 - RNA, 11 nt, Human
uaggugacaga

SEQ ID NO: 1221659 - RNA, 11 nt, Human
uagggaaaaac

SEQ ID NO: 1221660 - RNA, 22 nt, Human
uagcuggucuuauuuguaaagc

SEQ ID NO: 1221661 - RNA, 23 nt, Human
uaggugugacugaauuucuuuug

SEQ ID NO: 1221662 - RNA, 21 nt, Human
uaggugugacugaauuucuuu

SEQ ID NO: 1221663 - RNA, 19 nt, Human
uaggugugacugaauuucu

SEQ ID NO: 1221664 - RNA, 17 nt, Human
uaggugugggggaagca

SEQ ID NO: 1221665 - RNA, 13 nt, Human
uagguguggggga

SEQ ID NO: 1221666 - RNA, 18 nt, Human
uaguaugaggcauuuguu

SEQ ID NO: 1221667 - RNA, 17 nt, Human
uaguaugaggcauuugu

SEQ ID NO: 1221668 - RNA, 19 nt, Human
uagcauacguacacauuuu

SEQ ID NO: 1221669 - RNA, 18 nt, Human
uagcauacguacacauuu

SEQ ID NO: 1221670 - RNA, 17 nt, Human
uagcauacguacacauu

SEQ ID NO: 1221671 - RNA, 11 nt, Human
uagcagggaaa

SEQ ID NO: 1221672 - RNA, 16 nt, Human
uagauacuguaucaug

SEQ ID NO: 1221673 - RNA, 16 nt, Human
uagccuaggugacaga

SEQ ID NO: 1221674 - RNA, 12 nt, Human
uagcucauucuc

SEQ ID NO: 1221675 - RNA, 21 nt, Human
uagcucaggugucccugcacu

SEQ ID NO: 1221676 - RNA, 20 nt, Human
uagcucaggugucccugcac

SEQ ID NO: 1221677 - RNA, 20 nt, Human
uagccugugccucugggacu

SEQ ID NO: 1221678 - RNA, 18 nt, Human
uagccugugccucuggga

SEQ ID NO: 1221679 - RNA, 19 nt, Human
uagcugggacuacaggcac

SEQ ID NO: 1221680 - RNA, 17 nt, Human
uagcugggacuacaggc

SEQ ID NO: 1221681 - RNA, 15 nt, Human
uagcugggacuacag

SEQ ID NO: 1221682 - RNA, 22 nt, Human
uagcucauucuccuuguguuac

SEQ ID NO: 1221683 - RNA, 14 nt, Human
uacuuguggacaca

SEQ ID NO: 1221684 - RNA, 23 nt, Human
uagaauuaguggcacuugcuuuu

SEQ ID NO: 1221685 - RNA, 17 nt, Human
uagaguugauacuacag

SEQ ID NO: 1221686 - RNA, 14 nt, Human
uagaguugauacua

SEQ ID NO: 1221687 - RNA, 12 nt, Human
uagagugggagc

SEQ ID NO: 1221688 - RNA, 16 nt, Human
uagagguucaaagaua

SEQ ID NO: 1221689 - RNA, 15 nt, Human
uagagguucaaagau

SEQ ID NO: 1221690 - RNA, 14 nt, Human
uagagguucaaaga

SEQ ID NO: 1221691 - RNA, 11 nt, Human
uagagacaggg

SEQ ID NO: 1221692 - RNA, 14 nt, Human
uacauuuuuaagug

SEQ ID NO: 1221693 - RNA, 22 nt, Human
uacauuuuuaagugcugcauuu

SEQ ID NO: 1221694 - RNA, 19 nt, Human
uacauuuuuaagugcugca

SEQ ID NO: 1221695 - RNA, 22 nt, Human
uacauggaauaacauguaauua

SEQ ID NO: 1221696 - RNA, 19 nt, Human
uacauggaauaacauguaa

SEQ ID NO: 1221697 - RNA, 18 nt, Human
uacauggaauaacaugua

SEQ ID NO: 1221698 - RNA, 14 nt, Human
uacauggaauaaca

SEQ ID NO: 1221699 - RNA, 23 nt, Human
uacaugaaaacacauuuuucuua

SEQ ID NO: 1221700 - RNA, 19 nt, Human
uacaugaaaacacauuuuu

SEQ ID NO: 1221701 - RNA, 18 nt, Human
uacaugaaaacacauuuu

SEQ ID NO: 1221702 - RNA, 17 nt, Human
uacaugaaaacacauuu

SEQ ID NO: 1221703 - RNA, 16 nt, Human
uacaugaaaacacauu

SEQ ID NO: 1221704 - RNA, 17 nt, Human
uacauaagauaaaugug

SEQ ID NO: 1221705 - RNA, 16 nt, Human
uacauaagauaaaugu

SEQ ID NO: 1221706 - RNA, 16 nt, Human
uacauaaacaaguccu

SEQ ID NO: 1221707 - RNA, 21 nt, Human
uacaguuuguuaguaugaggc

SEQ ID NO: 1221708 - RNA, 19 nt, Human
uacaguuuguuaguaugag

SEQ ID NO: 1221709 - RNA, 18 nt, Human
uacaguuuguuaguauga

SEQ ID NO: 1221710 - RNA, 20 nt, Human
uacaguugaaaaacagcuga

SEQ ID NO: 1221711 - RNA, 19 nt, Human
uacaguugaaaaacagcug

SEQ ID NO: 1221712 - RNA, 17 nt, Human
uacaguugaaaaacagc

SEQ ID NO: 1221713 - RNA, 21 nt, Human
uacagcuugaccgugaggcca

SEQ ID NO: 1221714 - RNA, 15 nt, Human
uacaggagugagcac

SEQ ID NO: 1221715 - RNA, 22 nt, Human
uacaggaaguacuggagaaaau

SEQ ID NO: 1221716 - RNA, 15 nt, Human
uacaggaaguacugg

SEQ ID NO: 1221717 - RNA, 14 nt, Human
uacaggaaguacug

SEQ ID NO: 1221718 - RNA, 13 nt, Human
uacaggaaguacu

SEQ ID NO: 1221719 - RNA, 18 nt, Human
uacaggaagguagaaaua

SEQ ID NO: 1221720 - RNA, 20 nt, Human
uacagcuugaccgugaggcc

SEQ ID NO: 1221721 - RNA, 20 nt, Human
uacacuguuucaaacuuuac

SEQ ID NO: 1221722 - RNA, 23 nt, Human
uacacugugcugagucugaaggc

SEQ ID NO: 1221723 - RNA, 22 nt, Human
uacacugugcugagucugaagg

SEQ ID NO: 1221724 - RNA, 16 nt, Human
uacacuuacacuuuau

SEQ ID NO: 1221725 - RNA, 22 nt, Human
uacacuguuucaaacuuuacua

SEQ ID NO: 1221726 - RNA, 21 nt, Human
uacacugugcugagucugaag

SEQ ID NO: 1221727 - RNA, 19 nt, Human
uacacauuuuauuuuauua

SEQ ID NO: 1221728 - RNA, 17 nt, Human
uacacacugcauguuug

SEQ ID NO: 1221729 - RNA, 15 nt, Human
uacacacugcauguu

SEQ ID NO: 1221730 - RNA, 11 nt, Human
uacacacacac

SEQ ID NO: 1221731 - RNA, 18 nt, Human
uacaaaguagaagucuua

SEQ ID NO: 1221732 - RNA, 14 nt, Human
uacaaaguagaagu

SEQ ID NO: 1221733 - RNA, 23 nt, Human
uacauuuuuaagugcugcauuua

SEQ ID NO: 1221734 - RNA, 16 nt, Human
uacccagcgagcccug

SEQ ID NO: 1221735 - RNA, 15 nt, Human
uaccuacauacaauu

SEQ ID NO: 1221736 - RNA, 21 nt, Human
uacuaauagacaauuuauuau

SEQ ID NO: 1221737 - RNA, 22 nt, Human
uacuaauaaaauuuaaaagucu

SEQ ID NO: 1221738 - RNA, 14 nt, Human
uacuaaggaaucuu

SEQ ID NO: 1221739 - RNA, 17 nt, Human
uacuaaccagcagaaau

SEQ ID NO: 1221740 - RNA, 21 nt, Human
uacgaaaagaggggaagagac

SEQ ID NO: 1221741 - RNA, 18 nt, Human
uacgaaaagaggggaaga

SEQ ID NO: 1221742 - RNA, 17 nt, Human
uaccuuuuuuauacaua

SEQ ID NO: 1221743 - RNA, 16 nt, Human
uaccuuuuuuauacau

SEQ ID NO: 1221744 - RNA, 13 nt, Human
uaccuuuuuuaua

SEQ ID NO: 1221745 - RNA, 21 nt, Human
uaccucuugagccuugaacuu

SEQ ID NO: 1221746 - RNA, 18 nt, Human
uaccucggugccuuccuc

SEQ ID NO: 1221747 - RNA, 22 nt, Human
uaccuuuuuuagaguugauacu

SEQ ID NO: 1221748 - RNA, 19 nt, Human
uaccuuuuuuagaguugau

SEQ ID NO: 1221749 - RNA, 13 nt, Human
uaccuuuuuuaga

SEQ ID NO: 1221750 - RNA, 21 nt, Human
uacugucuucaguaagccgug

SEQ ID NO: 1221751 - RNA, 16 nt, Human
uacuguccuacccacc

SEQ ID NO: 1221752 - RNA, 13 nt, Human
uacuuguggacac

SEQ ID NO: 1221753 - RNA, 16 nt, Human
uacucuacccucuuag

SEQ ID NO: 1221754 - RNA, 20 nt, Human
uacuacaguuuguuaguaug

SEQ ID NO: 1221755 - RNA, 14 nt, Human
uacuacaguuuguu

SEQ ID NO: 1221756 - RNA, 13 nt, Human
uacuacaguuugu

SEQ ID NO: 1221757 - RNA, 22 nt, Human
uacuacaguccucccaucucac

SEQ ID NO: 1221758 - RNA, 12 nt, Human
uacucccaucug

SEQ ID NO: 1221759 - RNA, 22 nt, Human
uacucgaguuacagacaaagcg

SEQ ID NO: 1221760 - RNA, 14 nt, Human
uaagugcugcauuu

SEQ ID NO: 1221761 - RNA, 23 nt, Human
uaagugaggaugaaaaaauaaca

SEQ ID NO: 1221762 - RNA, 12 nt, Human
uaagugagagag

SEQ ID NO: 1221763 - RNA, 22 nt, Human
uaagugcugcauuuaaaagaua

SEQ ID NO: 1221764 - RNA, 18 nt, Human
uaagugcugcauuuaaaa

SEQ ID NO: 1221765 - RNA, 16 nt, Human
uaagugcugcauuuaa

SEQ ID NO: 1221766 - RNA, 15 nt, Human
uaagugcugcauuua

SEQ ID NO: 1221767 - RNA, 14 nt, Human
uaagcuauucagua

SEQ ID NO: 1221768 - RNA, 22 nt, Human
uaagaggcagggucucacucug

SEQ ID NO: 1221769 - RNA, 15 nt, Human
uaagaggcagggucu

SEQ ID NO: 1221770 - RNA, 12 nt, Human
uaagaggcaggg

SEQ ID NO: 1221771 - RNA, 17 nt, Human
uaaggguaucuggugac

SEQ ID NO: 1221772 - RNA, 15 nt, Human
uaaggugugcucuga

SEQ ID NO: 1221773 - RNA, 20 nt, Human
uaagguggguacgggagggu

SEQ ID NO: 1221774 - RNA, 19 nt, Human
uaauaugcacacauuuuuu

SEQ ID NO: 1221775 - RNA, 18 nt, Human
uaauaugcacacauuuuu

SEQ ID NO: 1221776 - RNA, 17 nt, Human
uaauaugcacacauuuu

SEQ ID NO: 1221777 - RNA, 16 nt, Human
uaauaugcacacauuu

SEQ ID NO: 1221778 - RNA, 15 nt, Human
uaauaugcacacauu

SEQ ID NO: 1221779 - RNA, 13 nt, Human
uaaucuaaaugga

SEQ ID NO: 1221780 - RNA, 20 nt, Human
uaauccucuaggaggucucu

SEQ ID NO: 1221781 - RNA, 20 nt, Human
uaauauuaaggaagacaaug

SEQ ID NO: 1221782 - RNA, 15 nt, Human
uaauggggcggugag

SEQ ID NO: 1221783 - RNA, 23 nt, Human
uaaugcgugcauaccacuuuugu

SEQ ID NO: 1221784 - RNA, 22 nt, Human
uaaugcgugcauaccacuuuug

SEQ ID NO: 1221785 - RNA, 19 nt, Human
uaaugcgugcauaccacuu

SEQ ID NO: 1221786 - RNA, 15 nt, Human
uaaugcgugcauacc

SEQ ID NO: 1221787 - RNA, 20 nt, Human
uaauuaaguacuauguauca

SEQ ID NO: 1221788 - RNA, 17 nt, Human
uaauuaaguacuaugua

SEQ ID NO: 1221789 - RNA, 14 nt, Human
uaauuaaguacuau

SEQ ID NO: 1221790 - RNA, 18 nt, Human
uaacaccaugauuaacca

SEQ ID NO: 1221791 - RNA, 22 nt, Human
uaaauucuugcaaaguaucccu

SEQ ID NO: 1221792 - RNA, 18 nt, Human
uaaauucuugcaaaguau

SEQ ID NO: 1221793 - RNA, 17 nt, Human
uaaauucuugcaaagua

SEQ ID NO: 1221794 - RNA, 16 nt, Human
uaaauucuugcaaagu

SEQ ID NO: 1221795 - RNA, 22 nt, Human
uaaaugucucuuuaaugucaca

SEQ ID NO: 1221796 - RNA, 20 nt, Human
uaaaugucuaguuguaacac

SEQ ID NO: 1221797 - RNA, 19 nt, Human
uaaaugggggugcauuuga

SEQ ID NO: 1221798 - RNA, 18 nt, Human
uaaaugggggugcauuug

SEQ ID NO: 1221799 - RNA, 17 nt, Human
uaaaugggggugcauuu

SEQ ID NO: 1221800 - RNA, 14 nt, Human
uaaaugggggugca

SEQ ID NO: 1221801 - RNA, 16 nt, Human
uaaauggaaccacucu

SEQ ID NO: 1221802 - RNA, 17 nt, Human
uaaaugcccagccccuu

SEQ ID NO: 1221803 - RNA, 16 nt, Human
uaaaugcccagccccu

SEQ ID NO: 1221804 - RNA, 15 nt, Human
uaaaugcccagcccc

SEQ ID NO: 1221805 - RNA, 14 nt, Human
uaaaugcccagccc

SEQ ID NO: 1221806 - RNA, 13 nt, Human
uaaaugcccagcc

SEQ ID NO: 1221807 - RNA, 22 nt, Human
uaagaaccuuuugagugccuua

SEQ ID NO: 1221808 - RNA, 19 nt, Human
uaagaaccuuuugagugcc

SEQ ID NO: 1221809 - RNA, 24 nt, Human
uaagaaagacuaucuaaauguuga

SEQ ID NO: 1221810 - RNA, 23 nt, Human
uaagaaaaaggaugcacagaguu

SEQ ID NO: 1221811 - RNA, 19 nt, Human
uaagaaaaaggaugcacag

SEQ ID NO: 1221812 - RNA, 18 nt, Human
uaagaaaaaggaugcaca

SEQ ID NO: 1221813 - RNA, 16 nt, Human
uaagaaaaaggaugca

SEQ ID NO: 1221814 - RNA, 23 nt, Human
uaaccaguguuguggauuuaaca

SEQ ID NO: 1221815 - RNA, 16 nt, Human
uaaccacuucagcuga

SEQ ID NO: 1221816 - RNA, 12 nt, Human
uaacagaaaugu

SEQ ID NO: 1221817 - RNA, 11 nt, Human
uaacagaaaug

SEQ ID NO: 1221818 - RNA, 15 nt, Human
guuuagauaauacac

SEQ ID NO: 1221819 - RNA, 14 nt, Human
guuuagauaauaca

SEQ ID NO: 1221820 - RNA, 20 nt, Human
guuguuugauucagacagcu

SEQ ID NO: 1221821 - RNA, 15 nt, Human
guuguuacauuuuua

SEQ ID NO: 1221822 - RNA, 14 nt, Human
guuguuacauuuuu

SEQ ID NO: 1221823 - RNA, 14 nt, Human
guugugguuaaucu

SEQ ID NO: 1221824 - RNA, 22 nt, Human
guuguggauuuaacagaaaugu

SEQ ID NO: 1221825 - RNA, 12 nt, Human
guugucagcuga

SEQ ID NO: 1221826 - RNA, 23 nt, Human
guuggcugggggccucagugcca

SEQ ID NO: 1221827 - RNA, 19 nt, Human
guuggcugggggccucagu

SEQ ID NO: 1221828 - RNA, 20 nt, Human
guuggccccugcccggcugc

SEQ ID NO: 1221829 - RNA, 14 nt, Human
guuggccccugccc

SEQ ID NO: 1221830 - RNA, 13 nt, Human
guuggccccugcc

SEQ ID NO: 1221831 - RNA, 12 nt, Human
guuggcuggggg

SEQ ID NO: 1221832 - RNA, 12 nt, Human
guuuucacucuu

SEQ ID NO: 1221833 - RNA, 11 nt, Human
guuuucacucu

SEQ ID NO: 1221834 - RNA, 17 nt, Human
guuuucaaaauaaaaau

SEQ ID NO: 1221835 - RNA, 20 nt, Human
guuuguuucugaaagggacg

SEQ ID NO: 1221836 - RNA, 13 nt, Human
guuuuccugaaga

SEQ ID NO: 1221837 - RNA, 20 nt, Human
guuuuccaugaguccccugu

SEQ ID NO: 1221838 - RNA, 19 nt, Human
guuuuccaugaguccccug

SEQ ID NO: 1221839 - RNA, 18 nt, Human
guuugagaucagccuggg

SEQ ID NO: 1221840 - RNA, 17 nt, Human
guuugagaucagccugg

SEQ ID NO: 1221841 - RNA, 21 nt, Human
guuugauucagacagcugccu

SEQ ID NO: 1221842 - RNA, 20 nt, Human
guuugauucagacagcugcc

SEQ ID NO: 1221843 - RNA, 16 nt, Human
guuugauucagacagc

SEQ ID NO: 1221844 - RNA, 14 nt, Human
uaaaagauacaguu

SEQ ID NO: 1221845 - RNA, 20 nt, Human
uaaaagauacaguuacucag

SEQ ID NO: 1221846 - RNA, 17 nt, Human
uaaaagauacaguuacu

SEQ ID NO: 1221847 - RNA, 21 nt, Human
uaaaagauacaguuacucaga

SEQ ID NO: 1221848 - RNA, 19 nt, Human
uaaaaggugaccaaugaug

SEQ ID NO: 1221849 - RNA, 12 nt, Human
uaaaaggugacc

SEQ ID NO: 1221850 - RNA, 21 nt, Human
uaaaagguaugcaaucaaauc

SEQ ID NO: 1221851 - RNA, 12 nt, Human
uaaaaggagcca

SEQ ID NO: 1221852 - RNA, 15 nt, Human
uaaaacaacacucac

SEQ ID NO: 1221853 - RNA, 23 nt, Human
uaaaacacaacaucuuuuucuac

SEQ ID NO: 1221854 - RNA, 22 nt, Human
uaaaacacaacaucuuuuucua

SEQ ID NO: 1221855 - RNA, 17 nt, Human
uaaaacacaacaucuuu

SEQ ID NO: 1221856 - RNA, 15 nt, Human
uaaaggcuaccuuug

SEQ ID NO: 1221857 - RNA, 20 nt, Human
uaaagccugaguuugcuuuc

SEQ ID NO: 1221858 - RNA, 17 nt, Human
uaaaggcuaccuuugua

SEQ ID NO: 1221859 - RNA, 19 nt, Human
uaaagcagcguuucuauga

SEQ ID NO: 1221860 - RNA, 17 nt, Human
uaaagcagcguuucuau

SEQ ID NO: 1221861 - RNA, 16 nt, Human
uaaagcagcguuucua

SEQ ID NO: 1221862 - RNA, 12 nt, Human
uaaagaaaacug

SEQ ID NO: 1221863 - RNA, 22 nt, Human
uaaacuugguuuuuaaaaaacu

SEQ ID NO: 1221864 - RNA, 13 nt, Human
uaaacuuaaucua

SEQ ID NO: 1221865 - RNA, 23 nt, Human
uaaacaagaccacguuucuaaag

SEQ ID NO: 1221866 - RNA, 22 nt, Human
uaaacaagaccacguuucuaaa

SEQ ID NO: 1221867 - RNA, 21 nt, Human
uaaacaagaccacguuucuaa

SEQ ID NO: 1221868 - RNA, 20 nt, Human
uaaacaagaccacguuucua

SEQ ID NO: 1221869 - RNA, 19 nt, Human
guucugauccuaguuccac

SEQ ID NO: 1221870 - RNA, 18 nt, Human
guucuuucacccuuuucu

SEQ ID NO: 1221871 - RNA, 23 nt, Human
guucugggacacaguucaauucu

SEQ ID NO: 1221872 - RNA, 16 nt, Human
guucugggacacaguu

SEQ ID NO: 1221873 - RNA, 15 nt, Human
guucugggacacagu

SEQ ID NO: 1221874 - RNA, 14 nt, Human
guucugggacacag

SEQ ID NO: 1221875 - RNA, 12 nt, Human
guucugggacac

SEQ ID NO: 1221876 - RNA, 11 nt, Human
guucugggaca

SEQ ID NO: 1221877 - RNA, 20 nt, Human
guucuggcucuuccaggcug

SEQ ID NO: 1221878 - RNA, 16 nt, Human
guucuggcucuuccag

SEQ ID NO: 1221879 - RNA, 12 nt, Human
guucuggcucuu

SEQ ID NO: 1221880 - RNA, 23 nt, Human
guucuggcagaguugaagacaga

SEQ ID NO: 1221881 - RNA, 17 nt, Human
guugaaaaacagcugag

SEQ ID NO: 1221882 - RNA, 20 nt, Human
guucuuuccaaaguacacug

SEQ ID NO: 1221883 - RNA, 18 nt, Human
guucuuuccaaaguacac

SEQ ID NO: 1221884 - RNA, 14 nt, Human
guucuuuccaaagu

SEQ ID NO: 1221885 - RNA, 13 nt, Human
guucuuuccaaag

SEQ ID NO: 1221886 - RNA, 16 nt, Human
guugaagacagagcua

SEQ ID NO: 1221887 - RNA, 15 nt, Human
guugcaggaccucag

SEQ ID NO: 1221888 - RNA, 15 nt, Human
guugcccaggcaggu

SEQ ID NO: 1221889 - RNA, 14 nt, Human
guugcccaggcagg

SEQ ID NO: 1221890 - RNA, 12 nt, Human
guugcccaggca

SEQ ID NO: 1221891 - RNA, 23 nt, Human
guugccagucaccccggccaccu

SEQ ID NO: 1221892 - RNA, 18 nt, Human
guugccagucaccccggc

SEQ ID NO: 1221893 - RNA, 17 nt, Human
guugccagucaccccgg

SEQ ID NO: 1221894 - RNA, 16 nt, Human
guugccagucaccccg

SEQ ID NO: 1221895 - RNA, 14 nt, Human
guugccagucaccc

SEQ ID NO: 1221896 - RNA, 13 nt, Human
guugccagucacc

SEQ ID NO: 1221897 - RNA, 23 nt, Human
guuggccaaagccaaagcuaggc

SEQ ID NO: 1221898 - RNA, 18 nt, Human
guuggcaaaaaggcagga

SEQ ID NO: 1221899 - RNA, 14 nt, Human
guuggcaaaaaggc

SEQ ID NO: 1221900 - RNA, 14 nt, Human
guuggccaguguga

SEQ ID NO: 1221901 - RNA, 19 nt, Human
guuggccaggcuggucuca

SEQ ID NO: 1221902 - RNA, 17 nt, Human
guuggccaggcuggucu

SEQ ID NO: 1221903 - RNA, 15 nt, Human
guuggccaggcuggu

SEQ ID NO: 1221904 - RNA, 14 nt, Human
guuggccaggcugg

SEQ ID NO: 1221905 - RNA, 13 nt, Human
guuggccaggcug

SEQ ID NO: 1221906 - RNA, 23 nt, Human
guuaccauuuugggguacccacu

SEQ ID NO: 1221907 - RNA, 21 nt, Human
guuacauuuuuaagugcugca

SEQ ID NO: 1221908 - RNA, 19 nt, Human
guuacauaagauaaaugug

SEQ ID NO: 1221909 - RNA, 18 nt, Human
guuacauaagauaaaugu

SEQ ID NO: 1221910 - RNA, 17 nt, Human
guuacagacaaagcgug

SEQ ID NO: 1221911 - RNA, 15 nt, Human
guuacagacaaagcg

SEQ ID NO: 1221912 - RNA, 22 nt, Human
guuaguuucuccaagcaggaca

SEQ ID NO: 1221913 - RNA, 19 nt, Human
guuaguuucuccaagcagg

SEQ ID NO: 1221914 - RNA, 16 nt, Human
guuaguuucuccaagc

SEQ ID NO: 1221915 - RNA, 22 nt, Human
guuacuaaguuuuuauggcuuu

SEQ ID NO: 1221916 - RNA, 15 nt, Human
guuacucagaauucu

SEQ ID NO: 1221917 - RNA, 21 nt, Human
guuaugacuccagaauuuccc

SEQ ID NO: 1221918 - RNA, 19 nt, Human
guuauuaaaaaucucaaau

SEQ ID NO: 1221919 - RNA, 19 nt, Human
guucaagcgauucuucugc

SEQ ID NO: 1221920 - RNA, 23 nt, Human
guucaauucucauuugucacaca

SEQ ID NO: 1221921 - RNA, 16 nt, Human
guucaauucucauuug

SEQ ID NO: 1221922 - RNA, 20 nt, Human
guucaagcgauucuucugcu

SEQ ID NO: 1221923 - RNA, 19 nt, Human
guucacugcaaccuccgcc

SEQ ID NO: 1221924 - RNA, 18 nt, Human
guucaucuugaauuguaa

SEQ ID NO: 1221925 - RNA, 13 nt, Human
guucaucuugaau

SEQ ID NO: 1221926 - RNA, 12 nt, Human
guucaucuugaa

SEQ ID NO: 1221927 - RNA, 17 nt, Human
guucaucauccuaagcu

SEQ ID NO: 1221928 - RNA, 20 nt, Human
guuccaccaucaagccacca

SEQ ID NO: 1221929 - RNA, 17 nt, Human
guuccaccaucaagcca

SEQ ID NO: 1221930 - RNA, 14 nt, Human
guuccuaauccucu

SEQ ID NO: 1221931 - RNA, 22 nt, Human
guuccucauuagcauuuugcua

SEQ ID NO: 1221932 - RNA, 21 nt, Human
guguggagaagcggcuggcag

SEQ ID NO: 1221933 - RNA, 13 nt, Human
guguggagaagcg

SEQ ID NO: 1221934 - RNA, 22 nt, Human
gugugcucugaucauccacugu

SEQ ID NO: 1221935 - RNA, 15 nt, Human
gugugcucugaucau

SEQ ID NO: 1221936 - RNA, 12 nt, Human
gugugcucugau

SEQ ID NO: 1221937 - RNA, 22 nt, Human
gugucucuugguccugcugcag

SEQ ID NO: 1221938 - RNA, 21 nt, Human
gugucucuugguccugcugca

SEQ ID NO: 1221939 - RNA, 20 nt, Human
gugucucuugguccugcugc

SEQ ID NO: 1221940 - RNA, 19 nt, Human
gugucucuugguccugcug

SEQ ID NO: 1221941 - RNA, 18 nt, Human
gugucucuugguccugcu

SEQ ID NO: 1221942 - RNA, 15 nt, Human
gugucgggcaugaca

SEQ ID NO: 1221943 - RNA, 14 nt, Human
guguccggucccug

SEQ ID NO: 1221944 - RNA, 23 nt, Human
gugucccugcacuugcagacucu

SEQ ID NO: 1221945 - RNA, 14 nt, Human
gugucucuuggucc

SEQ ID NO: 1221946 - RNA, 17 nt, Human
gugucucccuucauccu

SEQ ID NO: 1221947 - RNA, 22 nt, Human
guuaaaauaccagccaguaaau

SEQ ID NO: 1221948 - RNA, 13 nt, Human
guuacagacaaag

SEQ ID NO: 1221949 - RNA, 16 nt, Human
guuacacuaaaaggug

SEQ ID NO: 1221950 - RNA, 15 nt, Human
guuacacuaaaaggu

SEQ ID NO: 1221951 - RNA, 18 nt, Human
guguuaugacuccagaau

SEQ ID NO: 1221952 - RNA, 14 nt, Human
guguuacuaaguuu

SEQ ID NO: 1221953 - RNA, 12 nt, Human
guguuacuaagu

SEQ ID NO: 1221954 - RNA, 17 nt, Human
guguacauggaauaaca

SEQ ID NO: 1221955 - RNA, 22 nt, Human
guguacauggaauaacauguaa

SEQ ID NO: 1221956 - RNA, 18 nt, Human
gugucccugcacuugcag

SEQ ID NO: 1221957 - RNA, 16 nt, Human
gugucccugcacuugc

SEQ ID NO: 1221958 - RNA, 13 nt, Human
gugucccugcacu

SEQ ID NO: 1221959 - RNA, 19 nt, Human
guggugcgaucuggguuca

SEQ ID NO: 1221960 - RNA, 21 nt, Human
guguaaguauucuuauuuaau

SEQ ID NO: 1221961 - RNA, 21 nt, Human
guggugagaggcauccaguau

SEQ ID NO: 1221962 - RNA, 17 nt, Human
guggugaccucugccug

SEQ ID NO: 1221963 - RNA, 14 nt, Human
guggugaccucugc

SEQ ID NO: 1221964 - RNA, 18 nt, Human
gugguccuaaucuucuga

SEQ ID NO: 1221965 - RNA, 17 nt, Human
guggucccaccccacac

SEQ ID NO: 1221966 - RNA, 16 nt, Human
guggucccaccccaca

SEQ ID NO: 1221967 - RNA, 15 nt, Human
guggucccaccccac

SEQ ID NO: 1221968 - RNA, 14 nt, Human
guggucccacccca

SEQ ID NO: 1221969 - RNA, 17 nt, Human
gugguagagugugccug

SEQ ID NO: 1221970 - RNA, 19 nt, Human
gugguaugaucacggcuca

SEQ ID NO: 1221971 - RNA, 18 nt, Human
guggggaccucaggccug

SEQ ID NO: 1221972 - RNA, 15 nt, Human
guggggaccucaggc

SEQ ID NO: 1221973 - RNA, 17 nt, Human
guggggcagcuugaggg

SEQ ID NO: 1221974 - RNA, 13 nt, Human
guggggcagcuug

SEQ ID NO: 1221975 - RNA, 23 nt, Human
guggguuucuaaagcugccagcc

SEQ ID NO: 1221976 - RNA, 17 nt, Human
gugggcccaaugcacuu

SEQ ID NO: 1221977 - RNA, 15 nt, Human
gugggcuaguugggc

SEQ ID NO: 1221978 - RNA, 23 nt, Human
guggcugcuucaaggauccugag

SEQ ID NO: 1221979 - RNA, 19 nt, Human
guggcuggguuggagggug

SEQ ID NO: 1221980 - RNA, 22 nt, Human
guggcugcuucaaggauccuga

SEQ ID NO: 1221981 - RNA, 19 nt, Human
guggcugcuucaaggaucc

SEQ ID NO: 1221982 - RNA, 16 nt, Human
guggcugcuucaagga

SEQ ID NO: 1221983 - RNA, 15 nt, Human
guggcugcuucaagg

SEQ ID NO: 1221984 - RNA, 22 nt, Human
guggcuuaaaacaacacucaca

SEQ ID NO: 1221985 - RNA, 14 nt, Human
guggcugcuucaag

SEQ ID NO: 1221986 - RNA, 12 nt, Human
guggcugcuuca

SEQ ID NO: 1221987 - RNA, 14 nt, Human
guggcucacgccug

SEQ ID NO: 1221988 - RNA, 18 nt, Human
gugauuuuuguaauuuuu

SEQ ID NO: 1221989 - RNA, 13 nt, Human
gugauuuuuguaa

SEQ ID NO: 1221990 - RNA, 12 nt, Human
gugauuuucauu

SEQ ID NO: 1221991 - RNA, 24 nt, Human
gugauccacccaccucagccuccc

SEQ ID NO: 1221992 - RNA, 23 nt, Human
gugauccacccaccucagccucc

SEQ ID NO: 1221993 - RNA, 23 nt, Human
gugcaguggugcgaucuggguuc

SEQ ID NO: 1221994 - RNA, 20 nt, Human
gugcaguggugcgaucuggg

SEQ ID NO: 1221995 - RNA, 22 nt, Human
gugcauaccacuuuuguucuug

SEQ ID NO: 1221996 - RNA, 20 nt, Human
gugccagguuuuuggucuga

SEQ ID NO: 1221997 - RNA, 16 nt, Human
gugccaugugccaggu

SEQ ID NO: 1221998 - RNA, 14 nt, Human
gugccaugugccag

SEQ ID NO: 1221999 - RNA, 21 nt, Human
gugcgaucuggguucacugca

SEQ ID NO: 1222000 - RNA, 14 nt, Human
gugcggccuuuggc

SEQ ID NO: 1222001 - RNA, 14 nt, Human
gugcgccuacagga

SEQ ID NO: 1222002 - RNA, 17 nt, Human
gugaggaugaaaaaaua

SEQ ID NO: 1222003 - RNA, 19 nt, Human
gugagccgagaucacgcca

SEQ ID NO: 1222004 - RNA, 20 nt, Human
gugagccacugcaccgggcc

SEQ ID NO: 1222005 - RNA, 15 nt, Human
gugagccacugcacc

SEQ ID NO: 1222006 - RNA, 17 nt, Human
gugauacaaugcugugc

SEQ ID NO: 1222007 - RNA, 15 nt, Human
gugauacaaugcugu

SEQ ID NO: 1222008 - RNA, 17 nt, Human
gugaguugauagcacag

SEQ ID NO: 1222009 - RNA, 15 nt, Human
gugaccucugccuga

SEQ ID NO: 1222010 - RNA, 14 nt, Human
gugaccucugccug

SEQ ID NO: 1222011 - RNA, 13 nt, Human
gugaccucugccu

SEQ ID NO: 1222012 - RNA, 15 nt, Human
gugacagaggcagcc

SEQ ID NO: 1222013 - RNA, 14 nt, Human
gugacagaggcagc

SEQ ID NO: 1222014 - RNA, 13 nt, Human
gugacagaggcag

SEQ ID NO: 1222015 - RNA, 12 nt, Human
gugacagaggca

SEQ ID NO: 1222016 - RNA, 20 nt, Human
gugacaaggauugcuacugu

SEQ ID NO: 1222017 - RNA, 21 nt, Human
gugaaugaugauccuaggcau

SEQ ID NO: 1222018 - RNA, 17 nt, Human
gucuguucuuuccaaag

SEQ ID NO: 1222019 - RNA, 14 nt, Human
gucuguucuuucca

SEQ ID NO: 1222020 - RNA, 18 nt, Human
gucugugccauuuuguau

SEQ ID NO: 1222021 - RNA, 23 nt, Human
gucuugcaauggcagccuuggca

SEQ ID NO: 1222022 - RNA, 21 nt, Human
gucuugcaauggcagccuugg

SEQ ID NO: 1222023 - RNA, 20 nt, Human
gucuugcaauggcagccuug

SEQ ID NO: 1222024 - RNA, 19 nt, Human
gucuugcaauggcagccuu

SEQ ID NO: 1222025 - RNA, 18 nt, Human
gucuugcaauggcagccu

SEQ ID NO: 1222026 - RNA, 17 nt, Human
gucuugcaauggcagcc

SEQ ID NO: 1222027 - RNA, 16 nt, Human
gucuugcaauggcagc

SEQ ID NO: 1222028 - RNA, 21 nt, Human
gucuugaacuccuggccucaa

SEQ ID NO: 1222029 - RNA, 20 nt, Human
gucuugaacuccuggccuca

SEQ ID NO: 1222030 - RNA, 18 nt, Human
gucuugaacuccuggccu

SEQ ID NO: 1222031 - RNA, 17 nt, Human
gucuugaacuccuggcc

SEQ ID NO: 1222032 - RNA, 16 nt, Human
gucuugaacuccuggc

SEQ ID NO: 1222033 - RNA, 21 nt, Human
gucuuaaaaaguggaaaaaua

SEQ ID NO: 1222034 - RNA, 19 nt, Human
guccuuaccagcagagcac

SEQ ID NO: 1222035 - RNA, 21 nt, Human
guccuuaccagcagagcaccu

SEQ ID NO: 1222036 - RNA, 15 nt, Human
gucccugccaaugga

SEQ ID NO: 1222037 - RNA, 14 nt, Human
gucccugccaaugg

SEQ ID NO: 1222038 - RNA, 11 nt, Human
gucccugccaa

SEQ ID NO: 1222039 - RNA, 16 nt, Human
gucgggcaugacacga

SEQ ID NO: 1222040 - RNA, 21 nt, Human
gucggaaaacaugcuacacac

SEQ ID NO: 1222041 - RNA, 19 nt, Human
gucucacuauguugcccag

SEQ ID NO: 1222042 - RNA, 18 nt, Human
gucucacuauguugccca

SEQ ID NO: 1222043 - RNA, 19 nt, Human
gucucacucugucgcccag

SEQ ID NO: 1222044 - RNA, 18 nt, Human
gucucacucugucgccca

SEQ ID NO: 1222045 - RNA, 16 nt, Human
gucucacucugucgcc

SEQ ID NO: 1222046 - RNA, 15 nt, Human
gucucacucugucgc

SEQ ID NO: 1222047 - RNA, 22 nt, Human
gucucacucugucgcccagucu

SEQ ID NO: 1222048 - RNA, 13 nt, Human
gucucacuguugc

SEQ ID NO: 1222049 - RNA, 13 nt, Human
gucucuugguccu

SEQ ID NO: 1222050 - RNA, 16 nt, Human
gucccugcacuugcag

SEQ ID NO: 1222051 - RNA, 21 nt, Human
gucccugcacuugcagacucu

SEQ ID NO: 1222052 - RNA, 19 nt, Human
gucccugcacuugcagacu

SEQ ID NO: 1222053 - RNA, 17 nt, Human
guccccaccgcagacag

SEQ ID NO: 1222054 - RNA, 23 nt, Human
gucccaccuuggcugcagggagu

SEQ ID NO: 1222055 - RNA, 21 nt, Human
gucccaccuuggcugcaggga

SEQ ID NO: 1222056 - RNA, 23 nt, Human
guccacccaggagccccgaggcc

SEQ ID NO: 1222057 - RNA, 13 nt, Human
guccacccaggag

SEQ ID NO: 1222058 - RNA, 12 nt, Human
guccacccagga

SEQ ID NO: 1222059 - RNA, 14 nt, Human
guauuuuacuaaua

SEQ ID NO: 1222060 - RNA, 15 nt, Human
gucaagugaaaaagg

SEQ ID NO: 1222061 - RNA, 19 nt, Human
guauuuuguuuuugucuua

SEQ ID NO: 1222062 - RNA, 22 nt, Human
gucacucuggcagcucagagag

SEQ ID NO: 1222063 - RNA, 19 nt, Human
gucacucuggcagcucaga

SEQ ID NO: 1222064 - RNA, 17 nt, Human
gucacucuggcagcuca

SEQ ID NO: 1222065 - RNA, 16 nt, Human
gucacucuggcagcuc

SEQ ID NO: 1222066 - RNA, 14 nt, Human
gucacucuggcagc

SEQ ID NO: 1222067 - RNA, 13 nt, Human
gucacucuggcag

SEQ ID NO: 1222068 - RNA, 12 nt, Human
gucacucuggca

SEQ ID NO: 1222069 - RNA, 22 nt, Human
gucaccccggccaccugcggug

SEQ ID NO: 1222070 - RNA, 18 nt, Human
gucaccccggccaccugc

SEQ ID NO: 1222071 - RNA, 17 nt, Human
gucaccccggccaccug

SEQ ID NO: 1222072 - RNA, 16 nt, Human
gucagagccugcaguu

SEQ ID NO: 1222073 - RNA, 15 nt, Human
gucagagccugcagu

SEQ ID NO: 1222074 - RNA, 14 nt, Human
gucagagccugcag

SEQ ID NO: 1222075 - RNA, 14 nt, Human
guagucaggugccu

SEQ ID NO: 1222076 - RNA, 16 nt, Human
guaggguuauaauaau

SEQ ID NO: 1222077 - RNA, 23 nt, Human
guagggcgggaggauguucuggg

SEQ ID NO: 1222078 - RNA, 22 nt, Human
guagggcgggaggauguucugg

SEQ ID NO: 1222079 - RNA, 21 nt, Human
guagggcgggaggauguucug

SEQ ID NO: 1222080 - RNA, 16 nt, Human
guagggcgggaggaug

SEQ ID NO: 1222081 - RNA, 20 nt, Human
guaugaggcauuuguuugaa

SEQ ID NO: 1222082 - RNA, 17 nt, Human
guaugaggcauuuguuu

SEQ ID NO: 1222083 - RNA, 20 nt, Human
guaugaucacggcucacugc

SEQ ID NO: 1222084 - RNA, 21 nt, Human
guaugaucacggcucacugca

SEQ ID NO: 1222085 - RNA, 22 nt, Human
guaugaucacggcucacugcag

SEQ ID NO: 1222086 - RNA, 15 nt, Human
guaugaggcauuugu

SEQ ID NO: 1222087 - RNA, 13 nt, Human
guaugaggcauuu

SEQ ID NO: 1222088 - RNA, 19 nt, Human
guaucuggugacuuuccuc

SEQ ID NO: 1222089 - RNA, 12 nt, Human
guaucuggugac

SEQ ID NO: 1222090 - RNA, 12 nt, Human
guaucugagcag

SEQ ID NO: 1222091 - RNA, 22 nt, Human
guauaugucaagccauaauugu

SEQ ID NO: 1222092 - RNA, 20 nt, Human
uuucuguucuuucuggcuau

SEQ ID NO: 1222093 - RNA, 21 nt, Human
uuucuaaaggcuaccuuugua

SEQ ID NO: 1222094 - RNA, 20 nt, Human
uuucuaaaggcuaccuuugu

SEQ ID NO: 1222095 - RNA, 17 nt, Human
uuaccacagacauacua

SEQ ID NO: 1222096 - RNA, 14 nt, Human
uuaccacagacaua

SEQ ID NO: 1222097 - RNA, 16 nt, Human
uuuccugaggcugggc

SEQ ID NO: 1222098 - RNA, 22 nt, Human
uuugaagaugccgcauuuggau

SEQ ID NO: 1222099 - RNA, 19 nt, Human
uuugaacugauaaagauga

SEQ ID NO: 1222100 - RNA, 17 nt, Human
uuugaacugauaaagau

SEQ ID NO: 1222101 - RNA, 15 nt, Human
uuugaacugauaaag

SEQ ID NO: 1222102 - RNA, 14 nt, Human
uuugaacucuucaa

SEQ ID NO: 1222103 - RNA, 23 nt, Human
uuucuuagggaaggauacaaaag

SEQ ID NO: 1222104 - RNA, 18 nt, Human
uuucuuagggaaggauac

SEQ ID NO: 1222105 - RNA, 13 nt, Human
uuucuucucccuc

SEQ ID NO: 1222106 - RNA, 12 nt, Human
uuucuucucccu

SEQ ID NO: 1222107 - RNA, 21 nt, Human
uuuggaauuuugugcccccau

SEQ ID NO: 1222108 - RNA, 19 nt, Human
uuuggugguuucagaaaug

SEQ ID NO: 1222109 - RNA, 14 nt, Human
uuuggaauuuugug

SEQ ID NO: 1222110 - RNA, 12 nt, Human
uuuggaaaauaa

SEQ ID NO: 1222111 - RNA, 16 nt, Human
uuugcuuugugauuuu

SEQ ID NO: 1222112 - RNA, 15 nt, Human
uuugcuuugugauuu

SEQ ID NO: 1222113 - RNA, 17 nt, Human
uuuuaaagaaugcucuu

SEQ ID NO: 1222114 - RNA, 21 nt, Human
uuuguucuggcucuuccaggc

SEQ ID NO: 1222115 - RNA, 21 nt, Human
uuuuaaaugcaccuggaauau

SEQ ID NO: 1222116 - RNA, 12 nt, Human
uuuuaaaugcac

SEQ ID NO: 1222117 - RNA, 11 nt, Human
uuuuaaaugca

SEQ ID NO: 1222118 - RNA, 19 nt, Human
uuuuuccuucagugccuua

SEQ ID NO: 1222119 - RNA, 11 nt, Human
uuuuuaaaugc

SEQ ID NO: 1222120 - RNA, 11 nt, Human
uuuuuccuuca

SEQ ID NO: 1222121 - RNA, 16 nt, Human
uuuugucauauaagau

SEQ ID NO: 1222122 - RNA, 19 nt, Human
uuuuguagagccagggucu

SEQ ID NO: 1222123 - RNA, 15 nt, Human
uuuuggucuguguga

SEQ ID NO: 1222124 - RNA, 14 nt, Human
uuuuggcugcugaa

SEQ ID NO: 1222125 - RNA, 20 nt, Human
uuuugacaaggggcaguggu

SEQ ID NO: 1222126 - RNA, 13 nt, Human
gcggacagccacg

SEQ ID NO: 1222127 - RNA, 11 nt, Human
gcggacagcca

SEQ ID NO: 1222128 - RNA, 18 nt, Human
gcgccuacaggagugagc

SEQ ID NO: 1222129 - RNA, 15 nt, Human
gcgccuacaggagug

SEQ ID NO: 1222130 - RNA, 19 nt, Human
gcgucucauacucaccuca

SEQ ID NO: 1222131 - RNA, 16 nt, Human
gcggacagccacggcc

SEQ ID NO: 1222132 - RNA, 15 nt, Human
gcggacagccacggc

SEQ ID NO: 1222133 - RNA, 13 nt, Human
gcuaagagggagg

SEQ ID NO: 1222134 - RNA, 22 nt, Human
gcuacacaggggaaaagaggag

SEQ ID NO: 1222135 - RNA, 14 nt, Human
gcuacacaggggaa

SEQ ID NO: 1222136 - RNA, 20 nt, Human
gcuacacacugcauguuugu

SEQ ID NO: 1222137 - RNA, 13 nt, Human
gcuacacacugca

SEQ ID NO: 1222138 - RNA, 21 nt, Human
gcuaagagggagggagggcuc

SEQ ID NO: 1222139 - RNA, 20 nt, Human
gcuaagagggagggagggcu

SEQ ID NO: 1222140 - RNA, 20 nt, Human
gcuaccuuuguauucucucc

SEQ ID NO: 1222141 - RNA, 16 nt, Human
gcuaccuuuguauucu

SEQ ID NO: 1222142 - RNA, 16 nt, Human
gcuaggaacacuccuu

SEQ ID NO: 1222143 - RNA, 15 nt, Human
gcuaggaacacuccu

SEQ ID NO: 1222144 - RNA, 23 nt, Human
gcgacaaugcaaaccaucauuga

SEQ ID NO: 1222145 - RNA, 13 nt, Human
gccuuuggcuuca

SEQ ID NO: 1222146 - RNA, 21 nt, Human
gccuuccaggggugggacacc

SEQ ID NO: 1222147 - RNA, 16 nt, Human
gccuuccagggguggg

SEQ ID NO: 1222148 - RNA, 15 nt, Human
gccuuccaggggugg

SEQ ID NO: 1222149 - RNA, 20 nt, Human
gccuuauggaacacucugag

SEQ ID NO: 1222150 - RNA, 19 nt, Human
gccuuauggaacacucuga

SEQ ID NO: 1222151 - RNA, 18 nt, Human
gccuuauggaacacucug

SEQ ID NO: 1222152 - RNA, 16 nt, Human
gccuuauggaacacuc

SEQ ID NO: 1222153 - RNA, 12 nt, Human
gccuuccagggg

SEQ ID NO: 1222154 - RNA, 22 nt, Human
gccugggggcugggcagaggaa

SEQ ID NO: 1222155 - RNA, 21 nt, Human
gccugguggcagcugcggucc

SEQ ID NO: 1222156 - RNA, 19 nt, Human
gccugguggcagcugcggu

SEQ ID NO: 1222157 - RNA, 14 nt, Human
gccugguggcagcu

SEQ ID NO: 1222158 - RNA, 18 nt, Human
gccugguggcagcugcgg

SEQ ID NO: 1222159 - RNA, 13 nt, Human
gccugguggcagc

SEQ ID NO: 1222160 - RNA, 14 nt, Human
gccuuauggaacac

SEQ ID NO: 1222161 - RNA, 10 nt, Human
gccuuaugga

SEQ ID NO: 1222162 - RNA, 20 nt, Human
gccuuagaagucacacagua

SEQ ID NO: 1222163 - RNA, 19 nt, Human
gccuuacccucauguucuu

SEQ ID NO: 1222164 - RNA, 19 nt, Human
gccuuagaagucacacagu

SEQ ID NO: 1222165 - RNA, 18 nt, Human
gccuuagaagucacacag

SEQ ID NO: 1222166 - RNA, 17 nt, Human
gccuuagaagucacaca

SEQ ID NO: 1222167 - RNA, 18 nt, Human
gccuuacccucauguucu

SEQ ID NO: 1222168 - RNA, 21 nt, Human
gccuuacacaaugguuuucuu

SEQ ID NO: 1222169 - RNA, 20 nt, Human
gccuuacacaaugguuuucu

SEQ ID NO: 1222170 - RNA, 20 nt, Human
gccucccgaguagcugggac

SEQ ID NO: 1222171 - RNA, 19 nt, Human
gccucccgaguagcuggga

SEQ ID NO: 1222172 - RNA, 18 nt, Human
gccucccgaguagcuggg

SEQ ID NO: 1222173 - RNA, 17 nt, Human
gccucccaucacccgcu

SEQ ID NO: 1222174 - RNA, 16 nt, Human
gccucccaucacccgc

SEQ ID NO: 1222175 - RNA, 14 nt, Human
gccucccaucaccc

SEQ ID NO: 1222176 - RNA, 21 nt, Human
gccucccaacucaccccagcc

SEQ ID NO: 1222177 - RNA, 19 nt, Human
gccucccaacucaccccag

SEQ ID NO: 1222178 - RNA, 18 nt, Human
gccucccaacucacccca

SEQ ID NO: 1222179 - RNA, 17 nt, Human
gccucccaacucacccc

SEQ ID NO: 1222180 - RNA, 16 nt, Human
gccucccaacucaccc

SEQ ID NO: 1222181 - RNA, 13 nt, Human
gccucccaacuca

SEQ ID NO: 1222182 - RNA, 19 nt, Human
gccucccaaagugcuggga

SEQ ID NO: 1222183 - RNA, 17 nt, Human
gccucagcauccuggca

SEQ ID NO: 1222184 - RNA, 18 nt, Human
gccucccaaagugcuggg

SEQ ID NO: 1222185 - RNA, 16 nt, Human
gccucagcauccuggc

SEQ ID NO: 1222186 - RNA, 15 nt, Human
gccucagcauccugg

SEQ ID NO: 1222187 - RNA, 21 nt, Human
gccucacaguccuuaccagca

SEQ ID NO: 1222188 - RNA, 18 nt, Human
gccucacaguccuuacca

SEQ ID NO: 1222189 - RNA, 14 nt, Human
gccucucucaggcc

SEQ ID NO: 1222190 - RNA, 13 nt, Human
gccucucucaggc

SEQ ID NO: 1222191 - RNA, 18 nt, Human
gccucugacacacagcuc

SEQ ID NO: 1222192 - RNA, 17 nt, Human
gccucugacacacagcu

SEQ ID NO: 1222193 - RNA, 16 nt, Human
gccucucucaggccaa

SEQ ID NO: 1222194 - RNA, 14 nt, Human
gccucugcacuccc

SEQ ID NO: 1222195 - RNA, 21 nt, Human
gccucugacacacagcucugu

SEQ ID NO: 1222196 - RNA, 20 nt, Human
gccucugacacacagcucug

SEQ ID NO: 1222197 - RNA, 19 nt, Human
gccucugacacacagcucu

SEQ ID NO: 1222198 - RNA, 15 nt, Human
gccugcaagggagug

SEQ ID NO: 1222199 - RNA, 13 nt, Human
gccugcaagggag

SEQ ID NO: 1222200 - RNA, 18 nt, Human
gccucugccucugacaca

SEQ ID NO: 1222201 - RNA, 13 nt, Human
gccucugccucug

SEQ ID NO: 1222202 - RNA, 12 nt, Human
gccucugccucu

SEQ ID NO: 1222203 - RNA, 15 nt, Human
gccucugcacucccc

SEQ ID NO: 1222204 - RNA, 17 nt, Human
gccucacaguccuuacc

SEQ ID NO: 1222205 - RNA, 13 nt, Human
gccucacaguccu

SEQ ID NO: 1222206 - RNA, 19 nt, Human
gccucaaccuccugggcua

SEQ ID NO: 1222207 - RNA, 18 nt, Human
gccucaaccuccugggcu

SEQ ID NO: 1222208 - RNA, 17 nt, Human
gccgucuaccugagggg

SEQ ID NO: 1222209 - RNA, 16 nt, Human
gccgucuaccugaggg

SEQ ID NO: 1222210 - RNA, 15 nt, Human
gccgucuaccugagg

SEQ ID NO: 1222211 - RNA, 20 nt, Human
gccguguaaccauggaccca

SEQ ID NO: 1222212 - RNA, 18 nt, Human
gccgucuaccugaggggc

SEQ ID NO: 1222213 - RNA, 18 nt, Human
gcccuucucuccagcccc

SEQ ID NO: 1222214 - RNA, 17 nt, Human
gcccuucucuccagccc

SEQ ID NO: 1222215 - RNA, 16 nt, Human
gcccuucucuccagcc

SEQ ID NO: 1222216 - RNA, 14 nt, Human
gcccuucucuccag

SEQ ID NO: 1222217 - RNA, 13 nt, Human
gccgcagcccugc

SEQ ID NO: 1222218 - RNA, 12 nt, Human
gccgcagcccug

SEQ ID NO: 1222219 - RNA, 11 nt, Human
gccgcagcccu

SEQ ID NO: 1222220 - RNA, 17 nt, Human
gccgagauugcaccacu

SEQ ID NO: 1222221 - RNA, 22 nt, Human
gccgagaucacgccacugcacu

SEQ ID NO: 1222222 - RNA, 21 nt, Human
gccgagaucacgccacugcac

SEQ ID NO: 1222223 - RNA, 20 nt, Human
gccgagaucacgccacugca

SEQ ID NO: 1222224 - RNA, 21 nt, Human
gccgggcgcgguggcucacgc

SEQ ID NO: 1222225 - RNA, 14 nt, Human
gccauccagguuca

SEQ ID NO: 1222226 - RNA, 14 nt, Human
gccaugcuccuggc

SEQ ID NO: 1222227 - RNA, 23 nt, Human
gccaguaaaugggggugcauuug

SEQ ID NO: 1222228 - RNA, 15 nt, Human
gccaggcuggucuca

SEQ ID NO: 1222229 - RNA, 13 nt, Human
gccaggcuggucu

SEQ ID NO: 1222230 - RNA, 17 nt, Human
gcccaccuuggcucaag

SEQ ID NO: 1222231 - RNA, 16 nt, Human
gcccaccuuggcucaa

SEQ ID NO: 1222232 - RNA, 15 nt, Human
gcccaccuuggcuca

SEQ ID NO: 1222233 - RNA, 13 nt, Human
gcccaccuuggcu

SEQ ID NO: 1222234 - RNA, 24 nt, Human
gcccaccuggccucugcacucccc

SEQ ID NO: 1222235 - RNA, 21 nt, Human
gcccaccuggccucugcacuc

SEQ ID NO: 1222236 - RNA, 20 nt, Human
gcccaccuggccucugcacu

SEQ ID NO: 1222237 - RNA, 17 nt, Human
gcccaccuggccucugc

SEQ ID NO: 1222238 - RNA, 16 nt, Human
gcccaccuggccucug

SEQ ID NO: 1222239 - RNA, 15 nt, Human
gcccaccuggccucu

SEQ ID NO: 1222240 - RNA, 16 nt, Human
gccaugggccuccugu

SEQ ID NO: 1222241 - RNA, 15 nt, Human
gccaugggccuccug

SEQ ID NO: 1222242 - RNA, 24 nt, Human
gccaugcuccuggcccacugcauc

SEQ ID NO: 1222243 - RNA, 20 nt, Human
gccaggagccuccugcccuu

SEQ ID NO: 1222244 - RNA, 19 nt, Human
gccaggagccuccugcccu

SEQ ID NO: 1222245 - RNA, 16 nt, Human
gccaggagccuccugc

SEQ ID NO: 1222246 - RNA, 14 nt, Human
gccaggagccuccu

SEQ ID NO: 1222247 - RNA, 15 nt, Human
gccaggaagccagca

SEQ ID NO: 1222248 - RNA, 14 nt, Human
gccaggaagccagc

SEQ ID NO: 1222249 - RNA, 13 nt, Human
gccaggaagccag

SEQ ID NO: 1222250 - RNA, 12 nt, Human
gccaggaagcca

SEQ ID NO: 1222251 - RNA, 20 nt, Human
gccagcugcuugggcuucau

SEQ ID NO: 1222252 - RNA, 18 nt, Human
gccagcugcuugggcuuc

SEQ ID NO: 1222253 - RNA, 17 nt, Human
gccagcugcuugggcuu

SEQ ID NO: 1222254 - RNA, 22 nt, Human
gccagccgagauagccaaggcc

SEQ ID NO: 1222255 - RNA, 16 nt, Human
gccagauuucacucuc

SEQ ID NO: 1222256 - RNA, 13 nt, Human
gccagauuucacu

SEQ ID NO: 1222257 - RNA, 24 nt, Human
gccagauucuuuccugaggcuggg

SEQ ID NO: 1222258 - RNA, 20 nt, Human
gccagauucuuuccugaggc

SEQ ID NO: 1222259 - RNA, 15 nt, Human
gccagaugcaccagc

SEQ ID NO: 1222260 - RNA, 14 nt, Human
gccagaugcaccag

SEQ ID NO: 1222261 - RNA, 17 nt, Human
gccagagggagugacag

SEQ ID NO: 1222262 - RNA, 22 nt, Human
gccagagacacaagccuucggc

SEQ ID NO: 1222263 - RNA, 21 nt, Human
gccagagacacaagccuucgg

SEQ ID NO: 1222264 - RNA, 22 nt, Human
gccacugcaccgggccacagag

SEQ ID NO: 1222265 - RNA, 21 nt, Human
gccacugcaccgggccacaga

SEQ ID NO: 1222266 - RNA, 20 nt, Human
gccacugcaccgggccacag

SEQ ID NO: 1222267 - RNA, 20 nt, Human
gccaaggccaaaggaagcac

SEQ ID NO: 1222268 - RNA, 24 nt, Human
gccaaggccaaaggaagcacaugc

SEQ ID NO: 1222269 - RNA, 21 nt, Human
gcccuccaagaccuucuccuu

SEQ ID NO: 1222270 - RNA, 19 nt, Human
gcccuccaagaccuucucc

SEQ ID NO: 1222271 - RNA, 12 nt, Human
gcccgggcucug

SEQ ID NO: 1222272 - RNA, 23 nt, Human
gcccuccaagaccuucuccuuca

SEQ ID NO: 1222273 - RNA, 22 nt, Human
gcccuccaagaccuucuccuuc

SEQ ID NO: 1222274 - RNA, 16 nt, Human
gcccugcagagggcac

SEQ ID NO: 1222275 - RNA, 15 nt, Human
gcccugcagagggca

SEQ ID NO: 1222276 - RNA, 14 nt, Human
gcccugcagagggc

SEQ ID NO: 1222277 - RNA, 13 nt, Human
gcccugcagaggg

SEQ ID NO: 1222278 - RNA, 14 nt, Human
gcccugagcuuucu

SEQ ID NO: 1222279 - RNA, 19 nt, Human
gcccucugcccacucccug

SEQ ID NO: 1222280 - RNA, 18 nt, Human
gcccucugcccacucccu

SEQ ID NO: 1222281 - RNA, 16 nt, Human
gcccucugcccacucc

SEQ ID NO: 1222282 - RNA, 13 nt, Human
gcccucugcccac

SEQ ID NO: 1222283 - RNA, 17 nt, Human
gccccuguucuggcaga

SEQ ID NO: 1222284 - RNA, 14 nt, Human
gccccucagggucc

SEQ ID NO: 1222285 - RNA, 22 nt, Human
gccccgaggccuucucugaagg

SEQ ID NO: 1222286 - RNA, 18 nt, Human
gccccgaggccuucucug

SEQ ID NO: 1222287 - RNA, 15 nt, Human
gccccgaggccuucu

SEQ ID NO: 1222288 - RNA, 18 nt, Human
gccccucagggucccugg

SEQ ID NO: 1222289 - RNA, 16 nt, Human
gccccucagggucccu

SEQ ID NO: 1222290 - RNA, 15 nt, Human
gccccauucugccug

SEQ ID NO: 1222291 - RNA, 14 nt, Human
gccccauucugccu

SEQ ID NO: 1222292 - RNA, 22 nt, Human
gccccauccucuguacagagcc

SEQ ID NO: 1222293 - RNA, 14 nt, Human
gccccauccucugu

SEQ ID NO: 1222294 - RNA, 13 nt, Human
gccccauccucug

SEQ ID NO: 1222295 - RNA, 12 nt, Human
gccccagugccc

SEQ ID NO: 1222296 - RNA, 15 nt, Human
gccccagugcccaca

SEQ ID NO: 1222297 - RNA, 14 nt, Human
gccccagugcccac

SEQ ID NO: 1222298 - RNA, 13 nt, Human
gccccagugccca

SEQ ID NO: 1222299 - RNA, 18 nt, Human
gccccaucccaaacccuu

SEQ ID NO: 1222300 - RNA, 12 nt, Human
gcccaggcuggc

SEQ ID NO: 1222301 - RNA, 23 nt, Human
gcccaggccccugccacccuggg

SEQ ID NO: 1222302 - RNA, 21 nt, Human
gcccagagaggguggugaccu

SEQ ID NO: 1222303 - RNA, 13 nt, Human
gcccaggccuccu

SEQ ID NO: 1222304 - RNA, 17 nt, Human
gcauuaucuagauacug

SEQ ID NO: 1222305 - RNA, 19 nt, Human
gcauuaucuagauacugua

SEQ ID NO: 1222306 - RNA, 16 nt, Human
gcauuuguuugaacug

SEQ ID NO: 1222307 - RNA, 17 nt, Human
gcauuugcugaauacag

SEQ ID NO: 1222308 - RNA, 14 nt, Human
gcauuugcugaaua

SEQ ID NO: 1222309 - RNA, 13 nt, Human
gcauuugcugaau

SEQ ID NO: 1222310 - RNA, 12 nt, Human
gccaaaggaagc

SEQ ID NO: 1222311 - RNA, 22 nt, Human
gccaaagcuaggccuggccaga

SEQ ID NO: 1222312 - RNA, 16 nt, Human
gccaaagcuaggccug

SEQ ID NO: 1222313 - RNA, 19 nt, Human
gccaaagccuccuccagcc

SEQ ID NO: 1222314 - RNA, 16 nt, Human
gccaaagccuccucca

SEQ ID NO: 1222315 - RNA, 20 nt, Human
gccaaagccaaagcuaggcc

SEQ ID NO: 1222316 - RNA, 19 nt, Human
gccaaacucaccugccccu

SEQ ID NO: 1222317 - RNA, 16 nt, Human
gccaaacucaccugcc

SEQ ID NO: 1222318 - RNA, 14 nt, Human
gccaaacucaccug

SEQ ID NO: 1222319 - RNA, 18 nt, Human
gcauuuguuugaacugau

SEQ ID NO: 1222320 - RNA, 18 nt, Human
gcaugaaguaauaugcac

SEQ ID NO: 1222321 - RNA, 18 nt, Human
gcaugcgggcuuccuccu

SEQ ID NO: 1222322 - RNA, 22 nt, Human
gcauguucucugaggacacuaa

SEQ ID NO: 1222323 - RNA, 21 nt, Human
gcauguucucugaggacacua

SEQ ID NO: 1222324 - RNA, 15 nt, Human
gcauguucucugagg

SEQ ID NO: 1222325 - RNA, 22 nt, Human
gcagggcucagcggggacagcu

SEQ ID NO: 1222326 - RNA, 18 nt, Human
gcagggucucacucuguc

SEQ ID NO: 1222327 - RNA, 21 nt, Human
gcagggcucagcggggacagc

SEQ ID NO: 1222328 - RNA, 19 nt, Human
gcagggcucagcggggaca

SEQ ID NO: 1222329 - RNA, 17 nt, Human
gcaggcagccaggccac

SEQ ID NO: 1222330 - RNA, 16 nt, Human
gcaggcagccaggcca

SEQ ID NO: 1222331 - RNA, 15 nt, Human
gcaggcagccaggcc

SEQ ID NO: 1222332 - RNA, 20 nt, Human
gcaggucuugaacuccuggc

SEQ ID NO: 1222333 - RNA, 19 nt, Human
gcaggucuugaacuccugg

SEQ ID NO: 1222334 - RNA, 22 nt, Human
gcagguccaggguuugaguuca

SEQ ID NO: 1222335 - RNA, 16 nt, Human
gcagugcaugcugucc

SEQ ID NO: 1222336 - RNA, 15 nt, Human
gcagugcaugcuguc

SEQ ID NO: 1222337 - RNA, 23 nt, Human
gcaguggugguuuucuguucuuu

SEQ ID NO: 1222338 - RNA, 15 nt, Human
gcagugggagcugcc

SEQ ID NO: 1222339 - RNA, 14 nt, Human
gcagugggagcugc

SEQ ID NO: 1222340 - RNA, 13 nt, Human
gcagugggagcug

SEQ ID NO: 1222341 - RNA, 17 nt, Human
gcaguuauuaacacuaa

SEQ ID NO: 1222342 - RNA, 22 nt, Human
gcagauacaggaaaagcugcug

SEQ ID NO: 1222343 - RNA, 21 nt, Human
gcagaguugaagacagagcua

SEQ ID NO: 1222344 - RNA, 17 nt, Human
gcagacaguuaagagaa

SEQ ID NO: 1222345 - RNA, 24 nt, Human
gcagccccauucugccugcccagg

SEQ ID NO: 1222346 - RNA, 21 nt, Human
gcagccccauucugccugccc

SEQ ID NO: 1222347 - RNA, 19 nt, Human
gcagccccauucugccugc

SEQ ID NO: 1222348 - RNA, 18 nt, Human
gcagccccauucugccug

SEQ ID NO: 1222349 - RNA, 23 nt, Human
gcagcaauaaagcagcguuucua

SEQ ID NO: 1222350 - RNA, 16 nt, Human
gcagcaauaaagcagc

SEQ ID NO: 1222351 - RNA, 13 nt, Human
gcagcccugcaga

SEQ ID NO: 1222352 - RNA, 21 nt, Human
gcagccccuguucuggcagag

SEQ ID NO: 1222353 - RNA, 20 nt, Human
gcagccccuguucuggcaga

SEQ ID NO: 1222354 - RNA, 14 nt, Human
gcaggcagccaggc

SEQ ID NO: 1222355 - RNA, 13 nt, Human
gcaggcagccagg

SEQ ID NO: 1222356 - RNA, 12 nt, Human
gcaggcagccag

SEQ ID NO: 1222357 - RNA, 23 nt, Human
gcaggaggaucacuugaguccag

SEQ ID NO: 1222358 - RNA, 15 nt, Human
gcagcucaccucucc

SEQ ID NO: 1222359 - RNA, 14 nt, Human
gcagcucaccucuc

SEQ ID NO: 1222360 - RNA, 15 nt, Human
gcagccuuggcaaac

SEQ ID NO: 1222361 - RNA, 17 nt, Human
gcagcccugcagagggc

SEQ ID NO: 1222362 - RNA, 16 nt, Human
gcagcccugcagaggg

SEQ ID NO: 1222363 - RNA, 15 nt, Human
gcagcccugcagagg

SEQ ID NO: 1222364 - RNA, 14 nt, Human
gcagcccugcagag

SEQ ID NO: 1222365 - RNA, 12 nt, Human
gcacgauuucug

SEQ ID NO: 1222366 - RNA, 19 nt, Human
gcaccuuagacagucccug

SEQ ID NO: 1222367 - RNA, 18 nt, Human
gcaccuuagacagucccu

SEQ ID NO: 1222368 - RNA, 17 nt, Human
gcaccuuagacaguccc

SEQ ID NO: 1222369 - RNA, 14 nt, Human
gcaccuuagacagu

SEQ ID NO: 1222370 - RNA, 22 nt, Human
gcaccuggaauauauaaccagu

SEQ ID NO: 1222371 - RNA, 21 nt, Human
gcaccuggaauauauaaccag

SEQ ID NO: 1222372 - RNA, 18 nt, Human
gcaccuggaauauauaac

SEQ ID NO: 1222373 - RNA, 15 nt, Human
gcacccucaggcagg

SEQ ID NO: 1222374 - RNA, 19 nt, Human
gcacccggccccugcuggu

SEQ ID NO: 1222375 - RNA, 22 nt, Human
gcacccaccaucaugucuggcu

SEQ ID NO: 1222376 - RNA, 16 nt, Human
gcaccagcagccugga

SEQ ID NO: 1222377 - RNA, 15 nt, Human
gcaccagcagccugg

SEQ ID NO: 1222378 - RNA, 22 nt, Human
gcaccacugcacuccagccugg

SEQ ID NO: 1222379 - RNA, 21 nt, Human
gcaccacugcacuccagccug

SEQ ID NO: 1222380 - RNA, 14 nt, Human
gcaauggcagccuu

SEQ ID NO: 1222381 - RNA, 13 nt, Human
gcaauggcagccu

SEQ ID NO: 1222382 - RNA, 12 nt, Human
gcaauggcagcc

SEQ ID NO: 1222383 - RNA, 23 nt, Human
gcagacaggcaagcaccuccugc

SEQ ID NO: 1222384 - RNA, 19 nt, Human
gcagacaggcaagcaccuc

SEQ ID NO: 1222385 - RNA, 18 nt, Human
gcagacaggaccagggau

SEQ ID NO: 1222386 - RNA, 15 nt, Human
gcagacaggaccagg

SEQ ID NO: 1222387 - RNA, 13 nt, Human
gcagacaggacca

SEQ ID NO: 1222388 - RNA, 12 nt, Human
gcagacaggacc

SEQ ID NO: 1222389 - RNA, 18 nt, Human
gcacugcuuccagugagg

SEQ ID NO: 1222390 - RNA, 16 nt, Human
gcacugcuuccaguga

SEQ ID NO: 1222391 - RNA, 20 nt, Human
gcacugcuuccagugaggcu

SEQ ID NO: 1222392 - RNA, 22 nt, Human
gcacugcuuccagugaggcucu

SEQ ID NO: 1222393 - RNA, 18 nt, Human
gauuuccguuaaaauacc

SEQ ID NO: 1222394 - RNA, 15 nt, Human
gauuuccguuaaaau

SEQ ID NO: 1222395 - RNA, 21 nt, Human
gauuucuguuuagauaauaca

SEQ ID NO: 1222396 - RNA, 19 nt, Human
gauuucuguuuagauaaua

SEQ ID NO: 1222397 - RNA, 11 nt, Human
gauuucuguuu

SEQ ID NO: 1222398 - RNA, 19 nt, Human
gauuuguuaaugauagcua

SEQ ID NO: 1222399 - RNA, 19 nt, Human
gauucauauuuacuucuua

SEQ ID NO: 1222400 - RNA, 18 nt, Human
gauucauauuuacuucuu

SEQ ID NO: 1222401 - RNA, 17 nt, Human
gauucauauuuacuucu

SEQ ID NO: 1222402 - RNA, 15 nt, Human
gauucagcucugcaa

SEQ ID NO: 1222403 - RNA, 13 nt, Human
gauucagcucugc

SEQ ID NO: 1222404 - RNA, 19 nt, Human
gauucagacagcugccugg

SEQ ID NO: 1222405 - RNA, 23 nt, Human
gauggggcugcaccggcuggccu

SEQ ID NO: 1222406 - RNA, 24 nt, Human
gauggggcccugccuccuuuguga

SEQ ID NO: 1222407 - RNA, 23 nt, Human
gauugcaccacugcacuccagcc

SEQ ID NO: 1222408 - RNA, 16 nt, Human
gauugcaccacugcac

SEQ ID NO: 1222409 - RNA, 21 nt, Human
gauugcaacaggcugggcuuc

SEQ ID NO: 1222410 - RNA, 20 nt, Human
gauugcaacaggcugggcuu

SEQ ID NO: 1222411 - RNA, 18 nt, Human
gauucuuuccugaggcug

SEQ ID NO: 1222412 - RNA, 17 nt, Human
gauucuuuccugaggcu

SEQ ID NO: 1222413 - RNA, 16 nt, Human
gauucuuuccugaggc

SEQ ID NO: 1222414 - RNA, 21 nt, Human
gauucccaagcucugcuccuc

SEQ ID NO: 1222415 - RNA, 20 nt, Human
gauucccaagcucugcuccu

SEQ ID NO: 1222416 - RNA, 19 nt, Human
gauucccaagcucugcucc

SEQ ID NO: 1222417 - RNA, 16 nt, Human
gcaaaguaucccuacu

SEQ ID NO: 1222418 - RNA, 17 nt, Human
gcaagaauugaagcagg

SEQ ID NO: 1222419 - RNA, 23 nt, Human
gcaagacgcugugcugcccugcc

SEQ ID NO: 1222420 - RNA, 22 nt, Human
gcaagacgcugugcugcccugc

SEQ ID NO: 1222421 - RNA, 21 nt, Human
gcaagacgcugugcugcccug

SEQ ID NO: 1222422 - RNA, 20 nt, Human
gcaagacgcugugcugcccu

SEQ ID NO: 1222423 - RNA, 14 nt, Human
gcaagacgcugugc

SEQ ID NO: 1222424 - RNA, 23 nt, Human
gcaaugcuggcuguuggcugggg

SEQ ID NO: 1222425 - RNA, 22 nt, Human
gcaaugcuggcuguuggcuggg

SEQ ID NO: 1222426 - RNA, 14 nt, Human
gcaaugcuggcugu

SEQ ID NO: 1222427 - RNA, 13 nt, Human
gcaaugcuggcug

SEQ ID NO: 1222428 - RNA, 23 nt, Human
gcaaugaccuuucaauaggaaaa

SEQ ID NO: 1222429 - RNA, 22 nt, Human
gcaaugaccuuucaauaggaaa

SEQ ID NO: 1222430 - RNA, 20 nt, Human
gcaaugaccuuucaauagga

SEQ ID NO: 1222431 - RNA, 17 nt, Human
gcaaugaccuuucaaua

SEQ ID NO: 1222432 - RNA, 17 nt, Human
gcaaucaaaucugcuuu

SEQ ID NO: 1222433 - RNA, 15 nt, Human
gcaaucaaaucugcu

SEQ ID NO: 1222434 - RNA, 14 nt, Human
gcaaggucauuuuu

SEQ ID NO: 1222435 - RNA, 13 nt, Human
gcaaggcugucaa

SEQ ID NO: 1222436 - RNA, 11 nt, Human
gcaaggcuguc

SEQ ID NO: 1222437 - RNA, 18 nt, Human
gcaaggagauuuacaacu

SEQ ID NO: 1222438 - RNA, 18 nt, Human
gaucuuugcagacaggca

SEQ ID NO: 1222439 - RNA, 22 nt, Human
gauccugagccagauuucacuc

SEQ ID NO: 1222440 - RNA, 16 nt, Human
gaucccucauccucau

SEQ ID NO: 1222441 - RNA, 15 nt, Human
gaucccucauccuca

SEQ ID NO: 1222442 - RNA, 22 nt, Human
gauggauuuccagccaaagccu

SEQ ID NO: 1222443 - RNA, 20 nt, Human
gaugccugguggcagcugcg

SEQ ID NO: 1222444 - RNA, 19 nt, Human
gaugccugguggcagcugc

SEQ ID NO: 1222445 - RNA, 18 nt, Human
gaugccugguggcagcug

SEQ ID NO: 1222446 - RNA, 22 nt, Human
gauggggcccugccuccuuugu

SEQ ID NO: 1222447 - RNA, 14 nt, Human
gauggggcccugcc

SEQ ID NO: 1222448 - RNA, 13 nt, Human
gauggggcccugc

SEQ ID NO: 1222449 - RNA, 19 nt, Human
gaugcagccucacaguccu

SEQ ID NO: 1222450 - RNA, 14 nt, Human
gaugcagccucaca

SEQ ID NO: 1222451 - RNA, 12 nt, Human
gaugcagccuca

SEQ ID NO: 1222452 - RNA, 14 nt, Human
gaugcaccagcccu

SEQ ID NO: 1222453 - RNA, 13 nt, Human
gaugcaccagccc

SEQ ID NO: 1222454 - RNA, 22 nt, Human
gaugcacagaguuguuacauuu

SEQ ID NO: 1222455 - RNA, 19 nt, Human
gauacaggaaaagcugcug

SEQ ID NO: 1222456 - RNA, 18 nt, Human
gauacaggaaaagcugcu

SEQ ID NO: 1222457 - RNA, 22 nt, Human
gauagcacagacccugcccugu

SEQ ID NO: 1222458 - RNA, 21 nt, Human
gauagcacagacccugcccug

SEQ ID NO: 1222459 - RNA, 22 nt, Human
gauaauacaccacuacauucug

SEQ ID NO: 1222460 - RNA, 21 nt, Human
gauaauacaccacuacauucu

SEQ ID NO: 1222461 - RNA, 18 nt, Human
gauaauacaccacuacau

SEQ ID NO: 1222462 - RNA, 21 nt, Human
gaggaaggaaacccagcucug

SEQ ID NO: 1222463 - RNA, 20 nt, Human
gaggaaggaaacccagcucu

SEQ ID NO: 1222464 - RNA, 19 nt, Human
gaggaaggaaacccagcuc

SEQ ID NO: 1222465 - RNA, 13 nt, Human
gaggaaggaaacc

SEQ ID NO: 1222466 - RNA, 21 nt, Human
gaucauccacugugccaugug

SEQ ID NO: 1222467 - RNA, 19 nt, Human
gaucauccacugugccaug

SEQ ID NO: 1222468 - RNA, 17 nt, Human
gaucauccacugugcca

SEQ ID NO: 1222469 - RNA, 18 nt, Human
gaucacgccacugcacua

SEQ ID NO: 1222470 - RNA, 22 nt, Human
gaucagucugauucccaagcuc

SEQ ID NO: 1222471 - RNA, 15 nt, Human
gaucagccugggcaa

SEQ ID NO: 1222472 - RNA, 12 nt, Human
gaucagccuggg

SEQ ID NO: 1222473 - RNA, 12 nt, Human
gaucacggcuca

SEQ ID NO: 1222474 - RNA, 17 nt, Human
gagcuagcagcagggag

SEQ ID NO: 1222475 - RNA, 15 nt, Human
gagcuagcagcaggg

SEQ ID NO: 1222476 - RNA, 15 nt, Human
gagccugcaguuauu

SEQ ID NO: 1222477 - RNA, 15 nt, Human
gagcugaguggggga

SEQ ID NO: 1222478 - RNA, 17 nt, Human
gaggaaagcaaaggaga

SEQ ID NO: 1222479 - RNA, 16 nt, Human
gaggaaagcaaaggag

SEQ ID NO: 1222480 - RNA, 20 nt, Human
gagcuuugaaaauucagugg

SEQ ID NO: 1222481 - RNA, 22 nt, Human
gagcuuucugcuaucaaagagg

SEQ ID NO: 1222482 - RNA, 15 nt, Human
gagcugccuguucag

SEQ ID NO: 1222483 - RNA, 18 nt, Human
gaggaagccgcuggggcc

SEQ ID NO: 1222484 - RNA, 17 nt, Human
gaggaagccgcuggggc

SEQ ID NO: 1222485 - RNA, 14 nt, Human
gaggaagccgcugg

SEQ ID NO: 1222486 - RNA, 13 nt, Human
gaggaagccgcug

SEQ ID NO: 1222487 - RNA, 17 nt, Human
gaggaagagaaaaaaua

SEQ ID NO: 1222488 - RNA, 16 nt, Human
gaggaacaaggcaagg

SEQ ID NO: 1222489 - RNA, 14 nt, Human
gaggaacaaggcaa

SEQ ID NO: 1222490 - RNA, 12 nt, Human
gagccugcaguu

SEQ ID NO: 1222491 - RNA, 13 nt, Human
gagccuccugccc

SEQ ID NO: 1222492 - RNA, 13 nt, Human
gagccucagcauc

SEQ ID NO: 1222493 - RNA, 15 nt, Human
gagccucagcauccu

SEQ ID NO: 1222494 - RNA, 14 nt, Human
gagccucagcaucc

SEQ ID NO: 1222495 - RNA, 17 nt, Human
gagccucagcauccugg

SEQ ID NO: 1222496 - RNA, 22 nt, Human
gagccgagaucacgccacugca

SEQ ID NO: 1222497 - RNA, 21 nt, Human
gagccgagaucacgccacugc

SEQ ID NO: 1222498 - RNA, 20 nt, Human
gagccgagaucacgccacug

SEQ ID NO: 1222499 - RNA, 19 nt, Human
gagccgagaucacgccacu

SEQ ID NO: 1222500 - RNA, 11 nt, Human
gagcccacgcc

SEQ ID NO: 1222501 - RNA, 17 nt, Human
gagcccaccuuggcuca

SEQ ID NO: 1222502 - RNA, 15 nt, Human
gagcccaccuuggcu

SEQ ID NO: 1222503 - RNA, 13 nt, Human
gagcccaccuugg

SEQ ID NO: 1222504 - RNA, 20 nt, Human
gagccagauuucacucuccu

SEQ ID NO: 1222505 - RNA, 19 nt, Human
gagccagauuucacucucc

SEQ ID NO: 1222506 - RNA, 18 nt, Human
gagccagauuucacucuc

SEQ ID NO: 1222507 - RNA, 15 nt, Human
gagccagauuucacu

SEQ ID NO: 1222508 - RNA, 20 nt, Human
gagccacugcaccgggccac

SEQ ID NO: 1222509 - RNA, 19 nt, Human
gagccacugcaccgggcca

SEQ ID NO: 1222510 - RNA, 18 nt, Human
gagccacugcaccgggcc

SEQ ID NO: 1222511 - RNA, 22 nt, Human
gagcagccacauuccugaugcu

SEQ ID NO: 1222512 - RNA, 23 nt, Human
gagcagagaccaucccugaaggc

SEQ ID NO: 1222513 - RNA, 21 nt, Human
gagcagagaccaucccugaag

SEQ ID NO: 1222514 - RNA, 19 nt, Human
gagcagagaccaucccuga

SEQ ID NO: 1222515 - RNA, 18 nt, Human
gagcagagaccaucccug

SEQ ID NO: 1222516 - RNA, 17 nt, Human
gagcagagaccaucccu

SEQ ID NO: 1222517 - RNA, 21 nt, Human
gagauagccaaggccaaagga

SEQ ID NO: 1222518 - RNA, 20 nt, Human
gagauagccaaggccaaagg

SEQ ID NO: 1222519 - RNA, 22 nt, Human
gagaaugcacaaacagaggccg

SEQ ID NO: 1222520 - RNA, 21 nt, Human
gagaaugcacaaacagaggcc

SEQ ID NO: 1222521 - RNA, 20 nt, Human
gagaaugcacaaacagaggc

SEQ ID NO: 1222522 - RNA, 12 nt, Human
gagacagcccgg

SEQ ID NO: 1222523 - RNA, 19 nt, Human
gagacagaguuuucacucu

SEQ ID NO: 1222524 - RNA, 17 nt, Human
gagacacaagccuucgg

SEQ ID NO: 1222525 - RNA, 15 nt, Human
gagacacaagccuuc

SEQ ID NO: 1222526 - RNA, 21 nt, Human
gagaaaauggacguguuauga

SEQ ID NO: 1222527 - RNA, 16 nt, Human
gacuuggaagcuccgc

SEQ ID NO: 1222528 - RNA, 15 nt, Human
gacuuggaagcuccg

SEQ ID NO: 1222529 - RNA, 14 nt, Human
gacuuggaagcucc

SEQ ID NO: 1222530 - RNA, 19 nt, Human
gacucgcgacaaugcaaac

SEQ ID NO: 1222531 - RNA, 17 nt, Human
gacuccugcaggcagcc

SEQ ID NO: 1222532 - RNA, 23 nt, Human
gagaaaguacuucuccacccugc

SEQ ID NO: 1222533 - RNA, 17 nt, Human
gagagaagagaaugcac

SEQ ID NO: 1222534 - RNA, 21 nt, Human
gagagggugggagugggccca

SEQ ID NO: 1222535 - RNA, 18 nt, Human
gagaggggaacagacugg

SEQ ID NO: 1222536 - RNA, 13 nt, Human
gagaggggaacag

SEQ ID NO: 1222537 - RNA, 14 nt, Human
gagagccuuccagg

SEQ ID NO: 1222538 - RNA, 13 nt, Human
gagagccuuccag

SEQ ID NO: 1222539 - RNA, 24 nt, Human
gagacagcccgggcucugccuccc

SEQ ID NO: 1222540 - RNA, 23 nt, Human
gagacagcccgggcucugccucc

SEQ ID NO: 1222541 - RNA, 22 nt, Human
gagacagcccgggcucugccuc

SEQ ID NO: 1222542 - RNA, 21 nt, Human
gagacagcccgggcucugccu

SEQ ID NO: 1222543 - RNA, 20 nt, Human
gagacagcccgggcucugcc

SEQ ID NO: 1222544 - RNA, 19 nt, Human
gagacagcccgggcucugc

SEQ ID NO: 1222545 - RNA, 18 nt, Human
gagacagcccgggcucug

SEQ ID NO: 1222546 - RNA, 17 nt, Human
gagacagcccgggcucu

SEQ ID NO: 1222547 - RNA, 14 nt, Human
gagacagcccgggc

SEQ ID NO: 1222548 - RNA, 18 nt, Human
gagacucgcgacaaugca

SEQ ID NO: 1222549 - RNA, 16 nt, Human
gagacucgcgacaaug

SEQ ID NO: 1222550 - RNA, 12 nt, Human
gagaccaucccu

SEQ ID NO: 1222551 - RNA, 14 nt, Human
gagacucugucuca

SEQ ID NO: 1222552 - RNA, 21 nt, Human
gaccuuucaauaggaaaaacu

SEQ ID NO: 1222553 - RNA, 22 nt, Human
gaccuuuaagagaaaugagcug

SEQ ID NO: 1222554 - RNA, 20 nt, Human
gacguguuaugacuccagaa

SEQ ID NO: 1222555 - RNA, 17 nt, Human
gacguguuaugacucca

SEQ ID NO: 1222556 - RNA, 18 nt, Human
gacggagucccaccuugg

SEQ ID NO: 1222557 - RNA, 23 nt, Human
gacggagucccaccuuggcugca

SEQ ID NO: 1222558 - RNA, 21 nt, Human
gacggagucccaccuuggcug

SEQ ID NO: 1222559 - RNA, 17 nt, Human
gacuacucccccaggug

SEQ ID NO: 1222560 - RNA, 12 nt, Human
gacuacaggcac

SEQ ID NO: 1222561 - RNA, 22 nt, Human
gacguguuaugacuccagaauu

SEQ ID NO: 1222562 - RNA, 16 nt, Human
gacuccugcaggcagc

SEQ ID NO: 1222563 - RNA, 15 nt, Human
gacuccugcaggcag

SEQ ID NO: 1222564 - RNA, 14 nt, Human
gacucauucuucug

SEQ ID NO: 1222565 - RNA, 15 nt, Human
gaccgugaggccaga

SEQ ID NO: 1222566 - RNA, 14 nt, Human
gaccgugaggccag

SEQ ID NO: 1222567 - RNA, 17 nt, Human
gacccugcccugugggc

SEQ ID NO: 1222568 - RNA, 21 nt, Human
gaccugaggcccuucucucca

SEQ ID NO: 1222569 - RNA, 18 nt, Human
gaccugaggcccuucucu

SEQ ID NO: 1222570 - RNA, 15 nt, Human
gaccugaggcccuuc

SEQ ID NO: 1222571 - RNA, 13 nt, Human
gaccucaggccug

SEQ ID NO: 1222572 - RNA, 12 nt, Human
gaccucaggccu

SEQ ID NO: 1222573 - RNA, 11 nt, Human
gaccucaggcc

SEQ ID NO: 1222574 - RNA, 17 nt, Human
gacccaugcugcccugu

SEQ ID NO: 1222575 - RNA, 16 nt, Human
gacccaugcugcccug

SEQ ID NO: 1222576 - RNA, 15 nt, Human
gacccaugcugcccu

SEQ ID NO: 1222577 - RNA, 14 nt, Human
gacccaugcugccc

SEQ ID NO: 1222578 - RNA, 12 nt, Human
gacccacugcuu

SEQ ID NO: 1222579 - RNA, 11 nt, Human
gacccacugcu

SEQ ID NO: 1222580 - RNA, 16 nt, Human
gacccugcccuguggg

SEQ ID NO: 1222581 - RNA, 15 nt, Human
gacccugcccugugg

SEQ ID NO: 1222582 - RNA, 13 nt, Human
gacccugcccugu

SEQ ID NO: 1222583 - RNA, 22 nt, Human
gacccugaggcccagagggccu

SEQ ID NO: 1222584 - RNA, 21 nt, Human
gacccugaggcccagagggcc

SEQ ID NO: 1222585 - RNA, 20 nt, Human
gacccugaggcccagagggc

SEQ ID NO: 1222586 - RNA, 19 nt, Human
gacccugaggcccagaggg

SEQ ID NO: 1222587 - RNA, 13 nt, Human
gaccccuccaugu

SEQ ID NO: 1222588 - RNA, 23 nt, Human
gacacccugugauggggcccugc

SEQ ID NO: 1222589 - RNA, 22 nt, Human
gacacccugugauggggcccug

SEQ ID NO: 1222590 - RNA, 13 nt, Human
gacacccugugau

SEQ ID NO: 1222591 - RNA, 12 nt, Human
gacacccuguga

SEQ ID NO: 1222592 - RNA, 18 nt, Human
gacacaggcccggcucca

SEQ ID NO: 1222593 - RNA, 18 nt, Human
gacacuaaccacgcugga

SEQ ID NO: 1222594 - RNA, 17 nt, Human
gacacuaaccacgcugg

SEQ ID NO: 1222595 - RNA, 16 nt, Human
gacacuaaccacgcug

SEQ ID NO: 1222596 - RNA, 15 nt, Human
gacacuaaccacgcu

SEQ ID NO: 1222597 - RNA, 19 nt, Human
gacacgaauauugcugaug

SEQ ID NO: 1222598 - RNA, 18 nt, Human
gacacgaauauugcugau

SEQ ID NO: 1222599 - RNA, 17 nt, Human
gacacgaauauugcuga

SEQ ID NO: 1222600 - RNA, 15 nt, Human
gacacgaauauugcu

SEQ ID NO: 1222601 - RNA, 20 nt, Human
gacaccuugacagggcacac

SEQ ID NO: 1222602 - RNA, 18 nt, Human
gacaccuugacagggcac

SEQ ID NO: 1222603 - RNA, 17 nt, Human
gacaccuugacagggca

SEQ ID NO: 1222604 - RNA, 15 nt, Human
gacaccuugacaggg

SEQ ID NO: 1222605 - RNA, 17 nt, Human
gacacaggcccggcucc

SEQ ID NO: 1222606 - RNA, 15 nt, Human
gacacaggcccggcu

SEQ ID NO: 1222607 - RNA, 13 nt, Human
gacacacagcucu

SEQ ID NO: 1222608 - RNA, 19 nt, Human
gacaauuuauuauggcaca

SEQ ID NO: 1222609 - RNA, 13 nt, Human
gacaauuuauuau

SEQ ID NO: 1222610 - RNA, 12 nt, Human
gacaauuuauua

SEQ ID NO: 1222611 - RNA, 18 nt, Human
gacaaugcaaaccaucau

SEQ ID NO: 1222612 - RNA, 16 nt, Human
gacaaugcaaaccauc

SEQ ID NO: 1222613 - RNA, 12 nt, Human
gacaaugcaaac

SEQ ID NO: 1222614 - RNA, 21 nt, Human
gacaaugacuuacuguacaug

SEQ ID NO: 1222615 - RNA, 20 nt, Human
gacaaugacuuacuguacau

SEQ ID NO: 1222616 - RNA, 17 nt, Human
gacaaugacuuacugua

SEQ ID NO: 1222617 - RNA, 16 nt, Human
gacaaugacccagugg

SEQ ID NO: 1222618 - RNA, 22 nt, Human
gacaaggauugcuacuguccua

SEQ ID NO: 1222619 - RNA, 16 nt, Human
gaagucuuuguacaga

SEQ ID NO: 1222620 - RNA, 14 nt, Human
gaagucuuuguaca

SEQ ID NO: 1222621 - RNA, 21 nt, Human
gacaugucuuuucuugcauga

SEQ ID NO: 1222622 - RNA, 17 nt, Human
gacaugucuuuucuugc

SEQ ID NO: 1222623 - RNA, 23 nt, Human
gacauacuaaccagcagaaaugc

SEQ ID NO: 1222624 - RNA, 16 nt, Human
gacauacuaaccagca

SEQ ID NO: 1222625 - RNA, 15 nt, Human
gacauacuaaccagc

SEQ ID NO: 1222626 - RNA, 20 nt, Human
gacaggcauguucucugagg

SEQ ID NO: 1222627 - RNA, 19 nt, Human
gacaggcauguucucugag

SEQ ID NO: 1222628 - RNA, 18 nt, Human
gacaggcauguucucuga

SEQ ID NO: 1222629 - RNA, 18 nt, Human
gacaggcaaugcuggcug

SEQ ID NO: 1222630 - RNA, 17 nt, Human
gacaggcaaugcuggcu

SEQ ID NO: 1222631 - RNA, 16 nt, Human
gacaggcaaugcuggc

SEQ ID NO: 1222632 - RNA, 14 nt, Human
gacaggcaaugcug

SEQ ID NO: 1222633 - RNA, 15 nt, Human
gacagcugccuggga

SEQ ID NO: 1222634 - RNA, 14 nt, Human
gacagcugccuggg

SEQ ID NO: 1222635 - RNA, 13 nt, Human
gacagcugccugg

SEQ ID NO: 1222636 - RNA, 12 nt, Human
gacagcugccug

SEQ ID NO: 1222637 - RNA, 13 nt, Human
gacagccacggcc

SEQ ID NO: 1222638 - RNA, 14 nt, Human
gacagacacaggcc

SEQ ID NO: 1222639 - RNA, 21 nt, Human
gacacuaaccacgcuggaccu

SEQ ID NO: 1222640 - RNA, 20 nt, Human
gacacuaaccacgcuggacc

SEQ ID NO: 1222641 - RNA, 16 nt, Human
gacagacacaggcccg

SEQ ID NO: 1222642 - RNA, 15 nt, Human
gacagacacaggccc

SEQ ID NO: 1222643 - RNA, 17 nt, Human
gacagacacaggcccgg

SEQ ID NO: 1222644 - RNA, 16 nt, Human
gaagacuucaucccuc

SEQ ID NO: 1222645 - RNA, 15 nt, Human
gaagacuucaucccu

SEQ ID NO: 1222646 - RNA, 12 nt, Human
gaagagccuugc

SEQ ID NO: 1222647 - RNA, 19 nt, Human
gaagacuucaucccucugg

SEQ ID NO: 1222648 - RNA, 17 nt, Human
gaagacuucaucccucu

SEQ ID NO: 1222649 - RNA, 23 nt, Human
gaagauuuugaaauuuuuauuaa

SEQ ID NO: 1222650 - RNA, 22 nt, Human
gaacuuugaccucugcagcaau

SEQ ID NO: 1222651 - RNA, 16 nt, Human
gaacuuugaccucugc

SEQ ID NO: 1222652 - RNA, 17 nt, Human
gaacuugggccacugug

SEQ ID NO: 1222653 - RNA, 18 nt, Human
gaacuuggcgcugccccu

SEQ ID NO: 1222654 - RNA, 17 nt, Human
gaacuuuccaggaaggc

SEQ ID NO: 1222655 - RNA, 12 nt, Human
gaacuugguucc

SEQ ID NO: 1222656 - RNA, 17 nt, Human
gaacuuaaauaauguga

SEQ ID NO: 1222657 - RNA, 14 nt, Human
gaacuuaaauaaug

SEQ ID NO: 1222658 - RNA, 20 nt, Human
gaaccacaucuugcucugcu

SEQ ID NO: 1222659 - RNA, 18 nt, Human
gaaccacaucuugcucug

SEQ ID NO: 1222660 - RNA, 13 nt, Human
gaagggggcuggg

SEQ ID NO: 1222661 - RNA, 15 nt, Human
gaagggggcugggac

SEQ ID NO: 1222662 - RNA, 13 nt, Human
gaagucacacagu

SEQ ID NO: 1222663 - RNA, 21 nt, Human
gaaguaauaugcacacauuuu

SEQ ID NO: 1222664 - RNA, 20 nt, Human
gaaguaauaugcacacauuu

SEQ ID NO: 1222665 - RNA, 19 nt, Human
gaaguaauaugcacacauu

SEQ ID NO: 1222666 - RNA, 15 nt, Human
gaaggaacguccccu

SEQ ID NO: 1222667 - RNA, 22 nt, Human
gaaggaaacccagcucuggucc

SEQ ID NO: 1222668 - RNA, 21 nt, Human
gaaggaaacccagcucugguc

SEQ ID NO: 1222669 - RNA, 19 nt, Human
gaaggaagacuucaucccu

SEQ ID NO: 1222670 - RNA, 21 nt, Human
gaaggacauugcggacagcca

SEQ ID NO: 1222671 - RNA, 20 nt, Human
gaaggacauugcggacagcc

SEQ ID NO: 1222672 - RNA, 19 nt, Human
gaaggacauugcggacagc

SEQ ID NO: 1222673 - RNA, 20 nt, Human
gaaggaaacccagcucuggu

SEQ ID NO: 1222674 - RNA, 21 nt, Human
gaagccgcuggggccaguugg

SEQ ID NO: 1222675 - RNA, 20 nt, Human
gaagccgcuggggccaguug

SEQ ID NO: 1222676 - RNA, 18 nt, Human
gaagccgcuggggccagu

SEQ ID NO: 1222677 - RNA, 14 nt, Human
gaagccgcuggggc

SEQ ID NO: 1222678 - RNA, 20 nt, Human
gaaauaucugaaaauguaug

SEQ ID NO: 1222679 - RNA, 19 nt, Human
gaaauaucugaaaauguau

SEQ ID NO: 1222680 - RNA, 18 nt, Human
gaaauaucugaaaaugua

SEQ ID NO: 1222681 - RNA, 17 nt, Human
gaaauguacagcaagga

SEQ ID NO: 1222682 - RNA, 19 nt, Human
gaaaugggcagagcagaga

SEQ ID NO: 1222683 - RNA, 17 nt, Human
gaaaugggcagagcaga

SEQ ID NO: 1222684 - RNA, 16 nt, Human
gaaaugggcagagcag

SEQ ID NO: 1222685 - RNA, 18 nt, Human
gaaaugaggucagagccu

SEQ ID NO: 1222686 - RNA, 11 nt, Human
gaaaugagcug

SEQ ID NO: 1222687 - RNA, 16 nt, Human
gaacacuccuucacag

SEQ ID NO: 1222688 - RNA, 15 nt, Human
gaacacuccuucaca

SEQ ID NO: 1222689 - RNA, 20 nt, Human
gaacagacuggaagcacagc

SEQ ID NO: 1222690 - RNA, 17 nt, Human
gaacacuccuucacaga

SEQ ID NO: 1222691 - RNA, 22 nt, Human
gaacagacuggaagcacagcuu

SEQ ID NO: 1222692 - RNA, 16 nt, Human
gaaaggaaagaggcuc

SEQ ID NO: 1222693 - RNA, 11 nt, Human
gaaaggaaaga

SEQ ID NO: 1222694 - RNA, 16 nt, Human
gaaaaaugagccuggc

SEQ ID NO: 1222695 - RNA, 17 nt, Human
gaaagacuguacaaagu

SEQ ID NO: 1222696 - RNA, 16 nt, Human
gaaagaucaaaagguu

SEQ ID NO: 1222697 - RNA, 21 nt, Human
cuuuucgcaggauucuuccuc

SEQ ID NO: 1222698 - RNA, 20 nt, Human
cuuuucgcaggauucuuccu

SEQ ID NO: 1222699 - RNA, 23 nt, Human
cuuuuccaacccucaucaccaac

SEQ ID NO: 1222700 - RNA, 13 nt, Human
cuuuuccaacccu

SEQ ID NO: 1222701 - RNA, 22 nt, Human
cuuuucauuuaggugaggaagc

SEQ ID NO: 1222702 - RNA, 17 nt, Human
cuuuucuuucagccaag

SEQ ID NO: 1222703 - RNA, 13 nt, Human
cuuuucuuuucuu

SEQ ID NO: 1222704 - RNA, 22 nt, Human
cuuuuuaauauugauaugcuua

SEQ ID NO: 1222705 - RNA, 16 nt, Human
gaaaaagaaaaaauau

SEQ ID NO: 1222706 - RNA, 11 nt, Human
gaaaaagaaaa

SEQ ID NO: 1222707 - RNA, 15 nt, Human
cuuuuuucacuacau

SEQ ID NO: 1222708 - RNA, 18 nt, Human
cuuuuuuauacauaaaca

SEQ ID NO: 1222709 - RNA, 17 nt, Human
cuuuuuuauacauaaac

SEQ ID NO: 1222710 - RNA, 16 nt, Human
cuuuuuuauacauaaa

SEQ ID NO: 1222711 - RNA, 15 nt, Human
cuuuuuuauacauaa

SEQ ID NO: 1222712 - RNA, 21 nt, Human
cuuuccugaggcugggcuccc

SEQ ID NO: 1222713 - RNA, 20 nt, Human
cuuuccugaggcugggcucc

SEQ ID NO: 1222714 - RNA, 17 nt, Human
cuuuccugaggcugggc

SEQ ID NO: 1222715 - RNA, 23 nt, Human
cuuuggaaagaguaggaagacuu

SEQ ID NO: 1222716 - RNA, 19 nt, Human
cuuuggaaagaguaggaag

SEQ ID NO: 1222717 - RNA, 16 nt, Human
cuuugcagacaggcaa

SEQ ID NO: 1222718 - RNA, 15 nt, Human
cuuugcagacaggca

SEQ ID NO: 1222719 - RNA, 14 nt, Human
cuuugcagacaggc

SEQ ID NO: 1222720 - RNA, 14 nt, Human
cuuuccaggaaggc

SEQ ID NO: 1222721 - RNA, 16 nt, Human
cuuuccaaaugcccag

SEQ ID NO: 1222722 - RNA, 22 nt, Human
cuuuccaaaguacacuguuuca

SEQ ID NO: 1222723 - RNA, 16 nt, Human
cuuuccaaaguacacu

SEQ ID NO: 1222724 - RNA, 15 nt, Human
cuuuccaggaaggcu

SEQ ID NO: 1222725 - RNA, 20 nt, Human
cuuguguguuuauugucaaa

SEQ ID NO: 1222726 - RNA, 21 nt, Human
cuuguggacacagcucuucuc

SEQ ID NO: 1222727 - RNA, 18 nt, Human
cuuguggacacagcucuu

SEQ ID NO: 1222728 - RNA, 17 nt, Human
cuuguggacacagcucu

SEQ ID NO: 1222729 - RNA, 20 nt, Human
cuuggggaccagagcugcca

SEQ ID NO: 1222730 - RNA, 19 nt, Human
cuuggggaccagagcugcc

SEQ ID NO: 1222731 - RNA, 18 nt, Human
cuuggggaccagagcugc

SEQ ID NO: 1222732 - RNA, 17 nt, Human
cuuggggaccagagcug

SEQ ID NO: 1222733 - RNA, 14 nt, Human
cuuggcugcaggga

SEQ ID NO: 1222734 - RNA, 13 nt, Human
cuuggcugcaggg

SEQ ID NO: 1222735 - RNA, 12 nt, Human
cuuggcugcagg

SEQ ID NO: 1222736 - RNA, 23 nt, Human
cuuggcucaaguccucuuuucug

SEQ ID NO: 1222737 - RNA, 14 nt, Human
cuuggauugucccc

SEQ ID NO: 1222738 - RNA, 13 nt, Human
cuuggauuguccc

SEQ ID NO: 1222739 - RNA, 13 nt, Human
cuugcuugcuuuu

SEQ ID NO: 1222740 - RNA, 16 nt, Human
cuugaacuggguacuu

SEQ ID NO: 1222741 - RNA, 19 nt, Human
cuugaacuccuggccucaa

SEQ ID NO: 1222742 - RNA, 15 nt, Human
cuugaacuuugaccu

SEQ ID NO: 1222743 - RNA, 20 nt, Human
cuugaacuggguacuugugg

SEQ ID NO: 1222744 - RNA, 18 nt, Human
cuugaacuggguacuugu

SEQ ID NO: 1222745 - RNA, 18 nt, Human
cuugaacuccuggccuca

SEQ ID NO: 1222746 - RNA, 17 nt, Human
cuugaacuccuggccuc

SEQ ID NO: 1222747 - RNA, 15 nt, Human
cuugaacuccuggcc

SEQ ID NO: 1222748 - RNA, 14 nt, Human
cuugaacuccuggc

SEQ ID NO: 1222749 - RNA, 19 nt, Human
cuugaaauauaggaacuua

SEQ ID NO: 1222750 - RNA, 13 nt, Human
cuugagcucagga

SEQ ID NO: 1222751 - RNA, 22 nt, Human
cuugagccuugaacuuugaccu

SEQ ID NO: 1222752 - RNA, 20 nt, Human
cuugagccuugaacuuugac

SEQ ID NO: 1222753 - RNA, 19 nt, Human
cuugagccuugaacuuuga

SEQ ID NO: 1222754 - RNA, 21 nt, Human
cuugaccauucuccaccugcc

SEQ ID NO: 1222755 - RNA, 14 nt, Human
cuugagagggugga

SEQ ID NO: 1222756 - RNA, 20 nt, Human
cuugaccauucuccaccugc

SEQ ID NO: 1222757 - RNA, 17 nt, Human
cuugaccauucuccacc

SEQ ID NO: 1222758 - RNA, 14 nt, Human
cuugcaauggcagc

SEQ ID NO: 1222759 - RNA, 18 nt, Human
cuugaguugauucagcuc

SEQ ID NO: 1222760 - RNA, 22 nt, Human
cuugcaaaguaucccuacugua

SEQ ID NO: 1222761 - RNA, 21 nt, Human
cuugcaugaggcuaguguggu

SEQ ID NO: 1222762 - RNA, 20 nt, Human
cuugcagacucuacagaggc

SEQ ID NO: 1222763 - RNA, 18 nt, Human
cuugcagacucuacagag

SEQ ID NO: 1222764 - RNA, 22 nt, Human
cuguaccucuugagccuugaac

SEQ ID NO: 1222765 - RNA, 15 nt, Human
cuguaucccaugagc

SEQ ID NO: 1222766 - RNA, 19 nt, Human
cuguaucccaugagccuca

SEQ ID NO: 1222767 - RNA, 18 nt, Human
cuguaucccaugagccuc

SEQ ID NO: 1222768 - RNA, 22 nt, Human
cugucccagugccgagaaggaa

SEQ ID NO: 1222769 - RNA, 20 nt, Human
cuguccuacucugugucagg

SEQ ID NO: 1222770 - RNA, 18 nt, Human
cuguccuacucuguguca

SEQ ID NO: 1222771 - RNA, 17 nt, Human
cuguccuacucuguguc

SEQ ID NO: 1222772 - RNA, 16 nt, Human
cuguccuacucugugu

SEQ ID NO: 1222773 - RNA, 17 nt, Human
cuguccccgcacugggc

SEQ ID NO: 1222774 - RNA, 14 nt, Human
cugucccccugaca

SEQ ID NO: 1222775 - RNA, 13 nt, Human
cugucccccugac

SEQ ID NO: 1222776 - RNA, 22 nt, Human
cugucucaaaaaaagaaaaaga

SEQ ID NO: 1222777 - RNA, 14 nt, Human
cuguccgagcuuug

SEQ ID NO: 1222778 - RNA, 21 nt, Human
cuguccuacucugugucaggu

SEQ ID NO: 1222779 - RNA, 23 nt, Human
cuggucucaaacucuugaccuca

SEQ ID NO: 1222780 - RNA, 14 nt, Human
cuggucccacucag

SEQ ID NO: 1222781 - RNA, 13 nt, Human
cuggucccacuca

SEQ ID NO: 1222782 - RNA, 19 nt, Human
cuggguacuuguggacaca

SEQ ID NO: 1222783 - RNA, 18 nt, Human
cuggguacuuguggacac

SEQ ID NO: 1222784 - RNA, 16 nt, Human
cuggguacuuguggac

SEQ ID NO: 1222785 - RNA, 22 nt, Human
cugggcucccuucccaccucuc

SEQ ID NO: 1222786 - RNA, 21 nt, Human
cugggcucccuucccaccucu

SEQ ID NO: 1222787 - RNA, 20 nt, Human
cugggcucccuucccaccuc

SEQ ID NO: 1222788 - RNA, 15 nt, Human
cuggguuggagggug

SEQ ID NO: 1222789 - RNA, 21 nt, Human
cuguaccucuugagccuugaa

SEQ ID NO: 1222790 - RNA, 23 nt, Human
cuguacaugaaaacacauuuuuc

SEQ ID NO: 1222791 - RNA, 22 nt, Human
cuguacaugaaaacacauuuuu

SEQ ID NO: 1222792 - RNA, 23 nt, Human
cuguacagagcccacgcccccac

SEQ ID NO: 1222793 - RNA, 22 nt, Human
cuguaauuugugauacaaugcu

SEQ ID NO: 1222794 - RNA, 21 nt, Human
cuguaauuugugauacaaugc

SEQ ID NO: 1222795 - RNA, 18 nt, Human
cuguaauuugugauacaa

SEQ ID NO: 1222796 - RNA, 16 nt, Human
cugguuccauggccuc

SEQ ID NO: 1222797 - RNA, 20 nt, Human
cugguucaggguuggccccu

SEQ ID NO: 1222798 - RNA, 16 nt, Human
cugguggcagcucacc

SEQ ID NO: 1222799 - RNA, 14 nt, Human
cugguggcagcuca

SEQ ID NO: 1222800 - RNA, 13 nt, Human
cugguggcagcuc

SEQ ID NO: 1222801 - RNA, 12 nt, Human
cugguggcagcu

SEQ ID NO: 1222802 - RNA, 21 nt, Human
cugggaggucaaggcugcagu

SEQ ID NO: 1222803 - RNA, 19 nt, Human
cugggaggucaaggcugca

SEQ ID NO: 1222804 - RNA, 18 nt, Human
cugggaugauuggagggg

SEQ ID NO: 1222805 - RNA, 20 nt, Human
cugggaucccucauccucau

SEQ ID NO: 1222806 - RNA, 12 nt, Human
cugggagugagc

SEQ ID NO: 1222807 - RNA, 17 nt, Human
cugggauuacaggugug

SEQ ID NO: 1222808 - RNA, 20 nt, Human
cugggauuacaggugugaac

SEQ ID NO: 1222809 - RNA, 17 nt, Human
cuggcuguuggcugggg

SEQ ID NO: 1222810 - RNA, 16 nt, Human
cuggcuguuggcuggg

SEQ ID NO: 1222811 - RNA, 20 nt, Human
cuggcugguuagagguuccc

SEQ ID NO: 1222812 - RNA, 21 nt, Human
cugggagagccuuccaggggu

SEQ ID NO: 1222813 - RNA, 20 nt, Human
cugggagagccuuccagggg

SEQ ID NO: 1222814 - RNA, 19 nt, Human
cugggagagccuuccaggg

SEQ ID NO: 1222815 - RNA, 18 nt, Human
cugggagagccuuccagg

SEQ ID NO: 1222816 - RNA, 17 nt, Human
cugggagagccuuccag

SEQ ID NO: 1222817 - RNA, 18 nt, Human
cuggcuguuggcuggggg

SEQ ID NO: 1222818 - RNA, 19 nt, Human
cuggcacccggccccugcu

SEQ ID NO: 1222819 - RNA, 18 nt, Human
cuggcacccggccccugc

SEQ ID NO: 1222820 - RNA, 17 nt, Human
cuggcacccggccccug

SEQ ID NO: 1222821 - RNA, 16 nt, Human
cuggcacccggccccu

SEQ ID NO: 1222822 - RNA, 14 nt, Human
cuggcaagaaugug

SEQ ID NO: 1222823 - RNA, 14 nt, Human
cuggaaugcagugg

SEQ ID NO: 1222824 - RNA, 18 nt, Human
cuggaauauauaaccagu

SEQ ID NO: 1222825 - RNA, 24 nt, Human
cuggcaugggaaugaaugucagug

SEQ ID NO: 1222826 - RNA, 22 nt, Human
cuggcaugggaaugaaugucag

SEQ ID NO: 1222827 - RNA, 19 nt, Human
cuggcaugggaaugaaugu

SEQ ID NO: 1222828 - RNA, 18 nt, Human
cuggcaugggaaugaaug

SEQ ID NO: 1222829 - RNA, 16 nt, Human
cuggcaugggaaugaa

SEQ ID NO: 1222830 - RNA, 22 nt, Human
cuggcacuauaauguaagcucu

SEQ ID NO: 1222831 - RNA, 16 nt, Human
cuggcacuauaaugua

SEQ ID NO: 1222832 - RNA, 15 nt, Human
cuggcacuauaaugu

SEQ ID NO: 1222833 - RNA, 19 nt, Human
cuggccuggccccucaggg

SEQ ID NO: 1222834 - RNA, 17 nt, Human
cuggccuggccccucag

SEQ ID NO: 1222835 - RNA, 16 nt, Human
cuggccuggccccuca

SEQ ID NO: 1222836 - RNA, 14 nt, Human
cuggccuggccccu

SEQ ID NO: 1222837 - RNA, 18 nt, Human
cuggccugagcugggaug

SEQ ID NO: 1222838 - RNA, 16 nt, Human
cuggccugagcuggga

SEQ ID NO: 1222839 - RNA, 16 nt, Human
cuggccucugcacucc

SEQ ID NO: 1222840 - RNA, 14 nt, Human
cuggccucugcacu

SEQ ID NO: 1222841 - RNA, 13 nt, Human
cuggccucugcac

SEQ ID NO: 1222842 - RNA, 12 nt, Human
cuggccucugca

SEQ ID NO: 1222843 - RNA, 23 nt, Human
cuggccucaagugauucuccugc

SEQ ID NO: 1222844 - RNA, 22 nt, Human
cugccaggaagccagcaggcuc

SEQ ID NO: 1222845 - RNA, 15 nt, Human
cugccauccucccaa

SEQ ID NO: 1222846 - RNA, 21 nt, Human
cugccauccagguucagcuug

SEQ ID NO: 1222847 - RNA, 21 nt, Human
cugccaggaagccagcaggcu

SEQ ID NO: 1222848 - RNA, 20 nt, Human
cugccaggaagccagcaggc

SEQ ID NO: 1222849 - RNA, 14 nt, Human
cugccaggaagcca

SEQ ID NO: 1222850 - RNA, 13 nt, Human
cugccaggaagcc

SEQ ID NO: 1222851 - RNA, 21 nt, Human
cugccacccuggggagaaagu

SEQ ID NO: 1222852 - RNA, 14 nt, Human
cugccacccugggg

SEQ ID NO: 1222853 - RNA, 12 nt, Human
cugccacccugg

SEQ ID NO: 1222854 - RNA, 20 nt, Human
cugcaucaagaugugacaug

SEQ ID NO: 1222855 - RNA, 15 nt, Human
cugcauaugaaagga

SEQ ID NO: 1222856 - RNA, 20 nt, Human
cugcccggcaggguccuaga

SEQ ID NO: 1222857 - RNA, 13 nt, Human
cugcccggcaggg

SEQ ID NO: 1222858 - RNA, 19 nt, Human
cugccccuggcagccccug

SEQ ID NO: 1222859 - RNA, 18 nt, Human
cugccccuggcagccccu

SEQ ID NO: 1222860 - RNA, 15 nt, Human
cugcccaggccccug

SEQ ID NO: 1222861 - RNA, 14 nt, Human
cugcccaggccccu

SEQ ID NO: 1222862 - RNA, 13 nt, Human
cugcccaccuggc

SEQ ID NO: 1222863 - RNA, 12 nt, Human
cugcccaccugg

SEQ ID NO: 1222864 - RNA, 16 nt, Human
cugccauuucugagau

SEQ ID NO: 1222865 - RNA, 15 nt, Human
cugccauuucugaga

SEQ ID NO: 1222866 - RNA, 20 nt, Human
cugcccaggccccugccacc

SEQ ID NO: 1222867 - RNA, 19 nt, Human
cugcccaggccccugccac

SEQ ID NO: 1222868 - RNA, 18 nt, Human
cugcccaggccccugcca

SEQ ID NO: 1222869 - RNA, 16 nt, Human
cugcccaggccccugc

SEQ ID NO: 1222870 - RNA, 17 nt, Human
cugcaguugccagucac

SEQ ID NO: 1222871 - RNA, 16 nt, Human
cugcaguugccaguca

SEQ ID NO: 1222872 - RNA, 13 nt, Human
cugcaguugccag

SEQ ID NO: 1222873 - RNA, 17 nt, Human
cugcagcaauaaagcag

SEQ ID NO: 1222874 - RNA, 16 nt, Human
cugcagcaauaaagca

SEQ ID NO: 1222875 - RNA, 15 nt, Human
cugcagcaauaaagc

SEQ ID NO: 1222876 - RNA, 13 nt, Human
cugcagagggcac

SEQ ID NO: 1222877 - RNA, 10 nt, Human
cugcagaggg

SEQ ID NO: 1222878 - RNA, 21 nt, Human
cugcacuccccugcugggugu

SEQ ID NO: 1222879 - RNA, 20 nt, Human
cugcacuccccugcugggug

SEQ ID NO: 1222880 - RNA, 19 nt, Human
cugcacuccccugcugggu

SEQ ID NO: 1222881 - RNA, 14 nt, Human
cugcacuccccugc

SEQ ID NO: 1222882 - RNA, 13 nt, Human
cugcacuccccug

SEQ ID NO: 1222883 - RNA, 20 nt, Human
cugcacuccagccuggguga

SEQ ID NO: 1222884 - RNA, 20 nt, Human
cugcaccgggccacagagaa

SEQ ID NO: 1222885 - RNA, 18 nt, Human
cugcaccgggccacagag

SEQ ID NO: 1222886 - RNA, 15 nt, Human
cugcaccgggccaca

SEQ ID NO: 1222887 - RNA, 16 nt, Human
cugcaccggcuggccu

SEQ ID NO: 1222888 - RNA, 15 nt, Human
cugcaccggcuggcc

SEQ ID NO: 1222889 - RNA, 23 nt, Human
cugaggcccuucucuccagcccc

SEQ ID NO: 1222890 - RNA, 22 nt, Human
cugaggcccuucucuccagccc

SEQ ID NO: 1222891 - RNA, 14 nt, Human
cugcaccggcuggc

SEQ ID NO: 1222892 - RNA, 24 nt, Human
cugaggcccuucucuccagccccu

SEQ ID NO: 1222893 - RNA, 12 nt, Human
cugcucugguua

SEQ ID NO: 1222894 - RNA, 15 nt, Human
cugcugcaguugcca

SEQ ID NO: 1222895 - RNA, 14 nt, Human
cugcugcaguugcc

SEQ ID NO: 1222896 - RNA, 13 nt, Human
cugcugcaguugc

SEQ ID NO: 1222897 - RNA, 10 nt, Human
cugcugcagu

SEQ ID NO: 1222898 - RNA, 19 nt, Human
cugcucuccgaccagacac

SEQ ID NO: 1222899 - RNA, 15 nt, Human
cugcucuccgaccag

SEQ ID NO: 1222900 - RNA, 23 nt, Human
cugcuccucuccccagcaaguga

SEQ ID NO: 1222901 - RNA, 20 nt, Human
cugcuccucuccccagcaag

SEQ ID NO: 1222902 - RNA, 19 nt, Human
cugcuccucuccccagcaa

SEQ ID NO: 1222903 - RNA, 23 nt, Human
cugcggugcuaucucccccagcc

SEQ ID NO: 1222904 - RNA, 22 nt, Human
cugcggugcuaucucccccagc

SEQ ID NO: 1222905 - RNA, 21 nt, Human
cugcggugcuaucucccccag

SEQ ID NO: 1222906 - RNA, 20 nt, Human
cugcggugcuaucuccccca

SEQ ID NO: 1222907 - RNA, 19 nt, Human
cugcggugcuaucuccccc

SEQ ID NO: 1222908 - RNA, 18 nt, Human
cugcggugcuaucucccc

SEQ ID NO: 1222909 - RNA, 23 nt, Human
cugcgguccacccaggagccccg

SEQ ID NO: 1222910 - RNA, 18 nt, Human
cugccugaagucacacag

SEQ ID NO: 1222911 - RNA, 21 nt, Human
cugcccugcccaccuggccuc

SEQ ID NO: 1222912 - RNA, 20 nt, Human
cugcccugcccaccuggccu

SEQ ID NO: 1222913 - RNA, 23 nt, Human
cugccugaagucacacagugagu

SEQ ID NO: 1222914 - RNA, 19 nt, Human
cugccugaagucacacagu

SEQ ID NO: 1222915 - RNA, 19 nt, Human
cugcuugugaaaggaaaga

SEQ ID NO: 1222916 - RNA, 19 nt, Human
cugcuugggcuucauccuc

SEQ ID NO: 1222917 - RNA, 18 nt, Human
cugcuugggcuucauccu

SEQ ID NO: 1222918 - RNA, 17 nt, Human
cugcuugggcuucaucc

SEQ ID NO: 1222919 - RNA, 15 nt, Human
cugcuugggcuucau

SEQ ID NO: 1222920 - RNA, 13 nt, Human
cugcuugggcuuc

SEQ ID NO: 1222921 - RNA, 20 nt, Human
cugcuugcuugcuuuuuaau

SEQ ID NO: 1222922 - RNA, 22 nt, Human
cugcuugaggcaacucaucuua

SEQ ID NO: 1222923 - RNA, 19 nt, Human
cugcuuuugucuaugggac

SEQ ID NO: 1222924 - RNA, 17 nt, Human
cugcuuuuggucugugu

SEQ ID NO: 1222925 - RNA, 15 nt, Human
cugcuuuuggucugu

SEQ ID NO: 1222926 - RNA, 21 nt, Human
cugcuugaggcaacucaucuu

SEQ ID NO: 1222927 - RNA, 20 nt, Human
cugcuugaggcaacucaucu

SEQ ID NO: 1222928 - RNA, 13 nt, Human
cugcuugaggcaa

SEQ ID NO: 1222929 - RNA, 17 nt, Human
cugcuggguguggcgca

SEQ ID NO: 1222930 - RNA, 15 nt, Human
cugcuggguguggcg

SEQ ID NO: 1222931 - RNA, 14 nt, Human
cugcuggguguggc

SEQ ID NO: 1222932 - RNA, 13 nt, Human
cugcugcuggcug

SEQ ID NO: 1222933 - RNA, 12 nt, Human
cugcugcuggcu

SEQ ID NO: 1222934 - RNA, 14 nt, Human
cugcugcuggcugg

SEQ ID NO: 1222935 - RNA, 21 nt, Human
cucuuggguucaagcgauucu

SEQ ID NO: 1222936 - RNA, 19 nt, Human
cucuuggguucaagcgauu

SEQ ID NO: 1222937 - RNA, 22 nt, Human
cucuugaaauauaggaacuuaa

SEQ ID NO: 1222938 - RNA, 21 nt, Human
cucuuccaggcugggagagcc

SEQ ID NO: 1222939 - RNA, 17 nt, Human
cucuuucccucccuucc

SEQ ID NO: 1222940 - RNA, 23 nt, Human
cucuuuaaugucacaggcagguc

SEQ ID NO: 1222941 - RNA, 22 nt, Human
cucuuuaaugucacaggcaggu

SEQ ID NO: 1222942 - RNA, 21 nt, Human
cucuuuaaugucacaggcagg

SEQ ID NO: 1222943 - RNA, 20 nt, Human
cucuuuaaugucacaggcag

SEQ ID NO: 1222944 - RNA, 18 nt, Human
cucuuuaaugucacaggc

SEQ ID NO: 1222945 - RNA, 17 nt, Human
cucuugguccugcugca

SEQ ID NO: 1222946 - RNA, 16 nt, Human
cucuugguccugcugc

SEQ ID NO: 1222947 - RNA, 15 nt, Human
cucuugguccugcug

SEQ ID NO: 1222948 - RNA, 13 nt, Human
cucuugguccugc

SEQ ID NO: 1222949 - RNA, 23 nt, Human
cugaaagcccugagcuuucugcu

SEQ ID NO: 1222950 - RNA, 19 nt, Human
cugaaagcccugagcuuuc

SEQ ID NO: 1222951 - RNA, 18 nt, Human
cugaaagcccugagcuuu

SEQ ID NO: 1222952 - RNA, 17 nt, Human
cugaaagcccugagcuu

SEQ ID NO: 1222953 - RNA, 16 nt, Human
cugaaagcccugagcu

SEQ ID NO: 1222954 - RNA, 15 nt, Human
cugaaagcccugagc

SEQ ID NO: 1222955 - RNA, 17 nt, Human
cucuuucuauuguuucu

SEQ ID NO: 1222956 - RNA, 19 nt, Human
cugaagaauugaaaaacca

SEQ ID NO: 1222957 - RNA, 15 nt, Human
cucuuccaggcuggg

SEQ ID NO: 1222958 - RNA, 14 nt, Human
cucuuccaggcugg

SEQ ID NO: 1222959 - RNA, 13 nt, Human
cucuuccaggcug

SEQ ID NO: 1222960 - RNA, 15 nt, Human
cucuuagaaaaacca

SEQ ID NO: 1222961 - RNA, 13 nt, Human
cucuuagaaaaac

SEQ ID NO: 1222962 - RNA, 19 nt, Human
cucugugucagguggggca

SEQ ID NO: 1222963 - RNA, 15 nt, Human
cucugugucaggugg

SEQ ID NO: 1222964 - RNA, 15 nt, Human
cucuggacaggcaug

SEQ ID NO: 1222965 - RNA, 22 nt, Human
cucugccugaagucacacagug

SEQ ID NO: 1222966 - RNA, 21 nt, Human
cucugccugaagucacacagu

SEQ ID NO: 1222967 - RNA, 13 nt, Human
cucucuccucccu

SEQ ID NO: 1222968 - RNA, 14 nt, Human
cucuggcagcucag

SEQ ID NO: 1222969 - RNA, 12 nt, Human
cucuggcagcuc

SEQ ID NO: 1222970 - RNA, 22 nt, Human
cucuggacaggcauguucucug

SEQ ID NO: 1222971 - RNA, 16 nt, Human
cucuggacaggcaugu

SEQ ID NO: 1222972 - RNA, 16 nt, Human
cucuggcagcucagag

SEQ ID NO: 1222973 - RNA, 15 nt, Human
cucuggcagcucaga

SEQ ID NO: 1222974 - RNA, 20 nt, Human
cugaggcccuucucuccagc

SEQ ID NO: 1222975 - RNA, 19 nt, Human
cugaggcccuucucuccag

SEQ ID NO: 1222976 - RNA, 18 nt, Human
cugaggcccuucucucca

SEQ ID NO: 1222977 - RNA, 15 nt, Human
cugaggcccuucucu

SEQ ID NO: 1222978 - RNA, 14 nt, Human
cugaggcccuucuc

SEQ ID NO: 1222979 - RNA, 23 nt, Human
cugaggcccagagggccugcaag

SEQ ID NO: 1222980 - RNA, 21 nt, Human
cugaggcccagagggccugca

SEQ ID NO: 1222981 - RNA, 19 nt, Human
cugaggcccagagggccug

SEQ ID NO: 1222982 - RNA, 18 nt, Human
cugaggcccagagggccu

SEQ ID NO: 1222983 - RNA, 17 nt, Human
cugaggcccagagggcc

SEQ ID NO: 1222984 - RNA, 16 nt, Human
cugaggcccagagggc

SEQ ID NO: 1222985 - RNA, 15 nt, Human
cugaggcccagaggg

SEQ ID NO: 1222986 - RNA, 14 nt, Human
cugaggcccagagg

SEQ ID NO: 1222987 - RNA, 13 nt, Human
cugaggcccagag

SEQ ID NO: 1222988 - RNA, 12 nt, Human
cugaggcccaga

SEQ ID NO: 1222989 - RNA, 21 nt, Human
cugagccagauuucacucucc

SEQ ID NO: 1222990 - RNA, 20 nt, Human
cugagccagauuucacucuc

SEQ ID NO: 1222991 - RNA, 19 nt, Human
cugagccagauuucacucu

SEQ ID NO: 1222992 - RNA, 18 nt, Human
cugagccagauuucacuc

SEQ ID NO: 1222993 - RNA, 17 nt, Human
cugagccagauuucacu

SEQ ID NO: 1222994 - RNA, 18 nt, Human
cugagacagcccgggcuc

SEQ ID NO: 1222995 - RNA, 17 nt, Human
cugagacagcccgggcu

SEQ ID NO: 1222996 - RNA, 16 nt, Human
cugagacagcccgggc

SEQ ID NO: 1222997 - RNA, 19 nt, Human
cugagacagcccgggcucu

SEQ ID NO: 1222998 - RNA, 15 nt, Human
cugagacagcccggg

SEQ ID NO: 1222999 - RNA, 14 nt, Human
cugagacagcccgg

SEQ ID NO: 1223000 - RNA, 18 nt, Human
cugacuguuuucucuuga

SEQ ID NO: 1223001 - RNA, 16 nt, Human
cugacuguuuucucuu

SEQ ID NO: 1223002 - RNA, 17 nt, Human
cugacccaugcugcccu

SEQ ID NO: 1223003 - RNA, 16 nt, Human
cugacccaugcugccc

SEQ ID NO: 1223004 - RNA, 15 nt, Human
cugacccaugcugcc

SEQ ID NO: 1223005 - RNA, 14 nt, Human
cugacccaugcugc

SEQ ID NO: 1223006 - RNA, 14 nt, Human
cugacccacugcuu

SEQ ID NO: 1223007 - RNA, 13 nt, Human
cugacccacugcu

SEQ ID NO: 1223008 - RNA, 22 nt, Human
cugacauuguuggccaaagcca

SEQ ID NO: 1223009 - RNA, 19 nt, Human
cugaagacucauucuucug

SEQ ID NO: 1223010 - RNA, 14 nt, Human
cucucucacuccuu

SEQ ID NO: 1223011 - RNA, 12 nt, Human
cucucucacucc

SEQ ID NO: 1223012 - RNA, 18 nt, Human
cucuccucugcugcuggc

SEQ ID NO: 1223013 - RNA, 15 nt, Human
cucuccucugcugcu

SEQ ID NO: 1223014 - RNA, 14 nt, Human
cucuccucugcugc

SEQ ID NO: 1223015 - RNA, 13 nt, Human
cucuccucugcug

SEQ ID NO: 1223016 - RNA, 24 nt, Human
cucuccccagcaagugagagcugg

SEQ ID NO: 1223017 - RNA, 12 nt, Human
cucuccucugcu

SEQ ID NO: 1223018 - RNA, 22 nt, Human
cucuccccagcaagugagagcu

SEQ ID NO: 1223019 - RNA, 14 nt, Human
cucuccccagcaag

SEQ ID NO: 1223020 - RNA, 19 nt, Human
cucuccagccccuggaugc

SEQ ID NO: 1223021 - RNA, 14 nt, Human
cucuccagccccug

SEQ ID NO: 1223022 - RNA, 18 nt, Human
cucuccagccccuggaug

SEQ ID NO: 1223023 - RNA, 17 nt, Human
cucuccagccccuggau

SEQ ID NO: 1223024 - RNA, 16 nt, Human
cucuccagccccugga

SEQ ID NO: 1223025 - RNA, 15 nt, Human
cucuccagccccugg

SEQ ID NO: 1223026 - RNA, 22 nt, Human
cucucaggccagcugcuugggc

SEQ ID NO: 1223027 - RNA, 21 nt, Human
cucucaggccagcugcuuggg

SEQ ID NO: 1223028 - RNA, 19 nt, Human
cucucaggccagcugcuug

SEQ ID NO: 1223029 - RNA, 18 nt, Human
cucucaggccagcugcuu

SEQ ID NO: 1223030 - RNA, 17 nt, Human
cucucaggccagcugcu

SEQ ID NO: 1223031 - RNA, 15 nt, Human
cucucaggccagcug

SEQ ID NO: 1223032 - RNA, 13 nt, Human
cucucaggccagc

SEQ ID NO: 1223033 - RNA, 23 nt, Human
cucucaggccaaacucaccugcc

SEQ ID NO: 1223034 - RNA, 22 nt, Human
cucucaggccaaacucaccugc

SEQ ID NO: 1223035 - RNA, 21 nt, Human
cucucaggccaaacucaccug

SEQ ID NO: 1223036 - RNA, 20 nt, Human
cucucaggccaaacucaccu

SEQ ID NO: 1223037 - RNA, 12 nt, Human
cucucaggccaa

SEQ ID NO: 1223038 - RNA, 21 nt, Human
cucuaguuugauuaaauucuu

SEQ ID NO: 1223039 - RNA, 20 nt, Human
cucuaguuugauuaaauucu

SEQ ID NO: 1223040 - RNA, 19 nt, Human
cucuaguuugauuaaauuc

SEQ ID NO: 1223041 - RNA, 15 nt, Human
cucuaguuugauuaa

SEQ ID NO: 1223042 - RNA, 13 nt, Human
cucuacccuggca

SEQ ID NO: 1223043 - RNA, 20 nt, Human
cucuaccauccccuguagag

SEQ ID NO: 1223044 - RNA, 23 nt, Human
cucuagggaaaaaccagcgugug

SEQ ID NO: 1223045 - RNA, 13 nt, Human
cucuacaaaaagc

SEQ ID NO: 1223046 - RNA, 13 nt, Human
cucuacagaggcc

SEQ ID NO: 1223047 - RNA, 16 nt, Human
cucuacagaggccaug

SEQ ID NO: 1223048 - RNA, 14 nt, Human
cucuacagaggcca

SEQ ID NO: 1223049 - RNA, 19 nt, Human
cucuacagaggccaugggc

SEQ ID NO: 1223050 - RNA, 13 nt, Human
cuccuucaccuuu

SEQ ID NO: 1223051 - RNA, 19 nt, Human
cuccuucacagaugggugc

SEQ ID NO: 1223052 - RNA, 17 nt, Human
cuccuucacagaugggu

SEQ ID NO: 1223053 - RNA, 16 nt, Human
cuccuucacagauggg

SEQ ID NO: 1223054 - RNA, 15 nt, Human
cuccugugucuugca

SEQ ID NO: 1223055 - RNA, 20 nt, Human
cuccugugugugcgccuaca

SEQ ID NO: 1223056 - RNA, 15 nt, Human
cuccgaccagacacc

SEQ ID NO: 1223057 - RNA, 14 nt, Human
cuccugccucagcc

SEQ ID NO: 1223058 - RNA, 13 nt, Human
cuccugccucagc

SEQ ID NO: 1223059 - RNA, 11 nt, Human
cuccugcccuu

SEQ ID NO: 1223060 - RNA, 21 nt, Human
cuccugcaggcagccaggcca

SEQ ID NO: 1223061 - RNA, 20 nt, Human
cuccugcaggcagccaggcc

SEQ ID NO: 1223062 - RNA, 18 nt, Human
cuccugcaggcagccagg

SEQ ID NO: 1223063 - RNA, 17 nt, Human
cuccugcaggcagccag

SEQ ID NO: 1223064 - RNA, 12 nt, Human
cuccugcaggca

SEQ ID NO: 1223065 - RNA, 11 nt, Human
cuccugcaggc

SEQ ID NO: 1223066 - RNA, 19 nt, Human
cuccugugugugcgccuac

SEQ ID NO: 1223067 - RNA, 16 nt, Human
cuccugugugugcgcc

SEQ ID NO: 1223068 - RNA, 15 nt, Human
cuccugccucagccu

SEQ ID NO: 1223069 - RNA, 16 nt, Human
cuccugccucagccuc

SEQ ID NO: 1223070 - RNA, 18 nt, Human
cucacuauguugcccagg

SEQ ID NO: 1223071 - RNA, 13 nt, Human
cuccaugugggcu

SEQ ID NO: 1223072 - RNA, 17 nt, Human
cucccaaagugcuggga

SEQ ID NO: 1223073 - RNA, 23 nt, Human
cucccaucugugaaaggaaagag

SEQ ID NO: 1223074 - RNA, 18 nt, Human
cucccaucugugaaagga

SEQ ID NO: 1223075 - RNA, 15 nt, Human
cucccaucugugaaa

SEQ ID NO: 1223076 - RNA, 14 nt, Human
cucccaucugugaa

SEQ ID NO: 1223077 - RNA, 11 nt, Human
cucccaucugu

SEQ ID NO: 1223078 - RNA, 22 nt, Human
cucccaacucaccccagcccca

SEQ ID NO: 1223079 - RNA, 17 nt, Human
cucccaacucaccccag

SEQ ID NO: 1223080 - RNA, 23 nt, Human
cucccaaagugcugggauuacag

SEQ ID NO: 1223081 - RNA, 14 nt, Human
cuccaugugggcua

SEQ ID NO: 1223082 - RNA, 18 nt, Human
cucccaaagugcugggau

SEQ ID NO: 1223083 - RNA, 12 nt, Human
cuccccugcugg

SEQ ID NO: 1223084 - RNA, 21 nt, Human
cuccccagcaagugagagcug

SEQ ID NO: 1223085 - RNA, 20 nt, Human
cuccccagcaagugagagcu

SEQ ID NO: 1223086 - RNA, 12 nt, Human
cuccccagcaag

SEQ ID NO: 1223087 - RNA, 17 nt, Human
cucccgaguagcuggga

SEQ ID NO: 1223088 - RNA, 16 nt, Human
cucccgaguagcuggg

SEQ ID NO: 1223089 - RNA, 18 nt, Human
cucccgaauagcugggac

SEQ ID NO: 1223090 - RNA, 17 nt, Human
cucccgaauagcuggga

SEQ ID NO: 1223091 - RNA, 14 nt, Human
cuccccugcugggu

SEQ ID NO: 1223092 - RNA, 13 nt, Human
cuccccugcuggg

SEQ ID NO: 1223093 - RNA, 18 nt, Human
cucccgaguagcugggac

SEQ ID NO: 1223094 - RNA, 19 nt, Human
cucccgaauagcugggacu

SEQ ID NO: 1223095 - RNA, 12 nt, Human
cuacccaggugc

SEQ ID NO: 1223096 - RNA, 20 nt, Human
cuacccagcgagcccuggug

SEQ ID NO: 1223097 - RNA, 22 nt, Human
cuacccacccuccuuucaccac

SEQ ID NO: 1223098 - RNA, 17 nt, Human
cuacccacccuccuuuc

SEQ ID NO: 1223099 - RNA, 18 nt, Human
cuaccauccccuguagag

SEQ ID NO: 1223100 - RNA, 17 nt, Human
cuacagaggccaugggc

SEQ ID NO: 1223101 - RNA, 15 nt, Human
cuacagaggccaugg

SEQ ID NO: 1223102 - RNA, 21 nt, Human
cuacacacugcauguuuguga

SEQ ID NO: 1223103 - RNA, 15 nt, Human
cuacacacugcaugu

SEQ ID NO: 1223104 - RNA, 13 nt, Human
cuacacacugcau

SEQ ID NO: 1223105 - RNA, 16 nt, Human
cuaauguacugcauau

SEQ ID NO: 1223106 - RNA, 14 nt, Human
cuaauguacugcau

SEQ ID NO: 1223107 - RNA, 21 nt, Human
cuaauaaaauuuaaaagucuu

SEQ ID NO: 1223108 - RNA, 16 nt, Human
cuaaggugugcucuga

SEQ ID NO: 1223109 - RNA, 17 nt, Human
cuaaccagcagaaaugc

SEQ ID NO: 1223110 - RNA, 16 nt, Human
cuaaccagcagaaaug

SEQ ID NO: 1223111 - RNA, 17 nt, Human
cuaaccacgcuggaccu

SEQ ID NO: 1223112 - RNA, 21 nt, Human
cuaagcuauucaguaauaacu

SEQ ID NO: 1223113 - RNA, 19 nt, Human
cuaagcuauucaguaauaa

SEQ ID NO: 1223114 - RNA, 15 nt, Human
cuaaggugugcucug

SEQ ID NO: 1223115 - RNA, 17 nt, Human
cuacuguaauuugugau

SEQ ID NO: 1223116 - RNA, 16 nt, Human
cuacuguaauuuguga

SEQ ID NO: 1223117 - RNA, 14 nt, Human
cuacugaggugcua

SEQ ID NO: 1223118 - RNA, 21 nt, Human
cuacucugugucagguggggc

SEQ ID NO: 1223119 - RNA, 16 nt, Human
cuacucugugucaggu

SEQ ID NO: 1223120 - RNA, 21 nt, Human
cuacccgggaagggggcuggg

SEQ ID NO: 1223121 - RNA, 20 nt, Human
cuacccgggaagggggcugg

SEQ ID NO: 1223122 - RNA, 15 nt, Human
cuacccgggaagggg

SEQ ID NO: 1223123 - RNA, 14 nt, Human
cuacccgggaaggg

SEQ ID NO: 1223124 - RNA, 17 nt, Human
cuagcacuuugggaggc

SEQ ID NO: 1223125 - RNA, 21 nt, Human
cuagagugaacuugggccacu

SEQ ID NO: 1223126 - RNA, 17 nt, Human
cuagagugaacuugggc

SEQ ID NO: 1223127 - RNA, 15 nt, Human
cuagagguucaaaga

SEQ ID NO: 1223128 - RNA, 21 nt, Human
cuagacgagcaggcuucuucc

SEQ ID NO: 1223129 - RNA, 20 nt, Human
cuagacgagcaggcuucuuc

SEQ ID NO: 1223130 - RNA, 21 nt, Human
cuacuguaauuugugauacaa

SEQ ID NO: 1223131 - RNA, 22 nt, Human
cuaggaccccuccaugugggcu

SEQ ID NO: 1223132 - RNA, 17 nt, Human
cuaggaggucucuaaga

SEQ ID NO: 1223133 - RNA, 12 nt, Human
cuagcagcaggg

SEQ ID NO: 1223134 - RNA, 21 nt, Human
cuaggaagacuuuggaaagag

SEQ ID NO: 1223135 - RNA, 15 nt, Human
cuaggaacacuccuu

SEQ ID NO: 1223136 - RNA, 13 nt, Human
cuaggaacacucc

SEQ ID NO: 1223137 - RNA, 21 nt, Human
cuaggcauuugcugaauacag

SEQ ID NO: 1223138 - RNA, 19 nt, Human
cuagugugguguuuccugg

SEQ ID NO: 1223139 - RNA, 22 nt, Human
cuagugugguguuuccuggcac

SEQ ID NO: 1223140 - RNA, 21 nt, Human
cuagugugguguuuccuggca

SEQ ID NO: 1223141 - RNA, 23 nt, Human
cuagugugguguuuccuggcacu

SEQ ID NO: 1223142 - RNA, 20 nt, Human
cuaucaaguauuauaccuuu

SEQ ID NO: 1223143 - RNA, 14 nt, Human
cuaugacacaugca

SEQ ID NO: 1223144 - RNA, 23 nt, Human
cuauauuguuuucaguguacaug

SEQ ID NO: 1223145 - RNA, 22 nt, Human
cuauauuguuuucaguguacau

SEQ ID NO: 1223146 - RNA, 14 nt, Human
cuaguuccaccauc

SEQ ID NO: 1223147 - RNA, 21 nt, Human
cuaugcauuugaaaauuuuga

SEQ ID NO: 1223148 - RNA, 12 nt, Human
cuaugcauuuga

SEQ ID NO: 1223149 - RNA, 11 nt, Human
cuaugcauuug

SEQ ID NO: 1223150 - RNA, 21 nt, Human
cucaagugauucuccugccuc

SEQ ID NO: 1223151 - RNA, 20 nt, Human
cucaagugauucuccugccu

SEQ ID NO: 1223152 - RNA, 19 nt, Human
cucaagugauucuccugcc

SEQ ID NO: 1223153 - RNA, 18 nt, Human
cucaagugauucuccugc

SEQ ID NO: 1223154 - RNA, 21 nt, Human
cucaccagccccagugcccac

SEQ ID NO: 1223155 - RNA, 20 nt, Human
cucaccagccccagugccca

SEQ ID NO: 1223156 - RNA, 14 nt, Human
cucaccccagcccc

SEQ ID NO: 1223157 - RNA, 13 nt, Human
cucaccccagccc

SEQ ID NO: 1223158 - RNA, 12 nt, Human
cucaccccagcc

SEQ ID NO: 1223159 - RNA, 17 nt, Human
cucacuauguugcccag

SEQ ID NO: 1223160 - RNA, 16 nt, Human
cucacuauguugccca

SEQ ID NO: 1223161 - RNA, 14 nt, Human
cuaugcauuugaaa

SEQ ID NO: 1223162 - RNA, 21 nt, Human
cucaacucuccuccagaguca

SEQ ID NO: 1223163 - RNA, 20 nt, Human
cucaacucuccuccagaguc

SEQ ID NO: 1223164 - RNA, 13 nt, Human
cucaaauuucuaa

SEQ ID NO: 1223165 - RNA, 17 nt, Human
cuaacauggaaguacua

SEQ ID NO: 1223166 - RNA, 15 nt, Human
cuaacauggaaguac

SEQ ID NO: 1223167 - RNA, 16 nt, Human
cuaaauucaugcugcu

SEQ ID NO: 1223168 - RNA, 16 nt, Human
cuaaauguugaaagau

SEQ ID NO: 1223169 - RNA, 18 nt, Human
cuaaauggaaccacucua

SEQ ID NO: 1223170 - RNA, 17 nt, Human
cuaaauggaaccacucu

SEQ ID NO: 1223171 - RNA, 16 nt, Human
cuaaauggaaccacuc

SEQ ID NO: 1223172 - RNA, 15 nt, Human
cuaaauggaaccacu

SEQ ID NO: 1223173 - RNA, 20 nt, Human
cuaaaucuccaaaauaaaac

SEQ ID NO: 1223174 - RNA, 22 nt, Human
cgugcaguggugcgaucugggu

SEQ ID NO: 1223175 - RNA, 21 nt, Human
cgugcaguggugcgaucuggg

SEQ ID NO: 1223176 - RNA, 19 nt, Human
cgugcacacaccagagccc

SEQ ID NO: 1223177 - RNA, 18 nt, Human
cgugcacacaccagagcc

SEQ ID NO: 1223178 - RNA, 16 nt, Human
cgugcacacaccagag

SEQ ID NO: 1223179 - RNA, 22 nt, Human
cgucugacaggcaaugcuggcu

SEQ ID NO: 1223180 - RNA, 21 nt, Human
cgucugacaggcaaugcuggc

SEQ ID NO: 1223181 - RNA, 20 nt, Human
cgucugacaggcaaugcugg

SEQ ID NO: 1223182 - RNA, 22 nt, Human
cggugcuaucucccccagcccc

SEQ ID NO: 1223183 - RNA, 21 nt, Human
cggugcuaucucccccagccc

SEQ ID NO: 1223184 - RNA, 20 nt, Human
cggugcuaucucccccagcc

SEQ ID NO: 1223185 - RNA, 18 nt, Human
cggugcuaucucccccag

SEQ ID NO: 1223186 - RNA, 16 nt, Human
cgucucauacucaccu

SEQ ID NO: 1223187 - RNA, 20 nt, Human
cgguccacccaggagccccg

SEQ ID NO: 1223188 - RNA, 16 nt, Human
cgguccacccaggagc

SEQ ID NO: 1223189 - RNA, 15 nt, Human
cgguccacccaggag

SEQ ID NO: 1223190 - RNA, 14 nt, Human
cgguccacccagga

SEQ ID NO: 1223191 - RNA, 21 nt, Human
cggugagaggggaacagacug

SEQ ID NO: 1223192 - RNA, 20 nt, Human
cggugagaggggaacagacu

SEQ ID NO: 1223193 - RNA, 15 nt, Human
cgggggcagagaggg

SEQ ID NO: 1223194 - RNA, 23 nt, Human
cggggacagcuccuucuguccua

SEQ ID NO: 1223195 - RNA, 23 nt, Human
cggcuggccuggccccucagggu

SEQ ID NO: 1223196 - RNA, 22 nt, Human
cggcuggccuggccccucaggg

SEQ ID NO: 1223197 - RNA, 14 nt, Human
cggcuggcagccca

SEQ ID NO: 1223198 - RNA, 22 nt, Human
cgggcacucagaagacacugau

SEQ ID NO: 1223199 - RNA, 14 nt, Human
cgggcacucagaag

SEQ ID NO: 1223200 - RNA, 20 nt, Human
cgggaggucgaggcaggagg

SEQ ID NO: 1223201 - RNA, 18 nt, Human
cgggaggucgaggcagga

SEQ ID NO: 1223202 - RNA, 19 nt, Human
cggccccugcugguucagg

SEQ ID NO: 1223203 - RNA, 18 nt, Human
cggccccugcugguucag

SEQ ID NO: 1223204 - RNA, 13 nt, Human
cggccccugcugg

SEQ ID NO: 1223205 - RNA, 17 nt, Human
cggccaccugcggugcu

SEQ ID NO: 1223206 - RNA, 16 nt, Human
cggccaccugcggugc

SEQ ID NO: 1223207 - RNA, 15 nt, Human
cggccaccugcggug

SEQ ID NO: 1223208 - RNA, 11 nt, Human
cggccaccugc

SEQ ID NO: 1223209 - RNA, 14 nt, Human
cggaauaguuggcu

SEQ ID NO: 1223210 - RNA, 13 nt, Human
cggaagagccuug

SEQ ID NO: 1223211 - RNA, 22 nt, Human
cgcuaagagggagggagggcuc

SEQ ID NO: 1223212 - RNA, 16 nt, Human
cgcuacccgggaaggg

SEQ ID NO: 1223213 - RNA, 17 nt, Human
cgcuacccgggaagggg

SEQ ID NO: 1223214 - RNA, 20 nt, Human
cggaaaacaugcuacacacu

SEQ ID NO: 1223215 - RNA, 15 nt, Human
cggaaaacaugcuac

SEQ ID NO: 1223216 - RNA, 18 nt, Human
cgcugugcugcccugccc

SEQ ID NO: 1223217 - RNA, 17 nt, Human
cgcugugcugcccugcc

SEQ ID NO: 1223218 - RNA, 16 nt, Human
cgcugugcugcccugc

SEQ ID NO: 1223219 - RNA, 15 nt, Human
cgcugugcugcccug

SEQ ID NO: 1223220 - RNA, 22 nt, Human
cgcugucagccauuccuguucc

SEQ ID NO: 1223221 - RNA, 17 nt, Human
cgccaucccagccccaa

SEQ ID NO: 1223222 - RNA, 16 nt, Human
cgccaucccagcccca

SEQ ID NO: 1223223 - RNA, 14 nt, Human
cgccaucccagccc

SEQ ID NO: 1223224 - RNA, 23 nt, Human
cgccaggggaaaaucagccugcu

SEQ ID NO: 1223225 - RNA, 20 nt, Human
ccucugcccacucccugcaa

SEQ ID NO: 1223226 - RNA, 19 nt, Human
ccucugcccacucccugca

SEQ ID NO: 1223227 - RNA, 17 nt, Human
ccucugcccacucccug

SEQ ID NO: 1223228 - RNA, 22 nt, Human
cgcccaggcuuagucacugaga

SEQ ID NO: 1223229 - RNA, 12 nt, Human
cgcccagucugg

SEQ ID NO: 1223230 - RNA, 22 nt, Human
cagugguuccuaauccucuagg

SEQ ID NO: 1223231 - RNA, 16 nt, Human
caguggcagcugcuuu

SEQ ID NO: 1223232 - RNA, 15 nt, Human
caguggcagcugcuu

SEQ ID NO: 1223233 - RNA, 14 nt, Human
caguggcagcugcu

SEQ ID NO: 1223234 - RNA, 13 nt, Human
caguggcagcugc

SEQ ID NO: 1223235 - RNA, 12 nt, Human
caguggcagcug

SEQ ID NO: 1223236 - RNA, 12 nt, Human
cagugugacuga

SEQ ID NO: 1223237 - RNA, 14 nt, Human
cagugugacaagga

SEQ ID NO: 1223238 - RNA, 23 nt, Human
caguguacauggaauaacaugua

SEQ ID NO: 1223239 - RNA, 20 nt, Human
caguguacauggaauaacau

SEQ ID NO: 1223240 - RNA, 16 nt, Human
caguguacauggaaua

SEQ ID NO: 1223241 - RNA, 22 nt, Human
caguguuguggauuuaacagaa

SEQ ID NO: 1223242 - RNA, 20 nt, Human
caguguuguggauuuaacag

SEQ ID NO: 1223243 - RNA, 19 nt, Human
caguguuguggauuuaaca

SEQ ID NO: 1223244 - RNA, 14 nt, Human
caguuacucagaau

SEQ ID NO: 1223245 - RNA, 14 nt, Human
caguuaagagaaau

SEQ ID NO: 1223246 - RNA, 13 nt, Human
caguuaagagaaa

SEQ ID NO: 1223247 - RNA, 22 nt, Human
caguucucuccuucuucccccc

SEQ ID NO: 1223248 - RNA, 15 nt, Human
caguucucuccuucu

SEQ ID NO: 1223249 - RNA, 14 nt, Human
caguucucuccuuc

SEQ ID NO: 1223250 - RNA, 13 nt, Human
caguucucuccuu

SEQ ID NO: 1223251 - RNA, 19 nt, Human
caguugaaaaacagcugag

SEQ ID NO: 1223252 - RNA, 18 nt, Human
caguugaaaaacagcuga

SEQ ID NO: 1223253 - RNA, 12 nt, Human
caguugaaaaac

SEQ ID NO: 1223254 - RNA, 18 nt, Human
cauaccacuuuuguucuu

SEQ ID NO: 1223255 - RNA, 15 nt, Human
cauaccacuuuuguu

SEQ ID NO: 1223256 - RNA, 14 nt, Human
cauaccacuuuugu

SEQ ID NO: 1223257 - RNA, 13 nt, Human
cauaccacuuuug

SEQ ID NO: 1223258 - RNA, 12 nt, Human
cauacccacccc

SEQ ID NO: 1223259 - RNA, 11 nt, Human
cauacccaccc

SEQ ID NO: 1223260 - RNA, 19 nt, Human
cauaccacuuuuguucuug

SEQ ID NO: 1223261 - RNA, 14 nt, Human
cauaagauaaaugu

SEQ ID NO: 1223262 - RNA, 16 nt, Human
cauaaccuagccuuag

SEQ ID NO: 1223263 - RNA, 22 nt, Human
cauaaacaagaccacguuucua

SEQ ID NO: 1223264 - RNA, 21 nt, Human
cauaaacaagaccacguuucu

SEQ ID NO: 1223265 - RNA, 20 nt, Human
cauaaacaagaccacguuuc

SEQ ID NO: 1223266 - RNA, 21 nt, Human
cauaaaaauuagccaagugug

SEQ ID NO: 1223267 - RNA, 18 nt, Human
caguuguuagugugucuu

SEQ ID NO: 1223268 - RNA, 17 nt, Human
caguuguuagugugucu

SEQ ID NO: 1223269 - RNA, 22 nt, Human
caguuggucccccuuccaugga

SEQ ID NO: 1223270 - RNA, 21 nt, Human
caguuggucccccuuccaugg

SEQ ID NO: 1223271 - RNA, 20 nt, Human
caguuggucccccuuccaug

SEQ ID NO: 1223272 - RNA, 19 nt, Human
caguuggucccccuuccau

SEQ ID NO: 1223273 - RNA, 18 nt, Human
caguuggucccccuucca

SEQ ID NO: 1223274 - RNA, 19 nt, Human
caguuggguggaugccugg

SEQ ID NO: 1223275 - RNA, 18 nt, Human
caguuggguggaugccug

SEQ ID NO: 1223276 - RNA, 16 nt, Human
caguuggguggaugcc

SEQ ID NO: 1223277 - RNA, 23 nt, Human
caguugccagucaccccggccac

SEQ ID NO: 1223278 - RNA, 21 nt, Human
cauacccacccccacccaagg

SEQ ID NO: 1223279 - RNA, 18 nt, Human
cauacccacccccaccca

SEQ ID NO: 1223280 - RNA, 17 nt, Human
cauacccacccccaccc

SEQ ID NO: 1223281 - RNA, 14 nt, Human
cauacccaccccca

SEQ ID NO: 1223282 - RNA, 21 nt, Human
cauacuaaccagcagaaaugc

SEQ ID NO: 1223283 - RNA, 14 nt, Human
cauacuaaccagca

SEQ ID NO: 1223284 - RNA, 18 nt, Human
cauacguacacauuuuau

SEQ ID NO: 1223285 - RNA, 17 nt, Human
cauacguacacauuuua

SEQ ID NO: 1223286 - RNA, 16 nt, Human
cauacguacacauuuu

SEQ ID NO: 1223287 - RNA, 15 nt, Human
cauacguacacauuu

SEQ ID NO: 1223288 - RNA, 13 nt, Human
cauacguacacau

SEQ ID NO: 1223289 - RNA, 15 nt, Human
cauacucccaucugu

SEQ ID NO: 1223290 - RNA, 14 nt, Human
caucaagaugugac

SEQ ID NO: 1223291 - RNA, 20 nt, Human
cauauuuacuucuuauacau

SEQ ID NO: 1223292 - RNA, 17 nt, Human
cauauuuacuucuuaua

SEQ ID NO: 1223293 - RNA, 16 nt, Human
cauauuuacuucuuau

SEQ ID NO: 1223294 - RNA, 14 nt, Human
cauauuuacuucuu

SEQ ID NO: 1223295 - RNA, 13 nt, Human
cauaugccugggc

SEQ ID NO: 1223296 - RNA, 11 nt, Human
cauacucugcu

SEQ ID NO: 1223297 - RNA, 20 nt, Human
cauacucccaucugugaaag

SEQ ID NO: 1223298 - RNA, 18 nt, Human
cauacucccaucugugaa

SEQ ID NO: 1223299 - RNA, 16 nt, Human
cauacucccaucugug

SEQ ID NO: 1223300 - RNA, 21 nt, Human
cauagagagcaagacgcugug

SEQ ID NO: 1223301 - RNA, 19 nt, Human
cauagagagcaagacgcug

SEQ ID NO: 1223302 - RNA, 23 nt, Human
cauagagagcaagacgcugugcu

SEQ ID NO: 1223303 - RNA, 23 nt, Human
cauauauauguuuuaagaggcag

SEQ ID NO: 1223304 - RNA, 22 nt, Human
cauauauauguuuuaagaggca

SEQ ID NO: 1223305 - RNA, 19 nt, Human
cauaguaugguggcugggu

SEQ ID NO: 1223306 - RNA, 18 nt, Human
cauaguaugguggcuggg

SEQ ID NO: 1223307 - RNA, 20 nt, Human
cauaguaugguggcuggguu

SEQ ID NO: 1223308 - RNA, 22 nt, Human
cauaguggcuuaaaacaacacu

SEQ ID NO: 1223309 - RNA, 20 nt, Human
caucuugcucugcugacaga

SEQ ID NO: 1223310 - RNA, 15 nt, Human
caucuugcucugcug

SEQ ID NO: 1223311 - RNA, 14 nt, Human
caucuugcucugcu

SEQ ID NO: 1223312 - RNA, 13 nt, Human
caucuugcucugc

SEQ ID NO: 1223313 - RNA, 22 nt, Human
caucuuccaaggguacuaagga

SEQ ID NO: 1223314 - RNA, 15 nt, Human
caucuacccuccgau

SEQ ID NO: 1223315 - RNA, 21 nt, Human
cauccucuguacagagcccac

SEQ ID NO: 1223316 - RNA, 19 nt, Human
cauccucuguacagagccc

SEQ ID NO: 1223317 - RNA, 18 nt, Human
cauccucuguacagagcc

SEQ ID NO: 1223318 - RNA, 15 nt, Human
cauccucuguacaga

SEQ ID NO: 1223319 - RNA, 17 nt, Human
caucucacacaugagca

SEQ ID NO: 1223320 - RNA, 16 nt, Human
caucucacacaugagc

SEQ ID NO: 1223321 - RNA, 20 nt, Human
caucucacacaugagcauca

SEQ ID NO: 1223322 - RNA, 13 nt, Human
cauccucccaagg

SEQ ID NO: 1223323 - RNA, 22 nt, Human
cauccucauacccacccccacc

SEQ ID NO: 1223324 - RNA, 21 nt, Human
cauccucauacccacccccac

SEQ ID NO: 1223325 - RNA, 18 nt, Human
cauccucauacccacccc

SEQ ID NO: 1223326 - RNA, 17 nt, Human
cauccucauacccaccc

SEQ ID NO: 1223327 - RNA, 19 nt, Human
cauccuccucagaucuucu

SEQ ID NO: 1223328 - RNA, 18 nt, Human
cauccuccucagaucuuc

SEQ ID NO: 1223329 - RNA, 16 nt, Human
cauccuccucagaucu

SEQ ID NO: 1223330 - RNA, 15 nt, Human
cauccuccucagauc

SEQ ID NO: 1223331 - RNA, 12 nt, Human
cauccuccucag

SEQ ID NO: 1223332 - RNA, 11 nt, Human
cauccuccuca

SEQ ID NO: 1223333 - RNA, 16 nt, Human
cauccucauacccacc

SEQ ID NO: 1223334 - RNA, 15 nt, Human
cauccucauacccac

SEQ ID NO: 1223335 - RNA, 21 nt, Human
caucccugaaggccccgccca

SEQ ID NO: 1223336 - RNA, 19 nt, Human
caucccugaaggccccgcc

SEQ ID NO: 1223337 - RNA, 18 nt, Human
caucccugaaggccccgc

SEQ ID NO: 1223338 - RNA, 17 nt, Human
caucccugaaggccccg

SEQ ID NO: 1223339 - RNA, 22 nt, Human
caucccugaaggccccgcccag

SEQ ID NO: 1223340 - RNA, 21 nt, Human
caucauugaaaucuuuuugcu

SEQ ID NO: 1223341 - RNA, 20 nt, Human
caucauugaaaucuuuuugc

SEQ ID NO: 1223342 - RNA, 15 nt, Human
caucauugaaaucuu

SEQ ID NO: 1223343 - RNA, 14 nt, Human
caucauugaaaucu

SEQ ID NO: 1223344 - RNA, 13 nt, Human
caucauugaaauc

SEQ ID NO: 1223345 - RNA, 20 nt, Human
caucaccaacgucugugcca

SEQ ID NO: 1223346 - RNA, 15 nt, Human
caucaccaacgucug

SEQ ID NO: 1223347 - RNA, 13 nt, Human
caucccugaaggc

SEQ ID NO: 1223348 - RNA, 11 nt, Human
caucccugaag

SEQ ID NO: 1223349 - RNA, 19 nt, Human
caucccucuggggcuguuc

SEQ ID NO: 1223350 - RNA, 17 nt, Human
cauccagguucagcuug

SEQ ID NO: 1223351 - RNA, 15 nt, Human
cauccagguucagcu

SEQ ID NO: 1223352 - RNA, 15 nt, Human
cauguuuuguuuacg

SEQ ID NO: 1223353 - RNA, 21 nt, Human
cauuaaagccugaguuugcuu

SEQ ID NO: 1223354 - RNA, 18 nt, Human
cauguuuuucuucucccu

SEQ ID NO: 1223355 - RNA, 16 nt, Human
cauggucggaaaacau

SEQ ID NO: 1223356 - RNA, 23 nt, Human
caugucuuuucuugcaugaggcu

SEQ ID NO: 1223357 - RNA, 21 nt, Human
caugucuuuucuugcaugagg

SEQ ID NO: 1223358 - RNA, 19 nt, Human
caugucuuuucuugcauga

SEQ ID NO: 1223359 - RNA, 14 nt, Human
caugucuuuucuug

SEQ ID NO: 1223360 - RNA, 21 nt, Human
cauguaauuaaguacuaugua

SEQ ID NO: 1223361 - RNA, 18 nt, Human
cauguaauuaaguacuau

SEQ ID NO: 1223362 - RNA, 23 nt, Human
cauguuugauguaucugagcagg

SEQ ID NO: 1223363 - RNA, 22 nt, Human
caugugccagguuuuuggucug

SEQ ID NO: 1223364 - RNA, 21 nt, Human
caugugccagguuuuuggucu

SEQ ID NO: 1223365 - RNA, 15 nt, Human
caugugcacaugcac

SEQ ID NO: 1223366 - RNA, 17 nt, Human
caugggccuccugugug

SEQ ID NO: 1223367 - RNA, 16 nt, Human
caugggccuccugugu

SEQ ID NO: 1223368 - RNA, 15 nt, Human
caugggccuccugug

SEQ ID NO: 1223369 - RNA, 22 nt, Human
caugggaaugaaugucagugug

SEQ ID NO: 1223370 - RNA, 17 nt, Human
cauggucggaaaacaug

SEQ ID NO: 1223371 - RNA, 17 nt, Human
cauggagguuugaagau

SEQ ID NO: 1223372 - RNA, 13 nt, Human
cauggacuuuguu

SEQ ID NO: 1223373 - RNA, 11 nt, Human
cauggacuuug

SEQ ID NO: 1223374 - RNA, 18 nt, Human
caugggaaugaaugucag

SEQ ID NO: 1223375 - RNA, 16 nt, Human
cauggaguauauguca

SEQ ID NO: 1223376 - RNA, 18 nt, Human
cauggacaugaucuucuu

SEQ ID NO: 1223377 - RNA, 16 nt, Human
cauggaauaacaugua

SEQ ID NO: 1223378 - RNA, 22 nt, Human
cauggaaguacuauaauuuacc

SEQ ID NO: 1223379 - RNA, 20 nt, Human
cauggaaguacuauaauuua

SEQ ID NO: 1223380 - RNA, 22 nt, Human
caugcugucccuuacgugaguc

SEQ ID NO: 1223381 - RNA, 23 nt, Human
caugccuggauggggcugcaccg

SEQ ID NO: 1223382 - RNA, 21 nt, Human
caugccuggauggggcugcac

SEQ ID NO: 1223383 - RNA, 18 nt, Human
caugccuggauggggcug

SEQ ID NO: 1223384 - RNA, 13 nt, Human
caugccuggaugg

SEQ ID NO: 1223385 - RNA, 19 nt, Human
caugccucucucaggccaa

SEQ ID NO: 1223386 - RNA, 18 nt, Human
caugccucucucaggcca

SEQ ID NO: 1223387 - RNA, 17 nt, Human
caugccucucucaggcc

SEQ ID NO: 1223388 - RNA, 16 nt, Human
caugccucucucaggc

SEQ ID NO: 1223389 - RNA, 15 nt, Human
caugccucucucagg

SEQ ID NO: 1223390 - RNA, 14 nt, Human
caugccucucucag

SEQ ID NO: 1223391 - RNA, 13 nt, Human
caugccccugaac

SEQ ID NO: 1223392 - RNA, 20 nt, Human
caugccagcuuaucucaggg

SEQ ID NO: 1223393 - RNA, 19 nt, Human
caugccagcuuaucucagg

SEQ ID NO: 1223394 - RNA, 16 nt, Human
ccaacaucaacaucuu

SEQ ID NO: 1223395 - RNA, 16 nt, Human
ccaacauacucccauc

SEQ ID NO: 1223396 - RNA, 14 nt, Human
ccaacauacuccca

SEQ ID NO: 1223397 - RNA, 19 nt, Human
ccaaagcagugcaugcugu

SEQ ID NO: 1223398 - RNA, 22 nt, Human
ccaaauucuuucaguggcuacc

SEQ ID NO: 1223399 - RNA, 15 nt, Human
ccaaauucuuucagu

SEQ ID NO: 1223400 - RNA, 15 nt, Human
ccaagaccuucuccu

SEQ ID NO: 1223401 - RNA, 15 nt, Human
ccaacccucaucacc

SEQ ID NO: 1223402 - RNA, 14 nt, Human
ccaaagaugcagcc

SEQ ID NO: 1223403 - RNA, 13 nt, Human
ccaaagaugcagc

SEQ ID NO: 1223404 - RNA, 14 nt, Human
ccaagcaggacaug

SEQ ID NO: 1223405 - RNA, 14 nt, Human
ccaagcucccaggc

SEQ ID NO: 1223406 - RNA, 13 nt, Human
ccaagcucccagg

SEQ ID NO: 1223407 - RNA, 12 nt, Human
ccaagcucccag

SEQ ID NO: 1223408 - RNA, 13 nt, Human
ccacaagagccca

SEQ ID NO: 1223409 - RNA, 16 nt, Human
ccacaagacccuugug

SEQ ID NO: 1223410 - RNA, 18 nt, Human
ccacaaaggagagcuagc

SEQ ID NO: 1223411 - RNA, 14 nt, Human
ccaaggcuggggga

SEQ ID NO: 1223412 - RNA, 20 nt, Human
ccacaaguuaaauaaaucau

SEQ ID NO: 1223413 - RNA, 15 nt, Human
ccacaaguuaaauaa

SEQ ID NO: 1223414 - RNA, 21 nt, Human
ccacaagagcccaggccuccu

SEQ ID NO: 1223415 - RNA, 20 nt, Human
ccacaagagcccaggccucc

SEQ ID NO: 1223416 - RNA, 19 nt, Human
ccacaagagcccaggccuc

SEQ ID NO: 1223417 - RNA, 18 nt, Human
ccacaagagcccaggccu

SEQ ID NO: 1223418 - RNA, 17 nt, Human
ccacaagagcccaggcc

SEQ ID NO: 1223419 - RNA, 16 nt, Human
ccacaagagcccaggc

SEQ ID NO: 1223420 - RNA, 14 nt, Human
cauugaccugaggc

SEQ ID NO: 1223421 - RNA, 22 nt, Human
cauugaccugaggcccuucucu

SEQ ID NO: 1223422 - RNA, 13 nt, Human
cauugaccugagg

SEQ ID NO: 1223423 - RNA, 19 nt, Human
cauugaaaucuuuuugcuu

SEQ ID NO: 1223424 - RNA, 21 nt, Human
cauuucuuccacaagagccca

SEQ ID NO: 1223425 - RNA, 21 nt, Human
cauuuacuuuguguucaccuu

SEQ ID NO: 1223426 - RNA, 17 nt, Human
cauuuacuuuguguuca

SEQ ID NO: 1223427 - RNA, 19 nt, Human
cauuugaggucuguucuuu

SEQ ID NO: 1223428 - RNA, 18 nt, Human
cauuugaggucuguucuu

SEQ ID NO: 1223429 - RNA, 17 nt, Human
cauuugaggucuguucu

SEQ ID NO: 1223430 - RNA, 16 nt, Human
cauuugagcagggcuc

SEQ ID NO: 1223431 - RNA, 14 nt, Human
cauuugagcagggc

SEQ ID NO: 1223432 - RNA, 23 nt, Human
cauuucuuccacaagagcccagg

SEQ ID NO: 1223433 - RNA, 17 nt, Human
ccaaacucaccugcccc

SEQ ID NO: 1223434 - RNA, 21 nt, Human
ccaaaauaaaacuuuuuaaaa

SEQ ID NO: 1223435 - RNA, 18 nt, Human
ccaaaauaaaacuuuuua

SEQ ID NO: 1223436 - RNA, 20 nt, Human
cauuuuuaguagagacaggg

SEQ ID NO: 1223437 - RNA, 19 nt, Human
cauuuuuaguagagacagg

SEQ ID NO: 1223438 - RNA, 21 nt, Human
cauuuuuaagugcugcauuua

SEQ ID NO: 1223439 - RNA, 20 nt, Human
cauuuuuaagugcugcauuu

SEQ ID NO: 1223440 - RNA, 15 nt, Human
cauuuuuaagugcug

SEQ ID NO: 1223441 - RNA, 23 nt, Human
cauuuugggguacccacugcucu

SEQ ID NO: 1223442 - RNA, 22 nt, Human
cauuuugggguacccacugcuc

SEQ ID NO: 1223443 - RNA, 21 nt, Human
cauuuugggguacccacugcu

SEQ ID NO: 1223444 - RNA, 20 nt, Human
cauuuugggguacccacugc

SEQ ID NO: 1223445 - RNA, 24 nt, Human
cauuuugcuaaaugugaaugauga

SEQ ID NO: 1223446 - RNA, 21 nt, Human
cauuuugcuaaaugugaauga

SEQ ID NO: 1223447 - RNA, 18 nt, Human
cauuuugcuaaaugugaa

SEQ ID NO: 1223448 - RNA, 22 nt, Human
cauuugaggucuguucuuucca

SEQ ID NO: 1223449 - RNA, 22 nt, Human
cauuuuauuuuauuaugcauga

SEQ ID NO: 1223450 - RNA, 21 nt, Human
cauuuuauuuuauuaugcaug

SEQ ID NO: 1223451 - RNA, 19 nt, Human
cauuuuauuuuauuaugca

SEQ ID NO: 1223452 - RNA, 16 nt, Human
ccaucaugucuggcua

SEQ ID NO: 1223453 - RNA, 14 nt, Human
ccaucaugucuggc

SEQ ID NO: 1223454 - RNA, 21 nt, Human
ccauccucuguacagagccca

SEQ ID NO: 1223455 - RNA, 12 nt, Human
ccaucacccgcu

SEQ ID NO: 1223456 - RNA, 12 nt, Human
ccaucaagccac

SEQ ID NO: 1223457 - RNA, 19 nt, Human
ccauauucuguuggccagu

SEQ ID NO: 1223458 - RNA, 18 nt, Human
ccauauucuguuggccag

SEQ ID NO: 1223459 - RNA, 15 nt, Human
ccauauucuguuggc

SEQ ID NO: 1223460 - RNA, 23 nt, Human
ccauagagagcaagacgcugugc

SEQ ID NO: 1223461 - RNA, 22 nt, Human
ccagugguuccuaauccucuag

SEQ ID NO: 1223462 - RNA, 23 nt, Human
ccagggacagaggggguggccuc

SEQ ID NO: 1223463 - RNA, 14 nt, Human
ccagggacagaggg

SEQ ID NO: 1223464 - RNA, 19 nt, Human
ccaggccuccuacagcuug

SEQ ID NO: 1223465 - RNA, 18 nt, Human
ccaggccuccuacagcuu

SEQ ID NO: 1223466 - RNA, 13 nt, Human
ccaggccuccuac

SEQ ID NO: 1223467 - RNA, 20 nt, Human
ccaggcccucugcccacucc

SEQ ID NO: 1223468 - RNA, 19 nt, Human
ccaggcccucugcccacuc

SEQ ID NO: 1223469 - RNA, 18 nt, Human
ccaggcccucugcccacu

SEQ ID NO: 1223470 - RNA, 17 nt, Human
ccaggcccucugcccac

SEQ ID NO: 1223471 - RNA, 23 nt, Human
ccaggccccugccacccugggga

SEQ ID NO: 1223472 - RNA, 21 nt, Human
ccaggccccugccacccuggg

SEQ ID NO: 1223473 - RNA, 21 nt, Human
ccaggccagagggagugacag

SEQ ID NO: 1223474 - RNA, 14 nt, Human
ccaggccagaggga

SEQ ID NO: 1223475 - RNA, 15 nt, Human
ccaggagcagccaca

SEQ ID NO: 1223476 - RNA, 14 nt, Human
ccaggagcagccac

SEQ ID NO: 1223477 - RNA, 13 nt, Human
ccaggagcagcca

SEQ ID NO: 1223478 - RNA, 12 nt, Human
ccaggagcagcc

SEQ ID NO: 1223479 - RNA, 20 nt, Human
ccaggaagccagcaggcucu

SEQ ID NO: 1223480 - RNA, 19 nt, Human
ccaggaagccagcaggcuc

SEQ ID NO: 1223481 - RNA, 17 nt, Human
ccaggaagccagcaggc

SEQ ID NO: 1223482 - RNA, 15 nt, Human
ccaggaagccagcag

SEQ ID NO: 1223483 - RNA, 16 nt, Human
ccagcuguucagcugg

SEQ ID NO: 1223484 - RNA, 23 nt, Human
ccagcugugcucuggacaggcau

SEQ ID NO: 1223485 - RNA, 22 nt, Human
ccagcugugcucuggacaggca

SEQ ID NO: 1223486 - RNA, 21 nt, Human
ccagcugugcucuggacaggc

SEQ ID NO: 1223487 - RNA, 20 nt, Human
ccagcugugcucuggacagg

SEQ ID NO: 1223488 - RNA, 18 nt, Human
ccagcugugcucuggaca

SEQ ID NO: 1223489 - RNA, 15 nt, Human
ccagcugcuugggcu

SEQ ID NO: 1223490 - RNA, 18 nt, Human
ccagcugcuugggcuuca

SEQ ID NO: 1223491 - RNA, 16 nt, Human
ccagcugcuugggcuu

SEQ ID NO: 1223492 - RNA, 20 nt, Human
ccagcugcuugggcuucauc

SEQ ID NO: 1223493 - RNA, 15 nt, Human
cccagcgagcccugg

SEQ ID NO: 1223494 - RNA, 14 nt, Human
cccagcgagcccug

SEQ ID NO: 1223495 - RNA, 18 nt, Human
cccagcucugguccauag

SEQ ID NO: 1223496 - RNA, 16 nt, Human
cccagcucugguccau

SEQ ID NO: 1223497 - RNA, 15 nt, Human
cccagcucuggucca

SEQ ID NO: 1223498 - RNA, 14 nt, Human
cccagcucuggucc

SEQ ID NO: 1223499 - RNA, 13 nt, Human
cccagcucugguc

SEQ ID NO: 1223500 - RNA, 12 nt, Human
cccagcucuggu

SEQ ID NO: 1223501 - RNA, 14 nt, Human
cccaggaggccagc

SEQ ID NO: 1223502 - RNA, 18 nt, Human
cccaggagccccgaggcc

SEQ ID NO: 1223503 - RNA, 14 nt, Human
cccaggagccccga

SEQ ID NO: 1223504 - RNA, 13 nt, Human
cccaggagccccg

SEQ ID NO: 1223505 - RNA, 15 nt, Human
cccagccccauccuc

SEQ ID NO: 1223506 - RNA, 14 nt, Human
cccagccccauccu

SEQ ID NO: 1223507 - RNA, 14 nt, Human
cccagccccauccc

SEQ ID NO: 1223508 - RNA, 13 nt, Human
cccagccccaucc

SEQ ID NO: 1223509 - RNA, 19 nt, Human
cccagccccauccucugua

SEQ ID NO: 1223510 - RNA, 18 nt, Human
cccagccccauccucugu

SEQ ID NO: 1223511 - RNA, 12 nt, Human
cccagccccauc

SEQ ID NO: 1223512 - RNA, 11 nt, Human
cccagccccau

SEQ ID NO: 1223513 - RNA, 17 nt, Human
cccagccccaaugaaca

SEQ ID NO: 1223514 - RNA, 16 nt, Human
cccagcaagugagagc

SEQ ID NO: 1223515 - RNA, 18 nt, Human
cccaggaggccagccuug

SEQ ID NO: 1223516 - RNA, 15 nt, Human
cccacgcccccacug

SEQ ID NO: 1223517 - RNA, 14 nt, Human
cccacgcccccacu

SEQ ID NO: 1223518 - RNA, 13 nt, Human
cccacgcccccac

SEQ ID NO: 1223519 - RNA, 20 nt, Human
cccaccuuggcugcagggag

SEQ ID NO: 1223520 - RNA, 19 nt, Human
cccaccuuggcugcaggga

SEQ ID NO: 1223521 - RNA, 17 nt, Human
cccaccuuggcugcagg

SEQ ID NO: 1223522 - RNA, 16 nt, Human
cccaccuggccucugc

SEQ ID NO: 1223523 - RNA, 15 nt, Human
cccaccuggccucug

SEQ ID NO: 1223524 - RNA, 12 nt, Human
cccaccuggccu

SEQ ID NO: 1223525 - RNA, 21 nt, Human
ccauguuggccaggcuggucu

SEQ ID NO: 1223526 - RNA, 19 nt, Human
ccauguuggccaggcuggu

SEQ ID NO: 1223527 - RNA, 15 nt, Human
ccauguuggccaggc

SEQ ID NO: 1223528 - RNA, 16 nt, Human
ccauguuggccaggcu

SEQ ID NO: 1223529 - RNA, 14 nt, Human
ccauguuggccagg

SEQ ID NO: 1223530 - RNA, 13 nt, Human
ccauguuggccag

SEQ ID NO: 1223531 - RNA, 13 nt, Human
ccaugugccaggu

SEQ ID NO: 1223532 - RNA, 18 nt, Human
ccaugcuccuggcccacu

SEQ ID NO: 1223533 - RNA, 15 nt, Human
ccaugcuccuggccc

SEQ ID NO: 1223534 - RNA, 17 nt, Human
ccaugcugcccugugag

SEQ ID NO: 1223535 - RNA, 16 nt, Human
ccaugcugcccuguga

SEQ ID NO: 1223536 - RNA, 13 nt, Human
ccccaggaggcca

SEQ ID NO: 1223537 - RNA, 22 nt, Human
cccaugagccucagcauccugg

SEQ ID NO: 1223538 - RNA, 14 nt, Human
cccaugcugcccug

SEQ ID NO: 1223539 - RNA, 13 nt, Human
cccaugcugcccu

SEQ ID NO: 1223540 - RNA, 12 nt, Human
cccaugcugccc

SEQ ID NO: 1223541 - RNA, 20 nt, Human
cccaugagccucagcauccu

SEQ ID NO: 1223542 - RNA, 16 nt, Human
cccaugagccucagca

SEQ ID NO: 1223543 - RNA, 15 nt, Human
cccaugagccucagc

SEQ ID NO: 1223544 - RNA, 20 nt, Human
cccaucugugaaaggaaaga

SEQ ID NO: 1223545 - RNA, 18 nt, Human
cccaucucacacaugagc

SEQ ID NO: 1223546 - RNA, 13 nt, Human
cccaucucacaca

SEQ ID NO: 1223547 - RNA, 21 nt, Human
ccccaaauggaaaugggcaga

SEQ ID NO: 1223548 - RNA, 14 nt, Human
cccaguuagcucuc

SEQ ID NO: 1223549 - RNA, 20 nt, Human
cccagugguuccuaauccuc

SEQ ID NO: 1223550 - RNA, 17 nt, Human
cccagugccgagaagga

SEQ ID NO: 1223551 - RNA, 15 nt, Human
cccagugccgagaag

SEQ ID NO: 1223552 - RNA, 19 nt, Human
cccagucuggaaugcagug

SEQ ID NO: 1223553 - RNA, 18 nt, Human
cccagucuggaaugcagu

SEQ ID NO: 1223554 - RNA, 10 nt, Human
cccagucugg

SEQ ID NO: 1223555 - RNA, 15 nt, Human
cccaggcauucccca

SEQ ID NO: 1223556 - RNA, 23 nt, Human
cccaggcaggucuugaacuccug

SEQ ID NO: 1223557 - RNA, 16 nt, Human
cccaggaggccagccu

SEQ ID NO: 1223558 - RNA, 15 nt, Human
cccaggaggccagcc

SEQ ID NO: 1223559 - RNA, 18 nt, Human
cccaggcauuccccagga

SEQ ID NO: 1223560 - RNA, 17 nt, Human
cccaggcauuccccagg

SEQ ID NO: 1223561 - RNA, 13 nt, Human
cccagguuucuau

SEQ ID NO: 1223562 - RNA, 17 nt, Human
ccuccaggugcacaagc

SEQ ID NO: 1223563 - RNA, 12 nt, Human
ccuccaggugca

SEQ ID NO: 1223564 - RNA, 11 nt, Human
ccuccaggugc

SEQ ID NO: 1223565 - RNA, 14 nt, Human
ccucccaacucacc

SEQ ID NO: 1223566 - RNA, 17 nt, Human
ccucccaaagugcuggg

SEQ ID NO: 1223567 - RNA, 15 nt, Human
ccuccaugugggcua

SEQ ID NO: 1223568 - RNA, 12 nt, Human
ccuccauguggg

SEQ ID NO: 1223569 - RNA, 12 nt, Human
ccucauacccac

SEQ ID NO: 1223570 - RNA, 20 nt, Human
ccucaggugagaagcagagg

SEQ ID NO: 1223571 - RNA, 18 nt, Human
ccucaggugagaagcaga

SEQ ID NO: 1223572 - RNA, 14 nt, Human
ccuccucagaucuu

SEQ ID NO: 1223573 - RNA, 12 nt, Human
ccuccuccagcc

SEQ ID NO: 1223574 - RNA, 11 nt, Human
ccuccucagau

SEQ ID NO: 1223575 - RNA, 13 nt, Human
ccucccucuuucc

SEQ ID NO: 1223576 - RNA, 19 nt, Human
ccucccgaguagcugggac

SEQ ID NO: 1223577 - RNA, 18 nt, Human
ccucccgaguagcuggga

SEQ ID NO: 1223578 - RNA, 17 nt, Human
ccucccgaguagcuggg

SEQ ID NO: 1223579 - RNA, 20 nt, Human
ccucccgaauagcugggacu

SEQ ID NO: 1223580 - RNA, 19 nt, Human
ccucccgaauagcugggac

SEQ ID NO: 1223581 - RNA, 15 nt, Human
ccucccaacucaccc

SEQ ID NO: 1223582 - RNA, 18 nt, Human
ccucccgaauagcuggga

SEQ ID NO: 1223583 - RNA, 21 nt, Human
ccucccgaauagcugggacua

SEQ ID NO: 1223584 - RNA, 15 nt, Human
ccucuccccagcaag

SEQ ID NO: 1223585 - RNA, 22 nt, Human
ccucucccuuggauuguccccg

SEQ ID NO: 1223586 - RNA, 13 nt, Human
ccucucccuugga

SEQ ID NO: 1223587 - RNA, 20 nt, Human
ccucuccccagcaagugaga

SEQ ID NO: 1223588 - RNA, 21 nt, Human
ccuccuccagccgccaugcuc

SEQ ID NO: 1223589 - RNA, 21 nt, Human
ccucugacacacagcucuguc

SEQ ID NO: 1223590 - RNA, 20 nt, Human
ccucugacacacagcucugu

SEQ ID NO: 1223591 - RNA, 19 nt, Human
ccucugacacacagcucug

SEQ ID NO: 1223592 - RNA, 15 nt, Human
ccucugacacacagc

SEQ ID NO: 1223593 - RNA, 14 nt, Human
ccucugacacacag

SEQ ID NO: 1223594 - RNA, 13 nt, Human
ccucugacacaca

SEQ ID NO: 1223595 - RNA, 16 nt, Human
ccucugcccacucccu

SEQ ID NO: 1223596 - RNA, 13 nt, Human
ccucugcccacuc

SEQ ID NO: 1223597 - RNA, 19 nt, Human
ccucugcacuccccugcug

SEQ ID NO: 1223598 - RNA, 19 nt, Human
ccucugcagcaauaaagca

SEQ ID NO: 1223599 - RNA, 18 nt, Human
ccucugcagcaauaaagc

SEQ ID NO: 1223600 - RNA, 14 nt, Human
ccucugcagcaaua

SEQ ID NO: 1223601 - RNA, 18 nt, Human
ccucugcacuccccugcu

SEQ ID NO: 1223602 - RNA, 23 nt, Human
ccucugcacuccccugcugggug

SEQ ID NO: 1223603 - RNA, 17 nt, Human
ccucugcacuccccugc

SEQ ID NO: 1223604 - RNA, 16 nt, Human
ccucugcacuccccug

SEQ ID NO: 1223605 - RNA, 11 nt, Human
ccucugcacaa

SEQ ID NO: 1223606 - RNA, 14 nt, Human
ccucagcauccugg

SEQ ID NO: 1223607 - RNA, 16 nt, Human
ccucagaucuucugug

SEQ ID NO: 1223608 - RNA, 22 nt, Human
ccucagggucccugguggcagc

SEQ ID NO: 1223609 - RNA, 20 nt, Human
ccucagggucccugguggca

SEQ ID NO: 1223610 - RNA, 17 nt, Human
ccucagggucccuggug

SEQ ID NO: 1223611 - RNA, 16 nt, Human
ccucagggucccuggu

SEQ ID NO: 1223612 - RNA, 16 nt, Human
ccuauuagagaagaga

SEQ ID NO: 1223613 - RNA, 17 nt, Human
ccuauuagagaagagau

SEQ ID NO: 1223614 - RNA, 24 nt, Human
ccucacaguccuuaccagcagagc

SEQ ID NO: 1223615 - RNA, 23 nt, Human
ccucacaguccuuaccagcagag

SEQ ID NO: 1223616 - RNA, 18 nt, Human
ccuaggugacagagugag

SEQ ID NO: 1223617 - RNA, 15 nt, Human
ccuaggugacagagu

SEQ ID NO: 1223618 - RNA, 22 nt, Human
ccucaggugagaagcagaggaa

SEQ ID NO: 1223619 - RNA, 20 nt, Human
ccgggaagggggcugggaca

SEQ ID NO: 1223620 - RNA, 17 nt, Human
ccgggaagggggcuggg

SEQ ID NO: 1223621 - RNA, 13 nt, Human
cccuucccaccuc

SEQ ID NO: 1223622 - RNA, 12 nt, Human
cccuucccaccu

SEQ ID NO: 1223623 - RNA, 22 nt, Human
cccuuguggucccaccccacac

SEQ ID NO: 1223624 - RNA, 23 nt, Human
cccuugguuaggcauugugggaa

SEQ ID NO: 1223625 - RNA, 22 nt, Human
cccuugguuaggcauuguggga

SEQ ID NO: 1223626 - RNA, 17 nt, Human
cccuuggauuguccccg

SEQ ID NO: 1223627 - RNA, 19 nt, Human
ccuacagcuugaccgugag

SEQ ID NO: 1223628 - RNA, 22 nt, Human
ccuacaguugaaaaacagcuga

SEQ ID NO: 1223629 - RNA, 16 nt, Human
ccuaaaauucagugga

SEQ ID NO: 1223630 - RNA, 19 nt, Human
ccuacuguaauuugugaua

SEQ ID NO: 1223631 - RNA, 18 nt, Human
ccuacccacccuccuuuc

SEQ ID NO: 1223632 - RNA, 13 nt, Human
ccuacccacccuc

SEQ ID NO: 1223633 - RNA, 18 nt, Human
ccuacaggagugagcacu

SEQ ID NO: 1223634 - RNA, 13 nt, Human
ccuaggugacaga

SEQ ID NO: 1223635 - RNA, 21 nt, Human
ccuagaaauuccccacccuga

SEQ ID NO: 1223636 - RNA, 12 nt, Human
ccguuauuaaaa

SEQ ID NO: 1223637 - RNA, 13 nt, Human
cccugcccaccug

SEQ ID NO: 1223638 - RNA, 23 nt, Human
cccugccuccuuugugaggaagc

SEQ ID NO: 1223639 - RNA, 16 nt, Human
cccugccuccuuugug

SEQ ID NO: 1223640 - RNA, 18 nt, Human
cccugccacccuggggag

SEQ ID NO: 1223641 - RNA, 17 nt, Human
cccugccacccugggga

SEQ ID NO: 1223642 - RNA, 15 nt, Human
cccugccacccuggg

SEQ ID NO: 1223643 - RNA, 14 nt, Human
cccugccacccugg

SEQ ID NO: 1223644 - RNA, 12 nt, Human
cccugccacccu

SEQ ID NO: 1223645 - RNA, 20 nt, Human
cccugcagagggcacagaaa

SEQ ID NO: 1223646 - RNA, 18 nt, Human
cccugcagagggcacaga

SEQ ID NO: 1223647 - RNA, 12 nt, Human
cccugcagaggg

SEQ ID NO: 1223648 - RNA, 22 nt, Human
cccugcaaccugauugugucuc

SEQ ID NO: 1223649 - RNA, 13 nt, Human
cccugcugguuca

SEQ ID NO: 1223650 - RNA, 20 nt, Human
cccugcugguucaggguugg

SEQ ID NO: 1223651 - RNA, 19 nt, Human
cccugcugguucaggguug

SEQ ID NO: 1223652 - RNA, 22 nt, Human
cccugguggcagugggagcugc

SEQ ID NO: 1223653 - RNA, 14 nt, Human
cccugguggcagcu

SEQ ID NO: 1223654 - RNA, 22 nt, Human
cccucauccucauacccacccc

SEQ ID NO: 1223655 - RNA, 21 nt, Human
cccuccaagaccuucuccuuc

SEQ ID NO: 1223656 - RNA, 20 nt, Human
cccucauccucauacccacc

SEQ ID NO: 1223657 - RNA, 17 nt, Human
cccucauccucauaccc

SEQ ID NO: 1223658 - RNA, 22 nt, Human
cccucaucaccaacgucugugc

SEQ ID NO: 1223659 - RNA, 20 nt, Human
cccucagucuggcccuuccu

SEQ ID NO: 1223660 - RNA, 21 nt, Human
cccucagggucccugguggca

SEQ ID NO: 1223661 - RNA, 13 nt, Human
cccucccucuuuc

SEQ ID NO: 1223662 - RNA, 23 nt, Human
cccucccucuuucccucccuucc

SEQ ID NO: 1223663 - RNA, 17 nt, Human
cccuccaugugggcuag

SEQ ID NO: 1223664 - RNA, 19 nt, Human
cccucagggucccuggugg

SEQ ID NO: 1223665 - RNA, 18 nt, Human
cccucagggucccuggug

SEQ ID NO: 1223666 - RNA, 17 nt, Human
cccucagggucccuggu

SEQ ID NO: 1223667 - RNA, 16 nt, Human
cccucagggucccugg

SEQ ID NO: 1223668 - RNA, 15 nt, Human
cccucagggucccug

SEQ ID NO: 1223669 - RNA, 22 nt, Human
cccuaaaguguauuuuuuuacu

SEQ ID NO: 1223670 - RNA, 17 nt, Human
cccuaaaguguauuuuu

SEQ ID NO: 1223671 - RNA, 16 nt, Human
cccggcaggguccuag

SEQ ID NO: 1223672 - RNA, 15 nt, Human
ccccagccccauccu

SEQ ID NO: 1223673 - RNA, 13 nt, Human
ccccagccugcua

SEQ ID NO: 1223674 - RNA, 15 nt, Human
ccccuggcagccccu

SEQ ID NO: 1223675 - RNA, 14 nt, Human
ccccuggcagcccc

SEQ ID NO: 1223676 - RNA, 12 nt, Human
ccccuggcagcc

SEQ ID NO: 1223677 - RNA, 22 nt, Human
ccccaggugguuauggagaggg

SEQ ID NO: 1223678 - RNA, 12 nt, Human
ccccaggaggcc

SEQ ID NO: 1223679 - RNA, 21 nt, Human
cccgaggccuucucugaagga

SEQ ID NO: 1223680 - RNA, 20 nt, Human
cccgaggccuucucugaagg

SEQ ID NO: 1223681 - RNA, 15 nt, Human
cccgaggccuucucu

SEQ ID NO: 1223682 - RNA, 22 nt, Human
cccgcuaagagggagggagggc

SEQ ID NO: 1223683 - RNA, 22 nt, Human
ccccuguccccgcacugggcuu

SEQ ID NO: 1223684 - RNA, 18 nt, Human
gcaucaagaugugacaug

SEQ ID NO: 1223685 - RNA, 14 nt, Human
aucucucgugauug

SEQ ID NO: 1223686 - RNA, 21 nt, Hepatitis A virus
aauuucugagguuuguuuauu

SEQ ID NO: 1223687 - RNA, 14 nt, Hepatitis A virus
acaaauuuucuuaa

SEQ ID NO: 1223688 - RNA, 12 nt, Hepatitis A virus
uuuucuuaaaau

SEQ ID NO: 1223689 - RNA, 18 nt, Hepatitis A virus
uucugagguuuguuuauu

SEQ ID NO: 1223690 - RNA, 21 nt, Hepatitis A virus
uuuucuuaaaauuucugaggu

SEQ ID NO: 1223691 - RNA, 13 nt, Hepatitis A virus
uuuuaucaguaaa

SEQ ID NO: 1223692 - RNA, 13 nt, Hepatitis A virus
aaacaaauuuucu

SEQ ID NO: 1223693 - RNA, 17 nt, Hepatitis A virus
uucuuaaaauuucugag

SEQ ID NO: 1223694 - RNA, 13 nt, Hepatitis A virus
ucuuaaaauuucu

SEQ ID NO: 1223695 - RNA, 13 nt, Hepatitis A virus
uuaaaauuucuga

SEQ ID NO: 1223696 - RNA, 15 nt, Hepatitis A virus
ucuuaaaauuucuga

SEQ ID NO: 1223697 - RNA, 15 nt, Hepatitis A virus
cuuaaaauuucugag

SEQ ID NO: 1223698 - RNA, 14 nt, Hepatitis A virus
cuuuuaucaguaaa

SEQ ID NO: 1223699 - RNA, 16 nt, Hepatitis A virus
cugagguuuguuuauu

SEQ ID NO: 1223700 - RNA, 17 nt, Hepatitis A virus
uauuucuuuuaucagua

SEQ ID NO: 1223701 - RNA, 19 nt, Hepatitis A virus
cuuaaaauuucugagguuu

SEQ ID NO: 1223702 - RNA, 21 nt, Hepatitis A virus
uaaacaaauuuucuuaaaauu

SEQ ID NO: 1223703 - RNA, 22 nt, Hepatitis A virus
acaaauuuucuuaaaauuucug

SEQ ID NO: 1223704 - RNA, 15 nt, Hepatitis A virus
cuuuuaucaguaaau

SEQ ID NO: 1223705 - RNA, 13 nt, Hepatitis A virus
aauuucugagguu

SEQ ID NO: 1223706 - RNA, 20 nt, Hepatitis A virus
uguuuaaacaaauuuucuua

SEQ ID NO: 1223707 - RNA, 15 nt, Hepatitis A virus
uguuuauuucuuuua

SEQ ID NO: 1223708 - RNA, 22 nt, Hepatitis A virus
uguuuaaacaaauuuucuuaaa

SEQ ID NO: 1223709 - RNA, 23 nt, Hepatitis A virus
caaauuuucuuaaaauuucugag

SEQ ID NO: 1223710 - RNA, 20 nt, Hepatitis A virus
uuuaaacaaauuuucuuaaa

SEQ ID NO: 1223711 - RNA, 24 nt, Hepatitis A virus
uguuuaaacaaauuuucuuaaaau

SEQ ID NO: 1223712 - RNA, 15 nt, Hepatitis A virus
guuuauuucuuuuau

SEQ ID NO: 1223713 - RNA, 18 nt, Hepatitis A virus
auuucuuuuaucaguaaa

SEQ ID NO: 1223714 - RNA, 20 nt, Hepatitis A virus
aauuuucuuaaaauuucuga

SEQ ID NO: 1223715 - RNA, 23 nt, Hepatitis A virus
guuuauuucuuuuaucaguaaau

SEQ ID NO: 1223716 - RNA, 21 nt, Hepatitis A virus
auuuucuuaaaauuucugagg

SEQ ID NO: 1223717 - RNA, 16 nt, Human
aauauauaucaaauau

SEQ ID NO: 1223718 - RNA, 20 nt, Human
aaugaauacuuuauaaagga

SEQ ID NO: 1223719 - RNA, 20 nt, Human
aaugaagauacugaaauaaa

SEQ ID NO: 1223720 - RNA, 14 nt, Human
aaugaagcaaugcu

SEQ ID NO: 1223721 - RNA, 16 nt, Human
aaucucaauauuucag

SEQ ID NO: 1223722 - RNA, 17 nt, Human
aaucucaauucuucccu

SEQ ID NO: 1223723 - RNA, 11 nt, Human
aauaaagcaau

SEQ ID NO: 1223724 - RNA, 12 nt, Human
aauaaagcaauu

SEQ ID NO: 1223725 - RNA, 14 nt, Human
aaguugaauuuauu

SEQ ID NO: 1223726 - RNA, 15 nt, Human
aaguugaauuuauug

SEQ ID NO: 1223727 - RNA, 17 nt, Human
aaguugaauuuauuggc

SEQ ID NO: 1223728 - RNA, 12 nt, Human
aaguugaauuuu

SEQ ID NO: 1223729 - RNA, 23 nt, Human
aaguugaauuuauuggcuuuucu

SEQ ID NO: 1223730 - RNA, 24 nt, Human
aaguugaauuuauuggcuuuucug

SEQ ID NO: 1223731 - RNA, 19 nt, Human
aauaaacacucuugaaaaa

SEQ ID NO: 1223732 - RNA, 15 nt, Human
aaguuuaauauuaaa

SEQ ID NO: 1223733 - RNA, 17 nt, Human
aaguuuaauauuaaagc

SEQ ID NO: 1223734 - RNA, 18 nt, Human
aaguuuaauauuaaagcc

SEQ ID NO: 1223735 - RNA, 11 nt, Human
aauaaacacuc

SEQ ID NO: 1223736 - RNA, 16 nt, Human
aauaaacacucuugaa

SEQ ID NO: 1223737 - RNA, 22 nt, Human
aagacaagaacuccccuuuuuu

SEQ ID NO: 1223738 - RNA, 15 nt, Human
aagaagacugcauua

SEQ ID NO: 1223739 - RNA, 20 nt, Human
aagaagacugcauuauauuu

SEQ ID NO: 1223740 - RNA, 21 nt, Human
aagacaaggaaaaaauaacaa

SEQ ID NO: 1223741 - RNA, 15 nt, Human
aagaacugaaaucau

SEQ ID NO: 1223742 - RNA, 13 nt, Human
aagaacugaaauc

SEQ ID NO: 1223743 - RNA, 12 nt, Human
aagaacugaaau

SEQ ID NO: 1223744 - RNA, 11 nt, Human
aagaacugaaa

SEQ ID NO: 1223745 - RNA, 14 nt, Human
aagaacggaagaag

SEQ ID NO: 1223746 - RNA, 15 nt, Human
aagagaucaggaaga

SEQ ID NO: 1223747 - RNA, 16 nt, Human
aagagaucaggaagag

SEQ ID NO: 1223748 - RNA, 22 nt, Human
aagagaucaggaagagaaggag

SEQ ID NO: 1223749 - RNA, 19 nt, Human
aaggcagggaggaggcaga

SEQ ID NO: 1223750 - RNA, 23 nt, Human
aaggacuuguuagaucuaguuca

SEQ ID NO: 1223751 - RNA, 15 nt, Human
aaggacuuguuagau

SEQ ID NO: 1223752 - RNA, 21 nt, Human
aaggacuuguuagaucuaguu

SEQ ID NO: 1223753 - RNA, 13 nt, Human
aagcuacuuauug

SEQ ID NO: 1223754 - RNA, 22 nt, Human
aaaccgaacugauguaaguaaa

SEQ ID NO: 1223755 - RNA, 14 nt, Human
aaaccaguauugua

SEQ ID NO: 1223756 - RNA, 16 nt, Human
aaaccaguauuguaca

SEQ ID NO: 1223757 - RNA, 17 nt, Human
aaaccaguauuguacaa

SEQ ID NO: 1223758 - RNA, 18 nt, Human
aaaccaguauuguacaaa

SEQ ID NO: 1223759 - RNA, 22 nt, Human
aaaccaguauuguacaaaguau

SEQ ID NO: 1223760 - RNA, 14 nt, Human
aaagccauguuuau

SEQ ID NO: 1223761 - RNA, 16 nt, Human
aaagccauguuuauua

SEQ ID NO: 1223762 - RNA, 17 nt, Human
aaagccauguuuauuac

SEQ ID NO: 1223763 - RNA, 18 nt, Human
aaagccauguuuauuaca

SEQ ID NO: 1223764 - RNA, 23 nt, Human
aaagccauguuuauuacaguaua

SEQ ID NO: 1223765 - RNA, 20 nt, Human
aaaaguuuaauauuaaagcc

SEQ ID NO: 1223766 - RNA, 18 nt, Human
aaaaguuuaauauuaaag

SEQ ID NO: 1223767 - RNA, 18 nt, Human
aaaaguugaauuuuacau

SEQ ID NO: 1223768 - RNA, 14 nt, Human
aaaaguuuaauauu

SEQ ID NO: 1223769 - RNA, 16 nt, Human
aaaaguuuaauauuaa

SEQ ID NO: 1223770 - RNA, 11 nt, Human
aaaagaaugau

SEQ ID NO: 1223771 - RNA, 20 nt, Human
aaaagacaaggaaaaaauaa

SEQ ID NO: 1223772 - RNA, 15 nt, Human
aaaagaaaauuuuug

SEQ ID NO: 1223773 - RNA, 16 nt, Human
aaaucucaauucuucc

SEQ ID NO: 1223774 - RNA, 18 nt, Human
aaaucucaauauuucaga

SEQ ID NO: 1223775 - RNA, 14 nt, Human
aaaugaaaaaauau

SEQ ID NO: 1223776 - RNA, 21 nt, Human
aaauggacuguggugacuuug

SEQ ID NO: 1223777 - RNA, 23 nt, Human
aaauggacuguggugacuuugga

SEQ ID NO: 1223778 - RNA, 13 nt, Human
aaauauuuauuuu

SEQ ID NO: 1223779 - RNA, 22 nt, Human
aaauauuguuuuacaauaguuc

SEQ ID NO: 1223780 - RNA, 23 nt, Human
aaauguugacaugggacauuugc

SEQ ID NO: 1223781 - RNA, 22 nt, Human
aaauguugacaugggacauuug

SEQ ID NO: 1223782 - RNA, 18 nt, Human
aaccuuuguuugcaucug

SEQ ID NO: 1223783 - RNA, 12 nt, Human
aacaucuuuaag

SEQ ID NO: 1223784 - RNA, 18 nt, Human
aacaucuuuaaggggagg

SEQ ID NO: 1223785 - RNA, 21 nt, Human
acacgcacggcagccacagcu

SEQ ID NO: 1223786 - RNA, 11 nt, Human
aauuguaauag

SEQ ID NO: 1223787 - RNA, 14 nt, Human
aauuguaauuauau

SEQ ID NO: 1223788 - RNA, 15 nt, Human
aauuguaauuauauc

SEQ ID NO: 1223789 - RNA, 16 nt, Human
aauuguaauuauaucu

SEQ ID NO: 1223790 - RNA, 17 nt, Human
aauuguaauuauaucug

SEQ ID NO: 1223791 - RNA, 15 nt, Human
aauuuccugggagcu

SEQ ID NO: 1223792 - RNA, 12 nt, Human
aauuuccuggga

SEQ ID NO: 1223793 - RNA, 17 nt, Human
aauuuccugggagcuuu

SEQ ID NO: 1223794 - RNA, 23 nt, Human
aauucuaccaaggucuucuuaau

SEQ ID NO: 1223795 - RNA, 15 nt, Human
aauuggggauucuua

SEQ ID NO: 1223796 - RNA, 12 nt, Human
aauucuguauag

SEQ ID NO: 1223797 - RNA, 13 nt, Human
aauucuguauaga

SEQ ID NO: 1223798 - RNA, 14 nt, Human
aauucuguauagau

SEQ ID NO: 1223799 - RNA, 20 nt, Human
aauucuguauagauuagaga

SEQ ID NO: 1223800 - RNA, 18 nt, Human
aauuaugaaacuuuugga

SEQ ID NO: 1223801 - RNA, 23 nt, Human
aauuaucuauagcuaaguacaca

SEQ ID NO: 1223802 - RNA, 15 nt, Human
aauuaugaaacuuuu

SEQ ID NO: 1223803 - RNA, 13 nt, Human
aauuaugaaacuu

SEQ ID NO: 1223804 - RNA, 12 nt, Human
aauuaugaaacu

SEQ ID NO: 1223805 - RNA, 15 nt, Human
aauuaucuauagcua

SEQ ID NO: 1223806 - RNA, 22 nt, Human
aauuaucuauagcuaaguacac

SEQ ID NO: 1223807 - RNA, 20 nt, Human
aauuauaucugaggaauucu

SEQ ID NO: 1223808 - RNA, 22 nt, Human
aauuauaucugaggaauucugu

SEQ ID NO: 1223809 - RNA, 23 nt, Human
aauuauaucugaggaauucugua

SEQ ID NO: 1223810 - RNA, 19 nt, Human
aauuauaugcuauuucuau

SEQ ID NO: 1223811 - RNA, 20 nt, Human
aauuauaugcuauuucuaua

SEQ ID NO: 1223812 - RNA, 21 nt, Human
aauuauaugcuauuucuauau

SEQ ID NO: 1223813 - RNA, 14 nt, Human
acauguuaaaccau

SEQ ID NO: 1223814 - RNA, 16 nt, Human
acauguuaaaccaugg

SEQ ID NO: 1223815 - RNA, 21 nt, Human
acauguuaaaccaugggauaa

SEQ ID NO: 1223816 - RNA, 23 nt, Human
acauguuaaaccaugggauaaau

SEQ ID NO: 1223817 - RNA, 20 nt, Human
acauaaguauuuaauucaug

SEQ ID NO: 1223818 - RNA, 20 nt, Human
acaucccuuaccugggaaag

SEQ ID NO: 1223819 - RNA, 21 nt, Human
acauuuguauaaaauaauuuu

SEQ ID NO: 1223820 - RNA, 19 nt, Human
acauuuguauaaaauaauu

SEQ ID NO: 1223821 - RNA, 16 nt, Human
acauuuguauaaaaua

SEQ ID NO: 1223822 - RNA, 16 nt, Human
acauuugcucauggaa

SEQ ID NO: 1223823 - RNA, 15 nt, Human
acauuugcucaugga

SEQ ID NO: 1223824 - RNA, 24 nt, Human
acaggaugguucccuugaugaaga

SEQ ID NO: 1223825 - RNA, 23 nt, Human
acagugaucaaguuauuuuuaau

SEQ ID NO: 1223826 - RNA, 13 nt, Human
acuguaagaaaau

SEQ ID NO: 1223827 - RNA, 22 nt, Human
acugucuuuuuucuaaaguaaa

SEQ ID NO: 1223828 - RNA, 23 nt, Human
acugucuuuuuucuaaaguaaaa

SEQ ID NO: 1223829 - RNA, 16 nt, Human
acugucuuuuuucuaa

SEQ ID NO: 1223830 - RNA, 15 nt, Human
acugccuauuuuaau

SEQ ID NO: 1223831 - RNA, 17 nt, Human
acuguaaaauaauaacu

SEQ ID NO: 1223832 - RNA, 20 nt, Human
acuggugacugauucuucag

SEQ ID NO: 1223833 - RNA, 18 nt, Human
acuggugacugauucuuc

SEQ ID NO: 1223834 - RNA, 19 nt, Human
acuggugacugauucuuca

SEQ ID NO: 1223835 - RNA, 19 nt, Human
acuucaaauccuugaagau

SEQ ID NO: 1223836 - RNA, 18 nt, Human
acuucaaauccuugaaga

SEQ ID NO: 1223837 - RNA, 17 nt, Human
acuucaaauccuugaag

SEQ ID NO: 1223838 - RNA, 21 nt, Human
acuucuuuuuucaaaagaaag

SEQ ID NO: 1223839 - RNA, 22 nt, Human
acuucuuuuuucaaaagaaagu

SEQ ID NO: 1223840 - RNA, 23 nt, Human
acuucuuuuuucaaaagaaaguc

SEQ ID NO: 1223841 - RNA, 12 nt, Human
acuugaaaauua

SEQ ID NO: 1223842 - RNA, 14 nt, Human
acuugaaaauuaac

SEQ ID NO: 1223843 - RNA, 16 nt, Human
acuugaaaauuaacau

SEQ ID NO: 1223844 - RNA, 17 nt, Human
acuucagcgguuuauau

SEQ ID NO: 1223845 - RNA, 18 nt, Human
acuucuuuaauuuuggaa

SEQ ID NO: 1223846 - RNA, 19 nt, Human
acuucuuuaauuuuggaau

SEQ ID NO: 1223847 - RNA, 20 nt, Human
acuucuuuaauuuuggaauu

SEQ ID NO: 1223848 - RNA, 20 nt, Human
acuccgugcuuaaccaaaga

SEQ ID NO: 1223849 - RNA, 19 nt, Human
acucguuaauuuguagugu

SEQ ID NO: 1223850 - RNA, 14 nt, Human
acucguuaauuugu

SEQ ID NO: 1223851 - RNA, 22 nt, Human
acugauuugacauagucuggcu

SEQ ID NO: 1223852 - RNA, 19 nt, Human
acugauaugggucuugaua

SEQ ID NO: 1223853 - RNA, 14 nt, Human
acugauuacugccu

SEQ ID NO: 1223854 - RNA, 20 nt, Human
acugaauuaugaaacuuuug

SEQ ID NO: 1223855 - RNA, 15 nt, Human
acugaauuaugaaac

SEQ ID NO: 1223856 - RNA, 14 nt, Human
acugaauuaugaaa

SEQ ID NO: 1223857 - RNA, 13 nt, Human
acugaauuaugaa

SEQ ID NO: 1223858 - RNA, 20 nt, Human
accuguggaacauaaaaagg

SEQ ID NO: 1223859 - RNA, 23 nt, Human
accuguggaacauaaaaaggaca

SEQ ID NO: 1223860 - RNA, 20 nt, Human
acuaauguguaagacaaaaa

SEQ ID NO: 1223861 - RNA, 18 nt, Human
acgugcucugugggucuc

SEQ ID NO: 1223862 - RNA, 14 nt, Human
acgucuuaaauauu

SEQ ID NO: 1223863 - RNA, 13 nt, Human
acgucuuaaauau

SEQ ID NO: 1223864 - RNA, 15 nt, Human
acccucacacuggga

SEQ ID NO: 1223865 - RNA, 16 nt, Human
acccuaaauaauaaaa

SEQ ID NO: 1223866 - RNA, 20 nt, Human
acccuaaauaauaaaaauaa

SEQ ID NO: 1223867 - RNA, 13 nt, Human
acccuaaccaagu

SEQ ID NO: 1223868 - RNA, 14 nt, Human
acccuaaccaaguu

SEQ ID NO: 1223869 - RNA, 15 nt, Human
acccuaaccaaguuc

SEQ ID NO: 1223870 - RNA, 16 nt, Human
acccuaaccaaguucc

SEQ ID NO: 1223871 - RNA, 17 nt, Human
acccuaaccaaguuccu

SEQ ID NO: 1223872 - RNA, 13 nt, Human
acccuagcaaaag

SEQ ID NO: 1223873 - RNA, 13 nt, Human
acccucaugcugu

SEQ ID NO: 1223874 - RNA, 12 nt, Human
acccucaugcug

SEQ ID NO: 1223875 - RNA, 14 nt, Human
auacaauuuuguuu

SEQ ID NO: 1223876 - RNA, 16 nt, Human
auacaauuuuguuucu

SEQ ID NO: 1223877 - RNA, 17 nt, Human
auacaauuuuguuucug

SEQ ID NO: 1223878 - RNA, 18 nt, Human
auacaauuuuguuucugu

SEQ ID NO: 1223879 - RNA, 18 nt, Human
auaagcuuaugcuuaaau

SEQ ID NO: 1223880 - RNA, 17 nt, Human
agugcucauuucaggau

SEQ ID NO: 1223881 - RNA, 20 nt, Human
aguggcaucaucucagcuca

SEQ ID NO: 1223882 - RNA, 19 nt, Human
aguggcaucaucucagcuc

SEQ ID NO: 1223883 - RNA, 11 nt, Human
aguguuucuuu

SEQ ID NO: 1223884 - RNA, 15 nt, Human
aguuaacuauugcau

SEQ ID NO: 1223885 - RNA, 17 nt, Human
aguuaacuauugcauuu

SEQ ID NO: 1223886 - RNA, 19 nt, Human
aguuaacuauugcauuuau

SEQ ID NO: 1223887 - RNA, 24 nt, Human
aguuaacuauugcauuuauaugua

SEQ ID NO: 1223888 - RNA, 20 nt, Human
aguuaacuauugcauuuaua

SEQ ID NO: 1223889 - RNA, 16 nt, Human
auaaaagacagugaaa

SEQ ID NO: 1223890 - RNA, 16 nt, Human
auaaaaaauuaugaca

SEQ ID NO: 1223891 - RNA, 13 nt, Human
auaaaaagaauga

SEQ ID NO: 1223892 - RNA, 17 nt, Human
aguaacuacaguuaggg

SEQ ID NO: 1223893 - RNA, 19 nt, Human
aguaacuacaguuagggcu

SEQ ID NO: 1223894 - RNA, 22 nt, Human
aguauauugauccagaaagaaa

SEQ ID NO: 1223895 - RNA, 19 nt, Human
agucuggcuguacccagga

SEQ ID NO: 1223896 - RNA, 21 nt, Human
agucuggcuguacccaggaau

SEQ ID NO: 1223897 - RNA, 24 nt, Human
augcauauuauuuuauguugcaua

SEQ ID NO: 1223898 - RNA, 23 nt, Human
auggcuuccuggcaauagucaaa

SEQ ID NO: 1223899 - RNA, 15 nt, Human
auggcuuuguauaga

SEQ ID NO: 1223900 - RNA, 16 nt, Human
auggcuuuguauagaa

SEQ ID NO: 1223901 - RNA, 18 nt, Human
auggcuuuguauagaacc

SEQ ID NO: 1223902 - RNA, 20 nt, Human
augggacauuugcucaugga

SEQ ID NO: 1223903 - RNA, 21 nt, Human
augggacauuugcucauggaa

SEQ ID NO: 1223904 - RNA, 11 nt, Human
aucuaggauuu

SEQ ID NO: 1223905 - RNA, 19 nt, Human
aucuaggauuuuaagggaa

SEQ ID NO: 1223906 - RNA, 12 nt, Human
augaggccagac

SEQ ID NO: 1223907 - RNA, 13 nt, Human
augaggccagacc

SEQ ID NO: 1223908 - RNA, 14 nt, Human
augaggccagacca

SEQ ID NO: 1223909 - RNA, 17 nt, Human
augaggccagaccaugg

SEQ ID NO: 1223910 - RNA, 21 nt, Human
augaauacauuuccaaaaugg

SEQ ID NO: 1223911 - RNA, 14 nt, Human
augaauacauuucc

SEQ ID NO: 1223912 - RNA, 20 nt, Human
augaagccuccuuagaaaaa

SEQ ID NO: 1223913 - RNA, 16 nt, Human
augaaacuuuuggaag

SEQ ID NO: 1223914 - RNA, 18 nt, Human
augaaacuuguguaaaua

SEQ ID NO: 1223915 - RNA, 18 nt, Human
auauuuuuuucugaaauu

SEQ ID NO: 1223916 - RNA, 16 nt, Human
auauuuuuuucugaaa

SEQ ID NO: 1223917 - RNA, 14 nt, Human
auauuuuuuucuga

SEQ ID NO: 1223918 - RNA, 19 nt, Human
auauuuuuuucugaaauuu

SEQ ID NO: 1223919 - RNA, 23 nt, Human
auccacuuuaucuugaauaaugu

SEQ ID NO: 1223920 - RNA, 23 nt, Human
auccagccuaacuuacauucuua

SEQ ID NO: 1223921 - RNA, 19 nt, Human
auccagccuggggcugagg

SEQ ID NO: 1223922 - RNA, 18 nt, Human
auccagcagauuauucac

SEQ ID NO: 1223923 - RNA, 21 nt, Human
auccagccuggggcugaggcu

SEQ ID NO: 1223924 - RNA, 14 nt, Human
auccaggccggcuu

SEQ ID NO: 1223925 - RNA, 23 nt, Human
auccaggccggcuugccacaccc

SEQ ID NO: 1223926 - RNA, 12 nt, Human
auccuugaagau

SEQ ID NO: 1223927 - RNA, 17 nt, Human
auccagggggcaagagg

SEQ ID NO: 1223928 - RNA, 12 nt, Human
aucccccagaaa

SEQ ID NO: 1223929 - RNA, 17 nt, Human
aucccccagaaaagaaa

SEQ ID NO: 1223930 - RNA, 13 nt, Human
agaacaucccucc

SEQ ID NO: 1223931 - RNA, 17 nt, Human
agaacaucccuccuggg

SEQ ID NO: 1223932 - RNA, 17 nt, Human
agaaugauuaugaauua

SEQ ID NO: 1223933 - RNA, 21 nt, Human
agaagacugcauuauauuuau

SEQ ID NO: 1223934 - RNA, 19 nt, Human
agacaaggaaaaaauaaca

SEQ ID NO: 1223935 - RNA, 23 nt, Human
agacaauugagguaaguuuuuug

SEQ ID NO: 1223936 - RNA, 12 nt, Human
agaccaccucuc

SEQ ID NO: 1223937 - RNA, 17 nt, Human
agaccaccucucaauau

SEQ ID NO: 1223938 - RNA, 12 nt, Human
agaccauggaca

SEQ ID NO: 1223939 - RNA, 21 nt, Human
agaccauggacacuacaccca

SEQ ID NO: 1223940 - RNA, 22 nt, Human
agaccauggacacuacacccag

SEQ ID NO: 1223941 - RNA, 23 nt, Human
agaccauggacacuacacccagc

SEQ ID NO: 1223942 - RNA, 18 nt, Human
agacgaaacauuuguucu

SEQ ID NO: 1223943 - RNA, 13 nt, Human
agcaauuuaaaug

SEQ ID NO: 1223944 - RNA, 16 nt, Human
agcaauuuaaauguua

SEQ ID NO: 1223945 - RNA, 17 nt, Human
agcaauuuaaauguuau

SEQ ID NO: 1223946 - RNA, 19 nt, Human
agcaauuuaaauguuauga

SEQ ID NO: 1223947 - RNA, 17 nt, Human
agccaacuauggccugu

SEQ ID NO: 1223948 - RNA, 13 nt, Human
agaucugccuaag

SEQ ID NO: 1223949 - RNA, 18 nt, Human
agaucugccuaaggacuu

SEQ ID NO: 1223950 - RNA, 12 nt, Human
agcaacaauaaa

SEQ ID NO: 1223951 - RNA, 13 nt, Human
agcaacaauaaau

SEQ ID NO: 1223952 - RNA, 18 nt, Human
agcaacaauaaauagaca

SEQ ID NO: 1223953 - RNA, 23 nt, Human
agcaaaauuuuuucucuaggaaa

SEQ ID NO: 1223954 - RNA, 17 nt, Human
agauugagauguguuca

SEQ ID NO: 1223955 - RNA, 20 nt, Human
agauagauaggucagugcaa

SEQ ID NO: 1223956 - RNA, 16 nt, Human
agauaugauucaaaug

SEQ ID NO: 1223957 - RNA, 15 nt, Human
agauaugauucaaau

SEQ ID NO: 1223958 - RNA, 14 nt, Human
agauaugauucaaa

SEQ ID NO: 1223959 - RNA, 17 nt, Human
agccugcugccugcuuu

SEQ ID NO: 1223960 - RNA, 13 nt, Human
agcuacaaaugca

SEQ ID NO: 1223961 - RNA, 24 nt, Human
agcgauucuccugccucagccucc

SEQ ID NO: 1223962 - RNA, 23 nt, Human
agcuuuuuucucugauacagaaa

SEQ ID NO: 1223963 - RNA, 22 nt, Human
agcuuuuuucucugauacagaa

SEQ ID NO: 1223964 - RNA, 20 nt, Human
agcuuuuuucucugauacag

SEQ ID NO: 1223965 - RNA, 19 nt, Human
agcuuuuuucucugauaca

SEQ ID NO: 1223966 - RNA, 18 nt, Human
aggaaaaaauaacaauga

SEQ ID NO: 1223967 - RNA, 18 nt, Human
agcuguaugauucccagc

SEQ ID NO: 1223968 - RNA, 17 nt, Human
agcuguaugauucccag

SEQ ID NO: 1223969 - RNA, 22 nt, Human
aggcucuggagcccacuguacu

SEQ ID NO: 1223970 - RNA, 17 nt, Human
agggacugagaaauuua

SEQ ID NO: 1223971 - RNA, 15 nt, Human
agggacugagaaauu

SEQ ID NO: 1223972 - RNA, 13 nt, Human
agggacugagaaa

SEQ ID NO: 1223973 - RNA, 14 nt, Human
agggacugagaaau

SEQ ID NO: 1223974 - RNA, 22 nt, Human
aggcagaacucaucuagguaaa

SEQ ID NO: 1223975 - RNA, 23 nt, Human
aggcaugugucaccaugcccagc

SEQ ID NO: 1223976 - RNA, 18 nt, Human
aggaguuucguuuucaaa

SEQ ID NO: 1223977 - RNA, 21 nt, Human
gccagccacggggacucagcc

SEQ ID NO: 1223978 - RNA, 13 nt, Human
gccagaccaugga

SEQ ID NO: 1223979 - RNA, 16 nt, Human
gccagaccauggacac

SEQ ID NO: 1223980 - RNA, 17 nt, Human
gccagaccauggacacu

SEQ ID NO: 1223981 - RNA, 11 nt, Human
gccauguuuau

SEQ ID NO: 1223982 - RNA, 20 nt, Human
gccauucuccugccucagcc

SEQ ID NO: 1223983 - RNA, 13 nt, Human
gccacccucaugc

SEQ ID NO: 1223984 - RNA, 15 nt, Human
gccacccucaugcug

SEQ ID NO: 1223985 - RNA, 16 nt, Human
gccacccucaugcugu

SEQ ID NO: 1223986 - RNA, 18 nt, Human
gcccugcugcugccugcc

SEQ ID NO: 1223987 - RNA, 22 nt, Human
gcccccaguaucucuucagucu

SEQ ID NO: 1223988 - RNA, 22 nt, Human
gccugccuccccugccucacca

SEQ ID NO: 1223989 - RNA, 14 nt, Human
gcucaggagcccug

SEQ ID NO: 1223990 - RNA, 21 nt, Human
gcucaggagcccugggaggcu

SEQ ID NO: 1223991 - RNA, 15 nt, Human
gcucaggagcccugg

SEQ ID NO: 1223992 - RNA, 18 nt, Human
gcucaggagcccugggag

SEQ ID NO: 1223993 - RNA, 23 nt, Human
gcucuggagcccacuguacuugc

SEQ ID NO: 1223994 - RNA, 19 nt, Human
gcuugaaacccguggcgcu

SEQ ID NO: 1223995 - RNA, 14 nt, Human
gcuucccuuuccug

SEQ ID NO: 1223996 - RNA, 14 nt, Human
gcuggagugcagug

SEQ ID NO: 1223997 - RNA, 16 nt, Human
gcugggucgcccugga

SEQ ID NO: 1223998 - RNA, 17 nt, Human
gcugggucgcccuggac

SEQ ID NO: 1223999 - RNA, 18 nt, Human
gcugggucgcccuggacu

SEQ ID NO: 1224000 - RNA, 19 nt, Human
gcugggucgcccuggacug

SEQ ID NO: 1224001 - RNA, 12 nt, Human
gcuggagugcag

SEQ ID NO: 1224002 - RNA, 12 nt, Human
gcugcugccugc

SEQ ID NO: 1224003 - RNA, 16 nt, Human
gcugcugccugccugg

SEQ ID NO: 1224004 - RNA, 15 nt, Human
aaaggaaagaaaaca

SEQ ID NO: 1224005 - RNA, 16 nt, Human
aaaggaaagaaaacau

SEQ ID NO: 1224006 - RNA, 13 nt, Human
aaaggaauuuaaa

SEQ ID NO: 1224007 - RNA, 14 nt, Human
aaaggacaucagca

SEQ ID NO: 1224008 - RNA, 16 nt, Human
aaaggacaucagcaaa

SEQ ID NO: 1224009 - RNA, 15 nt, Human
aaaggacaucagcaa

SEQ ID NO: 1224010 - RNA, 17 nt, Human
aaagcuauauaagacaa

SEQ ID NO: 1224011 - RNA, 17 nt, Human
aaagcuacuuauuguag

SEQ ID NO: 1224012 - RNA, 16 nt, Human
aaagcuacuuauugua

SEQ ID NO: 1224013 - RNA, 17 nt, Human
ggugcacuggccccacc

SEQ ID NO: 1224014 - RNA, 17 nt, Human
gguauucguuaucuaau

SEQ ID NO: 1224015 - RNA, 17 nt, Human
aaacuuguguaaauaca

SEQ ID NO: 1224016 - RNA, 13 nt, Human
aaacuuuucugau

SEQ ID NO: 1224017 - RNA, 14 nt, Human
aaacuuuucugaua

SEQ ID NO: 1224018 - RNA, 16 nt, Human
aaacuuuucugauaga

SEQ ID NO: 1224019 - RNA, 17 nt, Human
aaacuuuucugauagag

SEQ ID NO: 1224020 - RNA, 18 nt, Human
aaagagaacuuccagauc

SEQ ID NO: 1224021 - RNA, 15 nt, Human
aaacuacauauugua

SEQ ID NO: 1224022 - RNA, 21 nt, Human
aaaccacauuggagauguuua

SEQ ID NO: 1224023 - RNA, 16 nt, Human
aaacggaugauuucua

SEQ ID NO: 1224024 - RNA, 18 nt, Human
aaacggaugauuucuaug

SEQ ID NO: 1224025 - RNA, 19 nt, Human
aaacauguuuccacuauug

SEQ ID NO: 1224026 - RNA, 19 nt, Human
aaacauguuucuuuguaau

SEQ ID NO: 1224027 - RNA, 22 nt, Human
aaacauguuucuuuguaaugaa

SEQ ID NO: 1224028 - RNA, 23 nt, Human
aaacauguuucuuuguaaugaaa

SEQ ID NO: 1224029 - RNA, 18 nt, Human
aaaccaaaucacugaacu

SEQ ID NO: 1224030 - RNA, 23 nt, Human
ggggucucuucugaauaaagcaa

SEQ ID NO: 1224031 - RNA, 16 nt, Human
ggggccaggcuggguc

SEQ ID NO: 1224032 - RNA, 14 nt, Human
ggggccaggcuggg

SEQ ID NO: 1224033 - RNA, 21 nt, Human
aaacauauauaacaaugcugu

SEQ ID NO: 1224034 - RNA, 19 nt, Human
aaacauauauaacaaugcu

SEQ ID NO: 1224035 - RNA, 16 nt, Human
aaacauauauaacaau

SEQ ID NO: 1224036 - RNA, 13 nt, Human
aaacauauauaac

SEQ ID NO: 1224037 - RNA, 19 nt, Human
aaacaagucagucauucag

SEQ ID NO: 1224038 - RNA, 14 nt, Human
aaacacaacuauau

SEQ ID NO: 1224039 - RNA, 21 nt, Human
aaaauuggggauucuuaaagu

SEQ ID NO: 1224040 - RNA, 23 nt, Human
aaaauuggggauucuuaaaguug

SEQ ID NO: 1224041 - RNA, 12 nt, Human
aaaauggaauac

SEQ ID NO: 1224042 - RNA, 22 nt, Human
aaaauggacuguggugacuuug

SEQ ID NO: 1224043 - RNA, 17 nt, Human
aaacaaggaugaauuaa

SEQ ID NO: 1224044 - RNA, 13 nt, Human
aaacaaagaaauu

SEQ ID NO: 1224045 - RNA, 16 nt, Human
aaaauuuuuaaucuuu

SEQ ID NO: 1224046 - RNA, 22 nt, Human
aaaauuuuuucucuaggaaaua

SEQ ID NO: 1224047 - RNA, 19 nt, Human
aaaauuuuuucucuaggaa

SEQ ID NO: 1224048 - RNA, 19 nt, Human
aaaauuuuuaaucuuuaau

SEQ ID NO: 1224049 - RNA, 17 nt, Human
aaaacuacuucuuuuuu

SEQ ID NO: 1224050 - RNA, 19 nt, Human
aaaacugcucauaugaugu

SEQ ID NO: 1224051 - RNA, 19 nt, Human
aaaaauuaucuauagcuaa

SEQ ID NO: 1224052 - RNA, 21 nt, Human
aaaaauuaaaccggaccaucu

SEQ ID NO: 1224053 - RNA, 17 nt, Human
gggacugcggaggaagg

SEQ ID NO: 1224054 - RNA, 22 nt, Human
aaaagcuccauuuuuagugaaa

SEQ ID NO: 1224055 - RNA, 16 nt, Human
aaaagccuguuuaaga

SEQ ID NO: 1224056 - RNA, 18 nt, Human
aaaagccuguuuaagaga

SEQ ID NO: 1224057 - RNA, 23 nt, Human
aaaauaauuuuuauauuugaaau

SEQ ID NO: 1224058 - RNA, 21 nt, Human
aaaauaauuuuuauauuugaa

SEQ ID NO: 1224059 - RNA, 13 nt, Human
aaaauauauacua

SEQ ID NO: 1224060 - RNA, 17 nt, Human
aaaauauauacuaaaca

SEQ ID NO: 1224061 - RNA, 18 nt, Human
aaaauauauaucaaauau

SEQ ID NO: 1224062 - RNA, 14 nt, Human
aaaauauauacuaa

SEQ ID NO: 1224063 - RNA, 16 nt, Human
gggcagcaauuuaaau

SEQ ID NO: 1224064 - RNA, 13 nt, Human
gggcagagccagg

SEQ ID NO: 1224065 - RNA, 14 nt, Human
gggcagagccagga

SEQ ID NO: 1224066 - RNA, 16 nt, Human
gggcagagccaggaag

SEQ ID NO: 1224067 - RNA, 15 nt, Human
gggauucuuaaaguu

SEQ ID NO: 1224068 - RNA, 20 nt, Human
gggauucuuaaaguugaauu

SEQ ID NO: 1224069 - RNA, 16 nt, Human
aaaagggacugagaaa

SEQ ID NO: 1224070 - RNA, 19 nt, Human
aaaagggacugagaaauuu

SEQ ID NO: 1224071 - RNA, 17 nt, Human
ggcuccuauucaacaca

SEQ ID NO: 1224072 - RNA, 23 nt, Human
ggcuccuccaggguggcagcaac

SEQ ID NO: 1224073 - RNA, 21 nt, Human
ggcugggaauggaggggcaga

SEQ ID NO: 1224074 - RNA, 22 nt, Human
ggcugggaauggaggggcagag

SEQ ID NO: 1224075 - RNA, 16 nt, Human
aaaaaggacaucagca

SEQ ID NO: 1224076 - RNA, 22 nt, Human
ggacugugugcucaggagcccu

SEQ ID NO: 1224077 - RNA, 23 nt, Human
ggacugugugcucaggagcccug

SEQ ID NO: 1224078 - RNA, 12 nt, Human
ggacuuguuaga

SEQ ID NO: 1224079 - RNA, 18 nt, Human
ggacuucuuuaauuuugg

SEQ ID NO: 1224080 - RNA, 17 nt, Human
ggaccccagccauccag

SEQ ID NO: 1224081 - RNA, 23 nt, Human
ggagcagagcugauggagaagga

SEQ ID NO: 1224082 - RNA, 15 nt, Human
ggagcccacuguacu

SEQ ID NO: 1224083 - RNA, 19 nt, Human
ggagcagagcugauggaga

SEQ ID NO: 1224084 - RNA, 19 nt, Human
ggaggaaccagagugcuga

SEQ ID NO: 1224085 - RNA, 17 nt, Human
ggaggcucuggagccca

SEQ ID NO: 1224086 - RNA, 20 nt, Human
ggaggcucuggagcccacug

SEQ ID NO: 1224087 - RNA, 18 nt, Human
ggagcccacuguacuugc

SEQ ID NO: 1224088 - RNA, 22 nt, Human
ggagcccacuguacuugcucuu

SEQ ID NO: 1224089 - RNA, 21 nt, Human
ggaggcucuggagcccacugu

SEQ ID NO: 1224090 - RNA, 20 nt, Human
ggcagagaagaaagaacgga

SEQ ID NO: 1224091 - RNA, 23 nt, Human
ggaugguucccuugaugaagaag

SEQ ID NO: 1224092 - RNA, 22 nt, Human
ggaugguucccuugaugaagaa

SEQ ID NO: 1224093 - RNA, 23 nt, Human
cuucaugcugucuacacuaagag

SEQ ID NO: 1224094 - RNA, 23 nt, Human
cuucaugcauggaaauucccuuc

SEQ ID NO: 1224095 - RNA, 11 nt, Human
cuuaaaguuga

SEQ ID NO: 1224096 - RNA, 13 nt, Human
cuuaaaguugaau

SEQ ID NO: 1224097 - RNA, 14 nt, Human
cuuaaaguugaauu

SEQ ID NO: 1224098 - RNA, 23 nt, Human
cuugugauccacucgccucagcc

SEQ ID NO: 1224099 - RNA, 20 nt, Human
cuuuaaggggaggaaccaga

SEQ ID NO: 1224100 - RNA, 13 nt, Human
cuuuaauuuugga

SEQ ID NO: 1224101 - RNA, 14 nt, Human
cuuuaauuuuggaa

SEQ ID NO: 1224102 - RNA, 15 nt, Human
cuuuaauuuuggaau

SEQ ID NO: 1224103 - RNA, 16 nt, Human
cuuuaauuuuggaauu

SEQ ID NO: 1224104 - RNA, 13 nt, Human
cuuucagauacug

SEQ ID NO: 1224105 - RNA, 15 nt, Human
cuuggccaugcagaa

SEQ ID NO: 1224106 - RNA, 18 nt, Human
cuuggccaugcagaaagc

SEQ ID NO: 1224107 - RNA, 20 nt, Human
cuucuguuuuauaauuuugu

SEQ ID NO: 1224108 - RNA, 15 nt, Human
cuucuguuuuauaau

SEQ ID NO: 1224109 - RNA, 12 nt, Human
cugcuuaauuca

SEQ ID NO: 1224110 - RNA, 13 nt, Human
cugcuuaauucaa

SEQ ID NO: 1224111 - RNA, 22 nt, Human
cuggacugugugcucaggagcc

SEQ ID NO: 1224112 - RNA, 23 nt, Human
cuggacugugugcucaggagccc

SEQ ID NO: 1224113 - RNA, 15 nt, Human
cugcugugaaagaag

SEQ ID NO: 1224114 - RNA, 17 nt, Human
cugggagaaaugaaaaa

SEQ ID NO: 1224115 - RNA, 16 nt, Human
cugggagaaaugaaaa

SEQ ID NO: 1224116 - RNA, 14 nt, Human
cugcacggugaaug

SEQ ID NO: 1224117 - RNA, 15 nt, Human
cugcacggugaaugg

SEQ ID NO: 1224118 - RNA, 17 nt, Human
cugcacggugaauggcu

SEQ ID NO: 1224119 - RNA, 20 nt, Human
cugcacggugaauggcuuug

SEQ ID NO: 1224120 - RNA, 13 nt, Human
cugauggagaagg

SEQ ID NO: 1224121 - RNA, 14 nt, Human
cugauggagaagga

SEQ ID NO: 1224122 - RNA, 15 nt, Human
cugauggagaaggaa

SEQ ID NO: 1224123 - RNA, 16 nt, Human
cugauggagaaggaag

SEQ ID NO: 1224124 - RNA, 17 nt, Human
cugauggagaaggaagg

SEQ ID NO: 1224125 - RNA, 18 nt, Human
cucuuauaucuauauuuu

SEQ ID NO: 1224126 - RNA, 15 nt, Human
cucuuauaucuauau

SEQ ID NO: 1224127 - RNA, 14 nt, Human
cugcaaccuccacc

SEQ ID NO: 1224128 - RNA, 16 nt, Human
cugcaaccuccaccuc

SEQ ID NO: 1224129 - RNA, 20 nt, Human
gaacccuaaauaauaaaaau

SEQ ID NO: 1224130 - RNA, 14 nt, Human
gaacugaaaucaua

SEQ ID NO: 1224131 - RNA, 14 nt, Human
gaagcaaaauuuuu

SEQ ID NO: 1224132 - RNA, 20 nt, Human
gaagcaaguaaaaaggcuaa

SEQ ID NO: 1224133 - RNA, 20 nt, Human
gaagcaaugcuucaucccuu

SEQ ID NO: 1224134 - RNA, 21 nt, Human
gaaguugacuuauaguacaug

SEQ ID NO: 1224135 - RNA, 23 nt, Human
gaaguugacuuauaguacaugau

SEQ ID NO: 1224136 - RNA, 20 nt, Human
gaagcuaucguaaaauuaag

SEQ ID NO: 1224137 - RNA, 23 nt, Human
gacauugaccuauuuccagaaau

SEQ ID NO: 1224138 - RNA, 17 nt, Human
gacauuugcucauggaa

SEQ ID NO: 1224139 - RNA, 16 nt, Human
gacauuugcucaugga

SEQ ID NO: 1224140 - RNA, 22 nt, Human
gaccagcuuuucccaaaagccc

SEQ ID NO: 1224141 - RNA, 16 nt, Human
gacacacugaagaagc

SEQ ID NO: 1224142 - RNA, 15 nt, Human
gacacacugaagaag

SEQ ID NO: 1224143 - RNA, 14 nt, Human
gacugaauuaugaa

SEQ ID NO: 1224144 - RNA, 20 nt, Human
gacugaauuaugaaacuuuu

SEQ ID NO: 1224145 - RNA, 17 nt, Human
gacuguggugacuuugg

SEQ ID NO: 1224146 - RNA, 13 nt, Human
gacuguggugacu

SEQ ID NO: 1224147 - RNA, 14 nt, Human
gacuguggugacuu

SEQ ID NO: 1224148 - RNA, 22 nt, Human
gacugugugcucaggagcccug

SEQ ID NO: 1224149 - RNA, 21 nt, Human
gacucuuaagaagacugcauu

SEQ ID NO: 1224150 - RNA, 15 nt, Human
gacucuuaagaagac

SEQ ID NO: 1224151 - RNA, 14 nt, Human
gacucuuaagaaga

SEQ ID NO: 1224152 - RNA, 12 nt, Human
gaggccagacca

SEQ ID NO: 1224153 - RNA, 18 nt, Human
gaggccagaccauggaca

SEQ ID NO: 1224154 - RNA, 20 nt, Human
gagcuggagaugaggccaga

SEQ ID NO: 1224155 - RNA, 21 nt, Human
gagcuggagaugaggccagac

SEQ ID NO: 1224156 - RNA, 16 nt, Human
gaguuuaaauuguaau

SEQ ID NO: 1224157 - RNA, 21 nt, Human
gagugaguuggguguauugug

SEQ ID NO: 1224158 - RNA, 17 nt, Human
gagucacuacgccuggc

SEQ ID NO: 1224159 - RNA, 16 nt, Human
gaggugagaccaccuc

SEQ ID NO: 1224160 - RNA, 15 nt, Human
gaggugagaccaccu

SEQ ID NO: 1224161 - RNA, 18 nt, Human
gauuuuuuuguuguuugu

SEQ ID NO: 1224162 - RNA, 21 nt, Human
gauuuuuuuguuguuuguuua

SEQ ID NO: 1224163 - RNA, 21 nt, Human
gauuuuuuucccaauugagaa

SEQ ID NO: 1224164 - RNA, 18 nt, Human
gcaagucagaauagaaau

SEQ ID NO: 1224165 - RNA, 12 nt, Human
gauggagaagga

SEQ ID NO: 1224166 - RNA, 13 nt, Human
gauggagaaggaa

SEQ ID NO: 1224167 - RNA, 14 nt, Human
gauggagaaggaag

SEQ ID NO: 1224168 - RNA, 16 nt, Human
gauggagaaggaaggc

SEQ ID NO: 1224169 - RNA, 15 nt, Human
gauggagaaggaagg

SEQ ID NO: 1224170 - RNA, 18 nt, Human
gaucugccuaaggacuuc

SEQ ID NO: 1224171 - RNA, 20 nt, Human
gaucugccuaaggacuucuu

SEQ ID NO: 1224172 - RNA, 21 nt, Human
gaucugccuaaggacuucuuu

SEQ ID NO: 1224173 - RNA, 23 nt, Human
gaucugccuaaggacuucuuuaa

SEQ ID NO: 1224174 - RNA, 22 nt, Human
gauuauucacugauuugacaua

SEQ ID NO: 1224175 - RNA, 14 nt, Human
gauuauauuaugaa

SEQ ID NO: 1224176 - RNA, 15 nt, Human
gauuuaccacuugug

SEQ ID NO: 1224177 - RNA, 23 nt, Human
gauucuucagcaaaaauauuuua

SEQ ID NO: 1224178 - RNA, 16 nt, Human
gauuuaccacuugugu

SEQ ID NO: 1224179 - RNA, 13 nt, Human
auuauguaaaucc

SEQ ID NO: 1224180 - RNA, 14 nt, Human
auuauguaaauccc

SEQ ID NO: 1224181 - RNA, 15 nt, Human
auuauguaaauccca

SEQ ID NO: 1224182 - RNA, 17 nt, Human
auuauguaaaucccauu

SEQ ID NO: 1224183 - RNA, 22 nt, Human
auuauguaaaucccauuauuca

SEQ ID NO: 1224184 - RNA, 23 nt, Human
auuauguaaaucccauuauucaa

SEQ ID NO: 1224185 - RNA, 13 nt, Human
auuaugugacauu

SEQ ID NO: 1224186 - RNA, 19 nt, Human
auuaugugacauuuuacau

SEQ ID NO: 1224187 - RNA, 13 nt, Human
auuaugugccaga

SEQ ID NO: 1224188 - RNA, 21 nt, Human
auuaugugccagauuuaugca

SEQ ID NO: 1224189 - RNA, 23 nt, Human
auuaugugccagauuuaugcaua

SEQ ID NO: 1224190 - RNA, 20 nt, Human
auuaugugacauuuuacauu

SEQ ID NO: 1224191 - RNA, 12 nt, Human
auucaauaaagc

SEQ ID NO: 1224192 - RNA, 13 nt, Human
auucaauaaagcu

SEQ ID NO: 1224193 - RNA, 12 nt, Human
auucauuccauu

SEQ ID NO: 1224194 - RNA, 17 nt, Human
auucauuccauucugga

SEQ ID NO: 1224195 - RNA, 19 nt, Human
auucauuccauucuggaag

SEQ ID NO: 1224196 - RNA, 18 nt, Human
auucauuccauucuggaa

SEQ ID NO: 1224197 - RNA, 17 nt, Human
auucguuaucuaauagg

SEQ ID NO: 1224198 - RNA, 22 nt, Human
auugaggacacugauauggguc

SEQ ID NO: 1224199 - RNA, 21 nt, Human
auuaacaugaauauuuagugu

SEQ ID NO: 1224200 - RNA, 17 nt, Human
auuaaauuuuuuuuaca

SEQ ID NO: 1224201 - RNA, 18 nt, Human
auuaaauuuuuuuuacau

SEQ ID NO: 1224202 - RNA, 19 nt, Human
auuaaauuuuuuuuacauu

SEQ ID NO: 1224203 - RNA, 20 nt, Human
auuaaauuuuuuuuacauuu

SEQ ID NO: 1224204 - RNA, 22 nt, Human
auuuaauagguuuggacaaaau

SEQ ID NO: 1224205 - RNA, 15 nt, Human
auuuaauaauuauau

SEQ ID NO: 1224206 - RNA, 18 nt, Human
auuuaauaauuauaugcu

SEQ ID NO: 1224207 - RNA, 14 nt, Human
auugagguaaguuu

SEQ ID NO: 1224208 - RNA, 16 nt, Human
auugagguaaguuuuu

SEQ ID NO: 1224209 - RNA, 22 nt, Human
auuuguguugaagagguuuuaa

SEQ ID NO: 1224210 - RNA, 18 nt, Human
auuuguguugaagagguu

SEQ ID NO: 1224211 - RNA, 15 nt, Human
auuuguguugaagag

SEQ ID NO: 1224212 - RNA, 14 nt, Human
auuuguguugaaga

SEQ ID NO: 1224213 - RNA, 19 nt, Human
auuuguucuauagcuuuuc

SEQ ID NO: 1224214 - RNA, 17 nt, Human
auuuucuauaauuuaaa

SEQ ID NO: 1224215 - RNA, 18 nt, Human
auuuucuauaauuuaaau

SEQ ID NO: 1224216 - RNA, 19 nt, Human
auuuucuauaauuuaaaua

SEQ ID NO: 1224217 - RNA, 13 nt, Human
auuuugaaaaacu

SEQ ID NO: 1224218 - RNA, 15 nt, Human
auuuugaaaaacugc

SEQ ID NO: 1224219 - RNA, 15 nt, Human
caaaagcccauucau

SEQ ID NO: 1224220 - RNA, 19 nt, Human
caaaagcccauucauucca

SEQ ID NO: 1224221 - RNA, 20 nt, Human
caaaagcccauucauuccau

SEQ ID NO: 1224222 - RNA, 14 nt, Human
auuuuuuuuacauu

SEQ ID NO: 1224223 - RNA, 19 nt, Human
auuuuuuucccaauugaga

SEQ ID NO: 1224224 - RNA, 17 nt, Human
auuuuuuucugaaauuu

SEQ ID NO: 1224225 - RNA, 16 nt, Human
auuuuuuucugaaauu

SEQ ID NO: 1224226 - RNA, 15 nt, Human
auuuuuuucugaauu

SEQ ID NO: 1224227 - RNA, 19 nt, Human
auuuuuauauuugaaauau

SEQ ID NO: 1224228 - RNA, 14 nt, Human
caagcaaguauuag

SEQ ID NO: 1224229 - RNA, 14 nt, Human
caagcaauccuccc

SEQ ID NO: 1224230 - RNA, 15 nt, Human
caagcaaaugugaau

SEQ ID NO: 1224231 - RNA, 17 nt, Human
caagcaaaugugaauca

SEQ ID NO: 1224232 - RNA, 19 nt, Human
caagcaaaugugaaucauu

SEQ ID NO: 1224233 - RNA, 12 nt, Human
caacuccagaaa

SEQ ID NO: 1224234 - RNA, 14 nt, Human
caacuauggccugu

SEQ ID NO: 1224235 - RNA, 21 nt, Human
caacuaucucauuuccaagca

SEQ ID NO: 1224236 - RNA, 13 nt, Human
caacuauggccug

SEQ ID NO: 1224237 - RNA, 19 nt, Human
caacuaucucauuuccaag

SEQ ID NO: 1224238 - RNA, 19 nt, Human
caacuauauuguuugcuaa

SEQ ID NO: 1224239 - RNA, 17 nt, Human
caaucagccuaguugau

SEQ ID NO: 1224240 - RNA, 10 nt, Human
caaguaaaaa

SEQ ID NO: 1224241 - RNA, 15 nt, Human
caaguaaaaaggcua

SEQ ID NO: 1224242 - RNA, 20 nt, Human
caaguuauuuuuaauuuggu

SEQ ID NO: 1224243 - RNA, 21 nt, Human
caaguuccuuggccaugcaga

SEQ ID NO: 1224244 - RNA, 16 nt, Human
cacccagcaauagaga

SEQ ID NO: 1224245 - RNA, 20 nt, Human
cacccaggcuggacugcaau

SEQ ID NO: 1224246 - RNA, 20 nt, Human
cacccagguuggagugcagu

SEQ ID NO: 1224247 - RNA, 13 nt, Human
cacccagcaauag

SEQ ID NO: 1224248 - RNA, 16 nt, Human
cacaugaaguccaagc

SEQ ID NO: 1224249 - RNA, 23 nt, Human
cacugaagaagcaccaaucauga

SEQ ID NO: 1224250 - RNA, 14 nt, Human
caccugcccugccc

SEQ ID NO: 1224251 - RNA, 16 nt, Human
caccugcccugcccug

SEQ ID NO: 1224252 - RNA, 17 nt, Human
caccugcccugcccugc

SEQ ID NO: 1224253 - RNA, 17 nt, Human
cacccucguggacaccu

SEQ ID NO: 1224254 - RNA, 18 nt, Human
cacccucguggacaccug

SEQ ID NO: 1224255 - RNA, 19 nt, Human
cacccucguggacaccugc

SEQ ID NO: 1224256 - RNA, 20 nt, Human
cacccucguggacaccugcc

SEQ ID NO: 1224257 - RNA, 12 nt, Human
caccugcccugc

SEQ ID NO: 1224258 - RNA, 13 nt, Human
caccugcccugcc

SEQ ID NO: 1224259 - RNA, 20 nt, Human
caggaaagagaacuuccaga

SEQ ID NO: 1224260 - RNA, 16 nt, Human
caggaaagagaacuuc

SEQ ID NO: 1224261 - RNA, 20 nt, Human
cagcuuauugucuagugaaa

SEQ ID NO: 1224262 - RNA, 14 nt, Human
cagcuuauugucua

SEQ ID NO: 1224263 - RNA, 20 nt, Human
cagcuguaugauucccagcc

SEQ ID NO: 1224264 - RNA, 20 nt, Human
caggccggcuugccacaccc

SEQ ID NO: 1224265 - RNA, 22 nt, Human
cagggagacuggguaggaaaga

SEQ ID NO: 1224266 - RNA, 17 nt, Human
cagagacuuuagggggu

SEQ ID NO: 1224267 - RNA, 20 nt, Human
cagagcugauggagaaggaa

SEQ ID NO: 1224268 - RNA, 21 nt, Human
cagagcugauggagaaggaag

SEQ ID NO: 1224269 - RNA, 19 nt, Human
cagagcugauggagaagga

SEQ ID NO: 1224270 - RNA, 22 nt, Human
cagagcugauggagaaggaagg

SEQ ID NO: 1224271 - RNA, 14 nt, Human
cagauacuggauug

SEQ ID NO: 1224272 - RNA, 18 nt, Human
cagauacuggauuguacu

SEQ ID NO: 1224273 - RNA, 15 nt, Human
cagauaugauucaaa

SEQ ID NO: 1224274 - RNA, 14 nt, Human
cagauaugauucaa

SEQ ID NO: 1224275 - RNA, 13 nt, Human
cagauuuaugcau

SEQ ID NO: 1224276 - RNA, 14 nt, Human
cagauuuccagccu

SEQ ID NO: 1224277 - RNA, 14 nt, Human
cagauuucugagga

SEQ ID NO: 1224278 - RNA, 15 nt, Human
cagauuucugaggaa

SEQ ID NO: 1224279 - RNA, 17 nt, Human
cagauuucugaggaaau

SEQ ID NO: 1224280 - RNA, 14 nt, Human
cauuauucaaaguu

SEQ ID NO: 1224281 - RNA, 15 nt, Human
cauuauucaaaguug

SEQ ID NO: 1224282 - RNA, 16 nt, Human
cauuauucaaaguugc

SEQ ID NO: 1224283 - RNA, 16 nt, Human
cauggcccugccaugc

SEQ ID NO: 1224284 - RNA, 21 nt, Human
caugaauauuuaguguucaua

SEQ ID NO: 1224285 - RNA, 16 nt, Human
cauuuguauaaaauaa

SEQ ID NO: 1224286 - RNA, 14 nt, Human
cauuuguauaaaau

SEQ ID NO: 1224287 - RNA, 17 nt, Human
cauuuguauaaaauaau

SEQ ID NO: 1224288 - RNA, 12 nt, Human
ccaaaaaacuac

SEQ ID NO: 1224289 - RNA, 17 nt, Human
cauugguguuguacuca

SEQ ID NO: 1224290 - RNA, 16 nt, Human
cauuggagauguuuag

SEQ ID NO: 1224291 - RNA, 19 nt, Human
ccaaaguccugggauuaca

SEQ ID NO: 1224292 - RNA, 16 nt, Human
ccaacuauggccugug

SEQ ID NO: 1224293 - RNA, 14 nt, Human
ccaacuauggccug

SEQ ID NO: 1224294 - RNA, 15 nt, Human
ccaacuauggccugu

SEQ ID NO: 1224295 - RNA, 20 nt, Human
ccaaaucacugaacuuugcu

SEQ ID NO: 1224296 - RNA, 21 nt, Human
ccaacuccagaaagugacaag

SEQ ID NO: 1224297 - RNA, 17 nt, Human
caguuauuauauuuaca

SEQ ID NO: 1224298 - RNA, 21 nt, Human
caguuauuauauuuacaaaug

SEQ ID NO: 1224299 - RNA, 19 nt, Human
cagucucuauaccaauaaa

SEQ ID NO: 1224300 - RNA, 20 nt, Human
cagucucuauaccaauaaag

SEQ ID NO: 1224301 - RNA, 21 nt, Human
cagucucuauaccaauaaagu

SEQ ID NO: 1224302 - RNA, 22 nt, Human
cagucucuauaccaauaaagug

SEQ ID NO: 1224303 - RNA, 23 nt, Human
cagucucuauaccaauaaaguga

SEQ ID NO: 1224304 - RNA, 17 nt, Human
cagucucuauaccaaua

SEQ ID NO: 1224305 - RNA, 22 nt, Human
caguuauuauauuuacaaaugg

SEQ ID NO: 1224306 - RNA, 15 nt, Human
caguucaaagcagga

SEQ ID NO: 1224307 - RNA, 18 nt, Human
caguuuauuugaaccaau

SEQ ID NO: 1224308 - RNA, 19 nt, Human
caguuuauuugaaccaaua

SEQ ID NO: 1224309 - RNA, 18 nt, Human
cauaauuauuauuuggcc

SEQ ID NO: 1224310 - RNA, 16 nt, Human
cauagguuuaauaauu

SEQ ID NO: 1224311 - RNA, 21 nt, Human
cauauuauuuuauguugcaua

SEQ ID NO: 1224312 - RNA, 16 nt, Human
caucuggauuccagag

SEQ ID NO: 1224313 - RNA, 19 nt, Human
caucagaaacacccucaca

SEQ ID NO: 1224314 - RNA, 17 nt, Human
caucagaaacacccuca

SEQ ID NO: 1224315 - RNA, 23 nt, Human
ccgaaggugaggagcuugaaacc

SEQ ID NO: 1224316 - RNA, 11 nt, Human
ccuaaggacuu

SEQ ID NO: 1224317 - RNA, 12 nt, Human
ccuaaggacuuc

SEQ ID NO: 1224318 - RNA, 16 nt, Human
ccuaaggacuucuuua

SEQ ID NO: 1224319 - RNA, 17 nt, Human
ccuaaggacuucuuuaa

SEQ ID NO: 1224320 - RNA, 18 nt, Human
ccuaaggacuucuuuaau

SEQ ID NO: 1224321 - RNA, 23 nt, Human
ccuaaggacuucuuuaauuuugg

SEQ ID NO: 1224322 - RNA, 20 nt, Human
cccugaauuuaaauagcuuu

SEQ ID NO: 1224323 - RNA, 15 nt, Human
cccugcccugccacc

SEQ ID NO: 1224324 - RNA, 17 nt, Human
cccugcccugccaccug

SEQ ID NO: 1224325 - RNA, 18 nt, Human
cccugcccugccaccugu

SEQ ID NO: 1224326 - RNA, 20 nt, Human
ccucucugcaggucccuaau

SEQ ID NO: 1224327 - RNA, 18 nt, Human
ccucucugcaggucccua

SEQ ID NO: 1224328 - RNA, 19 nt, Human
ccucucugcaggucccuaa

SEQ ID NO: 1224329 - RNA, 16 nt, Human
ccucucugcagguccc

SEQ ID NO: 1224330 - RNA, 17 nt, Human
ccucucugcaggucccu

SEQ ID NO: 1224331 - RNA, 18 nt, Human
ccucgccggaucugaggg

SEQ ID NO: 1224332 - RNA, 19 nt, Human
ccucgccggaucugaggga

SEQ ID NO: 1224333 - RNA, 20 nt, Human
ccugccucucugcagguccc

SEQ ID NO: 1224334 - RNA, 21 nt, Human
ccugccucucugcaggucccu

SEQ ID NO: 1224335 - RNA, 23 nt, Human
ccugccuggacuuggccccugcc

SEQ ID NO: 1224336 - RNA, 19 nt, Human
ccaugggauaaaugccauc

SEQ ID NO: 1224337 - RNA, 18 nt, Human
ccaugggcacugugggua

SEQ ID NO: 1224338 - RNA, 13 nt, Human
cccaccccuagga

SEQ ID NO: 1224339 - RNA, 19 nt, Human
cccacuguacuugcucuug

SEQ ID NO: 1224340 - RNA, 23 nt, Human
cccacuguacuugcucuugaugc

SEQ ID NO: 1224341 - RNA, 20 nt, Human
ccauugugccuaaguccagu

SEQ ID NO: 1224342 - RNA, 22 nt, Human
cccagcuggggccaggcugggu

SEQ ID NO: 1224343 - RNA, 23 nt, Human
cccagcuggggccaggcuggguc

SEQ ID NO: 1224344 - RNA, 17 nt, Human
ccccagccauccagggg

SEQ ID NO: 1224345 - RNA, 14 nt, Human
ccaguauuguacaa

SEQ ID NO: 1224346 - RNA, 15 nt, Human
ccaggggccaugaau

SEQ ID NO: 1224347 - RNA, 20 nt, Human
ccaguauuguacaaaguauu

SEQ ID NO: 1224348 - RNA, 18 nt, Human
ccaggcaggagcccuucu

SEQ ID NO: 1224349 - RNA, 15 nt, Human
ccacucuuucuuuca

SEQ ID NO: 1224350 - RNA, 14 nt, Human
ccagagacuuuagg

SEQ ID NO: 1224351 - RNA, 15 nt, Human
ccugcugcugccugc

SEQ ID NO: 1224352 - RNA, 16 nt, Human
ccugcugcugccugcc

SEQ ID NO: 1224353 - RNA, 17 nt, Human
ccugcugcugccugccu

SEQ ID NO: 1224354 - RNA, 18 nt, Human
ccugcugcugccugccug

SEQ ID NO: 1224355 - RNA, 13 nt, Human
ccuucccugcugu

SEQ ID NO: 1224356 - RNA, 14 nt, Human
ccuugcauaauggu

SEQ ID NO: 1224357 - RNA, 12 nt, Human
ccuuuucccaac

SEQ ID NO: 1224358 - RNA, 15 nt, Human
cgagugcucauuuca

SEQ ID NO: 1224359 - RNA, 19 nt, Human
cgcugauaagcguucaugg

SEQ ID NO: 1224360 - RNA, 19 nt, Human
cuaaguccaguguuucuuu

SEQ ID NO: 1224361 - RNA, 20 nt, Human
cuaaguacacaauaagcaaa

SEQ ID NO: 1224362 - RNA, 19 nt, Human
cuaaguacacaauaagcaa

SEQ ID NO: 1224363 - RNA, 23 nt, Human
cuaaaguaaaaacaaagaaauua

SEQ ID NO: 1224364 - RNA, 21 nt, Human
cguucauggaacgcguugaaa

SEQ ID NO: 1224365 - RNA, 23 nt, Human
cguuaucuaauagggcaauuaau

SEQ ID NO: 1224366 - RNA, 18 nt, Human
cuaucucauuuccaagca

SEQ ID NO: 1224367 - RNA, 17 nt, Human
cuaucguaaaauuaaga

SEQ ID NO: 1224368 - RNA, 14 nt, Human
cucaauucuucccu

SEQ ID NO: 1224369 - RNA, 16 nt, Human
cucagccucucgaagu

SEQ ID NO: 1224370 - RNA, 12 nt, Human
cucguggacacc

SEQ ID NO: 1224371 - RNA, 14 nt, Human
cucguggacaccug

SEQ ID NO: 1224372 - RNA, 15 nt, Human
cucguggacaccugc

SEQ ID NO: 1224373 - RNA, 16 nt, Human
cucguggacaccugcc

SEQ ID NO: 1224374 - RNA, 16 nt, Human
cucuccccaugauguu

SEQ ID NO: 1224375 - RNA, 13 nt, Human
cucugcagguccc

SEQ ID NO: 1224376 - RNA, 18 nt, Human
aacauuugguaaggggaa

SEQ ID NO: 1224377 - RNA, 20 nt, Human
aacauuuguucuauagcuuu

SEQ ID NO: 1224378 - RNA, 22 nt, Human
aacauuuguucuauagcuuuuc

SEQ ID NO: 1224379 - RNA, 19 nt, Human
aacaguuguguuugaagca

SEQ ID NO: 1224380 - RNA, 23 nt, Human
aaauuuuuaaucuuuaauuuuac

SEQ ID NO: 1224381 - RNA, 17 nt, Human
aaauuuuuguaguagcg

SEQ ID NO: 1224382 - RNA, 15 nt, Human
aacaaggaugaauua

SEQ ID NO: 1224383 - RNA, 18 nt, Human
aacaagucagucauucag

SEQ ID NO: 1224384 - RNA, 15 nt, Human
aacaagucagucauu

SEQ ID NO: 1224385 - RNA, 14 nt, Human
aacaaugcuguauu

SEQ ID NO: 1224386 - RNA, 21 nt, Human
guccaagcauuuagauguaua

SEQ ID NO: 1224387 - RNA, 19 nt, Human
gucuuauauauuguagaua

SEQ ID NO: 1224388 - RNA, 14 nt, Human
gucuuccucugucu

SEQ ID NO: 1224389 - RNA, 16 nt, Human
aaccucuuugucuaca

SEQ ID NO: 1224390 - RNA, 18 nt, Human
aacucguuaauuuguagu

SEQ ID NO: 1224391 - RNA, 21 nt, Human
aacuccagaaagugacaagcu

SEQ ID NO: 1224392 - RNA, 14 nt, Human
aacuccagaaagug

SEQ ID NO: 1224393 - RNA, 21 nt, Human
aaccaugggauaaaugccauc

SEQ ID NO: 1224394 - RNA, 20 nt, Human
aaccuagggugauauuaacc

SEQ ID NO: 1224395 - RNA, 20 nt, Human
aaccacauuggagauguuua

SEQ ID NO: 1224396 - RNA, 15 nt, Human
aaccaugggauaaau

SEQ ID NO: 1224397 - RNA, 17 nt, Human
aaccaugggauaaaugc

SEQ ID NO: 1224398 - RNA, 18 nt, Human
aaccaugggauaaaugcc

SEQ ID NO: 1224399 - RNA, 20 nt, Human
aaccaugggauaaaugccau

SEQ ID NO: 1224400 - RNA, 10 nt, Human
aaccaaguuc

SEQ ID NO: 1224401 - RNA, 20 nt, Human
gucuccuaagcuggagugca

SEQ ID NO: 1224402 - RNA, 14 nt, Human
gucaaaaauuaaac

SEQ ID NO: 1224403 - RNA, 13 nt, Human
gucaaaaauuaaa

SEQ ID NO: 1224404 - RNA, 23 nt, Human
gucaaaaauuaaaccggaccauc

SEQ ID NO: 1224405 - RNA, 19 nt, Human
gucaacucauauuuucaug

SEQ ID NO: 1224406 - RNA, 16 nt, Human
gucaaauugugugaaa

SEQ ID NO: 1224407 - RNA, 22 nt, Human
aaauuuccugggagcuuuugua

SEQ ID NO: 1224408 - RNA, 20 nt, Human
aaauuuaguauuuuguuuca

SEQ ID NO: 1224409 - RNA, 18 nt, Human
aaauucccuucaucugga

SEQ ID NO: 1224410 - RNA, 17 nt, Human
aaauuucagcagcugca

SEQ ID NO: 1224411 - RNA, 18 nt, Human
aaauuucagcagcugcag

SEQ ID NO: 1224412 - RNA, 16 nt, Human
aaauucccuucaucug

SEQ ID NO: 1224413 - RNA, 19 nt, Human
aaauucccuucaucuggaa

SEQ ID NO: 1224414 - RNA, 22 nt, Human
aaauguuaugacuauguaaacu

SEQ ID NO: 1224415 - RNA, 14 nt, Human
aaauuaagaaagga

SEQ ID NO: 1224416 - RNA, 20 nt, Human
guauuuaauagguuuggaca

SEQ ID NO: 1224417 - RNA, 16 nt, Human
guauuuaauucauguu

SEQ ID NO: 1224418 - RNA, 17 nt, Human
guauaaaagccuguuua

SEQ ID NO: 1224419 - RNA, 18 nt, Human
guauaaaagccuguuuaa

SEQ ID NO: 1224420 - RNA, 21 nt, Human
guauaaaagccuguuuaagag

SEQ ID NO: 1224421 - RNA, 18 nt, Human
guauaaaagggacugaga

SEQ ID NO: 1224422 - RNA, 17 nt, Human
guauauuacaaugauca

SEQ ID NO: 1224423 - RNA, 18 nt, Human
guauauuacaaugaucac

SEQ ID NO: 1224424 - RNA, 22 nt, Human
guauauugauccagaaagaaaa

SEQ ID NO: 1224425 - RNA, 14 nt, Human
guaugauucccagc

SEQ ID NO: 1224426 - RNA, 13 nt, Human
guaugugugaagu

SEQ ID NO: 1224427 - RNA, 17 nt, Human
guaugugugaagugagu

SEQ ID NO: 1224428 - RNA, 21 nt, Human
guaugugugaagugagugagu

SEQ ID NO: 1224429 - RNA, 21 nt, Human
guauggguuagggaaaacauu

SEQ ID NO: 1224430 - RNA, 14 nt, Human
aaaugcauuucuaa

SEQ ID NO: 1224431 - RNA, 19 nt, Human
aaauggcuuccuggcaaua

SEQ ID NO: 1224432 - RNA, 13 nt, Human
aaaugcauguugc

SEQ ID NO: 1224433 - RNA, 13 nt, Human
aaaugagaaaucu

SEQ ID NO: 1224434 - RNA, 14 nt, Human
aaaugagaaaucua

SEQ ID NO: 1224435 - RNA, 16 nt, Human
aaaugagaaaucuaaa

SEQ ID NO: 1224436 - RNA, 11 nt, Human
aaaugagaaau

SEQ ID NO: 1224437 - RNA, 14 nt, Human
aaauccuugaagau

SEQ ID NO: 1224438 - RNA, 19 nt, Human
aaaucccauuauucaaagu

SEQ ID NO: 1224439 - RNA, 20 nt, Human
aaaucccauuauucaaaguu

SEQ ID NO: 1224440 - RNA, 21 nt, Human
aaaucccauuauucaaaguug

SEQ ID NO: 1224441 - RNA, 22 nt, Human
aaaucccauuauucaaaguugc

SEQ ID NO: 1224442 - RNA, 18 nt, Human
aaauccauuuggaaaucu

SEQ ID NO: 1224443 - RNA, 21 nt, Human
aaauccauuuggaaaucuuua

SEQ ID NO: 1224444 - RNA, 22 nt, Human
aaauccauuuggaaaucuuuaa

SEQ ID NO: 1224445 - RNA, 23 nt, Human
aaauccauuuggaaaucuuuaaa

SEQ ID NO: 1224446 - RNA, 13 nt, Human
aaaucccauuauu

SEQ ID NO: 1224447 - RNA, 15 nt, Human
aaaucccauuauuca

SEQ ID NO: 1224448 - RNA, 16 nt, Human
aaaucccauuauucaa

SEQ ID NO: 1224449 - RNA, 17 nt, Human
aaaucccauuauucaaa

SEQ ID NO: 1224450 - RNA, 13 nt, Human
aaaggacuguaau

SEQ ID NO: 1224451 - RNA, 16 nt, Human
guaggaaagaggaagc

SEQ ID NO: 1224452 - RNA, 14 nt, Human
aaauccauuuggaa

SEQ ID NO: 1224453 - RNA, 15 nt, Human
aaauccauuuggaaa

SEQ ID NO: 1224454 - RNA, 16 nt, Human
aaauccauuuggaaau

SEQ ID NO: 1224455 - RNA, 19 nt, Human
aagaaugguccgugcuaag

SEQ ID NO: 1224456 - RNA, 22 nt, Human
aagaaugguccgugcuaaggac

SEQ ID NO: 1224457 - RNA, 18 nt, Human
aagaaugauuaugaauua

SEQ ID NO: 1224458 - RNA, 23 nt, Human
aagacaaaaagcuacuuauugua

SEQ ID NO: 1224459 - RNA, 20 nt, Human
aagacaaaaagcuacuuauu

SEQ ID NO: 1224460 - RNA, 16 nt, Human
aagaaugauuaugaau

SEQ ID NO: 1224461 - RNA, 15 nt, Human
gugcucaggagcccu

SEQ ID NO: 1224462 - RNA, 16 nt, Human
gugcucaggagcccug

SEQ ID NO: 1224463 - RNA, 16 nt, Human
aacuuguauuaugugu

SEQ ID NO: 1224464 - RNA, 21 nt, Human
aagaaacuggggcuccuccag

SEQ ID NO: 1224465 - RNA, 17 nt, Human
aagaaacuuguccuucc

SEQ ID NO: 1224466 - RNA, 16 nt, Human
aagaaagaacggaaga

SEQ ID NO: 1224467 - RNA, 13 nt, Human
aagaaauauaccu

SEQ ID NO: 1224468 - RNA, 18 nt, Human
gugcuaguaauuggaaag

SEQ ID NO: 1224469 - RNA, 13 nt, Human
aagaggaagcaaa

SEQ ID NO: 1224470 - RNA, 14 nt, Human
aagaggaagcaaau

SEQ ID NO: 1224471 - RNA, 14 nt, Human
guggguagacacac

SEQ ID NO: 1224472 - RNA, 19 nt, Human
guggcgcgaucucagcuca

SEQ ID NO: 1224473 - RNA, 21 nt, Human
gugggacagucaccucaugga

SEQ ID NO: 1224474 - RNA, 19 nt, Human
guggcgugaucucagcuca

SEQ ID NO: 1224475 - RNA, 17 nt, Human
gugggaggugagaccac

SEQ ID NO: 1224476 - RNA, 18 nt, Human
aagagguuuuaaagcuuc

SEQ ID NO: 1224477 - RNA, 14 nt, Human
aagagguuuuaaag

SEQ ID NO: 1224478 - RNA, 19 nt, Human
guguuguacucaauuuuaa

SEQ ID NO: 1224479 - RNA, 17 nt, Human
aagcuaucguaaaauua

SEQ ID NO: 1224480 - RNA, 23 nt, Human
guucugguaugaacuugaggaca

SEQ ID NO: 1224481 - RNA, 16 nt, Human
guucuuacugcuuaau

SEQ ID NO: 1224482 - RNA, 18 nt, Human
guugacaugggacauuug

SEQ ID NO: 1224483 - RNA, 14 nt, Human
guugacaugggaca

SEQ ID NO: 1224484 - RNA, 18 nt, Human
guguuuuaaaaugagaaa

SEQ ID NO: 1224485 - RNA, 12 nt, Human
guuagaucuagu

SEQ ID NO: 1224486 - RNA, 19 nt, Human
aagccuccuuagaaaaaaa

SEQ ID NO: 1224487 - RNA, 13 nt, Human
aagguacuucaaa

SEQ ID NO: 1224488 - RNA, 22 nt, Human
aaguaaaaacaaagaaauuaug

SEQ ID NO: 1224489 - RNA, 13 nt, Human
aaguaaaaacaaa

SEQ ID NO: 1224490 - RNA, 20 nt, Human
aaguaaaaacaaagaaauua

SEQ ID NO: 1224491 - RNA, 17 nt, Human
aaggggaauugaggaca

SEQ ID NO: 1224492 - RNA, 21 nt, Human
guuucaaacauauauaacaau

SEQ ID NO: 1224493 - RNA, 20 nt, Human
guuucuguacuuuuuggcau

SEQ ID NO: 1224494 - RNA, 11 nt, Human
guuuuacaaua

SEQ ID NO: 1224495 - RNA, 13 nt, Human
guuuuacaauagu

SEQ ID NO: 1224496 - RNA, 16 nt, Human
guuuuacaauaguucu

SEQ ID NO: 1224497 - RNA, 20 nt, Human
guuuuacaauaguucugugg

SEQ ID NO: 1224498 - RNA, 20 nt, Human
guuuucuuaaccagaucauu

SEQ ID NO: 1224499 - RNA, 17 nt, Human
guugccuaaauccauuu

SEQ ID NO: 1224500 - RNA, 14 nt, Human
guugccuaaaucca

SEQ ID NO: 1224501 - RNA, 15 nt, Human
guugccuaaauccau

SEQ ID NO: 1224502 - RNA, 16 nt, Human
guugccuaaauccauu

SEQ ID NO: 1224503 - RNA, 15 nt, Human
acaacagcuggugcc

SEQ ID NO: 1224504 - RNA, 21 nt, Human
acaaauucugucucuggauua

SEQ ID NO: 1224505 - RNA, 15 nt, Human
uagcuagacugguga

SEQ ID NO: 1224506 - RNA, 18 nt, Human
uagcuagacuggugacug

SEQ ID NO: 1224507 - RNA, 16 nt, Human
uagcuacuaauuuuaa

SEQ ID NO: 1224508 - RNA, 20 nt, Human
acaaaguauuaagcauauau

SEQ ID NO: 1224509 - RNA, 21 nt, Human
uagaugcaguucugaagaaga

SEQ ID NO: 1224510 - RNA, 14 nt, Human
uagaucuaguucac

SEQ ID NO: 1224511 - RNA, 22 nt, Human
uagauaggucagugcaaauacu

SEQ ID NO: 1224512 - RNA, 12 nt, Human
aauuuuuuuuac

SEQ ID NO: 1224513 - RNA, 16 nt, Human
aauuuuuuuuacauuu

SEQ ID NO: 1224514 - RNA, 13 nt, Human
aauuuuuguagua

SEQ ID NO: 1224515 - RNA, 16 nt, Human
aauuuuguuucuguac

SEQ ID NO: 1224516 - RNA, 22 nt, Human
aauuuuuaaucuuuaauuuuac

SEQ ID NO: 1224517 - RNA, 21 nt, Human
aauuugguuuucacauuggaa

SEQ ID NO: 1224518 - RNA, 15 nt, Human
aauuugguuuucaca

SEQ ID NO: 1224519 - RNA, 13 nt, Human
aauuugguuuuca

SEQ ID NO: 1224520 - RNA, 16 nt, Human
uacuuugugcuggggu

SEQ ID NO: 1224521 - RNA, 22 nt, Human
uacuuugugcugggguuaucug

SEQ ID NO: 1224522 - RNA, 14 nt, Human
uacuuuuuggcaua

SEQ ID NO: 1224523 - RNA, 19 nt, Human
uacuuuuuggcauaacaua

SEQ ID NO: 1224524 - RNA, 20 nt, Human
uacuuuuuggcauaacauaa

SEQ ID NO: 1224525 - RNA, 15 nt, Human
aauuugaaacacuuu

SEQ ID NO: 1224526 - RNA, 19 nt, Human
uacuucuuaggguuaugau

SEQ ID NO: 1224527 - RNA, 20 nt, Human
uacuucuuuuuucaaaagaa

SEQ ID NO: 1224528 - RNA, 22 nt, Human
uacuucuuuuuucaaaagaaag

SEQ ID NO: 1224529 - RNA, 15 nt, Human
uacuugaaaauuaac

SEQ ID NO: 1224530 - RNA, 13 nt, Human
aauuuaguauuuu

SEQ ID NO: 1224531 - RNA, 15 nt, Human
aauuggagcucgugg

SEQ ID NO: 1224532 - RNA, 13 nt, Human
aauuuaaauguua

SEQ ID NO: 1224533 - RNA, 11 nt, Human
aauuuaaaugu

SEQ ID NO: 1224534 - RNA, 17 nt, Human
aauuucuaggacugaau

SEQ ID NO: 1224535 - RNA, 22 nt, Human
aauuucuaggacugaauuauga

SEQ ID NO: 1224536 - RNA, 18 nt, Human
aauuucuaggacugaauu

SEQ ID NO: 1224537 - RNA, 23 nt, Human
aauuucuaggacugaauuaugaa

SEQ ID NO: 1224538 - RNA, 22 nt, Human
aauuuauaaacuuuuuucuuac

SEQ ID NO: 1224539 - RNA, 15 nt, Human
uacuaaaauggacug

SEQ ID NO: 1224540 - RNA, 18 nt, Human
uacuagggaaaugccuuu

SEQ ID NO: 1224541 - RNA, 19 nt, Human
aauugagaaaaauauauac

SEQ ID NO: 1224542 - RNA, 23 nt, Human
aauugagaaaaauauauacuaaa

SEQ ID NO: 1224543 - RNA, 18 nt, Human
aauugaggacacugauau

SEQ ID NO: 1224544 - RNA, 19 nt, Human
uacuguacagacagaaaaa

SEQ ID NO: 1224545 - RNA, 23 nt, Human
uacuguacagacagaaaaaacug

SEQ ID NO: 1224546 - RNA, 22 nt, Human
uacugaaauaaacgucuuaaau

SEQ ID NO: 1224547 - RNA, 19 nt, Human
uacugaaauaaacgucuua

SEQ ID NO: 1224548 - RNA, 20 nt, Human
uauauuuauuacuguaagaa

SEQ ID NO: 1224549 - RNA, 19 nt, Human
uauauuuauuacuguaaga

SEQ ID NO: 1224550 - RNA, 15 nt, Human
uauauuuauuacugu

SEQ ID NO: 1224551 - RNA, 23 nt, Human
acagagcuggagaugaggccaga

SEQ ID NO: 1224552 - RNA, 21 nt, Human
acagcccuucuuuccacagaa

SEQ ID NO: 1224553 - RNA, 20 nt, Human
acagcccuucuuuccacaga

SEQ ID NO: 1224554 - RNA, 12 nt, Human
uauauuuacaaa

SEQ ID NO: 1224555 - RNA, 14 nt, Human
acacugaagaagca

SEQ ID NO: 1224556 - RNA, 12 nt, Human
acacugaagaag

SEQ ID NO: 1224557 - RNA, 18 nt, Human
acaaugcuguauuuuaaa

SEQ ID NO: 1224558 - RNA, 17 nt, Human
acaaugcuguauuuuaa

SEQ ID NO: 1224559 - RNA, 14 nt, Human
acaaugcuguauuu

SEQ ID NO: 1224560 - RNA, 17 nt, Human
acacaacuauauuguuu

SEQ ID NO: 1224561 - RNA, 13 nt, Human
acacacugaagaa

SEQ ID NO: 1224562 - RNA, 17 nt, Human
uaguguuggagaagaac

SEQ ID NO: 1224563 - RNA, 16 nt, Human
uaguguuggagaagaa

SEQ ID NO: 1224564 - RNA, 12 nt, Human
uaguguuggaga

SEQ ID NO: 1224565 - RNA, 17 nt, Human
uagucuugucucagauu

SEQ ID NO: 1224566 - RNA, 22 nt, Human
uagucuugucucagauuuuauu

SEQ ID NO: 1224567 - RNA, 14 nt, Human
acacacugaagaag

SEQ ID NO: 1224568 - RNA, 22 nt, Human
uagguuuggacaaaauggaaua

SEQ ID NO: 1224569 - RNA, 21 nt, Human
uauaaaaauaaaaaacacugg

SEQ ID NO: 1224570 - RNA, 19 nt, Human
acacaugcuucccuuuccu

SEQ ID NO: 1224571 - RNA, 21 nt, Human
acacaugcuucccuuuccuga

SEQ ID NO: 1224572 - RNA, 23 nt, Human
acacaugcuucccuuuccugagu

SEQ ID NO: 1224573 - RNA, 23 nt, Human
acacuacacccagcaauagagac

SEQ ID NO: 1224574 - RNA, 17 nt, Human
acacuacacccagcaau

SEQ ID NO: 1224575 - RNA, 17 nt, Human
acacuaagagagaauga

SEQ ID NO: 1224576 - RNA, 13 nt, Human
acacuacacccag

SEQ ID NO: 1224577 - RNA, 14 nt, Human
acacuacacccagc

SEQ ID NO: 1224578 - RNA, 15 nt, Human
acacuacacccagca

SEQ ID NO: 1224579 - RNA, 19 nt, Human
acacuaagagagaaugaga

SEQ ID NO: 1224580 - RNA, 18 nt, Human
acacuaagagagaaugag

SEQ ID NO: 1224581 - RNA, 13 nt, Human
acaccugcccugc

SEQ ID NO: 1224582 - RNA, 14 nt, Human
acaccugcccugcc
